United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 67

SEQ ID NO: 2824367 - DNA, 21 bp, Homo sapiens
caaaataatttaactaattta

SEQ ID NO: 2824368 - DNA, 13 bp, Homo sapiens
caaaatatataat

SEQ ID NO: 2824369 - DNA, 16 bp, Homo sapiens
caaaatatttgtacat

SEQ ID NO: 2824370 - DNA, 17 bp, Homo sapiens
caaaatatttgtacata

SEQ ID NO: 2824371 - DNA, 17 bp, Homo sapiens
caaaatcacaagcaata

SEQ ID NO: 2824372 - DNA, 18 bp, Homo sapiens
caaaatcacaagcaataa

SEQ ID NO: 2824373 - DNA, 22 bp, Homo sapiens
caaaatgtcacaatcctgtccc

SEQ ID NO: 2824374 - DNA, 14 bp, Homo sapiens
caaaatttgaaatt

SEQ ID NO: 2824375 - DNA, 21 bp, Homo sapiens
caaaattttatagctcagttt

SEQ ID NO: 2824376 - DNA, 20 bp, Homo sapiens
caaacaataataaagagaga

SEQ ID NO: 2824377 - DNA, 18 bp, Homo sapiens
caaacaccaacataaaaa

SEQ ID NO: 2824378 - DNA, 14 bp, Homo sapiens
caaacatgaagtgt

SEQ ID NO: 2824379 - DNA, 11 bp, Homo sapiens
caaacatgtgg

SEQ ID NO: 2824380 - DNA, 18 bp, Homo sapiens
caaacatgtggttaatgc

SEQ ID NO: 2824381 - DNA, 13 bp, Homo sapiens
caaaccatttaat

SEQ ID NO: 2824382 - DNA, 19 bp, Homo sapiens
caaaccatttaattcataa

SEQ ID NO: 2824383 - DNA, 20 bp, Homo sapiens
caaaccatttaattcataat

SEQ ID NO: 2824384 - DNA, 13 bp, Homo sapiens
caaacccatgagg

SEQ ID NO: 2824385 - DNA, 19 bp, Homo sapiens
caaactcttgacctcaggt

SEQ ID NO: 2824386 - DNA, 15 bp, Homo sapiens
caaactgaagccaga

SEQ ID NO: 2824387 - DNA, 16 bp, Homo sapiens
caaagaacaagaaatt

SEQ ID NO: 2824388 - DNA, 16 bp, Homo sapiens
caaagacttagtatat

SEQ ID NO: 2824389 - DNA, 14 bp, Homo sapiens
caaagagactggag

SEQ ID NO: 2824390 - DNA, 16 bp, Homo sapiens
caaagagactggagca

SEQ ID NO: 2824391 - DNA, 13 bp, Homo sapiens
caaagagcctgga

SEQ ID NO: 2824392 - DNA, 18 bp, Homo sapiens
caaagagcctggagaagc

SEQ ID NO: 2824393 - DNA, 16 bp, Homo sapiens
caaagaggtatttatc

SEQ ID NO: 2824394 - DNA, 22 bp, Homo sapiens
caaagagtgggctgcatctggg

SEQ ID NO: 2824395 - DNA, 15 bp, Homo sapiens
caaagagttcaagaa

SEQ ID NO: 2824396 - DNA, 17 bp, Homo sapiens
caaagatatctcatctc

SEQ ID NO: 2824397 - DNA, 20 bp, Homo sapiens
caaagatatgctaagcagta

SEQ ID NO: 2824398 - DNA, 22 bp, Homo sapiens
caaagatgtttgtcagatatga

SEQ ID NO: 2824399 - DNA, 18 bp, Homo sapiens
caaagcaaaagaagtaaa

SEQ ID NO: 2824400 - DNA, 17 bp, Homo sapiens
atcactggagcaccagg

SEQ ID NO: 2824401 - DNA, 19 bp, Homo sapiens
atcactggagcaccaggca

SEQ ID NO: 2824402 - DNA, 23 bp, Homo sapiens
atcactggagcaccaggcacgaa

SEQ ID NO: 2824403 - DNA, 13 bp, Homo sapiens
atcactggagccc

SEQ ID NO: 2824404 - DNA, 15 bp, Homo sapiens
atcactggagcccag

SEQ ID NO: 2824405 - DNA, 17 bp, Homo sapiens
atcacttgtacaaaata

SEQ ID NO: 2824406 - DNA, 18 bp, Homo sapiens
atcacttgtacaaaataa

SEQ ID NO: 2824407 - DNA, 16 bp, Homo sapiens
atcactttgttaaaaa

SEQ ID NO: 2824408 - DNA, 11 bp, Homo sapiens
atcagaaaagt

SEQ ID NO: 2824409 - DNA, 14 bp, Homo sapiens
atcagaaaagtaga

SEQ ID NO: 2824410 - DNA, 18 bp, Homo sapiens
atcagaaaagtagaatta

SEQ ID NO: 2824411 - DNA, 20 bp, Homo sapiens
atcagaaaagtagaattata

SEQ ID NO: 2824412 - DNA, 19 bp, Homo sapiens
atcagaaagggagggctct

SEQ ID NO: 2824413 - DNA, 22 bp, Homo sapiens
atcagaaagggagggctctgag

SEQ ID NO: 2824414 - DNA, 23 bp, Homo sapiens
atcagaaagggagggctctgagg

SEQ ID NO: 2824415 - DNA, 21 bp, Homo sapiens
atcagaaatgtcatcaaatat

SEQ ID NO: 2824416 - DNA, 18 bp, Homo sapiens
atcagaagtttctcagct

SEQ ID NO: 2824417 - DNA, 20 bp, Homo sapiens
atcagaccataatgttacat

SEQ ID NO: 2824418 - DNA, 15 bp, Homo sapiens
atcagaccctacccc

SEQ ID NO: 2824419 - DNA, 16 bp, Homo sapiens
atcagaccctacccca

SEQ ID NO: 2824420 - DNA, 19 bp, Homo sapiens
atcagaccctaccccacca

SEQ ID NO: 2824421 - DNA, 18 bp, Homo sapiens
atcagacttcacactgca

SEQ ID NO: 2824422 - DNA, 20 bp, Homo sapiens
atcagagttgcttttctaat

SEQ ID NO: 2824423 - DNA, 15 bp, Homo sapiens
atcagatagcatctt

SEQ ID NO: 2824424 - DNA, 18 bp, Homo sapiens
atcagcctgagtctcctg

SEQ ID NO: 2824425 - DNA, 19 bp, Homo sapiens
atcagcctgagtctcctgt

SEQ ID NO: 2824426 - DNA, 20 bp, Homo sapiens
atcagcctgagtctcctgtg

SEQ ID NO: 2824427 - DNA, 13 bp, Homo sapiens
atcagcgtggcct

SEQ ID NO: 2824428 - DNA, 21 bp, Homo sapiens
atcagcgtggccttgttctgt

SEQ ID NO: 2824429 - DNA, 11 bp, Homo sapiens
atcagctccct

SEQ ID NO: 2824430 - DNA, 19 bp, Homo sapiens
atcagcttttaataaaatt

SEQ ID NO: 2824431 - DNA, 23 bp, Homo sapiens
atcagcttttaataaaattgaca

SEQ ID NO: 2824432 - DNA, 13 bp, Homo sapiens
atcaggctgaggt

SEQ ID NO: 2824433 - DNA, 18 bp, Homo sapiens
atcagggaggtcattttg

SEQ ID NO: 2824434 - DNA, 20 bp, Homo sapiens
atcaggtcctcagagaattt

SEQ ID NO: 2824435 - DNA, 15 bp, Homo sapiens
atcaggtgctgccat

SEQ ID NO: 2824436 - DNA, 15 bp, Homo sapiens
atcaggttgttaatg

SEQ ID NO: 2824437 - DNA, 19 bp, Homo sapiens
atcagtcataactaaataa

SEQ ID NO: 2824438 - DNA, 17 bp, Homo sapiens
atcagtgtcctcttgct

SEQ ID NO: 2824439 - DNA, 21 bp, Homo sapiens
atcagttactcagccctgggc

SEQ ID NO: 2824440 - DNA, 14 bp, Homo sapiens
atcatagaaaaact

SEQ ID NO: 2824441 - DNA, 12 bp, Homo sapiens
atcatagaaatg

SEQ ID NO: 2824442 - DNA, 15 bp, Homo sapiens
atcatagaaatgtaa

SEQ ID NO: 2824443 - DNA, 15 bp, Homo sapiens
atcatattgtatgta

SEQ ID NO: 2824444 - DNA, 22 bp, Homo sapiens
atcatcagcatacctttattgt

SEQ ID NO: 2824445 - DNA, 15 bp, Homo sapiens
atcatcagtgtagaa

SEQ ID NO: 2824446 - DNA, 14 bp, Homo sapiens
atcatcccagctgc

SEQ ID NO: 2824447 - DNA, 21 bp, Homo sapiens
atcatcccatctaagctgcag

SEQ ID NO: 2824448 - DNA, 23 bp, Homo sapiens
atcatcccatctaagctgcagct

SEQ ID NO: 2824449 - DNA, 16 bp, Homo sapiens
atcatgaaacacttct

SEQ ID NO: 2824450 - DNA, 21 bp, Homo sapiens
atcatgatctgactttaattg

SEQ ID NO: 2824451 - DNA, 22 bp, Homo sapiens
atcatgatctgactttaattgt

SEQ ID NO: 2824452 - DNA, 19 bp, Homo sapiens
atcatgcctctgaggccag

SEQ ID NO: 2824453 - DNA, 15 bp, Homo sapiens
atcatggctatctgt

SEQ ID NO: 2824454 - DNA, 18 bp, Homo sapiens
atcatgtaaatgattatc

SEQ ID NO: 2824455 - DNA, 16 bp, Homo sapiens
atcatgtgcctggaaa

SEQ ID NO: 2824456 - DNA, 11 bp, Homo sapiens
atcattaatac

SEQ ID NO: 2824457 - DNA, 16 bp, Homo sapiens
atcattataaacgtga

SEQ ID NO: 2824458 - DNA, 18 bp, Homo sapiens
atcattcaatatctgaca

SEQ ID NO: 2824459 - DNA, 14 bp, Homo sapiens
atcattttaattat

SEQ ID NO: 2824460 - DNA, 19 bp, Homo sapiens
atcattttgcctcttttct

SEQ ID NO: 2824461 - DNA, 14 bp, Homo sapiens
atcattttttactt

SEQ ID NO: 2824462 - DNA, 20 bp, Homo sapiens
atccaaccccccacctgcca

SEQ ID NO: 2824463 - DNA, 18 bp, Homo sapiens
atccaagctggtcccact

SEQ ID NO: 2824464 - DNA, 23 bp, Homo sapiens
atccaagcttttttaaagtaaaa

SEQ ID NO: 2824465 - DNA, 21 bp, Homo sapiens
atccaagttgaaatcagaagc

SEQ ID NO: 2824466 - DNA, 23 bp, Homo sapiens
atccaattatgtgacaacctttg

SEQ ID NO: 2824467 - DNA, 20 bp, Homo sapiens
atccacacacagaggaagag

SEQ ID NO: 2824468 - DNA, 15 bp, Homo sapiens
atccacccagcccat

SEQ ID NO: 2824469 - DNA, 21 bp, Homo sapiens
atccacttcttaatgctttcc

SEQ ID NO: 2824470 - DNA, 19 bp, Homo sapiens
atccagacccggctgcgtg

SEQ ID NO: 2824471 - DNA, 16 bp, Homo sapiens
atccaggttcagcttg

SEQ ID NO: 2824472 - DNA, 14 bp, Homo sapiens
atccagttgcaata

SEQ ID NO: 2824473 - DNA, 15 bp, Homo sapiens
atccagttgcaataa

SEQ ID NO: 2824474 - DNA, 17 bp, Homo sapiens
atccagttgcaataaaa

SEQ ID NO: 2824475 - DNA, 18 bp, Homo sapiens
atccagttgcaataaaat

SEQ ID NO: 2824476 - DNA, 15 bp, Homo sapiens
atccatcagctccct

SEQ ID NO: 2824477 - DNA, 11 bp, Homo sapiens
atccatcctgc

SEQ ID NO: 2824478 - DNA, 22 bp, Homo sapiens
atccattcctcagggacagaga

SEQ ID NO: 2824479 - DNA, 21 bp, Homo sapiens
atccatttcatctatttctga

SEQ ID NO: 2824480 - DNA, 22 bp, Homo sapiens
atccatttcatctatttctgag

SEQ ID NO: 2824481 - DNA, 15 bp, Homo sapiens
atcccaagtgccagt

SEQ ID NO: 2824482 - DNA, 15 bp, Homo sapiens
atcccacccacatgt

SEQ ID NO: 2824483 - DNA, 19 bp, Homo sapiens
atcccagctacatgggagc

SEQ ID NO: 2824484 - DNA, 20 bp, Homo sapiens
atcccagctactcaggaggc

SEQ ID NO: 2824485 - DNA, 20 bp, Homo sapiens
atcccatctaagctgcagct

SEQ ID NO: 2824486 - DNA, 19 bp, Homo sapiens
atcccatgagcctcagcat

SEQ ID NO: 2824487 - DNA, 13 bp, Homo sapiens
atccccaggtctc

SEQ ID NO: 2824488 - DNA, 18 bp, Homo sapiens
atcccccactgccacacc

SEQ ID NO: 2824489 - DNA, 22 bp, Homo sapiens
atcccccactgccacaccctcc

SEQ ID NO: 2824490 - DNA, 12 bp, Homo sapiens
atcccctttcct

SEQ ID NO: 2824491 - DNA, 17 bp, Homo sapiens
atccctgggcctgctgc

SEQ ID NO: 2824492 - DNA, 22 bp, Homo sapiens
atccctgggcctgctgctgaga

SEQ ID NO: 2824493 - DNA, 13 bp, Homo sapiens
atccgaggcaggg

SEQ ID NO: 2824494 - DNA, 17 bp, Homo sapiens
atccgattcgccatcac

SEQ ID NO: 2824495 - DNA, 21 bp, Homo sapiens
atcctattaaaacacagcttt

SEQ ID NO: 2824496 - DNA, 23 bp, Homo sapiens
atcctccaacgttaaaagacagt

SEQ ID NO: 2824497 - DNA, 23 bp, Homo sapiens
atcctccaacttcatttgatgct

SEQ ID NO: 2824498 - DNA, 14 bp, Homo sapiens
atcctctggctggc

SEQ ID NO: 2824499 - DNA, 20 bp, Homo sapiens
atcctgataaacattaaaca

SEQ ID NO: 2824500 - DNA, 21 bp, Homo sapiens
atcctgccttcatggaactca

SEQ ID NO: 2824501 - DNA, 18 bp, Homo sapiens
atcctgctagctgtagaa

SEQ ID NO: 2824502 - DNA, 19 bp, Homo sapiens
atcctgctagctgtagaaa

SEQ ID NO: 2824503 - DNA, 23 bp, Homo sapiens
atcctggcacccggcccctgctg

SEQ ID NO: 2824504 - DNA, 16 bp, Homo sapiens
atccttcaccagagcc

SEQ ID NO: 2824505 - DNA, 21 bp, Homo sapiens
atccttcaccagagcccatgc

SEQ ID NO: 2824506 - DNA, 19 bp, Homo sapiens
atccttcttatgtttgctt

SEQ ID NO: 2824507 - DNA, 19 bp, Homo sapiens
atcctttgccccaaggctg

SEQ ID NO: 2824508 - DNA, 16 bp, Homo sapiens
atccttttatgttatt

SEQ ID NO: 2824509 - DNA, 19 bp, Homo sapiens
atccttttatgttatttat

SEQ ID NO: 2824510 - DNA, 15 bp, Homo sapiens
atcctttttctttat

SEQ ID NO: 2824511 - DNA, 15 bp, Homo sapiens
atcgaaatgaattta

SEQ ID NO: 2824512 - DNA, 16 bp, Homo sapiens
atcgatctgtactgta

SEQ ID NO: 2824513 - DNA, 11 bp, Homo sapiens
atcgattggct

SEQ ID NO: 2824514 - DNA, 12 bp, Homo sapiens
atcgattggctt

SEQ ID NO: 2824515 - DNA, 17 bp, Homo sapiens
atcgctttgtactttgt

SEQ ID NO: 2824516 - DNA, 14 bp, Homo sapiens
atcggaagcagtgc

SEQ ID NO: 2824517 - DNA, 22 bp, Homo sapiens
atcggaagcagtgccttccata

SEQ ID NO: 2824518 - DNA, 21 bp, Homo sapiens
atcggatctggggctctggga

SEQ ID NO: 2824519 - DNA, 19 bp, Homo sapiens
atcggcccacagctcccac

SEQ ID NO: 2824520 - DNA, 15 bp, Homo sapiens
atcgggaacagtgtt

SEQ ID NO: 2824521 - DNA, 16 bp, Homo sapiens
atcgggagcagtgtct

SEQ ID NO: 2824522 - DNA, 12 bp, Homo sapiens
atcgtgctaaat

SEQ ID NO: 2824523 - DNA, 15 bp, Homo sapiens
atcgttatgtgtgta

SEQ ID NO: 2824524 - DNA, 18 bp, Homo sapiens
atcgttatgtgtgtatat

SEQ ID NO: 2824525 - DNA, 21 bp, Homo sapiens
atcgttatgtgtgtatatgta

SEQ ID NO: 2824526 - DNA, 15 bp, Homo sapiens
atctaagctgcagct

SEQ ID NO: 2824527 - DNA, 18 bp, Homo sapiens
atctaagctgcagcttcc

SEQ ID NO: 2824528 - DNA, 16 bp, Homo sapiens
atctaagttaatttaa

SEQ ID NO: 2824529 - DNA, 15 bp, Homo sapiens
atctaatacctctgt

SEQ ID NO: 2824530 - DNA, 22 bp, Homo sapiens
atctaatacctctgtgtgctcc

SEQ ID NO: 2824531 - DNA, 20 bp, Homo sapiens
atctaatatgtaacaagcca

SEQ ID NO: 2824532 - DNA, 12 bp, Homo sapiens
atctaatttata

SEQ ID NO: 2824533 - DNA, 16 bp, Homo sapiens
atctaatttatacaaa

SEQ ID NO: 2824534 - DNA, 18 bp, Homo sapiens
atctaatttatacaaaat

SEQ ID NO: 2824535 - DNA, 19 bp, Homo sapiens
atctaatttatacaaaata

SEQ ID NO: 2824536 - DNA, 21 bp, Homo sapiens
atctaatttatacaaaataat

SEQ ID NO: 2824537 - DNA, 16 bp, Homo sapiens
atctacagaacaaaga

SEQ ID NO: 2824538 - DNA, 19 bp, Homo sapiens
atctagaggcttccttcat

SEQ ID NO: 2824539 - DNA, 23 bp, Homo sapiens
atctatagtagtcaattagtaca

SEQ ID NO: 2824540 - DNA, 15 bp, Homo sapiens
atctatctatttgag

SEQ ID NO: 2824541 - DNA, 14 bp, Homo sapiens
atctatctgccttt

SEQ ID NO: 2824542 - DNA, 18 bp, Homo sapiens
atctatctgtattttcat

SEQ ID NO: 2824543 - DNA, 17 bp, Homo sapiens
atctatgcaatttttaa

SEQ ID NO: 2824544 - DNA, 15 bp, Homo sapiens
atctatggcagtcca

SEQ ID NO: 2824545 - DNA, 22 bp, Homo sapiens
atctatggcagtccagccagct

SEQ ID NO: 2824546 - DNA, 17 bp, Homo sapiens
atctattcagacaagca

SEQ ID NO: 2824547 - DNA, 14 bp, Homo sapiens
atctatttctgaga

SEQ ID NO: 2824548 - DNA, 20 bp, Homo sapiens
atctcagaattccttttcta

SEQ ID NO: 2824549 - DNA, 12 bp, Homo sapiens
atctcagagaca

SEQ ID NO: 2824550 - DNA, 19 bp, Homo sapiens
atctcagagacaggtggcc

SEQ ID NO: 2824551 - DNA, 20 bp, Homo sapiens
atctcagataaagtgaccag

SEQ ID NO: 2824552 - DNA, 21 bp, Homo sapiens
atctcaggagcttgcaagaag

SEQ ID NO: 2824553 - DNA, 15 bp, Homo sapiens
atctcagtgaagaat

SEQ ID NO: 2824554 - DNA, 20 bp, Homo sapiens
atctcatctcagtgaagaat

SEQ ID NO: 2824555 - DNA, 19 bp, Homo sapiens
atctcatttaagggaaaaa

SEQ ID NO: 2824556 - DNA, 16 bp, Homo sapiens
atctccaaggaccagg

SEQ ID NO: 2824557 - DNA, 21 bp, Homo sapiens
atctccaccctgagcctgacc

SEQ ID NO: 2824558 - DNA, 13 bp, Homo sapiens
atctccccactct

SEQ ID NO: 2824559 - DNA, 22 bp, Homo sapiens
atctcccccatcccccactgcc

SEQ ID NO: 2824560 - DNA, 15 bp, Homo sapiens
atctccctgccgcct

SEQ ID NO: 2824561 - DNA, 21 bp, Homo sapiens
atctcctatttttcagaatgc

SEQ ID NO: 2824562 - DNA, 20 bp, Homo sapiens
atctcctgtaattttgtagt

SEQ ID NO: 2824563 - DNA, 15 bp, Homo sapiens
atctcctttcaggga

SEQ ID NO: 2824564 - DNA, 16 bp, Homo sapiens
atctctaaactgctgt

SEQ ID NO: 2824565 - DNA, 15 bp, Homo sapiens
atctctaattggaag

SEQ ID NO: 2824566 - DNA, 15 bp, Homo sapiens
atctctagaatttta

SEQ ID NO: 2824567 - DNA, 18 bp, Homo sapiens
atctctagaattttaagt

SEQ ID NO: 2824568 - DNA, 22 bp, Homo sapiens
atctctatgtggatctaaataa

SEQ ID NO: 2824569 - DNA, 16 bp, Homo sapiens
atctctcaggagcaca

SEQ ID NO: 2824570 - DNA, 22 bp, Homo sapiens
atctctcaggagcacaggcagc

SEQ ID NO: 2824571 - DNA, 23 bp, Homo sapiens
atctctcaggagcacaggcagct

SEQ ID NO: 2824572 - DNA, 19 bp, Homo sapiens
atctctcggttccacgtcc

SEQ ID NO: 2824573 - DNA, 21 bp, Homo sapiens
atctctctactcctacctcag

SEQ ID NO: 2824574 - DNA, 23 bp, Homo sapiens
atctctctactcctacctcagcc

SEQ ID NO: 2824575 - DNA, 17 bp, Homo sapiens
atatgtaacaagccacc

SEQ ID NO: 2824576 - DNA, 12 bp, Homo sapiens
atatgtacagtt

SEQ ID NO: 2824577 - DNA, 19 bp, Homo sapiens
atatgtaccatgtacatga

SEQ ID NO: 2824578 - DNA, 17 bp, Homo sapiens
atatgtaggtgtctgca

SEQ ID NO: 2824579 - DNA, 13 bp, Homo sapiens
atatgtatatata

SEQ ID NO: 2824580 - DNA, 12 bp, Homo sapiens
atatgtatatgt

SEQ ID NO: 2824581 - DNA, 13 bp, Homo sapiens
atatgtatatgta

SEQ ID NO: 2824582 - DNA, 15 bp, Homo sapiens
atatgtatatgtata

SEQ ID NO: 2824583 - DNA, 17 bp, Homo sapiens
atatgtatatgtatata

SEQ ID NO: 2824584 - DNA, 18 bp, Homo sapiens
atatgtatttattgtcat

SEQ ID NO: 2824585 - DNA, 20 bp, Homo sapiens
atatgttaacctcagtgtca

SEQ ID NO: 2824586 - DNA, 15 bp, Homo sapiens
atatgttcaactgga

SEQ ID NO: 2824587 - DNA, 15 bp, Homo sapiens
atatgttgctgaaac

SEQ ID NO: 2824588 - DNA, 16 bp, Homo sapiens
atatgttgctgaaaca

SEQ ID NO: 2824589 - DNA, 12 bp, Homo sapiens
atattaaaggct

SEQ ID NO: 2824590 - DNA, 12 bp, Homo sapiens
atattaaataca

SEQ ID NO: 2824591 - DNA, 13 bp, Homo sapiens
atattaaatacag

SEQ ID NO: 2824592 - DNA, 19 bp, Homo sapiens
atattaaatacagacacta

SEQ ID NO: 2824593 - DNA, 18 bp, Homo sapiens
atattagaagtgttaact

SEQ ID NO: 2824594 - DNA, 17 bp, Homo sapiens
atattataacttaaaaa

SEQ ID NO: 2824595 - DNA, 22 bp, Homo sapiens
atattataataatgttctctgg

SEQ ID NO: 2824596 - DNA, 20 bp, Homo sapiens
atattatggtgtaatgcaca

SEQ ID NO: 2824597 - DNA, 14 bp, Homo sapiens
atattcagagatgt

SEQ ID NO: 2824598 - DNA, 21 bp, Homo sapiens
atattcatgtaataaatctga

SEQ ID NO: 2824599 - DNA, 14 bp, Homo sapiens
atattcattgtata

SEQ ID NO: 2824600 - DNA, 23 bp, Homo sapiens
atattcattgtataaaaatagaa

SEQ ID NO: 2824601 - DNA, 18 bp, Homo sapiens
atattccatatattagca

SEQ ID NO: 2824602 - DNA, 18 bp, Homo sapiens
atattcccctatctctag

SEQ ID NO: 2824603 - DNA, 21 bp, Homo sapiens
atattcctgcatttgtgaaat

SEQ ID NO: 2824604 - DNA, 21 bp, Homo sapiens
atattctacacatatatgtat

SEQ ID NO: 2824605 - DNA, 22 bp, Homo sapiens
atattctacacatatatgtata

SEQ ID NO: 2824606 - DNA, 19 bp, Homo sapiens
atattgaataagtattctt

SEQ ID NO: 2824607 - DNA, 18 bp, Homo sapiens
atattgtatgtaagtaat

SEQ ID NO: 2824608 - DNA, 12 bp, Homo sapiens
atattgtcagat

SEQ ID NO: 2824609 - DNA, 16 bp, Homo sapiens
atattgtcagatattt

SEQ ID NO: 2824610 - DNA, 13 bp, Homo sapiens
atatttaagtata

SEQ ID NO: 2824611 - DNA, 15 bp, Homo sapiens
atatttacatatgaa

SEQ ID NO: 2824612 - DNA, 14 bp, Homo sapiens
atatttactttaaa

SEQ ID NO: 2824613 - DNA, 19 bp, Homo sapiens
atatttagattgttaaaat

SEQ ID NO: 2824614 - DNA, 13 bp, Homo sapiens
atatttataactc

SEQ ID NO: 2824615 - DNA, 15 bp, Homo sapiens
atatttataactcat

SEQ ID NO: 2824616 - DNA, 14 bp, Homo sapiens
atatttccatttct

SEQ ID NO: 2824617 - DNA, 17 bp, Homo sapiens
atatttgcttatttata

SEQ ID NO: 2824618 - DNA, 18 bp, Homo sapiens
atatttgcttatttatat

SEQ ID NO: 2824619 - DNA, 19 bp, Homo sapiens
atatttgcttatttatatt

SEQ ID NO: 2824620 - DNA, 13 bp, Homo sapiens
atatttgtacata

SEQ ID NO: 2824621 - DNA, 12 bp, Homo sapiens
atatttgtagaa

SEQ ID NO: 2824622 - DNA, 21 bp, Homo sapiens
atattttatatgaaatgtttc

SEQ ID NO: 2824623 - DNA, 17 bp, Homo sapiens
atattttatgatttaaa

SEQ ID NO: 2824624 - DNA, 13 bp, Homo sapiens
atattttccctct

SEQ ID NO: 2824625 - DNA, 20 bp, Homo sapiens
atattttccctctcttgcct

SEQ ID NO: 2824626 - DNA, 15 bp, Homo sapiens
atatttttagctctg

SEQ ID NO: 2824627 - DNA, 13 bp, Homo sapiens
atatttttataga

SEQ ID NO: 2824628 - DNA, 14 bp, Homo sapiens
atatttttatagac

SEQ ID NO: 2824629 - DNA, 12 bp, Homo sapiens
atatttttcaac

SEQ ID NO: 2824630 - DNA, 24 bp, Homo sapiens
atatttttcaaccagcattttact

SEQ ID NO: 2824631 - DNA, 18 bp, Homo sapiens
atatttttggttgtcaat

SEQ ID NO: 2824632 - DNA, 16 bp, Homo sapiens
atcaaaaatattccat

SEQ ID NO: 2824633 - DNA, 19 bp, Homo sapiens
atcaaaaattgaagagaga

SEQ ID NO: 2824634 - DNA, 17 bp, Homo sapiens
atcaaaacatatcaatt

SEQ ID NO: 2824635 - DNA, 20 bp, Homo sapiens
atcaaaacatatcaattcaa

SEQ ID NO: 2824636 - DNA, 19 bp, Homo sapiens
atcaaaagctgcttgacta

SEQ ID NO: 2824637 - DNA, 16 bp, Homo sapiens
atcaaaataaattgaa

SEQ ID NO: 2824638 - DNA, 17 bp, Homo sapiens
atcaaaataaattgaaa

SEQ ID NO: 2824639 - DNA, 22 bp, Homo sapiens
atcaaacaccaacataaaaatg

SEQ ID NO: 2824640 - DNA, 17 bp, Homo sapiens
atcaaactgaagccaga

SEQ ID NO: 2824641 - DNA, 22 bp, Homo sapiens
atcaaatttcacgtcgtcttct

SEQ ID NO: 2824642 - DNA, 18 bp, Homo sapiens
atcaacaagagttgtctt

SEQ ID NO: 2824643 - DNA, 12 bp, Homo sapiens
atcaagaaagtc

SEQ ID NO: 2824644 - DNA, 20 bp, Homo sapiens
atcaagctagaaggccacat

SEQ ID NO: 2824645 - DNA, 15 bp, Homo sapiens
atcaaggagcccaga

SEQ ID NO: 2824646 - DNA, 15 bp, Homo sapiens
atcaaggatgttctg

SEQ ID NO: 2824647 - DNA, 13 bp, Homo sapiens
atcaattaaatgt

SEQ ID NO: 2824648 - DNA, 15 bp, Homo sapiens
atcaattaattctta

SEQ ID NO: 2824649 - DNA, 20 bp, Homo sapiens
atcaattttcacttgcttaa

SEQ ID NO: 2824650 - DNA, 24 bp, Homo sapiens
atcaatttttatacatatcagaaa

SEQ ID NO: 2824651 - DNA, 17 bp, Homo sapiens
atcacaagcaataatta

SEQ ID NO: 2824652 - DNA, 21 bp, Homo sapiens
atcacactctaagttctattg

SEQ ID NO: 2824653 - DNA, 22 bp, Homo sapiens
atcacagatgggtattaaactt

SEQ ID NO: 2824654 - DNA, 13 bp, Homo sapiens
atcacagctcctc

SEQ ID NO: 2824655 - DNA, 12 bp, Homo sapiens
atcacagggccc

SEQ ID NO: 2824656 - DNA, 12 bp, Homo sapiens
atcacatacaat

SEQ ID NO: 2824657 - DNA, 20 bp, Homo sapiens
atcacatacaatttgcactg

SEQ ID NO: 2824658 - DNA, 14 bp, Homo sapiens
atcacctcaggcca

SEQ ID NO: 2824659 - DNA, 12 bp, Homo sapiens
atcacctgaggt

SEQ ID NO: 2824660 - DNA, 17 bp, Homo sapiens
atcacgccactgcacta

SEQ ID NO: 2824661 - DNA, 18 bp, Homo sapiens
agctagcgctgccgcacc

SEQ ID NO: 2824662 - DNA, 16 bp, Homo sapiens
agctaggagcaaagcc

SEQ ID NO: 2824663 - DNA, 18 bp, Homo sapiens
agctaggagcaaagcctg

SEQ ID NO: 2824664 - DNA, 14 bp, Homo sapiens
agctaggcctggcc

SEQ ID NO: 2824665 - DNA, 15 bp, Homo sapiens
agctaggcctggcca

SEQ ID NO: 2824666 - DNA, 16 bp, Homo sapiens
agctaggcctggccag

SEQ ID NO: 2824667 - DNA, 13 bp, Homo sapiens
agctagggctgga

SEQ ID NO: 2824668 - DNA, 17 bp, Homo sapiens
agctagtgacccacatg

SEQ ID NO: 2824669 - DNA, 20 bp, Homo sapiens
agctagtgacccacatgcca

SEQ ID NO: 2824670 - DNA, 21 bp, Homo sapiens
agctagtgacccacatgccat

SEQ ID NO: 2824671 - DNA, 16 bp, Homo sapiens
agctatgagggtcccc

SEQ ID NO: 2824672 - DNA, 18 bp, Homo sapiens
agctattgcatgtaaaat

SEQ ID NO: 2824673 - DNA, 21 bp, Homo sapiens
agctattgcatgtaaaatgca

SEQ ID NO: 2824674 - DNA, 10 bp, Homo sapiens
agctattttt

SEQ ID NO: 2824675 - DNA, 16 bp, Homo sapiens
agctcacaaggcagca

SEQ ID NO: 2824676 - DNA, 21 bp, Homo sapiens
agctcacagttcctcgccctg

SEQ ID NO: 2824677 - DNA, 23 bp, Homo sapiens
agctcacagttcctcgccctggg

SEQ ID NO: 2824678 - DNA, 13 bp, Homo sapiens
agctcaccagccc

SEQ ID NO: 2824679 - DNA, 15 bp, Homo sapiens
agctcagacccccac

SEQ ID NO: 2824680 - DNA, 16 bp, Homo sapiens
agctccatctccactc

SEQ ID NO: 2824681 - DNA, 22 bp, Homo sapiens
agctccccaaaaacctcacccg

SEQ ID NO: 2824682 - DNA, 12 bp, Homo sapiens
agctccccagga

SEQ ID NO: 2824683 - DNA, 19 bp, Homo sapiens
agctcccttttctttttcc

SEQ ID NO: 2824684 - DNA, 12 bp, Homo sapiens
agctcctctgtc

SEQ ID NO: 2824685 - DNA, 24 bp, Homo sapiens
agctcctctgtctcgagcgccctg

SEQ ID NO: 2824686 - DNA, 13 bp, Homo sapiens
agctcctcttcct

SEQ ID NO: 2824687 - DNA, 16 bp, Homo sapiens
agctcctgggcagctt

SEQ ID NO: 2824688 - DNA, 12 bp, Homo sapiens
agctccttctgt

SEQ ID NO: 2824689 - DNA, 23 bp, Homo sapiens
agctccttctgtcctactctgtg

SEQ ID NO: 2824690 - DNA, 14 bp, Homo sapiens
agctcggtggaccc

SEQ ID NO: 2824691 - DNA, 15 bp, Homo sapiens
agctcggtggaccca

SEQ ID NO: 2824692 - DNA, 19 bp, Homo sapiens
agctcggtggacccaggga

SEQ ID NO: 2824693 - DNA, 20 bp, Homo sapiens
agctctgacattctgattcg

SEQ ID NO: 2824694 - DNA, 19 bp, Homo sapiens
agctctgagaggccctgga

SEQ ID NO: 2824695 - DNA, 21 bp, Homo sapiens
agctctgagaggccctggatc

SEQ ID NO: 2824696 - DNA, 15 bp, Homo sapiens
agctctgatgagaga

SEQ ID NO: 2824697 - DNA, 13 bp, Homo sapiens
agctctgcatgtg

SEQ ID NO: 2824698 - DNA, 15 bp, Homo sapiens
agctctggaccagcc

SEQ ID NO: 2824699 - DNA, 12 bp, Homo sapiens
agctctggcttc

SEQ ID NO: 2824700 - DNA, 12 bp, Homo sapiens
agctctgtcctg

SEQ ID NO: 2824701 - DNA, 16 bp, Homo sapiens
agctctgtcctgggag

SEQ ID NO: 2824702 - DNA, 20 bp, Homo sapiens
agctctgtttataaaaacaa

SEQ ID NO: 2824703 - DNA, 16 bp, Homo sapiens
agctcttcccctttcc

SEQ ID NO: 2824704 - DNA, 17 bp, Homo sapiens
agctcttctatttaaaa

SEQ ID NO: 2824705 - DNA, 17 bp, Homo sapiens
agctcttctccaggctg

SEQ ID NO: 2824706 - DNA, 17 bp, Homo sapiens
agctcttggcccctgtg

SEQ ID NO: 2824707 - DNA, 20 bp, Homo sapiens
agctcttggcccctgtgtga

SEQ ID NO: 2824708 - DNA, 15 bp, Homo sapiens
agctctttgttcagt

SEQ ID NO: 2824709 - DNA, 22 bp, Homo sapiens
agctgaacagccaaatgcatgg

SEQ ID NO: 2824710 - DNA, 19 bp, Homo sapiens
agctgaacccattttgagt

SEQ ID NO: 2824711 - DNA, 13 bp, Homo sapiens
agctgagcagggc

SEQ ID NO: 2824712 - DNA, 15 bp, Homo sapiens
agctgagcagggccg

SEQ ID NO: 2824713 - DNA, 17 bp, Homo sapiens
agctgagctcacaaggc

SEQ ID NO: 2824714 - DNA, 18 bp, Homo sapiens
agctgagctcacaaggca

SEQ ID NO: 2824715 - DNA, 17 bp, Homo sapiens
agctgaggtgcccagga

SEQ ID NO: 2824716 - DNA, 22 bp, Homo sapiens
agctgaggtgcccaggagaaga

SEQ ID NO: 2824717 - DNA, 13 bp, Homo sapiens
agctgatcagttt

SEQ ID NO: 2824718 - DNA, 21 bp, Homo sapiens
agctgatgtgagtgtgtgtga

SEQ ID NO: 2824719 - DNA, 21 bp, Homo sapiens
agctgcaagtgacatctcttt

SEQ ID NO: 2824720 - DNA, 11 bp, Homo sapiens
agctgcagaac

SEQ ID NO: 2824721 - DNA, 11 bp, Homo sapiens
agctgcagctt

SEQ ID NO: 2824722 - DNA, 14 bp, Homo sapiens
agctgcagcttcct

SEQ ID NO: 2824723 - DNA, 16 bp, Homo sapiens
agctgcaggaatcaaa

SEQ ID NO: 2824724 - DNA, 23 bp, Homo sapiens
agctgcaggaatcaaaaattgaa

SEQ ID NO: 2824725 - DNA, 15 bp, Homo sapiens
agctgcatctactca

SEQ ID NO: 2824726 - DNA, 18 bp, Homo sapiens
agctgcctgtagttagga

SEQ ID NO: 2824727 - DNA, 22 bp, Homo sapiens
agctgcctgtagttaggaaata

SEQ ID NO: 2824728 - DNA, 14 bp, Homo sapiens
agctgcctgttcag

SEQ ID NO: 2824729 - DNA, 18 bp, Homo sapiens
agctgcggtccacccagg

SEQ ID NO: 2824730 - DNA, 20 bp, Homo sapiens
agctgcggtccacccaggag

SEQ ID NO: 2824731 - DNA, 23 bp, Homo sapiens
agctgcgtttattaatgcctctc

SEQ ID NO: 2824732 - DNA, 16 bp, Homo sapiens
agctgcttgactatca

SEQ ID NO: 2824733 - DNA, 16 bp, Homo sapiens
agctgctttaaatcta

SEQ ID NO: 2824734 - DNA, 15 bp, Homo sapiens
agctggaaagcagcc

SEQ ID NO: 2824735 - DNA, 12 bp, Homo sapiens
agctggaagcac

SEQ ID NO: 2824736 - DNA, 18 bp, Homo sapiens
agctggaattgctgctct

SEQ ID NO: 2824737 - DNA, 19 bp, Homo sapiens
agctggaattgctgctctc

SEQ ID NO: 2824738 - DNA, 14 bp, Homo sapiens
agctggacaagaag

SEQ ID NO: 2824739 - DNA, 17 bp, Homo sapiens
agctggacaagaagctg

SEQ ID NO: 2824740 - DNA, 15 bp, Homo sapiens
agctggcattacagc

SEQ ID NO: 2824741 - DNA, 21 bp, Homo sapiens
agctggcattacagctggaga

SEQ ID NO: 2824742 - DNA, 16 bp, Homo sapiens
agctgggactacaggc

SEQ ID NO: 2824743 - DNA, 20 bp, Homo sapiens
agctgggactacaggcaccc

SEQ ID NO: 2824744 - DNA, 16 bp, Homo sapiens
agctgggactacaggt

SEQ ID NO: 2824745 - DNA, 17 bp, Homo sapiens
agctgggactacaggtg

SEQ ID NO: 2824746 - DNA, 19 bp, Homo sapiens
agctgggactacaggtgtg

SEQ ID NO: 2824747 - DNA, 12 bp, Homo sapiens
agctgggaggaa

SEQ ID NO: 2824748 - DNA, 19 bp, Homo sapiens
agctgggcaccacaggctg

SEQ ID NO: 2824749 - DNA, 15 bp, Homo sapiens
agctgggggaagggt

SEQ ID NO: 2824750 - DNA, 16 bp, Homo sapiens
agctggtcccactcag

SEQ ID NO: 2824751 - DNA, 22 bp, Homo sapiens
agctggtttcctcattcctgaa

SEQ ID NO: 2824752 - DNA, 18 bp, Homo sapiens
agttgagtctcctctctg

SEQ ID NO: 2824753 - DNA, 14 bp, Homo sapiens
agttgatgaccaat

SEQ ID NO: 2824754 - DNA, 23 bp, Homo sapiens
agttgatgaccaatctctgtgac

SEQ ID NO: 2824755 - DNA, 16 bp, Homo sapiens
agttgcaataaaatag

SEQ ID NO: 2824756 - DNA, 18 bp, Homo sapiens
agttgcaataaaatagta

SEQ ID NO: 2824757 - DNA, 16 bp, Homo sapiens
agttgcgtggactctg

SEQ ID NO: 2824758 - DNA, 20 bp, Homo sapiens
agttgcgtggactctgcaca

SEQ ID NO: 2824759 - DNA, 20 bp, Homo sapiens
agttgctactcttcagaata

SEQ ID NO: 2824760 - DNA, 18 bp, Homo sapiens
agttggaaccgtgtccag

SEQ ID NO: 2824761 - DNA, 22 bp, Homo sapiens
agttggaaccgtgtccagcaca

SEQ ID NO: 2824762 - DNA, 23 bp, Homo sapiens
agttggaaccgtgtccagcacag

SEQ ID NO: 2824763 - DNA, 18 bp, Homo sapiens
agttggaccagaggaagc

SEQ ID NO: 2824764 - DNA, 15 bp, Homo sapiens
agttgggagcactgg

SEQ ID NO: 2824765 - DNA, 13 bp, Homo sapiens
agttgggcttcct

SEQ ID NO: 2824766 - DNA, 17 bp, Homo sapiens
agttgggtggatgcctg

SEQ ID NO: 2824767 - DNA, 13 bp, Homo sapiens
agttggtgacaga

SEQ ID NO: 2824768 - DNA, 14 bp, Homo sapiens
agttgtatctcttt

SEQ ID NO: 2824769 - DNA, 15 bp, Homo sapiens
agttgtatctctttt

SEQ ID NO: 2824770 - DNA, 17 bp, Homo sapiens
agttgtatctcttttga

SEQ ID NO: 2824771 - DNA, 18 bp, Homo sapiens
agttgtggaaagcctctg

SEQ ID NO: 2824772 - DNA, 19 bp, Homo sapiens
agttgtgttaacaatgcag

SEQ ID NO: 2824773 - DNA, 15 bp, Homo sapiens
agttgttcacatata

SEQ ID NO: 2824774 - DNA, 16 bp, Homo sapiens
agttgtttcattgact

SEQ ID NO: 2824775 - DNA, 16 bp, Homo sapiens
agtttaaaaaatacac

SEQ ID NO: 2824776 - DNA, 15 bp, Homo sapiens
agtttaagtctctga

SEQ ID NO: 2824777 - DNA, 17 bp, Homo sapiens
agtttaataaatttatt

SEQ ID NO: 2824778 - DNA, 15 bp, Homo sapiens
agtttatatttaact

SEQ ID NO: 2824779 - DNA, 19 bp, Homo sapiens
agtttatttgttgagagtg

SEQ ID NO: 2824780 - DNA, 23 bp, Homo sapiens
agtttatttgttgagagtgtgac

SEQ ID NO: 2824781 - DNA, 23 bp, Homo sapiens
agtttattttttctacacagtaa

SEQ ID NO: 2824782 - DNA, 17 bp, Homo sapiens
agtttcaattcagtgct

SEQ ID NO: 2824783 - DNA, 18 bp, Homo sapiens
agtttcaggtgtttagtt

SEQ ID NO: 2824784 - DNA, 17 bp, Homo sapiens
agtttctattgtaaatt

SEQ ID NO: 2824785 - DNA, 21 bp, Homo sapiens
agtttctcctttattgctcct

SEQ ID NO: 2824786 - DNA, 21 bp, Homo sapiens
agtttgaaggaggtgagggat

SEQ ID NO: 2824787 - DNA, 12 bp, Homo sapiens
agtttgagacca

SEQ ID NO: 2824788 - DNA, 15 bp, Homo sapiens
agtttgagaccagcc

SEQ ID NO: 2824789 - DNA, 17 bp, Homo sapiens
agtttgagaccagcctg

SEQ ID NO: 2824790 - DNA, 17 bp, Homo sapiens
agtttgaggctgcagcg

SEQ ID NO: 2824791 - DNA, 16 bp, Homo sapiens
agtttgatttaatatc

SEQ ID NO: 2824792 - DNA, 14 bp, Homo sapiens
agtttgcagaaaag

SEQ ID NO: 2824793 - DNA, 13 bp, Homo sapiens
agtttgccagaag

SEQ ID NO: 2824794 - DNA, 15 bp, Homo sapiens
agtttgctgggttta

SEQ ID NO: 2824795 - DNA, 14 bp, Homo sapiens
agtttggatatgta

SEQ ID NO: 2824796 - DNA, 16 bp, Homo sapiens
agtttgggccactgca

SEQ ID NO: 2824797 - DNA, 23 bp, Homo sapiens
agtttgtacagacgtatgcttat

SEQ ID NO: 2824798 - DNA, 17 bp, Homo sapiens
agtttgtggtaaaaaga

SEQ ID NO: 2824799 - DNA, 13 bp, Homo sapiens
agttttaaatatg

SEQ ID NO: 2824800 - DNA, 15 bp, Homo sapiens
agttttaaatatgaa

SEQ ID NO: 2824801 - DNA, 18 bp, Homo sapiens
agttttaaatatgaacaa

SEQ ID NO: 2824802 - DNA, 18 bp, Homo sapiens
agttttaactagaattta

SEQ ID NO: 2824803 - DNA, 12 bp, Homo sapiens
agttttatcatt

SEQ ID NO: 2824804 - DNA, 13 bp, Homo sapiens
agttttatcattt

SEQ ID NO: 2824805 - DNA, 20 bp, Homo sapiens
agttttatcattttcaaaat

SEQ ID NO: 2824806 - DNA, 12 bp, Homo sapiens
agtttttacaaa

SEQ ID NO: 2824807 - DNA, 21 bp, Homo sapiens
agttttttttaacctgtttat

SEQ ID NO: 2824808 - DNA, 15 bp, Homo sapiens
ataaaaacaaaaaca

SEQ ID NO: 2824809 - DNA, 16 bp, Homo sapiens
ataaaaacataaaata

SEQ ID NO: 2824810 - DNA, 14 bp, Homo sapiens
ataaaaaccagaat

SEQ ID NO: 2824811 - DNA, 17 bp, Homo sapiens
ataaaaaccagaatcat

SEQ ID NO: 2824812 - DNA, 16 bp, Homo sapiens
ataaaaagtgcttttg

SEQ ID NO: 2824813 - DNA, 10 bp, Homo sapiens
ataaaaagtt

SEQ ID NO: 2824814 - DNA, 11 bp, Homo sapiens
ataaaaataca

SEQ ID NO: 2824815 - DNA, 11 bp, Homo sapiens
ataaaaccatg

SEQ ID NO: 2824816 - DNA, 11 bp, Homo sapiens
ataaaaccttt

SEQ ID NO: 2824817 - DNA, 13 bp, Homo sapiens
ataaaacctttca

SEQ ID NO: 2824818 - DNA, 15 bp, Homo sapiens
ataaaacctttcaaa

SEQ ID NO: 2824819 - DNA, 20 bp, Homo sapiens
ataaaacctttcaaatttca

SEQ ID NO: 2824820 - DNA, 19 bp, Homo sapiens
ataaaactcagttaaaatg

SEQ ID NO: 2824821 - DNA, 12 bp, Homo sapiens
ataaaatgatgt

SEQ ID NO: 2824822 - DNA, 15 bp, Homo sapiens
ataaaattatggtga

SEQ ID NO: 2824823 - DNA, 16 bp, Homo sapiens
ataaaattatggtgaa

SEQ ID NO: 2824824 - DNA, 17 bp, Homo sapiens
ataaacacccatgaatc

SEQ ID NO: 2824825 - DNA, 17 bp, Homo sapiens
ataaacattaaacactg

SEQ ID NO: 2824826 - DNA, 20 bp, Homo sapiens
ataaacgcgggaaaaaagat

SEQ ID NO: 2824827 - DNA, 20 bp, Homo sapiens
ataaacgtgatgatcagctg

SEQ ID NO: 2824828 - DNA, 15 bp, Homo sapiens
ataaactagatctcc

SEQ ID NO: 2824829 - DNA, 11 bp, Homo sapiens
ataaacttcag

SEQ ID NO: 2824830 - DNA, 21 bp, Homo sapiens
ataaagaacaaggtagttttt

SEQ ID NO: 2824831 - DNA, 17 bp, Homo sapiens
ataaagatggctattat

SEQ ID NO: 2824832 - DNA, 21 bp, Homo sapiens
ataaagatgtcaaatatctca

SEQ ID NO: 2824833 - DNA, 16 bp, Homo sapiens
ataaagattttttaat

SEQ ID NO: 2824834 - DNA, 17 bp, Homo sapiens
ataaagattttttaata

SEQ ID NO: 2824835 - DNA, 18 bp, Homo sapiens
ataaagattttttaataa

SEQ ID NO: 2824836 - DNA, 14 bp, Homo sapiens
ataaagcctgcttt

SEQ ID NO: 2824837 - DNA, 11 bp, Homo sapiens
ataaagctgga

SEQ ID NO: 2824838 - DNA, 20 bp, Homo sapiens
ataaagctggacaagaagct

SEQ ID NO: 2824839 - DNA, 14 bp, Homo sapiens
ataaaggtatttag

SEQ ID NO: 2824840 - DNA, 20 bp, Homo sapiens
ataaaggtggtatgtgtgtg

SEQ ID NO: 2824841 - DNA, 21 bp, Homo sapiens
ataaaggttgacaataaatgt

SEQ ID NO: 2824842 - DNA, 15 bp, Homo sapiens
ataaagtatcatcag

SEQ ID NO: 2824843 - DNA, 16 bp, Homo sapiens
aggatctagaatgtgt

SEQ ID NO: 2824844 - DNA, 15 bp, Homo sapiens
aggatctatgcaatt

SEQ ID NO: 2824845 - DNA, 16 bp, Homo sapiens
aggatctatgcaattt

SEQ ID NO: 2824846 - DNA, 22 bp, Homo sapiens
aggatctatgcaatttttaaac

SEQ ID NO: 2824847 - DNA, 15 bp, Homo sapiens
aggatctctcaggag

SEQ ID NO: 2824848 - DNA, 20 bp, Homo sapiens
aggatctgtttttaaaaatc

SEQ ID NO: 2824849 - DNA, 20 bp, Homo sapiens
aggatgaatgaggtcccagg

SEQ ID NO: 2824850 - DNA, 14 bp, Homo sapiens
aggcctggccaggc

SEQ ID NO: 2824851 - DNA, 22 bp, Homo sapiens
aggcctgtgtagctgtgacctg

SEQ ID NO: 2824852 - DNA, 18 bp, Homo sapiens
aggccttctctgaaggac

SEQ ID NO: 2824853 - DNA, 24 bp, Homo sapiens
aggcggagagtacagtgagccaag

SEQ ID NO: 2824854 - DNA, 24 bp, Homo sapiens
aggcggcacattggcagtgtgtca

SEQ ID NO: 2824855 - DNA, 18 bp, Homo sapiens
aggcgttcttcgaggtgg

SEQ ID NO: 2824856 - DNA, 16 bp, Homo sapiens
aggctattattttcac

SEQ ID NO: 2824857 - DNA, 15 bp, Homo sapiens
aggctccttcatgtg

SEQ ID NO: 2824858 - DNA, 17 bp, Homo sapiens
aggctgaccaagagaga

SEQ ID NO: 2824859 - DNA, 20 bp, Homo sapiens
aggctgaccaagagagaaag

SEQ ID NO: 2824860 - DNA, 16 bp, Homo sapiens
aggctgagactgcggg

SEQ ID NO: 2824861 - DNA, 17 bp, Homo sapiens
aggctgagactgcggga

SEQ ID NO: 2824862 - DNA, 17 bp, Homo sapiens
aggctgagtgagccaca

SEQ ID NO: 2824863 - DNA, 17 bp, Homo sapiens
aggctgcagaaggccaa

SEQ ID NO: 2824864 - DNA, 18 bp, Homo sapiens
aggctgcagaaggccaag

SEQ ID NO: 2824865 - DNA, 15 bp, Homo sapiens
aggctgcagcgagct

SEQ ID NO: 2824866 - DNA, 21 bp, Homo sapiens
aggctgcagtcagtcatgatg

SEQ ID NO: 2824867 - DNA, 19 bp, Homo sapiens
aggctgcctcatgaccctc

SEQ ID NO: 2824868 - DNA, 14 bp, Homo sapiens
aggctgctcagagg

SEQ ID NO: 2824869 - DNA, 15 bp, Homo sapiens
aggctgctcagaggg

SEQ ID NO: 2824870 - DNA, 21 bp, Homo sapiens
aggctgctcggggtgcacagg

SEQ ID NO: 2824871 - DNA, 20 bp, Homo sapiens
aggctggagaagctcaccca

SEQ ID NO: 2824872 - DNA, 18 bp, Homo sapiens
aggctggaggcagggcct

SEQ ID NO: 2824873 - DNA, 15 bp, Homo sapiens
aggctggcactcccc

SEQ ID NO: 2824874 - DNA, 20 bp, Homo sapiens
aggctggctgaaaatcacta

SEQ ID NO: 2824875 - DNA, 13 bp, Homo sapiens
aggctggctggcc

SEQ ID NO: 2824876 - DNA, 18 bp, Homo sapiens
aggctgggcttcagtggc

SEQ ID NO: 2824877 - DNA, 22 bp, Homo sapiens
aggctgggcttcagtggcagct

SEQ ID NO: 2824878 - DNA, 13 bp, Homo sapiens
aggctggtcttga

SEQ ID NO: 2824879 - DNA, 20 bp, Homo sapiens
aggctgtatcccatgagcct

SEQ ID NO: 2824880 - DNA, 24 bp, Homo sapiens
aggctgtatcccatgagcctcagc

SEQ ID NO: 2824881 - DNA, 20 bp, Homo sapiens
aggctgtggtggctgtctct

SEQ ID NO: 2824882 - DNA, 18 bp, Homo sapiens
aggcttccttcatttcct

SEQ ID NO: 2824883 - DNA, 23 bp, Homo sapiens
aggcttctagttagctgctttaa

SEQ ID NO: 2824884 - DNA, 23 bp, Homo sapiens
aggcttcttcagatcagtgcttg

SEQ ID NO: 2824885 - DNA, 20 bp, Homo sapiens
agggaaaacataatatcttg

SEQ ID NO: 2824886 - DNA, 16 bp, Homo sapiens
agggaaactattgtcc

SEQ ID NO: 2824887 - DNA, 23 bp, Homo sapiens
agggaaattcacactgtgcgttt

SEQ ID NO: 2824888 - DNA, 13 bp, Homo sapiens
agggaacagacag

SEQ ID NO: 2824889 - DNA, 14 bp, Homo sapiens
agggaacagacagg

SEQ ID NO: 2824890 - DNA, 18 bp, Homo sapiens
agggaacagacaggagaa

SEQ ID NO: 2824891 - DNA, 18 bp, Homo sapiens
agggaaggcaggcagggc

SEQ ID NO: 2824892 - DNA, 14 bp, Homo sapiens
agggaaggctgctg

SEQ ID NO: 2824893 - DNA, 15 bp, Homo sapiens
agggaatggcacagc

SEQ ID NO: 2824894 - DNA, 15 bp, Homo sapiens
agggaatttcaggaa

SEQ ID NO: 2824895 - DNA, 14 bp, Homo sapiens
agggacaaaggagc

SEQ ID NO: 2824896 - DNA, 15 bp, Homo sapiens
agggacaaaggagcc

SEQ ID NO: 2824897 - DNA, 18 bp, Homo sapiens
agggacaaaggagcctgt

SEQ ID NO: 2824898 - DNA, 20 bp, Homo sapiens
agggacaaaggagcctgtga

SEQ ID NO: 2824899 - DNA, 10 bp, Homo sapiens
agggacagag

SEQ ID NO: 2824900 - DNA, 18 bp, Homo sapiens
agggacagagacacctgc

SEQ ID NO: 2824901 - DNA, 20 bp, Homo sapiens
agggacagagacacctgcac

SEQ ID NO: 2824902 - DNA, 23 bp, Homo sapiens
agggactgccagtccccctgccc

SEQ ID NO: 2824903 - DNA, 17 bp, Homo sapiens
agggacttaaaaaactt

SEQ ID NO: 2824904 - DNA, 18 bp, Homo sapiens
agggacttggaagctccg

SEQ ID NO: 2824905 - DNA, 20 bp, Homo sapiens
agggacttggaagctccgct

SEQ ID NO: 2824906 - DNA, 18 bp, Homo sapiens
agggagaagggatggagg

SEQ ID NO: 2824907 - DNA, 18 bp, Homo sapiens
agggagactgcatctcaa

SEQ ID NO: 2824908 - DNA, 16 bp, Homo sapiens
agggagagcggggcag

SEQ ID NO: 2824909 - DNA, 12 bp, Homo sapiens
agggaggggact

SEQ ID NO: 2824910 - DNA, 20 bp, Homo sapiens
agggagtccgaaagggactt

SEQ ID NO: 2824911 - DNA, 14 bp, Homo sapiens
agggatacactgaa

SEQ ID NO: 2824912 - DNA, 13 bp, Homo sapiens
agggatcacaggg

SEQ ID NO: 2824913 - DNA, 19 bp, Homo sapiens
agggatcttgcattcccag

SEQ ID NO: 2824914 - DNA, 20 bp, Homo sapiens
agggatcttgcattcccagt

SEQ ID NO: 2824915 - DNA, 15 bp, Homo sapiens
agggatgactaaaat

SEQ ID NO: 2824916 - DNA, 17 bp, Homo sapiens
agggatgctgcctgagt

SEQ ID NO: 2824917 - DNA, 19 bp, Homo sapiens
agggatgctgcctgagtca

SEQ ID NO: 2824918 - DNA, 19 bp, Homo sapiens
agggcaaacccaaaacctc

SEQ ID NO: 2824919 - DNA, 22 bp, Homo sapiens
agggcaataaatgccctctctg

SEQ ID NO: 2824920 - DNA, 20 bp, Homo sapiens
agggcacaccgggcactcag

SEQ ID NO: 2824921 - DNA, 12 bp, Homo sapiens
agggcacaggag

SEQ ID NO: 2824922 - DNA, 17 bp, Homo sapiens
agggcacaggagctacc

SEQ ID NO: 2824923 - DNA, 19 bp, Homo sapiens
agggcacaggagctacctg

SEQ ID NO: 2824924 - DNA, 23 bp, Homo sapiens
agggcacaggagctacctgtgtg

SEQ ID NO: 2824925 - DNA, 16 bp, Homo sapiens
agggcaccgagaactc

SEQ ID NO: 2824926 - DNA, 17 bp, Homo sapiens
agggcagaggctggagg

SEQ ID NO: 2824927 - DNA, 21 bp, Homo sapiens
agggcagttcgcagccaccct

SEQ ID NO: 2824928 - DNA, 17 bp, Homo sapiens
agggcatcttagcttct

SEQ ID NO: 2824929 - DNA, 12 bp, Homo sapiens
agggccagggcc

SEQ ID NO: 2824930 - DNA, 22 bp, Homo sapiens
agggccagggccctgcagaggg

SEQ ID NO: 2824931 - DNA, 12 bp, Homo sapiens
agggcccagaga

SEQ ID NO: 2824932 - DNA, 13 bp, Homo sapiens
agggcccagagag

SEQ ID NO: 2824933 - DNA, 14 bp, Homo sapiens
agggcccagagagg

SEQ ID NO: 2824934 - DNA, 17 bp, Homo sapiens
aggaagtctaggagctg

SEQ ID NO: 2824935 - DNA, 14 bp, Homo sapiens
aggaataaggcctt

SEQ ID NO: 2824936 - DNA, 20 bp, Homo sapiens
aggaatctgtgcagatgagc

SEQ ID NO: 2824937 - DNA, 23 bp, Homo sapiens
aggaatgaaatcctgcttcagtg

SEQ ID NO: 2824938 - DNA, 24 bp, Homo sapiens
aggaatgcctcctccctgggcaga

SEQ ID NO: 2824939 - DNA, 18 bp, Homo sapiens
aggaatgtagctggtttc

SEQ ID NO: 2824940 - DNA, 14 bp, Homo sapiens
aggaatgttaaagt

SEQ ID NO: 2824941 - DNA, 22 bp, Homo sapiens
aggaatgttaaagtcagtggga

SEQ ID NO: 2824942 - DNA, 14 bp, Homo sapiens
agagttcaagaaat

SEQ ID NO: 2824943 - DNA, 15 bp, Homo sapiens
agagttcaagaaata

SEQ ID NO: 2824944 - DNA, 20 bp, Homo sapiens
agagttctttaggtgcctcc

SEQ ID NO: 2824945 - DNA, 17 bp, Homo sapiens
agagttgctttaaagta

SEQ ID NO: 2824946 - DNA, 19 bp, Homo sapiens
agagtttgaaggaggtgag

SEQ ID NO: 2824947 - DNA, 22 bp, Homo sapiens
agataactgaaaattatttaaa

SEQ ID NO: 2824948 - DNA, 22 bp, Homo sapiens
agataagaatgctggttttcct

SEQ ID NO: 2824949 - DNA, 17 bp, Homo sapiens
agataatatctgtgagg

SEQ ID NO: 2824950 - DNA, 19 bp, Homo sapiens
agataatatctgtgaggtg

SEQ ID NO: 2824951 - DNA, 21 bp, Homo sapiens
agataatatctgtgaggtgct

SEQ ID NO: 2824952 - DNA, 14 bp, Homo sapiens
agataatcagcctc

SEQ ID NO: 2824953 - DNA, 17 bp, Homo sapiens
agataatcagcctctta

SEQ ID NO: 2824954 - DNA, 16 bp, Homo sapiens
agataatttattttgt

SEQ ID NO: 2824955 - DNA, 17 bp, Homo sapiens
agataatttattttgta

SEQ ID NO: 2824956 - DNA, 22 bp, Homo sapiens
agatacattccctatcaaaaca

SEQ ID NO: 2824957 - DNA, 18 bp, Homo sapiens
agataccaggttgaaaga

SEQ ID NO: 2824958 - DNA, 12 bp, Homo sapiens
agatagaatgac

SEQ ID NO: 2824959 - DNA, 16 bp, Homo sapiens
agatagaatgacagtc

SEQ ID NO: 2824960 - DNA, 20 bp, Homo sapiens
agatagtgctttattttgtt

SEQ ID NO: 2824961 - DNA, 18 bp, Homo sapiens
agatatatctgaaaactg

SEQ ID NO: 2824962 - DNA, 21 bp, Homo sapiens
agatatatctgaaaactggaa

SEQ ID NO: 2824963 - DNA, 18 bp, Homo sapiens
agatattcctattgtgca

SEQ ID NO: 2824964 - DNA, 14 bp, Homo sapiens
agatatttatatat

SEQ ID NO: 2824965 - DNA, 17 bp, Homo sapiens
agatatttatatatatt

SEQ ID NO: 2824966 - DNA, 21 bp, Homo sapiens
agatatttccatttcttcctc

SEQ ID NO: 2824967 - DNA, 18 bp, Homo sapiens
agatattttttcagaaat

SEQ ID NO: 2824968 - DNA, 17 bp, Homo sapiens
agatcacatattctagt

SEQ ID NO: 2824969 - DNA, 14 bp, Homo sapiens
agatcaccagcccg

SEQ ID NO: 2824970 - DNA, 16 bp, Homo sapiens
agatcaccagcccggc

SEQ ID NO: 2824971 - DNA, 16 bp, Homo sapiens
agatcacgccactgca

SEQ ID NO: 2824972 - DNA, 20 bp, Homo sapiens
agatcccatccatcagctcc

SEQ ID NO: 2824973 - DNA, 14 bp, Homo sapiens
agatcgctggcaga

SEQ ID NO: 2824974 - DNA, 12 bp, Homo sapiens
agatcgtattaa

SEQ ID NO: 2824975 - DNA, 19 bp, Homo sapiens
agatcgtattaattatctg

SEQ ID NO: 2824976 - DNA, 21 bp, Homo sapiens
agatcgtgccgttactctcca

SEQ ID NO: 2824977 - DNA, 16 bp, Homo sapiens
agcaccccctcattcc

SEQ ID NO: 2824978 - DNA, 16 bp, Homo sapiens
agcacctcctgcctcg

SEQ ID NO: 2824979 - DNA, 19 bp, Homo sapiens
agcacctgccgacctcgtc

SEQ ID NO: 2824980 - DNA, 21 bp, Homo sapiens
agcacctgccgacctcgtcct

SEQ ID NO: 2824981 - DNA, 21 bp, Homo sapiens
agcacctgcttcatgctcagc

SEQ ID NO: 2824982 - DNA, 14 bp, Homo sapiens
agcactaaagcagt

SEQ ID NO: 2824983 - DNA, 16 bp, Homo sapiens
agcactaaagcagtgg

SEQ ID NO: 2824984 - DNA, 20 bp, Homo sapiens
agcactaaggtgtgctctga

SEQ ID NO: 2824985 - DNA, 23 bp, Homo sapiens
agcactcaaccaacctccccgca

SEQ ID NO: 2824986 - DNA, 12 bp, Homo sapiens
agcactcctctg

SEQ ID NO: 2824987 - DNA, 15 bp, Homo sapiens
agcactctctaaatc

SEQ ID NO: 2824988 - DNA, 23 bp, Homo sapiens
agcactctctaaatcttccttgt

SEQ ID NO: 2824989 - DNA, 13 bp, Homo sapiens
agcactgccagga

SEQ ID NO: 2824990 - DNA, 22 bp, Homo sapiens
agcactgctaggcgagtgccag

SEQ ID NO: 2824991 - DNA, 17 bp, Homo sapiens
agcactggagtgcaggg

SEQ ID NO: 2824992 - DNA, 22 bp, Homo sapiens
agcactggagtgcagggaggag

SEQ ID NO: 2824993 - DNA, 23 bp, Homo sapiens
agcactggagtgcagggaggaga

SEQ ID NO: 2824994 - DNA, 17 bp, Homo sapiens
agcacttctttcctctc

SEQ ID NO: 2824995 - DNA, 21 bp, Homo sapiens
agcacttctttcctctccaat

SEQ ID NO: 2824996 - DNA, 18 bp, Homo sapiens
agcactttaaccctctct

SEQ ID NO: 2824997 - DNA, 19 bp, Homo sapiens
agcactttaaccctctctt

SEQ ID NO: 2824998 - DNA, 22 bp, Homo sapiens
agcactttaaccctctcttccc

SEQ ID NO: 2824999 - DNA, 19 bp, Homo sapiens
agcactttgggaggctgaa

SEQ ID NO: 2825000 - DNA, 21 bp, Homo sapiens
agcactttgggaggctgaggc

SEQ ID NO: 2825001 - DNA, 15 bp, Homo sapiens
agcagaaaagtgctt

SEQ ID NO: 2825002 - DNA, 23 bp, Homo sapiens
agcagaaaagtgcttagaaagtt

SEQ ID NO: 2825003 - DNA, 15 bp, Homo sapiens
agcagaaagccaggg

SEQ ID NO: 2825004 - DNA, 21 bp, Homo sapiens
agcagacagtgttttctggga

SEQ ID NO: 2825005 - DNA, 16 bp, Homo sapiens
agcagactcagctctg

SEQ ID NO: 2825006 - DNA, 19 bp, Homo sapiens
agcagactcagctctgaca

SEQ ID NO: 2825007 - DNA, 20 bp, Homo sapiens
agcagactcagctctgacat

SEQ ID NO: 2825008 - DNA, 22 bp, Homo sapiens
agcagagaatgaaagggcccag

SEQ ID NO: 2825009 - DNA, 14 bp, Homo sapiens
agcagagcaggggc

SEQ ID NO: 2825010 - DNA, 17 bp, Homo sapiens
agcagaggagtccaggg

SEQ ID NO: 2825011 - DNA, 13 bp, Homo sapiens
agcagaggcagcg

SEQ ID NO: 2825012 - DNA, 15 bp, Homo sapiens
agcagagtcattgtt

SEQ ID NO: 2825013 - DNA, 17 bp, Homo sapiens
agcagagtgattcaggg

SEQ ID NO: 2825014 - DNA, 15 bp, Homo sapiens
agcagccagccctgc

SEQ ID NO: 2825015 - DNA, 18 bp, Homo sapiens
agcagccagccctgcctg

SEQ ID NO: 2825016 - DNA, 21 bp, Homo sapiens
agcagccagccctgcctggag

SEQ ID NO: 2825017 - DNA, 13 bp, Homo sapiens
agcagccagctct

SEQ ID NO: 2825018 - DNA, 16 bp, Homo sapiens
agcagccagctctcag

SEQ ID NO: 2825019 - DNA, 19 bp, Homo sapiens
agcagccagctctcagcca

SEQ ID NO: 2825020 - DNA, 18 bp, Homo sapiens
agcagccctaaggatctc

SEQ ID NO: 2825021 - DNA, 13 bp, Homo sapiens
agcagccctcctc

SEQ ID NO: 2825022 - DNA, 14 bp, Homo sapiens
agcagccctcctca

SEQ ID NO: 2825023 - DNA, 19 bp, Homo sapiens
agcagctcagcctcccccc

SEQ ID NO: 2825024 - DNA, 21 bp, Homo sapiens
agcagctcttcccctttcctg

SEQ ID NO: 2825025 - DNA, 18 bp, Homo sapiens
agcagctgaacagccaaa

SEQ ID NO: 2825026 - DNA, 14 bp, Homo sapiens
agcagctgagcagg

SEQ ID NO: 2825027 - DNA, 18 bp, Homo sapiens
agcagctgagcagggccg

SEQ ID NO: 2825028 - DNA, 19 bp, Homo sapiens
agcagctgagcagggccgg

SEQ ID NO: 2825029 - DNA, 12 bp, Homo sapiens
agcaggaaatag

SEQ ID NO: 2825030 - DNA, 14 bp, Homo sapiens
agcaggcacaggac

SEQ ID NO: 2825031 - DNA, 14 bp, Homo sapiens
agcagggaaacagc

SEQ ID NO: 2825032 - DNA, 14 bp, Homo sapiens
agcagggccgggga

SEQ ID NO: 2825033 - DNA, 22 bp, Homo sapiens
agcatgcatagtgctaagaaag

SEQ ID NO: 2825034 - DNA, 15 bp, Homo sapiens
agcatggctatttta

SEQ ID NO: 2825035 - DNA, 17 bp, Homo sapiens
agcatggtcacaagcac

SEQ ID NO: 2825036 - DNA, 22 bp, Homo sapiens
agcatggtcccacatccctggg

SEQ ID NO: 2825037 - DNA, 12 bp, Homo sapiens
agcatgtagctc

SEQ ID NO: 2825038 - DNA, 15 bp, Homo sapiens
agcatgtggggaagc

SEQ ID NO: 2825039 - DNA, 16 bp, Homo sapiens
agcatgtgttgaaaaa

SEQ ID NO: 2825040 - DNA, 18 bp, Homo sapiens
agcattacgtgagccagg

SEQ ID NO: 2825041 - DNA, 21 bp, Homo sapiens
agcattcagaagaaaaagaag

SEQ ID NO: 2825042 - DNA, 21 bp, Homo sapiens
agcattcttagactagttgaa

SEQ ID NO: 2825043 - DNA, 15 bp, Homo sapiens
agcattgaatggcta

SEQ ID NO: 2825044 - DNA, 14 bp, Homo sapiens
agcatttgtttcta

SEQ ID NO: 2825045 - DNA, 13 bp, Homo sapiens
agccaaacagagc

SEQ ID NO: 2825046 - DNA, 19 bp, Homo sapiens
agccaaacccatgaggcaa

SEQ ID NO: 2825047 - DNA, 15 bp, Homo sapiens
agccaaactctgcca

SEQ ID NO: 2825048 - DNA, 20 bp, Homo sapiens
agccaaagagaaaagattaa

SEQ ID NO: 2825049 - DNA, 21 bp, Homo sapiens
agccaaagagaaaagattaaa

SEQ ID NO: 2825050 - DNA, 18 bp, Homo sapiens
agccaaagctaggcctgg

SEQ ID NO: 2825051 - DNA, 19 bp, Homo sapiens
agccaaagctaggcctggc

SEQ ID NO: 2825052 - DNA, 23 bp, Homo sapiens
agccaaagctaggcctggccaga

SEQ ID NO: 2825053 - DNA, 13 bp, Homo sapiens
agccaaatttata

SEQ ID NO: 2825054 - DNA, 23 bp, Homo sapiens
agccaacaccctgtctaaaaaac

SEQ ID NO: 2825055 - DNA, 15 bp, Homo sapiens
agccaacaggtggca

SEQ ID NO: 2825056 - DNA, 21 bp, Homo sapiens
agccaacaggtggcaggacca

SEQ ID NO: 2825057 - DNA, 23 bp, Homo sapiens
agccaacaggtggcaggaccagg

SEQ ID NO: 2825058 - DNA, 21 bp, Homo sapiens
agccaacagtcaaaacagaga

SEQ ID NO: 2825059 - DNA, 15 bp, Homo sapiens
agccaacttgtaaat

SEQ ID NO: 2825060 - DNA, 20 bp, Homo sapiens
agccaacttgtaaatacacc

SEQ ID NO: 2825061 - DNA, 19 bp, Homo sapiens
agccaagatcgcgccactg

SEQ ID NO: 2825062 - DNA, 19 bp, Homo sapiens
agccaagcttcaaccctca

SEQ ID NO: 2825063 - DNA, 20 bp, Homo sapiens
agccaaggtgggctgagccc

SEQ ID NO: 2825064 - DNA, 23 bp, Homo sapiens
agccaaggtgggctgagccctgg

SEQ ID NO: 2825065 - DNA, 13 bp, Homo sapiens
agccacacagagc

SEQ ID NO: 2825066 - DNA, 19 bp, Homo sapiens
agccacacagagcctgcct

SEQ ID NO: 2825067 - DNA, 19 bp, Homo sapiens
agccacagaagccaggagc

SEQ ID NO: 2825068 - DNA, 20 bp, Homo sapiens
agccacagaagccaggagca

SEQ ID NO: 2825069 - DNA, 22 bp, Homo sapiens
agccacagaagccaggagcaaa

SEQ ID NO: 2825070 - DNA, 23 bp, Homo sapiens
agccacagaagccaggagcaaat

SEQ ID NO: 2825071 - DNA, 23 bp, Homo sapiens
agccacatccctttgaaacaaga

SEQ ID NO: 2825072 - DNA, 14 bp, Homo sapiens
agccaccctgagga

SEQ ID NO: 2825073 - DNA, 19 bp, Homo sapiens
agccaccctgaggagtctg

SEQ ID NO: 2825074 - DNA, 20 bp, Homo sapiens
agccaccgtctacagatggc

SEQ ID NO: 2825075 - DNA, 14 bp, Homo sapiens
agccacctctcttt

SEQ ID NO: 2825076 - DNA, 18 bp, Homo sapiens
agccacctctctttttca

SEQ ID NO: 2825077 - DNA, 12 bp, Homo sapiens
agccacctcttg

SEQ ID NO: 2825078 - DNA, 15 bp, Homo sapiens
agccacggccaggcc

SEQ ID NO: 2825079 - DNA, 23 bp, Homo sapiens
agccacgttccttactgcagaat

SEQ ID NO: 2825080 - DNA, 12 bp, Homo sapiens
agccactgaagc

SEQ ID NO: 2825081 - DNA, 13 bp, Homo sapiens
agccactgaagct

SEQ ID NO: 2825082 - DNA, 16 bp, Homo sapiens
agccactgaagctggg

SEQ ID NO: 2825083 - DNA, 13 bp, Homo sapiens
agccactgcaccg

SEQ ID NO: 2825084 - DNA, 18 bp, Homo sapiens
agccactgcaccgggcca

SEQ ID NO: 2825085 - DNA, 19 bp, Homo sapiens
agccactgcaccgggccac

SEQ ID NO: 2825086 - DNA, 22 bp, Homo sapiens
agccactgcaccgggccacaga

SEQ ID NO: 2825087 - DNA, 15 bp, Homo sapiens
agccacttaccttca

SEQ ID NO: 2825088 - DNA, 23 bp, Homo sapiens
agccacttaccttcaataaagta

SEQ ID NO: 2825089 - DNA, 12 bp, Homo sapiens
agccagagcctg

SEQ ID NO: 2825090 - DNA, 22 bp, Homo sapiens
agccagcaatgatgtccagaag

SEQ ID NO: 2825091 - DNA, 20 bp, Homo sapiens
agccagcagccagctctcag

SEQ ID NO: 2825092 - DNA, 13 bp, Homo sapiens
agccagccctccc

SEQ ID NO: 2825093 - DNA, 18 bp, Homo sapiens
agccagccctccctgtcc

SEQ ID NO: 2825094 - DNA, 14 bp, Homo sapiens
agccagccctgcct

SEQ ID NO: 2825095 - DNA, 17 bp, Homo sapiens
agccagccctgcctgga

SEQ ID NO: 2825096 - DNA, 18 bp, Homo sapiens
agccagccctgcctggag

SEQ ID NO: 2825097 - DNA, 20 bp, Homo sapiens
acttgccttcttcacccagc

SEQ ID NO: 2825098 - DNA, 17 bp, Homo sapiens
acttgctgcctgaagaa

SEQ ID NO: 2825099 - DNA, 21 bp, Homo sapiens
acttggaaaaatccagaaaga

SEQ ID NO: 2825100 - DNA, 14 bp, Homo sapiens
acttggaagctccg

SEQ ID NO: 2825101 - DNA, 22 bp, Homo sapiens
acttggagagggacgaagaaag

SEQ ID NO: 2825102 - DNA, 20 bp, Homo sapiens
acttgggagacctgtaatca

SEQ ID NO: 2825103 - DNA, 13 bp, Homo sapiens
acttgggcacccc

SEQ ID NO: 2825104 - DNA, 22 bp, Homo sapiens
acttgggcacccccagcctggg

SEQ ID NO: 2825105 - DNA, 16 bp, Homo sapiens
acttggtgtaattaat

SEQ ID NO: 2825106 - DNA, 15 bp, Homo sapiens
acttgtaaatacacc

SEQ ID NO: 2825107 - DNA, 20 bp, Homo sapiens
acttgtacaaaataaacaaa

SEQ ID NO: 2825108 - DNA, 22 bp, Homo sapiens
acttgtactatgttaataactt

SEQ ID NO: 2825109 - DNA, 17 bp, Homo sapiens
acttgtggacacagctc

SEQ ID NO: 2825110 - DNA, 22 bp, Homo sapiens
acttgtgtctctgtgcttttaa

SEQ ID NO: 2825111 - DNA, 15 bp, Homo sapiens
actttaaaataaaat

SEQ ID NO: 2825112 - DNA, 18 bp, Homo sapiens
actttaaccctctcttcc

SEQ ID NO: 2825113 - DNA, 15 bp, Homo sapiens
actttagagtagcat

SEQ ID NO: 2825114 - DNA, 19 bp, Homo sapiens
actttagagtagcatgaga

SEQ ID NO: 2825115 - DNA, 18 bp, Homo sapiens
actttcaggtactaaata

SEQ ID NO: 2825116 - DNA, 21 bp, Homo sapiens
actttcaggtactaaatacct

SEQ ID NO: 2825117 - DNA, 19 bp, Homo sapiens
actttctgttgccacaacc

SEQ ID NO: 2825118 - DNA, 19 bp, Homo sapiens
actttcttttctggaatgt

SEQ ID NO: 2825119 - DNA, 15 bp, Homo sapiens
actttgctctttctt

SEQ ID NO: 2825120 - DNA, 12 bp, Homo sapiens
actttgggaggc

SEQ ID NO: 2825121 - DNA, 15 bp, Homo sapiens
actttgggaggccaa

SEQ ID NO: 2825122 - DNA, 20 bp, Homo sapiens
actttgggaggccaaggtgg

SEQ ID NO: 2825123 - DNA, 19 bp, Homo sapiens
actttgggaggctgaggcg

SEQ ID NO: 2825124 - DNA, 19 bp, Homo sapiens
actttggttctctccagga

SEQ ID NO: 2825125 - DNA, 22 bp, Homo sapiens
actttgtacagtggagaaatat

SEQ ID NO: 2825126 - DNA, 15 bp, Homo sapiens
acttttaaacagtga

SEQ ID NO: 2825127 - DNA, 17 bp, Homo sapiens
acttttcctccctcagt

SEQ ID NO: 2825128 - DNA, 19 bp, Homo sapiens
acttttcctttgaatcctc

SEQ ID NO: 2825129 - DNA, 15 bp, Homo sapiens
acttttctaaagctc

SEQ ID NO: 2825130 - DNA, 17 bp, Homo sapiens
acttttgtaagacaaag

SEQ ID NO: 2825131 - DNA, 17 bp, Homo sapiens
acttttgtaccagtgtg

SEQ ID NO: 2825132 - DNA, 18 bp, Homo sapiens
actttttagtcttttact

SEQ ID NO: 2825133 - DNA, 14 bp, Homo sapiens
actttttatactcc

SEQ ID NO: 2825134 - DNA, 21 bp, Homo sapiens
actttttcagagttgctttaa

SEQ ID NO: 2825135 - DNA, 15 bp, Homo sapiens
agaaaaaaaaaaaga

SEQ ID NO: 2825136 - DNA, 18 bp, Homo sapiens
agaaaaaatacattttat

SEQ ID NO: 2825137 - DNA, 23 bp, Homo sapiens
agaaaaacaaactcgttttttac

SEQ ID NO: 2825138 - DNA, 18 bp, Homo sapiens
agaaaaaccaatgattca

SEQ ID NO: 2825139 - DNA, 23 bp, Homo sapiens
agaaaaaccaatgattcataaca

SEQ ID NO: 2825140 - DNA, 14 bp, Homo sapiens
agaaaaagaagcaa

SEQ ID NO: 2825141 - DNA, 15 bp, Homo sapiens
agaaaaattattgta

SEQ ID NO: 2825142 - DNA, 23 bp, Homo sapiens
agagcaagatcctgtctttaagg

SEQ ID NO: 2825143 - DNA, 14 bp, Homo sapiens
agagcaagtctgga

SEQ ID NO: 2825144 - DNA, 14 bp, Homo sapiens
agagcagagagcag

SEQ ID NO: 2825145 - DNA, 12 bp, Homo sapiens
agagcaggcaca

SEQ ID NO: 2825146 - DNA, 20 bp, Homo sapiens
agagcaggcacatggaggag

SEQ ID NO: 2825147 - DNA, 22 bp, Homo sapiens
agagcaggggtccttggtgtga

SEQ ID NO: 2825148 - DNA, 17 bp, Homo sapiens
agagcatcatgcctctg

SEQ ID NO: 2825149 - DNA, 23 bp, Homo sapiens
agagcatcatgcctctgaggcca

SEQ ID NO: 2825150 - DNA, 19 bp, Homo sapiens
agagcattacgtgagccag

SEQ ID NO: 2825151 - DNA, 14 bp, Homo sapiens
agagccagccctcc

SEQ ID NO: 2825152 - DNA, 16 bp, Homo sapiens
agagccagccctccct

SEQ ID NO: 2825153 - DNA, 20 bp, Homo sapiens
agagccagccctccctgtcc

SEQ ID NO: 2825154 - DNA, 22 bp, Homo sapiens
agagccagccctccctgtcctc

SEQ ID NO: 2825155 - DNA, 15 bp, Homo sapiens
agagcccatgctcaa

SEQ ID NO: 2825156 - DNA, 21 bp, Homo sapiens
agagcccatgctcaaccactg

SEQ ID NO: 2825157 - DNA, 17 bp, Homo sapiens
agagccctgggaccgct

SEQ ID NO: 2825158 - DNA, 19 bp, Homo sapiens
agagccctgtcagtagagt

SEQ ID NO: 2825159 - DNA, 15 bp, Homo sapiens
agagcccttcatttg

SEQ ID NO: 2825160 - DNA, 13 bp, Homo sapiens
agagcctgactgt

SEQ ID NO: 2825161 - DNA, 18 bp, Homo sapiens
agagcctgcctcagctgc

SEQ ID NO: 2825162 - DNA, 12 bp, Homo sapiens
agagcctggggc

SEQ ID NO: 2825163 - DNA, 13 bp, Homo sapiens
agagcctggggct

SEQ ID NO: 2825164 - DNA, 23 bp, Homo sapiens
agagcctggggctctaacgcctg

SEQ ID NO: 2825165 - DNA, 21 bp, Homo sapiens
agagcctgtctttcagcattc

SEQ ID NO: 2825166 - DNA, 19 bp, Homo sapiens
agagccttctcctgcctac

SEQ ID NO: 2825167 - DNA, 17 bp, Homo sapiens
agagcgagagtctgtct

SEQ ID NO: 2825168 - DNA, 14 bp, Homo sapiens
agagctacataatt

SEQ ID NO: 2825169 - DNA, 21 bp, Homo sapiens
agagctagcgctgccgcaccc

SEQ ID NO: 2825170 - DNA, 20 bp, Homo sapiens
agagctaggagcaaagcctg

SEQ ID NO: 2825171 - DNA, 21 bp, Homo sapiens
agagctaggagcaaagcctgt

SEQ ID NO: 2825172 - DNA, 11 bp, Homo sapiens
agagctgaggc

SEQ ID NO: 2825173 - DNA, 21 bp, Homo sapiens
agagctgatgtgagtgtgtgt

SEQ ID NO: 2825174 - DNA, 15 bp, Homo sapiens
agagctggcaaaggt

SEQ ID NO: 2825175 - DNA, 23 bp, Homo sapiens
agagctttctgtccttttggcac

SEQ ID NO: 2825176 - DNA, 19 bp, Homo sapiens
agaggaagagagagaccct

SEQ ID NO: 2825177 - DNA, 21 bp, Homo sapiens
agaggacttttctttgtggct

SEQ ID NO: 2825178 - DNA, 22 bp, Homo sapiens
acgtgagccaggtaatgaggga

SEQ ID NO: 2825179 - DNA, 23 bp, Homo sapiens
acgtgagccaggtaatgagggac

SEQ ID NO: 2825180 - DNA, 23 bp, Homo sapiens
acgtgcacctgtactcaggaggc

SEQ ID NO: 2825181 - DNA, 18 bp, Homo sapiens
acgtgctcttctgttctc

SEQ ID NO: 2825182 - DNA, 22 bp, Homo sapiens
acgtgctcttctgttctcaaat

SEQ ID NO: 2825183 - DNA, 12 bp, Homo sapiens
acgttaaaagac

SEQ ID NO: 2825184 - DNA, 14 bp, Homo sapiens
acgttaaaagacag

SEQ ID NO: 2825185 - DNA, 23 bp, Homo sapiens
acgttaacccatttttgagccaa

SEQ ID NO: 2825186 - DNA, 13 bp, Homo sapiens
acgttgctcccca

SEQ ID NO: 2825187 - DNA, 14 bp, Homo sapiens
acgtttgtgagaag

SEQ ID NO: 2825188 - DNA, 18 bp, Homo sapiens
actaaaaaatgtctatag

SEQ ID NO: 2825189 - DNA, 21 bp, Homo sapiens
actaaaaagtggctaattcaa

SEQ ID NO: 2825190 - DNA, 11 bp, Homo sapiens
actaaagcagt

SEQ ID NO: 2825191 - DNA, 12 bp, Homo sapiens
actaaagcagtg

SEQ ID NO: 2825192 - DNA, 14 bp, Homo sapiens
actaaagcagtgtt

SEQ ID NO: 2825193 - DNA, 15 bp, Homo sapiens
actaaagcagtgttt

SEQ ID NO: 2825194 - DNA, 18 bp, Homo sapiens
actaaatgagctcctgcg

SEQ ID NO: 2825195 - DNA, 19 bp, Homo sapiens
actaacactcagaagcctg

SEQ ID NO: 2825196 - DNA, 13 bp, Homo sapiens
actaaccacgctg

SEQ ID NO: 2825197 - DNA, 18 bp, Homo sapiens
actaagccctgtcgagac

SEQ ID NO: 2825198 - DNA, 18 bp, Homo sapiens
actaagttatagtatatc

SEQ ID NO: 2825199 - DNA, 21 bp, Homo sapiens
actacaaaaaagttgttaact

SEQ ID NO: 2825200 - DNA, 14 bp, Homo sapiens
actacaaaatttga

SEQ ID NO: 2825201 - DNA, 22 bp, Homo sapiens
actacaatttaaagcaaaggag

SEQ ID NO: 2825202 - DNA, 15 bp, Homo sapiens
actacactccagcct

SEQ ID NO: 2825203 - DNA, 17 bp, Homo sapiens
actacactccagcctga

SEQ ID NO: 2825204 - DNA, 16 bp, Homo sapiens
actacagtctaaagct

SEQ ID NO: 2825205 - DNA, 14 bp, Homo sapiens
actactattctgtt

SEQ ID NO: 2825206 - DNA, 14 bp, Homo sapiens
actactgctgcaaa

SEQ ID NO: 2825207 - DNA, 20 bp, Homo sapiens
actactgctgcaaagtgcaa

SEQ ID NO: 2825208 - DNA, 18 bp, Homo sapiens
actactgtggaaaaatat

SEQ ID NO: 2825209 - DNA, 20 bp, Homo sapiens
actactgtggaaaaatattt

SEQ ID NO: 2825210 - DNA, 22 bp, Homo sapiens
actactgtggaaaaatatttaa

SEQ ID NO: 2825211 - DNA, 13 bp, Homo sapiens
actagaactctcc

SEQ ID NO: 2825212 - DNA, 15 bp, Homo sapiens
actagaactctccat

SEQ ID NO: 2825213 - DNA, 16 bp, Homo sapiens
actagaactctccatc

SEQ ID NO: 2825214 - DNA, 20 bp, Homo sapiens
actagaatttgtattttgct

SEQ ID NO: 2825215 - DNA, 14 bp, Homo sapiens
actagaggcaggga

SEQ ID NO: 2825216 - DNA, 15 bp, Homo sapiens
actagaggcagggag

SEQ ID NO: 2825217 - DNA, 14 bp, Homo sapiens
actagaggtgagaa

SEQ ID NO: 2825218 - DNA, 14 bp, Homo sapiens
actagatctcctgt

SEQ ID NO: 2825219 - DNA, 15 bp, Homo sapiens
actagatggcgagca

SEQ ID NO: 2825220 - DNA, 13 bp, Homo sapiens
actagcagctgca

SEQ ID NO: 2825221 - DNA, 17 bp, Homo sapiens
actaggactctgaggct

SEQ ID NO: 2825222 - DNA, 23 bp, Homo sapiens
actaggaggttccggtgtctgga

SEQ ID NO: 2825223 - DNA, 23 bp, Homo sapiens
actagtgacaagctcctggtctt

SEQ ID NO: 2825224 - DNA, 15 bp, Homo sapiens
actagtgttgcttgg

SEQ ID NO: 2825225 - DNA, 20 bp, Homo sapiens
actagttgtgtctggcagtt

SEQ ID NO: 2825226 - DNA, 13 bp, Homo sapiens
actataaacatta

SEQ ID NO: 2825227 - DNA, 18 bp, Homo sapiens
actataaaggttgacaat

SEQ ID NO: 2825228 - DNA, 19 bp, Homo sapiens
actataaccatcagttact

SEQ ID NO: 2825229 - DNA, 22 bp, Homo sapiens
actatagcctaggtgacagagt

SEQ ID NO: 2825230 - DNA, 14 bp, Homo sapiens
actatcaaactgaa

SEQ ID NO: 2825231 - DNA, 23 bp, Homo sapiens
acctggccccatgtctctcagaa

SEQ ID NO: 2825232 - DNA, 18 bp, Homo sapiens
acctggccgcctccagga

SEQ ID NO: 2825233 - DNA, 11 bp, Homo sapiens
acctggccttc

SEQ ID NO: 2825234 - DNA, 15 bp, Homo sapiens
acctgtagtgagaaa

SEQ ID NO: 2825235 - DNA, 20 bp, Homo sapiens
acctgtagtgagaaactgat

SEQ ID NO: 2825236 - DNA, 18 bp, Homo sapiens
acctgtcaccgtgagcag

SEQ ID NO: 2825237 - DNA, 12 bp, Homo sapiens
acctgtctgtct

SEQ ID NO: 2825238 - DNA, 19 bp, Homo sapiens
acctgtgtggacaggacta

SEQ ID NO: 2825239 - DNA, 18 bp, Homo sapiens
acctgtgtttcttgcctc

SEQ ID NO: 2825240 - DNA, 21 bp, Homo sapiens
acctgtgtttcttgcctcatt

SEQ ID NO: 2825241 - DNA, 19 bp, Homo sapiens
acctgttaaaatgtacact

SEQ ID NO: 2825242 - DNA, 20 bp, Homo sapiens
acctgttaaaatgtacactg

SEQ ID NO: 2825243 - DNA, 17 bp, Homo sapiens
acctgtttatataattt

SEQ ID NO: 2825244 - DNA, 16 bp, Homo sapiens
acctgtttttaagctg

SEQ ID NO: 2825245 - DNA, 20 bp, Homo sapiens
acctgtttttaagctgtttc

SEQ ID NO: 2825246 - DNA, 18 bp, Homo sapiens
accttagcagctcttccc

SEQ ID NO: 2825247 - DNA, 21 bp, Homo sapiens
accttagctggcattacagct

SEQ ID NO: 2825248 - DNA, 12 bp, Homo sapiens
accttcaataaa

SEQ ID NO: 2825249 - DNA, 17 bp, Homo sapiens
accttcaataaagtatc

SEQ ID NO: 2825250 - DNA, 17 bp, Homo sapiens
accttcaattcctgggc

SEQ ID NO: 2825251 - DNA, 18 bp, Homo sapiens
accttcaattcctgggcc

SEQ ID NO: 2825252 - DNA, 14 bp, Homo sapiens
accttcagcagtta

SEQ ID NO: 2825253 - DNA, 11 bp, Homo sapiens
accttcccagc

SEQ ID NO: 2825254 - DNA, 17 bp, Homo sapiens
accttcccagctctccc

SEQ ID NO: 2825255 - DNA, 19 bp, Homo sapiens
accttcccagctctccctc

SEQ ID NO: 2825256 - DNA, 17 bp, Homo sapiens
accttcccatgccctgg

SEQ ID NO: 2825257 - DNA, 11 bp, Homo sapiens
accttcctgcc

SEQ ID NO: 2825258 - DNA, 18 bp, Homo sapiens
accttcctgccaccagtc

SEQ ID NO: 2825259 - DNA, 19 bp, Homo sapiens
accttctctacccatctcc

SEQ ID NO: 2825260 - DNA, 12 bp, Homo sapiens
accttctgaaga

SEQ ID NO: 2825261 - DNA, 14 bp, Homo sapiens
accttgacagggca

SEQ ID NO: 2825262 - DNA, 16 bp, Homo sapiens
accttggactcctccc

SEQ ID NO: 2825263 - DNA, 17 bp, Homo sapiens
accttggactcctccca

SEQ ID NO: 2825264 - DNA, 18 bp, Homo sapiens
accttggctgcagggagt

SEQ ID NO: 2825265 - DNA, 20 bp, Homo sapiens
accttgtcatgtaccatcaa

SEQ ID NO: 2825266 - DNA, 13 bp, Homo sapiens
accttgtgtctgt

SEQ ID NO: 2825267 - DNA, 14 bp, Homo sapiens
acctttattgtgat

SEQ ID NO: 2825268 - DNA, 13 bp, Homo sapiens
acctttccctcac

SEQ ID NO: 2825269 - DNA, 11 bp, Homo sapiens
acctttctagt

SEQ ID NO: 2825270 - DNA, 13 bp, Homo sapiens
acctttgtgtaat

SEQ ID NO: 2825271 - DNA, 14 bp, Homo sapiens
acctttgtgtaata

SEQ ID NO: 2825272 - DNA, 12 bp, Homo sapiens
acgaaatgttat

SEQ ID NO: 2825273 - DNA, 14 bp, Homo sapiens
acgaacccacctgc

SEQ ID NO: 2825274 - DNA, 20 bp, Homo sapiens
acgaacccactgtgcttaca

SEQ ID NO: 2825275 - DNA, 21 bp, Homo sapiens
acgaacccactgtgcttacag

SEQ ID NO: 2825276 - DNA, 16 bp, Homo sapiens
acgaacccctcccctc

SEQ ID NO: 2825277 - DNA, 21 bp, Homo sapiens
acgaacccctcccctcccccc

SEQ ID NO: 2825278 - DNA, 19 bp, Homo sapiens
acgaatttggtgtggctgt

SEQ ID NO: 2825279 - DNA, 18 bp, Homo sapiens
acgactgaagaaggacat

SEQ ID NO: 2825280 - DNA, 20 bp, Homo sapiens
acgagaccctacaggagagg

SEQ ID NO: 2825281 - DNA, 16 bp, Homo sapiens
acgagtaatttattgt

SEQ ID NO: 2825282 - DNA, 14 bp, Homo sapiens
acgatgaaaaactt

SEQ ID NO: 2825283 - DNA, 17 bp, Homo sapiens
acgcaaagggctgaaag

SEQ ID NO: 2825284 - DNA, 20 bp, Homo sapiens
acgccactcatttcatctca

SEQ ID NO: 2825285 - DNA, 18 bp, Homo sapiens
acgccactgcactatagc

SEQ ID NO: 2825286 - DNA, 18 bp, Homo sapiens
acgccagtttcaccattt

SEQ ID NO: 2825287 - DNA, 14 bp, Homo sapiens
acgcccagcctcct

SEQ ID NO: 2825288 - DNA, 15 bp, Homo sapiens
acgcccagcctcctc

SEQ ID NO: 2825289 - DNA, 19 bp, Homo sapiens
acgcccagctgaggctggg

SEQ ID NO: 2825290 - DNA, 16 bp, Homo sapiens
acgcctatgatcccag

SEQ ID NO: 2825291 - DNA, 18 bp, Homo sapiens
acgcctatgatcccagca

SEQ ID NO: 2825292 - DNA, 11 bp, Homo sapiens
acgcctgagcc

SEQ ID NO: 2825293 - DNA, 13 bp, Homo sapiens
acgcctgagccca

SEQ ID NO: 2825294 - DNA, 16 bp, Homo sapiens
acgcctgagcccaggg

SEQ ID NO: 2825295 - DNA, 19 bp, Homo sapiens
acgcctgagcccagggagg

SEQ ID NO: 2825296 - DNA, 20 bp, Homo sapiens
acgcctgagcccagggaggc

SEQ ID NO: 2825297 - DNA, 15 bp, Homo sapiens
acgcctgcccagcct

SEQ ID NO: 2825298 - DNA, 20 bp, Homo sapiens
acgcctgtaatcccagcact

SEQ ID NO: 2825299 - DNA, 20 bp, Homo sapiens
actgccaagaaaaggcatgg

SEQ ID NO: 2825300 - DNA, 19 bp, Homo sapiens
actgccacaccctccccat

SEQ ID NO: 2825301 - DNA, 14 bp, Homo sapiens
actgccccaccagc

SEQ ID NO: 2825302 - DNA, 19 bp, Homo sapiens
actgccccaccagccacct

SEQ ID NO: 2825303 - DNA, 22 bp, Homo sapiens
actgccgcaagtctgcagcccg

SEQ ID NO: 2825304 - DNA, 18 bp, Homo sapiens
actgcgatcttcagagca

SEQ ID NO: 2825305 - DNA, 19 bp, Homo sapiens
actgcgggatggtcctggg

SEQ ID NO: 2825306 - DNA, 21 bp, Homo sapiens
actgcgggatggtcctggggc

SEQ ID NO: 2825307 - DNA, 18 bp, Homo sapiens
actgctaggcgagtgcca

SEQ ID NO: 2825308 - DNA, 14 bp, Homo sapiens
actgctctcagcct

SEQ ID NO: 2825309 - DNA, 16 bp, Homo sapiens
actgctgcaaagtgca

SEQ ID NO: 2825310 - DNA, 21 bp, Homo sapiens
actgctgcaaagtgcaaatac

SEQ ID NO: 2825311 - DNA, 18 bp, Homo sapiens
actgctgcccagcctcca

SEQ ID NO: 2825312 - DNA, 18 bp, Homo sapiens
actgctgggactggccag

SEQ ID NO: 2825313 - DNA, 19 bp, Homo sapiens
actgctgggactggccagg

SEQ ID NO: 2825314 - DNA, 12 bp, Homo sapiens
actgctggggag

SEQ ID NO: 2825315 - DNA, 17 bp, Homo sapiens
actgctggggagtccct

SEQ ID NO: 2825316 - DNA, 21 bp, Homo sapiens
actgctgtcattgtccatgcc

SEQ ID NO: 2825317 - DNA, 22 bp, Homo sapiens
actgctgttaattgattaaaat

SEQ ID NO: 2825318 - DNA, 16 bp, Homo sapiens
actgcttgtgttttta

SEQ ID NO: 2825319 - DNA, 16 bp, Homo sapiens
actgctttcaacttaa

SEQ ID NO: 2825320 - DNA, 16 bp, Homo sapiens
actgcttttggtctgt

SEQ ID NO: 2825321 - DNA, 17 bp, Homo sapiens
actggaagcacagcttc

SEQ ID NO: 2825322 - DNA, 16 bp, Homo sapiens
actggaatcctttcag

SEQ ID NO: 2825323 - DNA, 21 bp, Homo sapiens
actggaatcgatctgtactgt

SEQ ID NO: 2825324 - DNA, 13 bp, Homo sapiens
actggacagcttg

SEQ ID NO: 2825325 - DNA, 21 bp, Homo sapiens
actggaccactgggcaatgat

SEQ ID NO: 2825326 - DNA, 13 bp, Homo sapiens
actggagcactga

SEQ ID NO: 2825327 - DNA, 13 bp, Homo sapiens
actggagtgcagg

SEQ ID NO: 2825328 - DNA, 17 bp, Homo sapiens
actggagtgcagggagg

SEQ ID NO: 2825329 - DNA, 12 bp, Homo sapiens
actggatatgtt

SEQ ID NO: 2825330 - DNA, 21 bp, Homo sapiens
actggccaagctgaggtgccc

SEQ ID NO: 2825331 - DNA, 13 bp, Homo sapiens
actggccccaccc

SEQ ID NO: 2825332 - DNA, 22 bp, Homo sapiens
actggcctcaaagcaagcattc

SEQ ID NO: 2825333 - DNA, 19 bp, Homo sapiens
actggggagttataaaaat

SEQ ID NO: 2825334 - DNA, 20 bp, Homo sapiens
actggggagttataaaaata

SEQ ID NO: 2825335 - DNA, 20 bp, Homo sapiens
actggggtcctggggcctcg

SEQ ID NO: 2825336 - DNA, 17 bp, Homo sapiens
actgggtacttgtggac

SEQ ID NO: 2825337 - DNA, 20 bp, Homo sapiens
actgggtacttgtggacaca

SEQ ID NO: 2825338 - DNA, 12 bp, Homo sapiens
actggtgactgc

SEQ ID NO: 2825339 - DNA, 22 bp, Homo sapiens
actggtttctcagaatccaaag

SEQ ID NO: 2825340 - DNA, 23 bp, Homo sapiens
actggtttctcagaatccaaaga

SEQ ID NO: 2825341 - DNA, 17 bp, Homo sapiens
actgtaatcttaaaagt

SEQ ID NO: 2825342 - DNA, 16 bp, Homo sapiens
aaaataaaaaccagaa

SEQ ID NO: 2825343 - DNA, 20 bp, Homo sapiens
aaaataaaaaccagaatcat

SEQ ID NO: 2825344 - DNA, 11 bp, Homo sapiens
aaaataaaatg

SEQ ID NO: 2825345 - DNA, 16 bp, Homo sapiens
aaaataatttaactaa

SEQ ID NO: 2825346 - DNA, 19 bp, Homo sapiens
aaaataatttaactaattt

SEQ ID NO: 2825347 - DNA, 23 bp, Homo sapiens
aaaataatttaactaatttaaac

SEQ ID NO: 2825348 - DNA, 13 bp, Homo sapiens
aaaatacagtaaa

SEQ ID NO: 2825349 - DNA, 17 bp, Homo sapiens
aaaatacataagaccat

SEQ ID NO: 2825350 - DNA, 10 bp, Homo sapiens
aaaatacatg

SEQ ID NO: 2825351 - DNA, 13 bp, Homo sapiens
aaaatacatttta

SEQ ID NO: 2825352 - DNA, 22 bp, Homo sapiens
aaaatagcaacactctatattt

SEQ ID NO: 2825353 - DNA, 18 bp, Homo sapiens
aaaatagtaaatgctttg

SEQ ID NO: 2825354 - DNA, 19 bp, Homo sapiens
aaaatagtagaacaagcaa

SEQ ID NO: 2825355 - DNA, 21 bp, Homo sapiens
aaaatagtagaacaagcaaca

SEQ ID NO: 2825356 - DNA, 18 bp, Homo sapiens
aaaatagtattgaaagtg

SEQ ID NO: 2825357 - DNA, 22 bp, Homo sapiens
aaaatagtttggatatgtaaaa

SEQ ID NO: 2825358 - DNA, 11 bp, Homo sapiens
aaaatataaat

SEQ ID NO: 2825359 - DNA, 12 bp, Homo sapiens
aaaatataaatg

SEQ ID NO: 2825360 - DNA, 22 bp, Homo sapiens
aaaatataaatgcatgatttta

SEQ ID NO: 2825361 - DNA, 17 bp, Homo sapiens
aaaatatacaaacatgt

SEQ ID NO: 2825362 - DNA, 17 bp, Homo sapiens
aaaatatattttatgat

SEQ ID NO: 2825363 - DNA, 16 bp, Homo sapiens
aaaatattataactta

SEQ ID NO: 2825364 - DNA, 19 bp, Homo sapiens
aaaatattataacttaaaa

SEQ ID NO: 2825365 - DNA, 17 bp, Homo sapiens
aaaatattttataattt

SEQ ID NO: 2825366 - DNA, 21 bp, Homo sapiens
aaaatcactatctttctgata

SEQ ID NO: 2825367 - DNA, 15 bp, Homo sapiens
aaaatcatgtacatt

SEQ ID NO: 2825368 - DNA, 22 bp, Homo sapiens
aaaatccctatttaattttcct

SEQ ID NO: 2825369 - DNA, 22 bp, Homo sapiens
aaaatctagatcaattaattct

SEQ ID NO: 2825370 - DNA, 23 bp, Homo sapiens
aaaatctagatcaattaattctt

SEQ ID NO: 2825371 - DNA, 17 bp, Homo sapiens
aaaatcttggcacagaa

SEQ ID NO: 2825372 - DNA, 21 bp, Homo sapiens
aaaatgaaagccaaatttata

SEQ ID NO: 2825373 - DNA, 17 bp, Homo sapiens
aaaatgacagatgttga

SEQ ID NO: 2825374 - DNA, 18 bp, Homo sapiens
aaaatgacagatgttgaa

SEQ ID NO: 2825375 - DNA, 16 bp, Homo sapiens
aaaatgcaaaatgaaa

SEQ ID NO: 2825376 - DNA, 18 bp, Homo sapiens
aaaatgcaacaacatgta

SEQ ID NO: 2825377 - DNA, 16 bp, Homo sapiens
aaaatgcagtccagaa

SEQ ID NO: 2825378 - DNA, 14 bp, Homo sapiens
aaaatggaaagaat

SEQ ID NO: 2825379 - DNA, 19 bp, Homo sapiens
aaaatggccatttgctttt

SEQ ID NO: 2825380 - DNA, 18 bp, Homo sapiens
aaaatgtctgttaactta

SEQ ID NO: 2825381 - DNA, 19 bp, Homo sapiens
aaaatgtgacccagatcct

SEQ ID NO: 2825382 - DNA, 13 bp, Homo sapiens
aaaatgttgaaat

SEQ ID NO: 2825383 - DNA, 17 bp, Homo sapiens
aaaatgttgaaatatga

SEQ ID NO: 2825384 - DNA, 18 bp, Homo sapiens
aaaatgtttcattttcat

SEQ ID NO: 2825385 - DNA, 14 bp, Homo sapiens
aaaattaacactgc

SEQ ID NO: 2825386 - DNA, 22 bp, Homo sapiens
aaaattgaagagagatatatct

SEQ ID NO: 2825387 - DNA, 14 bp, Homo sapiens
aaaattgaatgcaa

SEQ ID NO: 2825388 - DNA, 10 bp, Homo sapiens
aaaattgcac

SEQ ID NO: 2825389 - DNA, 11 bp, Homo sapiens
aaaattgcaca

SEQ ID NO: 2825390 - DNA, 15 bp, Homo sapiens
aaaattgcacaattt

SEQ ID NO: 2825391 - DNA, 16 bp, Homo sapiens
aaaattggccagagag

SEQ ID NO: 2825392 - DNA, 13 bp, Homo sapiens
aaaattgtgatca

SEQ ID NO: 2825393 - DNA, 13 bp, Homo sapiens
aaaatttgtttaa

SEQ ID NO: 2825394 - DNA, 13 bp, Homo sapiens
aaacaaaaacact

SEQ ID NO: 2825395 - DNA, 15 bp, Homo sapiens
aaacaaataatcaca

SEQ ID NO: 2825396 - DNA, 16 bp, Homo sapiens
aaacaagaaagaaacg

SEQ ID NO: 2825397 - DNA, 12 bp, Homo sapiens
aaacaagtattt

SEQ ID NO: 2825398 - DNA, 20 bp, Homo sapiens
aaacacaaaagttagctgag

SEQ ID NO: 2825399 - DNA, 14 bp, Homo sapiens
aaacacaatatttt

SEQ ID NO: 2825400 - DNA, 13 bp, Homo sapiens
aaacacagtgctg

SEQ ID NO: 2825401 - DNA, 15 bp, Homo sapiens
aaacaccaacataaa

SEQ ID NO: 2825402 - DNA, 17 bp, Homo sapiens
aaacacctgacacatct

SEQ ID NO: 2825403 - DNA, 21 bp, Homo sapiens
aaacactgtaatcttaaaagt

SEQ ID NO: 2825404 - DNA, 18 bp, Homo sapiens
aaacacttctcatcatat

SEQ ID NO: 2825405 - DNA, 15 bp, Homo sapiens
aaacagagacaggcc

SEQ ID NO: 2825406 - DNA, 22 bp, Homo sapiens
aaacagccgtcagccaaatgta

SEQ ID NO: 2825407 - DNA, 11 bp, Homo sapiens
aaacaggacca

SEQ ID NO: 2825408 - DNA, 16 bp, Homo sapiens
aaacaggggatcaaag

SEQ ID NO: 2825409 - DNA, 21 bp, Homo sapiens
aaacaggggatcaaagttcct

SEQ ID NO: 2825410 - DNA, 14 bp, Homo sapiens
aaacataatatctt

SEQ ID NO: 2825411 - DNA, 14 bp, Homo sapiens
aaacatagatagtg

SEQ ID NO: 2825412 - DNA, 18 bp, Homo sapiens
aaacatatcaattcaaca

SEQ ID NO: 2825413 - DNA, 20 bp, Homo sapiens
aaacatatcaattcaacaca

SEQ ID NO: 2825414 - DNA, 21 bp, Homo sapiens
aaacatatcaattcaacacat

SEQ ID NO: 2825415 - DNA, 19 bp, Homo sapiens
aaacatcattcatttttgt

SEQ ID NO: 2825416 - DNA, 12 bp, Homo sapiens
aaacatgaagtg

SEQ ID NO: 2825417 - DNA, 17 bp, Homo sapiens
aaacatgagaaatgtga

SEQ ID NO: 2825418 - DNA, 18 bp, Homo sapiens
aaacatgagaaatgtgaa

SEQ ID NO: 2825419 - DNA, 14 bp, Homo sapiens
aaacattaaacact

SEQ ID NO: 2825420 - DNA, 21 bp, Homo sapiens
aaacattaaacactgtaatct

SEQ ID NO: 2825421 - DNA, 20 bp, Homo sapiens
aaacattaagattgaggcct

SEQ ID NO: 2825422 - DNA, 22 bp, Homo sapiens
aaacatttacaataaatattct

SEQ ID NO: 2825423 - DNA, 14 bp, Homo sapiens
aaacatttattttg

SEQ ID NO: 2825424 - DNA, 21 bp, Homo sapiens
aaacatttattttgacataaa

SEQ ID NO: 2825425 - DNA, 21 bp, Homo sapiens
aaacattttgtggtcattaag

SEQ ID NO: 2825426 - DNA, 20 bp, Homo sapiens
aaaccaaataagcatctgtg

SEQ ID NO: 2825427 - DNA, 12 bp, Homo sapiens
aaaccaatgatt

SEQ ID NO: 2825428 - DNA, 15 bp, Homo sapiens
aaaccaatgattcat

SEQ ID NO: 2825429 - DNA, 16 bp, Homo sapiens
aaaccagaatcataat

SEQ ID NO: 2825430 - DNA, 13 bp, Homo sapiens
aaaccagctgcta

SEQ ID NO: 2825431 - DNA, 23 bp, Homo sapiens
aaaccatccatctgtggaaatga

SEQ ID NO: 2825432 - DNA, 15 bp, Homo sapiens
aaaccatgcaaatgc

SEQ ID NO: 2825433 - DNA, 13 bp, Homo sapiens
aaattgctccttg

SEQ ID NO: 2825434 - DNA, 15 bp, Homo sapiens
aaattggtgataagt

SEQ ID NO: 2825435 - DNA, 20 bp, Homo sapiens
aaattggtgataagtggaaa

SEQ ID NO: 2825436 - DNA, 18 bp, Homo sapiens
aaattgtcttttgtcatg

SEQ ID NO: 2825437 - DNA, 14 bp, Homo sapiens
aaattgttcctgat

SEQ ID NO: 2825438 - DNA, 19 bp, Homo sapiens
aaatttaaactataagcaa

SEQ ID NO: 2825439 - DNA, 16 bp, Homo sapiens
aaatttccagtacctt

SEQ ID NO: 2825440 - DNA, 23 bp, Homo sapiens
aaatttccagtacctttgtcaca

SEQ ID NO: 2825441 - DNA, 15 bp, Homo sapiens
aaatttggttctaat

SEQ ID NO: 2825442 - DNA, 11 bp, Homo sapiens
aaattttcaaa

SEQ ID NO: 2825443 - DNA, 14 bp, Homo sapiens
aaattttcaaactt

SEQ ID NO: 2825444 - DNA, 18 bp, Homo sapiens
aaattttctatgcttatt

SEQ ID NO: 2825445 - DNA, 11 bp, Homo sapiens
aacaaaaataa

SEQ ID NO: 2825446 - DNA, 17 bp, Homo sapiens
aacaaaacaaaaaactt

SEQ ID NO: 2825447 - DNA, 15 bp, Homo sapiens
aacaaaagcaagact

SEQ ID NO: 2825448 - DNA, 18 bp, Homo sapiens
aacaaagaaaaaaatata

SEQ ID NO: 2825449 - DNA, 13 bp, Homo sapiens
aacaaagaaatat

SEQ ID NO: 2825450 - DNA, 19 bp, Homo sapiens
aacaaagagttcaagaaat

SEQ ID NO: 2825451 - DNA, 16 bp, Homo sapiens
aacaaataatcacatt

SEQ ID NO: 2825452 - DNA, 16 bp, Homo sapiens
aacaactaggcttcag

SEQ ID NO: 2825453 - DNA, 12 bp, Homo sapiens
aacaagaaagaa

SEQ ID NO: 2825454 - DNA, 21 bp, Homo sapiens
aacaagaagccacagacctag

SEQ ID NO: 2825455 - DNA, 12 bp, Homo sapiens
aacaagtatttg

SEQ ID NO: 2825456 - DNA, 17 bp, Homo sapiens
aacaatagctattgcat

SEQ ID NO: 2825457 - DNA, 23 bp, Homo sapiens
aacaatagctattgcatgtaaaa

SEQ ID NO: 2825458 - DNA, 14 bp, Homo sapiens
aacaatgtcagaaa

SEQ ID NO: 2825459 - DNA, 15 bp, Homo sapiens
aacacaagctggaag

SEQ ID NO: 2825460 - DNA, 22 bp, Homo sapiens
aacacagctttacaacttccat

SEQ ID NO: 2825461 - DNA, 22 bp, Homo sapiens
aacacaggcaaaatccttgctt

SEQ ID NO: 2825462 - DNA, 22 bp, Homo sapiens
aacacagtgcctggcaaggcct

SEQ ID NO: 2825463 - DNA, 15 bp, Homo sapiens
aacacattacttgca

SEQ ID NO: 2825464 - DNA, 16 bp, Homo sapiens
aacacattacttgcac

SEQ ID NO: 2825465 - DNA, 21 bp, Homo sapiens
aacacattatcgggagcagtg

SEQ ID NO: 2825466 - DNA, 14 bp, Homo sapiens
aacacccggaaaga

SEQ ID NO: 2825467 - DNA, 13 bp, Homo sapiens
aacaccggcagaa

SEQ ID NO: 2825468 - DNA, 13 bp, Homo sapiens
aacacctcccagg

SEQ ID NO: 2825469 - DNA, 15 bp, Homo sapiens
aacacctgacacatc

SEQ ID NO: 2825470 - DNA, 21 bp, Homo sapiens
aacactatatggcagtgtctt

SEQ ID NO: 2825471 - DNA, 18 bp, Homo sapiens
aacactcagaagcctggg

SEQ ID NO: 2825472 - DNA, 13 bp, Homo sapiens
aacactctatatt

SEQ ID NO: 2825473 - DNA, 17 bp, Homo sapiens
aacactgcttgtgtttt

SEQ ID NO: 2825474 - DNA, 19 bp, Homo sapiens
aacactggcaacaacaaag

SEQ ID NO: 2825475 - DNA, 14 bp, Homo sapiens
aacactgtgtattt

SEQ ID NO: 2825476 - DNA, 13 bp, Homo sapiens
aacagaaacaaaa

SEQ ID NO: 2825477 - DNA, 16 bp, Homo sapiens
aacagaaacaaaaaca

SEQ ID NO: 2825478 - DNA, 16 bp, Homo sapiens
aacagacaacagaagt

SEQ ID NO: 2825479 - DNA, 18 bp, Homo sapiens
aacagacaacagaagtca

SEQ ID NO: 2825480 - DNA, 19 bp, Homo sapiens
aacagactggaagcacagc

SEQ ID NO: 2825481 - DNA, 19 bp, Homo sapiens
aacagagacaggcccaaga

SEQ ID NO: 2825482 - DNA, 21 bp, Homo sapiens
aacagaggccatggcagaata

SEQ ID NO: 2825483 - DNA, 17 bp, Homo sapiens
aacagagtatatatgta

SEQ ID NO: 2825484 - DNA, 15 bp, Homo sapiens
aacagattgtttgca

SEQ ID NO: 2825485 - DNA, 16 bp, Homo sapiens
aacagccaacaggtgg

SEQ ID NO: 2825486 - DNA, 16 bp, Homo sapiens
aacagctaatgggaca

SEQ ID NO: 2825487 - DNA, 15 bp, Homo sapiens
aacagctccctagtg

SEQ ID NO: 2825488 - DNA, 22 bp, Homo sapiens
aacagctccctagtggcttcct

SEQ ID NO: 2825489 - DNA, 14 bp, Homo sapiens
aacaggaatctcag

SEQ ID NO: 2825490 - DNA, 19 bp, Homo sapiens
aacaggaatctcagagaca

SEQ ID NO: 2825491 - DNA, 14 bp, Homo sapiens
aacaggcaagtgaa

SEQ ID NO: 2825492 - DNA, 11 bp, Homo sapiens
aacaggcagat

SEQ ID NO: 2825493 - DNA, 13 bp, Homo sapiens
aacagggaaggca

SEQ ID NO: 2825494 - DNA, 22 bp, Homo sapiens
aacagggagactgcatctcaaa

SEQ ID NO: 2825495 - DNA, 22 bp, Homo sapiens
aacaggggatcaaagttcctgt

SEQ ID NO: 2825496 - DNA, 18 bp, Homo sapiens
aacaggtctcctcttaaa

SEQ ID NO: 2825497 - DNA, 14 bp, Homo sapiens
aacaggtggagaaa

SEQ ID NO: 2825498 - DNA, 23 bp, Homo sapiens
aacaggtggcaggaccaggacta

SEQ ID NO: 2825499 - DNA, 21 bp, Homo sapiens
aacagtgagcctgaattttgt

SEQ ID NO: 2825500 - DNA, 15 bp, Homo sapiens
aacagtgtttcccat

SEQ ID NO: 2825501 - DNA, 18 bp, Homo sapiens
aacagtgtttcccataat

SEQ ID NO: 2825502 - DNA, 18 bp, Homo sapiens
aacagttaactttcagaa

SEQ ID NO: 2825503 - DNA, 14 bp, Homo sapiens
aacagttccttcag

SEQ ID NO: 2825504 - DNA, 15 bp, Homo sapiens
aacataaaatataca

SEQ ID NO: 2825505 - DNA, 16 bp, Homo sapiens
aacataatatcttgaa

SEQ ID NO: 2825506 - DNA, 17 bp, Homo sapiens
aacataattcttgtata

SEQ ID NO: 2825507 - DNA, 16 bp, Homo sapiens
aacatagacagaagaa

SEQ ID NO: 2825508 - DNA, 17 bp, Homo sapiens
aacatagatagtgcttt

SEQ ID NO: 2825509 - DNA, 18 bp, Homo sapiens
aacatataatgttgttat

SEQ ID NO: 2825510 - DNA, 21 bp, Homo sapiens
aacatataatgttgttattta

SEQ ID NO: 2825511 - DNA, 13 bp, Homo sapiens
aacatatcaattc

SEQ ID NO: 2825512 - DNA, 17 bp, Homo sapiens
aacatcactgaaatgct

SEQ ID NO: 2825513 - DNA, 23 bp, Homo sapiens
aacatcatcaggcttggaatgaa

SEQ ID NO: 2825514 - DNA, 16 bp, Homo sapiens
aacatcccattgccct

SEQ ID NO: 2825515 - DNA, 20 bp, Homo sapiens
aacatctattataaaaccat

SEQ ID NO: 2825516 - DNA, 16 bp, Homo sapiens
aacatgagaaatgtga

SEQ ID NO: 2825517 - DNA, 20 bp, Homo sapiens
aacatgcctgattttaaaag

SEQ ID NO: 2825518 - DNA, 17 bp, Homo sapiens
aacatggagaggacttt

SEQ ID NO: 2825519 - DNA, 23 bp, Homo sapiens
aacatggcaaaaccccatctcta

SEQ ID NO: 2825520 - DNA, 20 bp, Homo sapiens
aacatgtcggagtagaaatt

SEQ ID NO: 2825521 - DNA, 20 bp, Homo sapiens
aacatgttatttgtaataga

SEQ ID NO: 2825522 - DNA, 14 bp, Homo sapiens
aacattaaaagaag

SEQ ID NO: 2825523 - DNA, 18 bp, Homo sapiens
aacattaacatctattat

SEQ ID NO: 2825524 - DNA, 22 bp, Homo sapiens
aagcatctgtgtaacctccaca

SEQ ID NO: 2825525 - DNA, 17 bp, Homo sapiens
aagcatggtcccacatc

SEQ ID NO: 2825526 - DNA, 17 bp, Homo sapiens
aagcatgtctcaatagt

SEQ ID NO: 2825527 - DNA, 19 bp, Homo sapiens
aagcatgtggcatgttcat

SEQ ID NO: 2825528 - DNA, 18 bp, Homo sapiens
aagcattacatttccaaa

SEQ ID NO: 2825529 - DNA, 15 bp, Homo sapiens
aagcattcagaagaa

SEQ ID NO: 2825530 - DNA, 21 bp, Homo sapiens
aagcattcagaagaaaaagaa

SEQ ID NO: 2825531 - DNA, 13 bp, Homo sapiens
aagcattctgtct

SEQ ID NO: 2825532 - DNA, 12 bp, Homo sapiens
aagcattcttag

SEQ ID NO: 2825533 - DNA, 22 bp, Homo sapiens
aagcattcttagactagttgaa

SEQ ID NO: 2825534 - DNA, 16 bp, Homo sapiens
aagcattgaatggcta

SEQ ID NO: 2825535 - DNA, 19 bp, Homo sapiens
aagcatttgtttctacttt

SEQ ID NO: 2825536 - DNA, 18 bp, Homo sapiens
aagcattttactgtctgt

SEQ ID NO: 2825537 - DNA, 15 bp, Homo sapiens
aagccaaactctgcc

SEQ ID NO: 2825538 - DNA, 18 bp, Homo sapiens
aagccaaagctaggcctg

SEQ ID NO: 2825539 - DNA, 16 bp, Homo sapiens
aagccaacaccctgtc

SEQ ID NO: 2825540 - DNA, 17 bp, Homo sapiens
aagccaacagtcaaaac

SEQ ID NO: 2825541 - DNA, 16 bp, Homo sapiens
aagccaacgacaaagc

SEQ ID NO: 2825542 - DNA, 14 bp, Homo sapiens
aagccacagctggt

SEQ ID NO: 2825543 - DNA, 14 bp, Homo sapiens
aagccactgaagct

SEQ ID NO: 2825544 - DNA, 15 bp, Homo sapiens
aagccagctgccgac

SEQ ID NO: 2825545 - DNA, 23 bp, Homo sapiens
aagccagctgccgaccagagccc

SEQ ID NO: 2825546 - DNA, 21 bp, Homo sapiens
aagccagggtcctgagtggct

SEQ ID NO: 2825547 - DNA, 21 bp, Homo sapiens
aagcccatggagcagggatgt

SEQ ID NO: 2825548 - DNA, 9 bp, Homo sapiens
aagccctcc

SEQ ID NO: 2825549 - DNA, 14 bp, Homo sapiens
aagccctccttcca

SEQ ID NO: 2825550 - DNA, 19 bp, Homo sapiens
aagccctgtcgagacactt

SEQ ID NO: 2825551 - DNA, 19 bp, Homo sapiens
aagcctccatttagttctt

SEQ ID NO: 2825552 - DNA, 20 bp, Homo sapiens
aagcctccatttagttcttt

SEQ ID NO: 2825553 - DNA, 22 bp, Homo sapiens
aagcctccatttagttctttgt

SEQ ID NO: 2825554 - DNA, 19 bp, Homo sapiens
aagcctctgcctccctagc

SEQ ID NO: 2825555 - DNA, 15 bp, Homo sapiens
aagcctgaggctggg

SEQ ID NO: 2825556 - DNA, 19 bp, Homo sapiens
aagcctgctttttaagtgt

SEQ ID NO: 2825557 - DNA, 16 bp, Homo sapiens
aagcctgggggcctgg

SEQ ID NO: 2825558 - DNA, 21 bp, Homo sapiens
aagcctgggggcctggctggc

SEQ ID NO: 2825559 - DNA, 12 bp, Homo sapiens
aagcctgtgaat

SEQ ID NO: 2825560 - DNA, 23 bp, Homo sapiens
aagcctgtgaataaaaaccctgt

SEQ ID NO: 2825561 - DNA, 18 bp, Homo sapiens
aagcctgttcatggcaga

SEQ ID NO: 2825562 - DNA, 16 bp, Homo sapiens
aagcctttttccccaa

SEQ ID NO: 2825563 - DNA, 15 bp, Homo sapiens
aagcgaaaaaatcag

SEQ ID NO: 2825564 - DNA, 18 bp, Homo sapiens
aagcgaggtcaacagaga

SEQ ID NO: 2825565 - DNA, 21 bp, Homo sapiens
aagcgatgaatttggagactc

SEQ ID NO: 2825566 - DNA, 14 bp, Homo sapiens
aagcgattcttctg

SEQ ID NO: 2825567 - DNA, 16 bp, Homo sapiens
aagcgattcttctgct

SEQ ID NO: 2825568 - DNA, 21 bp, Homo sapiens
aagcgattcttctgcttcagc

SEQ ID NO: 2825569 - DNA, 15 bp, Homo sapiens
aagcgtgagccactg

SEQ ID NO: 2825570 - DNA, 17 bp, Homo sapiens
aagcgtgagccactgca

SEQ ID NO: 2825571 - DNA, 20 bp, Homo sapiens
aagcgtgagccactgcaccg

SEQ ID NO: 2825572 - DNA, 22 bp, Homo sapiens
aagctaacagggaaggcaggca

SEQ ID NO: 2825573 - DNA, 17 bp, Homo sapiens
aagctagaaggccacat

SEQ ID NO: 2825574 - DNA, 16 bp, Homo sapiens
aagctattgatgtttc

SEQ ID NO: 2825575 - DNA, 22 bp, Homo sapiens
aagctattgatgtttccagaaa

SEQ ID NO: 2825576 - DNA, 15 bp, Homo sapiens
aagctcacagttcct

SEQ ID NO: 2825577 - DNA, 19 bp, Homo sapiens
aagctcacagttcctcgcc

SEQ ID NO: 2825578 - DNA, 22 bp, Homo sapiens
aagctcacagttcctcgccctg

SEQ ID NO: 2825579 - DNA, 23 bp, Homo sapiens
aagctcacagttcctcgccctgg

SEQ ID NO: 2825580 - DNA, 16 bp, Homo sapiens
aagctctagtgggaag

SEQ ID NO: 2825581 - DNA, 18 bp, Homo sapiens
aagctctgaacaaaagct

SEQ ID NO: 2825582 - DNA, 16 bp, Homo sapiens
aagctctgaagtcaca

SEQ ID NO: 2825583 - DNA, 22 bp, Homo sapiens
aagctctgtttataaaaacaaa

SEQ ID NO: 2825584 - DNA, 17 bp, Homo sapiens
aagctgaggtgcccagg

SEQ ID NO: 2825585 - DNA, 13 bp, Homo sapiens
aagctgcagcttc

SEQ ID NO: 2825586 - DNA, 14 bp, Homo sapiens
aagctgcagcttcc

SEQ ID NO: 2825587 - DNA, 15 bp, Homo sapiens
aagctgcagcttcct

SEQ ID NO: 2825588 - DNA, 18 bp, Homo sapiens
aagctgcatctagaggct

SEQ ID NO: 2825589 - DNA, 14 bp, Homo sapiens
aagctgcctgtagt

SEQ ID NO: 2825590 - DNA, 13 bp, Homo sapiens
aagctgcttgact

SEQ ID NO: 2825591 - DNA, 15 bp, Homo sapiens
aagctgcttgactat

SEQ ID NO: 2825592 - DNA, 14 bp, Homo sapiens
aagctggaagcaca

SEQ ID NO: 2825593 - DNA, 15 bp, Homo sapiens
aagctggcagcactc

SEQ ID NO: 2825594 - DNA, 19 bp, Homo sapiens
aagctgggggaagggtggt

SEQ ID NO: 2825595 - DNA, 14 bp, Homo sapiens
aagcttatttaatt

SEQ ID NO: 2825596 - DNA, 18 bp, Homo sapiens
aagcttcaaactgcatga

SEQ ID NO: 2825597 - DNA, 12 bp, Homo sapiens
aagcttcaaccc

SEQ ID NO: 2825598 - DNA, 15 bp, Homo sapiens
aagcttcaaccctca

SEQ ID NO: 2825599 - DNA, 22 bp, Homo sapiens
aagcttcaaccctcagccttga

SEQ ID NO: 2825600 - DNA, 14 bp, Homo sapiens
aagcttgtatatac

SEQ ID NO: 2825601 - DNA, 16 bp, Homo sapiens
aagcttgtatatacat

SEQ ID NO: 2825602 - DNA, 15 bp, Homo sapiens
aaggaacacccggaa

SEQ ID NO: 2825603 - DNA, 20 bp, Homo sapiens
aaggaactctggcttccagg

SEQ ID NO: 2825604 - DNA, 11 bp, Homo sapiens
aaggaaggaaa

SEQ ID NO: 2825605 - DNA, 12 bp, Homo sapiens
aaggaaggaaag

SEQ ID NO: 2825606 - DNA, 13 bp, Homo sapiens
aaggaaggaaaga

SEQ ID NO: 2825607 - DNA, 16 bp, Homo sapiens
aaggaaggttttctcc

SEQ ID NO: 2825608 - DNA, 14 bp, Homo sapiens
aaggaagtctagga

SEQ ID NO: 2825609 - DNA, 21 bp, Homo sapiens
aaggaatctccagttttcagt

SEQ ID NO: 2825610 - DNA, 14 bp, Homo sapiens
aaggaatctgtgca

SEQ ID NO: 2825611 - DNA, 12 bp, Homo sapiens
aaggacacttgt

SEQ ID NO: 2825612 - DNA, 21 bp, Homo sapiens
aaggacattttctctttaaaa

SEQ ID NO: 2825613 - DNA, 22 bp, Homo sapiens
aaggacattttctctttaaaag

SEQ ID NO: 2825614 - DNA, 20 bp, Homo sapiens
aaggagaaaatgcattatgt

SEQ ID NO: 2825615 - DNA, 22 bp, Homo sapiens
aatatgacagctgtccctgtca

SEQ ID NO: 2825616 - DNA, 21 bp, Homo sapiens
aatatgcctgctatttgaagt

SEQ ID NO: 2825617 - DNA, 17 bp, Homo sapiens
aatatggactcagtttt

SEQ ID NO: 2825618 - DNA, 21 bp, Homo sapiens
aatatgttaacctcagtgtca

SEQ ID NO: 2825619 - DNA, 17 bp, Homo sapiens
aatattaaatacagaca

SEQ ID NO: 2825620 - DNA, 19 bp, Homo sapiens
aatattaaatacagacact

SEQ ID NO: 2825621 - DNA, 13 bp, Homo sapiens
aatattaccaaaa

SEQ ID NO: 2825622 - DNA, 15 bp, Homo sapiens
aatattcaataaagc

SEQ ID NO: 2825623 - DNA, 17 bp, Homo sapiens
aatatttaagtatatag

SEQ ID NO: 2825624 - DNA, 23 bp, Homo sapiens
aatatttaagtatatagtatatt

SEQ ID NO: 2825625 - DNA, 15 bp, Homo sapiens
aatatttacatatga

SEQ ID NO: 2825626 - DNA, 15 bp, Homo sapiens
aatatttatgtaaac

SEQ ID NO: 2825627 - DNA, 14 bp, Homo sapiens
aatatttattacct

SEQ ID NO: 2825628 - DNA, 18 bp, Homo sapiens
aatatttattacctctga

SEQ ID NO: 2825629 - DNA, 16 bp, Homo sapiens
aatatttgcttattta

SEQ ID NO: 2825630 - DNA, 15 bp, Homo sapiens
aatattttaaagaat

SEQ ID NO: 2825631 - DNA, 14 bp, Homo sapiens
aatcaaaaattgaa

SEQ ID NO: 2825632 - DNA, 17 bp, Homo sapiens
aatcaaaaattgaagag

SEQ ID NO: 2825633 - DNA, 15 bp, Homo sapiens
aatcaaaagctgctt

SEQ ID NO: 2825634 - DNA, 16 bp, Homo sapiens
aatcaataaaaatctt

SEQ ID NO: 2825635 - DNA, 18 bp, Homo sapiens
aatcacaagcaataatta

SEQ ID NO: 2825636 - DNA, 19 bp, Homo sapiens
aatcacaagcaataattag

SEQ ID NO: 2825637 - DNA, 17 bp, Homo sapiens
aatcacactctaagttc

SEQ ID NO: 2825638 - DNA, 14 bp, Homo sapiens
aatcacgctttttg

SEQ ID NO: 2825639 - DNA, 15 bp, Homo sapiens
aatcacgctttttga

SEQ ID NO: 2825640 - DNA, 16 bp, Homo sapiens
aatcacgctttttgaa

SEQ ID NO: 2825641 - DNA, 17 bp, Homo sapiens
aatcacgctttttgaaa

SEQ ID NO: 2825642 - DNA, 21 bp, Homo sapiens
aatcactgaggcatttttact

SEQ ID NO: 2825643 - DNA, 14 bp, Homo sapiens
aatcagaagtgcaa

SEQ ID NO: 2825644 - DNA, 15 bp, Homo sapiens
aatcagaagtgcaaa

SEQ ID NO: 2825645 - DNA, 20 bp, Homo sapiens
aatcagaccctaccccacca

SEQ ID NO: 2825646 - DNA, 16 bp, Homo sapiens
aatcagcctcttaaag

SEQ ID NO: 2825647 - DNA, 23 bp, Homo sapiens
aatcaggattttagtgcttgcca

SEQ ID NO: 2825648 - DNA, 16 bp, Homo sapiens
aatcaggtggcttttg

SEQ ID NO: 2825649 - DNA, 18 bp, Homo sapiens
aatcaggttgttaatgtt

SEQ ID NO: 2825650 - DNA, 19 bp, Homo sapiens
aatcaggttgttaatgttg

SEQ ID NO: 2825651 - DNA, 15 bp, Homo sapiens
aatcataattttcaa

SEQ ID NO: 2825652 - DNA, 22 bp, Homo sapiens
aatcatgatctgactttaattg

SEQ ID NO: 2825653 - DNA, 14 bp, Homo sapiens
aatcatgtacattt

SEQ ID NO: 2825654 - DNA, 18 bp, Homo sapiens
aatcattcaatatctgac

SEQ ID NO: 2825655 - DNA, 15 bp, Homo sapiens
aatcattttaattat

SEQ ID NO: 2825656 - DNA, 16 bp, Homo sapiens
aatcattttaattatt

SEQ ID NO: 2825657 - DNA, 19 bp, Homo sapiens
aatcattttaattattatt

SEQ ID NO: 2825658 - DNA, 13 bp, Homo sapiens
aatcattttgcaa

SEQ ID NO: 2825659 - DNA, 11 bp, Homo sapiens
aatccaaagat

SEQ ID NO: 2825660 - DNA, 13 bp, Homo sapiens
aatccagaaagaa

SEQ ID NO: 2825661 - DNA, 17 bp, Homo sapiens
aatccagacccggctgc

SEQ ID NO: 2825662 - DNA, 17 bp, Homo sapiens
aatccatgttagttttt

SEQ ID NO: 2825663 - DNA, 22 bp, Homo sapiens
aatccatgttagtttttacttt

SEQ ID NO: 2825664 - DNA, 18 bp, Homo sapiens
aatcccacccacatgtga

SEQ ID NO: 2825665 - DNA, 13 bp, Homo sapiens
aatcccagctact

SEQ ID NO: 2825666 - DNA, 20 bp, Homo sapiens
aatcccattcataactttca

SEQ ID NO: 2825667 - DNA, 19 bp, Homo sapiens
aatcccctcattcaggaaa

SEQ ID NO: 2825668 - DNA, 23 bp, Homo sapiens
aatcccttgtacctatggctgcc

SEQ ID NO: 2825669 - DNA, 24 bp, Homo sapiens
aatcctattaaaacacagctttac

SEQ ID NO: 2825670 - DNA, 22 bp, Homo sapiens
aatcctgtatattatggtgtaa

SEQ ID NO: 2825671 - DNA, 20 bp, Homo sapiens
aatcctgtcgattagactgg

SEQ ID NO: 2825672 - DNA, 21 bp, Homo sapiens
aatcctgtcgattagactgga

SEQ ID NO: 2825673 - DNA, 16 bp, Homo sapiens
aatcctgttacttaaa

SEQ ID NO: 2825674 - DNA, 17 bp, Homo sapiens
aatccttgcttatgaca

SEQ ID NO: 2825675 - DNA, 13 bp, Homo sapiens
aatcctttactgt

SEQ ID NO: 2825676 - DNA, 20 bp, Homo sapiens
aatcctttttctttataaac

SEQ ID NO: 2825677 - DNA, 14 bp, Homo sapiens
aatcgagtctacct

SEQ ID NO: 2825678 - DNA, 14 bp, Homo sapiens
aatcgatctgtact

SEQ ID NO: 2825679 - DNA, 17 bp, Homo sapiens
aatcgatctgtactgta

SEQ ID NO: 2825680 - DNA, 21 bp, Homo sapiens
aatcggatctggggctctggg

SEQ ID NO: 2825681 - DNA, 22 bp, Homo sapiens
aatcggcccacagctcccaccc

SEQ ID NO: 2825682 - DNA, 15 bp, Homo sapiens
aatcgttatgtgtgt

SEQ ID NO: 2825683 - DNA, 18 bp, Homo sapiens
aatcgttatgtgtgtata

SEQ ID NO: 2825684 - DNA, 15 bp, Homo sapiens
aatctatctatataa

SEQ ID NO: 2825685 - DNA, 20 bp, Homo sapiens
aatctcaaattctcaaccta

SEQ ID NO: 2825686 - DNA, 17 bp, Homo sapiens
aatctcatctcagtgaa

SEQ ID NO: 2825687 - DNA, 11 bp, Homo sapiens
aatctccaggg

SEQ ID NO: 2825688 - DNA, 13 bp, Homo sapiens
aatctctgtgact

SEQ ID NO: 2825689 - DNA, 23 bp, Homo sapiens
aatctgacactaccttatcaggc

SEQ ID NO: 2825690 - DNA, 19 bp, Homo sapiens
aatcttaggggagagcttt

SEQ ID NO: 2825691 - DNA, 20 bp, Homo sapiens
aatcttcagttttatcttta

SEQ ID NO: 2825692 - DNA, 22 bp, Homo sapiens
aatcttcagttttatctttaat

SEQ ID NO: 2825693 - DNA, 22 bp, Homo sapiens
aatctttctttacctgagacca

SEQ ID NO: 2825694 - DNA, 15 bp, Homo sapiens
aatctttgattcaga

SEQ ID NO: 2825695 - DNA, 12 bp, Homo sapiens
aatgaaaatgtc

SEQ ID NO: 2825696 - DNA, 13 bp, Homo sapiens
aatgaaaatgtca

SEQ ID NO: 2825697 - DNA, 20 bp, Homo sapiens
aatgaaacaaataatcacat

SEQ ID NO: 2825698 - DNA, 13 bp, Homo sapiens
aatgaaatatttg

SEQ ID NO: 2825699 - DNA, 17 bp, Homo sapiens
aatgaaatgctctcctt

SEQ ID NO: 2825700 - DNA, 12 bp, Homo sapiens
aatgaacagaac

SEQ ID NO: 2825701 - DNA, 22 bp, Homo sapiens
aatgaacagaacatagacagaa

SEQ ID NO: 2825702 - DNA, 17 bp, Homo sapiens
aatgaaccacatcttgc

SEQ ID NO: 2825703 - DNA, 23 bp, Homo sapiens
aatgaaccacatcttgctctgct

SEQ ID NO: 2825704 - DNA, 14 bp, Homo sapiens
aatgaactgtgaca

SEQ ID NO: 2825705 - DNA, 19 bp, Homo sapiens
aatgaactgtgacaggaag

SEQ ID NO: 2825706 - DNA, 13 bp, Homo sapiens
acaaaggagcctg

SEQ ID NO: 2825707 - DNA, 17 bp, Homo sapiens
acaaagtagagaagtat

SEQ ID NO: 2825708 - DNA, 16 bp, Homo sapiens
acaaatatatttaatt

SEQ ID NO: 2825709 - DNA, 19 bp, Homo sapiens
acaaatatatttaattgtg

SEQ ID NO: 2825710 - DNA, 14 bp, Homo sapiens
acaaatggccttta

SEQ ID NO: 2825711 - DNA, 13 bp, Homo sapiens
acaaatgtatgat

SEQ ID NO: 2825712 - DNA, 20 bp, Homo sapiens
acaaattaggttttgtacaa

SEQ ID NO: 2825713 - DNA, 22 bp, Homo sapiens
acaaattatgttacatctgttt

SEQ ID NO: 2825714 - DNA, 22 bp, Homo sapiens
acaaattcaaggagatataaaa

SEQ ID NO: 2825715 - DNA, 19 bp, Homo sapiens
acaaatttaattttgcaga

SEQ ID NO: 2825716 - DNA, 13 bp, Homo sapiens
acaacagaagtca

SEQ ID NO: 2825717 - DNA, 20 bp, Homo sapiens
acaacatttctatagccaaa

SEQ ID NO: 2825718 - DNA, 22 bp, Homo sapiens
acaacatttctatagccaaaaa

SEQ ID NO: 2825719 - DNA, 13 bp, Homo sapiens
acaaccagagccc

SEQ ID NO: 2825720 - DNA, 11 bp, Homo sapiens
acaacccagaa

SEQ ID NO: 2825721 - DNA, 18 bp, Homo sapiens
acaaccctgttttatact

SEQ ID NO: 2825722 - DNA, 14 bp, Homo sapiens
acaacctttgtgta

SEQ ID NO: 2825723 - DNA, 17 bp, Homo sapiens
acaactaatcaagagtg

SEQ ID NO: 2825724 - DNA, 19 bp, Homo sapiens
acaactaggcttcagcata

SEQ ID NO: 2825725 - DNA, 17 bp, Homo sapiens
acaacttcaagtgcatg

SEQ ID NO: 2825726 - DNA, 15 bp, Homo sapiens
acaagaagcattttg

SEQ ID NO: 2825727 - DNA, 23 bp, Homo sapiens
acaagagccatgtaccagtgtac

SEQ ID NO: 2825728 - DNA, 20 bp, Homo sapiens
acaagagcccagcagggcct

SEQ ID NO: 2825729 - DNA, 14 bp, Homo sapiens
acaagatctttcag

SEQ ID NO: 2825730 - DNA, 15 bp, Homo sapiens
acaagattcccagag

SEQ ID NO: 2825731 - DNA, 16 bp, Homo sapiens
acaagattcccagaga

SEQ ID NO: 2825732 - DNA, 22 bp, Homo sapiens
acaagcaacataaaacaatgaa

SEQ ID NO: 2825733 - DNA, 13 bp, Homo sapiens
acaagcaataatt

SEQ ID NO: 2825734 - DNA, 15 bp, Homo sapiens
acaagcaataattag

SEQ ID NO: 2825735 - DNA, 19 bp, Homo sapiens
acaagcacagttttaagag

SEQ ID NO: 2825736 - DNA, 21 bp, Homo sapiens
acaagcattctgtcttgaagg

SEQ ID NO: 2825737 - DNA, 20 bp, Homo sapiens
acaagcatttcccccaggga

SEQ ID NO: 2825738 - DNA, 18 bp, Homo sapiens
acaagccacagaagccag

SEQ ID NO: 2825739 - DNA, 12 bp, Homo sapiens
acaagccacccc

SEQ ID NO: 2825740 - DNA, 20 bp, Homo sapiens
acaagcgtgagccactgcac

SEQ ID NO: 2825741 - DNA, 19 bp, Homo sapiens
acaagcttgtatatacata

SEQ ID NO: 2825742 - DNA, 17 bp, Homo sapiens
acaaggattgctactgt

SEQ ID NO: 2825743 - DNA, 15 bp, Homo sapiens
acaaggcagcaaggc

SEQ ID NO: 2825744 - DNA, 16 bp, Homo sapiens
acaaggcagcaaggcc

SEQ ID NO: 2825745 - DNA, 18 bp, Homo sapiens
acaaggcagcaaggcccg

SEQ ID NO: 2825746 - DNA, 21 bp, Homo sapiens
acaaggcagcaaggcccgagc

SEQ ID NO: 2825747 - DNA, 13 bp, Homo sapiens
acaaggctgacca

SEQ ID NO: 2825748 - DNA, 19 bp, Homo sapiens
acaagggtctagggagaga

SEQ ID NO: 2825749 - DNA, 20 bp, Homo sapiens
acaagggtctagggagagac

SEQ ID NO: 2825750 - DNA, 21 bp, Homo sapiens
acaaggtacccctttctggct

SEQ ID NO: 2825751 - DNA, 16 bp, Homo sapiens
acaaggtagtttttac

SEQ ID NO: 2825752 - DNA, 19 bp, Homo sapiens
acaaggttccctctgagaa

SEQ ID NO: 2825753 - DNA, 18 bp, Homo sapiens
acaaggttcttctaaaat

SEQ ID NO: 2825754 - DNA, 16 bp, Homo sapiens
acaagttatttaaatc

SEQ ID NO: 2825755 - DNA, 13 bp, Homo sapiens
acaataaatattc

SEQ ID NO: 2825756 - DNA, 16 bp, Homo sapiens
acaataaatattctgc

SEQ ID NO: 2825757 - DNA, 15 bp, Homo sapiens
acaatagctattgca

SEQ ID NO: 2825758 - DNA, 18 bp, Homo sapiens
acaatatttaaaatttat

SEQ ID NO: 2825759 - DNA, 21 bp, Homo sapiens
acaatgaaggaaaacctcact

SEQ ID NO: 2825760 - DNA, 23 bp, Homo sapiens
acaatgaaggaaaacctcacttg

SEQ ID NO: 2825761 - DNA, 22 bp, Homo sapiens
acaatgatgattaaacacctga

SEQ ID NO: 2825762 - DNA, 14 bp, Homo sapiens
acaatgcagaattt

SEQ ID NO: 2825763 - DNA, 14 bp, Homo sapiens
acaatgtcacataa

SEQ ID NO: 2825764 - DNA, 17 bp, Homo sapiens
acaatgtttaaaccttt

SEQ ID NO: 2825765 - DNA, 20 bp, Homo sapiens
acaattcacttcattgacca

SEQ ID NO: 2825766 - DNA, 12 bp, Homo sapiens
acaattctaaaa

SEQ ID NO: 2825767 - DNA, 17 bp, Homo sapiens
acaattctaaaatgatt

SEQ ID NO: 2825768 - DNA, 24 bp, Homo sapiens
acaattctaaaatgattgtagtaa

SEQ ID NO: 2825769 - DNA, 14 bp, Homo sapiens
acaatttaaagcaa

SEQ ID NO: 2825770 - DNA, 23 bp, Homo sapiens
acaatttagaaaacattcatcca

SEQ ID NO: 2825771 - DNA, 15 bp, Homo sapiens
acaatttgcactgtt

SEQ ID NO: 2825772 - DNA, 13 bp, Homo sapiens
acacaagccacag

SEQ ID NO: 2825773 - DNA, 14 bp, Homo sapiens
acacaagccacaga

SEQ ID NO: 2825774 - DNA, 15 bp, Homo sapiens
acacaagccacagaa

SEQ ID NO: 2825775 - DNA, 14 bp, Homo sapiens
acacaagtaaacat

SEQ ID NO: 2825776 - DNA, 12 bp, Homo sapiens
acacacagctct

SEQ ID NO: 2825777 - DNA, 14 bp, Homo sapiens
acacacagctctgt

SEQ ID NO: 2825778 - DNA, 18 bp, Homo sapiens
acacacaggccatttcat

SEQ ID NO: 2825779 - DNA, 11 bp, Homo sapiens
acacacccctc

SEQ ID NO: 2825780 - DNA, 20 bp, Homo sapiens
acacacgcaggaactcccag

SEQ ID NO: 2825781 - DNA, 18 bp, Homo sapiens
acacagactacagccaga

SEQ ID NO: 2825782 - DNA, 13 bp, Homo sapiens
acacagaggaaga

SEQ ID NO: 2825783 - DNA, 20 bp, Homo sapiens
acacagaggttttaaacagt

SEQ ID NO: 2825784 - DNA, 21 bp, Homo sapiens
acacagaggttttaaacagtc

SEQ ID NO: 2825785 - DNA, 21 bp, Homo sapiens
acacagcagtatgaatgatgt

SEQ ID NO: 2825786 - DNA, 22 bp, Homo sapiens
acacagcctgggaccagggcat

SEQ ID NO: 2825787 - DNA, 11 bp, Homo sapiens
acacagctctt

SEQ ID NO: 2825788 - DNA, 22 bp, Homo sapiens
acacagctcttctccaggctgt

SEQ ID NO: 2825789 - DNA, 24 bp, Homo sapiens
acacaggatcctattctcaccagg

SEQ ID NO: 2825790 - DNA, 21 bp, Homo sapiens
acacaggcaactgaggcagac

SEQ ID NO: 2825791 - DNA, 16 bp, Homo sapiens
acacaggcatttcctg

SEQ ID NO: 2825792 - DNA, 21 bp, Homo sapiens
acacaggcccggctccaggct

SEQ ID NO: 2825793 - DNA, 12 bp, Homo sapiens
acacaggcctgt

SEQ ID NO: 2825794 - DNA, 17 bp, Homo sapiens
acacaggtacagcaaca

SEQ ID NO: 2825795 - DNA, 20 bp, Homo sapiens
acacaggtacagcaacagga

SEQ ID NO: 2825796 - DNA, 24 bp, Homo sapiens
acacagtaaaaacttgtactatgt

SEQ ID NO: 2825797 - DNA, 13 bp, Homo sapiens
acatgaaacagaa

SEQ ID NO: 2825798 - DNA, 15 bp, Homo sapiens
acatgaaacagaaac

SEQ ID NO: 2825799 - DNA, 16 bp, Homo sapiens
acatgaagaagctaaa

SEQ ID NO: 2825800 - DNA, 18 bp, Homo sapiens
acatgaattgcattttac

SEQ ID NO: 2825801 - DNA, 13 bp, Homo sapiens
acatgagaaatgt

SEQ ID NO: 2825802 - DNA, 19 bp, Homo sapiens
acatgcacatttatatata

SEQ ID NO: 2825803 - DNA, 20 bp, Homo sapiens
acatgcattactgcatgcac

SEQ ID NO: 2825804 - DNA, 18 bp, Homo sapiens
acatgctaagagaagtag

SEQ ID NO: 2825805 - DNA, 16 bp, Homo sapiens
acatggagactcctgc

SEQ ID NO: 2825806 - DNA, 16 bp, Homo sapiens
acatggggttttcaat

SEQ ID NO: 2825807 - DNA, 13 bp, Homo sapiens
acatggtattgta

SEQ ID NO: 2825808 - DNA, 21 bp, Homo sapiens
acatggtattgtaatgaatat

SEQ ID NO: 2825809 - DNA, 19 bp, Homo sapiens
acatgtataatatttttaa

SEQ ID NO: 2825810 - DNA, 20 bp, Homo sapiens
acatgtataatatttttaat

SEQ ID NO: 2825811 - DNA, 18 bp, Homo sapiens
acatgtatctatgcattt

SEQ ID NO: 2825812 - DNA, 16 bp, Homo sapiens
acatgtcttgtacatg

SEQ ID NO: 2825813 - DNA, 22 bp, Homo sapiens
acatgtcttgtacatgtgtagc

SEQ ID NO: 2825814 - DNA, 21 bp, Homo sapiens
acatgtgacacatatgcacct

SEQ ID NO: 2825815 - DNA, 17 bp, Homo sapiens
acatgtgtagcctgtgc

SEQ ID NO: 2825816 - DNA, 18 bp, Homo sapiens
acattaaaagaagactgg

SEQ ID NO: 2825817 - DNA, 16 bp, Homo sapiens
acattaaacactgtaa

SEQ ID NO: 2825818 - DNA, 18 bp, Homo sapiens
acattaaacactgtaatc

SEQ ID NO: 2825819 - DNA, 21 bp, Homo sapiens
acattaaacactgtaatctta

SEQ ID NO: 2825820 - DNA, 15 bp, Homo sapiens
acattaacatctatt

SEQ ID NO: 2825821 - DNA, 16 bp, Homo sapiens
acattaattctactaa

SEQ ID NO: 2825822 - DNA, 19 bp, Homo sapiens
acattacttgcacaagctt

SEQ ID NO: 2825823 - DNA, 12 bp, Homo sapiens
acattgaaagag

SEQ ID NO: 2825824 - DNA, 21 bp, Homo sapiens
acattgcggacagccacggcc

SEQ ID NO: 2825825 - DNA, 12 bp, Homo sapiens
acattgtctgcg

SEQ ID NO: 2825826 - DNA, 16 bp, Homo sapiens
acatttacaataaata

SEQ ID NO: 2825827 - DNA, 19 bp, Homo sapiens
acatttatatatatatgta

SEQ ID NO: 2825828 - DNA, 15 bp, Homo sapiens
acatttatctaaaag

SEQ ID NO: 2825829 - DNA, 12 bp, Homo sapiens
acatttgtacat

SEQ ID NO: 2825830 - DNA, 16 bp, Homo sapiens
acatttgtacattcct

SEQ ID NO: 2825831 - DNA, 23 bp, Homo sapiens
acattttatttattagctgtaaa

SEQ ID NO: 2825832 - DNA, 17 bp, Homo sapiens
acattttctctttaaaa

SEQ ID NO: 2825833 - DNA, 20 bp, Homo sapiens
acattttgtacaaagatatg

SEQ ID NO: 2825834 - DNA, 21 bp, Homo sapiens
accaaaaaggctagtttattt

SEQ ID NO: 2825835 - DNA, 13 bp, Homo sapiens
accaaaagaagta

SEQ ID NO: 2825836 - DNA, 21 bp, Homo sapiens
accaaaagttacatgtttgca

SEQ ID NO: 2825837 - DNA, 17 bp, Homo sapiens
accaaagagactggagc

SEQ ID NO: 2825838 - DNA, 22 bp, Homo sapiens
accaaagagactggagcatctg

SEQ ID NO: 2825839 - DNA, 15 bp, Homo sapiens
accaacacccctccc

SEQ ID NO: 2825840 - DNA, 16 bp, Homo sapiens
accaacagttccttca

SEQ ID NO: 2825841 - DNA, 24 bp, Homo sapiens
accaacatggagaaaccctgtctc

SEQ ID NO: 2825842 - DNA, 14 bp, Homo sapiens
accaacctccccgc

SEQ ID NO: 2825843 - DNA, 15 bp, Homo sapiens
accaacctccccgca

SEQ ID NO: 2825844 - DNA, 13 bp, Homo sapiens
accaacctgacca

SEQ ID NO: 2825845 - DNA, 16 bp, Homo sapiens
accaagactctgaaat

SEQ ID NO: 2825846 - DNA, 13 bp, Homo sapiens
accaagagagaaa

SEQ ID NO: 2825847 - DNA, 15 bp, Homo sapiens
accaagagagaaaga

SEQ ID NO: 2825848 - DNA, 14 bp, Homo sapiens
accaagagtattcc

SEQ ID NO: 2825849 - DNA, 15 bp, Homo sapiens
accaagatacttaag

SEQ ID NO: 2825850 - DNA, 20 bp, Homo sapiens
accaagatacttaagtgctg

SEQ ID NO: 2825851 - DNA, 14 bp, Homo sapiens
accaagatgatcac

SEQ ID NO: 2825852 - DNA, 19 bp, Homo sapiens
accaaggtcttcagccatc

SEQ ID NO: 2825853 - DNA, 23 bp, Homo sapiens
accaagttataaatcaatgtcac

SEQ ID NO: 2825854 - DNA, 12 bp, Homo sapiens
accaataacttc

SEQ ID NO: 2825855 - DNA, 13 bp, Homo sapiens
accaatatttgta

SEQ ID NO: 2825856 - DNA, 22 bp, Homo sapiens
accaatcccgtgaaagaattat

SEQ ID NO: 2825857 - DNA, 23 bp, Homo sapiens
accaatcccgtgaaagaattatt

SEQ ID NO: 2825858 - DNA, 13 bp, Homo sapiens
accaatctctgtg

SEQ ID NO: 2825859 - DNA, 16 bp, Homo sapiens
accaatctctgtgact

SEQ ID NO: 2825860 - DNA, 21 bp, Homo sapiens
accaatgattcataacaatgt

SEQ ID NO: 2825861 - DNA, 14 bp, Homo sapiens
accaatgtacccac

SEQ ID NO: 2825862 - DNA, 16 bp, Homo sapiens
accaatgttgtgatta

SEQ ID NO: 2825863 - DNA, 15 bp, Homo sapiens
accacaccaaacctc

SEQ ID NO: 2825864 - DNA, 23 bp, Homo sapiens
accacacccagcccacttctgcc

SEQ ID NO: 2825865 - DNA, 16 bp, Homo sapiens
accacacctccctgaa

SEQ ID NO: 2825866 - DNA, 18 bp, Homo sapiens
accacatcttgctctgct

SEQ ID NO: 2825867 - DNA, 18 bp, Homo sapiens
accacatgtgcacatgca

SEQ ID NO: 2825868 - DNA, 15 bp, Homo sapiens
accaccacacccagc

SEQ ID NO: 2825869 - DNA, 17 bp, Homo sapiens
accaccagccccagcaa

SEQ ID NO: 2825870 - DNA, 15 bp, Homo sapiens
accaccccttcctgt

SEQ ID NO: 2825871 - DNA, 18 bp, Homo sapiens
accacctaatcaggctga

SEQ ID NO: 2825872 - DNA, 17 bp, Homo sapiens
accacctaggccactcc

SEQ ID NO: 2825873 - DNA, 20 bp, Homo sapiens
accacctaggccactcctcc

SEQ ID NO: 2825874 - DNA, 15 bp, Homo sapiens
accacctctcaatat

SEQ ID NO: 2825875 - DNA, 20 bp, Homo sapiens
accacctgcttctgaactca

SEQ ID NO: 2825876 - DNA, 15 bp, Homo sapiens
accaccttcccagct

SEQ ID NO: 2825877 - DNA, 19 bp, Homo sapiens
accacgatgtggccctggc

SEQ ID NO: 2825878 - DNA, 21 bp, Homo sapiens
accacgatgtggccctggcct

SEQ ID NO: 2825879 - DNA, 15 bp, Homo sapiens
accactctggcagcc

SEQ ID NO: 2825880 - DNA, 18 bp, Homo sapiens
accactgaacatttgctt

SEQ ID NO: 2825881 - DNA, 13 bp, Homo sapiens
accacttcattct

SEQ ID NO: 2825882 - DNA, 15 bp, Homo sapiens
accacttcttttata

SEQ ID NO: 2825883 - DNA, 22 bp, Homo sapiens
accagacaccttgacagggcac

SEQ ID NO: 2825884 - DNA, 10 bp, Homo sapiens
accagagccc

SEQ ID NO: 2825885 - DNA, 14 bp, Homo sapiens
accagagcccatgc

SEQ ID NO: 2825886 - DNA, 16 bp, Homo sapiens
accagagcccatgctc

SEQ ID NO: 2825887 - DNA, 11 bp, Homo sapiens
accagagcccc

SEQ ID NO: 2825888 - DNA, 21 bp, Homo sapiens
accctggagcggctctcctga

SEQ ID NO: 2825889 - DNA, 19 bp, Homo sapiens
accctggtaggaaagcacc

SEQ ID NO: 2825890 - DNA, 11 bp, Homo sapiens
accctgtctct

SEQ ID NO: 2825891 - DNA, 18 bp, Homo sapiens
accctgtgggggcggctg

SEQ ID NO: 2825892 - DNA, 17 bp, Homo sapiens
accctgttaccattttg

SEQ ID NO: 2825893 - DNA, 14 bp, Homo sapiens
accctgtttcctga

SEQ ID NO: 2825894 - DNA, 15 bp, Homo sapiens
accctgtttcctgag

SEQ ID NO: 2825895 - DNA, 18 bp, Homo sapiens
acccttcgggagggcact

SEQ ID NO: 2825896 - DNA, 14 bp, Homo sapiens
acccttctttcctc

SEQ ID NO: 2825897 - DNA, 15 bp, Homo sapiens
acccttctttcctct

SEQ ID NO: 2825898 - DNA, 20 bp, Homo sapiens
acccttctttcctcttcccc

SEQ ID NO: 2825899 - DNA, 16 bp, Homo sapiens
acccttgcattagaaa

SEQ ID NO: 2825900 - DNA, 17 bp, Homo sapiens
acccttggctcaatcct

SEQ ID NO: 2825901 - DNA, 15 bp, Homo sapiens
accctttccttcctt

SEQ ID NO: 2825902 - DNA, 17 bp, Homo sapiens
accctttccttccttcc

SEQ ID NO: 2825903 - DNA, 19 bp, Homo sapiens
accctttccttccttccct

SEQ ID NO: 2825904 - DNA, 22 bp, Homo sapiens
accgaattttattttacagagc

SEQ ID NO: 2825905 - DNA, 23 bp, Homo sapiens
accgagagtagccgagagcctgc

SEQ ID NO: 2825906 - DNA, 13 bp, Homo sapiens
accgatgccagcc

SEQ ID NO: 2825907 - DNA, 19 bp, Homo sapiens
accgctacaccactctggc

SEQ ID NO: 2825908 - DNA, 20 bp, Homo sapiens
accgctgcctaagtggctgc

SEQ ID NO: 2825909 - DNA, 21 bp, Homo sapiens
accgctgcctaagtggctgct

SEQ ID NO: 2825910 - DNA, 12 bp, Homo sapiens
accgggcactca

SEQ ID NO: 2825911 - DNA, 20 bp, Homo sapiens
accgggccacagagaaagta

SEQ ID NO: 2825912 - DNA, 19 bp, Homo sapiens
accgggccactccttcctg

SEQ ID NO: 2825913 - DNA, 13 bp, Homo sapiens
accggtacagaaa

SEQ ID NO: 2825914 - DNA, 13 bp, Homo sapiens
accgtaattttat

SEQ ID NO: 2825915 - DNA, 14 bp, Homo sapiens
accgtaattttatt

SEQ ID NO: 2825916 - DNA, 16 bp, Homo sapiens
accgtctacagatggc

SEQ ID NO: 2825917 - DNA, 17 bp, Homo sapiens
accgtggaccttcctgc

SEQ ID NO: 2825918 - DNA, 12 bp, Homo sapiens
accgtttttcaa

SEQ ID NO: 2825919 - DNA, 13 bp, Homo sapiens
accgtttttcaag

SEQ ID NO: 2825920 - DNA, 14 bp, Homo sapiens
accgtttttcaaga

SEQ ID NO: 2825921 - DNA, 17 bp, Homo sapiens
acctaaagaaaaacaaa

SEQ ID NO: 2825922 - DNA, 21 bp, Homo sapiens
acctacataggcaaattggaa

SEQ ID NO: 2825923 - DNA, 17 bp, Homo sapiens
acctacatccccaggtc

SEQ ID NO: 2825924 - DNA, 14 bp, Homo sapiens
acctaccaaaaaat

SEQ ID NO: 2825925 - DNA, 19 bp, Homo sapiens
acctaccaccccttcctgt

SEQ ID NO: 2825926 - DNA, 18 bp, Homo sapiens
acctatacctgtgtttct

SEQ ID NO: 2825927 - DNA, 12 bp, Homo sapiens
acctatgtcatt

SEQ ID NO: 2825928 - DNA, 15 bp, Homo sapiens
acctatgtcatttca

SEQ ID NO: 2825929 - DNA, 16 bp, Homo sapiens
acctatgtcatttcat

SEQ ID NO: 2825930 - DNA, 19 bp, Homo sapiens
acctatgtcatttcatttc

SEQ ID NO: 2825931 - DNA, 19 bp, Homo sapiens
acctatgtcctaaggacac

SEQ ID NO: 2825932 - DNA, 23 bp, Homo sapiens
acctatgtcctaaggacacacta

SEQ ID NO: 2825933 - DNA, 14 bp, Homo sapiens
acctatttgacata

SEQ ID NO: 2825934 - DNA, 21 bp, Homo sapiens
acctcaacccccatttctatt

SEQ ID NO: 2825935 - DNA, 22 bp, Homo sapiens
acctcaacccccatttctattt

SEQ ID NO: 2825936 - DNA, 14 bp, Homo sapiens
acctcaagctgcat

SEQ ID NO: 2825937 - DNA, 19 bp, Homo sapiens
acctcacccgaggctgccc

SEQ ID NO: 2825938 - DNA, 21 bp, Homo sapiens
acctcactggggtcctggggc

SEQ ID NO: 2825939 - DNA, 23 bp, Homo sapiens
acctcactggggtcctggggcct

SEQ ID NO: 2825940 - DNA, 13 bp, Homo sapiens
acctcagcctaga

SEQ ID NO: 2825941 - DNA, 17 bp, Homo sapiens
acctcagcctgtgctgc

SEQ ID NO: 2825942 - DNA, 20 bp, Homo sapiens
acctcaggccaggtgcagtg

SEQ ID NO: 2825943 - DNA, 18 bp, Homo sapiens
acctcaggcttccttggc

SEQ ID NO: 2825944 - DNA, 21 bp, Homo sapiens
acctcagtaatttagaaatca

SEQ ID NO: 2825945 - DNA, 16 bp, Homo sapiens
acctcagtgtcattta

SEQ ID NO: 2825946 - DNA, 19 bp, Homo sapiens
acctcagtgtcatttatga

SEQ ID NO: 2825947 - DNA, 21 bp, Homo sapiens
acctcagtgtcatttatgaaa

SEQ ID NO: 2825948 - DNA, 14 bp, Homo sapiens
acctcatgacagcc

SEQ ID NO: 2825949 - DNA, 18 bp, Homo sapiens
acctcatgacagccagag

SEQ ID NO: 2825950 - DNA, 21 bp, Homo sapiens
acctcatgacagccagagcct

SEQ ID NO: 2825951 - DNA, 18 bp, Homo sapiens
acctcatgcctggccccc

SEQ ID NO: 2825952 - DNA, 16 bp, Homo sapiens
acctccagctttcctg

SEQ ID NO: 2825953 - DNA, 13 bp, Homo sapiens
acctcccagccct

SEQ ID NO: 2825954 - DNA, 22 bp, Homo sapiens
acctcccagccctatggatgtg

SEQ ID NO: 2825955 - DNA, 14 bp, Homo sapiens
acctccccccactg

SEQ ID NO: 2825956 - DNA, 18 bp, Homo sapiens
acctccccccactgcagg

SEQ ID NO: 2825957 - DNA, 23 bp, Homo sapiens
acctcccctatccacccagccca

SEQ ID NO: 2825958 - DNA, 19 bp, Homo sapiens
acctccgccccagacacac

SEQ ID NO: 2825959 - DNA, 20 bp, Homo sapiens
acctccgcctcttgggttca

SEQ ID NO: 2825960 - DNA, 23 bp, Homo sapiens
acctcctacgtcaaacatgaagt

SEQ ID NO: 2825961 - DNA, 14 bp, Homo sapiens
acctcctattttaa

SEQ ID NO: 2825962 - DNA, 16 bp, Homo sapiens
acctcctcctgccctc

SEQ ID NO: 2825963 - DNA, 21 bp, Homo sapiens
acctcctgcccaggagagcca

SEQ ID NO: 2825964 - DNA, 13 bp, Homo sapiens
acctcctgggcta

SEQ ID NO: 2825965 - DNA, 20 bp, Homo sapiens
acctcgtcctccccctgcca

SEQ ID NO: 2825966 - DNA, 22 bp, Homo sapiens
acctctatatgttgctgaaaca

SEQ ID NO: 2825967 - DNA, 12 bp, Homo sapiens
acctctcaatat

SEQ ID NO: 2825968 - DNA, 21 bp, Homo sapiens
acctctcaatattcaataaag

SEQ ID NO: 2825969 - DNA, 17 bp, Homo sapiens
acctctcccctggaact

SEQ ID NO: 2825970 - DNA, 21 bp, Homo sapiens
acctctcccctggaactgtct

SEQ ID NO: 2825971 - DNA, 20 bp, Homo sapiens
acctctcctttggccattcc

SEQ ID NO: 2825972 - DNA, 17 bp, Homo sapiens
acctctctctatatata

SEQ ID NO: 2825973 - DNA, 14 bp, Homo sapiens
acctctctttttca

SEQ ID NO: 2825974 - DNA, 14 bp, Homo sapiens
acctctgatccctc

SEQ ID NO: 2825975 - DNA, 12 bp, Homo sapiens
acctctgcctca

SEQ ID NO: 2825976 - DNA, 15 bp, Homo sapiens
acctctgcctcaatg

SEQ ID NO: 2825977 - DNA, 23 bp, Homo sapiens
acctctgcctgaagtcacacagt

SEQ ID NO: 2825978 - DNA, 12 bp, Homo sapiens
acctctgctctg

SEQ ID NO: 2825979 - DNA, 15 bp, Homo sapiens
actgctctcagcctc

SEQ ID NO: 2825980 - DNA, 17 bp, Homo sapiens
actgctctcagcctccc

SEQ ID NO: 2825981 - DNA, 13 bp, Homo sapiens
actgctgcaaagt

SEQ ID NO: 2825982 - DNA, 20 bp, Homo sapiens
actgctgcaaagtgcaaata

SEQ ID NO: 2825983 - DNA, 13 bp, Homo sapiens
actgctgggactg

SEQ ID NO: 2825984 - DNA, 16 bp, Homo sapiens
actgctggggagtccc

SEQ ID NO: 2825985 - DNA, 22 bp, Homo sapiens
actgctgtaaataaatgcttta

SEQ ID NO: 2825986 - DNA, 18 bp, Homo sapiens
actgctgtcattgtccat

SEQ ID NO: 2825987 - DNA, 22 bp, Homo sapiens
actgctgtcattgtccatgcct

SEQ ID NO: 2825988 - DNA, 14 bp, Homo sapiens
actgcttttggtct

SEQ ID NO: 2825989 - DNA, 15 bp, Homo sapiens
actgcttttggtctg

SEQ ID NO: 2825990 - DNA, 16 bp, Homo sapiens
actggaagcacagctt

SEQ ID NO: 2825991 - DNA, 21 bp, Homo sapiens
actggaagcatgtaggagaat

SEQ ID NO: 2825992 - DNA, 16 bp, Homo sapiens
actggaagttttgcat

SEQ ID NO: 2825993 - DNA, 17 bp, Homo sapiens
actggaagttttgcatt

SEQ ID NO: 2825994 - DNA, 23 bp, Homo sapiens
actggaataagaagcaaataaat

SEQ ID NO: 2825995 - DNA, 17 bp, Homo sapiens
actggaatcctttcagc

SEQ ID NO: 2825996 - DNA, 19 bp, Homo sapiens
actggaatcgatctgtact

SEQ ID NO: 2825997 - DNA, 14 bp, Homo sapiens
actggacagcttgt

SEQ ID NO: 2825998 - DNA, 21 bp, Homo sapiens
actggagacttggaagagttg

SEQ ID NO: 2825999 - DNA, 13 bp, Homo sapiens
actggagcaccag

SEQ ID NO: 2826000 - DNA, 17 bp, Homo sapiens
actggagcatctgactc

SEQ ID NO: 2826001 - DNA, 18 bp, Homo sapiens
actggagcatctgactca

SEQ ID NO: 2826002 - DNA, 23 bp, Homo sapiens
actggcacgtttgtgagaagaaa

SEQ ID NO: 2826003 - DNA, 18 bp, Homo sapiens
actggccaagctgaggtg

SEQ ID NO: 2826004 - DNA, 12 bp, Homo sapiens
actggccccacc

SEQ ID NO: 2826005 - DNA, 23 bp, Homo sapiens
actggggagttataaaaatacaa

SEQ ID NO: 2826006 - DNA, 15 bp, Homo sapiens
actgggggaaaagat

SEQ ID NO: 2826007 - DNA, 18 bp, Homo sapiens
actggggtcctggggcct

SEQ ID NO: 2826008 - DNA, 20 bp, Homo sapiens
actgggtaatgaaacaaaga

SEQ ID NO: 2826009 - DNA, 12 bp, Homo sapiens
actgggtacaag

SEQ ID NO: 2826010 - DNA, 19 bp, Homo sapiens
actgggtacttgtggacac

SEQ ID NO: 2826011 - DNA, 23 bp, Homo sapiens
actgggtacttgtggacacagct

SEQ ID NO: 2826012 - DNA, 16 bp, Homo sapiens
actgtaaaatgaaatt

SEQ ID NO: 2826013 - DNA, 14 bp, Homo sapiens
actgtaagtttatt

SEQ ID NO: 2826014 - DNA, 22 bp, Homo sapiens
actgtaagtttattttttctac

SEQ ID NO: 2826015 - DNA, 20 bp, Homo sapiens
actgtaattttgtttgtaat

SEQ ID NO: 2826016 - DNA, 18 bp, Homo sapiens
actgtcctacccaccctc

SEQ ID NO: 2826017 - DNA, 16 bp, Homo sapiens
actgtcgtgtttacaa

SEQ ID NO: 2826018 - DNA, 15 bp, Homo sapiens
actgtctctcatgaa

SEQ ID NO: 2826019 - DNA, 16 bp, Homo sapiens
actgtcttgcctgcca

SEQ ID NO: 2826020 - DNA, 22 bp, Homo sapiens
actgtcttgcctgccagggccc

SEQ ID NO: 2826021 - DNA, 13 bp, Homo sapiens
actgtgaaagtat

SEQ ID NO: 2826022 - DNA, 20 bp, Homo sapiens
actgtgaagacccagcagga

SEQ ID NO: 2826023 - DNA, 22 bp, Homo sapiens
actgtgaagacccagcaggaag

SEQ ID NO: 2826024 - DNA, 21 bp, Homo sapiens
actgtgatggggtgggcaggg

SEQ ID NO: 2826025 - DNA, 17 bp, Homo sapiens
actgtgcgttttagagt

SEQ ID NO: 2826026 - DNA, 18 bp, Homo sapiens
actgtgcgttttagagta

SEQ ID NO: 2826027 - DNA, 16 bp, Homo sapiens
actgtgcttacagtga

SEQ ID NO: 2826028 - DNA, 17 bp, Homo sapiens
actgtgcttacagtgac

SEQ ID NO: 2826029 - DNA, 16 bp, Homo sapiens
actgtggcgttctgct

SEQ ID NO: 2826030 - DNA, 18 bp, Homo sapiens
actgtggcgttctgctgc

SEQ ID NO: 2826031 - DNA, 12 bp, Homo sapiens
actgtggctgct

SEQ ID NO: 2826032 - DNA, 14 bp, Homo sapiens
actgtgttcagtgc

SEQ ID NO: 2826033 - DNA, 14 bp, Homo sapiens
actgttactccaca

SEQ ID NO: 2826034 - DNA, 14 bp, Homo sapiens
actgttacttttta

SEQ ID NO: 2826035 - DNA, 21 bp, Homo sapiens
actgttactttttagtctttt

SEQ ID NO: 2826036 - DNA, 14 bp, Homo sapiens
actgttgcccaggc

SEQ ID NO: 2826037 - DNA, 18 bp, Homo sapiens
actgttgcccaggctggc

SEQ ID NO: 2826038 - DNA, 23 bp, Homo sapiens
actgtttttatatgcacatgtaa

SEQ ID NO: 2826039 - DNA, 13 bp, Homo sapiens
acttaaaaaaatg

SEQ ID NO: 2826040 - DNA, 14 bp, Homo sapiens
acttaaaaaaatga

SEQ ID NO: 2826041 - DNA, 22 bp, Homo sapiens
acttaaaaaaatgacagatgtt

SEQ ID NO: 2826042 - DNA, 17 bp, Homo sapiens
acttaaaagattcacta

SEQ ID NO: 2826043 - DNA, 20 bp, Homo sapiens
acttaaaatattcctgcatt

SEQ ID NO: 2826044 - DNA, 13 bp, Homo sapiens
acttaaaatattt

SEQ ID NO: 2826045 - DNA, 16 bp, Homo sapiens
acttaaagcttgtttg

SEQ ID NO: 2826046 - DNA, 19 bp, Homo sapiens
acttaaataaatgtcatta

SEQ ID NO: 2826047 - DNA, 22 bp, Homo sapiens
acttaactgtgtgaagaaatgg

SEQ ID NO: 2826048 - DNA, 19 bp, Homo sapiens
acttacctaaacagatata

SEQ ID NO: 2826049 - DNA, 17 bp, Homo sapiens
acttaccttcaataaag

SEQ ID NO: 2826050 - DNA, 21 bp, Homo sapiens
acttagcttgaaggatctgtt

SEQ ID NO: 2826051 - DNA, 17 bp, Homo sapiens
acttagtatattttctt

SEQ ID NO: 2826052 - DNA, 20 bp, Homo sapiens
acttataagtgggagctaaa

SEQ ID NO: 2826053 - DNA, 18 bp, Homo sapiens
acttatatggaaattctg

SEQ ID NO: 2826054 - DNA, 18 bp, Homo sapiens
acttattttccaataaaa

SEQ ID NO: 2826055 - DNA, 21 bp, Homo sapiens
acttattttccaataaaattt

SEQ ID NO: 2826056 - DNA, 16 bp, Homo sapiens
acttatttttgacagt

SEQ ID NO: 2826057 - DNA, 22 bp, Homo sapiens
acttatttttgacagtgttgaa

SEQ ID NO: 2826058 - DNA, 12 bp, Homo sapiens
acttcaatgaac

SEQ ID NO: 2826059 - DNA, 15 bp, Homo sapiens
acttcaatgaacaaa

SEQ ID NO: 2826060 - DNA, 13 bp, Homo sapiens
acttcacaaaatg

SEQ ID NO: 2826061 - DNA, 17 bp, Homo sapiens
acttcacacacaggcaa

SEQ ID NO: 2826062 - DNA, 19 bp, Homo sapiens
acttcacacacaggcaact

SEQ ID NO: 2826063 - DNA, 13 bp, Homo sapiens
acttcacactgca

SEQ ID NO: 2826064 - DNA, 16 bp, Homo sapiens
acttcactaccaaatg

SEQ ID NO: 2826065 - DNA, 17 bp, Homo sapiens
acttcactttaattctc

SEQ ID NO: 2826066 - DNA, 13 bp, Homo sapiens
acttcagctctgt

SEQ ID NO: 2826067 - DNA, 14 bp, Homo sapiens
acttcagctctgtt

SEQ ID NO: 2826068 - DNA, 14 bp, Homo sapiens
acttcatggaccaa

SEQ ID NO: 2826069 - DNA, 14 bp, Homo sapiens
acttcattcttgaa

SEQ ID NO: 2826070 - DNA, 12 bp, Homo sapiens
agaccagcctgg

SEQ ID NO: 2826071 - DNA, 14 bp, Homo sapiens
agaccagcctggcc

SEQ ID NO: 2826072 - DNA, 13 bp, Homo sapiens
agaccagctcaga

SEQ ID NO: 2826073 - DNA, 20 bp, Homo sapiens
agaccagctcagaggcccag

SEQ ID NO: 2826074 - DNA, 22 bp, Homo sapiens
agaccagctcagaggcccagga

SEQ ID NO: 2826075 - DNA, 18 bp, Homo sapiens
agaccagttgggagcact

SEQ ID NO: 2826076 - DNA, 21 bp, Homo sapiens
agaccagttgggagcactgga

SEQ ID NO: 2826077 - DNA, 20 bp, Homo sapiens
agacccagcaggaagccagg

SEQ ID NO: 2826078 - DNA, 16 bp, Homo sapiens
agacccagtgtaaaga

SEQ ID NO: 2826079 - DNA, 20 bp, Homo sapiens
agacccagtgtaaagaataa

SEQ ID NO: 2826080 - DNA, 13 bp, Homo sapiens
agaccccttcctt

SEQ ID NO: 2826081 - DNA, 11 bp, Homo sapiens
agaccctcact

SEQ ID NO: 2826082 - DNA, 17 bp, Homo sapiens
agaccctgaagatttca

SEQ ID NO: 2826083 - DNA, 12 bp, Homo sapiens
agaccctgccct

SEQ ID NO: 2826084 - DNA, 13 bp, Homo sapiens
agacctcagcctg

SEQ ID NO: 2826085 - DNA, 19 bp, Homo sapiens
agacctcagcctgtgctgc

SEQ ID NO: 2826086 - DNA, 14 bp, Homo sapiens
agacctctgatccc

SEQ ID NO: 2826087 - DNA, 13 bp, Homo sapiens
agacctgaagaat

SEQ ID NO: 2826088 - DNA, 18 bp, Homo sapiens
agaccttctccaaatgag

SEQ ID NO: 2826089 - DNA, 19 bp, Homo sapiens
agacggagtcccaccttgg

SEQ ID NO: 2826090 - DNA, 23 bp, Homo sapiens
agacgggatttgaagctgtaccc

SEQ ID NO: 2826091 - DNA, 19 bp, Homo sapiens
agacgtatgcttattttaa

SEQ ID NO: 2826092 - DNA, 22 bp, Homo sapiens
agacgtcctggaatgaagcatg

SEQ ID NO: 2826093 - DNA, 17 bp, Homo sapiens
agactatattgtacaca

SEQ ID NO: 2826094 - DNA, 12 bp, Homo sapiens
agactcacctct

SEQ ID NO: 2826095 - DNA, 14 bp, Homo sapiens
agactcacctctgc

SEQ ID NO: 2826096 - DNA, 19 bp, Homo sapiens
agactcacctctgcctcaa

SEQ ID NO: 2826097 - DNA, 15 bp, Homo sapiens
agactcagactccat

SEQ ID NO: 2826098 - DNA, 15 bp, Homo sapiens
agactcagtttgtca

SEQ ID NO: 2826099 - DNA, 17 bp, Homo sapiens
agactcagtttgtcaga

SEQ ID NO: 2826100 - DNA, 17 bp, Homo sapiens
agactcattcttctgta

SEQ ID NO: 2826101 - DNA, 15 bp, Homo sapiens
agactcctgccctgt

SEQ ID NO: 2826102 - DNA, 20 bp, Homo sapiens
agactctgaaatctcagaat

SEQ ID NO: 2826103 - DNA, 18 bp, Homo sapiens
agactctgtctcaaaaaa

SEQ ID NO: 2826104 - DNA, 18 bp, Homo sapiens
agactgacacctcactga

SEQ ID NO: 2826105 - DNA, 21 bp, Homo sapiens
agactgcaagaggctcctgtc

SEQ ID NO: 2826106 - DNA, 12 bp, Homo sapiens
agactgcatctc

SEQ ID NO: 2826107 - DNA, 17 bp, Homo sapiens
agactgcatctcaaaaa

SEQ ID NO: 2826108 - DNA, 14 bp, Homo sapiens
agactgctgggact

SEQ ID NO: 2826109 - DNA, 22 bp, Homo sapiens
agactgctgggactggccaggt

SEQ ID NO: 2826110 - DNA, 14 bp, Homo sapiens
agactggagcatct

SEQ ID NO: 2826111 - DNA, 14 bp, Homo sapiens
agactggctggctg

SEQ ID NO: 2826112 - DNA, 23 bp, Homo sapiens
agactgttgctcaaatctattca

SEQ ID NO: 2826113 - DNA, 19 bp, Homo sapiens
agacttagtatattttctt

SEQ ID NO: 2826114 - DNA, 15 bp, Homo sapiens
agacttcacactgca

SEQ ID NO: 2826115 - DNA, 15 bp, Homo sapiens
agacttctctttctt

SEQ ID NO: 2826116 - DNA, 20 bp, Homo sapiens
agacttctctttcttatttt

SEQ ID NO: 2826117 - DNA, 21 bp, Homo sapiens
agagaaaaaaagtttgccaga

SEQ ID NO: 2826118 - DNA, 14 bp, Homo sapiens
agagaaagaagaga

SEQ ID NO: 2826119 - DNA, 15 bp, Homo sapiens
agagaaagaagagac

SEQ ID NO: 2826120 - DNA, 20 bp, Homo sapiens
agagaaggcaggaatgtgtg

SEQ ID NO: 2826121 - DNA, 16 bp, Homo sapiens
agagaagtagaaatca

SEQ ID NO: 2826122 - DNA, 15 bp, Homo sapiens
agagaatcatactta

SEQ ID NO: 2826123 - DNA, 22 bp, Homo sapiens
agagaatttctaccatttcaga

SEQ ID NO: 2826124 - DNA, 18 bp, Homo sapiens
agagacacctgcacctcc

SEQ ID NO: 2826125 - DNA, 21 bp, Homo sapiens
agagacacctgcacctccccc

SEQ ID NO: 2826126 - DNA, 13 bp, Homo sapiens
agagacaggaaaa

SEQ ID NO: 2826127 - DNA, 23 bp, Homo sapiens
agagacaggaaaatcctctggct

SEQ ID NO: 2826128 - DNA, 14 bp, Homo sapiens
agagacaggagggc

SEQ ID NO: 2826129 - DNA, 22 bp, Homo sapiens
agagacattaactcattagact

SEQ ID NO: 2826130 - DNA, 13 bp, Homo sapiens
agagacccaagga

SEQ ID NO: 2826131 - DNA, 15 bp, Homo sapiens
agagacccagatctc

SEQ ID NO: 2826132 - DNA, 20 bp, Homo sapiens
agagaccccttcctttcctc

SEQ ID NO: 2826133 - DNA, 14 bp, Homo sapiens
agagactggagcat

SEQ ID NO: 2826134 - DNA, 17 bp, Homo sapiens
agagactggagcatctg

SEQ ID NO: 2826135 - DNA, 21 bp, Homo sapiens
agagactggagcatctgactc

SEQ ID NO: 2826136 - DNA, 20 bp, Homo sapiens
agagagaacaactactgtga

SEQ ID NO: 2826137 - DNA, 15 bp, Homo sapiens
agagagggcagaggg

SEQ ID NO: 2826138 - DNA, 22 bp, Homo sapiens
agagaggggaataatagaagaa

SEQ ID NO: 2826139 - DNA, 18 bp, Homo sapiens
agagaggggacatttccc

SEQ ID NO: 2826140 - DNA, 23 bp, Homo sapiens
agagagggtggtgacctctgcct

SEQ ID NO: 2826141 - DNA, 16 bp, Homo sapiens
agagatatatctgaaa

SEQ ID NO: 2826142 - DNA, 12 bp, Homo sapiens
agagatgaatta

SEQ ID NO: 2826143 - DNA, 16 bp, Homo sapiens
agagatgcctccaccg

SEQ ID NO: 2826144 - DNA, 14 bp, Homo sapiens
agagattaatttgt

SEQ ID NO: 2826145 - DNA, 16 bp, Homo sapiens
agagattaatttgtgt

SEQ ID NO: 2826146 - DNA, 14 bp, Homo sapiens
agagcaagactctg

SEQ ID NO: 2826147 - DNA, 22 bp, Homo sapiens
agagcacaagaggaagagagag

SEQ ID NO: 2826148 - DNA, 14 bp, Homo sapiens
agagcacactgtag

SEQ ID NO: 2826149 - DNA, 19 bp, Homo sapiens
agagcatcatgcctctgag

SEQ ID NO: 2826150 - DNA, 20 bp, Homo sapiens
agagcatcatgcctctgagg

SEQ ID NO: 2826151 - DNA, 17 bp, Homo sapiens
agagcattacgtgagcc

SEQ ID NO: 2826152 - DNA, 17 bp, Homo sapiens
agagcattgcatggaca

SEQ ID NO: 2826153 - DNA, 12 bp, Homo sapiens
agagccagccct

SEQ ID NO: 2826154 - DNA, 13 bp, Homo sapiens
agagccagccctc

SEQ ID NO: 2826155 - DNA, 21 bp, Homo sapiens
agagccagccctccctgtcct

SEQ ID NO: 2826156 - DNA, 13 bp, Homo sapiens
agagccagctctc

SEQ ID NO: 2826157 - DNA, 13 bp, Homo sapiens
agagccagggtct

SEQ ID NO: 2826158 - DNA, 15 bp, Homo sapiens
agagccatgtaccag

SEQ ID NO: 2826159 - DNA, 17 bp, Homo sapiens
agagccccacacggagg

SEQ ID NO: 2826160 - DNA, 16 bp, Homo sapiens
agagccccccacaatg

SEQ ID NO: 2826161 - DNA, 21 bp, Homo sapiens
agcgctgccgcaccccagagt

SEQ ID NO: 2826162 - DNA, 18 bp, Homo sapiens
agcggagacggagtccca

SEQ ID NO: 2826163 - DNA, 18 bp, Homo sapiens
agcggaggagaccagctc

SEQ ID NO: 2826164 - DNA, 14 bp, Homo sapiens
agcggctctcctga

SEQ ID NO: 2826165 - DNA, 16 bp, Homo sapiens
agcggctgagtcatga

SEQ ID NO: 2826166 - DNA, 15 bp, Homo sapiens
agcggggacagctcc

SEQ ID NO: 2826167 - DNA, 19 bp, Homo sapiens
agcggggacagctccttct

SEQ ID NO: 2826168 - DNA, 22 bp, Homo sapiens
agcggggacagctccttctgtc

SEQ ID NO: 2826169 - DNA, 19 bp, Homo sapiens
agcggtttccaggccaccg

SEQ ID NO: 2826170 - DNA, 23 bp, Homo sapiens
agcgtagctaagtgaaaaggtca

SEQ ID NO: 2826171 - DNA, 16 bp, Homo sapiens
agcgtgagccactgca

SEQ ID NO: 2826172 - DNA, 17 bp, Homo sapiens
agcgtgagccactgcac

SEQ ID NO: 2826173 - DNA, 22 bp, Homo sapiens
agcgtgagccactgcaccgggc

SEQ ID NO: 2826174 - DNA, 20 bp, Homo sapiens
agctaaatacctcaatcagt

SEQ ID NO: 2826175 - DNA, 19 bp, Homo sapiens
agctaacagggaaggcagg

SEQ ID NO: 2826176 - DNA, 23 bp, Homo sapiens
agctaacagggaaggcaggcagg

SEQ ID NO: 2826177 - DNA, 18 bp, Homo sapiens
agctaagctaggaatgaa

SEQ ID NO: 2826178 - DNA, 17 bp, Homo sapiens
agctaatctgtagggct

SEQ ID NO: 2826179 - DNA, 19 bp, Homo sapiens
agctaatctgtagggctgg

SEQ ID NO: 2826180 - DNA, 19 bp, Homo sapiens
agctacctgtgtggacagg

SEQ ID NO: 2826181 - DNA, 14 bp, Homo sapiens
agctactcagaagc

SEQ ID NO: 2826182 - DNA, 18 bp, Homo sapiens
agctactcagaagcctga

SEQ ID NO: 2826183 - DNA, 15 bp, Homo sapiens
agctactcaggaggc

SEQ ID NO: 2826184 - DNA, 18 bp, Homo sapiens
agctactcaggaggctga

SEQ ID NO: 2826185 - DNA, 15 bp, Homo sapiens
agctagaagtgggcc

SEQ ID NO: 2826186 - DNA, 21 bp, Homo sapiens
agctagaagtgggccaggaca

SEQ ID NO: 2826187 - DNA, 20 bp, Homo sapiens
agctagaattgagtgtttaa

SEQ ID NO: 2826188 - DNA, 20 bp, Homo sapiens
agctagcgctgccgcacccc

SEQ ID NO: 2826189 - DNA, 19 bp, Homo sapiens
agctaggagcaaagcctgt

SEQ ID NO: 2826190 - DNA, 21 bp, Homo sapiens
agctaggcctggccagatgca

SEQ ID NO: 2826191 - DNA, 18 bp, Homo sapiens
agctataaaatgaataca

SEQ ID NO: 2826192 - DNA, 14 bp, Homo sapiens
agctatcatttctt

SEQ ID NO: 2826193 - DNA, 20 bp, Homo sapiens
agctattagcaactgtgcta

SEQ ID NO: 2826194 - DNA, 14 bp, Homo sapiens
agctattgatgttt

SEQ ID NO: 2826195 - DNA, 16 bp, Homo sapiens
agctattgatgtttcc

SEQ ID NO: 2826196 - DNA, 23 bp, Homo sapiens
agctattgatgtttccagaaaat

SEQ ID NO: 2826197 - DNA, 20 bp, Homo sapiens
agctattgcatgtaaaatgc

SEQ ID NO: 2826198 - DNA, 22 bp, Homo sapiens
agctatttttatttgtttgtgc

SEQ ID NO: 2826199 - DNA, 18 bp, Homo sapiens
agctcaagatgacagctc

SEQ ID NO: 2826200 - DNA, 19 bp, Homo sapiens
agctcaagatgacagctct

SEQ ID NO: 2826201 - DNA, 23 bp, Homo sapiens
agctcaagtcttccctgatcaag

SEQ ID NO: 2826202 - DNA, 18 bp, Homo sapiens
agctcacaaggcagcaag

SEQ ID NO: 2826203 - DNA, 20 bp, Homo sapiens
agctcacagttcctcgccct

SEQ ID NO: 2826204 - DNA, 14 bp, Homo sapiens
agctcaccagcccc

SEQ ID NO: 2826205 - DNA, 16 bp, Homo sapiens
agctcaccagccccag

SEQ ID NO: 2826206 - DNA, 14 bp, Homo sapiens
agctcactccctgg

SEQ ID NO: 2826207 - DNA, 17 bp, Homo sapiens
agctcagacccccactc

SEQ ID NO: 2826208 - DNA, 18 bp, Homo sapiens
agctcagacccccactct

SEQ ID NO: 2826209 - DNA, 18 bp, Homo sapiens
agctcagaggcccaggaa

SEQ ID NO: 2826210 - DNA, 14 bp, Homo sapiens
agctcagcctcccc

SEQ ID NO: 2826211 - DNA, 20 bp, Homo sapiens
agctcaggtgtccctgcact

SEQ ID NO: 2826212 - DNA, 21 bp, Homo sapiens
agctcaggtgtccctgcactt

SEQ ID NO: 2826213 - DNA, 13 bp, Homo sapiens
agctcagtcccat

SEQ ID NO: 2826214 - DNA, 21 bp, Homo sapiens
agctccagctcaccagcccca

SEQ ID NO: 2826215 - DNA, 13 bp, Homo sapiens
agctccatctcca

SEQ ID NO: 2826216 - DNA, 15 bp, Homo sapiens
agctccatctccact

SEQ ID NO: 2826217 - DNA, 21 bp, Homo sapiens
agctccatctccactccagat

SEQ ID NO: 2826218 - DNA, 15 bp, Homo sapiens
agctccccaggactc

SEQ ID NO: 2826219 - DNA, 22 bp, Homo sapiens
agctccccaggactcaccctca

SEQ ID NO: 2826220 - DNA, 15 bp, Homo sapiens
agctccctaggagac

SEQ ID NO: 2826221 - DNA, 20 bp, Homo sapiens
agctccgctttctacccagc

SEQ ID NO: 2826222 - DNA, 22 bp, Homo sapiens
agctcctcgctgcgtctccatc

SEQ ID NO: 2826223 - DNA, 22 bp, Homo sapiens
agctcctggtcttgagatgtct

SEQ ID NO: 2826224 - DNA, 13 bp, Homo sapiens
agctccttctgtc

SEQ ID NO: 2826225 - DNA, 16 bp, Homo sapiens
agctccttctgtccta

SEQ ID NO: 2826226 - DNA, 21 bp, Homo sapiens
agctccttctgtcctactctg

SEQ ID NO: 2826227 - DNA, 22 bp, Homo sapiens
agctccttctgtcctactctgt

SEQ ID NO: 2826228 - DNA, 12 bp, Homo sapiens
agctcggtggac

SEQ ID NO: 2826229 - DNA, 12 bp, Homo sapiens
agctctcagcca

SEQ ID NO: 2826230 - DNA, 13 bp, Homo sapiens
agctctcagccaa

SEQ ID NO: 2826231 - DNA, 18 bp, Homo sapiens
agctctccctctggccct

SEQ ID NO: 2826232 - DNA, 20 bp, Homo sapiens
agctctccctctggccctgc

SEQ ID NO: 2826233 - DNA, 23 bp, Homo sapiens
agctctccctctggccctgcctt

SEQ ID NO: 2826234 - DNA, 10 bp, Homo sapiens
agctctgaga

SEQ ID NO: 2826235 - DNA, 13 bp, Homo sapiens
agctctgagaggc

SEQ ID NO: 2826236 - DNA, 16 bp, Homo sapiens
agctctgagaggccct

SEQ ID NO: 2826237 - DNA, 17 bp, Homo sapiens
agctctgagaggccctg

SEQ ID NO: 2826238 - DNA, 18 bp, Homo sapiens
agctctgagaggccctgg

SEQ ID NO: 2826239 - DNA, 20 bp, Homo sapiens
agctctgagaggccctggat

SEQ ID NO: 2826240 - DNA, 21 bp, Homo sapiens
agctctgcagagcaggaaaca

SEQ ID NO: 2826241 - DNA, 13 bp, Homo sapiens
agctctgcattat

SEQ ID NO: 2826242 - DNA, 22 bp, Homo sapiens
agctctgctcctctccccagca

SEQ ID NO: 2826243 - DNA, 15 bp, Homo sapiens
agctctggccccagg

SEQ ID NO: 2826244 - DNA, 12 bp, Homo sapiens
agctctgtccac

SEQ ID NO: 2826245 - DNA, 14 bp, Homo sapiens
agctctgtcctggg

SEQ ID NO: 2826246 - DNA, 19 bp, Homo sapiens
agctctgtttataaaaaca

SEQ ID NO: 2826247 - DNA, 16 bp, Homo sapiens
agctcttcatgtttca

SEQ ID NO: 2826248 - DNA, 15 bp, Homo sapiens
agctcttctaaggaa

SEQ ID NO: 2826249 - DNA, 13 bp, Homo sapiens
agctcttctattt

SEQ ID NO: 2826250 - DNA, 19 bp, Homo sapiens
agctcttctatttaaaaaa

SEQ ID NO: 2826251 - DNA, 21 bp, Homo sapiens
aggcagagacaataaaacatt

SEQ ID NO: 2826252 - DNA, 15 bp, Homo sapiens
aggcagcaaggcccg

SEQ ID NO: 2826253 - DNA, 16 bp, Homo sapiens
aggcagcaaggcccga

SEQ ID NO: 2826254 - DNA, 17 bp, Homo sapiens
aggcagcaaggcccgag

SEQ ID NO: 2826255 - DNA, 23 bp, Homo sapiens
aggcagcaaggcccgagcagctg

SEQ ID NO: 2826256 - DNA, 22 bp, Homo sapiens
aggcagccccattctgcctgcc

SEQ ID NO: 2826257 - DNA, 20 bp, Homo sapiens
aggcaggcagggctctcctg

SEQ ID NO: 2826258 - DNA, 19 bp, Homo sapiens
aggcagggccttgcccaga

SEQ ID NO: 2826259 - DNA, 17 bp, Homo sapiens
aggcagggctctcctgg

SEQ ID NO: 2826260 - DNA, 18 bp, Homo sapiens
aggcagggctctcctggc

SEQ ID NO: 2826261 - DNA, 21 bp, Homo sapiens
aggcagggctctcctggcttc

SEQ ID NO: 2826262 - DNA, 22 bp, Homo sapiens
aggcagggctctcctggcttcc

SEQ ID NO: 2826263 - DNA, 17 bp, Homo sapiens
aggcaggggtgggagag

SEQ ID NO: 2826264 - DNA, 20 bp, Homo sapiens
aggcagggtctcactctgtc

SEQ ID NO: 2826265 - DNA, 21 bp, Homo sapiens
aggcaggtcttgaactcctgg

SEQ ID NO: 2826266 - DNA, 16 bp, Homo sapiens
aggcatcccaggggac

SEQ ID NO: 2826267 - DNA, 17 bp, Homo sapiens
aggcatcccaggggacc

SEQ ID NO: 2826268 - DNA, 18 bp, Homo sapiens
aggcatcccaggggacca

SEQ ID NO: 2826269 - DNA, 23 bp, Homo sapiens
aggcatcccaggggaccacacct

SEQ ID NO: 2826270 - DNA, 17 bp, Homo sapiens
aggcatctacacagcct

SEQ ID NO: 2826271 - DNA, 18 bp, Homo sapiens
aggcatctacacagcctg

SEQ ID NO: 2826272 - DNA, 19 bp, Homo sapiens
aggcatctacacagcctgg

SEQ ID NO: 2826273 - DNA, 20 bp, Homo sapiens
aggcatctacacagcctgga

SEQ ID NO: 2826274 - DNA, 23 bp, Homo sapiens
aggcatctacacagcctggactt

SEQ ID NO: 2826275 - DNA, 22 bp, Homo sapiens
aggcatgagggatcacagggcc

SEQ ID NO: 2826276 - DNA, 16 bp, Homo sapiens
aggcatgcaccagtgc

SEQ ID NO: 2826277 - DNA, 19 bp, Homo sapiens
aggcatgttctctgaggac

SEQ ID NO: 2826278 - DNA, 22 bp, Homo sapiens
aggcatgttctctgaggacact

SEQ ID NO: 2826279 - DNA, 14 bp, Homo sapiens
aggcattaaatttt

SEQ ID NO: 2826280 - DNA, 16 bp, Homo sapiens
aggcatttcctgggtg

SEQ ID NO: 2826281 - DNA, 17 bp, Homo sapiens
aggcatttcctgggtgg

SEQ ID NO: 2826282 - DNA, 14 bp, Homo sapiens
aggccaagagcaga

SEQ ID NO: 2826283 - DNA, 20 bp, Homo sapiens
aggccaagagcagaggcagc

SEQ ID NO: 2826284 - DNA, 22 bp, Homo sapiens
aggccaagtgtgataaataaac

SEQ ID NO: 2826285 - DNA, 22 bp, Homo sapiens
aggccacaccatctcctttcag

SEQ ID NO: 2826286 - DNA, 13 bp, Homo sapiens
aggccaccaggat

SEQ ID NO: 2826287 - DNA, 22 bp, Homo sapiens
aggccaccatattcagtgctgt

SEQ ID NO: 2826288 - DNA, 19 bp, Homo sapiens
aggccaccgggacagacct

SEQ ID NO: 2826289 - DNA, 13 bp, Homo sapiens
aggccactcctcc

SEQ ID NO: 2826290 - DNA, 14 bp, Homo sapiens
aggccactcctcca

SEQ ID NO: 2826291 - DNA, 21 bp, Homo sapiens
aggccagcctggcctcctgcc

SEQ ID NO: 2826292 - DNA, 20 bp, Homo sapiens
aggccaggttatgcctcatg

SEQ ID NO: 2826293 - DNA, 12 bp, Homo sapiens
aggcccaagaga

SEQ ID NO: 2826294 - DNA, 20 bp, Homo sapiens
aggcccaagagatgaagagt

SEQ ID NO: 2826295 - DNA, 17 bp, Homo sapiens
aggccccatgacctcca

SEQ ID NO: 2826296 - DNA, 20 bp, Homo sapiens
aggccccatgacctccagct

SEQ ID NO: 2826297 - DNA, 17 bp, Homo sapiens
aggcccccacctggctc

SEQ ID NO: 2826298 - DNA, 18 bp, Homo sapiens
aggcccccacctggctca

SEQ ID NO: 2826299 - DNA, 18 bp, Homo sapiens
aggccccccgcagcaccc

SEQ ID NO: 2826300 - DNA, 16 bp, Homo sapiens
aggcccccgctggctc

SEQ ID NO: 2826301 - DNA, 22 bp, Homo sapiens
aggcccccgctggctcctccag

SEQ ID NO: 2826302 - DNA, 18 bp, Homo sapiens
aggccccgcttgtccagc

SEQ ID NO: 2826303 - DNA, 21 bp, Homo sapiens
aggccccgcttgtccagcgcc

SEQ ID NO: 2826304 - DNA, 12 bp, Homo sapiens
aggcccctgcca

SEQ ID NO: 2826305 - DNA, 13 bp, Homo sapiens
aggcccctgccac

SEQ ID NO: 2826306 - DNA, 17 bp, Homo sapiens
aggcccctgccaccctg

SEQ ID NO: 2826307 - DNA, 19 bp, Homo sapiens
aggcccctggtctgccctg

SEQ ID NO: 2826308 - DNA, 15 bp, Homo sapiens
aggcccgagcagctg

SEQ ID NO: 2826309 - DNA, 19 bp, Homo sapiens
aggcccgagcagctgagca

SEQ ID NO: 2826310 - DNA, 22 bp, Homo sapiens
aggcccggccccatcagaggct

SEQ ID NO: 2826311 - DNA, 16 bp, Homo sapiens
aggcccggctccaggc

SEQ ID NO: 2826312 - DNA, 21 bp, Homo sapiens
aggcccggctccaggctcctt

SEQ ID NO: 2826313 - DNA, 22 bp, Homo sapiens
aggcccttattttcaagaaact

SEQ ID NO: 2826314 - DNA, 13 bp, Homo sapiens
aggccgctgcccc

SEQ ID NO: 2826315 - DNA, 16 bp, Homo sapiens
aggcctataaccccag

SEQ ID NO: 2826316 - DNA, 22 bp, Homo sapiens
aggcctcttggacctctgctct

SEQ ID NO: 2826317 - DNA, 22 bp, Homo sapiens
aggcctgccctcagggatcttg

SEQ ID NO: 2826318 - DNA, 13 bp, Homo sapiens
aggcctggccaga

SEQ ID NO: 2826319 - DNA, 16 bp, Homo sapiens
aggcctggccagatgc

SEQ ID NO: 2826320 - DNA, 15 bp, Homo sapiens
aggcctggccaggca

SEQ ID NO: 2826321 - DNA, 18 bp, Homo sapiens
aggcctggggtgacccgg

SEQ ID NO: 2826322 - DNA, 21 bp, Homo sapiens
aggcctgtgtagctgtgacct

SEQ ID NO: 2826323 - DNA, 16 bp, Homo sapiens
aggccttttggaatgt

SEQ ID NO: 2826324 - DNA, 21 bp, Homo sapiens
aggcgcagtgcttctctacag

SEQ ID NO: 2826325 - DNA, 21 bp, Homo sapiens
aggcgccccaacccgtggagg

SEQ ID NO: 2826326 - DNA, 15 bp, Homo sapiens
aggcggcacagaggc

SEQ ID NO: 2826327 - DNA, 14 bp, Homo sapiens
aggcgggaaggagg

SEQ ID NO: 2826328 - DNA, 15 bp, Homo sapiens
aggcgggaaggaggg

SEQ ID NO: 2826329 - DNA, 16 bp, Homo sapiens
aggcggggtgctgtgg

SEQ ID NO: 2826330 - DNA, 15 bp, Homo sapiens
aggcggtttccagga

SEQ ID NO: 2826331 - DNA, 18 bp, Homo sapiens
aggcggtttccaggaaga

SEQ ID NO: 2826332 - DNA, 15 bp, Homo sapiens
aggcgtcttgtattt

SEQ ID NO: 2826333 - DNA, 17 bp, Homo sapiens
aggcgtcttgtattttc

SEQ ID NO: 2826334 - DNA, 19 bp, Homo sapiens
aggcgttcttcgaggtgga

SEQ ID NO: 2826335 - DNA, 23 bp, Homo sapiens
aggctaatttttttgtattttag

SEQ ID NO: 2826336 - DNA, 20 bp, Homo sapiens
aggctacttcggggctggga

SEQ ID NO: 2826337 - DNA, 22 bp, Homo sapiens
aggctacttcggggctgggaag

SEQ ID NO: 2826338 - DNA, 17 bp, Homo sapiens
aggctagtttattttgt

SEQ ID NO: 2826339 - DNA, 17 bp, Homo sapiens
aggctattaaaagaatc

SEQ ID NO: 2826340 - DNA, 18 bp, Homo sapiens
aggctattattttcactg

SEQ ID NO: 2826341 - DNA, 12 bp, Homo sapiens
agtagaaatcat

SEQ ID NO: 2826342 - DNA, 19 bp, Homo sapiens
agtagaagtctcttccagt

SEQ ID NO: 2826343 - DNA, 20 bp, Homo sapiens
agtagcaagttctagagaag

SEQ ID NO: 2826344 - DNA, 22 bp, Homo sapiens
agtagcaagttctagagaagag

SEQ ID NO: 2826345 - DNA, 16 bp, Homo sapiens
agtagcagggaattga

SEQ ID NO: 2826346 - DNA, 18 bp, Homo sapiens
agtagcttaaataaattc

SEQ ID NO: 2826347 - DNA, 21 bp, Homo sapiens
agtagcttaaataaattcaaa

SEQ ID NO: 2826348 - DNA, 22 bp, Homo sapiens
agtagcttaaataaattcaaac

SEQ ID NO: 2826349 - DNA, 16 bp, Homo sapiens
agtaggaccaatgttg

SEQ ID NO: 2826350 - DNA, 17 bp, Homo sapiens
agtagtcaattagtaca

SEQ ID NO: 2826351 - DNA, 19 bp, Homo sapiens
agtagtcaattagtacagt

SEQ ID NO: 2826352 - DNA, 22 bp, Homo sapiens
agtagtgtcttcctagtatatt

SEQ ID NO: 2826353 - DNA, 23 bp, Homo sapiens
agtagttgatgaccaatctctgt

SEQ ID NO: 2826354 - DNA, 12 bp, Homo sapiens
agtataaagtca

SEQ ID NO: 2826355 - DNA, 15 bp, Homo sapiens
agtatatattctaca

SEQ ID NO: 2826356 - DNA, 22 bp, Homo sapiens
agtatatctggacaagccaact

SEQ ID NO: 2826357 - DNA, 19 bp, Homo sapiens
agtatattagtttgattta

SEQ ID NO: 2826358 - DNA, 11 bp, Homo sapiens
agtatatttat

SEQ ID NO: 2826359 - DNA, 13 bp, Homo sapiens
agtatatttatac

SEQ ID NO: 2826360 - DNA, 14 bp, Homo sapiens
agtatatttatact

SEQ ID NO: 2826361 - DNA, 14 bp, Homo sapiens
agtatatttatagt

SEQ ID NO: 2826362 - DNA, 18 bp, Homo sapiens
agtatatttatagtcaca

SEQ ID NO: 2826363 - DNA, 14 bp, Homo sapiens
agtatccactttgc

SEQ ID NO: 2826364 - DNA, 10 bp, Homo sapiens
agtatctcat

SEQ ID NO: 2826365 - DNA, 22 bp, Homo sapiens
agtatctcatcaacaaagaaat

SEQ ID NO: 2826366 - DNA, 16 bp, Homo sapiens
agtatggtggctgggt

SEQ ID NO: 2826367 - DNA, 15 bp, Homo sapiens
agtattacttctgct

SEQ ID NO: 2826368 - DNA, 22 bp, Homo sapiens
agtattgtccatatcagacctc

SEQ ID NO: 2826369 - DNA, 12 bp, Homo sapiens
agtatttatata

SEQ ID NO: 2826370 - DNA, 14 bp, Homo sapiens
agtatttatatatt

SEQ ID NO: 2826371 - DNA, 16 bp, Homo sapiens
agtatttatatattta

SEQ ID NO: 2826372 - DNA, 23 bp, Homo sapiens
agtatttatatatttataactca

SEQ ID NO: 2826373 - DNA, 18 bp, Homo sapiens
agtatttgttaatttaga

SEQ ID NO: 2826374 - DNA, 16 bp, Homo sapiens
agtattttatctgtgt

SEQ ID NO: 2826375 - DNA, 21 bp, Homo sapiens
agtcaaaaggtgcctgtgagg

SEQ ID NO: 2826376 - DNA, 20 bp, Homo sapiens
agtcaaaccataaacttcat

SEQ ID NO: 2826377 - DNA, 18 bp, Homo sapiens
agtcaatcccctcattca

SEQ ID NO: 2826378 - DNA, 18 bp, Homo sapiens
agtcaattagtacagtag

SEQ ID NO: 2826379 - DNA, 12 bp, Homo sapiens
agtcacacagac

SEQ ID NO: 2826380 - DNA, 13 bp, Homo sapiens
agtcacacagaca

SEQ ID NO: 2826381 - DNA, 18 bp, Homo sapiens
agtcacacagacacacaa

SEQ ID NO: 2826382 - DNA, 15 bp, Homo sapiens
agtcacacagtgagt

SEQ ID NO: 2826383 - DNA, 14 bp, Homo sapiens
agtcacatcacagg

SEQ ID NO: 2826384 - DNA, 19 bp, Homo sapiens
agtcaccaggaatgttaaa

SEQ ID NO: 2826385 - DNA, 16 bp, Homo sapiens
agtcacccatgaagac

SEQ ID NO: 2826386 - DNA, 19 bp, Homo sapiens
agtcaccctacctgtgcct

SEQ ID NO: 2826387 - DNA, 20 bp, Homo sapiens
agtcaccctacctgtgcctg

SEQ ID NO: 2826388 - DNA, 10 bp, Homo sapiens
agtcactgtc

SEQ ID NO: 2826389 - DNA, 21 bp, Homo sapiens
agtcagacatttggtatatta

SEQ ID NO: 2826390 - DNA, 15 bp, Homo sapiens
agtcagactgctggg

SEQ ID NO: 2826391 - DNA, 22 bp, Homo sapiens
agtcagccttccccctcccagg

SEQ ID NO: 2826392 - DNA, 23 bp, Homo sapiens
agtcagccttccccctcccaggg

SEQ ID NO: 2826393 - DNA, 16 bp, Homo sapiens
agtcaggacctggctt

SEQ ID NO: 2826394 - DNA, 17 bp, Homo sapiens
agtcaggacctggcttg

SEQ ID NO: 2826395 - DNA, 14 bp, Homo sapiens
agtcagttggagaa

SEQ ID NO: 2826396 - DNA, 13 bp, Homo sapiens
agtcatgaagccc

SEQ ID NO: 2826397 - DNA, 16 bp, Homo sapiens
agtcatgatctccctg

SEQ ID NO: 2826398 - DNA, 21 bp, Homo sapiens
agtcatgatctccctgccgcc

SEQ ID NO: 2826399 - DNA, 23 bp, Homo sapiens
agtcatgatctccctgccgcctc

SEQ ID NO: 2826400 - DNA, 23 bp, Homo sapiens
agtcattgttacaggtgtactat

SEQ ID NO: 2826401 - DNA, 19 bp, Homo sapiens
agtcatttgctgagcatgt

SEQ ID NO: 2826402 - DNA, 22 bp, Homo sapiens
agtcatttgctgagcatgtact

SEQ ID NO: 2826403 - DNA, 18 bp, Homo sapiens
agtccaatgtctttttaa

SEQ ID NO: 2826404 - DNA, 13 bp, Homo sapiens
agtccaggtcctg

SEQ ID NO: 2826405 - DNA, 14 bp, Homo sapiens
agtccaggtcctgg

SEQ ID NO: 2826406 - DNA, 17 bp, Homo sapiens
agtccaggtcctggtgg

SEQ ID NO: 2826407 - DNA, 17 bp, Homo sapiens
agtcccaaggaaagccc

SEQ ID NO: 2826408 - DNA, 21 bp, Homo sapiens
agtcccaaggaaagccccagc

SEQ ID NO: 2826409 - DNA, 14 bp, Homo sapiens
agtcccccaccaca

SEQ ID NO: 2826410 - DNA, 23 bp, Homo sapiens
agtccccgtgccccgcctccccg

SEQ ID NO: 2826411 - DNA, 14 bp, Homo sapiens
agtccctgggggaa

SEQ ID NO: 2826412 - DNA, 12 bp, Homo sapiens
agtccgcctggc

SEQ ID NO: 2826413 - DNA, 14 bp, Homo sapiens
agtccgtcaaaaca

SEQ ID NO: 2826414 - DNA, 22 bp, Homo sapiens
agtcctctggatggcaccagag

SEQ ID NO: 2826415 - DNA, 16 bp, Homo sapiens
agtcctcttattccta

SEQ ID NO: 2826416 - DNA, 17 bp, Homo sapiens
agtcctgcagaggattt

SEQ ID NO: 2826417 - DNA, 16 bp, Homo sapiens
agtcctggtctgctca

SEQ ID NO: 2826418 - DNA, 18 bp, Homo sapiens
agtcctggtctgctcagg

SEQ ID NO: 2826419 - DNA, 13 bp, Homo sapiens
agtcgtcaagttg

SEQ ID NO: 2826420 - DNA, 17 bp, Homo sapiens
agtcgtccttactcctg

SEQ ID NO: 2826421 - DNA, 20 bp, Homo sapiens
agtcgtccttactcctgtgg

SEQ ID NO: 2826422 - DNA, 22 bp, Homo sapiens
agtcgtccttactcctgtggga

SEQ ID NO: 2826423 - DNA, 15 bp, Homo sapiens
agtctacctcttcag

SEQ ID NO: 2826424 - DNA, 18 bp, Homo sapiens
agtctatatgaaaaacaa

SEQ ID NO: 2826425 - DNA, 14 bp, Homo sapiens
agtctatggtcagt

SEQ ID NO: 2826426 - DNA, 18 bp, Homo sapiens
agtctcactgttgcccag

SEQ ID NO: 2826427 - DNA, 19 bp, Homo sapiens
agtctcactgttgcccagg

SEQ ID NO: 2826428 - DNA, 21 bp, Homo sapiens
agtctcactgttgcccaggct

SEQ ID NO: 2826429 - DNA, 23 bp, Homo sapiens
agtctcactgttgcccaggctgg

SEQ ID NO: 2826430 - DNA, 19 bp, Homo sapiens
agtctcagaatgtcatttt

SEQ ID NO: 2826431 - DNA, 13 bp, Homo sapiens
agtctcaggagca

SEQ ID NO: 2826432 - DNA, 17 bp, Homo sapiens
ataaccatcagttactg

SEQ ID NO: 2826433 - DNA, 18 bp, Homo sapiens
ataaccatcagttactgg

SEQ ID NO: 2826434 - DNA, 19 bp, Homo sapiens
ataaccatcagttactggt

SEQ ID NO: 2826435 - DNA, 23 bp, Homo sapiens
ataaccatcagttactggtttca

SEQ ID NO: 2826436 - DNA, 21 bp, Homo sapiens
ataaccccaccttgccaagct

SEQ ID NO: 2826437 - DNA, 18 bp, Homo sapiens
ataacgtttaagccaaaa

SEQ ID NO: 2826438 - DNA, 20 bp, Homo sapiens
ataacgtttaagccaaaaca

SEQ ID NO: 2826439 - DNA, 22 bp, Homo sapiens
ataacgtttaagccaaaacaat

SEQ ID NO: 2826440 - DNA, 14 bp, Homo sapiens
ataactaaataaag

SEQ ID NO: 2826441 - DNA, 16 bp, Homo sapiens
ataactagatctcctg

SEQ ID NO: 2826442 - DNA, 19 bp, Homo sapiens
ataactagatctcctgtaa

SEQ ID NO: 2826443 - DNA, 21 bp, Homo sapiens
ataactagatctcctgtaatt

SEQ ID NO: 2826444 - DNA, 16 bp, Homo sapiens
ataactagtgttgctt

SEQ ID NO: 2826445 - DNA, 19 bp, Homo sapiens
ataactagtgttgcttgga

SEQ ID NO: 2826446 - DNA, 15 bp, Homo sapiens
ataactcatcataaa

SEQ ID NO: 2826447 - DNA, 19 bp, Homo sapiens
ataactcatcataaaataa

SEQ ID NO: 2826448 - DNA, 14 bp, Homo sapiens
ataactgaaggaga

SEQ ID NO: 2826449 - DNA, 16 bp, Homo sapiens
ataactgaaggagaag

SEQ ID NO: 2826450 - DNA, 18 bp, Homo sapiens
ataactgaaggagaaggt

SEQ ID NO: 2826451 - DNA, 12 bp, Homo sapiens
ataactgagaat

SEQ ID NO: 2826452 - DNA, 16 bp, Homo sapiens
ataacttaaaaaaatg

SEQ ID NO: 2826453 - DNA, 14 bp, Homo sapiens
ataacttcagagaa

SEQ ID NO: 2826454 - DNA, 16 bp, Homo sapiens
ataacttcagagaagt

SEQ ID NO: 2826455 - DNA, 17 bp, Homo sapiens
ataacttcagagaagtc

SEQ ID NO: 2826456 - DNA, 15 bp, Homo sapiens
ataagaagaatgctt

SEQ ID NO: 2826457 - DNA, 16 bp, Homo sapiens
ataagaatgctggttt

SEQ ID NO: 2826458 - DNA, 19 bp, Homo sapiens
ataagaatgctggttttcc

SEQ ID NO: 2826459 - DNA, 14 bp, Homo sapiens
ataagattaaagga

SEQ ID NO: 2826460 - DNA, 16 bp, Homo sapiens
ataagattaaaggaag

SEQ ID NO: 2826461 - DNA, 22 bp, Homo sapiens
ataagcatctgtgtaacctcca

SEQ ID NO: 2826462 - DNA, 14 bp, Homo sapiens
ataaggatcagaac

SEQ ID NO: 2826463 - DNA, 20 bp, Homo sapiens
ataaggatcagaacagcaga

SEQ ID NO: 2826464 - DNA, 17 bp, Homo sapiens
ataaggtttaaaaagat

SEQ ID NO: 2826465 - DNA, 22 bp, Homo sapiens
ataagtgctgtttgagatgtga

SEQ ID NO: 2826466 - DNA, 11 bp, Homo sapiens
ataagtggaaa

SEQ ID NO: 2826467 - DNA, 15 bp, Homo sapiens
ataagtggaaaaaag

SEQ ID NO: 2826468 - DNA, 17 bp, Homo sapiens
ataagtgggagctaaat

SEQ ID NO: 2826469 - DNA, 17 bp, Homo sapiens
ataagttccatgttaaa

SEQ ID NO: 2826470 - DNA, 21 bp, Homo sapiens
ataagtttctgggacctcagt

SEQ ID NO: 2826471 - DNA, 14 bp, Homo sapiens
ataataattttcct

SEQ ID NO: 2826472 - DNA, 13 bp, Homo sapiens
ataatatctgtga

SEQ ID NO: 2826473 - DNA, 24 bp, Homo sapiens
ataatatctgtgaggtgctgatga

SEQ ID NO: 2826474 - DNA, 22 bp, Homo sapiens
ataatatcttgaagaatattgt

SEQ ID NO: 2826475 - DNA, 20 bp, Homo sapiens
ataatatttttaattaaata

SEQ ID NO: 2826476 - DNA, 18 bp, Homo sapiens
ataatcaaagctacctgt

SEQ ID NO: 2826477 - DNA, 13 bp, Homo sapiens
ataatcagcctct

SEQ ID NO: 2826478 - DNA, 15 bp, Homo sapiens
ataatcagcctctta

SEQ ID NO: 2826479 - DNA, 19 bp, Homo sapiens
ataatctggactcctctgt

SEQ ID NO: 2826480 - DNA, 22 bp, Homo sapiens
ataatctggactcctctgtcca

SEQ ID NO: 2826481 - DNA, 17 bp, Homo sapiens
ataatgaacagaacata

SEQ ID NO: 2826482 - DNA, 11 bp, Homo sapiens
ataatgattta

SEQ ID NO: 2826483 - DNA, 18 bp, Homo sapiens
ataatggttgactgggtt

SEQ ID NO: 2826484 - DNA, 16 bp, Homo sapiens
ataatgtcaaaatcat

SEQ ID NO: 2826485 - DNA, 13 bp, Homo sapiens
ataatgtttgcta

SEQ ID NO: 2826486 - DNA, 23 bp, Homo sapiens
ataattaaaaaccactgaacatt

SEQ ID NO: 2826487 - DNA, 13 bp, Homo sapiens
ataattaggatct

SEQ ID NO: 2826488 - DNA, 18 bp, Homo sapiens
ataattaggatctatgca

SEQ ID NO: 2826489 - DNA, 20 bp, Homo sapiens
ataattaggatctatgcaat

SEQ ID NO: 2826490 - DNA, 22 bp, Homo sapiens
ataattaggatctatgcaattt

SEQ ID NO: 2826491 - DNA, 16 bp, Homo sapiens
ataattatcggaagca

SEQ ID NO: 2826492 - DNA, 14 bp, Homo sapiens
ataattatgacagt

SEQ ID NO: 2826493 - DNA, 20 bp, Homo sapiens
ataatttaactaatttaaac

SEQ ID NO: 2826494 - DNA, 15 bp, Homo sapiens
ataattttaaacaaa

SEQ ID NO: 2826495 - DNA, 14 bp, Homo sapiens
ataattttaaattc

SEQ ID NO: 2826496 - DNA, 23 bp, Homo sapiens
ataattttcaagagaagaaaaaa

SEQ ID NO: 2826497 - DNA, 14 bp, Homo sapiens
ataattttcctcct

SEQ ID NO: 2826498 - DNA, 21 bp, Homo sapiens
ataattttcctcctaaacaaa

SEQ ID NO: 2826499 - DNA, 17 bp, Homo sapiens
ataattttcttcatgca

SEQ ID NO: 2826500 - DNA, 15 bp, Homo sapiens
ataattttgcagcag

SEQ ID NO: 2826501 - DNA, 17 bp, Homo sapiens
ataattttgcagcagaa

SEQ ID NO: 2826502 - DNA, 20 bp, Homo sapiens
ataatttttttcaatattta

SEQ ID NO: 2826503 - DNA, 23 bp, Homo sapiens
atacaaaaatgagctaggcatgg

SEQ ID NO: 2826504 - DNA, 12 bp, Homo sapiens
atacaaaataat

SEQ ID NO: 2826505 - DNA, 15 bp, Homo sapiens
atacaaaataattta

SEQ ID NO: 2826506 - DNA, 16 bp, Homo sapiens
atacaaaataatttaa

SEQ ID NO: 2826507 - DNA, 15 bp, Homo sapiens
atacaatttgcactg

SEQ ID NO: 2826508 - DNA, 16 bp, Homo sapiens
atacaatttgcactgt

SEQ ID NO: 2826509 - DNA, 15 bp, Homo sapiens
atacacaacacacac

SEQ ID NO: 2826510 - DNA, 15 bp, Homo sapiens
atacacaagtaaaca

SEQ ID NO: 2826511 - DNA, 14 bp, Homo sapiens
atacacaggatcct

SEQ ID NO: 2826512 - DNA, 21 bp, Homo sapiens
atacaccacctcactcctgtt

SEQ ID NO: 2826513 - DNA, 12 bp, Homo sapiens
atacagacacta

SEQ ID NO: 2826514 - DNA, 20 bp, Homo sapiens
atacagtaaagtttaaaaaa

SEQ ID NO: 2826515 - DNA, 21 bp, Homo sapiens
atacagtaaagtttaaaaaat

SEQ ID NO: 2826516 - DNA, 14 bp, Homo sapiens
atacagtgttattt

SEQ ID NO: 2826517 - DNA, 15 bp, Homo sapiens
atacagtgttatttt

SEQ ID NO: 2826518 - DNA, 17 bp, Homo sapiens
atacataacttgatata

SEQ ID NO: 2826519 - DNA, 14 bp, Homo sapiens
atacatagtcacaa

SEQ ID NO: 2826520 - DNA, 17 bp, Homo sapiens
atacatagtcacaaaaa

SEQ ID NO: 2826521 - DNA, 18 bp, Homo sapiens
atacatagtcacaaaaat

SEQ ID NO: 2826522 - DNA, 17 bp, Homo sapiens
atacatatcagaaaagt

SEQ ID NO: 2826523 - DNA, 14 bp, Homo sapiens
atcacttttctgta

SEQ ID NO: 2826524 - DNA, 13 bp, Homo sapiens
atcagaaaagtag

SEQ ID NO: 2826525 - DNA, 15 bp, Homo sapiens
atcagaaaagtagaa

SEQ ID NO: 2826526 - DNA, 21 bp, Homo sapiens
atcagaaaagtagaattatat

SEQ ID NO: 2826527 - DNA, 17 bp, Homo sapiens
atcagaaagggagggct

SEQ ID NO: 2826528 - DNA, 21 bp, Homo sapiens
atcagaaagggagggctctga

SEQ ID NO: 2826529 - DNA, 13 bp, Homo sapiens
atcagaacagcag

SEQ ID NO: 2826530 - DNA, 16 bp, Homo sapiens
atcagaattttaccaa

SEQ ID NO: 2826531 - DNA, 20 bp, Homo sapiens
atcagaccctaccccaccac

SEQ ID NO: 2826532 - DNA, 12 bp, Homo sapiens
atcagacctctg

SEQ ID NO: 2826533 - DNA, 17 bp, Homo sapiens
atcagaggctgggggag

SEQ ID NO: 2826534 - DNA, 13 bp, Homo sapiens
atcagcctcttaa

SEQ ID NO: 2826535 - DNA, 17 bp, Homo sapiens
atcagcctgagtctcct

SEQ ID NO: 2826536 - DNA, 22 bp, Homo sapiens
atcagcctgagtctcctgtgcc

SEQ ID NO: 2826537 - DNA, 12 bp, Homo sapiens
atcagcgtggcc

SEQ ID NO: 2826538 - DNA, 16 bp, Homo sapiens
atcaggtcctcagaga

SEQ ID NO: 2826539 - DNA, 19 bp, Homo sapiens
atcaggtgctgccatccag

SEQ ID NO: 2826540 - DNA, 15 bp, Homo sapiens
atcaggttccatccc

SEQ ID NO: 2826541 - DNA, 17 bp, Homo sapiens
atcaggttgttaatgtt

SEQ ID NO: 2826542 - DNA, 21 bp, Homo sapiens
atcagtatgctgttttaataa

SEQ ID NO: 2826543 - DNA, 15 bp, Homo sapiens
atcagttactcagcc

SEQ ID NO: 2826544 - DNA, 19 bp, Homo sapiens
atcagttactcagccctgg

SEQ ID NO: 2826545 - DNA, 22 bp, Homo sapiens
atcagttactggtttcagttga

SEQ ID NO: 2826546 - DNA, 21 bp, Homo sapiens
atcagttttttcacctggaag

SEQ ID NO: 2826547 - DNA, 12 bp, Homo sapiens
atcataaaataa

SEQ ID NO: 2826548 - DNA, 13 bp, Homo sapiens
atcataattttca

SEQ ID NO: 2826549 - DNA, 13 bp, Homo sapiens
atcatattgtatg

SEQ ID NO: 2826550 - DNA, 16 bp, Homo sapiens
atcatcagtgtagaac

SEQ ID NO: 2826551 - DNA, 15 bp, Homo sapiens
atcatcatagaaaaa

SEQ ID NO: 2826552 - DNA, 21 bp, Homo sapiens
atcatccactgtgccatgtgc

SEQ ID NO: 2826553 - DNA, 15 bp, Homo sapiens
atcatgaaaagtgct

SEQ ID NO: 2826554 - DNA, 18 bp, Homo sapiens
atcatgaatatttcaaaa

SEQ ID NO: 2826555 - DNA, 20 bp, Homo sapiens
atcatgaatatttcaaaata

SEQ ID NO: 2826556 - DNA, 23 bp, Homo sapiens
atcatgatctgactttaattgtg

SEQ ID NO: 2826557 - DNA, 14 bp, Homo sapiens
atcatgcctctgag

SEQ ID NO: 2826558 - DNA, 20 bp, Homo sapiens
atcatgcctctgaggccagc

SEQ ID NO: 2826559 - DNA, 22 bp, Homo sapiens
atcatgcctctgaggccagcct

SEQ ID NO: 2826560 - DNA, 14 bp, Homo sapiens
atcatgtctggcta

SEQ ID NO: 2826561 - DNA, 16 bp, Homo sapiens
atcattaaattggaat

SEQ ID NO: 2826562 - DNA, 19 bp, Homo sapiens
atcatttcttttccaaaat

SEQ ID NO: 2826563 - DNA, 18 bp, Homo sapiens
atcatttgttggaatgaa

SEQ ID NO: 2826564 - DNA, 22 bp, Homo sapiens
atcattttgcaatcccttaata

SEQ ID NO: 2826565 - DNA, 21 bp, Homo sapiens
atccaaaggaatcagctgcag

SEQ ID NO: 2826566 - DNA, 14 bp, Homo sapiens
atccaaggagaaac

SEQ ID NO: 2826567 - DNA, 19 bp, Homo sapiens
atccaagttgaaatcagaa

SEQ ID NO: 2826568 - DNA, 16 bp, Homo sapiens
atccaattatgtgaca

SEQ ID NO: 2826569 - DNA, 13 bp, Homo sapiens
atccacccacctc

SEQ ID NO: 2826570 - DNA, 20 bp, Homo sapiens
atccacccacctcagcctcc

SEQ ID NO: 2826571 - DNA, 14 bp, Homo sapiens
atccacccagccca

SEQ ID NO: 2826572 - DNA, 13 bp, Homo sapiens
atccagaaagaaa

SEQ ID NO: 2826573 - DNA, 13 bp, Homo sapiens
atccaggactctg

SEQ ID NO: 2826574 - DNA, 16 bp, Homo sapiens
atccagttcatgagaa

SEQ ID NO: 2826575 - DNA, 16 bp, Homo sapiens
atccagttgcaataaa

SEQ ID NO: 2826576 - DNA, 20 bp, Homo sapiens
atccagttgcaataaaatag

SEQ ID NO: 2826577 - DNA, 21 bp, Homo sapiens
atccagttgcaataaaatagt

SEQ ID NO: 2826578 - DNA, 22 bp, Homo sapiens
atccagttgcaataaaatagta

SEQ ID NO: 2826579 - DNA, 19 bp, Homo sapiens
atccagtttcccaccacct

SEQ ID NO: 2826580 - DNA, 14 bp, Homo sapiens
atccatcagctccc

SEQ ID NO: 2826581 - DNA, 14 bp, Homo sapiens
atccatcaggactt

SEQ ID NO: 2826582 - DNA, 20 bp, Homo sapiens
atccatgttagtttttactt

SEQ ID NO: 2826583 - DNA, 18 bp, Homo sapiens
atccattcctcagggaca

SEQ ID NO: 2826584 - DNA, 18 bp, Homo sapiens
atccatttcatctatttc

SEQ ID NO: 2826585 - DNA, 20 bp, Homo sapiens
atcccacccacatgtgacac

SEQ ID NO: 2826586 - DNA, 21 bp, Homo sapiens
atcccagccctacccttgtta

SEQ ID NO: 2826587 - DNA, 19 bp, Homo sapiens
atcccaggggaccacacct

SEQ ID NO: 2826588 - DNA, 13 bp, Homo sapiens
atcccatgagcct

SEQ ID NO: 2826589 - DNA, 17 bp, Homo sapiens
atcccatgagcctcagc

SEQ ID NO: 2826590 - DNA, 18 bp, Homo sapiens
atcccatgagcctcagca

SEQ ID NO: 2826591 - DNA, 14 bp, Homo sapiens
atcccattgccctg

SEQ ID NO: 2826592 - DNA, 17 bp, Homo sapiens
atcccattgccctggtt

SEQ ID NO: 2826593 - DNA, 16 bp, Homo sapiens
atccccaagctggcag

SEQ ID NO: 2826594 - DNA, 16 bp, Homo sapiens
atcccccactgccaca

SEQ ID NO: 2826595 - DNA, 12 bp, Homo sapiens
atcccccagcct

SEQ ID NO: 2826596 - DNA, 14 bp, Homo sapiens
atcccctttcctcc

SEQ ID NO: 2826597 - DNA, 16 bp, Homo sapiens
atcccctttcctcccc

SEQ ID NO: 2826598 - DNA, 22 bp, Homo sapiens
atcccgcctcttcttcttcaga

SEQ ID NO: 2826599 - DNA, 18 bp, Homo sapiens
atccctgaggtcacctgg

SEQ ID NO: 2826600 - DNA, 13 bp, Homo sapiens
atccctgggcctg

SEQ ID NO: 2826601 - DNA, 14 bp, Homo sapiens
atccctgggcctgc

SEQ ID NO: 2826602 - DNA, 15 bp, Homo sapiens
atccctgggcctgct

SEQ ID NO: 2826603 - DNA, 18 bp, Homo sapiens
atccctgttacccagaga

SEQ ID NO: 2826604 - DNA, 21 bp, Homo sapiens
atcccttaatatcctaaacat

SEQ ID NO: 2826605 - DNA, 14 bp, Homo sapiens
atcctaaacatcat

SEQ ID NO: 2826606 - DNA, 21 bp, Homo sapiens
atcctaatgacttctaaaaat

SEQ ID NO: 2826607 - DNA, 20 bp, Homo sapiens
atcctattaaaacacagctt

SEQ ID NO: 2826608 - DNA, 20 bp, Homo sapiens
atcctattctcaccaggaag

SEQ ID NO: 2826609 - DNA, 17 bp, Homo sapiens
atcctcaaagcccccac

SEQ ID NO: 2826610 - DNA, 18 bp, Homo sapiens
atcctcccacctcagcct

SEQ ID NO: 2826611 - DNA, 10 bp, Homo sapiens
atcctctggc

SEQ ID NO: 2826612 - DNA, 20 bp, Homo sapiens
atcctgcagcctcctcctga

SEQ ID NO: 2826613 - DNA, 19 bp, Homo sapiens
atcctggcacccggcccct

SEQ ID NO: 2826614 - DNA, 13 bp, Homo sapiens
atgccaacatacc

SEQ ID NO: 2826615 - DNA, 22 bp, Homo sapiens
atgccaattagcaattgactgt

SEQ ID NO: 2826616 - DNA, 19 bp, Homo sapiens
atgccaccctgttttcagc

SEQ ID NO: 2826617 - DNA, 22 bp, Homo sapiens
atgccagagacggaagcctttt

SEQ ID NO: 2826618 - DNA, 18 bp, Homo sapiens
atgccagctcagtcccat

SEQ ID NO: 2826619 - DNA, 19 bp, Homo sapiens
atgccagctcagtcccatc

SEQ ID NO: 2826620 - DNA, 17 bp, Homo sapiens
atgccatggacagaaga

SEQ ID NO: 2826621 - DNA, 16 bp, Homo sapiens
atgccatttgtactga

SEQ ID NO: 2826622 - DNA, 14 bp, Homo sapiens
atgccctggatcca

SEQ ID NO: 2826623 - DNA, 16 bp, Homo sapiens
atgcctacagataatt

SEQ ID NO: 2826624 - DNA, 17 bp, Homo sapiens
atgcctacagataattt

SEQ ID NO: 2826625 - DNA, 14 bp, Homo sapiens
atgcctctcccgca

SEQ ID NO: 2826626 - DNA, 15 bp, Homo sapiens
atgcctctcccgcac

SEQ ID NO: 2826627 - DNA, 23 bp, Homo sapiens
atgcctctgaggccagcctggcc

SEQ ID NO: 2826628 - DNA, 12 bp, Homo sapiens
atgcctgagggt

SEQ ID NO: 2826629 - DNA, 14 bp, Homo sapiens
atgcctgagggtgg

SEQ ID NO: 2826630 - DNA, 20 bp, Homo sapiens
atgcctggcccccctccagg

SEQ ID NO: 2826631 - DNA, 15 bp, Homo sapiens
atgcctggtggcagc

SEQ ID NO: 2826632 - DNA, 16 bp, Homo sapiens
atgccttgtctgggga

SEQ ID NO: 2826633 - DNA, 21 bp, Homo sapiens
atgcctttctagtcctattct

SEQ ID NO: 2826634 - DNA, 22 bp, Homo sapiens
atgcctttctagtcctattcta

SEQ ID NO: 2826635 - DNA, 13 bp, Homo sapiens
atgcgctgctcaa

SEQ ID NO: 2826636 - DNA, 18 bp, Homo sapiens
atgcgctgctcaacctct

SEQ ID NO: 2826637 - DNA, 13 bp, Homo sapiens
atgctaaatgcaa

SEQ ID NO: 2826638 - DNA, 19 bp, Homo sapiens
atgctaaatgcaaacactg

SEQ ID NO: 2826639 - DNA, 15 bp, Homo sapiens
atgctcaagtttttc

SEQ ID NO: 2826640 - DNA, 13 bp, Homo sapiens
atgctcagccctg

SEQ ID NO: 2826641 - DNA, 13 bp, Homo sapiens
atgctctctgcag

SEQ ID NO: 2826642 - DNA, 19 bp, Homo sapiens
atgctctctgcagccagcc

SEQ ID NO: 2826643 - DNA, 22 bp, Homo sapiens
atgctctctgcagccagcccag

SEQ ID NO: 2826644 - DNA, 23 bp, Homo sapiens
atgctctctgcagccagcccagc

SEQ ID NO: 2826645 - DNA, 13 bp, Homo sapiens
atgctgaattatt

SEQ ID NO: 2826646 - DNA, 18 bp, Homo sapiens
atgctgaattattttgtt

SEQ ID NO: 2826647 - DNA, 18 bp, Homo sapiens
atgctgacttgcagagtt

SEQ ID NO: 2826648 - DNA, 12 bp, Homo sapiens
atgctgcctcca

SEQ ID NO: 2826649 - DNA, 12 bp, Homo sapiens
atgctgcctgag

SEQ ID NO: 2826650 - DNA, 13 bp, Homo sapiens
atgctgcctgagt

SEQ ID NO: 2826651 - DNA, 22 bp, Homo sapiens
atgctggacggcattcctgctt

SEQ ID NO: 2826652 - DNA, 22 bp, Homo sapiens
atgctggcctcccaataaagct

SEQ ID NO: 2826653 - DNA, 22 bp, Homo sapiens
atgctggggcaagtccctgact

SEQ ID NO: 2826654 - DNA, 22 bp, Homo sapiens
atgctggttttcctaaatgcag

SEQ ID NO: 2826655 - DNA, 14 bp, Homo sapiens
atgctgttgcctca

SEQ ID NO: 2826656 - DNA, 18 bp, Homo sapiens
atgctgttgcctcatcta

SEQ ID NO: 2826657 - DNA, 15 bp, Homo sapiens
atgctgttttaataa

SEQ ID NO: 2826658 - DNA, 20 bp, Homo sapiens
atgctgttttaataattatg

SEQ ID NO: 2826659 - DNA, 15 bp, Homo sapiens
atgcttacaaaaaag

SEQ ID NO: 2826660 - DNA, 21 bp, Homo sapiens
atgcttattttaaaattttat

SEQ ID NO: 2826661 - DNA, 14 bp, Homo sapiens
atgcttcagttgta

SEQ ID NO: 2826662 - DNA, 14 bp, Homo sapiens
atgcttcttgcccc

SEQ ID NO: 2826663 - DNA, 23 bp, Homo sapiens
atgctttatgtttaaaaacattc

SEQ ID NO: 2826664 - DNA, 15 bp, Homo sapiens
atggaaactggccag

SEQ ID NO: 2826665 - DNA, 11 bp, Homo sapiens
atggaaagaat

SEQ ID NO: 2826666 - DNA, 15 bp, Homo sapiens
atggaaatcctgtta

SEQ ID NO: 2826667 - DNA, 18 bp, Homo sapiens
atggaaattctgctcaga

SEQ ID NO: 2826668 - DNA, 16 bp, Homo sapiens
atggaagattttaaat

SEQ ID NO: 2826669 - DNA, 17 bp, Homo sapiens
atggaaggtttgtatat

SEQ ID NO: 2826670 - DNA, 17 bp, Homo sapiens
atggaatacagtgttat

SEQ ID NO: 2826671 - DNA, 21 bp, Homo sapiens
atggacaccccttatccagga

SEQ ID NO: 2826672 - DNA, 22 bp, Homo sapiens
atggacaccccttatccaggac

SEQ ID NO: 2826673 - DNA, 23 bp, Homo sapiens
atggacaccccttatccaggact

SEQ ID NO: 2826674 - DNA, 14 bp, Homo sapiens
atggagaaaccctg

SEQ ID NO: 2826675 - DNA, 14 bp, Homo sapiens
atggagacagcgaa

SEQ ID NO: 2826676 - DNA, 17 bp, Homo sapiens
atggagagaggggaata

SEQ ID NO: 2826677 - DNA, 15 bp, Homo sapiens
atggagagccctggg

SEQ ID NO: 2826678 - DNA, 16 bp, Homo sapiens
atggagagccctggga

SEQ ID NO: 2826679 - DNA, 17 bp, Homo sapiens
atggagagggggtacaa

SEQ ID NO: 2826680 - DNA, 21 bp, Homo sapiens
atggagccagctctgcattat

SEQ ID NO: 2826681 - DNA, 13 bp, Homo sapiens
atggagcttgtac

SEQ ID NO: 2826682 - DNA, 15 bp, Homo sapiens
atggaggagaagaat

SEQ ID NO: 2826683 - DNA, 16 bp, Homo sapiens
atggagggaataatac

SEQ ID NO: 2826684 - DNA, 22 bp, Homo sapiens
atggagtgacggtcccacactg

SEQ ID NO: 2826685 - DNA, 17 bp, Homo sapiens
atggatgtggggtcccc

SEQ ID NO: 2826686 - DNA, 15 bp, Homo sapiens
atggattctaaaatg

SEQ ID NO: 2826687 - DNA, 14 bp, Homo sapiens
atggatttgaagca

SEQ ID NO: 2826688 - DNA, 16 bp, Homo sapiens
atggcaattttgtaac

SEQ ID NO: 2826689 - DNA, 14 bp, Homo sapiens
atggcaccagaggc

SEQ ID NO: 2826690 - DNA, 14 bp, Homo sapiens
atggcagatgtagg

SEQ ID NO: 2826691 - DNA, 20 bp, Homo sapiens
atggcagatgtaggagggac

SEQ ID NO: 2826692 - DNA, 12 bp, Homo sapiens
atggcagctgga

SEQ ID NO: 2826693 - DNA, 21 bp, Homo sapiens
atggcagtccagccagctcct

SEQ ID NO: 2826694 - DNA, 18 bp, Homo sapiens
atggcagtgttcctattt

SEQ ID NO: 2826695 - DNA, 19 bp, Homo sapiens
atggcgctattgcactcca

SEQ ID NO: 2826696 - DNA, 15 bp, Homo sapiens
atggcgttgcaggcc

SEQ ID NO: 2826697 - DNA, 13 bp, Homo sapiens
atggctgcctgca

SEQ ID NO: 2826698 - DNA, 17 bp, Homo sapiens
atggctgtgcctctgcc

SEQ ID NO: 2826699 - DNA, 19 bp, Homo sapiens
atggctgtgcctctgcctg

SEQ ID NO: 2826700 - DNA, 14 bp, Homo sapiens
atgggaagacatga

SEQ ID NO: 2826701 - DNA, 20 bp, Homo sapiens
atgggagctggttagaaatg

SEQ ID NO: 2826702 - DNA, 17 bp, Homo sapiens
atgggatctgtaaggaa

SEQ ID NO: 2826703 - DNA, 23 bp, Homo sapiens
atgggattcagtgcttcttaaag

SEQ ID NO: 2826704 - DNA, 13 bp, Homo sapiens
atgggatttcatg

SEQ ID NO: 2826705 - DNA, 21 bp, Homo sapiens
attgaaaatagtaaatgcttt

SEQ ID NO: 2826706 - DNA, 20 bp, Homo sapiens
attgaaatataatgcaaacc

SEQ ID NO: 2826707 - DNA, 22 bp, Homo sapiens
attgaacaagttgtttcattga

SEQ ID NO: 2826708 - DNA, 15 bp, Homo sapiens
attgaacccaggagg

SEQ ID NO: 2826709 - DNA, 23 bp, Homo sapiens
attgaagagatttcaacatatca

SEQ ID NO: 2826710 - DNA, 16 bp, Homo sapiens
attgaaggagaaaatg

SEQ ID NO: 2826711 - DNA, 19 bp, Homo sapiens
attgaaggagaaaatgcat

SEQ ID NO: 2826712 - DNA, 19 bp, Homo sapiens
attgaataagtattcttca

SEQ ID NO: 2826713 - DNA, 13 bp, Homo sapiens
attgacacacagc

SEQ ID NO: 2826714 - DNA, 15 bp, Homo sapiens
attgacacacagcac

SEQ ID NO: 2826715 - DNA, 17 bp, Homo sapiens
attgacacacagcactc

SEQ ID NO: 2826716 - DNA, 13 bp, Homo sapiens
attgacagaagct

SEQ ID NO: 2826717 - DNA, 21 bp, Homo sapiens
attgagaattttaaattataa

SEQ ID NO: 2826718 - DNA, 19 bp, Homo sapiens
attgagataatatctgtga

SEQ ID NO: 2826719 - DNA, 20 bp, Homo sapiens
attgagataatatctgtgag

SEQ ID NO: 2826720 - DNA, 21 bp, Homo sapiens
attgagataatatctgtgagg

SEQ ID NO: 2826721 - DNA, 21 bp, Homo sapiens
attgagatgtgtttttaatgt

SEQ ID NO: 2826722 - DNA, 18 bp, Homo sapiens
attgatagagtgttatca

SEQ ID NO: 2826723 - DNA, 13 bp, Homo sapiens
attgatgtttcca

SEQ ID NO: 2826724 - DNA, 16 bp, Homo sapiens
attgatgtttccagaa

SEQ ID NO: 2826725 - DNA, 17 bp, Homo sapiens
attgatgtttccagaaa

SEQ ID NO: 2826726 - DNA, 19 bp, Homo sapiens
attgatgtttccagaaaat

SEQ ID NO: 2826727 - DNA, 13 bp, Homo sapiens
attgcactccagt

SEQ ID NO: 2826728 - DNA, 16 bp, Homo sapiens
attgcatgtaaaatgc

SEQ ID NO: 2826729 - DNA, 19 bp, Homo sapiens
attgcattctgaatgaata

SEQ ID NO: 2826730 - DNA, 14 bp, Homo sapiens
attgcatttctgct

SEQ ID NO: 2826731 - DNA, 17 bp, Homo sapiens
attgcccacgctggagt

SEQ ID NO: 2826732 - DNA, 17 bp, Homo sapiens
attgcctgcagagagaa

SEQ ID NO: 2826733 - DNA, 18 bp, Homo sapiens
attgcggacagccacggc

SEQ ID NO: 2826734 - DNA, 19 bp, Homo sapiens
attgcggacagccacggcc

SEQ ID NO: 2826735 - DNA, 14 bp, Homo sapiens
attgctactgtcct

SEQ ID NO: 2826736 - DNA, 15 bp, Homo sapiens
attgctactgtccta

SEQ ID NO: 2826737 - DNA, 22 bp, Homo sapiens
attgctactgtcctacccaccc

SEQ ID NO: 2826738 - DNA, 15 bp, Homo sapiens
attgctgctctctga

SEQ ID NO: 2826739 - DNA, 18 bp, Homo sapiens
attgctgctctctgaggg

SEQ ID NO: 2826740 - DNA, 16 bp, Homo sapiens
attgcttaaaatagca

SEQ ID NO: 2826741 - DNA, 13 bp, Homo sapiens
attgcttaatccc

SEQ ID NO: 2826742 - DNA, 19 bp, Homo sapiens
attgcttgaaccggggaga

SEQ ID NO: 2826743 - DNA, 14 bp, Homo sapiens
attggaagaaattc

SEQ ID NO: 2826744 - DNA, 18 bp, Homo sapiens
attggaagaaattcctgt

SEQ ID NO: 2826745 - DNA, 20 bp, Homo sapiens
attggctcccaactcctccc

SEQ ID NO: 2826746 - DNA, 19 bp, Homo sapiens
attggctcccatctgaacc

SEQ ID NO: 2826747 - DNA, 19 bp, Homo sapiens
attggcttattttttaaaa

SEQ ID NO: 2826748 - DNA, 17 bp, Homo sapiens
attgggaagctggggga

SEQ ID NO: 2826749 - DNA, 15 bp, Homo sapiens
attggtgataagtgg

SEQ ID NO: 2826750 - DNA, 12 bp, Homo sapiens
attgtaaaaaaa

SEQ ID NO: 2826751 - DNA, 21 bp, Homo sapiens
attgtaatgaatatctgcttt

SEQ ID NO: 2826752 - DNA, 15 bp, Homo sapiens
attgtacatatggaa

SEQ ID NO: 2826753 - DNA, 13 bp, Homo sapiens
attgtagtaatct

SEQ ID NO: 2826754 - DNA, 14 bp, Homo sapiens
attgtataaaaata

SEQ ID NO: 2826755 - DNA, 15 bp, Homo sapiens
attgtataaaaatag

SEQ ID NO: 2826756 - DNA, 22 bp, Homo sapiens
attgtataagattagaatgaaa

SEQ ID NO: 2826757 - DNA, 17 bp, Homo sapiens
attgtcattactgcctt

SEQ ID NO: 2826758 - DNA, 20 bp, Homo sapiens
attgtcattactgcctttgg

SEQ ID NO: 2826759 - DNA, 12 bp, Homo sapiens
attgtccatatc

SEQ ID NO: 2826760 - DNA, 23 bp, Homo sapiens
attgtccatatcagacctctgat

SEQ ID NO: 2826761 - DNA, 20 bp, Homo sapiens
attgtcttttgtcatgtggc

SEQ ID NO: 2826762 - DNA, 18 bp, Homo sapiens
attgtgccatgtcaaaca

SEQ ID NO: 2826763 - DNA, 22 bp, Homo sapiens
attgtgtacaaagtagagaagt

SEQ ID NO: 2826764 - DNA, 17 bp, Homo sapiens
attgtgtcagactgttt

SEQ ID NO: 2826765 - DNA, 16 bp, Homo sapiens
attgtgtgttatttaa

SEQ ID NO: 2826766 - DNA, 20 bp, Homo sapiens
attgtgttgccttagcactt

SEQ ID NO: 2826767 - DNA, 13 bp, Homo sapiens
attgttaaaacct

SEQ ID NO: 2826768 - DNA, 18 bp, Homo sapiens
attgttccaaatgaatgt

SEQ ID NO: 2826769 - DNA, 21 bp, Homo sapiens
attgtttaagtgttgtaaata

SEQ ID NO: 2826770 - DNA, 15 bp, Homo sapiens
attgtttatttatca

SEQ ID NO: 2826771 - DNA, 19 bp, Homo sapiens
attgtttatttatcagtga

SEQ ID NO: 2826772 - DNA, 20 bp, Homo sapiens
attgtttctttaagaaagta

SEQ ID NO: 2826773 - DNA, 20 bp, Homo sapiens
attgttttatggtgtgttcc

SEQ ID NO: 2826774 - DNA, 17 bp, Homo sapiens
atttaaaaaactaaaaa

SEQ ID NO: 2826775 - DNA, 13 bp, Homo sapiens
atttaaaaaataa

SEQ ID NO: 2826776 - DNA, 18 bp, Homo sapiens
atttaaaaaataaatata

SEQ ID NO: 2826777 - DNA, 21 bp, Homo sapiens
atttaaaaaataaatataatt

SEQ ID NO: 2826778 - DNA, 20 bp, Homo sapiens
atttaaaatagcaaaagaag

SEQ ID NO: 2826779 - DNA, 13 bp, Homo sapiens
atttaaaccagca

SEQ ID NO: 2826780 - DNA, 18 bp, Homo sapiens
atttaaaccgctaaaaga

SEQ ID NO: 2826781 - DNA, 19 bp, Homo sapiens
atttaaactataagcaaga

SEQ ID NO: 2826782 - DNA, 18 bp, Homo sapiens
atttaaattctttttcaa

SEQ ID NO: 2826783 - DNA, 15 bp, Homo sapiens
atttaacactaaaaa

SEQ ID NO: 2826784 - DNA, 14 bp, Homo sapiens
atttaactaattta

SEQ ID NO: 2826785 - DNA, 13 bp, Homo sapiens
atttaactgcctt

SEQ ID NO: 2826786 - DNA, 17 bp, Homo sapiens
atttaacttttagtaaa

SEQ ID NO: 2826787 - DNA, 21 bp, Homo sapiens
atttaacttttagtaaagtca

SEQ ID NO: 2826788 - DNA, 23 bp, Homo sapiens
atttaacttttagtaaagtcaag

SEQ ID NO: 2826789 - DNA, 13 bp, Homo sapiens
atttaatatctga

SEQ ID NO: 2826790 - DNA, 16 bp, Homo sapiens
atttaatatctgagaa

SEQ ID NO: 2826791 - DNA, 13 bp, Homo sapiens
atttaattaaaaa

SEQ ID NO: 2826792 - DNA, 13 bp, Homo sapiens
atttaattcataa

SEQ ID NO: 2826793 - DNA, 14 bp, Homo sapiens
atttaattcataat

SEQ ID NO: 2826794 - DNA, 18 bp, Homo sapiens
atttaattcataattaga

SEQ ID NO: 2826795 - DNA, 22 bp, Homo sapiens
atttaattgtgtcatattaaac

SEQ ID NO: 2826796 - DNA, 18 bp, Homo sapiens
caacctttccctcacccc

SEQ ID NO: 2826797 - DNA, 19 bp, Homo sapiens
caacctttccctcaccccc

SEQ ID NO: 2826798 - DNA, 19 bp, Homo sapiens
caactagatcaaggagccc

SEQ ID NO: 2826799 - DNA, 13 bp, Homo sapiens
caactccagctcc

SEQ ID NO: 2826800 - DNA, 17 bp, Homo sapiens
caactcctggaagctgt

SEQ ID NO: 2826801 - DNA, 12 bp, Homo sapiens
caactctctcct

SEQ ID NO: 2826802 - DNA, 17 bp, Homo sapiens
caactgaggcagacagc

SEQ ID NO: 2826803 - DNA, 22 bp, Homo sapiens
caactgaggcagacagcagctc

SEQ ID NO: 2826804 - DNA, 14 bp, Homo sapiens
caacttaaatcact

SEQ ID NO: 2826805 - DNA, 21 bp, Homo sapiens
caacttaatgttctgaataat

SEQ ID NO: 2826806 - DNA, 18 bp, Homo sapiens
caacttcaagtgcatgct

SEQ ID NO: 2826807 - DNA, 23 bp, Homo sapiens
caacttcccagttcaggagtccc

SEQ ID NO: 2826808 - DNA, 16 bp, Homo sapiens
caacttgtaaatacac

SEQ ID NO: 2826809 - DNA, 20 bp, Homo sapiens
caacttttcctttgaatcct

SEQ ID NO: 2826810 - DNA, 12 bp, Homo sapiens
caagaaagtcca

SEQ ID NO: 2826811 - DNA, 12 bp, Homo sapiens
caagaagaatat

SEQ ID NO: 2826812 - DNA, 18 bp, Homo sapiens
caagaagaatataaataa

SEQ ID NO: 2826813 - DNA, 12 bp, Homo sapiens
caagaagacatg

SEQ ID NO: 2826814 - DNA, 13 bp, Homo sapiens
caagaagaccaga

SEQ ID NO: 2826815 - DNA, 15 bp, Homo sapiens
caagaagcaggaagg

SEQ ID NO: 2826816 - DNA, 13 bp, Homo sapiens
caagaagctgcta

SEQ ID NO: 2826817 - DNA, 20 bp, Homo sapiens
caagaaggaaatagccaccg

SEQ ID NO: 2826818 - DNA, 19 bp, Homo sapiens
caagaagtcaaagtaaaac

SEQ ID NO: 2826819 - DNA, 14 bp, Homo sapiens
caagaatacagaaa

SEQ ID NO: 2826820 - DNA, 17 bp, Homo sapiens
caagaatacagaaaatg

SEQ ID NO: 2826821 - DNA, 21 bp, Homo sapiens
caagaattggaagctgccctg

SEQ ID NO: 2826822 - DNA, 22 bp, Homo sapiens
caagaatttcttggtaagaagc

SEQ ID NO: 2826823 - DNA, 14 bp, Homo sapiens
caagacaaagcaaa

SEQ ID NO: 2826824 - DNA, 20 bp, Homo sapiens
caagacgtcctggaatgaag

SEQ ID NO: 2826825 - DNA, 14 bp, Homo sapiens
caagactccgtctc

SEQ ID NO: 2826826 - DNA, 21 bp, Homo sapiens
caagactccgtctcaaaaaaa

SEQ ID NO: 2826827 - DNA, 20 bp, Homo sapiens
caagacttctctttgcctca

SEQ ID NO: 2826828 - DNA, 12 bp, Homo sapiens
caagagaacatt

SEQ ID NO: 2826829 - DNA, 21 bp, Homo sapiens
caagagaagaaaaaattaaga

SEQ ID NO: 2826830 - DNA, 22 bp, Homo sapiens
caagagaattgcttgaacccag

SEQ ID NO: 2826831 - DNA, 12 bp, Homo sapiens
caagagactgag

SEQ ID NO: 2826832 - DNA, 15 bp, Homo sapiens
caagagcagaggcag

SEQ ID NO: 2826833 - DNA, 19 bp, Homo sapiens
caagagcatcatgcctctg

SEQ ID NO: 2826834 - DNA, 21 bp, Homo sapiens
caagagcatcatgcctctgag

SEQ ID NO: 2826835 - DNA, 22 bp, Homo sapiens
caagagccatgtaccagtgtac

SEQ ID NO: 2826836 - DNA, 23 bp, Homo sapiens
caagagccttggtgtccacctgg

SEQ ID NO: 2826837 - DNA, 18 bp, Homo sapiens
caagagcgaaactccgtc

SEQ ID NO: 2826838 - DNA, 17 bp, Homo sapiens
caagagggtctgaggaa

SEQ ID NO: 2826839 - DNA, 22 bp, Homo sapiens
caagagttctttaggtgcctcc

SEQ ID NO: 2826840 - DNA, 23 bp, Homo sapiens
caagagttctttaggtgcctcct

SEQ ID NO: 2826841 - DNA, 15 bp, Homo sapiens
caagataactgagaa

SEQ ID NO: 2826842 - DNA, 19 bp, Homo sapiens
caagatcctgtctttaagg

SEQ ID NO: 2826843 - DNA, 16 bp, Homo sapiens
caagatcttgtctcca

SEQ ID NO: 2826844 - DNA, 13 bp, Homo sapiens
caagatctttcag

SEQ ID NO: 2826845 - DNA, 13 bp, Homo sapiens
caagatgacagct

SEQ ID NO: 2826846 - DNA, 14 bp, Homo sapiens
caagatgacagctc

SEQ ID NO: 2826847 - DNA, 19 bp, Homo sapiens
caagatgacagctcttcta

SEQ ID NO: 2826848 - DNA, 23 bp, Homo sapiens
caagatgacagctcttctaagga

SEQ ID NO: 2826849 - DNA, 21 bp, Homo sapiens
caagatgtcctccttgttcta

SEQ ID NO: 2826850 - DNA, 21 bp, Homo sapiens
caagattatattataataatg

SEQ ID NO: 2826851 - DNA, 14 bp, Homo sapiens
caagattcccagag

SEQ ID NO: 2826852 - DNA, 18 bp, Homo sapiens
caagattcccagagacag

SEQ ID NO: 2826853 - DNA, 23 bp, Homo sapiens
caagattcccagagacaggaaaa

SEQ ID NO: 2826854 - DNA, 13 bp, Homo sapiens
caagattgcttaa

SEQ ID NO: 2826855 - DNA, 23 bp, Homo sapiens
caagatttaacactaaaaaggtt

SEQ ID NO: 2826856 - DNA, 17 bp, Homo sapiens
caagattttccacaaga

SEQ ID NO: 2826857 - DNA, 18 bp, Homo sapiens
caagattttccacaagat

SEQ ID NO: 2826858 - DNA, 13 bp, Homo sapiens
caagcaataatta

SEQ ID NO: 2826859 - DNA, 16 bp, Homo sapiens
caagcacctcctgcct

SEQ ID NO: 2826860 - DNA, 17 bp, Homo sapiens
caagcacctcctgcctc

SEQ ID NO: 2826861 - DNA, 19 bp, Homo sapiens
caagcagagtgattcaggg

SEQ ID NO: 2826862 - DNA, 22 bp, Homo sapiens
caagcatggtcccacatccctg

SEQ ID NO: 2826863 - DNA, 23 bp, Homo sapiens
caagcatggtcccacatccctgg

SEQ ID NO: 2826864 - DNA, 16 bp, Homo sapiens
caagcattcagaagaa

SEQ ID NO: 2826865 - DNA, 18 bp, Homo sapiens
caagccaacgacaaagcc

SEQ ID NO: 2826866 - DNA, 19 bp, Homo sapiens
caagccaacgacaaagcca

SEQ ID NO: 2826867 - DNA, 15 bp, Homo sapiens
caagccaacttgtaa

SEQ ID NO: 2826868 - DNA, 20 bp, Homo sapiens
caagccaacttgtaaataca

SEQ ID NO: 2826869 - DNA, 11 bp, Homo sapiens
caagccacaga

SEQ ID NO: 2826870 - DNA, 15 bp, Homo sapiens
caagccagatttttt

SEQ ID NO: 2826871 - DNA, 17 bp, Homo sapiens
caagcgaggtcaacaga

SEQ ID NO: 2826872 - DNA, 20 bp, Homo sapiens
caagcgaggtcaacagagaa

SEQ ID NO: 2826873 - DNA, 22 bp, Homo sapiens
caagcgattcttctgcttcagc

SEQ ID NO: 2826874 - DNA, 16 bp, Homo sapiens
caagcgtgagccactg

SEQ ID NO: 2826875 - DNA, 18 bp, Homo sapiens
caagctagaaggccacat

SEQ ID NO: 2826876 - DNA, 16 bp, Homo sapiens
caagctcacagttcct

SEQ ID NO: 2826877 - DNA, 19 bp, Homo sapiens
caagctcacagttcctcgc

SEQ ID NO: 2826878 - DNA, 22 bp, Homo sapiens
caagctcacagttcctcgccct

SEQ ID NO: 2826879 - DNA, 17 bp, Homo sapiens
caagctccatctccact

SEQ ID NO: 2826880 - DNA, 16 bp, Homo sapiens
caagctctgctcctct

SEQ ID NO: 2826881 - DNA, 18 bp, Homo sapiens
caagctgaggtgcccagg

SEQ ID NO: 2826882 - DNA, 12 bp, Homo sapiens
caagctggaagc

SEQ ID NO: 2826883 - DNA, 23 bp, Homo sapiens
caagcttcaaccctcagccttga

SEQ ID NO: 2826884 - DNA, 17 bp, Homo sapiens
caagcttcaagtgatat

SEQ ID NO: 2826885 - DNA, 14 bp, Homo sapiens
caagcttgtatata

SEQ ID NO: 2826886 - DNA, 19 bp, Homo sapiens
caccaagctcacagttcct

SEQ ID NO: 2826887 - DNA, 16 bp, Homo sapiens
caccaataacttcaga

SEQ ID NO: 2826888 - DNA, 20 bp, Homo sapiens
caccaataacttcagagaag

SEQ ID NO: 2826889 - DNA, 21 bp, Homo sapiens
caccaataacttcagagaagt

SEQ ID NO: 2826890 - DNA, 24 bp, Homo sapiens
caccaataacttcagagaagtcag

SEQ ID NO: 2826891 - DNA, 17 bp, Homo sapiens
caccaatgtacccaccg

SEQ ID NO: 2826892 - DNA, 17 bp, Homo sapiens
caccacacccagcccac

SEQ ID NO: 2826893 - DNA, 15 bp, Homo sapiens
caccacaggctgcct

SEQ ID NO: 2826894 - DNA, 18 bp, Homo sapiens
caccacatgtgcacatgc

SEQ ID NO: 2826895 - DNA, 21 bp, Homo sapiens
caccaccagatgagaagttaa

SEQ ID NO: 2826896 - DNA, 23 bp, Homo sapiens
caccacctaggccactcctccaa

SEQ ID NO: 2826897 - DNA, 12 bp, Homo sapiens
caccacctctcc

SEQ ID NO: 2826898 - DNA, 13 bp, Homo sapiens
caccaccttccca

SEQ ID NO: 2826899 - DNA, 15 bp, Homo sapiens
caccaccttcccagc

SEQ ID NO: 2826900 - DNA, 16 bp, Homo sapiens
caccaccttcccagct

SEQ ID NO: 2826901 - DNA, 19 bp, Homo sapiens
caccaccttggactcctcc

SEQ ID NO: 2826902 - DNA, 13 bp, Homo sapiens
caccacgaatttg

SEQ ID NO: 2826903 - DNA, 22 bp, Homo sapiens
caccacgatgtggccctggcct

SEQ ID NO: 2826904 - DNA, 17 bp, Homo sapiens
caccactctggcagcca

SEQ ID NO: 2826905 - DNA, 18 bp, Homo sapiens
caccactctggcagccac

SEQ ID NO: 2826906 - DNA, 19 bp, Homo sapiens
caccactctggcagccaca

SEQ ID NO: 2826907 - DNA, 16 bp, Homo sapiens
caccacttcttttata

SEQ ID NO: 2826908 - DNA, 15 bp, Homo sapiens
caccagagcccacct

SEQ ID NO: 2826909 - DNA, 22 bp, Homo sapiens
caccagagcccaccttggctca

SEQ ID NO: 2826910 - DNA, 14 bp, Homo sapiens
caccagagcccatg

SEQ ID NO: 2826911 - DNA, 15 bp, Homo sapiens
caccagatgagaagt

SEQ ID NO: 2826912 - DNA, 17 bp, Homo sapiens
caccagatgagaagtta

SEQ ID NO: 2826913 - DNA, 13 bp, Homo sapiens
caccagcatgtca

SEQ ID NO: 2826914 - DNA, 14 bp, Homo sapiens
caccagcatgtcac

SEQ ID NO: 2826915 - DNA, 17 bp, Homo sapiens
caccagccccagtgccc

SEQ ID NO: 2826916 - DNA, 20 bp, Homo sapiens
caccagcccttccctgcttt

SEQ ID NO: 2826917 - DNA, 20 bp, Homo sapiens
caccagcctaagaagctctg

SEQ ID NO: 2826918 - DNA, 11 bp, Homo sapiens
caccaggaagg

SEQ ID NO: 2826919 - DNA, 21 bp, Homo sapiens
caccaggaatgttaaagtcag

SEQ ID NO: 2826920 - DNA, 13 bp, Homo sapiens
caccaggatggcc

SEQ ID NO: 2826921 - DNA, 15 bp, Homo sapiens
caccaggatggccct

SEQ ID NO: 2826922 - DNA, 21 bp, Homo sapiens
caccaggcacgaacccacctg

SEQ ID NO: 2826923 - DNA, 14 bp, Homo sapiens
caccaggccgggct

SEQ ID NO: 2826924 - DNA, 15 bp, Homo sapiens
caccagtcactgtcc

SEQ ID NO: 2826925 - DNA, 16 bp, Homo sapiens
caccagtgccgcctgt

SEQ ID NO: 2826926 - DNA, 18 bp, Homo sapiens
caccagttcctttcaatg

SEQ ID NO: 2826927 - DNA, 18 bp, Homo sapiens
caccatcatgtctggcta

SEQ ID NO: 2826928 - DNA, 15 bp, Homo sapiens
caccatcctgcagcc

SEQ ID NO: 2826929 - DNA, 21 bp, Homo sapiens
caccatcctgcagcctcctcc

SEQ ID NO: 2826930 - DNA, 16 bp, Homo sapiens
caccatgcgctgctca

SEQ ID NO: 2826931 - DNA, 22 bp, Homo sapiens
caccatgcgctgctcaacctct

SEQ ID NO: 2826932 - DNA, 18 bp, Homo sapiens
caccatgtttgagctcag

SEQ ID NO: 2826933 - DNA, 22 bp, Homo sapiens
caccatgtttgagctcagaccc

SEQ ID NO: 2826934 - DNA, 23 bp, Homo sapiens
caccatgtttgagctcagacccc

SEQ ID NO: 2826935 - DNA, 21 bp, Homo sapiens
cacccaagtatacaataaagt

SEQ ID NO: 2826936 - DNA, 17 bp, Homo sapiens
cacccaattcaaaacat

SEQ ID NO: 2826937 - DNA, 13 bp, Homo sapiens
cacccacctcagc

SEQ ID NO: 2826938 - DNA, 11 bp, Homo sapiens
cacccagccca

SEQ ID NO: 2826939 - DNA, 13 bp, Homo sapiens
cacccagcccatt

SEQ ID NO: 2826940 - DNA, 16 bp, Homo sapiens
cacccaggagccccga

SEQ ID NO: 2826941 - DNA, 24 bp, Homo sapiens
cacccaggagccccgaggccttct

SEQ ID NO: 2826942 - DNA, 15 bp, Homo sapiens
cacccatgaagacag

SEQ ID NO: 2826943 - DNA, 22 bp, Homo sapiens
cacccatgaagacaggacagtg

SEQ ID NO: 2826944 - DNA, 19 bp, Homo sapiens
cacccatgaatcaaagaca

SEQ ID NO: 2826945 - DNA, 17 bp, Homo sapiens
caccccaggacgccact

SEQ ID NO: 2826946 - DNA, 20 bp, Homo sapiens
caccccaggacgccactcat

SEQ ID NO: 2826947 - DNA, 23 bp, Homo sapiens
cacccccagccccgactccagcc

SEQ ID NO: 2826948 - DNA, 19 bp, Homo sapiens
cacccccagcctgggccta

SEQ ID NO: 2826949 - DNA, 12 bp, Homo sapiens
cacccccagctt

SEQ ID NO: 2826950 - DNA, 15 bp, Homo sapiens
caccccccaagctgt

SEQ ID NO: 2826951 - DNA, 11 bp, Homo sapiens
caccccctcat

SEQ ID NO: 2826952 - DNA, 16 bp, Homo sapiens
caccccctcccacccc

SEQ ID NO: 2826953 - DNA, 19 bp, Homo sapiens
caccccctcccacccccag

SEQ ID NO: 2826954 - DNA, 14 bp, Homo sapiens
caccccctccccag

SEQ ID NO: 2826955 - DNA, 16 bp, Homo sapiens
caccccctccccaggg

SEQ ID NO: 2826956 - DNA, 13 bp, Homo sapiens
caccccctgcagc

SEQ ID NO: 2826957 - DNA, 17 bp, Homo sapiens
cacccccttcagtgccc

SEQ ID NO: 2826958 - DNA, 21 bp, Homo sapiens
cacccccttcagtgcccacca

SEQ ID NO: 2826959 - DNA, 16 bp, Homo sapiens
caccccttatccagga

SEQ ID NO: 2826960 - DNA, 13 bp, Homo sapiens
caccccttcctgt

SEQ ID NO: 2826961 - DNA, 16 bp, Homo sapiens
caccccttcctgtccc

SEQ ID NO: 2826962 - DNA, 17 bp, Homo sapiens
cacccgaggctgcccac

SEQ ID NO: 2826963 - DNA, 17 bp, Homo sapiens
cacccggaaagactgaa

SEQ ID NO: 2826964 - DNA, 13 bp, Homo sapiens
cacccggcccctg

SEQ ID NO: 2826965 - DNA, 17 bp, Homo sapiens
cacccggcccctgctgg

SEQ ID NO: 2826966 - DNA, 15 bp, Homo sapiens
cacccggctccccct

SEQ ID NO: 2826967 - DNA, 16 bp, Homo sapiens
cacccgttcaccttct

SEQ ID NO: 2826968 - DNA, 18 bp, Homo sapiens
cacccgttctgctggcct

SEQ ID NO: 2826969 - DNA, 17 bp, Homo sapiens
caccctccccattagta

SEQ ID NO: 2826970 - DNA, 12 bp, Homo sapiens
caccctcctttc

SEQ ID NO: 2826971 - DNA, 15 bp, Homo sapiens
caccctgagcctgac

SEQ ID NO: 2826972 - DNA, 22 bp, Homo sapiens
caccctgaggagtctgaggtcc

SEQ ID NO: 2826973 - DNA, 14 bp, Homo sapiens
caccctgcagagca

SEQ ID NO: 2826974 - DNA, 19 bp, Homo sapiens
caccctgcagagcacacag

SEQ ID NO: 2826975 - DNA, 12 bp, Homo sapiens
caccctgctctc

SEQ ID NO: 2826976 - DNA, 17 bp, Homo sapiens
caccctggggagaaagt

SEQ ID NO: 2826977 - DNA, 13 bp, Homo sapiens
cagagaggaatca

SEQ ID NO: 2826978 - DNA, 12 bp, Homo sapiens
cagagagggcag

SEQ ID NO: 2826979 - DNA, 17 bp, Homo sapiens
cagagagggtggtgacc

SEQ ID NO: 2826980 - DNA, 23 bp, Homo sapiens
cagagagggtggtgacctctgcc

SEQ ID NO: 2826981 - DNA, 14 bp, Homo sapiens
cagagagtcctctg

SEQ ID NO: 2826982 - DNA, 19 bp, Homo sapiens
cagagagtcctctggatgg

SEQ ID NO: 2826983 - DNA, 23 bp, Homo sapiens
cagagagtgagagacattaactc

SEQ ID NO: 2826984 - DNA, 16 bp, Homo sapiens
cagagatgcctccacc

SEQ ID NO: 2826985 - DNA, 18 bp, Homo sapiens
cagagatgcctccaccgc

SEQ ID NO: 2826986 - DNA, 16 bp, Homo sapiens
cagagcaaaataattt

SEQ ID NO: 2826987 - DNA, 17 bp, Homo sapiens
cagagcaagactccgtc

SEQ ID NO: 2826988 - DNA, 17 bp, Homo sapiens
cagagcacacaggtaca

SEQ ID NO: 2826989 - DNA, 14 bp, Homo sapiens
cagagcaggggcag

SEQ ID NO: 2826990 - DNA, 22 bp, Homo sapiens
cagagcattacgtgagccaggt

SEQ ID NO: 2826991 - DNA, 15 bp, Homo sapiens
cagagccccccacaa

SEQ ID NO: 2826992 - DNA, 13 bp, Homo sapiens
cagagcctgcagt

SEQ ID NO: 2826993 - DNA, 14 bp, Homo sapiens
cagagcctgcctca

SEQ ID NO: 2826994 - DNA, 13 bp, Homo sapiens
cagagcctggggc

SEQ ID NO: 2826995 - DNA, 14 bp, Homo sapiens
cagagcctggggct

SEQ ID NO: 2826996 - DNA, 14 bp, Homo sapiens
cagagccttcacaa

SEQ ID NO: 2826997 - DNA, 20 bp, Homo sapiens
cagagccttctcctgcctac

SEQ ID NO: 2826998 - DNA, 16 bp, Homo sapiens
cagagcctttggatga

SEQ ID NO: 2826999 - DNA, 20 bp, Homo sapiens
cagagcctttggatgaccag

SEQ ID NO: 2827000 - DNA, 20 bp, Homo sapiens
cagagcctttttcacaattc

SEQ ID NO: 2827001 - DNA, 20 bp, Homo sapiens
cagagctgggatgtttctgt

SEQ ID NO: 2827002 - DNA, 14 bp, Homo sapiens
cagaggaagagcag

SEQ ID NO: 2827003 - DNA, 15 bp, Homo sapiens
cagaggaagagcagg

SEQ ID NO: 2827004 - DNA, 14 bp, Homo sapiens
cagaggaagcccct

SEQ ID NO: 2827005 - DNA, 15 bp, Homo sapiens
cagaggaagcccctt

SEQ ID NO: 2827006 - DNA, 19 bp, Homo sapiens
cagaggagtccagggcggg

SEQ ID NO: 2827007 - DNA, 11 bp, Homo sapiens
cagaggcagcc

SEQ ID NO: 2827008 - DNA, 14 bp, Homo sapiens
cagaggcagcccca

SEQ ID NO: 2827009 - DNA, 20 bp, Homo sapiens
cagaggcagccccattctgc

SEQ ID NO: 2827010 - DNA, 23 bp, Homo sapiens
cagaggcagccccattctgcctg

SEQ ID NO: 2827011 - DNA, 16 bp, Homo sapiens
cagaggcagctgtgtg

SEQ ID NO: 2827012 - DNA, 21 bp, Homo sapiens
cagaggccatgggcctcctgt

SEQ ID NO: 2827013 - DNA, 12 bp, Homo sapiens
cagaggctgcag

SEQ ID NO: 2827014 - DNA, 15 bp, Homo sapiens
cagaggctgcaggac

SEQ ID NO: 2827015 - DNA, 13 bp, Homo sapiens
cagaggctggagg

SEQ ID NO: 2827016 - DNA, 19 bp, Homo sapiens
cagagggactttgtataga

SEQ ID NO: 2827017 - DNA, 18 bp, Homo sapiens
cagagggagtgacagagg

SEQ ID NO: 2827018 - DNA, 19 bp, Homo sapiens
cagagggagtgacagaggc

SEQ ID NO: 2827019 - DNA, 20 bp, Homo sapiens
cagagggagtgacagaggca

SEQ ID NO: 2827020 - DNA, 23 bp, Homo sapiens
cagagggagtgacagaggcagcc

SEQ ID NO: 2827021 - DNA, 13 bp, Homo sapiens
cagagggcccagg

SEQ ID NO: 2827022 - DNA, 15 bp, Homo sapiens
cagagggcccaggca

SEQ ID NO: 2827023 - DNA, 15 bp, Homo sapiens
cagaggggtaggcag

SEQ ID NO: 2827024 - DNA, 20 bp, Homo sapiens
cagaggggtaggcagagcct

SEQ ID NO: 2827025 - DNA, 23 bp, Homo sapiens
cagaggggtgggttcctcttccc

SEQ ID NO: 2827026 - DNA, 18 bp, Homo sapiens
cagaggtaaaagtgtgag

SEQ ID NO: 2827027 - DNA, 15 bp, Homo sapiens
cagaggtgagcagag

SEQ ID NO: 2827028 - DNA, 17 bp, Homo sapiens
cagagtatatatgtaca

SEQ ID NO: 2827029 - DNA, 12 bp, Homo sapiens
cagagtcattgt

SEQ ID NO: 2827030 - DNA, 14 bp, Homo sapiens
cagagtcattgtta

SEQ ID NO: 2827031 - DNA, 17 bp, Homo sapiens
cagagtctcactgttgc

SEQ ID NO: 2827032 - DNA, 23 bp, Homo sapiens
cagagtgacacccaagagggctg

SEQ ID NO: 2827033 - DNA, 15 bp, Homo sapiens
cagagtgagaccctg

SEQ ID NO: 2827034 - DNA, 19 bp, Homo sapiens
cagagtgagaccctgtctc

SEQ ID NO: 2827035 - DNA, 20 bp, Homo sapiens
cagagtgagaccctgtctct

SEQ ID NO: 2827036 - DNA, 20 bp, Homo sapiens
cagagtgagactctgtctca

SEQ ID NO: 2827037 - DNA, 16 bp, Homo sapiens
cagagtgtagaataat

SEQ ID NO: 2827038 - DNA, 12 bp, Homo sapiens
cagagttcacta

SEQ ID NO: 2827039 - DNA, 19 bp, Homo sapiens
cagataactgaaaattatt

SEQ ID NO: 2827040 - DNA, 21 bp, Homo sapiens
cagatactggaagttttgcat

SEQ ID NO: 2827041 - DNA, 20 bp, Homo sapiens
cagatataaatggctggttt

SEQ ID NO: 2827042 - DNA, 18 bp, Homo sapiens
cagatatgatatgtaaac

SEQ ID NO: 2827043 - DNA, 17 bp, Homo sapiens
cagatatttccatttct

SEQ ID NO: 2827044 - DNA, 18 bp, Homo sapiens
cagatatttccatttctt

SEQ ID NO: 2827045 - DNA, 23 bp, Homo sapiens
cagatatttccatttcttcctca

SEQ ID NO: 2827046 - DNA, 14 bp, Homo sapiens
cagatcccatccat

SEQ ID NO: 2827047 - DNA, 17 bp, Homo sapiens
cagatcccatccatcag

SEQ ID NO: 2827048 - DNA, 18 bp, Homo sapiens
cagatcgtattaattatc

SEQ ID NO: 2827049 - DNA, 22 bp, Homo sapiens
cagatcgtattaattatctgat

SEQ ID NO: 2827050 - DNA, 13 bp, Homo sapiens
cagatgagaagtt

SEQ ID NO: 2827051 - DNA, 22 bp, Homo sapiens
cagatgagaagttaagcagcct

SEQ ID NO: 2827052 - DNA, 17 bp, Homo sapiens
cagatgagattccctct

SEQ ID NO: 2827053 - DNA, 18 bp, Homo sapiens
cagatgagattccctctc

SEQ ID NO: 2827054 - DNA, 19 bp, Homo sapiens
cagatgagcagtcacactg

SEQ ID NO: 2827055 - DNA, 14 bp, Homo sapiens
cagatgcaccagcc

SEQ ID NO: 2827056 - DNA, 17 bp, Homo sapiens
cagatgcaccagccctt

SEQ ID NO: 2827057 - DNA, 16 bp, Homo sapiens
cagatgccacacctgc

SEQ ID NO: 2827058 - DNA, 19 bp, Homo sapiens
cagatgcccagagggccca

SEQ ID NO: 2827059 - DNA, 18 bp, Homo sapiens
cagatgtaggagggactg

SEQ ID NO: 2827060 - DNA, 24 bp, Homo sapiens
cagatgtaggagggactgtcgctg

SEQ ID NO: 2827061 - DNA, 23 bp, Homo sapiens
cagattattttagtctgtcatcc

SEQ ID NO: 2827062 - DNA, 18 bp, Homo sapiens
cagattcccagagcaaaa

SEQ ID NO: 2827063 - DNA, 19 bp, Homo sapiens
cagattcccagagcaaaat

SEQ ID NO: 2827064 - DNA, 20 bp, Homo sapiens
cagattgcaacaggctgggc

SEQ ID NO: 2827065 - DNA, 21 bp, Homo sapiens
cagattgcaacaggctgggct

SEQ ID NO: 2827066 - DNA, 15 bp, Homo sapiens
cagatttcctgtgtg

SEQ ID NO: 2827067 - DNA, 16 bp, Homo sapiens
cagatttcctgtgtgg

SEQ ID NO: 2827068 - DNA, 15 bp, Homo sapiens
caggaaaaggcctgg

SEQ ID NO: 2827069 - DNA, 19 bp, Homo sapiens
caggaaaaggcctggggtg

SEQ ID NO: 2827070 - DNA, 21 bp, Homo sapiens
caggaaaaggcctggggtgac

SEQ ID NO: 2827071 - DNA, 22 bp, Homo sapiens
caggaacacccgactcctcaaa

SEQ ID NO: 2827072 - DNA, 12 bp, Homo sapiens
caggaacagaag

SEQ ID NO: 2827073 - DNA, 14 bp, Homo sapiens
caggaacagaagga

SEQ ID NO: 2827074 - DNA, 15 bp, Homo sapiens
caggaacagaaggat

SEQ ID NO: 2827075 - DNA, 18 bp, Homo sapiens
caggaacagaaggatgaa

SEQ ID NO: 2827076 - DNA, 14 bp, Homo sapiens
caggaactcccagc

SEQ ID NO: 2827077 - DNA, 15 bp, Homo sapiens
caggaactcccagca

SEQ ID NO: 2827078 - DNA, 17 bp, Homo sapiens
caggaactcccagcaac

SEQ ID NO: 2827079 - DNA, 12 bp, Homo sapiens
caggaactgggc

SEQ ID NO: 2827080 - DNA, 18 bp, Homo sapiens
caggaagccaggctgagt

SEQ ID NO: 2827081 - DNA, 13 bp, Homo sapiens
caggaatctcaga

SEQ ID NO: 2827082 - DNA, 13 bp, Homo sapiens
caggacacaggcc

SEQ ID NO: 2827083 - DNA, 14 bp, Homo sapiens
caggacacaggcct

SEQ ID NO: 2827084 - DNA, 15 bp, Homo sapiens
caggacacaggcctg

SEQ ID NO: 2827085 - DNA, 17 bp, Homo sapiens
caggacacaggcctgtg

SEQ ID NO: 2827086 - DNA, 22 bp, Homo sapiens
caggacacaggcctgtgtagct

SEQ ID NO: 2827087 - DNA, 19 bp, Homo sapiens
caggacacctggccgcctc

SEQ ID NO: 2827088 - DNA, 15 bp, Homo sapiens
caggacacggggcag

SEQ ID NO: 2827089 - DNA, 12 bp, Homo sapiens
caggacaggacc

SEQ ID NO: 2827090 - DNA, 13 bp, Homo sapiens
caggacaggcccg

SEQ ID NO: 2827091 - DNA, 21 bp, Homo sapiens
caggacagtgcttcagcctga

SEQ ID NO: 2827092 - DNA, 13 bp, Homo sapiens
caggacctgacta

SEQ ID NO: 2827093 - DNA, 14 bp, Homo sapiens
caggacctggcttg

SEQ ID NO: 2827094 - DNA, 20 bp, Homo sapiens
caggacctggcttggcttta

SEQ ID NO: 2827095 - DNA, 20 bp, Homo sapiens
caggacgccactcatttcat

SEQ ID NO: 2827096 - DNA, 19 bp, Homo sapiens
caggactaacactcagaag

SEQ ID NO: 2827097 - DNA, 21 bp, Homo sapiens
caggactatagcccaggtcct

SEQ ID NO: 2827098 - DNA, 12 bp, Homo sapiens
caggactcaccc

SEQ ID NO: 2827099 - DNA, 14 bp, Homo sapiens
caggactcaccctc

SEQ ID NO: 2827100 - DNA, 16 bp, Homo sapiens
caggactcaccctcat

SEQ ID NO: 2827101 - DNA, 18 bp, Homo sapiens
caggactgaattgtcccc

SEQ ID NO: 2827102 - DNA, 20 bp, Homo sapiens
caggactgaattgtccccag

SEQ ID NO: 2827103 - DNA, 23 bp, Homo sapiens
caggacttggtctgatttcagga

SEQ ID NO: 2827104 - DNA, 18 bp, Homo sapiens
caggagaatcaataaaaa

SEQ ID NO: 2827105 - DNA, 12 bp, Homo sapiens
caggagacaaga

SEQ ID NO: 2827106 - DNA, 17 bp, Homo sapiens
caggagagccagccctc

SEQ ID NO: 2827107 - DNA, 18 bp, Homo sapiens
caggagagccagccctcc

SEQ ID NO: 2827108 - DNA, 16 bp, Homo sapiens
caggagcaatttgcac

SEQ ID NO: 2827109 - DNA, 15 bp, Homo sapiens
caggagcacaggcag

SEQ ID NO: 2827110 - DNA, 16 bp, Homo sapiens
caggagccccgaggcc

SEQ ID NO: 2827111 - DNA, 15 bp, Homo sapiens
caggagcctgtgcct

SEQ ID NO: 2827112 - DNA, 22 bp, Homo sapiens
caggagctacctgtgtggacag

SEQ ID NO: 2827113 - DNA, 23 bp, Homo sapiens
caggagctacctgtgtggacagg

SEQ ID NO: 2827114 - DNA, 17 bp, Homo sapiens
caggaggctagcaaagc

SEQ ID NO: 2827115 - DNA, 16 bp, Homo sapiens
caggaggctgaggcag

SEQ ID NO: 2827116 - DNA, 21 bp, Homo sapiens
caggaggctgaggcagaagaa

SEQ ID NO: 2827117 - DNA, 18 bp, Homo sapiens
caggaggctgaggcagga

SEQ ID NO: 2827118 - DNA, 20 bp, Homo sapiens
caggaggctgaggcaggagg

SEQ ID NO: 2827119 - DNA, 21 bp, Homo sapiens
caggaggctgaggcaggagga

SEQ ID NO: 2827120 - DNA, 24 bp, Homo sapiens
caggagggacaaaggagcctgtga

SEQ ID NO: 2827121 - DNA, 15 bp, Homo sapiens
caggaggtggaggtt

SEQ ID NO: 2827122 - DNA, 22 bp, Homo sapiens
caggaggtggctatggccaccc

SEQ ID NO: 2827123 - DNA, 14 bp, Homo sapiens
caggagtagctgag

SEQ ID NO: 2827124 - DNA, 15 bp, Homo sapiens
caggagtagctgagc

SEQ ID NO: 2827125 - DNA, 19 bp, Homo sapiens
caggagtcccaaggaaagc

SEQ ID NO: 2827126 - DNA, 21 bp, Homo sapiens
caggagtcccaaggaaagccc

SEQ ID NO: 2827127 - DNA, 24 bp, Homo sapiens
caggagtcccaaggaaagccccag

SEQ ID NO: 2827128 - DNA, 15 bp, Homo sapiens
caggagtccctggta

SEQ ID NO: 2827129 - DNA, 21 bp, Homo sapiens
caggagttcgagaccagccca

SEQ ID NO: 2827130 - DNA, 22 bp, Homo sapiens
caggagttcgagaccagcccag

SEQ ID NO: 2827131 - DNA, 18 bp, Homo sapiens
caggatactctgtcagat

SEQ ID NO: 2827132 - DNA, 20 bp, Homo sapiens
caggatactctgtcagatgg

SEQ ID NO: 2827133 - DNA, 23 bp, Homo sapiens
caggatggggtatggattctaaa

SEQ ID NO: 2827134 - DNA, 14 bp, Homo sapiens
caggattccaaagt

SEQ ID NO: 2827135 - DNA, 15 bp, Homo sapiens
caggattccaaagtt

SEQ ID NO: 2827136 - DNA, 14 bp, Homo sapiens
caggcaaaatcctt

SEQ ID NO: 2827137 - DNA, 19 bp, Homo sapiens
caggcaactgaggcagaca

SEQ ID NO: 2827138 - DNA, 22 bp, Homo sapiens
caggcaactgaggcagacagca

SEQ ID NO: 2827139 - DNA, 14 bp, Homo sapiens
caggcaatgctggc

SEQ ID NO: 2827140 - DNA, 17 bp, Homo sapiens
caggcaatgctggctgt

SEQ ID NO: 2827141 - DNA, 21 bp, Homo sapiens
caggcaatgctggctgttggc

SEQ ID NO: 2827142 - DNA, 15 bp, Homo sapiens
caggcaccaaaagaa

SEQ ID NO: 2827143 - DNA, 21 bp, Homo sapiens
caggcaccccctggagagaag

SEQ ID NO: 2827144 - DNA, 13 bp, Homo sapiens
caggcacccttct

SEQ ID NO: 2827145 - DNA, 21 bp, Homo sapiens
caggcacccttctttcctctt

SEQ ID NO: 2827146 - DNA, 19 bp, Homo sapiens
caggcacgaacccacctgc

SEQ ID NO: 2827147 - DNA, 20 bp, Homo sapiens
caggcacgaacccacctgct

SEQ ID NO: 2827148 - DNA, 21 bp, Homo sapiens
caggcacgaacccacctgctg

SEQ ID NO: 2827149 - DNA, 22 bp, Homo sapiens
caggcacgtcccggacctgtgg

SEQ ID NO: 2827150 - DNA, 16 bp, Homo sapiens
caggcactgctgccca

SEQ ID NO: 2827151 - DNA, 17 bp, Homo sapiens
caggcactgctgcccag

SEQ ID NO: 2827152 - DNA, 14 bp, Homo sapiens
caggcagagaatca

SEQ ID NO: 2827153 - DNA, 17 bp, Homo sapiens
caggcagagacaataaa

SEQ ID NO: 2827154 - DNA, 21 bp, Homo sapiens
caggcagagacaataaaacat

SEQ ID NO: 2827155 - DNA, 18 bp, Homo sapiens
caggcagggctctcctgg

SEQ ID NO: 2827156 - DNA, 14 bp, Homo sapiens
caggcaggtccagg

SEQ ID NO: 2827157 - DNA, 23 bp, Homo sapiens
caggcaggtcttgaactcctggc

SEQ ID NO: 2827158 - DNA, 19 bp, Homo sapiens
catagcagagaatgaaagg

SEQ ID NO: 2827159 - DNA, 23 bp, Homo sapiens
catagcagagaatgaaagggccc

SEQ ID NO: 2827160 - DNA, 13 bp, Homo sapiens
catagcttccatg

SEQ ID NO: 2827161 - DNA, 15 bp, Homo sapiens
catagggtctcttca

SEQ ID NO: 2827162 - DNA, 17 bp, Homo sapiens
cataggtagaatgtaaa

SEQ ID NO: 2827163 - DNA, 19 bp, Homo sapiens
catagtatggtggctgggt

SEQ ID NO: 2827164 - DNA, 23 bp, Homo sapiens
catagtgctaagaaagcaagcca

SEQ ID NO: 2827165 - DNA, 17 bp, Homo sapiens
catataatgttgttatt

SEQ ID NO: 2827166 - DNA, 18 bp, Homo sapiens
catataatgttgttattt

SEQ ID NO: 2827167 - DNA, 18 bp, Homo sapiens
catatataactagctaga

SEQ ID NO: 2827168 - DNA, 13 bp, Homo sapiens
catatatcttatg

SEQ ID NO: 2827169 - DNA, 21 bp, Homo sapiens
catatattcatgtaataaatc

SEQ ID NO: 2827170 - DNA, 13 bp, Homo sapiens
catatcaattcaa

SEQ ID NO: 2827171 - DNA, 15 bp, Homo sapiens
catatcaattcaaca

SEQ ID NO: 2827172 - DNA, 21 bp, Homo sapiens
catatgcaccttgtgtctgta

SEQ ID NO: 2827173 - DNA, 21 bp, Homo sapiens
catatgcctacttgtaatttc

SEQ ID NO: 2827174 - DNA, 20 bp, Homo sapiens
catatggactctgcacatga

SEQ ID NO: 2827175 - DNA, 13 bp, Homo sapiens
catatgtaaaata

SEQ ID NO: 2827176 - DNA, 15 bp, Homo sapiens
catatgtaccatgta

SEQ ID NO: 2827177 - DNA, 15 bp, Homo sapiens
catatgttacactaa

SEQ ID NO: 2827178 - DNA, 18 bp, Homo sapiens
catattaaacttctgatt

SEQ ID NO: 2827179 - DNA, 12 bp, Homo sapiens
catattataaat

SEQ ID NO: 2827180 - DNA, 13 bp, Homo sapiens
catattataaata

SEQ ID NO: 2827181 - DNA, 17 bp, Homo sapiens
catattataaataaatg

SEQ ID NO: 2827182 - DNA, 18 bp, Homo sapiens
catattataaataaatgc

SEQ ID NO: 2827183 - DNA, 17 bp, Homo sapiens
catattctgttggccag

SEQ ID NO: 2827184 - DNA, 13 bp, Homo sapiens
catattgtatgta

SEQ ID NO: 2827185 - DNA, 16 bp, Homo sapiens
catattgtatgtaagt

SEQ ID NO: 2827186 - DNA, 18 bp, Homo sapiens
catattgtatgtaagtaa

SEQ ID NO: 2827187 - DNA, 16 bp, Homo sapiens
catcaacaaagaaata

SEQ ID NO: 2827188 - DNA, 12 bp, Homo sapiens
catcaatttaaa

SEQ ID NO: 2827189 - DNA, 16 bp, Homo sapiens
catcaatttttataca

SEQ ID NO: 2827190 - DNA, 23 bp, Homo sapiens
catcaatttttatacatatcaga

SEQ ID NO: 2827191 - DNA, 13 bp, Homo sapiens
catcacagggcag

SEQ ID NO: 2827192 - DNA, 14 bp, Homo sapiens
catcacctactcac

SEQ ID NO: 2827193 - DNA, 20 bp, Homo sapiens
catcacctactcacacaggc

SEQ ID NO: 2827194 - DNA, 12 bp, Homo sapiens
catcacctcagg

SEQ ID NO: 2827195 - DNA, 18 bp, Homo sapiens
catcacctcaggccaggt

SEQ ID NO: 2827196 - DNA, 19 bp, Homo sapiens
catcactggagcaccaggc

SEQ ID NO: 2827197 - DNA, 19 bp, Homo sapiens
catcacttgtacaaaataa

SEQ ID NO: 2827198 - DNA, 15 bp, Homo sapiens
catcagaaggagaag

SEQ ID NO: 2827199 - DNA, 17 bp, Homo sapiens
catcagcatacctttat

SEQ ID NO: 2827200 - DNA, 11 bp, Homo sapiens
catcagctccc

SEQ ID NO: 2827201 - DNA, 12 bp, Homo sapiens
catcagggtggg

SEQ ID NO: 2827202 - DNA, 16 bp, Homo sapiens
catcaggttccatccc

SEQ ID NO: 2827203 - DNA, 13 bp, Homo sapiens
catcagttactgg

SEQ ID NO: 2827204 - DNA, 13 bp, Homo sapiens
catcataaaataa

SEQ ID NO: 2827205 - DNA, 21 bp, Homo sapiens
catcatcaggcttggaatgaa

SEQ ID NO: 2827206 - DNA, 13 bp, Homo sapiens
catcatgcctctg

SEQ ID NO: 2827207 - DNA, 17 bp, Homo sapiens
catcatgcctctgaggc

SEQ ID NO: 2827208 - DNA, 19 bp, Homo sapiens
catcatgcctctgaggcca

SEQ ID NO: 2827209 - DNA, 20 bp, Homo sapiens
catcatgcctctgaggccag

SEQ ID NO: 2827210 - DNA, 22 bp, Homo sapiens
catcatgcctctgaggccagcc

SEQ ID NO: 2827211 - DNA, 15 bp, Homo sapiens
catcatggctatctg

SEQ ID NO: 2827212 - DNA, 17 bp, Homo sapiens
catcatgtgcctggaaa

SEQ ID NO: 2827213 - DNA, 17 bp, Homo sapiens
catcattataaacgtga

SEQ ID NO: 2827214 - DNA, 21 bp, Homo sapiens
catcattatttgcagagacag

SEQ ID NO: 2827215 - DNA, 22 bp, Homo sapiens
catcattccttgagaaaaacaa

SEQ ID NO: 2827216 - DNA, 14 bp, Homo sapiens
catcattttttact

SEQ ID NO: 2827217 - DNA, 15 bp, Homo sapiens
catccaaccccccac

SEQ ID NO: 2827218 - DNA, 16 bp, Homo sapiens
catccaaccccccacc

SEQ ID NO: 2827219 - DNA, 21 bp, Homo sapiens
catccaaccccccacctgcca

SEQ ID NO: 2827220 - DNA, 14 bp, Homo sapiens
catccaaggagaaa

SEQ ID NO: 2827221 - DNA, 23 bp, Homo sapiens
catccaaggagaaacagagacag

SEQ ID NO: 2827222 - DNA, 17 bp, Homo sapiens
catccactgtgccatgt

SEQ ID NO: 2827223 - DNA, 13 bp, Homo sapiens
catccagttcatg

SEQ ID NO: 2827224 - DNA, 18 bp, Homo sapiens
catccagttgcaataaaa

SEQ ID NO: 2827225 - DNA, 21 bp, Homo sapiens
catccagttgcaataaaatag

SEQ ID NO: 2827226 - DNA, 15 bp, Homo sapiens
catccatctgtggaa

SEQ ID NO: 2827227 - DNA, 20 bp, Homo sapiens
catccatttcatctatttct

SEQ ID NO: 2827228 - DNA, 19 bp, Homo sapiens
catcccaggggaccacacc

SEQ ID NO: 2827229 - DNA, 19 bp, Homo sapiens
catcccatctaagctgcag

SEQ ID NO: 2827230 - DNA, 20 bp, Homo sapiens
catcccatctaagctgcagc

SEQ ID NO: 2827231 - DNA, 13 bp, Homo sapiens
catcccattgccc

SEQ ID NO: 2827232 - DNA, 22 bp, Homo sapiens
catccccaggtctctccactgc

SEQ ID NO: 2827233 - DNA, 14 bp, Homo sapiens
catcccccactgcc

SEQ ID NO: 2827234 - DNA, 15 bp, Homo sapiens
catcccctttattaa

SEQ ID NO: 2827235 - DNA, 13 bp, Homo sapiens
catccctgggcct

SEQ ID NO: 2827236 - DNA, 15 bp, Homo sapiens
catccctgggcctgc

SEQ ID NO: 2827237 - DNA, 16 bp, Homo sapiens
catccctgggcctgct

SEQ ID NO: 2827238 - DNA, 21 bp, Homo sapiens
catccctgggcctgctgctga

SEQ ID NO: 2827239 - DNA, 15 bp, Homo sapiens
catccgaggcagggt

SEQ ID NO: 2827240 - DNA, 23 bp, Homo sapiens
catccgaggcagggtcaggagag

SEQ ID NO: 2827241 - DNA, 18 bp, Homo sapiens
catcctccaattccacag

SEQ ID NO: 2827242 - DNA, 12 bp, Homo sapiens
catcctgcagcc

SEQ ID NO: 2827243 - DNA, 21 bp, Homo sapiens
catccttcaagaactctgggc

SEQ ID NO: 2827244 - DNA, 22 bp, Homo sapiens
catccttcaagaactctgggct

SEQ ID NO: 2827245 - DNA, 13 bp, Homo sapiens
catccttcaccag

SEQ ID NO: 2827246 - DNA, 17 bp, Homo sapiens
catccttttctgcagag

SEQ ID NO: 2827247 - DNA, 14 bp, Homo sapiens
catctaagctgcag

SEQ ID NO: 2827248 - DNA, 17 bp, Homo sapiens
catctaagctgcagctt

SEQ ID NO: 2827249 - DNA, 19 bp, Homo sapiens
catttttactaaagcagtg

SEQ ID NO: 2827250 - DNA, 20 bp, Homo sapiens
catttttactactattctgt

SEQ ID NO: 2827251 - DNA, 17 bp, Homo sapiens
catttttagtagagaca

SEQ ID NO: 2827252 - DNA, 16 bp, Homo sapiens
catttttcatgataat

SEQ ID NO: 2827253 - DNA, 14 bp, Homo sapiens
catttttgagccaa

SEQ ID NO: 2827254 - DNA, 16 bp, Homo sapiens
ccaaaaaagtattttt

SEQ ID NO: 2827255 - DNA, 14 bp, Homo sapiens
ccaaaacaatgttt

SEQ ID NO: 2827256 - DNA, 23 bp, Homo sapiens
ccaaaacctcatgacagccagag

SEQ ID NO: 2827257 - DNA, 21 bp, Homo sapiens
ccaaaagtcaaaaggtgcctg

SEQ ID NO: 2827258 - DNA, 20 bp, Homo sapiens
ccaaaagttacatgtttgca

SEQ ID NO: 2827259 - DNA, 17 bp, Homo sapiens
ccaaaatgttgaaatat

SEQ ID NO: 2827260 - DNA, 12 bp, Homo sapiens
ccaaacagagcc

SEQ ID NO: 2827261 - DNA, 15 bp, Homo sapiens
ccaaactaccgttcc

SEQ ID NO: 2827262 - DNA, 17 bp, Homo sapiens
ccaaagagactggagca

SEQ ID NO: 2827263 - DNA, 21 bp, Homo sapiens
ccaaagagactggagcatctg

SEQ ID NO: 2827264 - DNA, 16 bp, Homo sapiens
ccaaagagcctggaga

SEQ ID NO: 2827265 - DNA, 18 bp, Homo sapiens
ccaaagagcctggagaag

SEQ ID NO: 2827266 - DNA, 20 bp, Homo sapiens
ccaaagagcctggagaagct

SEQ ID NO: 2827267 - DNA, 15 bp, Homo sapiens
ccaaagcaaaagaag

SEQ ID NO: 2827268 - DNA, 21 bp, Homo sapiens
ccaaagctaggcctggccaga

SEQ ID NO: 2827269 - DNA, 22 bp, Homo sapiens
ccaaaggccctaccagagggaa

SEQ ID NO: 2827270 - DNA, 20 bp, Homo sapiens
ccaaagttttgaagtcatct

SEQ ID NO: 2827271 - DNA, 18 bp, Homo sapiens
ccaaataaatgtgtaaat

SEQ ID NO: 2827272 - DNA, 20 bp, Homo sapiens
ccaaataaatgtgtaaatgt

SEQ ID NO: 2827273 - DNA, 17 bp, Homo sapiens
ccaaatgcatggtgcag

SEQ ID NO: 2827274 - DNA, 20 bp, Homo sapiens
ccaaattgctgggattacag

SEQ ID NO: 2827275 - DNA, 21 bp, Homo sapiens
ccaaattttggccaaagtgtt

SEQ ID NO: 2827276 - DNA, 15 bp, Homo sapiens
ccaacaataaagagc

SEQ ID NO: 2827277 - DNA, 15 bp, Homo sapiens
ccaacaggtggcagg

SEQ ID NO: 2827278 - DNA, 19 bp, Homo sapiens
ccaacagtcaaaacagaga

SEQ ID NO: 2827279 - DNA, 14 bp, Homo sapiens
ccaaccagcttgtc

SEQ ID NO: 2827280 - DNA, 14 bp, Homo sapiens
ccaaccccagggcc

SEQ ID NO: 2827281 - DNA, 21 bp, Homo sapiens
ccaacccgtggaggctgctcg

SEQ ID NO: 2827282 - DNA, 18 bp, Homo sapiens
ccaaccctgtttcctgag

SEQ ID NO: 2827283 - DNA, 18 bp, Homo sapiens
ccaacctaacccctttcc

SEQ ID NO: 2827284 - DNA, 13 bp, Homo sapiens
ccaacctgaccaa

SEQ ID NO: 2827285 - DNA, 14 bp, Homo sapiens
ccaacctggacaac

SEQ ID NO: 2827286 - DNA, 15 bp, Homo sapiens
ccaacctttccctca

SEQ ID NO: 2827287 - DNA, 17 bp, Homo sapiens
ccaacctttccctcacc

SEQ ID NO: 2827288 - DNA, 19 bp, Homo sapiens
ccaacgttaaaagacagtg

SEQ ID NO: 2827289 - DNA, 15 bp, Homo sapiens
ccaactcctggaagc

SEQ ID NO: 2827290 - DNA, 22 bp, Homo sapiens
ccaactcctggaagctgtgtcc

SEQ ID NO: 2827291 - DNA, 12 bp, Homo sapiens
ccaactccttcc

SEQ ID NO: 2827292 - DNA, 14 bp, Homo sapiens
ccaactccttccag

SEQ ID NO: 2827293 - DNA, 15 bp, Homo sapiens
ccaactccttccagc

SEQ ID NO: 2827294 - DNA, 13 bp, Homo sapiens
ccaacttcccagt

SEQ ID NO: 2827295 - DNA, 20 bp, Homo sapiens
ccaagaaaaggcatggagac

SEQ ID NO: 2827296 - DNA, 12 bp, Homo sapiens
ccaagagagaaa

SEQ ID NO: 2827297 - DNA, 14 bp, Homo sapiens
ccaagagatgaaga

SEQ ID NO: 2827298 - DNA, 16 bp, Homo sapiens
ccaagagcatcatgcc

SEQ ID NO: 2827299 - DNA, 23 bp, Homo sapiens
ccaagagcatcatgcctctgagg

SEQ ID NO: 2827300 - DNA, 22 bp, Homo sapiens
ccaagagctacgtatttaatag

SEQ ID NO: 2827301 - DNA, 22 bp, Homo sapiens
ccaagagttctttaggtgcctc

SEQ ID NO: 2827302 - DNA, 18 bp, Homo sapiens
ccaagatacttaagtgct

SEQ ID NO: 2827303 - DNA, 20 bp, Homo sapiens
ccaagcaaaggtgaagagac

SEQ ID NO: 2827304 - DNA, 21 bp, Homo sapiens
ccaagcgaggtcaacagagaa

SEQ ID NO: 2827305 - DNA, 19 bp, Homo sapiens
ccaagctcacagttcctcg

SEQ ID NO: 2827306 - DNA, 22 bp, Homo sapiens
ccaagctcacagttcctcgccc

SEQ ID NO: 2827307 - DNA, 13 bp, Homo sapiens
ccaagctctgctc

SEQ ID NO: 2827308 - DNA, 12 bp, Homo sapiens
ccaagctgaggt

SEQ ID NO: 2827309 - DNA, 13 bp, Homo sapiens
ccaaggaccaggt

SEQ ID NO: 2827310 - DNA, 14 bp, Homo sapiens
ccaaggaccaggtt

SEQ ID NO: 2827311 - DNA, 14 bp, Homo sapiens
ccaaggagaaacag

SEQ ID NO: 2827312 - DNA, 18 bp, Homo sapiens
ccaaggagaaacagagac

SEQ ID NO: 2827313 - DNA, 19 bp, Homo sapiens
ccaaggcagtgttcctcac

SEQ ID NO: 2827314 - DNA, 16 bp, Homo sapiens
ccaaggctgctcagag

SEQ ID NO: 2827315 - DNA, 22 bp, Homo sapiens
ccaagggcggggctatgccttg

SEQ ID NO: 2827316 - DNA, 22 bp, Homo sapiens
ccaaggggaatgtttgcctctg

SEQ ID NO: 2827317 - DNA, 19 bp, Homo sapiens
ccaaggggctttgtcctgg

SEQ ID NO: 2827318 - DNA, 22 bp, Homo sapiens
ccaagggttgaattctggagga

SEQ ID NO: 2827319 - DNA, 18 bp, Homo sapiens
ccaaggtgggctgagccc

SEQ ID NO: 2827320 - DNA, 20 bp, Homo sapiens
ccaagtattttatctgtgtt

SEQ ID NO: 2827321 - DNA, 21 bp, Homo sapiens
ccaagtattttatctgtgttg

SEQ ID NO: 2827322 - DNA, 16 bp, Homo sapiens
ccaagtccaggtcctg

SEQ ID NO: 2827323 - DNA, 19 bp, Homo sapiens
ccaagtccaggtcctggtg

SEQ ID NO: 2827324 - DNA, 16 bp, Homo sapiens
ccaagtgccagtcttg

SEQ ID NO: 2827325 - DNA, 21 bp, Homo sapiens
ccaagtggtgggaatcagatc

SEQ ID NO: 2827326 - DNA, 22 bp, Homo sapiens
ccaagttataaatcaatgtcac

SEQ ID NO: 2827327 - DNA, 13 bp, Homo sapiens
ccaataaaagtga

SEQ ID NO: 2827328 - DNA, 14 bp, Homo sapiens
ccaataaaagtgac

SEQ ID NO: 2827329 - DNA, 15 bp, Homo sapiens
ccaataaaagtgact

SEQ ID NO: 2827330 - DNA, 23 bp, Homo sapiens
ccaataaagctggacaagaagct

SEQ ID NO: 2827331 - DNA, 12 bp, Homo sapiens
ccaatattataa

SEQ ID NO: 2827332 - DNA, 13 bp, Homo sapiens
ccaatattataat

SEQ ID NO: 2827333 - DNA, 12 bp, Homo sapiens
ccaatcatttta

SEQ ID NO: 2827334 - DNA, 22 bp, Homo sapiens
ccaatcattttaattattattc

SEQ ID NO: 2827335 - DNA, 17 bp, Homo sapiens
ccaatgattcataacaa

SEQ ID NO: 2827336 - DNA, 19 bp, Homo sapiens
ccaattatgtgacaacctt

SEQ ID NO: 2827337 - DNA, 11 bp, Homo sapiens
ccaattcttac

SEQ ID NO: 2827338 - DNA, 14 bp, Homo sapiens
ccaattgtaaaaaa

SEQ ID NO: 2827339 - DNA, 15 bp, Homo sapiens
ccacaaccaggaaga

SEQ ID NO: 2827340 - DNA, 15 bp, Homo sapiens
ccatgggcctcctgt

SEQ ID NO: 2827341 - DNA, 17 bp, Homo sapiens
ccatgggcctcctgtgt

SEQ ID NO: 2827342 - DNA, 16 bp, Homo sapiens
ccatgtacatgaagaa

SEQ ID NO: 2827343 - DNA, 16 bp, Homo sapiens
ccatgtagcaggactg

SEQ ID NO: 2827344 - DNA, 16 bp, Homo sapiens
ccatgtcgcctctgca

SEQ ID NO: 2827345 - DNA, 19 bp, Homo sapiens
ccatgtcgcctctgcattc

SEQ ID NO: 2827346 - DNA, 17 bp, Homo sapiens
ccatgtcgcctgccccc

SEQ ID NO: 2827347 - DNA, 16 bp, Homo sapiens
ccatgtgtagattgcg

SEQ ID NO: 2827348 - DNA, 14 bp, Homo sapiens
ccatgttggccagg

SEQ ID NO: 2827349 - DNA, 16 bp, Homo sapiens
ccatgttggccaggct

SEQ ID NO: 2827350 - DNA, 18 bp, Homo sapiens
ccatgttggccaggctgg

SEQ ID NO: 2827351 - DNA, 15 bp, Homo sapiens
ccattcacagagcct

SEQ ID NO: 2827352 - DNA, 22 bp, Homo sapiens
ccattcacatttgatgtacatg

SEQ ID NO: 2827353 - DNA, 16 bp, Homo sapiens
ccattcagacacttca

SEQ ID NO: 2827354 - DNA, 18 bp, Homo sapiens
ccattcatgccaaagcaa

SEQ ID NO: 2827355 - DNA, 19 bp, Homo sapiens
ccattctgcctgcccaggc

SEQ ID NO: 2827356 - DNA, 14 bp, Homo sapiens
ccattcttcctagt

SEQ ID NO: 2827357 - DNA, 14 bp, Homo sapiens
ccatttaattcata

SEQ ID NO: 2827358 - DNA, 19 bp, Homo sapiens
ccatttagttctttgttat

SEQ ID NO: 2827359 - DNA, 20 bp, Homo sapiens
ccatttcattgagggaaaac

SEQ ID NO: 2827360 - DNA, 14 bp, Homo sapiens
ccatttccagttca

SEQ ID NO: 2827361 - DNA, 15 bp, Homo sapiens
ccatttccagttcat

SEQ ID NO: 2827362 - DNA, 13 bp, Homo sapiens
ccatttcctgaga

SEQ ID NO: 2827363 - DNA, 12 bp, Homo sapiens
ccatttccttgg

SEQ ID NO: 2827364 - DNA, 14 bp, Homo sapiens
ccatttccttggag

SEQ ID NO: 2827365 - DNA, 12 bp, Homo sapiens
ccatttctattt

SEQ ID NO: 2827366 - DNA, 14 bp, Homo sapiens
ccatttctatttat

SEQ ID NO: 2827367 - DNA, 13 bp, Homo sapiens
ccatttcttcctc

SEQ ID NO: 2827368 - DNA, 18 bp, Homo sapiens
ccatttcttcctcactat

SEQ ID NO: 2827369 - DNA, 12 bp, Homo sapiens
ccattttaataa

SEQ ID NO: 2827370 - DNA, 17 bp, Homo sapiens
ccattttgcaaaatttc

SEQ ID NO: 2827371 - DNA, 21 bp, Homo sapiens
ccattttgcaaaatttccagt

SEQ ID NO: 2827372 - DNA, 18 bp, Homo sapiens
ccatttttactaaagcag

SEQ ID NO: 2827373 - DNA, 23 bp, Homo sapiens
ccatttttactaaagcagtgttt

SEQ ID NO: 2827374 - DNA, 21 bp, Homo sapiens
ccatttttgagccaagcttca

SEQ ID NO: 2827375 - DNA, 17 bp, Homo sapiens
cccaaagcccagctctt

SEQ ID NO: 2827376 - DNA, 21 bp, Homo sapiens
cccaaagcccagctctttgtt

SEQ ID NO: 2827377 - DNA, 16 bp, Homo sapiens
cccaaagtgctgggat

SEQ ID NO: 2827378 - DNA, 22 bp, Homo sapiens
cccaacccgtggaggctgctcg

SEQ ID NO: 2827379 - DNA, 16 bp, Homo sapiens
cccaacctttccctca

SEQ ID NO: 2827380 - DNA, 17 bp, Homo sapiens
cccaacctttccctcac

SEQ ID NO: 2827381 - DNA, 17 bp, Homo sapiens
cccaactcctggaagct

SEQ ID NO: 2827382 - DNA, 14 bp, Homo sapiens
cccaaggaggaaaa

SEQ ID NO: 2827383 - DNA, 15 bp, Homo sapiens
cccaaggaggaaaaa

SEQ ID NO: 2827384 - DNA, 17 bp, Homo sapiens
cccaaggggtttctgtt

SEQ ID NO: 2827385 - DNA, 18 bp, Homo sapiens
cccaagtgccagtcttgt

SEQ ID NO: 2827386 - DNA, 19 bp, Homo sapiens
cccaagtgggggcagaggg

SEQ ID NO: 2827387 - DNA, 21 bp, Homo sapiens
cccaataaacattaagattga

SEQ ID NO: 2827388 - DNA, 11 bp, Homo sapiens
cccaataaagc

SEQ ID NO: 2827389 - DNA, 23 bp, Homo sapiens
cccacacggaggcatctgcaccc

SEQ ID NO: 2827390 - DNA, 15 bp, Homo sapiens
cccacagaactgctt

SEQ ID NO: 2827391 - DNA, 12 bp, Homo sapiens
cccacagctccc

SEQ ID NO: 2827392 - DNA, 15 bp, Homo sapiens
cccacagctcccacc

SEQ ID NO: 2827393 - DNA, 17 bp, Homo sapiens
cccacagctcccacccc

SEQ ID NO: 2827394 - DNA, 20 bp, Homo sapiens
cccacagctcccaccccacc

SEQ ID NO: 2827395 - DNA, 17 bp, Homo sapiens
cccacaggatcagtctg

SEQ ID NO: 2827396 - DNA, 14 bp, Homo sapiens
cccacagggccaga

SEQ ID NO: 2827397 - DNA, 15 bp, Homo sapiens
cccacatccctgggc

SEQ ID NO: 2827398 - DNA, 16 bp, Homo sapiens
cccacatccctgggcc

SEQ ID NO: 2827399 - DNA, 17 bp, Homo sapiens
cccacatccctgggcct

SEQ ID NO: 2827400 - DNA, 14 bp, Homo sapiens
cccacattggaccc

SEQ ID NO: 2827401 - DNA, 13 bp, Homo sapiens
cccaccaccctcc

SEQ ID NO: 2827402 - DNA, 23 bp, Homo sapiens
cccaccaccctcccaccatgcgc

SEQ ID NO: 2827403 - DNA, 19 bp, Homo sapiens
cccaccacctaggccactc

SEQ ID NO: 2827404 - DNA, 18 bp, Homo sapiens
cccaccaccttggactcc

SEQ ID NO: 2827405 - DNA, 20 bp, Homo sapiens
cccaccaccttggactcctc

SEQ ID NO: 2827406 - DNA, 22 bp, Homo sapiens
cccaccaccttggactcctccc

SEQ ID NO: 2827407 - DNA, 20 bp, Homo sapiens
cccaccacgatgtggccctg

SEQ ID NO: 2827408 - DNA, 23 bp, Homo sapiens
cccaccagcatgtcactcccaga

SEQ ID NO: 2827409 - DNA, 17 bp, Homo sapiens
cccaccagccacctctt

SEQ ID NO: 2827410 - DNA, 15 bp, Homo sapiens
cccacccacatgtga

SEQ ID NO: 2827411 - DNA, 13 bp, Homo sapiens
cccacccccagcc

SEQ ID NO: 2827412 - DNA, 16 bp, Homo sapiens
cccacccccagccccg

SEQ ID NO: 2827413 - DNA, 17 bp, Homo sapiens
cccaccccctccccagg

SEQ ID NO: 2827414 - DNA, 23 bp, Homo sapiens
cccaccctcgtggacacctgccc

SEQ ID NO: 2827415 - DNA, 19 bp, Homo sapiens
cccaccgggccactccttc

SEQ ID NO: 2827416 - DNA, 15 bp, Homo sapiens
cccacctcagcctcc

SEQ ID NO: 2827417 - DNA, 19 bp, Homo sapiens
cccacctgctgagagaccc

SEQ ID NO: 2827418 - DNA, 19 bp, Homo sapiens
cccaccttcaattcctggg

SEQ ID NO: 2827419 - DNA, 20 bp, Homo sapiens
cccaccttcaattcctgggc

SEQ ID NO: 2827420 - DNA, 14 bp, Homo sapiens
cccaccttccccag

SEQ ID NO: 2827421 - DNA, 17 bp, Homo sapiens
cccaccttccccagact

SEQ ID NO: 2827422 - DNA, 16 bp, Homo sapiens
cccaccttgccaagct

SEQ ID NO: 2827423 - DNA, 15 bp, Homo sapiens
cccaccttggctcaa

SEQ ID NO: 2827424 - DNA, 14 bp, Homo sapiens
cccaccttggctgc

SEQ ID NO: 2827425 - DNA, 20 bp, Homo sapiens
cccacgctggagtgcagtga

SEQ ID NO: 2827426 - DNA, 17 bp, Homo sapiens
cccacgtgtgcagactg

SEQ ID NO: 2827427 - DNA, 17 bp, Homo sapiens
cccactacgtgccaggc

SEQ ID NO: 2827428 - DNA, 20 bp, Homo sapiens
cccactccctggctctcaga

SEQ ID NO: 2827429 - DNA, 21 bp, Homo sapiens
cccactctcattccccaggtg

SEQ ID NO: 2827430 - DNA, 15 bp, Homo sapiens
cccactctgctctga

SEQ ID NO: 2827431 - DNA, 16 bp, Homo sapiens
cccggaaagactgaaa

SEQ ID NO: 2827432 - DNA, 13 bp, Homo sapiens
cccggagaaggcc

SEQ ID NO: 2827433 - DNA, 21 bp, Homo sapiens
cccggagaaggccgctgcccc

SEQ ID NO: 2827434 - DNA, 22 bp, Homo sapiens
cccggagaaggccgctgcccca

SEQ ID NO: 2827435 - DNA, 15 bp, Homo sapiens
cccggcaccccctgc

SEQ ID NO: 2827436 - DNA, 17 bp, Homo sapiens
cccggcaccccctgcag

SEQ ID NO: 2827437 - DNA, 19 bp, Homo sapiens
cccggcaccccctgcagct

SEQ ID NO: 2827438 - DNA, 19 bp, Homo sapiens
cccggccccatcagaggct

SEQ ID NO: 2827439 - DNA, 18 bp, Homo sapiens
cccggcctgctcccagca

SEQ ID NO: 2827440 - DNA, 20 bp, Homo sapiens
cccggcctgctcccagcagc

SEQ ID NO: 2827441 - DNA, 13 bp, Homo sapiens
cccggctccccct

SEQ ID NO: 2827442 - DNA, 13 bp, Homo sapiens
cccgggcctgcct

SEQ ID NO: 2827443 - DNA, 22 bp, Homo sapiens
cccgggcctgcctctgactcac

SEQ ID NO: 2827444 - DNA, 14 bp, Homo sapiens
cccgggtccccagc

SEQ ID NO: 2827445 - DNA, 16 bp, Homo sapiens
cccgggtccccagctc

SEQ ID NO: 2827446 - DNA, 17 bp, Homo sapiens
cccgggtccccagctcc

SEQ ID NO: 2827447 - DNA, 15 bp, Homo sapiens
cccggtcctggcccc

SEQ ID NO: 2827448 - DNA, 21 bp, Homo sapiens
cccgtctggggttcagcccct

SEQ ID NO: 2827449 - DNA, 17 bp, Homo sapiens
cccgtcttcagcctagc

SEQ ID NO: 2827450 - DNA, 20 bp, Homo sapiens
cccgtgaaagaattattttt

SEQ ID NO: 2827451 - DNA, 17 bp, Homo sapiens
cccgtggaggctgctcg

SEQ ID NO: 2827452 - DNA, 17 bp, Homo sapiens
cccgtggtctttgaata

SEQ ID NO: 2827453 - DNA, 20 bp, Homo sapiens
cccgtggtctttgaataaag

SEQ ID NO: 2827454 - DNA, 21 bp, Homo sapiens
cccgtggtctttgaataaagt

SEQ ID NO: 2827455 - DNA, 17 bp, Homo sapiens
cccgttctgctggcctg

SEQ ID NO: 2827456 - DNA, 12 bp, Homo sapiens
ccctaaaataaa

SEQ ID NO: 2827457 - DNA, 19 bp, Homo sapiens
ccctaaggatctctcagga

SEQ ID NO: 2827458 - DNA, 18 bp, Homo sapiens
ccctacacccctcccctg

SEQ ID NO: 2827459 - DNA, 19 bp, Homo sapiens
ccctacttcattttcagag

SEQ ID NO: 2827460 - DNA, 22 bp, Homo sapiens
ccctacttcattttcagagtga

SEQ ID NO: 2827461 - DNA, 11 bp, Homo sapiens
ccctatcaaaa

SEQ ID NO: 2827462 - DNA, 20 bp, Homo sapiens
ccctatcaaaacatatcaat

SEQ ID NO: 2827463 - DNA, 21 bp, Homo sapiens
ccctatcaaaacatatcaatt

SEQ ID NO: 2827464 - DNA, 19 bp, Homo sapiens
ccctatccacccagcccat

SEQ ID NO: 2827465 - DNA, 18 bp, Homo sapiens
ccctcaaaaaaagccttt

SEQ ID NO: 2827466 - DNA, 19 bp, Homo sapiens
ccctcaaaaaaagccttta

SEQ ID NO: 2827467 - DNA, 18 bp, Homo sapiens
ccctcaccccctcccacc

SEQ ID NO: 2827468 - DNA, 17 bp, Homo sapiens
ccctcactgctggggag

SEQ ID NO: 2827469 - DNA, 22 bp, Homo sapiens
ccctcagggatcttgcattccc

SEQ ID NO: 2827470 - DNA, 15 bp, Homo sapiens
ccctcataccatctg

SEQ ID NO: 2827471 - DNA, 17 bp, Homo sapiens
ccctcataccatctgct

SEQ ID NO: 2827472 - DNA, 19 bp, Homo sapiens
ccctcataccatctgctgc

SEQ ID NO: 2827473 - DNA, 15 bp, Homo sapiens
ccctcattcccctcg

SEQ ID NO: 2827474 - DNA, 16 bp, Homo sapiens
ccctccacagccgcag

SEQ ID NO: 2827475 - DNA, 13 bp, Homo sapiens
ccctccaccccag

SEQ ID NO: 2827476 - DNA, 13 bp, Homo sapiens
ccctcccaccatg

SEQ ID NO: 2827477 - DNA, 15 bp, Homo sapiens
ccctcccacccccag

SEQ ID NO: 2827478 - DNA, 17 bp, Homo sapiens
ccctccccattcacaga

SEQ ID NO: 2827479 - DNA, 14 bp, Homo sapiens
ccctcccccctgta

SEQ ID NO: 2827480 - DNA, 16 bp, Homo sapiens
ccctcccctgccctag

SEQ ID NO: 2827481 - DNA, 15 bp, Homo sapiens
ccctccctggcctca

SEQ ID NO: 2827482 - DNA, 22 bp, Homo sapiens
ccctccgccttcactccggtgt

SEQ ID NO: 2827483 - DNA, 20 bp, Homo sapiens
ccctcctccccttcctgcac

SEQ ID NO: 2827484 - DNA, 22 bp, Homo sapiens
ccctcctccccttcctgcaccc

SEQ ID NO: 2827485 - DNA, 12 bp, Homo sapiens
ccctcctctgcc

SEQ ID NO: 2827486 - DNA, 13 bp, Homo sapiens
ccctcctctgcca

SEQ ID NO: 2827487 - DNA, 16 bp, Homo sapiens
ccctcctctgccacct

SEQ ID NO: 2827488 - DNA, 11 bp, Homo sapiens
ccctccttcca

SEQ ID NO: 2827489 - DNA, 15 bp, Homo sapiens
ccctcgctgtcctgc

SEQ ID NO: 2827490 - DNA, 16 bp, Homo sapiens
ccctcgctgtcctgct

SEQ ID NO: 2827491 - DNA, 16 bp, Homo sapiens
ccctcgtggacacctg

SEQ ID NO: 2827492 - DNA, 14 bp, Homo sapiens
ccctctcccaggcc

SEQ ID NO: 2827493 - DNA, 20 bp, Homo sapiens
ccctctcctcccccaccttc

SEQ ID NO: 2827494 - DNA, 12 bp, Homo sapiens
ccctctcctgcc

SEQ ID NO: 2827495 - DNA, 12 bp, Homo sapiens
ccctctcttgcc

SEQ ID NO: 2827496 - DNA, 20 bp, Homo sapiens
ccctctgagaattccaagga

SEQ ID NO: 2827497 - DNA, 14 bp, Homo sapiens
ccctctggccctgc

SEQ ID NO: 2827498 - DNA, 17 bp, Homo sapiens
ccctgaaaacccagaga

SEQ ID NO: 2827499 - DNA, 15 bp, Homo sapiens
ccctgaacatctgtg

SEQ ID NO: 2827500 - DNA, 17 bp, Homo sapiens
ccctgaacatctgtgtg

SEQ ID NO: 2827501 - DNA, 15 bp, Homo sapiens
ccctgaagatttcag

SEQ ID NO: 2827502 - DNA, 18 bp, Homo sapiens
ccctgaagatttcagagg

SEQ ID NO: 2827503 - DNA, 19 bp, Homo sapiens
ccctgaagatttcagaggc

SEQ ID NO: 2827504 - DNA, 20 bp, Homo sapiens
ccctgaatggttccatgcct

SEQ ID NO: 2827505 - DNA, 15 bp, Homo sapiens
ccctgacctcccagc

SEQ ID NO: 2827506 - DNA, 17 bp, Homo sapiens
ccctgacctcccagccc

SEQ ID NO: 2827507 - DNA, 18 bp, Homo sapiens
ccctgacctcccagccct

SEQ ID NO: 2827508 - DNA, 18 bp, Homo sapiens
ccctgaggagtctgaggt

SEQ ID NO: 2827509 - DNA, 22 bp, Homo sapiens
ccctgaggagtctgaggtcctg

SEQ ID NO: 2827510 - DNA, 23 bp, Homo sapiens
ccctgaggtcacctggaatcaga

SEQ ID NO: 2827511 - DNA, 17 bp, Homo sapiens
ccctgagtcaccaggaa

SEQ ID NO: 2827512 - DNA, 20 bp, Homo sapiens
ccctgatcaagtcaccggag

SEQ ID NO: 2827513 - DNA, 20 bp, Homo sapiens
ccctgcacagatatttccat

SEQ ID NO: 2827514 - DNA, 12 bp, Homo sapiens
ccctgcacttgc

SEQ ID NO: 2827515 - DNA, 19 bp, Homo sapiens
ccctgcacttgcagactct

SEQ ID NO: 2827516 - DNA, 13 bp, Homo sapiens
ccctgcagaccct

SEQ ID NO: 2827517 - DNA, 14 bp, Homo sapiens
ccctgcagaccctg

SEQ ID NO: 2827518 - DNA, 15 bp, Homo sapiens
ccctgcagaccctgc

SEQ ID NO: 2827519 - DNA, 19 bp, Homo sapiens
ccctgcagaccctgccctt

SEQ ID NO: 2827520 - DNA, 12 bp, Homo sapiens
ccctgcagcctg

SEQ ID NO: 2827521 - DNA, 22 bp, Homo sapiens
ccctgcagcttgtagccagccg

SEQ ID NO: 2827522 - DNA, 13 bp, Homo sapiens
cctccaccgctgc

SEQ ID NO: 2827523 - DNA, 17 bp, Homo sapiens
cctccagctttcctgta

SEQ ID NO: 2827524 - DNA, 13 bp, Homo sapiens
cctccaggcaaaa

SEQ ID NO: 2827525 - DNA, 18 bp, Homo sapiens
cctccaggcatgctggcc

SEQ ID NO: 2827526 - DNA, 16 bp, Homo sapiens
cctccagggccacgtg

SEQ ID NO: 2827527 - DNA, 20 bp, Homo sapiens
cctccagggccacgtgccag

SEQ ID NO: 2827528 - DNA, 20 bp, Homo sapiens
cctccagtagtggacaacag

SEQ ID NO: 2827529 - DNA, 16 bp, Homo sapiens
cctccatgctgcctcc

SEQ ID NO: 2827530 - DNA, 19 bp, Homo sapiens
cctccatgctgcctccaga

SEQ ID NO: 2827531 - DNA, 15 bp, Homo sapiens
cctcccaaagtgctg

SEQ ID NO: 2827532 - DNA, 16 bp, Homo sapiens
cctcccaaagtgctgg

SEQ ID NO: 2827533 - DNA, 17 bp, Homo sapiens
cctcccaaagtgctggg

SEQ ID NO: 2827534 - DNA, 16 bp, Homo sapiens
cctcccaataaagctg

SEQ ID NO: 2827535 - DNA, 15 bp, Homo sapiens
cctcccaccaccctc

SEQ ID NO: 2827536 - DNA, 20 bp, Homo sapiens
cctcccaccaccctcccacc

SEQ ID NO: 2827537 - DNA, 21 bp, Homo sapiens
cctcccaccatgcgctgctca

SEQ ID NO: 2827538 - DNA, 17 bp, Homo sapiens
cctcccacctcagcctc

SEQ ID NO: 2827539 - DNA, 13 bp, Homo sapiens
cctcccagcccta

SEQ ID NO: 2827540 - DNA, 18 bp, Homo sapiens
cctcccagccctatggat

SEQ ID NO: 2827541 - DNA, 16 bp, Homo sapiens
cctccccaccttcccc

SEQ ID NO: 2827542 - DNA, 19 bp, Homo sapiens
cctccccaccttccccaga

SEQ ID NO: 2827543 - DNA, 14 bp, Homo sapiens
cctccccaggggag

SEQ ID NO: 2827544 - DNA, 22 bp, Homo sapiens
cctccccaggggagagggtctg

SEQ ID NO: 2827545 - DNA, 20 bp, Homo sapiens
cctccccattagagtcagcc

SEQ ID NO: 2827546 - DNA, 22 bp, Homo sapiens
cctccccattcacagagccttt

SEQ ID NO: 2827547 - DNA, 21 bp, Homo sapiens
cctccccattcagacacttca

SEQ ID NO: 2827548 - DNA, 16 bp, Homo sapiens
cctccccccactgcag

SEQ ID NO: 2827549 - DNA, 18 bp, Homo sapiens
cctccccccactgcaggc

SEQ ID NO: 2827550 - DNA, 17 bp, Homo sapiens
cctccccccagcccctc

SEQ ID NO: 2827551 - DNA, 15 bp, Homo sapiens
cctcccctatccacc

SEQ ID NO: 2827552 - DNA, 14 bp, Homo sapiens
cctcccctccccca

SEQ ID NO: 2827553 - DNA, 13 bp, Homo sapiens
cctccccttcctg

SEQ ID NO: 2827554 - DNA, 18 bp, Homo sapiens
cctcccgaatagctggga

SEQ ID NO: 2827555 - DNA, 19 bp, Homo sapiens
cctccctccaccccaggac

SEQ ID NO: 2827556 - DNA, 20 bp, Homo sapiens
cctccctccaccccaggacg

SEQ ID NO: 2827557 - DNA, 13 bp, Homo sapiens
cctccctgaacca

SEQ ID NO: 2827558 - DNA, 13 bp, Homo sapiens
cctccctgccctg

SEQ ID NO: 2827559 - DNA, 15 bp, Homo sapiens
cctccctgtcctcct

SEQ ID NO: 2827560 - DNA, 17 bp, Homo sapiens
cctccgccccagacaca

SEQ ID NO: 2827561 - DNA, 19 bp, Homo sapiens
cctccgccccagacacacc

SEQ ID NO: 2827562 - DNA, 19 bp, Homo sapiens
cctccgccttcactccggt

SEQ ID NO: 2827563 - DNA, 19 bp, Homo sapiens
cctcctatcagaagtttct

SEQ ID NO: 2827564 - DNA, 20 bp, Homo sapiens
cctcctattttaattggaat

SEQ ID NO: 2827565 - DNA, 15 bp, Homo sapiens
cctcctcaccccgtc

SEQ ID NO: 2827566 - DNA, 12 bp, Homo sapiens
cctcctcccacc

SEQ ID NO: 2827567 - DNA, 16 bp, Homo sapiens
cctcctccccttcctg

SEQ ID NO: 2827568 - DNA, 15 bp, Homo sapiens
cctcctcctttgcct

SEQ ID NO: 2827569 - DNA, 13 bp, Homo sapiens
cctcctctgccac

SEQ ID NO: 2827570 - DNA, 15 bp, Homo sapiens
cctcctctgccacct

SEQ ID NO: 2827571 - DNA, 20 bp, Homo sapiens
cctcctctgccacctcccct

SEQ ID NO: 2827572 - DNA, 21 bp, Homo sapiens
cctcctctgccacctccccta

SEQ ID NO: 2827573 - DNA, 15 bp, Homo sapiens
cctcctctgtccagg

SEQ ID NO: 2827574 - DNA, 15 bp, Homo sapiens
cctcctgacctgtca

SEQ ID NO: 2827575 - DNA, 14 bp, Homo sapiens
cctcctgcccagga

SEQ ID NO: 2827576 - DNA, 15 bp, Homo sapiens
cctcctgcccaggag

SEQ ID NO: 2827577 - DNA, 16 bp, Homo sapiens
cctcctgcccaggaga

SEQ ID NO: 2827578 - DNA, 13 bp, Homo sapiens
cctcctgcctcga

SEQ ID NO: 2827579 - DNA, 14 bp, Homo sapiens
cctcctgggctaag

SEQ ID NO: 2827580 - DNA, 13 bp, Homo sapiens
cctcctgtgtgtg

SEQ ID NO: 2827581 - DNA, 20 bp, Homo sapiens
cctccttccttgctgtccta

SEQ ID NO: 2827582 - DNA, 23 bp, Homo sapiens
cctccttctctgcccccagcctc

SEQ ID NO: 2827583 - DNA, 19 bp, Homo sapiens
cctcctttgcctaggaggc

SEQ ID NO: 2827584 - DNA, 16 bp, Homo sapiens
cctcgaactggctgca

SEQ ID NO: 2827585 - DNA, 22 bp, Homo sapiens
cctcgcatgccagagcctgggg

SEQ ID NO: 2827586 - DNA, 23 bp, Homo sapiens
cctcgcatgccagagcctggggc

SEQ ID NO: 2827587 - DNA, 13 bp, Homo sapiens
cctcgccctgggt

SEQ ID NO: 2827588 - DNA, 14 bp, Homo sapiens
cctcgccctgggtc

SEQ ID NO: 2827589 - DNA, 22 bp, Homo sapiens
cctcgctccccactctgctctg

SEQ ID NO: 2827590 - DNA, 15 bp, Homo sapiens
cctcggatcaccgag

SEQ ID NO: 2827591 - DNA, 17 bp, Homo sapiens
cctcggatcaccgagag

SEQ ID NO: 2827592 - DNA, 14 bp, Homo sapiens
cctcggtggccatg

SEQ ID NO: 2827593 - DNA, 20 bp, Homo sapiens
cctcggtggccatgcttctt

SEQ ID NO: 2827594 - DNA, 21 bp, Homo sapiens
cctcggtggccatgcttcttg

SEQ ID NO: 2827595 - DNA, 22 bp, Homo sapiens
cctcggtggccatgcttcttgc

SEQ ID NO: 2827596 - DNA, 19 bp, Homo sapiens
cctcgtcctccccctgcca

SEQ ID NO: 2827597 - DNA, 20 bp, Homo sapiens
cctcgtcctccccctgccag

SEQ ID NO: 2827598 - DNA, 15 bp, Homo sapiens
cctcgtggacacctg

SEQ ID NO: 2827599 - DNA, 16 bp, Homo sapiens
cctcgtggacacctgc

SEQ ID NO: 2827600 - DNA, 17 bp, Homo sapiens
cctcgtggacacctgcc

SEQ ID NO: 2827601 - DNA, 18 bp, Homo sapiens
cctcgtggacacctgccc

SEQ ID NO: 2827602 - DNA, 20 bp, Homo sapiens
cctcgtggacacctgccctg

SEQ ID NO: 2827603 - DNA, 21 bp, Homo sapiens
cctcgtggacacctgccctgc

SEQ ID NO: 2827604 - DNA, 22 bp, Homo sapiens
cctcgtggacacctgccctgcc

SEQ ID NO: 2827605 - DNA, 21 bp, Homo sapiens
cctctaacccccagtgccaca

SEQ ID NO: 2827606 - DNA, 20 bp, Homo sapiens
cctctacttaatgagatagt

SEQ ID NO: 2827607 - DNA, 23 bp, Homo sapiens
cctctcatcagtgtcctcttgct

SEQ ID NO: 2827608 - DNA, 16 bp, Homo sapiens
cctctccagccttctc

SEQ ID NO: 2827609 - DNA, 17 bp, Homo sapiens
cctctcccaggccccat

SEQ ID NO: 2827610 - DNA, 15 bp, Homo sapiens
cctctccccagcaag

SEQ ID NO: 2827611 - DNA, 20 bp, Homo sapiens
cctctccccagcaagtgaga

SEQ ID NO: 2827612 - DNA, 17 bp, Homo sapiens
cctctcccgcaccaggc

SEQ ID NO: 2827613 - DNA, 18 bp, Homo sapiens
cctgtagttgcgtggact

SEQ ID NO: 2827614 - DNA, 19 bp, Homo sapiens
cctgtagttgcgtggactc

SEQ ID NO: 2827615 - DNA, 23 bp, Homo sapiens
cctgtagttgcgtggactctgca

SEQ ID NO: 2827616 - DNA, 16 bp, Homo sapiens
cctgtataaccccacc

SEQ ID NO: 2827617 - DNA, 16 bp, Homo sapiens
cctgtatgtctccagt

SEQ ID NO: 2827618 - DNA, 14 bp, Homo sapiens
cctgtcaccaagct

SEQ ID NO: 2827619 - DNA, 19 bp, Homo sapiens
cctgtccaacctaacccct

SEQ ID NO: 2827620 - DNA, 14 bp, Homo sapiens
cctgtcccacctct

SEQ ID NO: 2827621 - DNA, 15 bp, Homo sapiens
cctgtcctccagctt

SEQ ID NO: 2827622 - DNA, 13 bp, Homo sapiens
cctgtcctcctcg

SEQ ID NO: 2827623 - DNA, 15 bp, Homo sapiens
cctgtcctcctcgga

SEQ ID NO: 2827624 - DNA, 23 bp, Homo sapiens
cctgtcctcctcggatcaccgag

SEQ ID NO: 2827625 - DNA, 17 bp, Homo sapiens
cctgtcgagacacttgc

SEQ ID NO: 2827626 - DNA, 20 bp, Homo sapiens
cctgtctgccagccagcagc

SEQ ID NO: 2827627 - DNA, 14 bp, Homo sapiens
cctgtctttaagga

SEQ ID NO: 2827628 - DNA, 17 bp, Homo sapiens
cctgtgcccacgtgtgc

SEQ ID NO: 2827629 - DNA, 21 bp, Homo sapiens
cctgtgcctcctcacccccag

SEQ ID NO: 2827630 - DNA, 18 bp, Homo sapiens
cctgtggcggtgcctggg

SEQ ID NO: 2827631 - DNA, 19 bp, Homo sapiens
cctgtggcggtgcctgggt

SEQ ID NO: 2827632 - DNA, 13 bp, Homo sapiens
cctgtgggagcct

SEQ ID NO: 2827633 - DNA, 14 bp, Homo sapiens
cctgtgggagcctc

SEQ ID NO: 2827634 - DNA, 17 bp, Homo sapiens
cctgtgggggcggctgt

SEQ ID NO: 2827635 - DNA, 13 bp, Homo sapiens
cctgtgtagctgt

SEQ ID NO: 2827636 - DNA, 15 bp, Homo sapiens
cctgtgtagctgtga

SEQ ID NO: 2827637 - DNA, 21 bp, Homo sapiens
cctgtgtagctgtgacctgct

SEQ ID NO: 2827638 - DNA, 11 bp, Homo sapiens
cctgtgtctta

SEQ ID NO: 2827639 - DNA, 17 bp, Homo sapiens
cctgtgtcttgcaatgg

SEQ ID NO: 2827640 - DNA, 19 bp, Homo sapiens
cctgtgtcttgcaatggca

SEQ ID NO: 2827641 - DNA, 22 bp, Homo sapiens
cctgtgtcttgcaatggcagcc

SEQ ID NO: 2827642 - DNA, 16 bp, Homo sapiens
cctgtgtgagttgagt

SEQ ID NO: 2827643 - DNA, 17 bp, Homo sapiens
cctgtgtggacaggact

SEQ ID NO: 2827644 - DNA, 21 bp, Homo sapiens
cctgtgtgtgcgcctacagga

SEQ ID NO: 2827645 - DNA, 20 bp, Homo sapiens
cctgttaacgtcatctcagg

SEQ ID NO: 2827646 - DNA, 21 bp, Homo sapiens
cctgttaacgtcatctcaggg

SEQ ID NO: 2827647 - DNA, 17 bp, Homo sapiens
cctgttacttaaatagc

SEQ ID NO: 2827648 - DNA, 22 bp, Homo sapiens
cctgttacttaaatagcatctg

SEQ ID NO: 2827649 - DNA, 14 bp, Homo sapiens
cctgttacttacct

SEQ ID NO: 2827650 - DNA, 15 bp, Homo sapiens
cctgttcagctccag

SEQ ID NO: 2827651 - DNA, 17 bp, Homo sapiens
cctgttcccccgctggc

SEQ ID NO: 2827652 - DNA, 17 bp, Homo sapiens
cctgtttaaaaaaagta

SEQ ID NO: 2827653 - DNA, 18 bp, Homo sapiens
cctgttttgttggaaggt

SEQ ID NO: 2827654 - DNA, 17 bp, Homo sapiens
cctgtttttaagctgtt

SEQ ID NO: 2827655 - DNA, 19 bp, Homo sapiens
cctgtttttaagctgtttc

SEQ ID NO: 2827656 - DNA, 14 bp, Homo sapiens
ccttacctcctgcc

SEQ ID NO: 2827657 - DNA, 18 bp, Homo sapiens
ccttacctcctgcccagg

SEQ ID NO: 2827658 - DNA, 20 bp, Homo sapiens
ccttacctcctgcccaggag

SEQ ID NO: 2827659 - DNA, 18 bp, Homo sapiens
ccttactatgatctcagg

SEQ ID NO: 2827660 - DNA, 12 bp, Homo sapiens
ccttactcctgt

SEQ ID NO: 2827661 - DNA, 18 bp, Homo sapiens
ccttagaagtcacacagt

SEQ ID NO: 2827662 - DNA, 19 bp, Homo sapiens
ccttagcagggaaacagct

SEQ ID NO: 2827663 - DNA, 22 bp, Homo sapiens
ccttagcttagacctcagcctg

SEQ ID NO: 2827664 - DNA, 23 bp, Homo sapiens
ccttagcttagacctcagcctgt

SEQ ID NO: 2827665 - DNA, 12 bp, Homo sapiens
ccttatgtatta

SEQ ID NO: 2827666 - DNA, 20 bp, Homo sapiens
ccttatgtattattttctat

SEQ ID NO: 2827667 - DNA, 15 bp, Homo sapiens
ccttattgtacctct

SEQ ID NO: 2827668 - DNA, 14 bp, Homo sapiens
ccttattttcaaga

SEQ ID NO: 2827669 - DNA, 22 bp, Homo sapiens
ccttcaacaattctaaaatgat

SEQ ID NO: 2827670 - DNA, 14 bp, Homo sapiens
ccttcaagcaccct

SEQ ID NO: 2827671 - DNA, 19 bp, Homo sapiens
ccttcaagttagctcagga

SEQ ID NO: 2827672 - DNA, 16 bp, Homo sapiens
ccttcaataaagtatc

SEQ ID NO: 2827673 - DNA, 16 bp, Homo sapiens
ccttcacaaccagcca

SEQ ID NO: 2827674 - DNA, 20 bp, Homo sapiens
ccttcacaaccagccacaca

SEQ ID NO: 2827675 - DNA, 22 bp, Homo sapiens
ccttcaccagagcccatgctca

SEQ ID NO: 2827676 - DNA, 15 bp, Homo sapiens
ccttcactccctccc

SEQ ID NO: 2827677 - DNA, 12 bp, Homo sapiens
ccttcagtgccc

SEQ ID NO: 2827678 - DNA, 15 bp, Homo sapiens
ccttcagtgcccacc

SEQ ID NO: 2827679 - DNA, 18 bp, Homo sapiens
ccttcagtgcccaccaac

SEQ ID NO: 2827680 - DNA, 20 bp, Homo sapiens
ccttccacggatccatgtag

SEQ ID NO: 2827681 - DNA, 20 bp, Homo sapiens
ccttccagtggtaccagctc

SEQ ID NO: 2827682 - DNA, 12 bp, Homo sapiens
ccttcccagctc

SEQ ID NO: 2827683 - DNA, 23 bp, Homo sapiens
ccttcccatgatgccgctcttct

SEQ ID NO: 2827684 - DNA, 15 bp, Homo sapiens
ccttcccatgccctg

SEQ ID NO: 2827685 - DNA, 13 bp, Homo sapiens
ccttccccagact

SEQ ID NO: 2827686 - DNA, 23 bp, Homo sapiens
ccttccccagactcagctccaga

SEQ ID NO: 2827687 - DNA, 20 bp, Homo sapiens
ccttcccccatcccctttcc

SEQ ID NO: 2827688 - DNA, 20 bp, Homo sapiens
ccttccccttgcccagggct

SEQ ID NO: 2827689 - DNA, 20 bp, Homo sapiens
ccttccctgctttgaggaca

SEQ ID NO: 2827690 - DNA, 16 bp, Homo sapiens
ccttcctacagatagt

SEQ ID NO: 2827691 - DNA, 18 bp, Homo sapiens
ccttcctgaccctccgct

SEQ ID NO: 2827692 - DNA, 13 bp, Homo sapiens
ccttcctgcaccc

SEQ ID NO: 2827693 - DNA, 14 bp, Homo sapiens
ccttcctgccacca

SEQ ID NO: 2827694 - DNA, 13 bp, Homo sapiens
ccttcctggacag

SEQ ID NO: 2827695 - DNA, 18 bp, Homo sapiens
ccttcctggacagctgtg

SEQ ID NO: 2827696 - DNA, 19 bp, Homo sapiens
ccttcctggacagctgtgc

SEQ ID NO: 2827697 - DNA, 14 bp, Homo sapiens
ccttccttccctgg

SEQ ID NO: 2827698 - DNA, 22 bp, Homo sapiens
ccttcctttcctctgcagcact

SEQ ID NO: 2827699 - DNA, 13 bp, Homo sapiens
ccttcgctcctgt

SEQ ID NO: 2827700 - DNA, 15 bp, Homo sapiens
ccttcgctcctgtgt

SEQ ID NO: 2827701 - DNA, 18 bp, Homo sapiens
ccttcgctcctgtgtctt

SEQ ID NO: 2827702 - DNA, 15 bp, Homo sapiens
ccttctactgagcct

SEQ ID NO: 2827703 - DNA, 14 bp, Homo sapiens
ccttctaggaagct

SEQ ID NO: 2827704 - DNA, 16 bp, Homo sapiens
cgctggtggaccacag

SEQ ID NO: 2827705 - DNA, 14 bp, Homo sapiens
cgctgtcctgctgt

SEQ ID NO: 2827706 - DNA, 16 bp, Homo sapiens
cgctgtcctgctgtgt

SEQ ID NO: 2827707 - DNA, 13 bp, Homo sapiens
cgcttccccacag

SEQ ID NO: 2827708 - DNA, 15 bp, Homo sapiens
cgcttccccacagaa

SEQ ID NO: 2827709 - DNA, 12 bp, Homo sapiens
cgcttctgactg

SEQ ID NO: 2827710 - DNA, 16 bp, Homo sapiens
cgctttctagctgttg

SEQ ID NO: 2827711 - DNA, 12 bp, Homo sapiens
cgctttgcctgc

SEQ ID NO: 2827712 - DNA, 14 bp, Homo sapiens
cggaagcagtgcct

SEQ ID NO: 2827713 - DNA, 21 bp, Homo sapiens
cggaatcctgtcgattagact

SEQ ID NO: 2827714 - DNA, 22 bp, Homo sapiens
cggaatcctgtcgattagactg

SEQ ID NO: 2827715 - DNA, 20 bp, Homo sapiens
cggaatgaaccacatcttgc

SEQ ID NO: 2827716 - DNA, 15 bp, Homo sapiens
cggacagccacggcc

SEQ ID NO: 2827717 - DNA, 16 bp, Homo sapiens
cggacagccacggcca

SEQ ID NO: 2827718 - DNA, 22 bp, Homo sapiens
cggacctgtggggccccagaga

SEQ ID NO: 2827719 - DNA, 18 bp, Homo sapiens
cggacgtttccatcaggt

SEQ ID NO: 2827720 - DNA, 16 bp, Homo sapiens
cggaggagaccagctc

SEQ ID NO: 2827721 - DNA, 18 bp, Homo sapiens
cggaggagaccagctcag

SEQ ID NO: 2827722 - DNA, 19 bp, Homo sapiens
cggaggttccagtgagccg

SEQ ID NO: 2827723 - DNA, 21 bp, Homo sapiens
cggagtagaaattgttcctga

SEQ ID NO: 2827724 - DNA, 22 bp, Homo sapiens
cggagtcccaccttggctgcag

SEQ ID NO: 2827725 - DNA, 18 bp, Homo sapiens
cggatcaccgagagtagc

SEQ ID NO: 2827726 - DNA, 19 bp, Homo sapiens
cggatgttgtcaggaatca

SEQ ID NO: 2827727 - DNA, 23 bp, Homo sapiens
cggatttgacaaaataacatttg

SEQ ID NO: 2827728 - DNA, 17 bp, Homo sapiens
cggcaaccccagttctg

SEQ ID NO: 2827729 - DNA, 20 bp, Homo sapiens
cggcaaccccagttctgctc

SEQ ID NO: 2827730 - DNA, 19 bp, Homo sapiens
cggcacattggcagtgtgt

SEQ ID NO: 2827731 - DNA, 17 bp, Homo sapiens
cggcaccccctgcagct

SEQ ID NO: 2827732 - DNA, 22 bp, Homo sapiens
cggcacctacatccccaggtct

SEQ ID NO: 2827733 - DNA, 23 bp, Homo sapiens
cggcacctacatccccaggtctc

SEQ ID NO: 2827734 - DNA, 20 bp, Homo sapiens
cggcacctgggccctggggc

SEQ ID NO: 2827735 - DNA, 22 bp, Homo sapiens
cggcacctgggccctggggcct

SEQ ID NO: 2827736 - DNA, 18 bp, Homo sapiens
cggcagtcatactggggt

SEQ ID NO: 2827737 - DNA, 19 bp, Homo sapiens
cggcccacagctcccaccc

SEQ ID NO: 2827738 - DNA, 22 bp, Homo sapiens
cggcccacagctcccaccccac

SEQ ID NO: 2827739 - DNA, 12 bp, Homo sapiens
cggcccagagac

SEQ ID NO: 2827740 - DNA, 17 bp, Homo sapiens
cggcccagagacccctt

SEQ ID NO: 2827741 - DNA, 23 bp, Homo sapiens
cggccccatcagaggctggggga

SEQ ID NO: 2827742 - DNA, 13 bp, Homo sapiens
cggcccctgctgg

SEQ ID NO: 2827743 - DNA, 19 bp, Homo sapiens
cggcctatgacttgggcac

SEQ ID NO: 2827744 - DNA, 13 bp, Homo sapiens
cggcgccaccatc

SEQ ID NO: 2827745 - DNA, 17 bp, Homo sapiens
cggcgccaccatcctgc

SEQ ID NO: 2827746 - DNA, 20 bp, Homo sapiens
cggcgcggtggctcacgcct

SEQ ID NO: 2827747 - DNA, 16 bp, Homo sapiens
cggctacatcaaatca

SEQ ID NO: 2827748 - DNA, 12 bp, Homo sapiens
cggctactcagc

SEQ ID NO: 2827749 - DNA, 17 bp, Homo sapiens
cggctcactgcagcctc

SEQ ID NO: 2827750 - DNA, 18 bp, Homo sapiens
cggctcactgcagcctca

SEQ ID NO: 2827751 - DNA, 12 bp, Homo sapiens
cggctccaggct

SEQ ID NO: 2827752 - DNA, 14 bp, Homo sapiens
cggctccaggctcc

SEQ ID NO: 2827753 - DNA, 15 bp, Homo sapiens
cggctccaggctcct

SEQ ID NO: 2827754 - DNA, 18 bp, Homo sapiens
cggctccccctgcttctc

SEQ ID NO: 2827755 - DNA, 16 bp, Homo sapiens
cggctctcctgagagg

SEQ ID NO: 2827756 - DNA, 22 bp, Homo sapiens
cggctgagtcatgatctccctg

SEQ ID NO: 2827757 - DNA, 20 bp, Homo sapiens
cggctgtgggggaggtccct

SEQ ID NO: 2827758 - DNA, 23 bp, Homo sapiens
cggctgtgggggaggtccctgcc

SEQ ID NO: 2827759 - DNA, 15 bp, Homo sapiens
cgggaacagacaaca

SEQ ID NO: 2827760 - DNA, 20 bp, Homo sapiens
cgggaacagtgtttcccata

SEQ ID NO: 2827761 - DNA, 12 bp, Homo sapiens
cgggacagacct

SEQ ID NO: 2827762 - DNA, 13 bp, Homo sapiens
cgggacagacctg

SEQ ID NO: 2827763 - DNA, 17 bp, Homo sapiens
cgggacatgcagctctg

SEQ ID NO: 2827764 - DNA, 21 bp, Homo sapiens
cgggacgagaccctacaggag

SEQ ID NO: 2827765 - DNA, 19 bp, Homo sapiens
cgggagaggagatcagggc

SEQ ID NO: 2827766 - DNA, 15 bp, Homo sapiens
cgggagcctctcctt

SEQ ID NO: 2827767 - DNA, 20 bp, Homo sapiens
cgggaggatgttctgggaca

SEQ ID NO: 2827768 - DNA, 21 bp, Homo sapiens
cgggaggcggaggttccagtg

SEQ ID NO: 2827769 - DNA, 17 bp, Homo sapiens
cgggaggctgagacagg

SEQ ID NO: 2827770 - DNA, 20 bp, Homo sapiens
cgggaggtggaggttgcagt

SEQ ID NO: 2827771 - DNA, 18 bp, Homo sapiens
cgggatggtcctggggct

SEQ ID NO: 2827772 - DNA, 21 bp, Homo sapiens
cgggcacctatagtcccagct

SEQ ID NO: 2827773 - DNA, 15 bp, Homo sapiens
cgggcagcccagcct

SEQ ID NO: 2827774 - DNA, 16 bp, Homo sapiens
cgggcagcccagcctc

SEQ ID NO: 2827775 - DNA, 21 bp, Homo sapiens
cgggcatggtggcgcaagcct

SEQ ID NO: 2827776 - DNA, 19 bp, Homo sapiens
cgggccactccttcctgcc

SEQ ID NO: 2827777 - DNA, 23 bp, Homo sapiens
cgggcgcctgtagtcccagccac

SEQ ID NO: 2827778 - DNA, 18 bp, Homo sapiens
cgggcttgggccctgcac

SEQ ID NO: 2827779 - DNA, 20 bp, Homo sapiens
cgggcttgggccctgcacag

SEQ ID NO: 2827780 - DNA, 22 bp, Homo sapiens
cggggaactggccaagctgagg

SEQ ID NO: 2827781 - DNA, 19 bp, Homo sapiens
cggggcatgctggggcaag

SEQ ID NO: 2827782 - DNA, 14 bp, Homo sapiens
cggggccccagggc

SEQ ID NO: 2827783 - DNA, 13 bp, Homo sapiens
cggggctgggaag

SEQ ID NO: 2827784 - DNA, 19 bp, Homo sapiens
cgggggagccaacagcagc

SEQ ID NO: 2827785 - DNA, 17 bp, Homo sapiens
cggggtgcacaggaggg

SEQ ID NO: 2827786 - DNA, 14 bp, Homo sapiens
cgggtacctcagtt

SEQ ID NO: 2827787 - DNA, 18 bp, Homo sapiens
cgggtacctcagtttctc

SEQ ID NO: 2827788 - DNA, 16 bp, Homo sapiens
cgggtccccagctccc

SEQ ID NO: 2827789 - DNA, 20 bp, Homo sapiens
cgggtccccagctccccagg

SEQ ID NO: 2827790 - DNA, 23 bp, Homo sapiens
cgggtggaaaagaatccctgcag

SEQ ID NO: 2827791 - DNA, 18 bp, Homo sapiens
cgggtggatcacctgagg

SEQ ID NO: 2827792 - DNA, 18 bp, Homo sapiens
cgggtggctagtcagaga

SEQ ID NO: 2827793 - DNA, 14 bp, Homo sapiens
cggtccacccagga

SEQ ID NO: 2827794 - DNA, 13 bp, Homo sapiens
ctatacctgtgtt

SEQ ID NO: 2827795 - DNA, 12 bp, Homo sapiens
ctatagactcta

SEQ ID NO: 2827796 - DNA, 15 bp, Homo sapiens
ctatagagaaaaact

SEQ ID NO: 2827797 - DNA, 17 bp, Homo sapiens
ctatagcctaggtgaca

SEQ ID NO: 2827798 - DNA, 19 bp, Homo sapiens
ctatagcctaggtgacaga

SEQ ID NO: 2827799 - DNA, 15 bp, Homo sapiens
ctataggctggagaa

SEQ ID NO: 2827800 - DNA, 16 bp, Homo sapiens
ctataggctggagaag

SEQ ID NO: 2827801 - DNA, 18 bp, Homo sapiens
ctataggctggagaagct

SEQ ID NO: 2827802 - DNA, 16 bp, Homo sapiens
ctatatagtttattga

SEQ ID NO: 2827803 - DNA, 17 bp, Homo sapiens
ctatatatacatgtata

SEQ ID NO: 2827804 - DNA, 18 bp, Homo sapiens
ctatatatacatgtatag

SEQ ID NO: 2827805 - DNA, 14 bp, Homo sapiens
ctatatctctaaac

SEQ ID NO: 2827806 - DNA, 15 bp, Homo sapiens
ctatatgaaaaacaa

SEQ ID NO: 2827807 - DNA, 15 bp, Homo sapiens
ctatattgtacacac

SEQ ID NO: 2827808 - DNA, 14 bp, Homo sapiens
ctatcaaaacatat

SEQ ID NO: 2827809 - DNA, 13 bp, Homo sapiens
ctatcaaactgaa

SEQ ID NO: 2827810 - DNA, 21 bp, Homo sapiens
ctatcaaccccagacactggt

SEQ ID NO: 2827811 - DNA, 21 bp, Homo sapiens
ctatcaacctaagcaacagaa

SEQ ID NO: 2827812 - DNA, 14 bp, Homo sapiens
ctatcaatagtcaa

SEQ ID NO: 2827813 - DNA, 17 bp, Homo sapiens
ctatccacccagcccat

SEQ ID NO: 2827814 - DNA, 14 bp, Homo sapiens
ctatccacctgggg

SEQ ID NO: 2827815 - DNA, 21 bp, Homo sapiens
ctatctctgtgtgcacaaata

SEQ ID NO: 2827816 - DNA, 17 bp, Homo sapiens
ctatctggaatttaatt

SEQ ID NO: 2827817 - DNA, 16 bp, Homo sapiens
ctatgaaaagctagaa

SEQ ID NO: 2827818 - DNA, 20 bp, Homo sapiens
ctatgacttgggcaccccca

SEQ ID NO: 2827819 - DNA, 21 bp, Homo sapiens
ctatgagaattgggattacat

SEQ ID NO: 2827820 - DNA, 21 bp, Homo sapiens
ctatgatcccagcactttggg

SEQ ID NO: 2827821 - DNA, 13 bp, Homo sapiens
ctatgattttcta

SEQ ID NO: 2827822 - DNA, 18 bp, Homo sapiens
ctatgcacatatggactc

SEQ ID NO: 2827823 - DNA, 20 bp, Homo sapiens
ctatgcacatatggactctg

SEQ ID NO: 2827824 - DNA, 22 bp, Homo sapiens
ctatgcacatatggactctgca

SEQ ID NO: 2827825 - DNA, 10 bp, Homo sapiens
ctatggatgt

SEQ ID NO: 2827826 - DNA, 11 bp, Homo sapiens
ctatggatgtg

SEQ ID NO: 2827827 - DNA, 19 bp, Homo sapiens
ctatggcagtccagccagc

SEQ ID NO: 2827828 - DNA, 19 bp, Homo sapiens
ctatggctgcctgcatcta

SEQ ID NO: 2827829 - DNA, 15 bp, Homo sapiens
ctatggctgtatttt

SEQ ID NO: 2827830 - DNA, 21 bp, Homo sapiens
ctatggctgtatttttagaga

SEQ ID NO: 2827831 - DNA, 23 bp, Homo sapiens
ctatgggactcaatgcactgaca

SEQ ID NO: 2827832 - DNA, 18 bp, Homo sapiens
ctatggttcccaataaaa

SEQ ID NO: 2827833 - DNA, 20 bp, Homo sapiens
ctatgtcctaaggacacact

SEQ ID NO: 2827834 - DNA, 19 bp, Homo sapiens
ctatgtggatctaaataat

SEQ ID NO: 2827835 - DNA, 17 bp, Homo sapiens
ctatgtgggacacctca

SEQ ID NO: 2827836 - DNA, 21 bp, Homo sapiens
ctatgtgtcatgatttcaatg

SEQ ID NO: 2827837 - DNA, 18 bp, Homo sapiens
ctatgttgcccaggcagg

SEQ ID NO: 2827838 - DNA, 19 bp, Homo sapiens
ctatgttgcccaggcaggt

SEQ ID NO: 2827839 - DNA, 17 bp, Homo sapiens
ctattagatgttttaca

SEQ ID NO: 2827840 - DNA, 16 bp, Homo sapiens
ctattataactgcata

SEQ ID NO: 2827841 - DNA, 20 bp, Homo sapiens
ctattattttcactgtagaa

SEQ ID NO: 2827842 - DNA, 14 bp, Homo sapiens
ctattcagacaagc

SEQ ID NO: 2827843 - DNA, 14 bp, Homo sapiens
ctattctattgcag

SEQ ID NO: 2827844 - DNA, 18 bp, Homo sapiens
ctattctctcctcagact

SEQ ID NO: 2827845 - DNA, 17 bp, Homo sapiens
ctattgacaagtcattt

SEQ ID NO: 2827846 - DNA, 23 bp, Homo sapiens
ctattgatgtttccagaaaatat

SEQ ID NO: 2827847 - DNA, 13 bp, Homo sapiens
ctattgcactcca

SEQ ID NO: 2827848 - DNA, 15 bp, Homo sapiens
ctattgcatgtaaaa

SEQ ID NO: 2827849 - DNA, 16 bp, Homo sapiens
ctattgcatgtaaaat

SEQ ID NO: 2827850 - DNA, 20 bp, Homo sapiens
ctattgcatgtaaaatgcag

SEQ ID NO: 2827851 - DNA, 15 bp, Homo sapiens
ctattgtaaatttgg

SEQ ID NO: 2827852 - DNA, 22 bp, Homo sapiens
ctattgtcccctagcaaggcat

SEQ ID NO: 2827853 - DNA, 22 bp, Homo sapiens
ctattgtgcaatgtaaatattt

SEQ ID NO: 2827854 - DNA, 15 bp, Homo sapiens
ctattgtgcctctgg

SEQ ID NO: 2827855 - DNA, 17 bp, Homo sapiens
ctatttaaaaaataaaa

SEQ ID NO: 2827856 - DNA, 23 bp, Homo sapiens
ctatttaaaaaataaaaaaatac

SEQ ID NO: 2827857 - DNA, 22 bp, Homo sapiens
ctatttaactggcttcagcctc

SEQ ID NO: 2827858 - DNA, 18 bp, Homo sapiens
ctatttatttactgagct

SEQ ID NO: 2827859 - DNA, 13 bp, Homo sapiens
ctattttaaaacc

SEQ ID NO: 2827860 - DNA, 14 bp, Homo sapiens
ctattttaaaacca

SEQ ID NO: 2827861 - DNA, 16 bp, Homo sapiens
ctattttaaaaccatg

SEQ ID NO: 2827862 - DNA, 12 bp, Homo sapiens
ctattttattcc

SEQ ID NO: 2827863 - DNA, 15 bp, Homo sapiens
ctatttttcttctaa

SEQ ID NO: 2827864 - DNA, 15 bp, Homo sapiens
ctatttttgtagaag

SEQ ID NO: 2827865 - DNA, 18 bp, Homo sapiens
ctcaaaatatttgtacat

SEQ ID NO: 2827866 - DNA, 20 bp, Homo sapiens
ctcaaactcttgacctcagg

SEQ ID NO: 2827867 - DNA, 13 bp, Homo sapiens
ctcaaactgggta

SEQ ID NO: 2827868 - DNA, 19 bp, Homo sapiens
ctcaaagcaagcattcaga

SEQ ID NO: 2827869 - DNA, 23 bp, Homo sapiens
ctcaaagcccccacttctctcca

SEQ ID NO: 2827870 - DNA, 19 bp, Homo sapiens
ctcaaataaaaagtgcttt

SEQ ID NO: 2827871 - DNA, 11 bp, Homo sapiens
ctcaaatacat

SEQ ID NO: 2827872 - DNA, 15 bp, Homo sapiens
ctcaaatctattcag

SEQ ID NO: 2827873 - DNA, 22 bp, Homo sapiens
ctcaaatctattcagacaagca

SEQ ID NO: 2827874 - DNA, 16 bp, Homo sapiens
ctcaaatgctaaatgc

SEQ ID NO: 2827875 - DNA, 18 bp, Homo sapiens
ctcaaatgctaaatgcaa

SEQ ID NO: 2827876 - DNA, 13 bp, Homo sapiens
ctcaaccactgtg

SEQ ID NO: 2827877 - DNA, 18 bp, Homo sapiens
ctcaaccccaccacttct

SEQ ID NO: 2827878 - DNA, 20 bp, Homo sapiens
ctcaacctaccaccccttcc

SEQ ID NO: 2827879 - DNA, 14 bp, Homo sapiens
ctcaacctctctcc

SEQ ID NO: 2827880 - DNA, 16 bp, Homo sapiens
ctcaacctctctcctt

SEQ ID NO: 2827881 - DNA, 20 bp, Homo sapiens
ctcaacctctctccttctgg

SEQ ID NO: 2827882 - DNA, 19 bp, Homo sapiens
ctcaagaagacatggagac

SEQ ID NO: 2827883 - DNA, 16 bp, Homo sapiens
ctcaagaggctgaggc

SEQ ID NO: 2827884 - DNA, 17 bp, Homo sapiens
ctcaagctgcatctaga

SEQ ID NO: 2827885 - DNA, 18 bp, Homo sapiens
ctccaggagcctaccccc

SEQ ID NO: 2827886 - DNA, 20 bp, Homo sapiens
ctccaggcacccttctttcc

SEQ ID NO: 2827887 - DNA, 21 bp, Homo sapiens
ctccaggcacccttctttcct

SEQ ID NO: 2827888 - DNA, 23 bp, Homo sapiens
ctccaggctcctttagcgcccag

SEQ ID NO: 2827889 - DNA, 15 bp, Homo sapiens
ctccaggctgtttct

SEQ ID NO: 2827890 - DNA, 16 bp, Homo sapiens
ctccagggccacgtgc

SEQ ID NO: 2827891 - DNA, 22 bp, Homo sapiens
ctccaggtcctctacttaatga

SEQ ID NO: 2827892 - DNA, 15 bp, Homo sapiens
ctccagtttccccat

SEQ ID NO: 2827893 - DNA, 13 bp, Homo sapiens
ctccatctccact

SEQ ID NO: 2827894 - DNA, 14 bp, Homo sapiens
ctccatctccactc

SEQ ID NO: 2827895 - DNA, 15 bp, Homo sapiens
ctccatgctgcctcc

SEQ ID NO: 2827896 - DNA, 17 bp, Homo sapiens
ctccatgctgcctccag

SEQ ID NO: 2827897 - DNA, 14 bp, Homo sapiens
ctccatgtgggcta

SEQ ID NO: 2827898 - DNA, 22 bp, Homo sapiens
ctccattaggatttgccccttc

SEQ ID NO: 2827899 - DNA, 18 bp, Homo sapiens
ctcccaaagtgctgggat

SEQ ID NO: 2827900 - DNA, 15 bp, Homo sapiens
ctcccaataaagctg

SEQ ID NO: 2827901 - DNA, 16 bp, Homo sapiens
ctcccaataaagctgg

SEQ ID NO: 2827902 - DNA, 17 bp, Homo sapiens
ctcccaataaagctgga

SEQ ID NO: 2827903 - DNA, 18 bp, Homo sapiens
ctcccaataaagctggac

SEQ ID NO: 2827904 - DNA, 23 bp, Homo sapiens
ctcccacaatctgggactttcac

SEQ ID NO: 2827905 - DNA, 14 bp, Homo sapiens
ctcccaccatgcgc

SEQ ID NO: 2827906 - DNA, 12 bp, Homo sapiens
ctcccaccccac

SEQ ID NO: 2827907 - DNA, 14 bp, Homo sapiens
ctcccacctcagcc

SEQ ID NO: 2827908 - DNA, 19 bp, Homo sapiens
ctcccaggccccatgacct

SEQ ID NO: 2827909 - DNA, 21 bp, Homo sapiens
ctcccaggccccatgacctcc

SEQ ID NO: 2827910 - DNA, 16 bp, Homo sapiens
ctcccagggccagggc

SEQ ID NO: 2827911 - DNA, 19 bp, Homo sapiens
ctcccaggggctccacctg

SEQ ID NO: 2827912 - DNA, 21 bp, Homo sapiens
ctccccaccttcaattcctgg

SEQ ID NO: 2827913 - DNA, 16 bp, Homo sapiens
ctccccaccttcccca

SEQ ID NO: 2827914 - DNA, 13 bp, Homo sapiens
ctccccactctag

SEQ ID NO: 2827915 - DNA, 14 bp, Homo sapiens
ctccccactctgct

SEQ ID NO: 2827916 - DNA, 16 bp, Homo sapiens
ctccccactctgctct

SEQ ID NO: 2827917 - DNA, 20 bp, Homo sapiens
ctccccagcaagtgagagct

SEQ ID NO: 2827918 - DNA, 13 bp, Homo sapiens
ctccccaggactc

SEQ ID NO: 2827919 - DNA, 17 bp, Homo sapiens
ctccccaggactcaccc

SEQ ID NO: 2827920 - DNA, 22 bp, Homo sapiens
ctccccaggactcaccctcata

SEQ ID NO: 2827921 - DNA, 21 bp, Homo sapiens
ctccccaggggagagggtctg

SEQ ID NO: 2827922 - DNA, 21 bp, Homo sapiens
ctccccattagagtcagcctt

SEQ ID NO: 2827923 - DNA, 17 bp, Homo sapiens
ctccccattcacagagc

SEQ ID NO: 2827924 - DNA, 15 bp, Homo sapiens
ctccccccactgcag

SEQ ID NO: 2827925 - DNA, 11 bp, Homo sapiens
ctccccctggg

SEQ ID NO: 2827926 - DNA, 12 bp, Homo sapiens
ctccccctgggc

SEQ ID NO: 2827927 - DNA, 15 bp, Homo sapiens
ctccccgcagagctc

SEQ ID NO: 2827928 - DNA, 21 bp, Homo sapiens
ctccccgcagagctcccttcc

SEQ ID NO: 2827929 - DNA, 22 bp, Homo sapiens
ctccccgggggcagacacctgt

SEQ ID NO: 2827930 - DNA, 17 bp, Homo sapiens
ctcccctatccacccag

SEQ ID NO: 2827931 - DNA, 21 bp, Homo sapiens
ctcccctatccacccagccca

SEQ ID NO: 2827932 - DNA, 19 bp, Homo sapiens
ctcccctcccccctgtaaa

SEQ ID NO: 2827933 - DNA, 14 bp, Homo sapiens
ctcccctccctctt

SEQ ID NO: 2827934 - DNA, 20 bp, Homo sapiens
ctcccctccctcttccttcc

SEQ ID NO: 2827935 - DNA, 13 bp, Homo sapiens
ctcccctgccctg

SEQ ID NO: 2827936 - DNA, 21 bp, Homo sapiens
ctccccttcctgcacccgtac

SEQ ID NO: 2827937 - DNA, 18 bp, Homo sapiens
ctcccgaatagctgggac

SEQ ID NO: 2827938 - DNA, 19 bp, Homo sapiens
ctcccgaatagctgggact

SEQ ID NO: 2827939 - DNA, 16 bp, Homo sapiens
ctcccgagtagctggg

SEQ ID NO: 2827940 - DNA, 19 bp, Homo sapiens
ctcccgagtagctgggact

SEQ ID NO: 2827941 - DNA, 18 bp, Homo sapiens
ctcccgcaccaggccggg

SEQ ID NO: 2827942 - DNA, 23 bp, Homo sapiens
ctccctaaaataaaaaccagaat

SEQ ID NO: 2827943 - DNA, 14 bp, Homo sapiens
ctccctcagtgccc

SEQ ID NO: 2827944 - DNA, 16 bp, Homo sapiens
ctccctccaccccagg

SEQ ID NO: 2827945 - DNA, 17 bp, Homo sapiens
ctccctctcctgcctac

SEQ ID NO: 2827946 - DNA, 13 bp, Homo sapiens
ctccctctgacct

SEQ ID NO: 2827947 - DNA, 21 bp, Homo sapiens
ctccctctgacctgcaggcca

SEQ ID NO: 2827948 - DNA, 19 bp, Homo sapiens
ctccctctggccctgcctt

SEQ ID NO: 2827949 - DNA, 12 bp, Homo sapiens
ctccctcttcct

SEQ ID NO: 2827950 - DNA, 19 bp, Homo sapiens
ctccctcttccttccccca

SEQ ID NO: 2827951 - DNA, 12 bp, Homo sapiens
ctccctggagtg

SEQ ID NO: 2827952 - DNA, 18 bp, Homo sapiens
ctccctggcctcacgccc

SEQ ID NO: 2827953 - DNA, 15 bp, Homo sapiens
ctccctggctctcag

SEQ ID NO: 2827954 - DNA, 18 bp, Homo sapiens
ctccctggctctcagaag

SEQ ID NO: 2827955 - DNA, 20 bp, Homo sapiens
ctccctggctctcagaaggt

SEQ ID NO: 2827956 - DNA, 18 bp, Homo sapiens
ctcccttttctttttccc

SEQ ID NO: 2827957 - DNA, 17 bp, Homo sapiens
ctccgccccagacacac

SEQ ID NO: 2827958 - DNA, 18 bp, Homo sapiens
ctccgccttcactccggt

SEQ ID NO: 2827959 - DNA, 19 bp, Homo sapiens
ctccgccttcactccggtg

SEQ ID NO: 2827960 - DNA, 20 bp, Homo sapiens
ctccggcctgatgacagagc

SEQ ID NO: 2827961 - DNA, 19 bp, Homo sapiens
ctccggtgtgcctgcagcc

SEQ ID NO: 2827962 - DNA, 12 bp, Homo sapiens
ctcctacctcag

SEQ ID NO: 2827963 - DNA, 14 bp, Homo sapiens
ctcctacctcagcc

SEQ ID NO: 2827964 - DNA, 18 bp, Homo sapiens
ctcctacctcagcctaga

SEQ ID NO: 2827965 - DNA, 14 bp, Homo sapiens
ctcctcacccccag

SEQ ID NO: 2827966 - DNA, 15 bp, Homo sapiens
ctcctcaccccgtct

SEQ ID NO: 2827967 - DNA, 11 bp, Homo sapiens
ctcctcagact

SEQ ID NO: 2827968 - DNA, 18 bp, Homo sapiens
ctcctccaaaggaagtct

SEQ ID NO: 2827969 - DNA, 11 bp, Homo sapiens
ctcctccaggg

SEQ ID NO: 2827970 - DNA, 15 bp, Homo sapiens
ctcctccccttcctg

SEQ ID NO: 2827971 - DNA, 18 bp, Homo sapiens
ctcctccccttcctgcac

SEQ ID NO: 2827972 - DNA, 13 bp, Homo sapiens
ctcctcctgccct

SEQ ID NO: 2827973 - DNA, 16 bp, Homo sapiens
ctcctctgccacctcc

SEQ ID NO: 2827974 - DNA, 19 bp, Homo sapiens
ctcctctgtctctgctctt

SEQ ID NO: 2827975 - DNA, 23 bp, Homo sapiens
ctcctcttcaactgaccagcctc

SEQ ID NO: 2827976 - DNA, 13 bp, Homo sapiens
ctgaacaagaatt

SEQ ID NO: 2827977 - DNA, 16 bp, Homo sapiens
ctgaacaagaattgga

SEQ ID NO: 2827978 - DNA, 19 bp, Homo sapiens
ctgaacatctgtgtgtgtc

SEQ ID NO: 2827979 - DNA, 13 bp, Homo sapiens
ctgaaccactttg

SEQ ID NO: 2827980 - DNA, 14 bp, Homo sapiens
ctgaaccatccctg

SEQ ID NO: 2827981 - DNA, 16 bp, Homo sapiens
ctgaaccatccctgat

SEQ ID NO: 2827982 - DNA, 13 bp, Homo sapiens
ctgaacggggaga

SEQ ID NO: 2827983 - DNA, 14 bp, Homo sapiens
ctgaactcaagctg

SEQ ID NO: 2827984 - DNA, 17 bp, Homo sapiens
ctgaactcaagctgcgt

SEQ ID NO: 2827985 - DNA, 13 bp, Homo sapiens
ctgaactgagcct

SEQ ID NO: 2827986 - DNA, 16 bp, Homo sapiens
ctgaactgagcctagc

SEQ ID NO: 2827987 - DNA, 14 bp, Homo sapiens
ctgaagacctacca

SEQ ID NO: 2827988 - DNA, 23 bp, Homo sapiens
ctgaaggacattgcggacagcca

SEQ ID NO: 2827989 - DNA, 16 bp, Homo sapiens
ctgaagtcacacagtg

SEQ ID NO: 2827990 - DNA, 19 bp, Homo sapiens
ctgaagtcacatcacagga

SEQ ID NO: 2827991 - DNA, 21 bp, Homo sapiens
ctgaagtcacatcacaggaca

SEQ ID NO: 2827992 - DNA, 22 bp, Homo sapiens
ctgaagtcacatcacaggacac

SEQ ID NO: 2827993 - DNA, 23 bp, Homo sapiens
ctgaatgcctcaatgtgaccagg

SEQ ID NO: 2827994 - DNA, 12 bp, Homo sapiens
ctgaatgctctg

SEQ ID NO: 2827995 - DNA, 14 bp, Homo sapiens
ctgaatggtccagg

SEQ ID NO: 2827996 - DNA, 15 bp, Homo sapiens
ctgaattattttgtt

SEQ ID NO: 2827997 - DNA, 11 bp, Homo sapiens
ctgaattttta

SEQ ID NO: 2827998 - DNA, 22 bp, Homo sapiens
ctgacaacatttctatagccaa

SEQ ID NO: 2827999 - DNA, 15 bp, Homo sapiens
ctgacacctcactga

SEQ ID NO: 2828000 - DNA, 18 bp, Homo sapiens
ctgacacctcactgagga

SEQ ID NO: 2828001 - DNA, 20 bp, Homo sapiens
ctgacactaccttatcaggc

SEQ ID NO: 2828002 - DNA, 15 bp, Homo sapiens
ctgacagacacaggc

SEQ ID NO: 2828003 - DNA, 18 bp, Homo sapiens
ctgacagacacaggcccg

SEQ ID NO: 2828004 - DNA, 19 bp, Homo sapiens
ctgacagacacaggcccgg

SEQ ID NO: 2828005 - DNA, 12 bp, Homo sapiens
ctgacagaggag

SEQ ID NO: 2828006 - DNA, 16 bp, Homo sapiens
ctgacaggcaatgctg

SEQ ID NO: 2828007 - DNA, 19 bp, Homo sapiens
ctgacaggcaatgctggct

SEQ ID NO: 2828008 - DNA, 17 bp, Homo sapiens
ctgacattgttggccaa

SEQ ID NO: 2828009 - DNA, 19 bp, Homo sapiens
ctgaccaacagttccttca

SEQ ID NO: 2828010 - DNA, 16 bp, Homo sapiens
ctgaccaacatggaga

SEQ ID NO: 2828011 - DNA, 13 bp, Homo sapiens
ctgacccactgct

SEQ ID NO: 2828012 - DNA, 14 bp, Homo sapiens
ctgacccactgctt

SEQ ID NO: 2828013 - DNA, 21 bp, Homo sapiens
ctgacccagccccttgagaaa

SEQ ID NO: 2828014 - DNA, 15 bp, Homo sapiens
ctgacccagtccctg

SEQ ID NO: 2828015 - DNA, 18 bp, Homo sapiens
ctgacccagtccctgggg

SEQ ID NO: 2828016 - DNA, 20 bp, Homo sapiens
ctgaccccaaagagcctgga

SEQ ID NO: 2828017 - DNA, 18 bp, Homo sapiens
ctgaccccatcacctact

SEQ ID NO: 2828018 - DNA, 20 bp, Homo sapiens
ctgaccctggagcggctctc

SEQ ID NO: 2828019 - DNA, 21 bp, Homo sapiens
ctgaccctggagcggctctcc

SEQ ID NO: 2828020 - DNA, 12 bp, Homo sapiens
ctgacctcccag

SEQ ID NO: 2828021 - DNA, 17 bp, Homo sapiens
ctgacctcccagcccta

SEQ ID NO: 2828022 - DNA, 22 bp, Homo sapiens
ctgacctcccagccctatggat

SEQ ID NO: 2828023 - DNA, 23 bp, Homo sapiens
ctgacctcccagccctatggatg

SEQ ID NO: 2828024 - DNA, 20 bp, Homo sapiens
ctgacctccctctaatttat

SEQ ID NO: 2828025 - DNA, 18 bp, Homo sapiens
ctgacctttgtcatcttt

SEQ ID NO: 2828026 - DNA, 23 bp, Homo sapiens
ctgacctttgtcatctttcttct

SEQ ID NO: 2828027 - DNA, 13 bp, Homo sapiens
ctgactcacaaga

SEQ ID NO: 2828028 - DNA, 17 bp, Homo sapiens
ctgactcctctaagcca

SEQ ID NO: 2828029 - DNA, 19 bp, Homo sapiens
ctgactcctctaagccact

SEQ ID NO: 2828030 - DNA, 14 bp, Homo sapiens
ctgactctctgtga

SEQ ID NO: 2828031 - DNA, 13 bp, Homo sapiens
ctgacttgcagag

SEQ ID NO: 2828032 - DNA, 21 bp, Homo sapiens
ctgacttggggagatggagtt

SEQ ID NO: 2828033 - DNA, 22 bp, Homo sapiens
ctgacttggggagatggagttc

SEQ ID NO: 2828034 - DNA, 14 bp, Homo sapiens
ctgactttgctctt

SEQ ID NO: 2828035 - DNA, 15 bp, Homo sapiens
ctgactttgctcttt

SEQ ID NO: 2828036 - DNA, 16 bp, Homo sapiens
ctgactttgctctttc

SEQ ID NO: 2828037 - DNA, 18 bp, Homo sapiens
ctgagaaacccaccagcc

SEQ ID NO: 2828038 - DNA, 18 bp, Homo sapiens
ctgagaacctggccttca

SEQ ID NO: 2828039 - DNA, 19 bp, Homo sapiens
ctgagaacctggccttcag

SEQ ID NO: 2828040 - DNA, 22 bp, Homo sapiens
ctgagaatttaaaaataagaaa

SEQ ID NO: 2828041 - DNA, 19 bp, Homo sapiens
ctgagaccagttgggagca

SEQ ID NO: 2828042 - DNA, 22 bp, Homo sapiens
ctgagaccagttgggagcactg

SEQ ID NO: 2828043 - DNA, 14 bp, Homo sapiens
ctgagactgcggga

SEQ ID NO: 2828044 - DNA, 15 bp, Homo sapiens
ctgagagacccaagg

SEQ ID NO: 2828045 - DNA, 21 bp, Homo sapiens
ctgagaggacttttctttgtg

SEQ ID NO: 2828046 - DNA, 13 bp, Homo sapiens
ctgagaggccctg

SEQ ID NO: 2828047 - DNA, 15 bp, Homo sapiens
ctgagaggccctgga

SEQ ID NO: 2828048 - DNA, 14 bp, Homo sapiens
ctgagatcgtgccg

SEQ ID NO: 2828049 - DNA, 17 bp, Homo sapiens
ctgagcaaatgtggctc

SEQ ID NO: 2828050 - DNA, 12 bp, Homo sapiens
ctgagcaagagc

SEQ ID NO: 2828051 - DNA, 16 bp, Homo sapiens
ctgagcaagagctggc

SEQ ID NO: 2828052 - DNA, 14 bp, Homo sapiens
ctgagcaccccctc

SEQ ID NO: 2828053 - DNA, 18 bp, Homo sapiens
ctgagcactgccaggagg

SEQ ID NO: 2828054 - DNA, 16 bp, Homo sapiens
ctgagcagggccgggg

SEQ ID NO: 2828055 - DNA, 23 bp, Homo sapiens
ctgagcagggccggggaactggc

SEQ ID NO: 2828056 - DNA, 12 bp, Homo sapiens
ctgagcccaggg

SEQ ID NO: 2828057 - DNA, 13 bp, Homo sapiens
ctgagcctgccga

SEQ ID NO: 2828058 - DNA, 15 bp, Homo sapiens
ctgagccttgtaatt

SEQ ID NO: 2828059 - DNA, 23 bp, Homo sapiens
ctgagctcacaaggcagcaaggc

SEQ ID NO: 2828060 - DNA, 17 bp, Homo sapiens
ctgagctcggtggaccc

SEQ ID NO: 2828061 - DNA, 12 bp, Homo sapiens
ctgagctctgag

SEQ ID NO: 2828062 - DNA, 13 bp, Homo sapiens
ctgagctctgaga

SEQ ID NO: 2828063 - DNA, 15 bp, Homo sapiens
ctgagctctgagagg

SEQ ID NO: 2828064 - DNA, 21 bp, Homo sapiens
ctgagctctgagaggccctgg

SEQ ID NO: 2828065 - DNA, 23 bp, Homo sapiens
ctgagctctgagaggccctggat

SEQ ID NO: 2828066 - DNA, 19 bp, Homo sapiens
ctgagctggccctttccag

SEQ ID NO: 2828067 - DNA, 18 bp, Homo sapiens
ctgctgagaacctggcct

SEQ ID NO: 2828068 - DNA, 19 bp, Homo sapiens
ctgctgagaacctggcctt

SEQ ID NO: 2828069 - DNA, 13 bp, Homo sapiens
ctgctgagctctg

SEQ ID NO: 2828070 - DNA, 19 bp, Homo sapiens
ctgctgagctctgagaggc

SEQ ID NO: 2828071 - DNA, 22 bp, Homo sapiens
ctgctgagctctgagaggccct

SEQ ID NO: 2828072 - DNA, 23 bp, Homo sapiens
ctgctgagctctgagaggccctg

SEQ ID NO: 2828073 - DNA, 13 bp, Homo sapiens
ctgctgcaaagtg

SEQ ID NO: 2828074 - DNA, 22 bp, Homo sapiens
ctgctgccatggcgtgtccctc

SEQ ID NO: 2828075 - DNA, 14 bp, Homo sapiens
ctgctgcccctgca

SEQ ID NO: 2828076 - DNA, 15 bp, Homo sapiens
ctgctgcccctgcag

SEQ ID NO: 2828077 - DNA, 16 bp, Homo sapiens
ctgctgcccctgcagt

SEQ ID NO: 2828078 - DNA, 17 bp, Homo sapiens
ctgctgccgcctcccag

SEQ ID NO: 2828079 - DNA, 22 bp, Homo sapiens
ctgctgcggccagcctgactag

SEQ ID NO: 2828080 - DNA, 11 bp, Homo sapiens
ctgctgctgag

SEQ ID NO: 2828081 - DNA, 16 bp, Homo sapiens
ctgctgctgagaacct

SEQ ID NO: 2828082 - DNA, 19 bp, Homo sapiens
ctgctgctgagaacctggc

SEQ ID NO: 2828083 - DNA, 20 bp, Homo sapiens
ctgctgctgagaacctggcc

SEQ ID NO: 2828084 - DNA, 18 bp, Homo sapiens
ctgctgggctctccacct

SEQ ID NO: 2828085 - DNA, 19 bp, Homo sapiens
ctgctgggctctccacctc

SEQ ID NO: 2828086 - DNA, 14 bp, Homo sapiens
ctgctggggagtcc

SEQ ID NO: 2828087 - DNA, 13 bp, Homo sapiens
ctgctggttcagg

SEQ ID NO: 2828088 - DNA, 15 bp, Homo sapiens
ctgctggttcagggt

SEQ ID NO: 2828089 - DNA, 13 bp, Homo sapiens
ctgctgtgtagct

SEQ ID NO: 2828090 - DNA, 17 bp, Homo sapiens
ctgctgtgtagctctgt

SEQ ID NO: 2828091 - DNA, 22 bp, Homo sapiens
ctgctgtgtagctctgtccact

SEQ ID NO: 2828092 - DNA, 22 bp, Homo sapiens
ctgctgttccaacagacagggc

SEQ ID NO: 2828093 - DNA, 23 bp, Homo sapiens
ctgcttagtatctcatcaacaaa

SEQ ID NO: 2828094 - DNA, 14 bp, Homo sapiens
ctgcttcagcctcc

SEQ ID NO: 2828095 - DNA, 21 bp, Homo sapiens
ctgcttcatgctcagccctga

SEQ ID NO: 2828096 - DNA, 17 bp, Homo sapiens
ctgcttcccatgcctgc

SEQ ID NO: 2828097 - DNA, 14 bp, Homo sapiens
ctgcttctcagccc

SEQ ID NO: 2828098 - DNA, 17 bp, Homo sapiens
ctgcttgaaggaacagt

SEQ ID NO: 2828099 - DNA, 23 bp, Homo sapiens
ctgcttgaaggaacagtgctgtt

SEQ ID NO: 2828100 - DNA, 17 bp, Homo sapiens
ctgcttgactatcacat

SEQ ID NO: 2828101 - DNA, 20 bp, Homo sapiens
ctgcttgactatcacataca

SEQ ID NO: 2828102 - DNA, 21 bp, Homo sapiens
ctgcttggggggtgatgaggg

SEQ ID NO: 2828103 - DNA, 21 bp, Homo sapiens
ctgcttgtccctgcccagaat

SEQ ID NO: 2828104 - DNA, 16 bp, Homo sapiens
ctgcttgttgtcaagt

SEQ ID NO: 2828105 - DNA, 20 bp, Homo sapiens
ctgcttgttgtcaagtataa

SEQ ID NO: 2828106 - DNA, 15 bp, Homo sapiens
ctgctttcaacttaa

SEQ ID NO: 2828107 - DNA, 19 bp, Homo sapiens
ctgctttcaacttaaatca

SEQ ID NO: 2828108 - DNA, 13 bp, Homo sapiens
ctgctttctcctg

SEQ ID NO: 2828109 - DNA, 17 bp, Homo sapiens
ctgctttgcgctggtgg

SEQ ID NO: 2828110 - DNA, 17 bp, Homo sapiens
ctgcttttggtctgtgt

SEQ ID NO: 2828111 - DNA, 20 bp, Homo sapiens
ctgcttttgtctatgggact

SEQ ID NO: 2828112 - DNA, 15 bp, Homo sapiens
ctggaaaactcagga

SEQ ID NO: 2828113 - DNA, 14 bp, Homo sapiens
ctggaaaagcactt

SEQ ID NO: 2828114 - DNA, 15 bp, Homo sapiens
ctggaaaagcacttt

SEQ ID NO: 2828115 - DNA, 21 bp, Homo sapiens
ctggaaagactgattgtttta

SEQ ID NO: 2828116 - DNA, 13 bp, Homo sapiens
ctggaaaggctca

SEQ ID NO: 2828117 - DNA, 15 bp, Homo sapiens
ctggaaaggctcagt

SEQ ID NO: 2828118 - DNA, 18 bp, Homo sapiens
ctggaactgtctctcatg

SEQ ID NO: 2828119 - DNA, 14 bp, Homo sapiens
ctggaagcacagct

SEQ ID NO: 2828120 - DNA, 15 bp, Homo sapiens
ctggaagcacatgtt

SEQ ID NO: 2828121 - DNA, 15 bp, Homo sapiens
ctggaagcactgctg

SEQ ID NO: 2828122 - DNA, 16 bp, Homo sapiens
ctggaagcactgctgt

SEQ ID NO: 2828123 - DNA, 22 bp, Homo sapiens
ctggaagcatttgtttctactt

SEQ ID NO: 2828124 - DNA, 17 bp, Homo sapiens
ctggaagttttgcattt

SEQ ID NO: 2828125 - DNA, 13 bp, Homo sapiens
ctggaataagaag

SEQ ID NO: 2828126 - DNA, 19 bp, Homo sapiens
ctggaataagaagcaaata

SEQ ID NO: 2828127 - DNA, 14 bp, Homo sapiens
ctggaatgaagcat

SEQ ID NO: 2828128 - DNA, 17 bp, Homo sapiens
ctggaatgaagcatgta

SEQ ID NO: 2828129 - DNA, 19 bp, Homo sapiens
ctggaatgaagcatgtagc

SEQ ID NO: 2828130 - DNA, 15 bp, Homo sapiens
ctggaatgcagtggt

SEQ ID NO: 2828131 - DNA, 14 bp, Homo sapiens
ctggaatgtaatca

SEQ ID NO: 2828132 - DNA, 21 bp, Homo sapiens
ctggaatgtaatcaatgtttc

SEQ ID NO: 2828133 - DNA, 16 bp, Homo sapiens
ctggaattgctgctct

SEQ ID NO: 2828134 - DNA, 19 bp, Homo sapiens
ctggaattgctgctctctg

SEQ ID NO: 2828135 - DNA, 16 bp, Homo sapiens
ctggacaacccagaac

SEQ ID NO: 2828136 - DNA, 18 bp, Homo sapiens
ctggacaagaagctgcta

SEQ ID NO: 2828137 - DNA, 15 bp, Homo sapiens
ctggacagctgtgcc

SEQ ID NO: 2828138 - DNA, 19 bp, Homo sapiens
ctggacagctgtgcctcgc

SEQ ID NO: 2828139 - DNA, 20 bp, Homo sapiens
ctggacagctgtgcctcgct

SEQ ID NO: 2828140 - DNA, 12 bp, Homo sapiens
ctggacagcttg

SEQ ID NO: 2828141 - DNA, 22 bp, Homo sapiens
ctggaccaccagccccagcaag

SEQ ID NO: 2828142 - DNA, 20 bp, Homo sapiens
ctggacctatgtcctaagga

SEQ ID NO: 2828143 - DNA, 20 bp, Homo sapiens
ctggaccttgaactgggtac

SEQ ID NO: 2828144 - DNA, 21 bp, Homo sapiens
ctggaccttgaactgggtact

SEQ ID NO: 2828145 - DNA, 15 bp, Homo sapiens
ctggacggcattcct

SEQ ID NO: 2828146 - DNA, 17 bp, Homo sapiens
ctggacggcattcctgc

SEQ ID NO: 2828147 - DNA, 18 bp, Homo sapiens
ctggactcctctgtccag

SEQ ID NO: 2828148 - DNA, 23 bp, Homo sapiens
ctggactcctctgtccaggcact

SEQ ID NO: 2828149 - DNA, 18 bp, Homo sapiens
ctggactgtcatagaaat

SEQ ID NO: 2828150 - DNA, 13 bp, Homo sapiens
ctggacttgagct

SEQ ID NO: 2828151 - DNA, 15 bp, Homo sapiens
ctggagaagctgatg

SEQ ID NO: 2828152 - DNA, 15 bp, Homo sapiens
ctggagcaccaggca

SEQ ID NO: 2828153 - DNA, 23 bp, Homo sapiens
ctggagcaccaggcacgaaccca

SEQ ID NO: 2828154 - DNA, 16 bp, Homo sapiens
ctggagcatctgactc

SEQ ID NO: 2828155 - DNA, 17 bp, Homo sapiens
ctggagcatctgactca

SEQ ID NO: 2828156 - DNA, 12 bp, Homo sapiens
ctggagcccagg

SEQ ID NO: 2828157 - DNA, 15 bp, Homo sapiens
ctggagcccaggagt

SEQ ID NO: 2828158 - DNA, 23 bp, Homo sapiens
ctgtgcagatgagcagtcacact

SEQ ID NO: 2828159 - DNA, 15 bp, Homo sapiens
ctgtgcatgtatgtc

SEQ ID NO: 2828160 - DNA, 17 bp, Homo sapiens
ctgtgcatgtatgtctt

SEQ ID NO: 2828161 - DNA, 13 bp, Homo sapiens
ctgtgccagagcc

SEQ ID NO: 2828162 - DNA, 15 bp, Homo sapiens
ctgtgccagagcctg

SEQ ID NO: 2828163 - DNA, 19 bp, Homo sapiens
ctgtgccagagcctggggc

SEQ ID NO: 2828164 - DNA, 18 bp, Homo sapiens
ctgtgcccacatcccagg

SEQ ID NO: 2828165 - DNA, 23 bp, Homo sapiens
ctgtgcccacatcccaggcttca

SEQ ID NO: 2828166 - DNA, 14 bp, Homo sapiens
ctgtgcccctgtaa

SEQ ID NO: 2828167 - DNA, 16 bp, Homo sapiens
ctgtgcccctgtaaat

SEQ ID NO: 2828168 - DNA, 13 bp, Homo sapiens
ctgtgcctcctca

SEQ ID NO: 2828169 - DNA, 16 bp, Homo sapiens
ctgtgcctcctcaccc

SEQ ID NO: 2828170 - DNA, 15 bp, Homo sapiens
ctgtgcctctgcctg

SEQ ID NO: 2828171 - DNA, 17 bp, Homo sapiens
ctgtgcgttactaattg

SEQ ID NO: 2828172 - DNA, 14 bp, Homo sapiens
ctgtgcgttttaga

SEQ ID NO: 2828173 - DNA, 19 bp, Homo sapiens
ctgtgcttacagtgactgt

SEQ ID NO: 2828174 - DNA, 19 bp, Homo sapiens
ctgtgctttgactcacctg

SEQ ID NO: 2828175 - DNA, 21 bp, Homo sapiens
ctgtgctttgactcacctgtt

SEQ ID NO: 2828176 - DNA, 22 bp, Homo sapiens
ctgtggaggtacactcttatag

SEQ ID NO: 2828177 - DNA, 23 bp, Homo sapiens
ctgtggattttttccttcaaagt

SEQ ID NO: 2828178 - DNA, 20 bp, Homo sapiens
ctgtggcttcccatgtcttt

SEQ ID NO: 2828179 - DNA, 13 bp, Homo sapiens
ctgtgggagcctc

SEQ ID NO: 2828180 - DNA, 19 bp, Homo sapiens
ctgtggggccttggttccc

SEQ ID NO: 2828181 - DNA, 22 bp, Homo sapiens
ctgtgggggaggtccctgccag

SEQ ID NO: 2828182 - DNA, 23 bp, Homo sapiens
ctgtgggggaggtccctgccagt

SEQ ID NO: 2828183 - DNA, 19 bp, Homo sapiens
ctgtgggggcggctgtggg

SEQ ID NO: 2828184 - DNA, 19 bp, Homo sapiens
ctgtggtggctgtctctgt

SEQ ID NO: 2828185 - DNA, 18 bp, Homo sapiens
ctgtggtggggagaggca

SEQ ID NO: 2828186 - DNA, 23 bp, Homo sapiens
ctgtgtaacctccacagtagcat

SEQ ID NO: 2828187 - DNA, 15 bp, Homo sapiens
ctgtgtacccactcc

SEQ ID NO: 2828188 - DNA, 15 bp, Homo sapiens
ctgtgtactgcagtt

SEQ ID NO: 2828189 - DNA, 17 bp, Homo sapiens
ctgtgtagctctgtcca

SEQ ID NO: 2828190 - DNA, 22 bp, Homo sapiens
ctgtgtagctgtgacctgctga

SEQ ID NO: 2828191 - DNA, 19 bp, Homo sapiens
ctgtgtcaggtggggcagc

SEQ ID NO: 2828192 - DNA, 22 bp, Homo sapiens
ctgtgtcaggtggggcagcttg

SEQ ID NO: 2828193 - DNA, 14 bp, Homo sapiens
ctgtgtccttgcac

SEQ ID NO: 2828194 - DNA, 22 bp, Homo sapiens
ctgtgtccttgcacctgcatcc

SEQ ID NO: 2828195 - DNA, 19 bp, Homo sapiens
ctgtgtcttgcaatggcag

SEQ ID NO: 2828196 - DNA, 21 bp, Homo sapiens
ctgtgtcttgcaatggcagcc

SEQ ID NO: 2828197 - DNA, 20 bp, Homo sapiens
ctgtgtcttttttcactaca

SEQ ID NO: 2828198 - DNA, 12 bp, Homo sapiens
ctgtgtgaaata

SEQ ID NO: 2828199 - DNA, 21 bp, Homo sapiens
ctgtgtgaaataccagtgtgg

SEQ ID NO: 2828200 - DNA, 17 bp, Homo sapiens
ctgtgtgaattcccagg

SEQ ID NO: 2828201 - DNA, 12 bp, Homo sapiens
ctgtgtgagcat

SEQ ID NO: 2828202 - DNA, 15 bp, Homo sapiens
ctgtgtgagttgagt

SEQ ID NO: 2828203 - DNA, 20 bp, Homo sapiens
ctgtgtgtgcgcctacagga

SEQ ID NO: 2828204 - DNA, 16 bp, Homo sapiens
ctgtgttcagtgcctt

SEQ ID NO: 2828205 - DNA, 21 bp, Homo sapiens
ctgtgttcagtgccttggagc

SEQ ID NO: 2828206 - DNA, 20 bp, Homo sapiens
ctgtgttgcgtgtcgtgggt

SEQ ID NO: 2828207 - DNA, 15 bp, Homo sapiens
ctgtgtttcttgcct

SEQ ID NO: 2828208 - DNA, 15 bp, Homo sapiens
ctgttaaaatcagga

SEQ ID NO: 2828209 - DNA, 17 bp, Homo sapiens
ctgttaaaatgtacact

SEQ ID NO: 2828210 - DNA, 20 bp, Homo sapiens
ctgttaacgtcatctcaggg

SEQ ID NO: 2828211 - DNA, 16 bp, Homo sapiens
ctgttaatagttcagg

SEQ ID NO: 2828212 - DNA, 14 bp, Homo sapiens
ctgttactccacag

SEQ ID NO: 2828213 - DNA, 17 bp, Homo sapiens
ctgttactccacagcgg

SEQ ID NO: 2828214 - DNA, 21 bp, Homo sapiens
ctgttacttgaaataccagtg

SEQ ID NO: 2828215 - DNA, 12 bp, Homo sapiens
ctgttacttttt

SEQ ID NO: 2828216 - DNA, 20 bp, Homo sapiens
ctgttactttttagtctttt

SEQ ID NO: 2828217 - DNA, 19 bp, Homo sapiens
ctgttattttttatttcca

SEQ ID NO: 2828218 - DNA, 18 bp, Homo sapiens
ctgttcacccacagggct

SEQ ID NO: 2828219 - DNA, 19 bp, Homo sapiens
ctgttcaccttatgtatta

SEQ ID NO: 2828220 - DNA, 14 bp, Homo sapiens
ctgttcatttcctc

SEQ ID NO: 2828221 - DNA, 17 bp, Homo sapiens
ctgttccacttctctag

SEQ ID NO: 2828222 - DNA, 15 bp, Homo sapiens
ctgttccctctttct

SEQ ID NO: 2828223 - DNA, 21 bp, Homo sapiens
ctgttctggagctgctgttcc

SEQ ID NO: 2828224 - DNA, 20 bp, Homo sapiens
ctgttgagctgttttccctg

SEQ ID NO: 2828225 - DNA, 17 bp, Homo sapiens
ctgttgatgaggcctct

SEQ ID NO: 2828226 - DNA, 13 bp, Homo sapiens
ctgttgccacaac

SEQ ID NO: 2828227 - DNA, 12 bp, Homo sapiens
ctgttgcccagg

SEQ ID NO: 2828228 - DNA, 14 bp, Homo sapiens
ctgttgcccaggct

SEQ ID NO: 2828229 - DNA, 14 bp, Homo sapiens
ctgttgcctcatct

SEQ ID NO: 2828230 - DNA, 22 bp, Homo sapiens
ctgttgctcaaatctattcaga

SEQ ID NO: 2828231 - DNA, 18 bp, Homo sapiens
ctgttggacccgctctgg

SEQ ID NO: 2828232 - DNA, 22 bp, Homo sapiens
ctgttggacccgctctggacca

SEQ ID NO: 2828233 - DNA, 17 bp, Homo sapiens
ctgtttagtagcagtga

SEQ ID NO: 2828234 - DNA, 17 bp, Homo sapiens
ctgtttataaaaacaaa

SEQ ID NO: 2828235 - DNA, 15 bp, Homo sapiens
ctgtttatttattca

SEQ ID NO: 2828236 - DNA, 15 bp, Homo sapiens
ctgtttccttttatg

SEQ ID NO: 2828237 - DNA, 14 bp, Homo sapiens
ctgttttaataatt

SEQ ID NO: 2828238 - DNA, 14 bp, Homo sapiens
ctgttttatactgt

SEQ ID NO: 2828239 - DNA, 13 bp, Homo sapiens
ctgttttccctga

SEQ ID NO: 2828240 - DNA, 22 bp, Homo sapiens
ctgttttgtcctttgagaaaga

SEQ ID NO: 2828241 - DNA, 23 bp, Homo sapiens
ctgttttgtcctttgagaaagaa

SEQ ID NO: 2828242 - DNA, 17 bp, Homo sapiens
ctgtttttcggacagtt

SEQ ID NO: 2828243 - DNA, 20 bp, Homo sapiens
ctgtttttcggacagtttat

SEQ ID NO: 2828244 - DNA, 12 bp, Homo sapiens
cttaaaaaactt

SEQ ID NO: 2828245 - DNA, 13 bp, Homo sapiens
cttaaaaaatgtc

SEQ ID NO: 2828246 - DNA, 19 bp, Homo sapiens
cttaaaaagtaattgtaga

SEQ ID NO: 2828247 - DNA, 12 bp, Homo sapiens
cttaaaactttg

SEQ ID NO: 2828248 - DNA, 15 bp, Homo sapiens
ctttcaaatttcaca

SEQ ID NO: 2828249 - DNA, 20 bp, Homo sapiens
ctttcagcaagacttctctt

SEQ ID NO: 2828250 - DNA, 21 bp, Homo sapiens
ctttcaggggggttgtgaggc

SEQ ID NO: 2828251 - DNA, 12 bp, Homo sapiens
ctttcaggtact

SEQ ID NO: 2828252 - DNA, 21 bp, Homo sapiens
ctttcatctattctttcccta

SEQ ID NO: 2828253 - DNA, 23 bp, Homo sapiens
ctttcatctattctttccctaga

SEQ ID NO: 2828254 - DNA, 12 bp, Homo sapiens
ctttccagccaa

SEQ ID NO: 2828255 - DNA, 14 bp, Homo sapiens
ctttccatctgctt

SEQ ID NO: 2828256 - DNA, 20 bp, Homo sapiens
ctttccctagaggcaaacat

SEQ ID NO: 2828257 - DNA, 19 bp, Homo sapiens
ctttccctcaccccctccc

SEQ ID NO: 2828258 - DNA, 21 bp, Homo sapiens
ctttccgtctccctaaaataa

SEQ ID NO: 2828259 - DNA, 22 bp, Homo sapiens
ctttccgtctccctaaaataaa

SEQ ID NO: 2828260 - DNA, 18 bp, Homo sapiens
ctttcctatcatggagtg

SEQ ID NO: 2828261 - DNA, 13 bp, Homo sapiens
ctttcctccccac

SEQ ID NO: 2828262 - DNA, 15 bp, Homo sapiens
ctttcctccccacct

SEQ ID NO: 2828263 - DNA, 21 bp, Homo sapiens
ctttcctccccaccttcccca

SEQ ID NO: 2828264 - DNA, 22 bp, Homo sapiens
ctttcctctccaattgtaaaaa

SEQ ID NO: 2828265 - DNA, 13 bp, Homo sapiens
ctttcctcttccc

SEQ ID NO: 2828266 - DNA, 19 bp, Homo sapiens
ctttcctcttccccttgcc

SEQ ID NO: 2828267 - DNA, 16 bp, Homo sapiens
ctttctacccagcgag

SEQ ID NO: 2828268 - DNA, 22 bp, Homo sapiens
ctttctcactaaatcttttata

SEQ ID NO: 2828269 - DNA, 14 bp, Homo sapiens
ctttctccaaagtt

SEQ ID NO: 2828270 - DNA, 15 bp, Homo sapiens
ctttctccaaagtta

SEQ ID NO: 2828271 - DNA, 20 bp, Homo sapiens
ctttctccaaagttatccag

SEQ ID NO: 2828272 - DNA, 16 bp, Homo sapiens
ctttctccagccagca

SEQ ID NO: 2828273 - DNA, 14 bp, Homo sapiens
ctttctgggccaag

SEQ ID NO: 2828274 - DNA, 14 bp, Homo sapiens
ctttctgtgcttct

SEQ ID NO: 2828275 - DNA, 14 bp, Homo sapiens
ctttcttcctctgc

SEQ ID NO: 2828276 - DNA, 21 bp, Homo sapiens
ctttcttctacaaccagagcc

SEQ ID NO: 2828277 - DNA, 15 bp, Homo sapiens
ctttcttggtgtctg

SEQ ID NO: 2828278 - DNA, 17 bp, Homo sapiens
ctttctttctaactcca

SEQ ID NO: 2828279 - DNA, 22 bp, Homo sapiens
ctttcttttctggaatgtaatc

SEQ ID NO: 2828280 - DNA, 21 bp, Homo sapiens
ctttgaagttagctttaactt

SEQ ID NO: 2828281 - DNA, 18 bp, Homo sapiens
ctttgaataaagtctgag

SEQ ID NO: 2828282 - DNA, 19 bp, Homo sapiens
ctttgaatcctctctctgt

SEQ ID NO: 2828283 - DNA, 21 bp, Homo sapiens
ctttgactcttttgccattaa

SEQ ID NO: 2828284 - DNA, 13 bp, Homo sapiens
ctttgagaaagaa

SEQ ID NO: 2828285 - DNA, 15 bp, Homo sapiens
ctttgagaaagaaat

SEQ ID NO: 2828286 - DNA, 18 bp, Homo sapiens
ctttgagagagtttatca

SEQ ID NO: 2828287 - DNA, 21 bp, Homo sapiens
ctttgatgattaattcacctt

SEQ ID NO: 2828288 - DNA, 15 bp, Homo sapiens
ctttgcactgagggc

SEQ ID NO: 2828289 - DNA, 16 bp, Homo sapiens
ctttgcactgagggcc

SEQ ID NO: 2828290 - DNA, 14 bp, Homo sapiens
ctttgcagacaggc

SEQ ID NO: 2828291 - DNA, 21 bp, Homo sapiens
ctttgcattccatgattttac

SEQ ID NO: 2828292 - DNA, 16 bp, Homo sapiens
ctttgcccttctttct

SEQ ID NO: 2828293 - DNA, 19 bp, Homo sapiens
ctttgcccttctttctacc

SEQ ID NO: 2828294 - DNA, 11 bp, Homo sapiens
ctttgcctcaa

SEQ ID NO: 2828295 - DNA, 12 bp, Homo sapiens
ctttgcctcaaa

SEQ ID NO: 2828296 - DNA, 13 bp, Homo sapiens
ctttgcctgtgtg

SEQ ID NO: 2828297 - DNA, 14 bp, Homo sapiens
ctttgctctttctt

SEQ ID NO: 2828298 - DNA, 20 bp, Homo sapiens
ctttgctttttaattgagga

SEQ ID NO: 2828299 - DNA, 16 bp, Homo sapiens
ctttggaagaaacagg

SEQ ID NO: 2828300 - DNA, 11 bp, Homo sapiens
ctttggaagga

SEQ ID NO: 2828301 - DNA, 16 bp, Homo sapiens
ctttggttctctccag

SEQ ID NO: 2828302 - DNA, 17 bp, Homo sapiens
ctttggttctctccagg

SEQ ID NO: 2828303 - DNA, 20 bp, Homo sapiens
ctttggttctctccaggaag

SEQ ID NO: 2828304 - DNA, 21 bp, Homo sapiens
ctttggttctctccaggaagg

SEQ ID NO: 2828305 - DNA, 16 bp, Homo sapiens
ctttgtaccatctgtc

SEQ ID NO: 2828306 - DNA, 17 bp, Homo sapiens
ctttgtgtagctttgct

SEQ ID NO: 2828307 - DNA, 21 bp, Homo sapiens
ctttgttgcaagtactgctgt

SEQ ID NO: 2828308 - DNA, 14 bp, Homo sapiens
ctttgttttctaaa

SEQ ID NO: 2828309 - DNA, 23 bp, Homo sapiens
cttttaaaggggcagaaaaactc

SEQ ID NO: 2828310 - DNA, 16 bp, Homo sapiens
cttttaatgaacaaat

SEQ ID NO: 2828311 - DNA, 18 bp, Homo sapiens
cttttaatgaacaaatgg

SEQ ID NO: 2828312 - DNA, 23 bp, Homo sapiens
cttttaattaatatgttcattaa

SEQ ID NO: 2828313 - DNA, 12 bp, Homo sapiens
cttttactcctt

SEQ ID NO: 2828314 - DNA, 14 bp, Homo sapiens
cttttactcctttg

SEQ ID NO: 2828315 - DNA, 19 bp, Homo sapiens
cttttactcctttgcattc

SEQ ID NO: 2828316 - DNA, 10 bp, Homo sapiens
cttttataaa

SEQ ID NO: 2828317 - DNA, 18 bp, Homo sapiens
cttttatgttatttatat

SEQ ID NO: 2828318 - DNA, 20 bp, Homo sapiens
cttttatgttatttatatat

SEQ ID NO: 2828319 - DNA, 15 bp, Homo sapiens
cttttcaaaacattt

SEQ ID NO: 2828320 - DNA, 22 bp, Homo sapiens
cttttcccaaaatgttgaaata

SEQ ID NO: 2828321 - DNA, 14 bp, Homo sapiens
cttttcccttcttt

SEQ ID NO: 2828322 - DNA, 12 bp, Homo sapiens
cttttctgcaga

SEQ ID NO: 2828323 - DNA, 19 bp, Homo sapiens
cttttctggaatgtaatca

SEQ ID NO: 2828324 - DNA, 20 bp, Homo sapiens
cttttgaatccatgcttggg

SEQ ID NO: 2828325 - DNA, 22 bp, Homo sapiens
cttttgcataagattaaaggaa

SEQ ID NO: 2828326 - DNA, 15 bp, Homo sapiens
cttttggtctgtgtg

SEQ ID NO: 2828327 - DNA, 17 bp, Homo sapiens
cttttgtaccagtgtga

SEQ ID NO: 2828328 - DNA, 16 bp, Homo sapiens
cttttgtcctgttatt

SEQ ID NO: 2828329 - DNA, 17 bp, Homo sapiens
cttttgtcctgttattt

SEQ ID NO: 2828330 - DNA, 17 bp, Homo sapiens
cttttgtctatgggact

SEQ ID NO: 2828331 - DNA, 19 bp, Homo sapiens
ctttttaagcttatttaat

SEQ ID NO: 2828332 - DNA, 15 bp, Homo sapiens
ctttttagtctttta

SEQ ID NO: 2828333 - DNA, 17 bp, Homo sapiens
ctttttagtcttttact

SEQ ID NO: 2828334 - DNA, 18 bp, Homo sapiens
ctttttataatgtggatt

SEQ ID NO: 2828335 - DNA, 13 bp, Homo sapiens
ctttttccagagg

SEQ ID NO: 2828336 - DNA, 18 bp, Homo sapiens
ctttttctttataaactt

SEQ ID NO: 2828337 - DNA, 16 bp, Homo sapiens
ctttttttatgactgt

SEQ ID NO: 2828338 - DNA, 17 bp, Homo sapiens
gaaaaaatacattttat

SEQ ID NO: 2828339 - DNA, 23 bp, Homo sapiens
gaattttctttgtgtagctttgc

SEQ ID NO: 2828340 - DNA, 15 bp, Homo sapiens
gaattttgttgctgt

SEQ ID NO: 2828341 - DNA, 20 bp, Homo sapiens
gaatttttaatgacttttta

SEQ ID NO: 2828342 - DNA, 20 bp, Homo sapiens
gacaaaaacagcctcacaga

SEQ ID NO: 2828343 - DNA, 15 bp, Homo sapiens
gacaaaactagagac

SEQ ID NO: 2828344 - DNA, 18 bp, Homo sapiens
gacaaaattggccagaga

SEQ ID NO: 2828345 - DNA, 16 bp, Homo sapiens
gacaaacacctcccag

SEQ ID NO: 2828346 - DNA, 22 bp, Homo sapiens
gacaaacacctcccaggagaca

SEQ ID NO: 2828347 - DNA, 16 bp, Homo sapiens
gacaaaccagagcaga

SEQ ID NO: 2828348 - DNA, 20 bp, Homo sapiens
gacaaagccaaactctgcca

SEQ ID NO: 2828349 - DNA, 17 bp, Homo sapiens
gacaaaggagcctgtga

SEQ ID NO: 2828350 - DNA, 21 bp, Homo sapiens
gacaaagggaaggctgctgtg

SEQ ID NO: 2828351 - DNA, 22 bp, Homo sapiens
gacaacagaagtcatgaagccc

SEQ ID NO: 2828352 - DNA, 14 bp, Homo sapiens
gacaacattttatt

SEQ ID NO: 2828353 - DNA, 16 bp, Homo sapiens
gacaagcactgctagg

SEQ ID NO: 2828354 - DNA, 13 bp, Homo sapiens
gacaataatttca

SEQ ID NO: 2828355 - DNA, 23 bp, Homo sapiens
gacacacaaaatgtcacaatcct

SEQ ID NO: 2828356 - DNA, 19 bp, Homo sapiens
gacacacagcactctctaa

SEQ ID NO: 2828357 - DNA, 17 bp, Homo sapiens
gacacacagctctgtcc

SEQ ID NO: 2828358 - DNA, 18 bp, Homo sapiens
gacacacagctctgtcct

SEQ ID NO: 2828359 - DNA, 13 bp, Homo sapiens
gacacagctcttc

SEQ ID NO: 2828360 - DNA, 16 bp, Homo sapiens
gacacagctcttctcc

SEQ ID NO: 2828361 - DNA, 19 bp, Homo sapiens
gacacagctcttctccagg

SEQ ID NO: 2828362 - DNA, 21 bp, Homo sapiens
gacacagctcttctccaggct

SEQ ID NO: 2828363 - DNA, 23 bp, Homo sapiens
gacacagctcttctccaggctgt

SEQ ID NO: 2828364 - DNA, 15 bp, Homo sapiens
gacacaggcctgtgt

SEQ ID NO: 2828365 - DNA, 16 bp, Homo sapiens
gacacaggcctgtgta

SEQ ID NO: 2828366 - DNA, 18 bp, Homo sapiens
gacacagtttctattgta

SEQ ID NO: 2828367 - DNA, 15 bp, Homo sapiens
gacacataatttgaa

SEQ ID NO: 2828368 - DNA, 22 bp, Homo sapiens
gacaccatcttttgtgagatgt

SEQ ID NO: 2828369 - DNA, 18 bp, Homo sapiens
gacacccaagagggctgc

SEQ ID NO: 2828370 - DNA, 19 bp, Homo sapiens
gacaccccttatccaggac

SEQ ID NO: 2828371 - DNA, 21 bp, Homo sapiens
gacaccccttatccaggactc

SEQ ID NO: 2828372 - DNA, 15 bp, Homo sapiens
gacacctgcacctcc

SEQ ID NO: 2828373 - DNA, 22 bp, Homo sapiens
gacacctgccctgccctgccac

SEQ ID NO: 2828374 - DNA, 19 bp, Homo sapiens
gacacctggccgcctccag

SEQ ID NO: 2828375 - DNA, 20 bp, Homo sapiens
gacacctggccgcctccagg

SEQ ID NO: 2828376 - DNA, 17 bp, Homo sapiens
gacaccttgacagggca

SEQ ID NO: 2828377 - DNA, 20 bp, Homo sapiens
gacaccttgacagggcacac

SEQ ID NO: 2828378 - DNA, 23 bp, Homo sapiens
gacacgctcttctattttattcc

SEQ ID NO: 2828379 - DNA, 21 bp, Homo sapiens
gacactaaccacgctggacct

SEQ ID NO: 2828380 - DNA, 12 bp, Homo sapiens
gacactgtacaa

SEQ ID NO: 2828381 - DNA, 13 bp, Homo sapiens
gacagaagaaggc

SEQ ID NO: 2828382 - DNA, 16 bp, Homo sapiens
gacagacacaggcccg

SEQ ID NO: 2828383 - DNA, 18 bp, Homo sapiens
gacagagacacctgcacc

SEQ ID NO: 2828384 - DNA, 12 bp, Homo sapiens
gacagaggcagc

SEQ ID NO: 2828385 - DNA, 17 bp, Homo sapiens
gacagaggcagccccat

SEQ ID NO: 2828386 - DNA, 23 bp, Homo sapiens
gacagaggcagccccattctgcc

SEQ ID NO: 2828387 - DNA, 21 bp, Homo sapiens
gacagagtctcactgttgccc

SEQ ID NO: 2828388 - DNA, 19 bp, Homo sapiens
gacagagtgagactctgtc

SEQ ID NO: 2828389 - DNA, 22 bp, Homo sapiens
gacagagtgagactctgtctca

SEQ ID NO: 2828390 - DNA, 18 bp, Homo sapiens
gacagatgtcagccgagc

SEQ ID NO: 2828391 - DNA, 13 bp, Homo sapiens
gacagcagctcag

SEQ ID NO: 2828392 - DNA, 15 bp, Homo sapiens
gacagcagctcaggc

SEQ ID NO: 2828393 - DNA, 16 bp, Homo sapiens
gacagcagctcaggca

SEQ ID NO: 2828394 - DNA, 16 bp, Homo sapiens
gacagcaggtgggaaa

SEQ ID NO: 2828395 - DNA, 19 bp, Homo sapiens
gacagccacggccaggcca

SEQ ID NO: 2828396 - DNA, 12 bp, Homo sapiens
gacagccagagc

SEQ ID NO: 2828397 - DNA, 14 bp, Homo sapiens
gacagccagagcct

SEQ ID NO: 2828398 - DNA, 16 bp, Homo sapiens
gacagccagagcctgt

SEQ ID NO: 2828399 - DNA, 21 bp, Homo sapiens
gacagcggggaaggtttttat

SEQ ID NO: 2828400 - DNA, 13 bp, Homo sapiens
gacagctccttct

SEQ ID NO: 2828401 - DNA, 14 bp, Homo sapiens
gacagctccttctg

SEQ ID NO: 2828402 - DNA, 15 bp, Homo sapiens
gacagctccttctgt

SEQ ID NO: 2828403 - DNA, 16 bp, Homo sapiens
gacagctccttctgtc

SEQ ID NO: 2828404 - DNA, 14 bp, Homo sapiens
gacagctgtccctg

SEQ ID NO: 2828405 - DNA, 15 bp, Homo sapiens
gacagctgtccctgt

SEQ ID NO: 2828406 - DNA, 19 bp, Homo sapiens
gacagctgtccctgtcacc

SEQ ID NO: 2828407 - DNA, 13 bp, Homo sapiens
gacagctgtgcct

SEQ ID NO: 2828408 - DNA, 20 bp, Homo sapiens
gacaggaagcccaaggcagt

SEQ ID NO: 2828409 - DNA, 19 bp, Homo sapiens
gacaggactaacactcaga

SEQ ID NO: 2828410 - DNA, 21 bp, Homo sapiens
gacaggactaacactcagaag

SEQ ID NO: 2828411 - DNA, 24 bp, Homo sapiens
gacaggactaacactcagaagcct

SEQ ID NO: 2828412 - DNA, 13 bp, Homo sapiens
gacaggcaagcac

SEQ ID NO: 2828413 - DNA, 17 bp, Homo sapiens
gacaggcaagcacctcc

SEQ ID NO: 2828414 - DNA, 23 bp, Homo sapiens
gacaggcaatgctggctgttggc

SEQ ID NO: 2828415 - DNA, 24 bp, Homo sapiens
gacaggcaatgctggctgttggct

SEQ ID NO: 2828416 - DNA, 18 bp, Homo sapiens
gacaggcatgttctctga

SEQ ID NO: 2828417 - DNA, 19 bp, Homo sapiens
gacaggcatgttctctgag

SEQ ID NO: 2828418 - DNA, 16 bp, Homo sapiens
gacaggcccaagagat

SEQ ID NO: 2828419 - DNA, 23 bp, Homo sapiens
gacagggcacaccgggcactcag

SEQ ID NO: 2828420 - DNA, 16 bp, Homo sapiens
gacagtattctcagtg

SEQ ID NO: 2828421 - DNA, 13 bp, Homo sapiens
gacagtcctggga

SEQ ID NO: 2828422 - DNA, 23 bp, Homo sapiens
gacagtcctgggagaacctcagg

SEQ ID NO: 2828423 - DNA, 23 bp, Homo sapiens
gacagtctcaagcactaaaaagt

SEQ ID NO: 2828424 - DNA, 15 bp, Homo sapiens
gacagtgatctccat

SEQ ID NO: 2828425 - DNA, 20 bp, Homo sapiens
gacagtgcttcagcctgagg

SEQ ID NO: 2828426 - DNA, 23 bp, Homo sapiens
gacagtgttgaaaatgttcagaa

SEQ ID NO: 2828427 - DNA, 15 bp, Homo sapiens
gacagttcatatgta

SEQ ID NO: 2828428 - DNA, 16 bp, Homo sapiens
gacagtttatttgttg

SEQ ID NO: 2828429 - DNA, 23 bp, Homo sapiens
gagcacctgcttcatgctcagcc

SEQ ID NO: 2828430 - DNA, 15 bp, Homo sapiens
gagcactaaggtgtg

SEQ ID NO: 2828431 - DNA, 14 bp, Homo sapiens
gagcactgccagga

SEQ ID NO: 2828432 - DNA, 15 bp, Homo sapiens
gagcactgccaggag

SEQ ID NO: 2828433 - DNA, 20 bp, Homo sapiens
gagcactgccaggagggaca

SEQ ID NO: 2828434 - DNA, 17 bp, Homo sapiens
gagcactgggttgactt

SEQ ID NO: 2828435 - DNA, 16 bp, Homo sapiens
gagcagaaagccaggg

SEQ ID NO: 2828436 - DNA, 14 bp, Homo sapiens
gagcagctgagcag

SEQ ID NO: 2828437 - DNA, 17 bp, Homo sapiens
gagcagctgagcagggc

SEQ ID NO: 2828438 - DNA, 20 bp, Homo sapiens
gagcagctgagcagggccgg

SEQ ID NO: 2828439 - DNA, 22 bp, Homo sapiens
gagcagggccggggaactggcc

SEQ ID NO: 2828440 - DNA, 17 bp, Homo sapiens
gagcagtgtcttccata

SEQ ID NO: 2828441 - DNA, 19 bp, Homo sapiens
gagcagtgtcttccataat

SEQ ID NO: 2828442 - DNA, 14 bp, Homo sapiens
gagcatcatgcctc

SEQ ID NO: 2828443 - DNA, 18 bp, Homo sapiens
gagcatcatgcctctgag

SEQ ID NO: 2828444 - DNA, 22 bp, Homo sapiens
gagcatctctgtgtacccactc

SEQ ID NO: 2828445 - DNA, 22 bp, Homo sapiens
gagcatctcttgaggccaggag

SEQ ID NO: 2828446 - DNA, 22 bp, Homo sapiens
gagcatgtactgagccttgtaa

SEQ ID NO: 2828447 - DNA, 16 bp, Homo sapiens
gagcatttccctcccg

SEQ ID NO: 2828448 - DNA, 17 bp, Homo sapiens
gagcatttccctcccgg

SEQ ID NO: 2828449 - DNA, 18 bp, Homo sapiens
gagccaagcttcaaccct

SEQ ID NO: 2828450 - DNA, 19 bp, Homo sapiens
gagccacagaccacctgct

SEQ ID NO: 2828451 - DNA, 13 bp, Homo sapiens
gagcccaccttgg

SEQ ID NO: 2828452 - DNA, 11 bp, Homo sapiens
gagcccaggag

SEQ ID NO: 2828453 - DNA, 20 bp, Homo sapiens
gagcccagggaggccgaagc

SEQ ID NO: 2828454 - DNA, 13 bp, Homo sapiens
gagcccatgctca

SEQ ID NO: 2828455 - DNA, 12 bp, Homo sapiens
gagccctgcagc

SEQ ID NO: 2828456 - DNA, 17 bp, Homo sapiens
gagccctggtggcagtg

SEQ ID NO: 2828457 - DNA, 13 bp, Homo sapiens
gagccgggcctgg

SEQ ID NO: 2828458 - DNA, 16 bp, Homo sapiens
gagcctaccccctgaa

SEQ ID NO: 2828459 - DNA, 14 bp, Homo sapiens
gagcctcagcatcc

SEQ ID NO: 2828460 - DNA, 15 bp, Homo sapiens
gagcctcagcatcct

SEQ ID NO: 2828461 - DNA, 20 bp, Homo sapiens
gagcctcagcatcctggcac

SEQ ID NO: 2828462 - DNA, 19 bp, Homo sapiens
gagcctcatccgaggcagg

SEQ ID NO: 2828463 - DNA, 19 bp, Homo sapiens
gagcctcgcaacccgtgcc

SEQ ID NO: 2828464 - DNA, 19 bp, Homo sapiens
gagcctgaattttgttgct

SEQ ID NO: 2828465 - DNA, 12 bp, Homo sapiens
gagcctgcagtt

SEQ ID NO: 2828466 - DNA, 16 bp, Homo sapiens
gagcctgccgagcaac

SEQ ID NO: 2828467 - DNA, 22 bp, Homo sapiens
gagcctgccgagcaaccgtggc

SEQ ID NO: 2828468 - DNA, 23 bp, Homo sapiens
gagcctgccgagcaaccgtggcc

SEQ ID NO: 2828469 - DNA, 12 bp, Homo sapiens
gagcctggagaa

SEQ ID NO: 2828470 - DNA, 11 bp, Homo sapiens
gagcctggggc

SEQ ID NO: 2828471 - DNA, 17 bp, Homo sapiens
gagcctgtgaacccagg

SEQ ID NO: 2828472 - DNA, 18 bp, Homo sapiens
gagcctgtgaacccagga

SEQ ID NO: 2828473 - DNA, 21 bp, Homo sapiens
gagcctgtgaacccaggacaa

SEQ ID NO: 2828474 - DNA, 12 bp, Homo sapiens
gagcgccctgca

SEQ ID NO: 2828475 - DNA, 13 bp, Homo sapiens
gagcgccctgcag

SEQ ID NO: 2828476 - DNA, 14 bp, Homo sapiens
gagcgccctgcaga

SEQ ID NO: 2828477 - DNA, 20 bp, Homo sapiens
gagcgccctgcagaccctgc

SEQ ID NO: 2828478 - DNA, 22 bp, Homo sapiens
gagcgccctgcagaccctgccc

SEQ ID NO: 2828479 - DNA, 20 bp, Homo sapiens
gagctacctgtgtggacagg

SEQ ID NO: 2828480 - DNA, 21 bp, Homo sapiens
gagctaggagcaaagcctgtt

SEQ ID NO: 2828481 - DNA, 20 bp, Homo sapiens
gagctcagacccccactctc

SEQ ID NO: 2828482 - DNA, 11 bp, Homo sapiens
gagctcctgcg

SEQ ID NO: 2828483 - DNA, 11 bp, Homo sapiens
gagctctgaga

SEQ ID NO: 2828484 - DNA, 22 bp, Homo sapiens
gagctgaacccattttgagtga

SEQ ID NO: 2828485 - DNA, 23 bp, Homo sapiens
gagctgaacccattttgagtgac

SEQ ID NO: 2828486 - DNA, 20 bp, Homo sapiens
gagctgatgtgagtgtgtgt

SEQ ID NO: 2828487 - DNA, 19 bp, Homo sapiens
gagctgcctgttcagctcc

SEQ ID NO: 2828488 - DNA, 20 bp, Homo sapiens
gagctgcctgttcagctcca

SEQ ID NO: 2828489 - DNA, 21 bp, Homo sapiens
gagctgcctgttcagctccag

SEQ ID NO: 2828490 - DNA, 16 bp, Homo sapiens
gagctgctctggaaaa

SEQ ID NO: 2828491 - DNA, 16 bp, Homo sapiens
gagctgggaggaaaag

SEQ ID NO: 2828492 - DNA, 22 bp, Homo sapiens
gagctgggcttctgtccaaggc

SEQ ID NO: 2828493 - DNA, 15 bp, Homo sapiens
gagctggggtacagg

SEQ ID NO: 2828494 - DNA, 19 bp, Homo sapiens
gagctggggtacaggtttg

SEQ ID NO: 2828495 - DNA, 18 bp, Homo sapiens
gagctgggtgtcaagagg

SEQ ID NO: 2828496 - DNA, 14 bp, Homo sapiens
gagcttctctgtga

SEQ ID NO: 2828497 - DNA, 22 bp, Homo sapiens
gagcttctgggaagacaactag

SEQ ID NO: 2828498 - DNA, 21 bp, Homo sapiens
gagcttgcaagaagcaggaag

SEQ ID NO: 2828499 - DNA, 14 bp, Homo sapiens
gaggaatccagacc

SEQ ID NO: 2828500 - DNA, 15 bp, Homo sapiens
gaggaatccagaccc

SEQ ID NO: 2828501 - DNA, 12 bp, Homo sapiens
gaggacagtggg

SEQ ID NO: 2828502 - DNA, 15 bp, Homo sapiens
gaggacctgagcctg

SEQ ID NO: 2828503 - DNA, 18 bp, Homo sapiens
gaggacctgagcctgccg

SEQ ID NO: 2828504 - DNA, 16 bp, Homo sapiens
gaggacttgtgtctct

SEQ ID NO: 2828505 - DNA, 22 bp, Homo sapiens
gaggacttgtgtctctgtgctt

SEQ ID NO: 2828506 - DNA, 20 bp, Homo sapiens
gaggagaagaattttcagac

SEQ ID NO: 2828507 - DNA, 19 bp, Homo sapiens
gaggagcttccagtgcatg

SEQ ID NO: 2828508 - DNA, 20 bp, Homo sapiens
gaggaggtggcagccctgta

SEQ ID NO: 2828509 - DNA, 18 bp, Homo sapiens
gaggagtctgaggtcctg

SEQ ID NO: 2828510 - DNA, 19 bp, Homo sapiens
gaggagtctgaggtcctga

SEQ ID NO: 2828511 - DNA, 22 bp, Homo sapiens
gaggagtctgaggtcctgagca

SEQ ID NO: 2828512 - DNA, 16 bp, Homo sapiens
gaggatcactggagcc

SEQ ID NO: 2828513 - DNA, 21 bp, Homo sapiens
gaggatggacgaacaggggcc

SEQ ID NO: 2828514 - DNA, 12 bp, Homo sapiens
gaggatggagag

SEQ ID NO: 2828515 - DNA, 18 bp, Homo sapiens
gaggattgcttgagccca

SEQ ID NO: 2828516 - DNA, 17 bp, Homo sapiens
gaggatttcaagcctgc

SEQ ID NO: 2828517 - DNA, 14 bp, Homo sapiens
gaggattttccagt

SEQ ID NO: 2828518 - DNA, 22 bp, Homo sapiens
gaggattttccagttctgacac

SEQ ID NO: 2828519 - DNA, 13 bp, Homo sapiens
gaggcaagagaat

SEQ ID NO: 2828520 - DNA, 16 bp, Homo sapiens
gattagctctggacca

SEQ ID NO: 2828521 - DNA, 21 bp, Homo sapiens
gattatagttgtgggtgggag

SEQ ID NO: 2828522 - DNA, 18 bp, Homo sapiens
gattatatatcataaagt

SEQ ID NO: 2828523 - DNA, 22 bp, Homo sapiens
gattatatatcataaagtatgc

SEQ ID NO: 2828524 - DNA, 19 bp, Homo sapiens
gattatgggtcctgcaatt

SEQ ID NO: 2828525 - DNA, 23 bp, Homo sapiens
gattattccctgtacaatattta

SEQ ID NO: 2828526 - DNA, 20 bp, Homo sapiens
gattattttagtctgtcatc

SEQ ID NO: 2828527 - DNA, 16 bp, Homo sapiens
gattcacatctcattt

SEQ ID NO: 2828528 - DNA, 18 bp, Homo sapiens
gattcaggaaaaggcctg

SEQ ID NO: 2828529 - DNA, 15 bp, Homo sapiens
gattcataacaatgt

SEQ ID NO: 2828530 - DNA, 19 bp, Homo sapiens
gattcattttaacatctga

SEQ ID NO: 2828531 - DNA, 17 bp, Homo sapiens
gattcccaagctctgct

SEQ ID NO: 2828532 - DNA, 19 bp, Homo sapiens
gattcccaagctctgctcc

SEQ ID NO: 2828533 - DNA, 20 bp, Homo sapiens
gattcccaagctctgctcct

SEQ ID NO: 2828534 - DNA, 22 bp, Homo sapiens
gattcccaccaaggtcttcagc

SEQ ID NO: 2828535 - DNA, 19 bp, Homo sapiens
gattcccagagacaggaaa

SEQ ID NO: 2828536 - DNA, 13 bp, Homo sapiens
gattcccagagca

SEQ ID NO: 2828537 - DNA, 21 bp, Homo sapiens
gattcccctaacctcattccc

SEQ ID NO: 2828538 - DNA, 19 bp, Homo sapiens
gattccctctcccaggccc

SEQ ID NO: 2828539 - DNA, 14 bp, Homo sapiens
gattctcctgcctc

SEQ ID NO: 2828540 - DNA, 18 bp, Homo sapiens
gattctcctgcctcagcc

SEQ ID NO: 2828541 - DNA, 19 bp, Homo sapiens
gattctcctgcctcagcct

SEQ ID NO: 2828542 - DNA, 20 bp, Homo sapiens
gattcttctgcttcagcctc

SEQ ID NO: 2828543 - DNA, 21 bp, Homo sapiens
gattcttctgcttcagcctcc

SEQ ID NO: 2828544 - DNA, 15 bp, Homo sapiens
gattgacacacagca

SEQ ID NO: 2828545 - DNA, 16 bp, Homo sapiens
gattgacacacagcac

SEQ ID NO: 2828546 - DNA, 22 bp, Homo sapiens
gattgatcggagcctcctctct

SEQ ID NO: 2828547 - DNA, 15 bp, Homo sapiens
gattgcaacaggctg

SEQ ID NO: 2828548 - DNA, 18 bp, Homo sapiens
gattgcaacaggctgggc

SEQ ID NO: 2828549 - DNA, 21 bp, Homo sapiens
gattgcaacaggctgggcttc

SEQ ID NO: 2828550 - DNA, 22 bp, Homo sapiens
gattgcgtggaattgtgctgag

SEQ ID NO: 2828551 - DNA, 17 bp, Homo sapiens
gattgcttaaaatagca

SEQ ID NO: 2828552 - DNA, 14 bp, Homo sapiens
gattggacattttc

SEQ ID NO: 2828553 - DNA, 16 bp, Homo sapiens
gattggctttaaacac

SEQ ID NO: 2828554 - DNA, 21 bp, Homo sapiens
gattgttctgtccagtttcca

SEQ ID NO: 2828555 - DNA, 11 bp, Homo sapiens
gatttaagtaa

SEQ ID NO: 2828556 - DNA, 14 bp, Homo sapiens
gatttcaacatatc

SEQ ID NO: 2828557 - DNA, 22 bp, Homo sapiens
gatttcatgtaaccaagagtat

SEQ ID NO: 2828558 - DNA, 16 bp, Homo sapiens
gatttcctattttaaa

SEQ ID NO: 2828559 - DNA, 18 bp, Homo sapiens
gatttgaagctgtaccca

SEQ ID NO: 2828560 - DNA, 20 bp, Homo sapiens
gatttgtatttatattagag

SEQ ID NO: 2828561 - DNA, 14 bp, Homo sapiens
gattttaaaaacat

SEQ ID NO: 2828562 - DNA, 23 bp, Homo sapiens
gattttaaaaacatgagaaatgt

SEQ ID NO: 2828563 - DNA, 15 bp, Homo sapiens
gattttacagagaat

SEQ ID NO: 2828564 - DNA, 15 bp, Homo sapiens
gattttatacatagt

SEQ ID NO: 2828565 - DNA, 21 bp, Homo sapiens
gattttatacatagtcacaaa

SEQ ID NO: 2828566 - DNA, 18 bp, Homo sapiens
gattttcaaagctttttc

SEQ ID NO: 2828567 - DNA, 15 bp, Homo sapiens
gattttcatgttctt

SEQ ID NO: 2828568 - DNA, 19 bp, Homo sapiens
gattttgatccaagctggt

SEQ ID NO: 2828569 - DNA, 13 bp, Homo sapiens
gattttgtacaga

SEQ ID NO: 2828570 - DNA, 14 bp, Homo sapiens
gatttttacacatg

SEQ ID NO: 2828571 - DNA, 19 bp, Homo sapiens
gattttttaataatttaga

SEQ ID NO: 2828572 - DNA, 20 bp, Homo sapiens
gattttttacagctgcctgc

SEQ ID NO: 2828573 - DNA, 18 bp, Homo sapiens
gattttttccttcaaagt

SEQ ID NO: 2828574 - DNA, 18 bp, Homo sapiens
gcaaaaaagaaaaccttt

SEQ ID NO: 2828575 - DNA, 11 bp, Homo sapiens
gcaaaagaaga

SEQ ID NO: 2828576 - DNA, 13 bp, Homo sapiens
gcaaaataatttt

SEQ ID NO: 2828577 - DNA, 17 bp, Homo sapiens
gcaaacacacaaaggta

SEQ ID NO: 2828578 - DNA, 16 bp, Homo sapiens
gcaaacttgtatctga

SEQ ID NO: 2828579 - DNA, 16 bp, Homo sapiens
gcaaagatatctcatc

SEQ ID NO: 2828580 - DNA, 13 bp, Homo sapiens
gcaaagcaccagc

SEQ ID NO: 2828581 - DNA, 15 bp, Homo sapiens
gcaaagggctgaaag

SEQ ID NO: 2828582 - DNA, 19 bp, Homo sapiens
gcaaagggctgaaagccat

SEQ ID NO: 2828583 - DNA, 22 bp, Homo sapiens
gcaaagggctgaaagccatttg

SEQ ID NO: 2828584 - DNA, 18 bp, Homo sapiens
gcaaaggtggctctccag

SEQ ID NO: 2828585 - DNA, 23 bp, Homo sapiens
gcaaagttccctacttcctgtga

SEQ ID NO: 2828586 - DNA, 12 bp, Homo sapiens
gcaaatcaatgc

SEQ ID NO: 2828587 - DNA, 22 bp, Homo sapiens
gcaaatcgaatgaaattaactg

SEQ ID NO: 2828588 - DNA, 17 bp, Homo sapiens
gcaacacaagctggaag

SEQ ID NO: 2828589 - DNA, 19 bp, Homo sapiens
gcaacacaagctggaagca

SEQ ID NO: 2828590 - DNA, 21 bp, Homo sapiens
gcaacaggaatctcagagaca

SEQ ID NO: 2828591 - DNA, 20 bp, Homo sapiens
gcaacaggttttataatttt

SEQ ID NO: 2828592 - DNA, 19 bp, Homo sapiens
gcaacccgtgccaagtcca

SEQ ID NO: 2828593 - DNA, 20 bp, Homo sapiens
gcaaccgtggcccttcctgg

SEQ ID NO: 2828594 - DNA, 21 bp, Homo sapiens
gcaaccgtggcccttcctgga

SEQ ID NO: 2828595 - DNA, 19 bp, Homo sapiens
gcaacctcagtaatttaga

SEQ ID NO: 2828596 - DNA, 18 bp, Homo sapiens
gcaacctccgcctcttgg

SEQ ID NO: 2828597 - DNA, 16 bp, Homo sapiens
gcaactcggagagggc

SEQ ID NO: 2828598 - DNA, 15 bp, Homo sapiens
gcaacttgaaattat

SEQ ID NO: 2828599 - DNA, 20 bp, Homo sapiens
gcaagaaggcaaaaatagtt

SEQ ID NO: 2828600 - DNA, 19 bp, Homo sapiens
gcaagactccgtctcaaaa

SEQ ID NO: 2828601 - DNA, 22 bp, Homo sapiens
gcaagagccttggtgtccacct

SEQ ID NO: 2828602 - DNA, 16 bp, Homo sapiens
gcaagatatttatata

SEQ ID NO: 2828603 - DNA, 16 bp, Homo sapiens
gcaagatttaacacta

SEQ ID NO: 2828604 - DNA, 20 bp, Homo sapiens
gcaagcatttatgtttattt

SEQ ID NO: 2828605 - DNA, 23 bp, Homo sapiens
gcaagcttaatggctgataattt

SEQ ID NO: 2828606 - DNA, 16 bp, Homo sapiens
gcaaggcccgagcagc

SEQ ID NO: 2828607 - DNA, 20 bp, Homo sapiens
gcaaggcccgagcagctgag

SEQ ID NO: 2828608 - DNA, 22 bp, Homo sapiens
gcaaggcccgagcagctgagca

SEQ ID NO: 2828609 - DNA, 13 bp, Homo sapiens
gcaagtgaatttg

SEQ ID NO: 2828610 - DNA, 14 bp, Homo sapiens
gcattactgcatgc

SEQ ID NO: 2828611 - DNA, 23 bp, Homo sapiens
gcattattggaatataattgttt

SEQ ID NO: 2828612 - DNA, 23 bp, Homo sapiens
gcattcagtccgcctggccggct

SEQ ID NO: 2828613 - DNA, 16 bp, Homo sapiens
gcattccatgatttta

SEQ ID NO: 2828614 - DNA, 17 bp, Homo sapiens
gcattccatgattttac

SEQ ID NO: 2828615 - DNA, 13 bp, Homo sapiens
gcattcccagtgg

SEQ ID NO: 2828616 - DNA, 21 bp, Homo sapiens
gcattccctgagtcaccagga

SEQ ID NO: 2828617 - DNA, 19 bp, Homo sapiens
gcattcctacaaagatgtt

SEQ ID NO: 2828618 - DNA, 19 bp, Homo sapiens
gcattctgaatgaataaag

SEQ ID NO: 2828619 - DNA, 16 bp, Homo sapiens
gcattgaatatattat

SEQ ID NO: 2828620 - DNA, 13 bp, Homo sapiens
gcatttaataaat

SEQ ID NO: 2828621 - DNA, 14 bp, Homo sapiens
gcatttaataaatg

SEQ ID NO: 2828622 - DNA, 19 bp, Homo sapiens
gcatttatggtcaacactt

SEQ ID NO: 2828623 - DNA, 13 bp, Homo sapiens
gcatttcctgggt

SEQ ID NO: 2828624 - DNA, 20 bp, Homo sapiens
gcatttcttgatgttgctta

SEQ ID NO: 2828625 - DNA, 18 bp, Homo sapiens
gcattttactacttgtta

SEQ ID NO: 2828626 - DNA, 19 bp, Homo sapiens
gccaaagacttagtatatt

SEQ ID NO: 2828627 - DNA, 16 bp, Homo sapiens
gccaaagcaaaagaag

SEQ ID NO: 2828628 - DNA, 21 bp, Homo sapiens
gccaaagcaaaagaagtaaaa

SEQ ID NO: 2828629 - DNA, 12 bp, Homo sapiens
gccaaagtgtta

SEQ ID NO: 2828630 - DNA, 14 bp, Homo sapiens
gccaaatttatatg

SEQ ID NO: 2828631 - DNA, 20 bp, Homo sapiens
gccaaatttatatgccaccg

SEQ ID NO: 2828632 - DNA, 22 bp, Homo sapiens
gccaaattttttgtatattaaa

SEQ ID NO: 2828633 - DNA, 17 bp, Homo sapiens
gccaacagaagcttcca

SEQ ID NO: 2828634 - DNA, 16 bp, Homo sapiens
gccaacaggtggcagg

SEQ ID NO: 2828635 - DNA, 20 bp, Homo sapiens
gccaacatggtgaaaccctg

SEQ ID NO: 2828636 - DNA, 23 bp, Homo sapiens
gccaactcactcttatgaaatgg

SEQ ID NO: 2828637 - DNA, 14 bp, Homo sapiens
gccaacttgtaaat

SEQ ID NO: 2828638 - DNA, 15 bp, Homo sapiens
gccaagctgaggtgc

SEQ ID NO: 2828639 - DNA, 21 bp, Homo sapiens
gccaagctgaggtgcccagga

SEQ ID NO: 2828640 - DNA, 22 bp, Homo sapiens
gccaagctgaggtgcccaggag

SEQ ID NO: 2828641 - DNA, 12 bp, Homo sapiens
gccaaggcagcg

SEQ ID NO: 2828642 - DNA, 16 bp, Homo sapiens
gccaaggtgggctgag

SEQ ID NO: 2828643 - DNA, 22 bp, Homo sapiens
gccaaggtgggctgagccctgg

SEQ ID NO: 2828644 - DNA, 21 bp, Homo sapiens
gccaagtccaggtcctggtgg

SEQ ID NO: 2828645 - DNA, 22 bp, Homo sapiens
gccaagtccaggtcctggtggg

SEQ ID NO: 2828646 - DNA, 19 bp, Homo sapiens
gccaatgcacctaaagaaa

SEQ ID NO: 2828647 - DNA, 19 bp, Homo sapiens
gccaattaaaatatatata

SEQ ID NO: 2828648 - DNA, 15 bp, Homo sapiens
gccacaccctcccca

SEQ ID NO: 2828649 - DNA, 16 bp, Homo sapiens
gccacaccctccccat

SEQ ID NO: 2828650 - DNA, 21 bp, Homo sapiens
gccacactattaccatgagaa

SEQ ID NO: 2828651 - DNA, 17 bp, Homo sapiens
gccacactcagtccccc

SEQ ID NO: 2828652 - DNA, 19 bp, Homo sapiens
gccacactcagtcccccac

SEQ ID NO: 2828653 - DNA, 22 bp, Homo sapiens
gccacacttctcaggacacagg

SEQ ID NO: 2828654 - DNA, 14 bp, Homo sapiens
gccacagaagccag

SEQ ID NO: 2828655 - DNA, 18 bp, Homo sapiens
gccacagaagccaggagc

SEQ ID NO: 2828656 - DNA, 21 bp, Homo sapiens
gccacagaccacctgcttctg

SEQ ID NO: 2828657 - DNA, 12 bp, Homo sapiens
gccacagagaag

SEQ ID NO: 2828658 - DNA, 11 bp, Homo sapiens
gccacattttg

SEQ ID NO: 2828659 - DNA, 16 bp, Homo sapiens
gccaccagtcactgtc

SEQ ID NO: 2828660 - DNA, 17 bp, Homo sapiens
gccaccatcctgcagcc

SEQ ID NO: 2828661 - DNA, 22 bp, Homo sapiens
gccacccgttctgctggcctgg

SEQ ID NO: 2828662 - DNA, 12 bp, Homo sapiens
gccaccctgagg

SEQ ID NO: 2828663 - DNA, 16 bp, Homo sapiens
gccaccctgaggagtc

SEQ ID NO: 2828664 - DNA, 23 bp, Homo sapiens
gccaccctgaggagtctgaggtc

SEQ ID NO: 2828665 - DNA, 13 bp, Homo sapiens
gccaccctgggga

SEQ ID NO: 2828666 - DNA, 18 bp, Homo sapiens
gccaccgggacagacctg

SEQ ID NO: 2828667 - DNA, 19 bp, Homo sapiens
gccaccgggacagacctgg

SEQ ID NO: 2828668 - DNA, 22 bp, Homo sapiens
gccaccgggacagacctggaca

SEQ ID NO: 2828669 - DNA, 12 bp, Homo sapiens
gccacctcccct

SEQ ID NO: 2828670 - DNA, 13 bp, Homo sapiens
gccacctccccta

SEQ ID NO: 2828671 - DNA, 17 bp, Homo sapiens
gccacctcccctatcca

SEQ ID NO: 2828672 - DNA, 20 bp, Homo sapiens
gccacctcccctatccaccc

SEQ ID NO: 2828673 - DNA, 22 bp, Homo sapiens
gccacctcccctatccacccag

SEQ ID NO: 2828674 - DNA, 12 bp, Homo sapiens
gccacctgtctg

SEQ ID NO: 2828675 - DNA, 14 bp, Homo sapiens
gccacggccaggcc

SEQ ID NO: 2828676 - DNA, 16 bp, Homo sapiens
gccacggccaggccag

SEQ ID NO: 2828677 - DNA, 19 bp, Homo sapiens
gccactacactccagcctg

SEQ ID NO: 2828678 - DNA, 12 bp, Homo sapiens
gccactcatttc

SEQ ID NO: 2828679 - DNA, 16 bp, Homo sapiens
gccactcatttcatct

SEQ ID NO: 2828680 - DNA, 23 bp, Homo sapiens
gccactcgggaggctgagacagg

SEQ ID NO: 2828681 - DNA, 15 bp, Homo sapiens
gccactctcccctcc

SEQ ID NO: 2828682 - DNA, 17 bp, Homo sapiens
gccactgaagctgggat

SEQ ID NO: 2828683 - DNA, 19 bp, Homo sapiens
gccactgaagctgggattc

SEQ ID NO: 2828684 - DNA, 21 bp, Homo sapiens
gccactgcaccgggccacaga

SEQ ID NO: 2828685 - DNA, 19 bp, Homo sapiens
gccactgcactctagcctg

SEQ ID NO: 2828686 - DNA, 17 bp, Homo sapiens
gccactgcctcttcctc

SEQ ID NO: 2828687 - DNA, 18 bp, Homo sapiens
gccactggtttctcagaa

SEQ ID NO: 2828688 - DNA, 19 bp, Homo sapiens
gccactggtttctcagaat

SEQ ID NO: 2828689 - DNA, 20 bp, Homo sapiens
gccactggtttctcagaatc

SEQ ID NO: 2828690 - DNA, 21 bp, Homo sapiens
gccacttgatgacccccaacc

SEQ ID NO: 2828691 - DNA, 21 bp, Homo sapiens
gccactttcgggagggtggat

SEQ ID NO: 2828692 - DNA, 22 bp, Homo sapiens
gccactttggtacatggccagt

SEQ ID NO: 2828693 - DNA, 14 bp, Homo sapiens
gccagaagcccatg

SEQ ID NO: 2828694 - DNA, 19 bp, Homo sapiens
gccagaagcctctgcctcc

SEQ ID NO: 2828695 - DNA, 21 bp, Homo sapiens
gccagaaggggcacgcctgcc

SEQ ID NO: 2828696 - DNA, 14 bp, Homo sapiens
gccagacatgtggt

SEQ ID NO: 2828697 - DNA, 20 bp, Homo sapiens
gccagagacggaagcctttt

SEQ ID NO: 2828698 - DNA, 15 bp, Homo sapiens
gccagagcctggggc

SEQ ID NO: 2828699 - DNA, 16 bp, Homo sapiens
gccagagcctggggca

SEQ ID NO: 2828700 - DNA, 11 bp, Homo sapiens
gcctagggagc

SEQ ID NO: 2828701 - DNA, 20 bp, Homo sapiens
gcctaggtgacagagtgaga

SEQ ID NO: 2828702 - DNA, 22 bp, Homo sapiens
gcctagtggggtctccctctcc

SEQ ID NO: 2828703 - DNA, 18 bp, Homo sapiens
gcctatgacttgggcacc

SEQ ID NO: 2828704 - DNA, 14 bp, Homo sapiens
gcctatgcacatat

SEQ ID NO: 2828705 - DNA, 20 bp, Homo sapiens
gcctatgcacatatggactc

SEQ ID NO: 2828706 - DNA, 22 bp, Homo sapiens
gcctatgcacatatggactctg

SEQ ID NO: 2828707 - DNA, 16 bp, Homo sapiens
gcctatggagagccct

SEQ ID NO: 2828708 - DNA, 17 bp, Homo sapiens
gcctatggagagccctg

SEQ ID NO: 2828709 - DNA, 19 bp, Homo sapiens
gcctatggagagccctggg

SEQ ID NO: 2828710 - DNA, 22 bp, Homo sapiens
gcctatggagagccctgggacc

SEQ ID NO: 2828711 - DNA, 19 bp, Homo sapiens
gcctcaacctcctgggcta

SEQ ID NO: 2828712 - DNA, 22 bp, Homo sapiens
gcctcaagtgattctcctgcct

SEQ ID NO: 2828713 - DNA, 17 bp, Homo sapiens
gcctcaatgtgaccagg

SEQ ID NO: 2828714 - DNA, 13 bp, Homo sapiens
gcctcacagaaga

SEQ ID NO: 2828715 - DNA, 16 bp, Homo sapiens
gcctcacagaagaata

SEQ ID NO: 2828716 - DNA, 18 bp, Homo sapiens
gcctcacgcccagcctcc

SEQ ID NO: 2828717 - DNA, 20 bp, Homo sapiens
gcctcacgcccagcctcctc

SEQ ID NO: 2828718 - DNA, 12 bp, Homo sapiens
gcctcagaccaa

SEQ ID NO: 2828719 - DNA, 12 bp, Homo sapiens
gcctcagcctcc

SEQ ID NO: 2828720 - DNA, 12 bp, Homo sapiens
gcctcagctgct

SEQ ID NO: 2828721 - DNA, 14 bp, Homo sapiens
gcctcagtgccact

SEQ ID NO: 2828722 - DNA, 15 bp, Homo sapiens
gcctcagtgccacta

SEQ ID NO: 2828723 - DNA, 19 bp, Homo sapiens
gcctcatccgaggcagggt

SEQ ID NO: 2828724 - DNA, 21 bp, Homo sapiens
gcctcatgaccctcctgtcca

SEQ ID NO: 2828725 - DNA, 19 bp, Homo sapiens
gcctcatgctgacttgcag

SEQ ID NO: 2828726 - DNA, 15 bp, Homo sapiens
gcctcatttttttcc

SEQ ID NO: 2828727 - DNA, 20 bp, Homo sapiens
gcctccaggagcctaccccc

SEQ ID NO: 2828728 - DNA, 16 bp, Homo sapiens
gcctccattctgacca

SEQ ID NO: 2828729 - DNA, 15 bp, Homo sapiens
gcctcccaataaagc

SEQ ID NO: 2828730 - DNA, 16 bp, Homo sapiens
gcctcccaataaagct

SEQ ID NO: 2828731 - DNA, 12 bp, Homo sapiens
gcctccccacct

SEQ ID NO: 2828732 - DNA, 15 bp, Homo sapiens
gcctccccccagccc

SEQ ID NO: 2828733 - DNA, 19 bp, Homo sapiens
gcctccccccagcccctcc

SEQ ID NO: 2828734 - DNA, 13 bp, Homo sapiens
gcctccccccgct

SEQ ID NO: 2828735 - DNA, 18 bp, Homo sapiens
gcctcccgaatagctggg

SEQ ID NO: 2828736 - DNA, 23 bp, Homo sapiens
gcctcccgaatagctgggactac

SEQ ID NO: 2828737 - DNA, 14 bp, Homo sapiens
gcctccctcaaccc

SEQ ID NO: 2828738 - DNA, 14 bp, Homo sapiens
gcctccctctgacc

SEQ ID NO: 2828739 - DNA, 14 bp, Homo sapiens
gcctcctcccacca

SEQ ID NO: 2828740 - DNA, 13 bp, Homo sapiens
gcctcctctgtcc

SEQ ID NO: 2828741 - DNA, 17 bp, Homo sapiens
gcctcgaactggctgca

SEQ ID NO: 2828742 - DNA, 20 bp, Homo sapiens
gcctcgaactggctgcaaag

SEQ ID NO: 2828743 - DNA, 18 bp, Homo sapiens
gcctcgcaacccgtgcca

SEQ ID NO: 2828744 - DNA, 23 bp, Homo sapiens
gcctcgcaacccgtgccaagtcc

SEQ ID NO: 2828745 - DNA, 20 bp, Homo sapiens
gcctcgcatgccagagcctg

SEQ ID NO: 2828746 - DNA, 16 bp, Homo sapiens
gcctcgctccccactc

SEQ ID NO: 2828747 - DNA, 15 bp, Homo sapiens
gcctcggagcctcat

SEQ ID NO: 2828748 - DNA, 17 bp, Homo sapiens
gcctcggtggccatgct

SEQ ID NO: 2828749 - DNA, 19 bp, Homo sapiens
gcctcggtggccatgcttc

SEQ ID NO: 2828750 - DNA, 23 bp, Homo sapiens
gcctcggtggccatgcttcttgc

SEQ ID NO: 2828751 - DNA, 17 bp, Homo sapiens
gcctctactgggaaggc

SEQ ID NO: 2828752 - DNA, 16 bp, Homo sapiens
gcctctgacacacagc

SEQ ID NO: 2828753 - DNA, 21 bp, Homo sapiens
gcctctgacacacagctctgt

SEQ ID NO: 2828754 - DNA, 17 bp, Homo sapiens
gcctctgaggccagcct

SEQ ID NO: 2828755 - DNA, 18 bp, Homo sapiens
gcctctgaggccagcctg

SEQ ID NO: 2828756 - DNA, 19 bp, Homo sapiens
gcctctgaggccagcctgg

SEQ ID NO: 2828757 - DNA, 22 bp, Homo sapiens
gcctctgaggccagcctggcct

SEQ ID NO: 2828758 - DNA, 15 bp, Homo sapiens
gcctctgcattcagg

SEQ ID NO: 2828759 - DNA, 18 bp, Homo sapiens
gcctctgcctctgacaca

SEQ ID NO: 2828760 - DNA, 13 bp, Homo sapiens
gcctctgcctgtg

SEQ ID NO: 2828761 - DNA, 16 bp, Homo sapiens
gcctctgcctgtgcac

SEQ ID NO: 2828762 - DNA, 16 bp, Homo sapiens
gcctctggctgctgta

SEQ ID NO: 2828763 - DNA, 18 bp, Homo sapiens
gcctcttaaagctgcctg

SEQ ID NO: 2828764 - DNA, 19 bp, Homo sapiens
gcctcttaaagctgcctgt

SEQ ID NO: 2828765 - DNA, 12 bp, Homo sapiens
gcctcttcctcc

SEQ ID NO: 2828766 - DNA, 19 bp, Homo sapiens
gcctcttggacctctgctc

SEQ ID NO: 2828767 - DNA, 20 bp, Homo sapiens
gcctcttggacctctgctct

SEQ ID NO: 2828768 - DNA, 14 bp, Homo sapiens
gcctcttgggttca

SEQ ID NO: 2828769 - DNA, 18 bp, Homo sapiens
gcctcttttctctgtgct

SEQ ID NO: 2828770 - DNA, 21 bp, Homo sapiens
gcctgaacctggggtcatcga

SEQ ID NO: 2828771 - DNA, 16 bp, Homo sapiens
gcctgaagtcacacag

SEQ ID NO: 2828772 - DNA, 17 bp, Homo sapiens
gcctgaagtcacacagt

SEQ ID NO: 2828773 - DNA, 22 bp, Homo sapiens
gcctgaagtcacacagtgagtc

SEQ ID NO: 2828774 - DNA, 22 bp, Homo sapiens
gcctgagcaacagagtgagacc

SEQ ID NO: 2828775 - DNA, 17 bp, Homo sapiens
gcctgagcccagggagg

SEQ ID NO: 2828776 - DNA, 18 bp, Homo sapiens
gcctgagcccagggaggc

SEQ ID NO: 2828777 - DNA, 15 bp, Homo sapiens
gcctgaggctgagac

SEQ ID NO: 2828778 - DNA, 14 bp, Homo sapiens
gcctgagggtggag

SEQ ID NO: 2828779 - DNA, 12 bp, Homo sapiens
gcctgatgacag

SEQ ID NO: 2828780 - DNA, 13 bp, Homo sapiens
gcctgattttaaa

SEQ ID NO: 2828781 - DNA, 19 bp, Homo sapiens
gcctgcacccttcctcctc

SEQ ID NO: 2828782 - DNA, 14 bp, Homo sapiens
gcctgcagagagaa

SEQ ID NO: 2828783 - DNA, 17 bp, Homo sapiens
gcctgccagggcccctg

SEQ ID NO: 2828784 - DNA, 13 bp, Homo sapiens
gcctgcccagcct

SEQ ID NO: 2828785 - DNA, 14 bp, Homo sapiens
gcctgcccagcctc

SEQ ID NO: 2828786 - DNA, 12 bp, Homo sapiens
gcctgcccaggc

SEQ ID NO: 2828787 - DNA, 18 bp, Homo sapiens
gcctgcccaggcccctgc

SEQ ID NO: 2828788 - DNA, 22 bp, Homo sapiens
gcctgcccaggcccctgccacc

SEQ ID NO: 2828789 - DNA, 16 bp, Homo sapiens
gcctgccgagcaaccg

SEQ ID NO: 2828790 - DNA, 23 bp, Homo sapiens
gcctgctaattccccagattgca

SEQ ID NO: 2828791 - DNA, 13 bp, Homo sapiens
gcgaaagtttctt

SEQ ID NO: 2828792 - DNA, 21 bp, Homo sapiens
gcgaacatgcctgattttaaa

SEQ ID NO: 2828793 - DNA, 15 bp, Homo sapiens
gcgaaccaatatttg

SEQ ID NO: 2828794 - DNA, 16 bp, Homo sapiens
gcgaaggggccctggt

SEQ ID NO: 2828795 - DNA, 11 bp, Homo sapiens
gcgacccctca

SEQ ID NO: 2828796 - DNA, 17 bp, Homo sapiens
gcgacttcctctccagc

SEQ ID NO: 2828797 - DNA, 21 bp, Homo sapiens
gcgagacccttgcattagaaa

SEQ ID NO: 2828798 - DNA, 19 bp, Homo sapiens
gcgagagaggtgggcagca

SEQ ID NO: 2828799 - DNA, 16 bp, Homo sapiens
gcgagagtctgtctca

SEQ ID NO: 2828800 - DNA, 13 bp, Homo sapiens
gcgagcatttccc

SEQ ID NO: 2828801 - DNA, 16 bp, Homo sapiens
gcgagcatttccctcc

SEQ ID NO: 2828802 - DNA, 15 bp, Homo sapiens
gcgagccctggtggc

SEQ ID NO: 2828803 - DNA, 15 bp, Homo sapiens
gcgagtgccaggact

SEQ ID NO: 2828804 - DNA, 17 bp, Homo sapiens
gcgagttgtggaaagcc

SEQ ID NO: 2828805 - DNA, 19 bp, Homo sapiens
gcgatgaatttggagactc

SEQ ID NO: 2828806 - DNA, 18 bp, Homo sapiens
gcgattccctctcccagg

SEQ ID NO: 2828807 - DNA, 23 bp, Homo sapiens
gcgcaagcctgtaatcccagcta

SEQ ID NO: 2828808 - DNA, 17 bp, Homo sapiens
gcgcacctgccccctgg

SEQ ID NO: 2828809 - DNA, 22 bp, Homo sapiens
gcgcagtgcttctctacagact

SEQ ID NO: 2828810 - DNA, 22 bp, Homo sapiens
gcgcatgtaatcccagctactc

SEQ ID NO: 2828811 - DNA, 22 bp, Homo sapiens
gcgccactacactccagcctga

SEQ ID NO: 2828812 - DNA, 24 bp, Homo sapiens
gcgccactacactccagcctgagc

SEQ ID NO: 2828813 - DNA, 23 bp, Homo sapiens
gcgcccagttgggtggatgcctg

SEQ ID NO: 2828814 - DNA, 13 bp, Homo sapiens
gcgccctgcagac

SEQ ID NO: 2828815 - DNA, 12 bp, Homo sapiens
gcgcctccctcc

SEQ ID NO: 2828816 - DNA, 16 bp, Homo sapiens
gcgcctgtagtcccag

SEQ ID NO: 2828817 - DNA, 21 bp, Homo sapiens
gcgcgcatgtaatcccagcta

SEQ ID NO: 2828818 - DNA, 23 bp, Homo sapiens
gcgcgcatgtaatcccagctact

SEQ ID NO: 2828819 - DNA, 22 bp, Homo sapiens
gcgctctgccctccctggcctc

SEQ ID NO: 2828820 - DNA, 16 bp, Homo sapiens
gcgctgccgcacccca

SEQ ID NO: 2828821 - DNA, 22 bp, Homo sapiens
gcgctttctggaaaagaggagt

SEQ ID NO: 2828822 - DNA, 13 bp, Homo sapiens
gcggacagccacg

SEQ ID NO: 2828823 - DNA, 15 bp, Homo sapiens
gcggacagccacggc

SEQ ID NO: 2828824 - DNA, 23 bp, Homo sapiens
gcggacagccacggccaggccag

SEQ ID NO: 2828825 - DNA, 19 bp, Homo sapiens
gcggagacggagtcccacc

SEQ ID NO: 2828826 - DNA, 16 bp, Homo sapiens
gcggagagtacagtga

SEQ ID NO: 2828827 - DNA, 15 bp, Homo sapiens
gcggaggagaccagc

SEQ ID NO: 2828828 - DNA, 19 bp, Homo sapiens
gcggcacattggcagtgtg

SEQ ID NO: 2828829 - DNA, 13 bp, Homo sapiens
gcggccaccaccc

SEQ ID NO: 2828830 - DNA, 22 bp, Homo sapiens
gcggctactcagcagccctcct

SEQ ID NO: 2828831 - DNA, 14 bp, Homo sapiens
gcgggaaggagggt

SEQ ID NO: 2828832 - DNA, 21 bp, Homo sapiens
gcgggaggatgttctgggaca

SEQ ID NO: 2828833 - DNA, 19 bp, Homo sapiens
gcgggagtgggggctgtgc

SEQ ID NO: 2828834 - DNA, 20 bp, Homo sapiens
gcgggcgcctgtagtcccag

SEQ ID NO: 2828835 - DNA, 17 bp, Homo sapiens
gcgggggagccaacagc

SEQ ID NO: 2828836 - DNA, 20 bp, Homo sapiens
gcgggggagccaacagcagc

SEQ ID NO: 2828837 - DNA, 19 bp, Homo sapiens
gcgggtggatcacctgagg

SEQ ID NO: 2828838 - DNA, 16 bp, Homo sapiens
gcggtccacccaggag

SEQ ID NO: 2828839 - DNA, 18 bp, Homo sapiens
gcggtccacccaggagcc

SEQ ID NO: 2828840 - DNA, 15 bp, Homo sapiens
gcggtttccaggcca

SEQ ID NO: 2828841 - DNA, 15 bp, Homo sapiens
gcgtctaccctggga

SEQ ID NO: 2828842 - DNA, 14 bp, Homo sapiens
gcgtcttgtatttt

SEQ ID NO: 2828843 - DNA, 18 bp, Homo sapiens
gcgtgcacacaccagagc

SEQ ID NO: 2828844 - DNA, 23 bp, Homo sapiens
gcgtgcacacaccagagcccacc

SEQ ID NO: 2828845 - DNA, 21 bp, Homo sapiens
gcgtgccctgacccctgcacc

SEQ ID NO: 2828846 - DNA, 17 bp, Homo sapiens
gcgtggactctgcacat

SEQ ID NO: 2828847 - DNA, 18 bp, Homo sapiens
gcgtggactctgcacatg

SEQ ID NO: 2828848 - DNA, 15 bp, Homo sapiens
gcgtggttcctttct

SEQ ID NO: 2828849 - DNA, 16 bp, Homo sapiens
gcgttactaattggcc

SEQ ID NO: 2828850 - DNA, 18 bp, Homo sapiens
gcgttctgctgcccctgc

SEQ ID NO: 2828851 - DNA, 12 bp, Homo sapiens
gcgttttagagt

SEQ ID NO: 2828852 - DNA, 12 bp, Homo sapiens
gctaaaagaaac

SEQ ID NO: 2828853 - DNA, 21 bp, Homo sapiens
gctaaatgcaaacactgtgta

SEQ ID NO: 2828854 - DNA, 23 bp, Homo sapiens
gctaaatggtcgcccaggagaca

SEQ ID NO: 2828855 - DNA, 18 bp, Homo sapiens
gctaaattacaattgtca

SEQ ID NO: 2828856 - DNA, 16 bp, Homo sapiens
gctaacagggaaggca

SEQ ID NO: 2828857 - DNA, 20 bp, Homo sapiens
gctaacagggaaggcaggca

SEQ ID NO: 2828858 - DNA, 13 bp, Homo sapiens
gctaagagaagta

SEQ ID NO: 2828859 - DNA, 19 bp, Homo sapiens
gctaagctaggaatgaaat

SEQ ID NO: 2828860 - DNA, 13 bp, Homo sapiens
gctaagtgaaaag

SEQ ID NO: 2828861 - DNA, 22 bp, Homo sapiens
gctaagtgatcctcccacctca

SEQ ID NO: 2828862 - DNA, 21 bp, Homo sapiens
gctaatctgtagggctggacc

SEQ ID NO: 2828863 - DNA, 22 bp, Homo sapiens
gctaatctgtagggctggacct

SEQ ID NO: 2828864 - DNA, 13 bp, Homo sapiens
gctaatgggacac

SEQ ID NO: 2828865 - DNA, 14 bp, Homo sapiens
gctaattcaattta

SEQ ID NO: 2828866 - DNA, 17 bp, Homo sapiens
gctacccacttctaaat

SEQ ID NO: 2828867 - DNA, 14 bp, Homo sapiens
gctacctcactggg

SEQ ID NO: 2828868 - DNA, 21 bp, Homo sapiens
gctacctctctcttccctagg

SEQ ID NO: 2828869 - DNA, 18 bp, Homo sapiens
gctacctgtgtggacagg

SEQ ID NO: 2828870 - DNA, 19 bp, Homo sapiens
gctacctgtgtggacagga

SEQ ID NO: 2828871 - DNA, 14 bp, Homo sapiens
gctactcagaagcc

SEQ ID NO: 2828872 - DNA, 16 bp, Homo sapiens
gctactcagaagcctg

SEQ ID NO: 2828873 - DNA, 21 bp, Homo sapiens
gctactcagcagccctcctca

SEQ ID NO: 2828874 - DNA, 22 bp, Homo sapiens
gctactcagcagccctcctcac

SEQ ID NO: 2828875 - DNA, 16 bp, Homo sapiens
gctactcaggaggctg

SEQ ID NO: 2828876 - DNA, 23 bp, Homo sapiens
gctactcaggaggctgaggcaga

SEQ ID NO: 2828877 - DNA, 19 bp, Homo sapiens
gctactctagtattccaga

SEQ ID NO: 2828878 - DNA, 21 bp, Homo sapiens
gctactctagtattccagacc

SEQ ID NO: 2828879 - DNA, 14 bp, Homo sapiens
gctactctgtgcca

SEQ ID NO: 2828880 - DNA, 20 bp, Homo sapiens
gctactctgtgccagagcct

SEQ ID NO: 2828881 - DNA, 15 bp, Homo sapiens
gctggtttcctcatt

SEQ ID NO: 2828882 - DNA, 12 bp, Homo sapiens
gctggttttcct

SEQ ID NO: 2828883 - DNA, 16 bp, Homo sapiens
gctgtaaacagctctg

SEQ ID NO: 2828884 - DNA, 15 bp, Homo sapiens
gctgtaaataaatgc

SEQ ID NO: 2828885 - DNA, 20 bp, Homo sapiens
gctgtatcccatgagcctca

SEQ ID NO: 2828886 - DNA, 18 bp, Homo sapiens
gctgtattcagatcgtat

SEQ ID NO: 2828887 - DNA, 24 bp, Homo sapiens
gctgtattcagatcgtattaatta

SEQ ID NO: 2828888 - DNA, 16 bp, Homo sapiens
gctgtatttttagaga

SEQ ID NO: 2828889 - DNA, 18 bp, Homo sapiens
gctgtcataagaatgaat

SEQ ID NO: 2828890 - DNA, 19 bp, Homo sapiens
gctgtcattcaggacccca

SEQ ID NO: 2828891 - DNA, 12 bp, Homo sapiens
gctgtgacctgc

SEQ ID NO: 2828892 - DNA, 13 bp, Homo sapiens
gctgtgacctgct

SEQ ID NO: 2828893 - DNA, 16 bp, Homo sapiens
gctgtgacctgctgag

SEQ ID NO: 2828894 - DNA, 17 bp, Homo sapiens
gctgtgacctgctgagc

SEQ ID NO: 2828895 - DNA, 19 bp, Homo sapiens
gctgtgacctgctgagctc

SEQ ID NO: 2828896 - DNA, 20 bp, Homo sapiens
gctgtgacctgctgagctct

SEQ ID NO: 2828897 - DNA, 23 bp, Homo sapiens
gctgtgacctgctgagctctgag

SEQ ID NO: 2828898 - DNA, 13 bp, Homo sapiens
gctgtgctctgga

SEQ ID NO: 2828899 - DNA, 15 bp, Homo sapiens
gctgtggcctgggca

SEQ ID NO: 2828900 - DNA, 18 bp, Homo sapiens
gctgtgggggaggtccct

SEQ ID NO: 2828901 - DNA, 20 bp, Homo sapiens
gctgtggtggctgtctctgt

SEQ ID NO: 2828902 - DNA, 20 bp, Homo sapiens
gctgtggtggggagaggcat

SEQ ID NO: 2828903 - DNA, 21 bp, Homo sapiens
gctgtgtccgctttcatgaac

SEQ ID NO: 2828904 - DNA, 14 bp, Homo sapiens
gctgtgtccttgca

SEQ ID NO: 2828905 - DNA, 18 bp, Homo sapiens
gctgtgtccttgcacctg

SEQ ID NO: 2828906 - DNA, 23 bp, Homo sapiens
gctgtgtccttgcacctgcatcc

SEQ ID NO: 2828907 - DNA, 19 bp, Homo sapiens
gctgtgtgaattcccaggt

SEQ ID NO: 2828908 - DNA, 22 bp, Homo sapiens
gctgttcacccacagggctaag

SEQ ID NO: 2828909 - DNA, 12 bp, Homo sapiens
gctgttgagctg

SEQ ID NO: 2828910 - DNA, 15 bp, Homo sapiens
gctgttgcctcatct

SEQ ID NO: 2828911 - DNA, 14 bp, Homo sapiens
gctgttggctgggg

SEQ ID NO: 2828912 - DNA, 16 bp, Homo sapiens
gctgttggctgggggc

SEQ ID NO: 2828913 - DNA, 11 bp, Homo sapiens
gctgtttcctt

SEQ ID NO: 2828914 - DNA, 13 bp, Homo sapiens
gctgtttgagatg

SEQ ID NO: 2828915 - DNA, 14 bp, Homo sapiens
gctgttttcatctc

SEQ ID NO: 2828916 - DNA, 17 bp, Homo sapiens
gctgttttccctgacct

SEQ ID NO: 2828917 - DNA, 12 bp, Homo sapiens
gcttaaaacttt

SEQ ID NO: 2828918 - DNA, 13 bp, Homo sapiens
gcttaaaactttg

SEQ ID NO: 2828919 - DNA, 17 bp, Homo sapiens
gcttaatcagatagata

SEQ ID NO: 2828920 - DNA, 20 bp, Homo sapiens
gcttaatggctgataatttt

SEQ ID NO: 2828921 - DNA, 16 bp, Homo sapiens
gcttacagtgactgtc

SEQ ID NO: 2828922 - DNA, 21 bp, Homo sapiens
gcttactagccctgcggagcc

SEQ ID NO: 2828923 - DNA, 17 bp, Homo sapiens
gcttagacctcagcctg

SEQ ID NO: 2828924 - DNA, 18 bp, Homo sapiens
gcttagacctcagcctgt

SEQ ID NO: 2828925 - DNA, 23 bp, Homo sapiens
gcttagacctcagcctgtgctgc

SEQ ID NO: 2828926 - DNA, 12 bp, Homo sapiens
gcttaggatgtt

SEQ ID NO: 2828927 - DNA, 14 bp, Homo sapiens
gcttagtatctcat

SEQ ID NO: 2828928 - DNA, 23 bp, Homo sapiens
gcttatgacatcacttgtacaaa

SEQ ID NO: 2828929 - DNA, 18 bp, Homo sapiens
gcttatggggtattttaa

SEQ ID NO: 2828930 - DNA, 20 bp, Homo sapiens
gcttattcatctgtttttct

SEQ ID NO: 2828931 - DNA, 12 bp, Homo sapiens
gcttattttaaa

SEQ ID NO: 2828932 - DNA, 22 bp, Homo sapiens
gcttcaccctgaatggttccat

SEQ ID NO: 2828933 - DNA, 19 bp, Homo sapiens
gcttcagcatatttatagc

SEQ ID NO: 2828934 - DNA, 13 bp, Homo sapiens
gcttcatttcctg

SEQ ID NO: 2828935 - DNA, 16 bp, Homo sapiens
gcttcatttcctgtgt

SEQ ID NO: 2828936 - DNA, 17 bp, Homo sapiens
gcttcatttcctgtgtc

SEQ ID NO: 2828937 - DNA, 18 bp, Homo sapiens
gcttcatttcctgtgtct

SEQ ID NO: 2828938 - DNA, 20 bp, Homo sapiens
gcttccagagagtcctctgg

SEQ ID NO: 2828939 - DNA, 14 bp, Homo sapiens
gcttccagtgcatg

SEQ ID NO: 2828940 - DNA, 17 bp, Homo sapiens
gcttccatgagaacagc

SEQ ID NO: 2828941 - DNA, 17 bp, Homo sapiens
gcttcccatccccagcg

SEQ ID NO: 2828942 - DNA, 12 bp, Homo sapiens
gcttccccacag

SEQ ID NO: 2828943 - DNA, 14 bp, Homo sapiens
gcttccccacagaa

SEQ ID NO: 2828944 - DNA, 19 bp, Homo sapiens
gcttcctccgtctgcaatg

SEQ ID NO: 2828945 - DNA, 14 bp, Homo sapiens
gcttccttcatttc

SEQ ID NO: 2828946 - DNA, 22 bp, Homo sapiens
gcttccttggcatcacagggca

SEQ ID NO: 2828947 - DNA, 14 bp, Homo sapiens
gcttctatcccagg

SEQ ID NO: 2828948 - DNA, 12 bp, Homo sapiens
gcttctccaggc

SEQ ID NO: 2828949 - DNA, 14 bp, Homo sapiens
gcttctcctgaccc

SEQ ID NO: 2828950 - DNA, 19 bp, Homo sapiens
gcttctctgtgaacgattt

SEQ ID NO: 2828951 - DNA, 13 bp, Homo sapiens
gcttctgaactca

SEQ ID NO: 2828952 - DNA, 18 bp, Homo sapiens
gcttctgaactcaagctg

SEQ ID NO: 2828953 - DNA, 13 bp, Homo sapiens
gcttctggagccc

SEQ ID NO: 2828954 - DNA, 15 bp, Homo sapiens
gcttcttaaagagtt

SEQ ID NO: 2828955 - DNA, 17 bp, Homo sapiens
gcttcttgccccttggg

SEQ ID NO: 2828956 - DNA, 23 bp, Homo sapiens
gcttcttgccccttgggcctccc

SEQ ID NO: 2828957 - DNA, 21 bp, Homo sapiens
gcttgaagatcgttagtatct

SEQ ID NO: 2828958 - DNA, 22 bp, Homo sapiens
gcttgaagatcgttagtatcta

SEQ ID NO: 2828959 - DNA, 18 bp, Homo sapiens
gcttgaaggaacagtgct

SEQ ID NO: 2828960 - DNA, 14 bp, Homo sapiens
gcttgactatcaca

SEQ ID NO: 2828961 - DNA, 20 bp, Homo sapiens
gcttgactatcacatacaat

SEQ ID NO: 2828962 - DNA, 15 bp, Homo sapiens
gcttgagcccaggag

SEQ ID NO: 2828963 - DNA, 13 bp, Homo sapiens
gcttgagcctgtc

SEQ ID NO: 2828964 - DNA, 14 bp, Homo sapiens
gcttgagcctgtca

SEQ ID NO: 2828965 - DNA, 19 bp, Homo sapiens
gcttgagtttggggaatgc

SEQ ID NO: 2828966 - DNA, 18 bp, Homo sapiens
gcttggaaactggatgag

SEQ ID NO: 2828967 - DNA, 19 bp, Homo sapiens
gcttggaaagcatcacctc

SEQ ID NO: 2828968 - DNA, 13 bp, Homo sapiens
gcttgggccctgc

SEQ ID NO: 2828969 - DNA, 20 bp, Homo sapiens
gcttgggccctgcacagata

SEQ ID NO: 2828970 - DNA, 16 bp, Homo sapiens
gcttggggcttcctaa

SEQ ID NO: 2828971 - DNA, 24 bp, Homo sapiens
gcttgggggatgactagaggcagg

SEQ ID NO: 2828972 - DNA, 12 bp, Homo sapiens
ggagtgcagtga

SEQ ID NO: 2828973 - DNA, 13 bp, Homo sapiens
ggagtttgaggct

SEQ ID NO: 2828974 - DNA, 15 bp, Homo sapiens
ggataaaatgaggtt

SEQ ID NO: 2828975 - DNA, 22 bp, Homo sapiens
ggataacaaaatcacaagcaat

SEQ ID NO: 2828976 - DNA, 23 bp, Homo sapiens
ggataacaaaatcacaagcaata

SEQ ID NO: 2828977 - DNA, 21 bp, Homo sapiens
ggataagcgtgggtggaggaa

SEQ ID NO: 2828978 - DNA, 13 bp, Homo sapiens
ggatcactggagc

SEQ ID NO: 2828979 - DNA, 17 bp, Homo sapiens
ggatcagaacagcagag

SEQ ID NO: 2828980 - DNA, 16 bp, Homo sapiens
ggatcagcgtggcctt

SEQ ID NO: 2828981 - DNA, 19 bp, Homo sapiens
ggatcagcgtggccttgtt

SEQ ID NO: 2828982 - DNA, 14 bp, Homo sapiens
ggatcctattctca

SEQ ID NO: 2828983 - DNA, 21 bp, Homo sapiens
ggatctccaaggaccaggtta

SEQ ID NO: 2828984 - DNA, 13 bp, Homo sapiens
ggatctctcagga

SEQ ID NO: 2828985 - DNA, 16 bp, Homo sapiens
ggatctctcaggagca

SEQ ID NO: 2828986 - DNA, 23 bp, Homo sapiens
ggatctgggaccctttccttcct

SEQ ID NO: 2828987 - DNA, 14 bp, Homo sapiens
ggatgaatgaggtc

SEQ ID NO: 2828988 - DNA, 19 bp, Homo sapiens
ggatgactagaggcaggga

SEQ ID NO: 2828989 - DNA, 12 bp, Homo sapiens
ggatgagaaagg

SEQ ID NO: 2828990 - DNA, 13 bp, Homo sapiens
ggatgcctggtgg

SEQ ID NO: 2828991 - DNA, 18 bp, Homo sapiens
ggatgcctggtggcagct

SEQ ID NO: 2828992 - DNA, 17 bp, Homo sapiens
ggatggacgaacagggg

SEQ ID NO: 2828993 - DNA, 22 bp, Homo sapiens
ggatggcccttcccactggagg

SEQ ID NO: 2828994 - DNA, 15 bp, Homo sapiens
ggatgggagtgagac

SEQ ID NO: 2828995 - DNA, 16 bp, Homo sapiens
ggatggtcctggggct

SEQ ID NO: 2828996 - DNA, 20 bp, Homo sapiens
ggatggtcctggggctctgt

SEQ ID NO: 2828997 - DNA, 16 bp, Homo sapiens
ggatgtaaacagtgcc

SEQ ID NO: 2828998 - DNA, 17 bp, Homo sapiens
ggatgtaaacagtgcct

SEQ ID NO: 2828999 - DNA, 19 bp, Homo sapiens
ggatgtaaacagtgcctgc

SEQ ID NO: 2829000 - DNA, 20 bp, Homo sapiens
ggatgtaaacagtgcctgct

SEQ ID NO: 2829001 - DNA, 18 bp, Homo sapiens
ggatgtggagctcctgct

SEQ ID NO: 2829002 - DNA, 13 bp, Homo sapiens
ggatgtgtaaatg

SEQ ID NO: 2829003 - DNA, 21 bp, Homo sapiens
ggatgttttgtcccatttcct

SEQ ID NO: 2829004 - DNA, 23 bp, Homo sapiens
ggattcccaccaaggtcttcagc

SEQ ID NO: 2829005 - DNA, 12 bp, Homo sapiens
ggattctccagg

SEQ ID NO: 2829006 - DNA, 19 bp, Homo sapiens
ggattctgggaggaagcag

SEQ ID NO: 2829007 - DNA, 17 bp, Homo sapiens
ggattgctactgtccta

SEQ ID NO: 2829008 - DNA, 19 bp, Homo sapiens
ggatttatatctatagtag

SEQ ID NO: 2829009 - DNA, 16 bp, Homo sapiens
ggatttcctattttaa

SEQ ID NO: 2829010 - DNA, 21 bp, Homo sapiens
ggatttcctattttaaaacca

SEQ ID NO: 2829011 - DNA, 13 bp, Homo sapiens
ggatttgaagcaa

SEQ ID NO: 2829012 - DNA, 23 bp, Homo sapiens
ggattttaaaaacatgagaaatg

SEQ ID NO: 2829013 - DNA, 20 bp, Homo sapiens
ggcaaaggtggctctccagt

SEQ ID NO: 2829014 - DNA, 12 bp, Homo sapiens
ggcaacagagca

SEQ ID NO: 2829015 - DNA, 18 bp, Homo sapiens
ggcaacagagcaagactc

SEQ ID NO: 2829016 - DNA, 23 bp, Homo sapiens
ggcaacagagcaagactccgtct

SEQ ID NO: 2829017 - DNA, 19 bp, Homo sapiens
ggcaacccccagcctgcta

SEQ ID NO: 2829018 - DNA, 17 bp, Homo sapiens
ggcaacgacggtttcaa

SEQ ID NO: 2829019 - DNA, 13 bp, Homo sapiens
ggcaactgaggca

SEQ ID NO: 2829020 - DNA, 14 bp, Homo sapiens
ggcaactgaggcag

SEQ ID NO: 2829021 - DNA, 20 bp, Homo sapiens
ggcaactgaggcagacagca

SEQ ID NO: 2829022 - DNA, 23 bp, Homo sapiens
ggcaactgaggcagacagcagct

SEQ ID NO: 2829023 - DNA, 18 bp, Homo sapiens
ggcaagagtgagactccg

SEQ ID NO: 2829024 - DNA, 18 bp, Homo sapiens
ggcaagcacctcctgcct

SEQ ID NO: 2829025 - DNA, 19 bp, Homo sapiens
ggcaagggccatgctgaag

SEQ ID NO: 2829026 - DNA, 22 bp, Homo sapiens
ggcaagtccctgactctctgtg

SEQ ID NO: 2829027 - DNA, 23 bp, Homo sapiens
ggcaatgctggctgttggctggg

SEQ ID NO: 2829028 - DNA, 14 bp, Homo sapiens
ggcaattttgtaac

SEQ ID NO: 2829029 - DNA, 22 bp, Homo sapiens
ggcacaatggctaattcccaga

SEQ ID NO: 2829030 - DNA, 17 bp, Homo sapiens
ggcacacgcctgtaatc

SEQ ID NO: 2829031 - DNA, 18 bp, Homo sapiens
ggcacaggtgtaaatata

SEQ ID NO: 2829032 - DNA, 22 bp, Homo sapiens
ggcaccagaggctgcagaaggc

SEQ ID NO: 2829033 - DNA, 20 bp, Homo sapiens
ggcacccaccatcatgtctg

SEQ ID NO: 2829034 - DNA, 14 bp, Homo sapiens
ggcacccccagcct

SEQ ID NO: 2829035 - DNA, 17 bp, Homo sapiens
ggcacccccagcctggg

SEQ ID NO: 2829036 - DNA, 19 bp, Homo sapiens
ggcacccccagcctgggcc

SEQ ID NO: 2829037 - DNA, 16 bp, Homo sapiens
ggcacccggcccctgc

SEQ ID NO: 2829038 - DNA, 18 bp, Homo sapiens
ggcacccggcccctgctg

SEQ ID NO: 2829039 - DNA, 20 bp, Homo sapiens
ggcacctacatccccaggtc

SEQ ID NO: 2829040 - DNA, 21 bp, Homo sapiens
ggcacctacatccccaggtct

SEQ ID NO: 2829041 - DNA, 22 bp, Homo sapiens
ggcacctatagtcccagctact

SEQ ID NO: 2829042 - DNA, 18 bp, Homo sapiens
ggcacgaacccacctgct

SEQ ID NO: 2829043 - DNA, 13 bp, Homo sapiens
ggcacgcctgccc

SEQ ID NO: 2829044 - DNA, 18 bp, Homo sapiens
ggcacgcctgcccagcct

SEQ ID NO: 2829045 - DNA, 20 bp, Homo sapiens
ggcactcagaagacactgat

SEQ ID NO: 2829046 - DNA, 17 bp, Homo sapiens
ggcagaagaattgaacc

SEQ ID NO: 2829047 - DNA, 15 bp, Homo sapiens
ggcagacagcagctc

SEQ ID NO: 2829048 - DNA, 17 bp, Homo sapiens
ggcagacagcagctcag

SEQ ID NO: 2829049 - DNA, 17 bp, Homo sapiens
ggcagagaaagaagaga

SEQ ID NO: 2829050 - DNA, 16 bp, Homo sapiens
ggcagagaaggcttcc

SEQ ID NO: 2829051 - DNA, 14 bp, Homo sapiens
ggcagagaatcata

SEQ ID NO: 2829052 - DNA, 23 bp, Homo sapiens
ggcagaggctggaggcagggcct

SEQ ID NO: 2829053 - DNA, 15 bp, Homo sapiens
ggcagataatcagcc

SEQ ID NO: 2829054 - DNA, 23 bp, Homo sapiens
ggcagatacaggaaaagctgctg

SEQ ID NO: 2829055 - DNA, 16 bp, Homo sapiens
ggcagatgtaggaggg

SEQ ID NO: 2829056 - DNA, 20 bp, Homo sapiens
ggcagatgtaggagggactg

SEQ ID NO: 2829057 - DNA, 16 bp, Homo sapiens
ggcagcaaagtgtcag

SEQ ID NO: 2829058 - DNA, 12 bp, Homo sapiens
ggcagcaaggcc

SEQ ID NO: 2829059 - DNA, 18 bp, Homo sapiens
ggcagcaaggcccgagca

SEQ ID NO: 2829060 - DNA, 16 bp, Homo sapiens
ggcagcagccagccct

SEQ ID NO: 2829061 - DNA, 18 bp, Homo sapiens
ggcagcagccagccctgc

SEQ ID NO: 2829062 - DNA, 22 bp, Homo sapiens
gggcagctcctctgtctcgagc

SEQ ID NO: 2829063 - DNA, 11 bp, Homo sapiens
gggcagggctg

SEQ ID NO: 2829064 - DNA, 20 bp, Homo sapiens
gggcatggacgttcggggca

SEQ ID NO: 2829065 - DNA, 13 bp, Homo sapiens
gggccaattaaaa

SEQ ID NO: 2829066 - DNA, 12 bp, Homo sapiens
gggccactcctt

SEQ ID NO: 2829067 - DNA, 21 bp, Homo sapiens
gggccactccttcctgcccca

SEQ ID NO: 2829068 - DNA, 19 bp, Homo sapiens
gggccactctcccctccct

SEQ ID NO: 2829069 - DNA, 16 bp, Homo sapiens
gggccaggacaggccc

SEQ ID NO: 2829070 - DNA, 16 bp, Homo sapiens
gggccagtctgggctg

SEQ ID NO: 2829071 - DNA, 20 bp, Homo sapiens
gggccagtctgggctgccgg

SEQ ID NO: 2829072 - DNA, 17 bp, Homo sapiens
gggcccgctttgcctgc

SEQ ID NO: 2829073 - DNA, 12 bp, Homo sapiens
gggccctgcaca

SEQ ID NO: 2829074 - DNA, 15 bp, Homo sapiens
gggccctgcagaggg

SEQ ID NO: 2829075 - DNA, 16 bp, Homo sapiens
gggccggggaactggc

SEQ ID NO: 2829076 - DNA, 23 bp, Homo sapiens
gggccggggaactggccaagctg

SEQ ID NO: 2829077 - DNA, 14 bp, Homo sapiens
gggccgtgcccagg

SEQ ID NO: 2829078 - DNA, 20 bp, Homo sapiens
gggcctatggagagccctgg

SEQ ID NO: 2829079 - DNA, 17 bp, Homo sapiens
gggcctccccccagccc

SEQ ID NO: 2829080 - DNA, 15 bp, Homo sapiens
gggcctcggagcctc

SEQ ID NO: 2829081 - DNA, 17 bp, Homo sapiens
gggcctcggagcctcat

SEQ ID NO: 2829082 - DNA, 12 bp, Homo sapiens
gggcctgctgct

SEQ ID NO: 2829083 - DNA, 13 bp, Homo sapiens
gggcctgctgctg

SEQ ID NO: 2829084 - DNA, 17 bp, Homo sapiens
gggcctgctgctgagaa

SEQ ID NO: 2829085 - DNA, 19 bp, Homo sapiens
gggcctgctgctgagaacc

SEQ ID NO: 2829086 - DNA, 14 bp, Homo sapiens
gggcctggctggct

SEQ ID NO: 2829087 - DNA, 23 bp, Homo sapiens
gggcgctctgccctccctggcct

SEQ ID NO: 2829088 - DNA, 15 bp, Homo sapiens
gggcgggaggatgtt

SEQ ID NO: 2829089 - DNA, 20 bp, Homo sapiens
gggctaagagctagcgctgc

SEQ ID NO: 2829090 - DNA, 15 bp, Homo sapiens
gggctatgccttgtc

SEQ ID NO: 2829091 - DNA, 20 bp, Homo sapiens
gggctcagcctggtgggcct

SEQ ID NO: 2829092 - DNA, 14 bp, Homo sapiens
gggctcctggaacc

SEQ ID NO: 2829093 - DNA, 21 bp, Homo sapiens
gggctctaacgcctgagccca

SEQ ID NO: 2829094 - DNA, 23 bp, Homo sapiens
gggctctaacgcctgagcccagg

SEQ ID NO: 2829095 - DNA, 13 bp, Homo sapiens
gggctctccacct

SEQ ID NO: 2829096 - DNA, 14 bp, Homo sapiens
gggctctccacctc

SEQ ID NO: 2829097 - DNA, 17 bp, Homo sapiens
gggctctccacctcagc

SEQ ID NO: 2829098 - DNA, 12 bp, Homo sapiens
gggctctcctgg

SEQ ID NO: 2829099 - DNA, 11 bp, Homo sapiens
gggctctgccc

SEQ ID NO: 2829100 - DNA, 13 bp, Homo sapiens
gggctgagccctg

SEQ ID NO: 2829101 - DNA, 19 bp, Homo sapiens
gggctgccgggccaggcgc

SEQ ID NO: 2829102 - DNA, 22 bp, Homo sapiens
gggctggaaaagtcacacagac

SEQ ID NO: 2829103 - DNA, 16 bp, Homo sapiens
gggctgggagctctgc

SEQ ID NO: 2829104 - DNA, 14 bp, Homo sapiens
gggcttcagtggca

SEQ ID NO: 2829105 - DNA, 19 bp, Homo sapiens
gggcttcagtggcagctgc

SEQ ID NO: 2829106 - DNA, 18 bp, Homo sapiens
gggcttctgtccaaggca

SEQ ID NO: 2829107 - DNA, 23 bp, Homo sapiens
gggctttaacaaaacaagaaaga

SEQ ID NO: 2829108 - DNA, 13 bp, Homo sapiens
ggggaactcctgg

SEQ ID NO: 2829109 - DNA, 21 bp, Homo sapiens
ggggaactggccaagctgagg

SEQ ID NO: 2829110 - DNA, 22 bp, Homo sapiens
ggggaagggccagtctgggctg

SEQ ID NO: 2829111 - DNA, 22 bp, Homo sapiens
ggggaatgtttgcctctgcctc

SEQ ID NO: 2829112 - DNA, 19 bp, Homo sapiens
ggggacttacatgattcat

SEQ ID NO: 2829113 - DNA, 11 bp, Homo sapiens
ggggagaaagt

SEQ ID NO: 2829114 - DNA, 19 bp, Homo sapiens
ggggagaacttacattgtg

SEQ ID NO: 2829115 - DNA, 15 bp, Homo sapiens
ggggaggggcctagg

SEQ ID NO: 2829116 - DNA, 19 bp, Homo sapiens
ggggcacgcctgcccagcc

SEQ ID NO: 2829117 - DNA, 13 bp, Homo sapiens
ggggcagaacagc

SEQ ID NO: 2829118 - DNA, 18 bp, Homo sapiens
ggggcagagggcagaggc

SEQ ID NO: 2829119 - DNA, 21 bp, Homo sapiens
ggggcagccaaacccatgagg

SEQ ID NO: 2829120 - DNA, 17 bp, Homo sapiens
ggggcctagggagccgc

SEQ ID NO: 2829121 - DNA, 15 bp, Homo sapiens
ggggcctcagtgcca

SEQ ID NO: 2829122 - DNA, 12 bp, Homo sapiens
ggggcctccctg

SEQ ID NO: 2829123 - DNA, 17 bp, Homo sapiens
ggggcctgtactgcctg

SEQ ID NO: 2829124 - DNA, 19 bp, Homo sapiens
ggggcctgtactgcctgct

SEQ ID NO: 2829125 - DNA, 16 bp, Homo sapiens
ggggctatgccttgtc

SEQ ID NO: 2829126 - DNA, 11 bp, Homo sapiens
ggggctcctgg

SEQ ID NO: 2829127 - DNA, 13 bp, Homo sapiens
ggggctcctggaa

SEQ ID NO: 2829128 - DNA, 18 bp, Homo sapiens
ggggctctaacgcctgag

SEQ ID NO: 2829129 - DNA, 23 bp, Homo sapiens
ggggctctaacgcctgagcccag

SEQ ID NO: 2829130 - DNA, 15 bp, Homo sapiens
ggggctgctcctcca

SEQ ID NO: 2829131 - DNA, 20 bp, Homo sapiens
ggggctgctcctccagggcc

SEQ ID NO: 2829132 - DNA, 13 bp, Homo sapiens
gggggcagagggc

SEQ ID NO: 2829133 - DNA, 12 bp, Homo sapiens
gggggcctggct

SEQ ID NO: 2829134 - DNA, 17 bp, Homo sapiens
gggggcctggctggctg

SEQ ID NO: 2829135 - DNA, 15 bp, Homo sapiens
gggggcggcctatga

SEQ ID NO: 2829136 - DNA, 16 bp, Homo sapiens
gggggtccacccagca

SEQ ID NO: 2829137 - DNA, 17 bp, Homo sapiens
ggggtaggcagagcctt

SEQ ID NO: 2829138 - DNA, 15 bp, Homo sapiens
ggggtcaggctccat

SEQ ID NO: 2829139 - DNA, 18 bp, Homo sapiens
ggggtcgtggagagctag

SEQ ID NO: 2829140 - DNA, 22 bp, Homo sapiens
ggggtctccctctcctgcctac

SEQ ID NO: 2829141 - DNA, 22 bp, Homo sapiens
ggggtctttgtgagagtgagct

SEQ ID NO: 2829142 - DNA, 17 bp, Homo sapiens
ggggtgatttcagagag

SEQ ID NO: 2829143 - DNA, 18 bp, Homo sapiens
ggggtgatttcagagagg

SEQ ID NO: 2829144 - DNA, 15 bp, Homo sapiens
ggggtgcacaggagg

SEQ ID NO: 2829145 - DNA, 17 bp, Homo sapiens
ggggtggggagacctgg

SEQ ID NO: 2829146 - DNA, 17 bp, Homo sapiens
ggggtgggggtggggag

SEQ ID NO: 2829147 - DNA, 16 bp, Homo sapiens
ggggttcagcccctcc

SEQ ID NO: 2829148 - DNA, 22 bp, Homo sapiens
ggggttcagcccctcctctgcc

SEQ ID NO: 2829149 - DNA, 23 bp, Homo sapiens
ggggttcagcccctcctctgcca

SEQ ID NO: 2829150 - DNA, 22 bp, Homo sapiens
ggggttctttcttcctctgctg

SEQ ID NO: 2829151 - DNA, 13 bp, Homo sapiens
gggtacccactgc

SEQ ID NO: 2829152 - DNA, 18 bp, Homo sapiens
gggtacccactgctctgg

SEQ ID NO: 2829153 - DNA, 13 bp, Homo sapiens
ggtcctggcccca

SEQ ID NO: 2829154 - DNA, 18 bp, Homo sapiens
ggtcctggtggggcagct

SEQ ID NO: 2829155 - DNA, 21 bp, Homo sapiens
ggtccttcaagttagctcagg

SEQ ID NO: 2829156 - DNA, 16 bp, Homo sapiens
ggtccttccaggcccc

SEQ ID NO: 2829157 - DNA, 20 bp, Homo sapiens
ggtcgaccccaaagcccctt

SEQ ID NO: 2829158 - DNA, 12 bp, Homo sapiens
ggtcgcccagga

SEQ ID NO: 2829159 - DNA, 22 bp, Homo sapiens
ggtcgcttactttgagtgatcc

SEQ ID NO: 2829160 - DNA, 19 bp, Homo sapiens
ggtcggcaagagtgagact

SEQ ID NO: 2829161 - DNA, 15 bp, Homo sapiens
ggtcgtggagagcta

SEQ ID NO: 2829162 - DNA, 19 bp, Homo sapiens
ggtcgtggagagctaggag

SEQ ID NO: 2829163 - DNA, 14 bp, Homo sapiens
ggtctagggagaga

SEQ ID NO: 2829164 - DNA, 22 bp, Homo sapiens
ggtctcactatgttgcccaggc

SEQ ID NO: 2829165 - DNA, 12 bp, Homo sapiens
ggtctcactctg

SEQ ID NO: 2829166 - DNA, 22 bp, Homo sapiens
ggtctcagcttcatttccgtga

SEQ ID NO: 2829167 - DNA, 19 bp, Homo sapiens
ggtctccctccagctggaa

SEQ ID NO: 2829168 - DNA, 19 bp, Homo sapiens
ggtctccctctcctgccta

SEQ ID NO: 2829169 - DNA, 19 bp, Homo sapiens
ggtctctctctctctacaa

SEQ ID NO: 2829170 - DNA, 15 bp, Homo sapiens
ggtctgacccactgc

SEQ ID NO: 2829171 - DNA, 17 bp, Homo sapiens
ggtctgagcaccccctc

SEQ ID NO: 2829172 - DNA, 22 bp, Homo sapiens
ggtctggagaagcagtgagccg

SEQ ID NO: 2829173 - DNA, 14 bp, Homo sapiens
ggtctgtcccacca

SEQ ID NO: 2829174 - DNA, 21 bp, Homo sapiens
ggtcttgaactcctggcctca

SEQ ID NO: 2829175 - DNA, 18 bp, Homo sapiens
ggtcttggccgactcagg

SEQ ID NO: 2829176 - DNA, 14 bp, Homo sapiens
ggtgaccccagggc

SEQ ID NO: 2829177 - DNA, 20 bp, Homo sapiens
ggtgaccccagggcacagga

SEQ ID NO: 2829178 - DNA, 21 bp, Homo sapiens
ggtgaccccagggcacaggag

SEQ ID NO: 2829179 - DNA, 16 bp, Homo sapiens
ggtgacctctgcctga

SEQ ID NO: 2829180 - DNA, 21 bp, Homo sapiens
ggtgacctctgcctgaagtca

SEQ ID NO: 2829181 - DNA, 14 bp, Homo sapiens
ggtgagaccacctc

SEQ ID NO: 2829182 - DNA, 15 bp, Homo sapiens
ggtgataagtggaaa

SEQ ID NO: 2829183 - DNA, 16 bp, Homo sapiens
ggtgataagtggaaaa

SEQ ID NO: 2829184 - DNA, 18 bp, Homo sapiens
ggtgatccacccacctca

SEQ ID NO: 2829185 - DNA, 13 bp, Homo sapiens
ggtgatgagggca

SEQ ID NO: 2829186 - DNA, 17 bp, Homo sapiens
ggtgatgagggcagcag

SEQ ID NO: 2829187 - DNA, 22 bp, Homo sapiens
ggtgatgagggcagcagccagc

SEQ ID NO: 2829188 - DNA, 12 bp, Homo sapiens
ggtgcaaatcct

SEQ ID NO: 2829189 - DNA, 12 bp, Homo sapiens
ggtgcacaggag

SEQ ID NO: 2829190 - DNA, 14 bp, Homo sapiens
ggtgcacaggaggg

SEQ ID NO: 2829191 - DNA, 20 bp, Homo sapiens
ggtgcagttgacagcaggtg

SEQ ID NO: 2829192 - DNA, 18 bp, Homo sapiens
ggtgcctgggtggggctg

SEQ ID NO: 2829193 - DNA, 17 bp, Homo sapiens
ggtgcctgtgaggcagg

SEQ ID NO: 2829194 - DNA, 18 bp, Homo sapiens
ggtgcctgtgaggcaggg

SEQ ID NO: 2829195 - DNA, 19 bp, Homo sapiens
ggtgctataggctggagaa

SEQ ID NO: 2829196 - DNA, 21 bp, Homo sapiens
ggtgctataggctggagaagc

SEQ ID NO: 2829197 - DNA, 15 bp, Homo sapiens
ggtgctgccatccag

SEQ ID NO: 2829198 - DNA, 20 bp, Homo sapiens
ggtggaagccctccttccac

SEQ ID NO: 2829199 - DNA, 17 bp, Homo sapiens
ggtggacagtcctggga

SEQ ID NO: 2829200 - DNA, 12 bp, Homo sapiens
ggtggacccagg

SEQ ID NO: 2829201 - DNA, 14 bp, Homo sapiens
ggtggacccaggga

SEQ ID NO: 2829202 - DNA, 12 bp, Homo sapiens
ggtggcagctgc

SEQ ID NO: 2829203 - DNA, 13 bp, Homo sapiens
ggtggcagctgcg

SEQ ID NO: 2829204 - DNA, 15 bp, Homo sapiens
ggtggcatacgcctg

SEQ ID NO: 2829205 - DNA, 19 bp, Homo sapiens
ggtggccatgcttcttgcc

SEQ ID NO: 2829206 - DNA, 17 bp, Homo sapiens
ggtggctagtcagagag

SEQ ID NO: 2829207 - DNA, 13 bp, Homo sapiens
ggtggctgaccca

SEQ ID NO: 2829208 - DNA, 14 bp, Homo sapiens
ggtggcttttgcgg

SEQ ID NO: 2829209 - DNA, 15 bp, Homo sapiens
ggtgggagagcccag

SEQ ID NO: 2829210 - DNA, 16 bp, Homo sapiens
ggtgggatggaggaga

SEQ ID NO: 2829211 - DNA, 17 bp, Homo sapiens
ggtgggctgagccctgg

SEQ ID NO: 2829212 - DNA, 13 bp, Homo sapiens
ggtggggaatgtt

SEQ ID NO: 2829213 - DNA, 13 bp, Homo sapiens
ggtggggcagctc

SEQ ID NO: 2829214 - DNA, 15 bp, Homo sapiens
ggtggggcagctcct

SEQ ID NO: 2829215 - DNA, 14 bp, Homo sapiens
ggtggtatgtgtgt

SEQ ID NO: 2829216 - DNA, 18 bp, Homo sapiens
ggtggtcctgagacctga

SEQ ID NO: 2829217 - DNA, 16 bp, Homo sapiens
ggtggtgacctctgcc

SEQ ID NO: 2829218 - DNA, 14 bp, Homo sapiens
ggtgtaatgcacaa

SEQ ID NO: 2829219 - DNA, 21 bp, Homo sapiens
ggtgtcgctctgctggcctgg

SEQ ID NO: 2829220 - DNA, 13 bp, Homo sapiens
ggtgtgcctgcag

SEQ ID NO: 2829221 - DNA, 14 bp, Homo sapiens
ggtgtgcctgcagc

SEQ ID NO: 2829222 - DNA, 14 bp, Homo sapiens
ggtgtggtggctca

SEQ ID NO: 2829223 - DNA, 18 bp, Homo sapiens
ggtgtgtggagatgcaga

SEQ ID NO: 2829224 - DNA, 20 bp, Homo sapiens
ggttaggagttcgagaccag

SEQ ID NO: 2829225 - DNA, 13 bp, Homo sapiens
ggttagggagggg

SEQ ID NO: 2829226 - DNA, 21 bp, Homo sapiens
ggttatattttactactgtgg

SEQ ID NO: 2829227 - DNA, 21 bp, Homo sapiens
ggttcaagcgattcttctgct

SEQ ID NO: 2829228 - DNA, 16 bp, Homo sapiens
ggttcagagactcagg

SEQ ID NO: 2829229 - DNA, 18 bp, Homo sapiens
ggttcagcccctcctctg

SEQ ID NO: 2829230 - DNA, 20 bp, Homo sapiens
ggttcagcccctcctctgcc

SEQ ID NO: 2829231 - DNA, 18 bp, Homo sapiens
ggttcagggttggcccct

SEQ ID NO: 2829232 - DNA, 15 bp, Homo sapiens
ggttccatgcctgag

SEQ ID NO: 2829233 - DNA, 14 bp, Homo sapiens
ggttcccaataaaa

SEQ ID NO: 2829234 - DNA, 20 bp, Homo sapiens
ggttcccaataaaagtgact

SEQ ID NO: 2829235 - DNA, 23 bp, Homo sapiens
ggttcccattttcgctttcctct

SEQ ID NO: 2829236 - DNA, 17 bp, Homo sapiens
ggttctctccaggaagg

SEQ ID NO: 2829237 - DNA, 18 bp, Homo sapiens
ggttctttcttcctctgc

SEQ ID NO: 2829238 - DNA, 19 bp, Homo sapiens
ggttgcttaaaagggacag

SEQ ID NO: 2829239 - DNA, 22 bp, Homo sapiens
ggttggccgtggtccagctctt

SEQ ID NO: 2829240 - DNA, 13 bp, Homo sapiens
ggttgtcaatatt

SEQ ID NO: 2829241 - DNA, 16 bp, Homo sapiens
ggttgtgaggcctggc

SEQ ID NO: 2829242 - DNA, 21 bp, Homo sapiens
ggttgtgaggcctggccaggc

SEQ ID NO: 2829243 - DNA, 22 bp, Homo sapiens
ggttgtgaggcctggccaggca

SEQ ID NO: 2829244 - DNA, 16 bp, Homo sapiens
gtccatatcagacctc

SEQ ID NO: 2829245 - DNA, 18 bp, Homo sapiens
gtccatatcagacctctg

SEQ ID NO: 2829246 - DNA, 19 bp, Homo sapiens
gtccatatcagacctctga

SEQ ID NO: 2829247 - DNA, 18 bp, Homo sapiens
gtccatgcctacagataa

SEQ ID NO: 2829248 - DNA, 20 bp, Homo sapiens
gtccatgcctacagataatt

SEQ ID NO: 2829249 - DNA, 18 bp, Homo sapiens
gtccatgtattcacacac

SEQ ID NO: 2829250 - DNA, 21 bp, Homo sapiens
gtcccaagtagtagtgtcttc

SEQ ID NO: 2829251 - DNA, 17 bp, Homo sapiens
gtcccacatccctgggc

SEQ ID NO: 2829252 - DNA, 23 bp, Homo sapiens
gtcccacatccctgggcctgctg

SEQ ID NO: 2829253 - DNA, 13 bp, Homo sapiens
gtcccacctcttc

SEQ ID NO: 2829254 - DNA, 22 bp, Homo sapiens
gtcccacctcttctcttcctgt

SEQ ID NO: 2829255 - DNA, 23 bp, Homo sapiens
gtcccacctcttctcttcctgta

SEQ ID NO: 2829256 - DNA, 16 bp, Homo sapiens
gtcccaccttggctgc

SEQ ID NO: 2829257 - DNA, 19 bp, Homo sapiens
gtcccaccttggctgcagg

SEQ ID NO: 2829258 - DNA, 20 bp, Homo sapiens
gtcccatctgctcctcccat

SEQ ID NO: 2829259 - DNA, 20 bp, Homo sapiens
gtcccatttccttggaggcc

SEQ ID NO: 2829260 - DNA, 16 bp, Homo sapiens
gtccccagctccccag

SEQ ID NO: 2829261 - DNA, 18 bp, Homo sapiens
gtccccagtttgcagaaa

SEQ ID NO: 2829262 - DNA, 15 bp, Homo sapiens
gtccccatcatccca

SEQ ID NO: 2829263 - DNA, 21 bp, Homo sapiens
gtcccccttggaggagggctg

SEQ ID NO: 2829264 - DNA, 14 bp, Homo sapiens
gtccccgggagcac

SEQ ID NO: 2829265 - DNA, 14 bp, Homo sapiens
gtcccctccgtagg

SEQ ID NO: 2829266 - DNA, 16 bp, Homo sapiens
gtccctacacccctcc

SEQ ID NO: 2829267 - DNA, 13 bp, Homo sapiens
gtccctctttgcc

SEQ ID NO: 2829268 - DNA, 20 bp, Homo sapiens
gtccctgactctctgtgacc

SEQ ID NO: 2829269 - DNA, 16 bp, Homo sapiens
gtccctgcacttgcag

SEQ ID NO: 2829270 - DNA, 19 bp, Homo sapiens
gtccctgggggaagccctg

SEQ ID NO: 2829271 - DNA, 15 bp, Homo sapiens
gtccctggtaataag

SEQ ID NO: 2829272 - DNA, 14 bp, Homo sapiens
gtcccttgagacct

SEQ ID NO: 2829273 - DNA, 17 bp, Homo sapiens
gtcccttgtttccagct

SEQ ID NO: 2829274 - DNA, 21 bp, Homo sapiens
gtccgaaagggacttggaagc

SEQ ID NO: 2829275 - DNA, 15 bp, Homo sapiens
gtccgatctttgact

SEQ ID NO: 2829276 - DNA, 15 bp, Homo sapiens
gtccgtccaccacct

SEQ ID NO: 2829277 - DNA, 19 bp, Homo sapiens
gtcctaaggacacactaat

SEQ ID NO: 2829278 - DNA, 20 bp, Homo sapiens
gtcctacagcctcagaggca

SEQ ID NO: 2829279 - DNA, 17 bp, Homo sapiens
gtcctacagtggctgtc

SEQ ID NO: 2829280 - DNA, 20 bp, Homo sapiens
gtcctcagagaatttctacc

SEQ ID NO: 2829281 - DNA, 21 bp, Homo sapiens
gtcctccaacaataaagagct

SEQ ID NO: 2829282 - DNA, 14 bp, Homo sapiens
gtcctccacaataa

SEQ ID NO: 2829283 - DNA, 17 bp, Homo sapiens
gtcctccccctgccagt

SEQ ID NO: 2829284 - DNA, 21 bp, Homo sapiens
gtcctccccctgccagtgcct

SEQ ID NO: 2829285 - DNA, 17 bp, Homo sapiens
gtcctcgtagccatctc

SEQ ID NO: 2829286 - DNA, 18 bp, Homo sapiens
gtcctctggatggcacca

SEQ ID NO: 2829287 - DNA, 21 bp, Homo sapiens
gtcctctggatggcaccagag

SEQ ID NO: 2829288 - DNA, 13 bp, Homo sapiens
gtcctgagcactg

SEQ ID NO: 2829289 - DNA, 21 bp, Homo sapiens
gtcctgagcactgccaggagg

SEQ ID NO: 2829290 - DNA, 18 bp, Homo sapiens
gtcctgcaatctccaggg

SEQ ID NO: 2829291 - DNA, 21 bp, Homo sapiens
gtcctgggagaacctcaggct

SEQ ID NO: 2829292 - DNA, 17 bp, Homo sapiens
gtcctgggagtgagctg

SEQ ID NO: 2829293 - DNA, 19 bp, Homo sapiens
gtcctgggagtgagctggt

SEQ ID NO: 2829294 - DNA, 15 bp, Homo sapiens
gtcctggggctctgt

SEQ ID NO: 2829295 - DNA, 16 bp, Homo sapiens
gtcctggggctctgtg

SEQ ID NO: 2829296 - DNA, 18 bp, Homo sapiens
gtcctggtctgctcagga

SEQ ID NO: 2829297 - DNA, 21 bp, Homo sapiens
gtcctgtagttgcgtggactc

SEQ ID NO: 2829298 - DNA, 22 bp, Homo sapiens
gtccttactcctgtgggagcct

SEQ ID NO: 2829299 - DNA, 16 bp, Homo sapiens
gtccttgcacctgcat

SEQ ID NO: 2829300 - DNA, 17 bp, Homo sapiens
gtccttgcacctgcatc

SEQ ID NO: 2829301 - DNA, 20 bp, Homo sapiens
gtccttggcaggctgatttc

SEQ ID NO: 2829302 - DNA, 18 bp, Homo sapiens
gtcctttgagaaagaaat

SEQ ID NO: 2829303 - DNA, 18 bp, Homo sapiens
gtccttttcactacacca

SEQ ID NO: 2829304 - DNA, 16 bp, Homo sapiens
gtcgagccctgcagcc

SEQ ID NO: 2829305 - DNA, 14 bp, Homo sapiens
gtcgaggacaggga

SEQ ID NO: 2829306 - DNA, 16 bp, Homo sapiens
gtcgaggacagggagg

SEQ ID NO: 2829307 - DNA, 13 bp, Homo sapiens
gtcgattagactg

SEQ ID NO: 2829308 - DNA, 14 bp, Homo sapiens
gtcgattagactgg

SEQ ID NO: 2829309 - DNA, 23 bp, Homo sapiens
gtcgccacacccggctccccctg

SEQ ID NO: 2829310 - DNA, 13 bp, Homo sapiens
gtcgccaggctag

SEQ ID NO: 2829311 - DNA, 12 bp, Homo sapiens
gtcgcctctgca

SEQ ID NO: 2829312 - DNA, 19 bp, Homo sapiens
gtcgctggacaacccagaa

SEQ ID NO: 2829313 - DNA, 15 bp, Homo sapiens
gtcggagtagaaatt

SEQ ID NO: 2829314 - DNA, 18 bp, Homo sapiens
gtcgtggagagctaggag

SEQ ID NO: 2829315 - DNA, 15 bp, Homo sapiens
gtcgtggcagataat

SEQ ID NO: 2829316 - DNA, 21 bp, Homo sapiens
gtctaggagctgggaggaaaa

SEQ ID NO: 2829317 - DNA, 18 bp, Homo sapiens
gtctataatggaaacatt

SEQ ID NO: 2829318 - DNA, 19 bp, Homo sapiens
gtctataatggaaacattt

SEQ ID NO: 2829319 - DNA, 18 bp, Homo sapiens
gtctatagagaaaaactt

SEQ ID NO: 2829320 - DNA, 22 bp, Homo sapiens
gtctatcaaccccagacactgg

SEQ ID NO: 2829321 - DNA, 23 bp, Homo sapiens
gtctatcaaccccagacactggt

SEQ ID NO: 2829322 - DNA, 15 bp, Homo sapiens
gtctatgggactcaa

SEQ ID NO: 2829323 - DNA, 23 bp, Homo sapiens
gtctcaaaaaaagggcaataaat

SEQ ID NO: 2829324 - DNA, 20 bp, Homo sapiens
gtctcactatgttgcccagg

SEQ ID NO: 2829325 - DNA, 23 bp, Homo sapiens
gtctcactatgttgcccaggcag

SEQ ID NO: 2829326 - DNA, 15 bp, Homo sapiens
gtctcactctgtcgc

SEQ ID NO: 2829327 - DNA, 16 bp, Homo sapiens
gtctcactctgtcgcc

SEQ ID NO: 2829328 - DNA, 18 bp, Homo sapiens
gtctcactctgtcgccca

SEQ ID NO: 2829329 - DNA, 21 bp, Homo sapiens
gtctcactgttgcccaggctg

SEQ ID NO: 2829330 - DNA, 22 bp, Homo sapiens
gtctcactgttgcccaggctgg

SEQ ID NO: 2829331 - DNA, 20 bp, Homo sapiens
gtctcagcttcatttccgtg

SEQ ID NO: 2829332 - DNA, 23 bp, Homo sapiens
gtctcagcttcatttccgtgaag

SEQ ID NO: 2829333 - DNA, 18 bp, Homo sapiens
gtctccagtggttgctgt

SEQ ID NO: 2829334 - DNA, 19 bp, Homo sapiens
gttacagcgagaggcagag

SEQ ID NO: 2829335 - DNA, 16 bp, Homo sapiens
gttacaggtgtactat

SEQ ID NO: 2829336 - DNA, 17 bp, Homo sapiens
gttacatcacagtgttt

SEQ ID NO: 2829337 - DNA, 23 bp, Homo sapiens
gttaccattttggggtacccact

SEQ ID NO: 2829338 - DNA, 13 bp, Homo sapiens
gttacccagagaa

SEQ ID NO: 2829339 - DNA, 15 bp, Homo sapiens
gttacctcctataaa

SEQ ID NO: 2829340 - DNA, 23 bp, Homo sapiens
gttactaattggcctctttaaga

SEQ ID NO: 2829341 - DNA, 14 bp, Homo sapiens
gttactcagccctg

SEQ ID NO: 2829342 - DNA, 16 bp, Homo sapiens
gttactcagccctggg

SEQ ID NO: 2829343 - DNA, 18 bp, Homo sapiens
gttactcagccctgggcc

SEQ ID NO: 2829344 - DNA, 17 bp, Homo sapiens
gttactctccaacctgg

SEQ ID NO: 2829345 - DNA, 13 bp, Homo sapiens
gttactggtttca

SEQ ID NO: 2829346 - DNA, 23 bp, Homo sapiens
gttacttcactttaattctcatg

SEQ ID NO: 2829347 - DNA, 16 bp, Homo sapiens
gttacttgaaatacca

SEQ ID NO: 2829348 - DNA, 14 bp, Homo sapiens
gttagcaggaaata

SEQ ID NO: 2829349 - DNA, 16 bp, Homo sapiens
gttaggaaataaaacc

SEQ ID NO: 2829350 - DNA, 19 bp, Homo sapiens
gttaggaaataaaaccttt

SEQ ID NO: 2829351 - DNA, 23 bp, Homo sapiens
gttaggaaataaaacctttcaaa

SEQ ID NO: 2829352 - DNA, 16 bp, Homo sapiens
gttagtatctaacatg

SEQ ID NO: 2829353 - DNA, 22 bp, Homo sapiens
gttagtgacaaaattggccaga

SEQ ID NO: 2829354 - DNA, 23 bp, Homo sapiens
gttagttattttaggagacagtc

SEQ ID NO: 2829355 - DNA, 16 bp, Homo sapiens
gttagtttctttggga

SEQ ID NO: 2829356 - DNA, 14 bp, Homo sapiens
gttataaaaataca

SEQ ID NO: 2829357 - DNA, 21 bp, Homo sapiens
gttatagcaatgtaacattaa

SEQ ID NO: 2829358 - DNA, 16 bp, Homo sapiens
gttatagtatatctgg

SEQ ID NO: 2829359 - DNA, 20 bp, Homo sapiens
gttatattttactactgtgg

SEQ ID NO: 2829360 - DNA, 21 bp, Homo sapiens
gttattgggcaagtgattgaa

SEQ ID NO: 2829361 - DNA, 14 bp, Homo sapiens
gttcaaaaagtcta

SEQ ID NO: 2829362 - DNA, 16 bp, Homo sapiens
gttcaagaaataagtt

SEQ ID NO: 2829363 - DNA, 23 bp, Homo sapiens
gttcaattctcatttgtcacaca

SEQ ID NO: 2829364 - DNA, 16 bp, Homo sapiens
gttcacccacagggct

SEQ ID NO: 2829365 - DNA, 18 bp, Homo sapiens
gttcaccttatgtattat

SEQ ID NO: 2829366 - DNA, 19 bp, Homo sapiens
gttcactgcaacctccgcc

SEQ ID NO: 2829367 - DNA, 16 bp, Homo sapiens
gttcagagactcaggg

SEQ ID NO: 2829368 - DNA, 19 bp, Homo sapiens
gttcagcccctcctctgcc

SEQ ID NO: 2829369 - DNA, 21 bp, Homo sapiens
gttcagcccctcctctgccac

SEQ ID NO: 2829370 - DNA, 23 bp, Homo sapiens
gttcagcccctcctctgccacct

SEQ ID NO: 2829371 - DNA, 18 bp, Homo sapiens
gttcagctccagctcacc

SEQ ID NO: 2829372 - DNA, 18 bp, Homo sapiens
gttcaggagtcccaagga

SEQ ID NO: 2829373 - DNA, 19 bp, Homo sapiens
gttcagggttggcccctgc

SEQ ID NO: 2829374 - DNA, 22 bp, Homo sapiens
gttcagggttggcccctgcccg

SEQ ID NO: 2829375 - DNA, 18 bp, Homo sapiens
gttcaggtaacaggcaga

SEQ ID NO: 2829376 - DNA, 17 bp, Homo sapiens
gttcatagggtctcttc

SEQ ID NO: 2829377 - DNA, 18 bp, Homo sapiens
gttcatagggtctcttca

SEQ ID NO: 2829378 - DNA, 19 bp, Homo sapiens
gttcatgagaatctatatt

SEQ ID NO: 2829379 - DNA, 16 bp, Homo sapiens
gttcattaaagcatga

SEQ ID NO: 2829380 - DNA, 19 bp, Homo sapiens
gttccaaatgaatgttgtc

SEQ ID NO: 2829381 - DNA, 21 bp, Homo sapiens
gttccacgtccccctggggct

SEQ ID NO: 2829382 - DNA, 14 bp, Homo sapiens
gttccacttctcta

SEQ ID NO: 2829383 - DNA, 15 bp, Homo sapiens
gttccacttctctag

SEQ ID NO: 2829384 - DNA, 16 bp, Homo sapiens
gttcccaataaaagtg

SEQ ID NO: 2829385 - DNA, 21 bp, Homo sapiens
gttcccccgctggcagccacc

SEQ ID NO: 2829386 - DNA, 12 bp, Homo sapiens
gttccctctgag

SEQ ID NO: 2829387 - DNA, 14 bp, Homo sapiens
gttccctctgagaa

SEQ ID NO: 2829388 - DNA, 17 bp, Homo sapiens
gttccctgaaaacccag

SEQ ID NO: 2829389 - DNA, 18 bp, Homo sapiens
gttccctgaaaacccaga

SEQ ID NO: 2829390 - DNA, 19 bp, Homo sapiens
gttccctgaaaacccagag

SEQ ID NO: 2829391 - DNA, 21 bp, Homo sapiens
gttccctgaacatctgtgtgt

SEQ ID NO: 2829392 - DNA, 14 bp, Homo sapiens
gttccttactgcag

SEQ ID NO: 2829393 - DNA, 15 bp, Homo sapiens
gttccttactgcaga

SEQ ID NO: 2829394 - DNA, 23 bp, Homo sapiens
gttccttgatctgtatatacaat

SEQ ID NO: 2829395 - DNA, 16 bp, Homo sapiens
gttcgagaccagcctg

SEQ ID NO: 2829396 - DNA, 20 bp, Homo sapiens
gttcgcagccaccctgagga

SEQ ID NO: 2829397 - DNA, 19 bp, Homo sapiens
gttctaaaaattgtgatca

SEQ ID NO: 2829398 - DNA, 21 bp, Homo sapiens
gttctagtctcctttgcactg

SEQ ID NO: 2829399 - DNA, 12 bp, Homo sapiens
gttctctgagga

SEQ ID NO: 2829400 - DNA, 14 bp, Homo sapiens
gttctctgaggaca

SEQ ID NO: 2829401 - DNA, 15 bp, Homo sapiens
gttctgaaaactgtt

SEQ ID NO: 2829402 - DNA, 18 bp, Homo sapiens
gttctgaataatttctta

SEQ ID NO: 2829403 - DNA, 14 bp, Homo sapiens
gttctgagtgtttt

SEQ ID NO: 2829404 - DNA, 14 bp, Homo sapiens
gttctgctcctctc

SEQ ID NO: 2829405 - DNA, 17 bp, Homo sapiens
gttctgctcctctccag

SEQ ID NO: 2829406 - DNA, 22 bp, Homo sapiens
gttctgctcctctccaggcacc

SEQ ID NO: 2829407 - DNA, 20 bp, Homo sapiens
gttctgctgcccctgcagtt

SEQ ID NO: 2829408 - DNA, 14 bp, Homo sapiens
gttctgctggcctg

SEQ ID NO: 2829409 - DNA, 19 bp, Homo sapiens
gttctgctggcctggatct

SEQ ID NO: 2829410 - DNA, 16 bp, Homo sapiens
gttctggagctgctgt

SEQ ID NO: 2829411 - DNA, 16 bp, Homo sapiens
gttctggcctcagacc

SEQ ID NO: 2829412 - DNA, 17 bp, Homo sapiens
gttctggcctcagacca

SEQ ID NO: 2829413 - DNA, 21 bp, Homo sapiens
gttctggctttacattttatt

SEQ ID NO: 2829414 - DNA, 23 bp, Homo sapiens
gttctgggacacagttcaattct

SEQ ID NO: 2829415 - DNA, 22 bp, Homo sapiens
gttcttagctgaacaatgaatg

SEQ ID NO: 2829416 - DNA, 17 bp, Homo sapiens
gttctttaggtgcctcc

SEQ ID NO: 2829417 - DNA, 15 bp, Homo sapiens
gttctttcttcctct

SEQ ID NO: 2829418 - DNA, 13 bp, Homo sapiens
gttcttttactgt

SEQ ID NO: 2829419 - DNA, 16 bp, Homo sapiens
gttgaaatatgatgtt

SEQ ID NO: 2829420 - DNA, 12 bp, Homo sapiens
gttgaagaagag

SEQ ID NO: 2829421 - DNA, 22 bp, Homo sapiens
gttgaagctaagatttagagat

SEQ ID NO: 2829422 - DNA, 19 bp, Homo sapiens
gttgacaaaatatataatg

SEQ ID NO: 2829423 - DNA, 21 bp, Homo sapiens
gttgactcaagtttttacaaa

SEQ ID NO: 2829424 - DNA, 16 bp, Homo sapiens
tatcggagacagtgat

SEQ ID NO: 2829425 - DNA, 14 bp, Homo sapiens
tatcgggaacagtg

SEQ ID NO: 2829426 - DNA, 15 bp, Homo sapiens
tatcgggagcagtgt

SEQ ID NO: 2829427 - DNA, 20 bp, Homo sapiens
tatctaagttaatttaaagt

SEQ ID NO: 2829428 - DNA, 22 bp, Homo sapiens
tatctaagttaatttaaagttg

SEQ ID NO: 2829429 - DNA, 23 bp, Homo sapiens
tatctaagttaatttaaagttgt

SEQ ID NO: 2829430 - DNA, 20 bp, Homo sapiens
tatctactgataaagaaaga

SEQ ID NO: 2829431 - DNA, 11 bp, Homo sapiens
tatctagctct

SEQ ID NO: 2829432 - DNA, 15 bp, Homo sapiens
tatctatatctctaa

SEQ ID NO: 2829433 - DNA, 17 bp, Homo sapiens
tatctatctatttgagg

SEQ ID NO: 2829434 - DNA, 23 bp, Homo sapiens
tatctccaggattgaagagcatt

SEQ ID NO: 2829435 - DNA, 16 bp, Homo sapiens
tatctctaaactgctg

SEQ ID NO: 2829436 - DNA, 22 bp, Homo sapiens
tatctctaggctgttttctcca

SEQ ID NO: 2829437 - DNA, 23 bp, Homo sapiens
tatctctgtgtgcacaaatattt

SEQ ID NO: 2829438 - DNA, 22 bp, Homo sapiens
tatctcttttgaatccatgctt

SEQ ID NO: 2829439 - DNA, 13 bp, Homo sapiens
tatctgaacacat

SEQ ID NO: 2829440 - DNA, 19 bp, Homo sapiens
tatctgaatttttaaacaa

SEQ ID NO: 2829441 - DNA, 23 bp, Homo sapiens
tatctgcatttataaatgtgtgg

SEQ ID NO: 2829442 - DNA, 12 bp, Homo sapiens
tatctggaattt

SEQ ID NO: 2829443 - DNA, 18 bp, Homo sapiens
tatctggacaagccaact

SEQ ID NO: 2829444 - DNA, 16 bp, Homo sapiens
tatctgtattttcatt

SEQ ID NO: 2829445 - DNA, 22 bp, Homo sapiens
tatctgtattttcatttaacta

SEQ ID NO: 2829446 - DNA, 22 bp, Homo sapiens
tatcttatttaatttttgcaat

SEQ ID NO: 2829447 - DNA, 12 bp, Homo sapiens
tatcttatttat

SEQ ID NO: 2829448 - DNA, 13 bp, Homo sapiens
tatcttgaagaat

SEQ ID NO: 2829449 - DNA, 18 bp, Homo sapiens
tatcttgaagaatattgt

SEQ ID NO: 2829450 - DNA, 18 bp, Homo sapiens
tatgaaaaacaaaaataa

SEQ ID NO: 2829451 - DNA, 14 bp, Homo sapiens
tatgaaaaagaaga

SEQ ID NO: 2829452 - DNA, 15 bp, Homo sapiens
tatgaaaagaataaa

SEQ ID NO: 2829453 - DNA, 19 bp, Homo sapiens
tatgaaaagctagaattga

SEQ ID NO: 2829454 - DNA, 12 bp, Homo sapiens
tatgaaatgata

SEQ ID NO: 2829455 - DNA, 20 bp, Homo sapiens
tatgaaatgataaagatgtc

SEQ ID NO: 2829456 - DNA, 22 bp, Homo sapiens
tatgaaatttaatatagctatt

SEQ ID NO: 2829457 - DNA, 21 bp, Homo sapiens
tatgaacaaagaaaaaaatat

SEQ ID NO: 2829458 - DNA, 21 bp, Homo sapiens
tatgaacatggagaggacttt

SEQ ID NO: 2829459 - DNA, 20 bp, Homo sapiens
tatgaacttgaggacacatg

SEQ ID NO: 2829460 - DNA, 21 bp, Homo sapiens
tatgaacttgaggacacatgt

SEQ ID NO: 2829461 - DNA, 15 bp, Homo sapiens
tatgaagaaaaaata

SEQ ID NO: 2829462 - DNA, 20 bp, Homo sapiens
tatgaagaaaaaatacattt

SEQ ID NO: 2829463 - DNA, 13 bp, Homo sapiens
tatgaagtaagtt

SEQ ID NO: 2829464 - DNA, 22 bp, Homo sapiens
tatgaatgatgttttagaatga

SEQ ID NO: 2829465 - DNA, 16 bp, Homo sapiens
tatgacagctgtccct

SEQ ID NO: 2829466 - DNA, 14 bp, Homo sapiens
tatgactgtaaaca

SEQ ID NO: 2829467 - DNA, 23 bp, Homo sapiens
tatgacttgggcacccccagcct

SEQ ID NO: 2829468 - DNA, 14 bp, Homo sapiens
tatgagctcttcat

SEQ ID NO: 2829469 - DNA, 13 bp, Homo sapiens
tatgagctgaggg

SEQ ID NO: 2829470 - DNA, 16 bp, Homo sapiens
tatgagctgagggggg

SEQ ID NO: 2829471 - DNA, 23 bp, Homo sapiens
tatgaggacttgtgtctctgtgc

SEQ ID NO: 2829472 - DNA, 15 bp, Homo sapiens
tatgagggaaaatga

SEQ ID NO: 2829473 - DNA, 22 bp, Homo sapiens
tatgagtttttgatagctttat

SEQ ID NO: 2829474 - DNA, 13 bp, Homo sapiens
tatgatccaagta

SEQ ID NO: 2829475 - DNA, 15 bp, Homo sapiens
tatgatcgcgccact

SEQ ID NO: 2829476 - DNA, 18 bp, Homo sapiens
tatgatgtgggtcaagga

SEQ ID NO: 2829477 - DNA, 13 bp, Homo sapiens
tatgatttaaaaa

SEQ ID NO: 2829478 - DNA, 16 bp, Homo sapiens
tatgatttaaaaaata

SEQ ID NO: 2829479 - DNA, 22 bp, Homo sapiens
tatgatttaaaaaataaatata

SEQ ID NO: 2829480 - DNA, 17 bp, Homo sapiens
tatgcaagaagaatata

SEQ ID NO: 2829481 - DNA, 17 bp, Homo sapiens
tatgcaaggaaggaaag

SEQ ID NO: 2829482 - DNA, 19 bp, Homo sapiens
tatgcaatttttaaactag

SEQ ID NO: 2829483 - DNA, 14 bp, Homo sapiens
tatgcaccttgtgt

SEQ ID NO: 2829484 - DNA, 14 bp, Homo sapiens
tatgccagctcagt

SEQ ID NO: 2829485 - DNA, 20 bp, Homo sapiens
tatgcctacttgtaatttct

SEQ ID NO: 2829486 - DNA, 18 bp, Homo sapiens
tatgcctgctatttgaag

SEQ ID NO: 2829487 - DNA, 17 bp, Homo sapiens
tatgccttcctgtttaa

SEQ ID NO: 2829488 - DNA, 16 bp, Homo sapiens
tatgctactacaaaaa

SEQ ID NO: 2829489 - DNA, 17 bp, Homo sapiens
tatggaactctctccac

SEQ ID NO: 2829490 - DNA, 20 bp, Homo sapiens
tatggaatttttcattgata

SEQ ID NO: 2829491 - DNA, 16 bp, Homo sapiens
tatggactctgcacat

SEQ ID NO: 2829492 - DNA, 14 bp, Homo sapiens
tatggagagccctg

SEQ ID NO: 2829493 - DNA, 13 bp, Homo sapiens
tatggattctaaa

SEQ ID NO: 2829494 - DNA, 14 bp, Homo sapiens
tatggattctaaaa

SEQ ID NO: 2829495 - DNA, 15 bp, Homo sapiens
tatggattctaaaat

SEQ ID NO: 2829496 - DNA, 22 bp, Homo sapiens
tatggcagtccagccagctcct

SEQ ID NO: 2829497 - DNA, 16 bp, Homo sapiens
tatggcagtgtctttc

SEQ ID NO: 2829498 - DNA, 12 bp, Homo sapiens
tatggcattttt

SEQ ID NO: 2829499 - DNA, 11 bp, Homo sapiens
tatggccaggg

SEQ ID NO: 2829500 - DNA, 23 bp, Homo sapiens
tatgggactcaatgcactgacat

SEQ ID NO: 2829501 - DNA, 15 bp, Homo sapiens
tatgggtcctgcaat

SEQ ID NO: 2829502 - DNA, 13 bp, Homo sapiens
tatggtattttcg

SEQ ID NO: 2829503 - DNA, 20 bp, Homo sapiens
tatggtattttcgtgcattt

SEQ ID NO: 2829504 - DNA, 13 bp, Homo sapiens
tatggtgtaatgc

SEQ ID NO: 2829505 - DNA, 17 bp, Homo sapiens
tatggttcccaataaaa

SEQ ID NO: 2829506 - DNA, 19 bp, Homo sapiens
tatggttcccaataaaagt

SEQ ID NO: 2829507 - DNA, 15 bp, Homo sapiens
tatgtaaaacattta

SEQ ID NO: 2829508 - DNA, 18 bp, Homo sapiens
tatgtacagttatacata

SEQ ID NO: 2829509 - DNA, 16 bp, Homo sapiens
tatgtaccatgtacat

SEQ ID NO: 2829510 - DNA, 17 bp, Homo sapiens
tatgtatatgtatatct

SEQ ID NO: 2829511 - DNA, 14 bp, Homo sapiens
tatgtatgtgtgta

SEQ ID NO: 2829512 - DNA, 17 bp, Homo sapiens
tatgtatgtgtgtatgg

SEQ ID NO: 2829513 - DNA, 19 bp, Homo sapiens
tatgtattaatattcattg

SEQ ID NO: 2829514 - DNA, 14 bp, Homo sapiens
tatgtcttggacac

SEQ ID NO: 2829515 - DNA, 15 bp, Homo sapiens
tcaagaaaactggaa

SEQ ID NO: 2829516 - DNA, 12 bp, Homo sapiens
tcaagaaactga

SEQ ID NO: 2829517 - DNA, 13 bp, Homo sapiens
tcaagaaactgag

SEQ ID NO: 2829518 - DNA, 14 bp, Homo sapiens
tcaagaaataagtt

SEQ ID NO: 2829519 - DNA, 19 bp, Homo sapiens
tcaagaagacatggagact

SEQ ID NO: 2829520 - DNA, 15 bp, Homo sapiens
tcaagagactgagtc

SEQ ID NO: 2829521 - DNA, 20 bp, Homo sapiens
tcaagattatattataataa

SEQ ID NO: 2829522 - DNA, 16 bp, Homo sapiens
tcaagcaccctgttcc

SEQ ID NO: 2829523 - DNA, 19 bp, Homo sapiens
tcaagctagaaggccacat

SEQ ID NO: 2829524 - DNA, 17 bp, Homo sapiens
tcaaggagatataaaat

SEQ ID NO: 2829525 - DNA, 15 bp, Homo sapiens
tcaaggagcccagaa

SEQ ID NO: 2829526 - DNA, 13 bp, Homo sapiens
tcaagtataaagt

SEQ ID NO: 2829527 - DNA, 15 bp, Homo sapiens
tcaagtataaagtca

SEQ ID NO: 2829528 - DNA, 22 bp, Homo sapiens
tcaagtcctcttttctgagagg

SEQ ID NO: 2829529 - DNA, 13 bp, Homo sapiens
tcaagtgatatat

SEQ ID NO: 2829530 - DNA, 16 bp, Homo sapiens
tcaagtgattctcctg

SEQ ID NO: 2829531 - DNA, 20 bp, Homo sapiens
tcaagtgcatgctctctgca

SEQ ID NO: 2829532 - DNA, 15 bp, Homo sapiens
tcaagttagctcagg

SEQ ID NO: 2829533 - DNA, 23 bp, Homo sapiens
tcaagttgttccttaagtcagaa

SEQ ID NO: 2829534 - DNA, 16 bp, Homo sapiens
tcaagtttttcagaaa

SEQ ID NO: 2829535 - DNA, 13 bp, Homo sapiens
tcaataaaatcat

SEQ ID NO: 2829536 - DNA, 17 bp, Homo sapiens
tcaataaagtatctaca

SEQ ID NO: 2829537 - DNA, 22 bp, Homo sapiens
tcaataccccaagtccacctgc

SEQ ID NO: 2829538 - DNA, 14 bp, Homo sapiens
tcaatagtcaagaa

SEQ ID NO: 2829539 - DNA, 17 bp, Homo sapiens
tcaatattaaatacaga

SEQ ID NO: 2829540 - DNA, 19 bp, Homo sapiens
tcaatattaaatacagaca

SEQ ID NO: 2829541 - DNA, 14 bp, Homo sapiens
tcaatattcctgaa

SEQ ID NO: 2829542 - DNA, 22 bp, Homo sapiens
tcaatattcctgaatgaaatat

SEQ ID NO: 2829543 - DNA, 15 bp, Homo sapiens
tcaatattttccatg

SEQ ID NO: 2829544 - DNA, 15 bp, Homo sapiens
tcaatcccctcattc

SEQ ID NO: 2829545 - DNA, 12 bp, Homo sapiens
tcaatgaaatat

SEQ ID NO: 2829546 - DNA, 14 bp, Homo sapiens
tcaatgcactgaca

SEQ ID NO: 2829547 - DNA, 18 bp, Homo sapiens
tcaatgcactgacattgt

SEQ ID NO: 2829548 - DNA, 19 bp, Homo sapiens
tcaatggtttgcaaggaag

SEQ ID NO: 2829549 - DNA, 11 bp, Homo sapiens
tcaatgtcact

SEQ ID NO: 2829550 - DNA, 21 bp, Homo sapiens
tcaatgtttatgcaaggaagg

SEQ ID NO: 2829551 - DNA, 23 bp, Homo sapiens
tcaatgtttatgcaaggaaggaa

SEQ ID NO: 2829552 - DNA, 18 bp, Homo sapiens
tcaatgtttcttctaggt

SEQ ID NO: 2829553 - DNA, 16 bp, Homo sapiens
tcaattaaatgtaggt

SEQ ID NO: 2829554 - DNA, 13 bp, Homo sapiens
tcaattagtacag

SEQ ID NO: 2829555 - DNA, 16 bp, Homo sapiens
tcaattagtacagtag

SEQ ID NO: 2829556 - DNA, 17 bp, Homo sapiens
tcaattagtacagtagc

SEQ ID NO: 2829557 - DNA, 20 bp, Homo sapiens
tcaatttccaagagctgagg

SEQ ID NO: 2829558 - DNA, 17 bp, Homo sapiens
tcaatttttatacatat

SEQ ID NO: 2829559 - DNA, 19 bp, Homo sapiens
tcaatttttatacatatca

SEQ ID NO: 2829560 - DNA, 13 bp, Homo sapiens
tcacaaaatgcaa

SEQ ID NO: 2829561 - DNA, 22 bp, Homo sapiens
tcacaaaattttattcctatat

SEQ ID NO: 2829562 - DNA, 22 bp, Homo sapiens
tcacaacagcctgacaacattt

SEQ ID NO: 2829563 - DNA, 23 bp, Homo sapiens
tcacaaccagccacacagagcct

SEQ ID NO: 2829564 - DNA, 20 bp, Homo sapiens
tcacaactgtttttgaagaa

SEQ ID NO: 2829565 - DNA, 14 bp, Homo sapiens
tcacaagaagacca

SEQ ID NO: 2829566 - DNA, 15 bp, Homo sapiens
tcacaagaagaccag

SEQ ID NO: 2829567 - DNA, 22 bp, Homo sapiens
tcacaaggcagcaaggcccgag

SEQ ID NO: 2829568 - DNA, 15 bp, Homo sapiens
tcacaataattttct

SEQ ID NO: 2829569 - DNA, 14 bp, Homo sapiens
tcacaatagaaact

SEQ ID NO: 2829570 - DNA, 16 bp, Homo sapiens
tcacaatagaaactca

SEQ ID NO: 2829571 - DNA, 17 bp, Homo sapiens
tcacaattccatttcca

SEQ ID NO: 2829572 - DNA, 22 bp, Homo sapiens
tcacaattccatttccagttca

SEQ ID NO: 2829573 - DNA, 15 bp, Homo sapiens
tcacacagacacaca

SEQ ID NO: 2829574 - DNA, 19 bp, Homo sapiens
tcacacaggcatttcctgg

SEQ ID NO: 2829575 - DNA, 13 bp, Homo sapiens
tcacacagtgagt

SEQ ID NO: 2829576 - DNA, 22 bp, Homo sapiens
tcacacagtgagtcgaggacag

SEQ ID NO: 2829577 - DNA, 18 bp, Homo sapiens
tcacactgcaagagcctt

SEQ ID NO: 2829578 - DNA, 18 bp, Homo sapiens
tcacactgttactccaca

SEQ ID NO: 2829579 - DNA, 12 bp, Homo sapiens
tcacagaggctt

SEQ ID NO: 2829580 - DNA, 17 bp, Homo sapiens
tcacagaggcttcttca

SEQ ID NO: 2829581 - DNA, 18 bp, Homo sapiens
tcacaggactctgcctcc

SEQ ID NO: 2829582 - DNA, 19 bp, Homo sapiens
tcacaggactctgcctcct

SEQ ID NO: 2829583 - DNA, 16 bp, Homo sapiens
tcacaggcaggtccag

SEQ ID NO: 2829584 - DNA, 18 bp, Homo sapiens
tcacaggcaggtccaggg

SEQ ID NO: 2829585 - DNA, 19 bp, Homo sapiens
tcacagggcagagccggga

SEQ ID NO: 2829586 - DNA, 16 bp, Homo sapiens
tcacagggccccagaa

SEQ ID NO: 2829587 - DNA, 17 bp, Homo sapiens
tcacagggccccagaag

SEQ ID NO: 2829588 - DNA, 21 bp, Homo sapiens
tcacagtctctttaatcttca

SEQ ID NO: 2829589 - DNA, 23 bp, Homo sapiens
tcacagtgtttgcaatggtgttg

SEQ ID NO: 2829590 - DNA, 14 bp, Homo sapiens
tcacagttcctcgc

SEQ ID NO: 2829591 - DNA, 16 bp, Homo sapiens
tcacagttcctcgccc

SEQ ID NO: 2829592 - DNA, 22 bp, Homo sapiens
tcacagttcctcgccctgggtc

SEQ ID NO: 2829593 - DNA, 13 bp, Homo sapiens
tcacatacaattt

SEQ ID NO: 2829594 - DNA, 13 bp, Homo sapiens
tcacatcacagga

SEQ ID NO: 2829595 - DNA, 16 bp, Homo sapiens
tcacatggcctatgca

SEQ ID NO: 2829596 - DNA, 13 bp, Homo sapiens
tcacattcaggaa

SEQ ID NO: 2829597 - DNA, 14 bp, Homo sapiens
tcacatttattctg

SEQ ID NO: 2829598 - DNA, 17 bp, Homo sapiens
tcacatttattctgctc

SEQ ID NO: 2829599 - DNA, 19 bp, Homo sapiens
tcacatttattctgctcac

SEQ ID NO: 2829600 - DNA, 22 bp, Homo sapiens
tcacatttgatgtacatgtgta

SEQ ID NO: 2829601 - DNA, 20 bp, Homo sapiens
tcacatttttacttggtgta

SEQ ID NO: 2829602 - DNA, 16 bp, Homo sapiens
tcaccaagctcacagt

SEQ ID NO: 2829603 - DNA, 21 bp, Homo sapiens
tcaccaagctcacagttcctc

SEQ ID NO: 2829604 - DNA, 12 bp, Homo sapiens
tcaccaataact

SEQ ID NO: 2829605 - DNA, 15 bp, Homo sapiens
tcaccaataacttca

SEQ ID NO: 2829606 - DNA, 17 bp, Homo sapiens
tcaggcccactgcagag

SEQ ID NO: 2829607 - DNA, 19 bp, Homo sapiens
tcaggcccttattttcaag

SEQ ID NO: 2829608 - DNA, 20 bp, Homo sapiens
tcaggcggggtgctgtggtg

SEQ ID NO: 2829609 - DNA, 18 bp, Homo sapiens
tcaggcttggaatgaatt

SEQ ID NO: 2829610 - DNA, 22 bp, Homo sapiens
tcagggaatttcaggaactaga

SEQ ID NO: 2829611 - DNA, 21 bp, Homo sapiens
tcagggacagagacacctgca

SEQ ID NO: 2829612 - DNA, 15 bp, Homo sapiens
tcagggaggtcattt

SEQ ID NO: 2829613 - DNA, 14 bp, Homo sapiens
tcagggccccagca

SEQ ID NO: 2829614 - DNA, 21 bp, Homo sapiens
tcagggctggaaaagtcacac

SEQ ID NO: 2829615 - DNA, 18 bp, Homo sapiens
tcagggtgggccactctc

SEQ ID NO: 2829616 - DNA, 20 bp, Homo sapiens
tcagggtgggccactctccc

SEQ ID NO: 2829617 - DNA, 16 bp, Homo sapiens
tcagggttggcccctg

SEQ ID NO: 2829618 - DNA, 18 bp, Homo sapiens
tcagggttggcccctgcc

SEQ ID NO: 2829619 - DNA, 16 bp, Homo sapiens
tcaggtcctcagagaa

SEQ ID NO: 2829620 - DNA, 16 bp, Homo sapiens
tcaggtgatccaccca

SEQ ID NO: 2829621 - DNA, 20 bp, Homo sapiens
tcaggtggggcagcttgagg

SEQ ID NO: 2829622 - DNA, 17 bp, Homo sapiens
tcaggtgtccctgcact

SEQ ID NO: 2829623 - DNA, 16 bp, Homo sapiens
tcaggttgttaatgtt

SEQ ID NO: 2829624 - DNA, 14 bp, Homo sapiens
tcaggttttgtaaa

SEQ ID NO: 2829625 - DNA, 17 bp, Homo sapiens
tcagtaatttgaggaca

SEQ ID NO: 2829626 - DNA, 18 bp, Homo sapiens
tcagtaatttgaggacaa

SEQ ID NO: 2829627 - DNA, 18 bp, Homo sapiens
tcagtccccacagataac

SEQ ID NO: 2829628 - DNA, 16 bp, Homo sapiens
tcagtccgcctggccg

SEQ ID NO: 2829629 - DNA, 12 bp, Homo sapiens
tcagtcctggaa

SEQ ID NO: 2829630 - DNA, 14 bp, Homo sapiens
tcagtctcaggagc

SEQ ID NO: 2829631 - DNA, 17 bp, Homo sapiens
tcagtctgattcccaag

SEQ ID NO: 2829632 - DNA, 11 bp, Homo sapiens
tcagtgacaga

SEQ ID NO: 2829633 - DNA, 19 bp, Homo sapiens
tcagtgacagagttcacta

SEQ ID NO: 2829634 - DNA, 9 bp, Homo sapiens
tcagtgccc

SEQ ID NO: 2829635 - DNA, 17 bp, Homo sapiens
tcagtgccttggagcag

SEQ ID NO: 2829636 - DNA, 14 bp, Homo sapiens
tcagtgctgtggcc

SEQ ID NO: 2829637 - DNA, 22 bp, Homo sapiens
tcagtgctgtggcctgggcaag

SEQ ID NO: 2829638 - DNA, 19 bp, Homo sapiens
tcagtgggaacgtgactgc

SEQ ID NO: 2829639 - DNA, 23 bp, Homo sapiens
tcagtgggaacgtgactgcccca

SEQ ID NO: 2829640 - DNA, 12 bp, Homo sapiens
tcagtgggagaa

SEQ ID NO: 2829641 - DNA, 16 bp, Homo sapiens
tcagtgggagaaaaca

SEQ ID NO: 2829642 - DNA, 22 bp, Homo sapiens
tcagtgtatggaaataaatgta

SEQ ID NO: 2829643 - DNA, 19 bp, Homo sapiens
tcagtgtcctcttgctcaa

SEQ ID NO: 2829644 - DNA, 23 bp, Homo sapiens
tcagtttatccaaggtgtaactc

SEQ ID NO: 2829645 - DNA, 13 bp, Homo sapiens
tcagttttaacta

SEQ ID NO: 2829646 - DNA, 14 bp, Homo sapiens
tcagttttatcttt

SEQ ID NO: 2829647 - DNA, 12 bp, Homo sapiens
tcataaaataaa

SEQ ID NO: 2829648 - DNA, 13 bp, Homo sapiens
tcataaactgtgt

SEQ ID NO: 2829649 - DNA, 14 bp, Homo sapiens
tcataaactgtgtg

SEQ ID NO: 2829650 - DNA, 15 bp, Homo sapiens
tcataaactgtgtgc

SEQ ID NO: 2829651 - DNA, 16 bp, Homo sapiens
tcataaactgtgtgca

SEQ ID NO: 2829652 - DNA, 13 bp, Homo sapiens
tcataacaatgta

SEQ ID NO: 2829653 - DNA, 14 bp, Homo sapiens
tcataacctagcct

SEQ ID NO: 2829654 - DNA, 23 bp, Homo sapiens
tcataagttggaccagaggaagc

SEQ ID NO: 2829655 - DNA, 12 bp, Homo sapiens
tcataattagaa

SEQ ID NO: 2829656 - DNA, 18 bp, Homo sapiens
tcataattagaacaatag

SEQ ID NO: 2829657 - DNA, 13 bp, Homo sapiens
tcataattttcaa

SEQ ID NO: 2829658 - DNA, 15 bp, Homo sapiens
tcataattttcaaga

SEQ ID NO: 2829659 - DNA, 14 bp, Homo sapiens
tcataccatctgct

SEQ ID NO: 2829660 - DNA, 22 bp, Homo sapiens
tcatactaccggctacatcaaa

SEQ ID NO: 2829661 - DNA, 22 bp, Homo sapiens
tcatagaaatgtaacttttgta

SEQ ID NO: 2829662 - DNA, 18 bp, Homo sapiens
tcatagcagattttaatt

SEQ ID NO: 2829663 - DNA, 17 bp, Homo sapiens
tcatagctgagattcct

SEQ ID NO: 2829664 - DNA, 18 bp, Homo sapiens
tcatagtatggtggctgg

SEQ ID NO: 2829665 - DNA, 19 bp, Homo sapiens
tcatagtatggtggctggg

SEQ ID NO: 2829666 - DNA, 21 bp, Homo sapiens
tcatagtatggtggctgggtt

SEQ ID NO: 2829667 - DNA, 16 bp, Homo sapiens
tcatataaagtatcat

SEQ ID NO: 2829668 - DNA, 15 bp, Homo sapiens
tcatataataaatgt

SEQ ID NO: 2829669 - DNA, 14 bp, Homo sapiens
tcatatattcatgt

SEQ ID NO: 2829670 - DNA, 17 bp, Homo sapiens
tcatatcctttgcccca

SEQ ID NO: 2829671 - DNA, 22 bp, Homo sapiens
tcatatgtaccatgtacatgaa

SEQ ID NO: 2829672 - DNA, 13 bp, Homo sapiens
tcatattgtatgt

SEQ ID NO: 2829673 - DNA, 18 bp, Homo sapiens
tcatattgtatgtaagta

SEQ ID NO: 2829674 - DNA, 13 bp, Homo sapiens
tcatcaattttta

SEQ ID NO: 2829675 - DNA, 18 bp, Homo sapiens
tcatcaatttttatacat

SEQ ID NO: 2829676 - DNA, 19 bp, Homo sapiens
tcatcaatttttatacata

SEQ ID NO: 2829677 - DNA, 13 bp, Homo sapiens
tcatcagaagtgg

SEQ ID NO: 2829678 - DNA, 15 bp, Homo sapiens
tcatcataaaataaa

SEQ ID NO: 2829679 - DNA, 20 bp, Homo sapiens
tcatcatattgtatgtaagt

SEQ ID NO: 2829680 - DNA, 14 bp, Homo sapiens
tcatccactgtgcc

SEQ ID NO: 2829681 - DNA, 18 bp, Homo sapiens
tcatccactgtgccatgt

SEQ ID NO: 2829682 - DNA, 23 bp, Homo sapiens
tcatccactgtgccatgtgccag

SEQ ID NO: 2829683 - DNA, 21 bp, Homo sapiens
tcatccagttgcaataaaata

SEQ ID NO: 2829684 - DNA, 14 bp, Homo sapiens
tcatcccgctcctg

SEQ ID NO: 2829685 - DNA, 17 bp, Homo sapiens
tcatcccgctcctgctg

SEQ ID NO: 2829686 - DNA, 17 bp, Homo sapiens
tcatcctgccttcatgg

SEQ ID NO: 2829687 - DNA, 20 bp, Homo sapiens
tcatcgattcaaactgctcc

SEQ ID NO: 2829688 - DNA, 23 bp, Homo sapiens
tcatcgattcaaactgctccaag

SEQ ID NO: 2829689 - DNA, 17 bp, Homo sapiens
tcatctatggcagtcca

SEQ ID NO: 2829690 - DNA, 21 bp, Homo sapiens
tcatctatggcagtccagcca

SEQ ID NO: 2829691 - DNA, 16 bp, Homo sapiens
tcatctatttctgaga

SEQ ID NO: 2829692 - DNA, 20 bp, Homo sapiens
tcatctcatttaagggaaaa

SEQ ID NO: 2829693 - DNA, 16 bp, Homo sapiens
tcatgaacacagcctg

SEQ ID NO: 2829694 - DNA, 13 bp, Homo sapiens
tcatgaagcccaa

SEQ ID NO: 2829695 - DNA, 23 bp, Homo sapiens
tcatgacaaagttacaaattcaa

SEQ ID NO: 2829696 - DNA, 17 bp, Homo sapiens
tcatgagtcagacattt

SEQ ID NO: 2829697 - DNA, 14 bp, Homo sapiens
tcctattttaaaac

SEQ ID NO: 2829698 - DNA, 21 bp, Homo sapiens
tcctcacagttgccatgtaga

SEQ ID NO: 2829699 - DNA, 16 bp, Homo sapiens
tcctcacccccagctt

SEQ ID NO: 2829700 - DNA, 14 bp, Homo sapiens
tcctcactgcccca

SEQ ID NO: 2829701 - DNA, 18 bp, Homo sapiens
tcctcagggacagagaca

SEQ ID NO: 2829702 - DNA, 15 bp, Homo sapiens
tcctcagtcctggaa

SEQ ID NO: 2829703 - DNA, 20 bp, Homo sapiens
tcctccaggcacgtcccgga

SEQ ID NO: 2829704 - DNA, 19 bp, Homo sapiens
tcctccagggccacgtgcc

SEQ ID NO: 2829705 - DNA, 23 bp, Homo sapiens
tcctccagggccacgtgccaggc

SEQ ID NO: 2829706 - DNA, 20 bp, Homo sapiens
tcctcccaccaccctcccac

SEQ ID NO: 2829707 - DNA, 16 bp, Homo sapiens
tcctcccacctcagcc

SEQ ID NO: 2829708 - DNA, 23 bp, Homo sapiens
tcctccccaccttccccagactc

SEQ ID NO: 2829709 - DNA, 22 bp, Homo sapiens
tcctccccattagagtcagcct

SEQ ID NO: 2829710 - DNA, 15 bp, Homo sapiens
tcctccccctgccag

SEQ ID NO: 2829711 - DNA, 17 bp, Homo sapiens
tcctccccctgccagtg

SEQ ID NO: 2829712 - DNA, 20 bp, Homo sapiens
tcctccccctgccagtgcct

SEQ ID NO: 2829713 - DNA, 11 bp, Homo sapiens
tcctccccttc

SEQ ID NO: 2829714 - DNA, 14 bp, Homo sapiens
tcctccccttcctg

SEQ ID NO: 2829715 - DNA, 16 bp, Homo sapiens
tcctccccttcctgca

SEQ ID NO: 2829716 - DNA, 17 bp, Homo sapiens
tcctcctaaacaaaaac

SEQ ID NO: 2829717 - DNA, 13 bp, Homo sapiens
tcctcctgccctc

SEQ ID NO: 2829718 - DNA, 13 bp, Homo sapiens
tcctcgccctggg

SEQ ID NO: 2829719 - DNA, 19 bp, Homo sapiens
tcctcggatcaccgagagt

SEQ ID NO: 2829720 - DNA, 20 bp, Homo sapiens
tcctctaagccactcttcca

SEQ ID NO: 2829721 - DNA, 19 bp, Homo sapiens
tcctctacttaatgagata

SEQ ID NO: 2829722 - DNA, 14 bp, Homo sapiens
tcctctccaattgt

SEQ ID NO: 2829723 - DNA, 24 bp, Homo sapiens
tcctctccagccttctctctctgg

SEQ ID NO: 2829724 - DNA, 14 bp, Homo sapiens
tcctctccaggcac

SEQ ID NO: 2829725 - DNA, 15 bp, Homo sapiens
tcctctccaggcacc

SEQ ID NO: 2829726 - DNA, 14 bp, Homo sapiens
tcctctgcagcact

SEQ ID NO: 2829727 - DNA, 23 bp, Homo sapiens
tcctctgccacctcccctatcca

SEQ ID NO: 2829728 - DNA, 14 bp, Homo sapiens
tcctctgtccaggg

SEQ ID NO: 2829729 - DNA, 15 bp, Homo sapiens
tcctctgtctcgagc

SEQ ID NO: 2829730 - DNA, 18 bp, Homo sapiens
tcctcttccccttgccct

SEQ ID NO: 2829731 - DNA, 19 bp, Homo sapiens
tcctcttgccactgcctct

SEQ ID NO: 2829732 - DNA, 18 bp, Homo sapiens
tcctgaaagaaacagtta

SEQ ID NO: 2829733 - DNA, 14 bp, Homo sapiens
tcctgaaatttcag

SEQ ID NO: 2829734 - DNA, 14 bp, Homo sapiens
tcctgacccagtcc

SEQ ID NO: 2829735 - DNA, 15 bp, Homo sapiens
tcctgacccagtccc

SEQ ID NO: 2829736 - DNA, 16 bp, Homo sapiens
tcctgacccagtcccc

SEQ ID NO: 2829737 - DNA, 18 bp, Homo sapiens
tcctgaccctccgctgca

SEQ ID NO: 2829738 - DNA, 16 bp, Homo sapiens
tcctgagaccacagag

SEQ ID NO: 2829739 - DNA, 18 bp, Homo sapiens
tcctgagaggtgctgcag

SEQ ID NO: 2829740 - DNA, 13 bp, Homo sapiens
tcctgagcactgc

SEQ ID NO: 2829741 - DNA, 15 bp, Homo sapiens
tcctgagcactgcca

SEQ ID NO: 2829742 - DNA, 19 bp, Homo sapiens
tcctgagcactgccaggag

SEQ ID NO: 2829743 - DNA, 18 bp, Homo sapiens
tcctgataaacattaaac

SEQ ID NO: 2829744 - DNA, 19 bp, Homo sapiens
tcctgataaacattaaaca

SEQ ID NO: 2829745 - DNA, 19 bp, Homo sapiens
tcctgatactgggtacaag

SEQ ID NO: 2829746 - DNA, 22 bp, Homo sapiens
tcctgatgtgccagaacttcga

SEQ ID NO: 2829747 - DNA, 15 bp, Homo sapiens
tcctgcaatctccag

SEQ ID NO: 2829748 - DNA, 18 bp, Homo sapiens
tcctgcaatctccagggc

SEQ ID NO: 2829749 - DNA, 20 bp, Homo sapiens
tcctgcaatctccagggctg

SEQ ID NO: 2829750 - DNA, 17 bp, Homo sapiens
tcctgcaattctacagt

SEQ ID NO: 2829751 - DNA, 21 bp, Homo sapiens
tcctgcactgacccacagcct

SEQ ID NO: 2829752 - DNA, 16 bp, Homo sapiens
tcctgcagcctcctcc

SEQ ID NO: 2829753 - DNA, 13 bp, Homo sapiens
tcctgccaagcca

SEQ ID NO: 2829754 - DNA, 16 bp, Homo sapiens
tcctgcctacatccca

SEQ ID NO: 2829755 - DNA, 14 bp, Homo sapiens
tcctgcctcagcct

SEQ ID NO: 2829756 - DNA, 17 bp, Homo sapiens
tcctgcctctactggga

SEQ ID NO: 2829757 - DNA, 22 bp, Homo sapiens
tcctgcctctactgggaaggct

SEQ ID NO: 2829758 - DNA, 23 bp, Homo sapiens
tcctgcgggcttttccccggtcc

SEQ ID NO: 2829759 - DNA, 17 bp, Homo sapiens
tcctgctagctgtagaa

SEQ ID NO: 2829760 - DNA, 18 bp, Homo sapiens
tcctgctagctgtagaaa

SEQ ID NO: 2829761 - DNA, 18 bp, Homo sapiens
tcctgctgaaacacctcc

SEQ ID NO: 2829762 - DNA, 22 bp, Homo sapiens
tcctgctgaaacacctcccagg

SEQ ID NO: 2829763 - DNA, 23 bp, Homo sapiens
tcctgctgaaacacctcccaggg

SEQ ID NO: 2829764 - DNA, 22 bp, Homo sapiens
tcctggaaaggctcagtctcag

SEQ ID NO: 2829765 - DNA, 14 bp, Homo sapiens
tcctggaaccaatc

SEQ ID NO: 2829766 - DNA, 21 bp, Homo sapiens
tcctggaagctgtgtccttgc

SEQ ID NO: 2829767 - DNA, 15 bp, Homo sapiens
tcctggacagctgtg

SEQ ID NO: 2829768 - DNA, 18 bp, Homo sapiens
tcctggacagctgtgcct

SEQ ID NO: 2829769 - DNA, 22 bp, Homo sapiens
tcctggacagctgtgcctcgct

SEQ ID NO: 2829770 - DNA, 14 bp, Homo sapiens
tcctggcacccggc

SEQ ID NO: 2829771 - DNA, 16 bp, Homo sapiens
tcctggcacccggccc

SEQ ID NO: 2829772 - DNA, 14 bp, Homo sapiens
tcctggcttcccat

SEQ ID NO: 2829773 - DNA, 20 bp, Homo sapiens
tcctggcttcccatccccag

SEQ ID NO: 2829774 - DNA, 21 bp, Homo sapiens
tcctggcttcccatccccagc

SEQ ID NO: 2829775 - DNA, 17 bp, Homo sapiens
tcctggctttgacatga

SEQ ID NO: 2829776 - DNA, 17 bp, Homo sapiens
tcctgggagaacctcag

SEQ ID NO: 2829777 - DNA, 12 bp, Homo sapiens
tcctgggagtga

SEQ ID NO: 2829778 - DNA, 18 bp, Homo sapiens
tcctgggagtgagctggt

SEQ ID NO: 2829779 - DNA, 19 bp, Homo sapiens
tcctgggcccgctttgcct

SEQ ID NO: 2829780 - DNA, 15 bp, Homo sapiens
tcctggggctctgtg

SEQ ID NO: 2829781 - DNA, 19 bp, Homo sapiens
tcctggggctctgtgcagg

SEQ ID NO: 2829782 - DNA, 18 bp, Homo sapiens
tcctgggggatgtgcacg

SEQ ID NO: 2829783 - DNA, 21 bp, Homo sapiens
tcctgggggttctttcttcct

SEQ ID NO: 2829784 - DNA, 17 bp, Homo sapiens
tcctggtggggcagctc

SEQ ID NO: 2829785 - DNA, 21 bp, Homo sapiens
tcctggtggggcagctcctct

SEQ ID NO: 2829786 - DNA, 21 bp, Homo sapiens
tcctgtaacacaagccacaga

SEQ ID NO: 2829787 - DNA, 19 bp, Homo sapiens
tctatgggactcaatgcac

SEQ ID NO: 2829788 - DNA, 13 bp, Homo sapiens
tctattgaaaaat

SEQ ID NO: 2829789 - DNA, 15 bp, Homo sapiens
tctattgtagcattt

SEQ ID NO: 2829790 - DNA, 16 bp, Homo sapiens
tctatttaaaaaataa

SEQ ID NO: 2829791 - DNA, 17 bp, Homo sapiens
tctattttgtaaactca

SEQ ID NO: 2829792 - DNA, 21 bp, Homo sapiens
tctcaaactcttgacctcagg

SEQ ID NO: 2829793 - DNA, 16 bp, Homo sapiens
tctcaaatgctaaatg

SEQ ID NO: 2829794 - DNA, 17 bp, Homo sapiens
tctcaaattctcaacct

SEQ ID NO: 2829795 - DNA, 22 bp, Homo sapiens
tctcaacctaccaccccttcct

SEQ ID NO: 2829796 - DNA, 22 bp, Homo sapiens
tctcaagattatattataataa

SEQ ID NO: 2829797 - DNA, 17 bp, Homo sapiens
tctcaatattcaataaa

SEQ ID NO: 2829798 - DNA, 18 bp, Homo sapiens
tctcaatattcaataaag

SEQ ID NO: 2829799 - DNA, 19 bp, Homo sapiens
tctcactatgttgcccagg

SEQ ID NO: 2829800 - DNA, 21 bp, Homo sapiens
tctcactatgttgcccaggca

SEQ ID NO: 2829801 - DNA, 22 bp, Homo sapiens
tctcactatgttgcccaggcag

SEQ ID NO: 2829802 - DNA, 12 bp, Homo sapiens
tctcactccacc

SEQ ID NO: 2829803 - DNA, 17 bp, Homo sapiens
tctcactccaccaccca

SEQ ID NO: 2829804 - DNA, 16 bp, Homo sapiens
tctcactctgtcgccc

SEQ ID NO: 2829805 - DNA, 19 bp, Homo sapiens
tctcagaaggtattccttt

SEQ ID NO: 2829806 - DNA, 18 bp, Homo sapiens
tctcagaatgtcattttg

SEQ ID NO: 2829807 - DNA, 11 bp, Homo sapiens
tctcagagaca

SEQ ID NO: 2829808 - DNA, 21 bp, Homo sapiens
tctcagagacaggtggcctag

SEQ ID NO: 2829809 - DNA, 13 bp, Homo sapiens
tctcagcctccca

SEQ ID NO: 2829810 - DNA, 14 bp, Homo sapiens
tctcagcctcccaa

SEQ ID NO: 2829811 - DNA, 11 bp, Homo sapiens
tctcagcttca

SEQ ID NO: 2829812 - DNA, 21 bp, Homo sapiens
tctcaggacacaggcctgtgt

SEQ ID NO: 2829813 - DNA, 19 bp, Homo sapiens
tctcaggagcacaggcagc

SEQ ID NO: 2829814 - DNA, 20 bp, Homo sapiens
tctcaggatcaagaaagtgt

SEQ ID NO: 2829815 - DNA, 15 bp, Homo sapiens
tctcagtcagtaatt

SEQ ID NO: 2829816 - DNA, 18 bp, Homo sapiens
tctcagtcggtgtgtaat

SEQ ID NO: 2829817 - DNA, 23 bp, Homo sapiens
tctcagtgggacaaaccagagca

SEQ ID NO: 2829818 - DNA, 21 bp, Homo sapiens
tctcatcagtgtcctcttgct

SEQ ID NO: 2829819 - DNA, 15 bp, Homo sapiens
tctcatcatattgta

SEQ ID NO: 2829820 - DNA, 19 bp, Homo sapiens
tctcatctcagtgaagaat

SEQ ID NO: 2829821 - DNA, 20 bp, Homo sapiens
tctcatctcagtgaagaata

SEQ ID NO: 2829822 - DNA, 17 bp, Homo sapiens
tctcatgtgatcctttt

SEQ ID NO: 2829823 - DNA, 13 bp, Homo sapiens
tctcattccccag

SEQ ID NO: 2829824 - DNA, 17 bp, Homo sapiens
tctcatttttccgtaaa

SEQ ID NO: 2829825 - DNA, 20 bp, Homo sapiens
tctcattttttaaaaaagct

SEQ ID NO: 2829826 - DNA, 13 bp, Homo sapiens
tctccaattgtaa

SEQ ID NO: 2829827 - DNA, 18 bp, Homo sapiens
tctccaccctgagcctga

SEQ ID NO: 2829828 - DNA, 13 bp, Homo sapiens
tctccaccctgct

SEQ ID NO: 2829829 - DNA, 17 bp, Homo sapiens
tctccaccctgctctcc

SEQ ID NO: 2829830 - DNA, 12 bp, Homo sapiens
tctccacctcag

SEQ ID NO: 2829831 - DNA, 13 bp, Homo sapiens
tctccacctcagc

SEQ ID NO: 2829832 - DNA, 14 bp, Homo sapiens
tctccacctcagcc

SEQ ID NO: 2829833 - DNA, 16 bp, Homo sapiens
tctccacctgaagtga

SEQ ID NO: 2829834 - DNA, 22 bp, Homo sapiens
tctccactaaatgagctcctgc

SEQ ID NO: 2829835 - DNA, 16 bp, Homo sapiens
tctccactgctctcag

SEQ ID NO: 2829836 - DNA, 16 bp, Homo sapiens
tctccagccagcaatg

SEQ ID NO: 2829837 - DNA, 22 bp, Homo sapiens
tctccaggaaggtagcccagca

SEQ ID NO: 2829838 - DNA, 16 bp, Homo sapiens
tctccaggctgtatcc

SEQ ID NO: 2829839 - DNA, 19 bp, Homo sapiens
tctccagtatccactttgc

SEQ ID NO: 2829840 - DNA, 18 bp, Homo sapiens
tctccagtggttgctgtt

SEQ ID NO: 2829841 - DNA, 15 bp, Homo sapiens
tctccatatgttaca

SEQ ID NO: 2829842 - DNA, 21 bp, Homo sapiens
tctcccacccagccctgcccc

SEQ ID NO: 2829843 - DNA, 12 bp, Homo sapiens
tctcccaggccc

SEQ ID NO: 2829844 - DNA, 20 bp, Homo sapiens
tctcccaggccccatgacct

SEQ ID NO: 2829845 - DNA, 23 bp, Homo sapiens
tctcccaggccccatgacctcca

SEQ ID NO: 2829846 - DNA, 13 bp, Homo sapiens
tctccccctgggc

SEQ ID NO: 2829847 - DNA, 20 bp, Homo sapiens
tctccccctgggctctgccc

SEQ ID NO: 2829848 - DNA, 17 bp, Homo sapiens
tctcccctccctcttcc

SEQ ID NO: 2829849 - DNA, 15 bp, Homo sapiens
tctcccctgccctgc

SEQ ID NO: 2829850 - DNA, 18 bp, Homo sapiens
tctcccgcaccaggccgg

SEQ ID NO: 2829851 - DNA, 21 bp, Homo sapiens
tctcccgcaccaggccgggct

SEQ ID NO: 2829852 - DNA, 13 bp, Homo sapiens
tctccctaaaata

SEQ ID NO: 2829853 - DNA, 17 bp, Homo sapiens
tctccctctcctgccta

SEQ ID NO: 2829854 - DNA, 19 bp, Homo sapiens
tctccctctggccctgcct

SEQ ID NO: 2829855 - DNA, 15 bp, Homo sapiens
tctccctgccgcctc

SEQ ID NO: 2829856 - DNA, 17 bp, Homo sapiens
tctccgaccagacacct

SEQ ID NO: 2829857 - DNA, 16 bp, Homo sapiens
tctcctaccccacctc

SEQ ID NO: 2829858 - DNA, 17 bp, Homo sapiens
tctcctaccccacctca

SEQ ID NO: 2829859 - DNA, 24 bp, Homo sapiens
tctcctaccccacctcatgcctgg

SEQ ID NO: 2829860 - DNA, 22 bp, Homo sapiens
tctcctcttgccactgcctctt

SEQ ID NO: 2829861 - DNA, 16 bp, Homo sapiens
tctcctcttttatctt

SEQ ID NO: 2829862 - DNA, 16 bp, Homo sapiens
tctcctgacccagtcc

SEQ ID NO: 2829863 - DNA, 20 bp, Homo sapiens
tctcctgagaggtgctgcag

SEQ ID NO: 2829864 - DNA, 15 bp, Homo sapiens
tctcctgcctcagcc

SEQ ID NO: 2829865 - DNA, 17 bp, Homo sapiens
tctcctgcctcagcctc

SEQ ID NO: 2829866 - DNA, 19 bp, Homo sapiens
tctcctgtaattttgtagt

SEQ ID NO: 2829867 - DNA, 14 bp, Homo sapiens
tctccttggaggac

SEQ ID NO: 2829868 - DNA, 13 bp, Homo sapiens
tctccttgttctg

SEQ ID NO: 2829869 - DNA, 18 bp, Homo sapiens
tctccttgttctgataat

SEQ ID NO: 2829870 - DNA, 14 bp, Homo sapiens
tctcctttcaggga

SEQ ID NO: 2829871 - DNA, 17 bp, Homo sapiens
tctcctttgcactgagg

SEQ ID NO: 2829872 - DNA, 19 bp, Homo sapiens
tctcgagcgccctgcagac

SEQ ID NO: 2829873 - DNA, 14 bp, Homo sapiens
tctctaaacccaaa

SEQ ID NO: 2829874 - DNA, 20 bp, Homo sapiens
tctctaaactgctgttaatt

SEQ ID NO: 2829875 - DNA, 19 bp, Homo sapiens
tctctaaatcttccttgtg

SEQ ID NO: 2829876 - DNA, 16 bp, Homo sapiens
tctctacccatctccc

SEQ ID NO: 2829877 - DNA, 14 bp, Homo sapiens
tctctactaaaaat

SEQ ID NO: 2829878 - DNA, 24 bp, Homo sapiens
tcttgtacatgtgtagcctgtgca

SEQ ID NO: 2829879 - DNA, 13 bp, Homo sapiens
tcttgtattttct

SEQ ID NO: 2829880 - DNA, 20 bp, Homo sapiens
tcttgtattttcttcccatt

SEQ ID NO: 2829881 - DNA, 12 bp, Homo sapiens
tcttgtctctgg

SEQ ID NO: 2829882 - DNA, 14 bp, Homo sapiens
tcttgtttcaattc

SEQ ID NO: 2829883 - DNA, 12 bp, Homo sapiens
tctttaaaagaa

SEQ ID NO: 2829884 - DNA, 14 bp, Homo sapiens
tctttaaatcaaaa

SEQ ID NO: 2829885 - DNA, 14 bp, Homo sapiens
tctttaagaaagta

SEQ ID NO: 2829886 - DNA, 15 bp, Homo sapiens
tctttaatcttcagt

SEQ ID NO: 2829887 - DNA, 19 bp, Homo sapiens
tctttaatgtcacaggcag

SEQ ID NO: 2829888 - DNA, 20 bp, Homo sapiens
tctttaatgtcacaggcagg

SEQ ID NO: 2829889 - DNA, 16 bp, Homo sapiens
tctttacctgagacca

SEQ ID NO: 2829890 - DNA, 17 bp, Homo sapiens
tctttaggtgcctcctg

SEQ ID NO: 2829891 - DNA, 20 bp, Homo sapiens
tctttcaagtgaatctaaaa

SEQ ID NO: 2829892 - DNA, 21 bp, Homo sapiens
tctttcaagtgaatctaaaag

SEQ ID NO: 2829893 - DNA, 20 bp, Homo sapiens
tctttcaggggggttgtgag

SEQ ID NO: 2829894 - DNA, 22 bp, Homo sapiens
tctttccgtctccctaaaataa

SEQ ID NO: 2829895 - DNA, 16 bp, Homo sapiens
tctttctgatgtcaaa

SEQ ID NO: 2829896 - DNA, 20 bp, Homo sapiens
tctttcttattttgtaataa

SEQ ID NO: 2829897 - DNA, 21 bp, Homo sapiens
tctttcttattttgtaataaa

SEQ ID NO: 2829898 - DNA, 14 bp, Homo sapiens
tctttcttcctctg

SEQ ID NO: 2829899 - DNA, 16 bp, Homo sapiens
tctttcttcctctgct

SEQ ID NO: 2829900 - DNA, 21 bp, Homo sapiens
tctttctttacctgagaccag

SEQ ID NO: 2829901 - DNA, 13 bp, Homo sapiens
tctttgattcaga

SEQ ID NO: 2829902 - DNA, 15 bp, Homo sapiens
tctttgcctgtgtga

SEQ ID NO: 2829903 - DNA, 24 bp, Homo sapiens
tctttggaaggagtgagatcattt

SEQ ID NO: 2829904 - DNA, 16 bp, Homo sapiens
tctttggaggaacagc

SEQ ID NO: 2829905 - DNA, 23 bp, Homo sapiens
tctttgtaatgtcaccaccttcc

SEQ ID NO: 2829906 - DNA, 15 bp, Homo sapiens
tctttgtgtagcttt

SEQ ID NO: 2829907 - DNA, 18 bp, Homo sapiens
tctttgtgtagctttgct

SEQ ID NO: 2829908 - DNA, 14 bp, Homo sapiens
tcttttactgtaat

SEQ ID NO: 2829909 - DNA, 19 bp, Homo sapiens
tcttttgaatccatgcttg

SEQ ID NO: 2829910 - DNA, 18 bp, Homo sapiens
tctttttaaaaagttgca

SEQ ID NO: 2829911 - DNA, 22 bp, Homo sapiens
tctttttaaaaagttgcacatt

SEQ ID NO: 2829912 - DNA, 19 bp, Homo sapiens
tcttttttaaatgaagaaa

SEQ ID NO: 2829913 - DNA, 16 bp, Homo sapiens
tctttttttgtgatgt

SEQ ID NO: 2829914 - DNA, 14 bp, Homo sapiens
tgaaaaaaaagttt

SEQ ID NO: 2829915 - DNA, 13 bp, Homo sapiens
tgaaaaagaagaa

SEQ ID NO: 2829916 - DNA, 13 bp, Homo sapiens
tgaaaaagcgaaa

SEQ ID NO: 2829917 - DNA, 13 bp, Homo sapiens
tgaaaaattctca

SEQ ID NO: 2829918 - DNA, 14 bp, Homo sapiens
tgaaaacccagaga

SEQ ID NO: 2829919 - DNA, 15 bp, Homo sapiens
tgaaaacccagagag

SEQ ID NO: 2829920 - DNA, 16 bp, Homo sapiens
tgaaaacccagagagg

SEQ ID NO: 2829921 - DNA, 12 bp, Homo sapiens
tgaaaactggaa

SEQ ID NO: 2829922 - DNA, 13 bp, Homo sapiens
tgaaaactggaat

SEQ ID NO: 2829923 - DNA, 14 bp, Homo sapiens
tgaaaactgtaaat

SEQ ID NO: 2829924 - DNA, 17 bp, Homo sapiens
tgaaaactgtaaataca

SEQ ID NO: 2829925 - DNA, 17 bp, Homo sapiens
tgaaaactgtttatggt

SEQ ID NO: 2829926 - DNA, 18 bp, Homo sapiens
tgaaaagaataaaaattg

SEQ ID NO: 2829927 - DNA, 22 bp, Homo sapiens
tgaaaagataggtttgagttca

SEQ ID NO: 2829928 - DNA, 13 bp, Homo sapiens
tgaaaataattgt

SEQ ID NO: 2829929 - DNA, 18 bp, Homo sapiens
tgaaaataggtatacagt

SEQ ID NO: 2829930 - DNA, 17 bp, Homo sapiens
tgaaaatgagcctgtaa

SEQ ID NO: 2829931 - DNA, 15 bp, Homo sapiens
tgaaaatgtcagaaa

SEQ ID NO: 2829932 - DNA, 14 bp, Homo sapiens
tgaaaattaacact

SEQ ID NO: 2829933 - DNA, 18 bp, Homo sapiens
tgaaaattaacactgctt

SEQ ID NO: 2829934 - DNA, 14 bp, Homo sapiens
tgaaaattatttaa

SEQ ID NO: 2829935 - DNA, 19 bp, Homo sapiens
tgaaacaaataatcacatt

SEQ ID NO: 2829936 - DNA, 17 bp, Homo sapiens
tgaaacaagaagccaca

SEQ ID NO: 2829937 - DNA, 21 bp, Homo sapiens
tgaaacacacaggccatttca

SEQ ID NO: 2829938 - DNA, 16 bp, Homo sapiens
tgaaacacctcccagg

SEQ ID NO: 2829939 - DNA, 17 bp, Homo sapiens
tgaaacacctcccaggg

SEQ ID NO: 2829940 - DNA, 16 bp, Homo sapiens
tgaaacagaaacaaaa

SEQ ID NO: 2829941 - DNA, 14 bp, Homo sapiens
tgaaagaaacagtt

SEQ ID NO: 2829942 - DNA, 20 bp, Homo sapiens
tgaaagaattatttttgtgt

SEQ ID NO: 2829943 - DNA, 13 bp, Homo sapiens
tgaaagagaacca

SEQ ID NO: 2829944 - DNA, 16 bp, Homo sapiens
tgaaagagaaccagtt

SEQ ID NO: 2829945 - DNA, 15 bp, Homo sapiens
tgaaagatgcaagca

SEQ ID NO: 2829946 - DNA, 18 bp, Homo sapiens
tgaaagatggctgtgcct

SEQ ID NO: 2829947 - DNA, 19 bp, Homo sapiens
tgaaagatggctgtgcctc

SEQ ID NO: 2829948 - DNA, 22 bp, Homo sapiens
tgaaagatggctgtgcctctgc

SEQ ID NO: 2829949 - DNA, 13 bp, Homo sapiens
tgaaagctagaga

SEQ ID NO: 2829950 - DNA, 18 bp, Homo sapiens
tgaaagggcccagagagg

SEQ ID NO: 2829951 - DNA, 18 bp, Homo sapiens
tgaaagtgaataaacttc

SEQ ID NO: 2829952 - DNA, 21 bp, Homo sapiens
tgaaagtgaataaacttcagc

SEQ ID NO: 2829953 - DNA, 17 bp, Homo sapiens
tgaaataatgttctgtc

SEQ ID NO: 2829954 - DNA, 19 bp, Homo sapiens
tgaaataattaaaaaccac

SEQ ID NO: 2829955 - DNA, 19 bp, Homo sapiens
tgaaatacacaagtaaaca

SEQ ID NO: 2829956 - DNA, 14 bp, Homo sapiens
tgaaataccagtgt

SEQ ID NO: 2829957 - DNA, 20 bp, Homo sapiens
tgaaatatgatgttaaaaaa

SEQ ID NO: 2829958 - DNA, 19 bp, Homo sapiens
tgaaatgacctcaagatgt

SEQ ID NO: 2829959 - DNA, 23 bp, Homo sapiens
tgaaatgaggtcagagcctgcag

SEQ ID NO: 2829960 - DNA, 17 bp, Homo sapiens
tgaaatggatacttata

SEQ ID NO: 2829961 - DNA, 15 bp, Homo sapiens
tgaaatgggctttaa

SEQ ID NO: 2829962 - DNA, 16 bp, Homo sapiens
tgaaatgtttcactat

SEQ ID NO: 2829963 - DNA, 15 bp, Homo sapiens
tgaaattatatctgt

SEQ ID NO: 2829964 - DNA, 22 bp, Homo sapiens
tgaaatttaatatagctatttt

SEQ ID NO: 2829965 - DNA, 19 bp, Homo sapiens
tgaacaaagaaaaaaatat

SEQ ID NO: 2829966 - DNA, 21 bp, Homo sapiens
tgaacaaagggattctccagg

SEQ ID NO: 2829967 - DNA, 15 bp, Homo sapiens
tgaacaaatggcctt

SEQ ID NO: 2829968 - DNA, 11 bp, Homo sapiens
tgaacaagaat

SEQ ID NO: 2829969 - DNA, 15 bp, Homo sapiens
tgcactgtatgctgg

SEQ ID NO: 2829970 - DNA, 16 bp, Homo sapiens
tgcactgttacttttt

SEQ ID NO: 2829971 - DNA, 14 bp, Homo sapiens
tgcacttcttacaa

SEQ ID NO: 2829972 - DNA, 21 bp, Homo sapiens
tgcacttgcagactctacaga

SEQ ID NO: 2829973 - DNA, 21 bp, Homo sapiens
tgcagaaaaaaaaaaagaaac

SEQ ID NO: 2829974 - DNA, 17 bp, Homo sapiens
tgcagaaaagcacctgc

SEQ ID NO: 2829975 - DNA, 20 bp, Homo sapiens
tgcagaaaagcacctgccga

SEQ ID NO: 2829976 - DNA, 22 bp, Homo sapiens
tgcagaaaagcacctgccgacc

SEQ ID NO: 2829977 - DNA, 21 bp, Homo sapiens
tgcagaatacagtaagctgct

SEQ ID NO: 2829978 - DNA, 12 bp, Homo sapiens
tgcagacaggca

SEQ ID NO: 2829979 - DNA, 16 bp, Homo sapiens
tgcagactcaataaaa

SEQ ID NO: 2829980 - DNA, 14 bp, Homo sapiens
tgcagactcactgt

SEQ ID NO: 2829981 - DNA, 19 bp, Homo sapiens
tgcagactcagtttgtcag

SEQ ID NO: 2829982 - DNA, 20 bp, Homo sapiens
tgcagactctacagaggcca

SEQ ID NO: 2829983 - DNA, 18 bp, Homo sapiens
tgcagactgtggctgcag

SEQ ID NO: 2829984 - DNA, 15 bp, Homo sapiens
tgcagagctgaagat

SEQ ID NO: 2829985 - DNA, 20 bp, Homo sapiens
tgcagaggggctttctggag

SEQ ID NO: 2829986 - DNA, 21 bp, Homo sapiens
tgcagaggggctttctggaga

SEQ ID NO: 2829987 - DNA, 15 bp, Homo sapiens
tgcagaggtgagcag

SEQ ID NO: 2829988 - DNA, 16 bp, Homo sapiens
tgcagagttcatggaa

SEQ ID NO: 2829989 - DNA, 18 bp, Homo sapiens
tgcagatggtgagagata

SEQ ID NO: 2829990 - DNA, 11 bp, Homo sapiens
tgcagcacttt

SEQ ID NO: 2829991 - DNA, 20 bp, Homo sapiens
tgcagcactttaaccctctc

SEQ ID NO: 2829992 - DNA, 22 bp, Homo sapiens
tgcagcactttaaccctctctt

SEQ ID NO: 2829993 - DNA, 23 bp, Homo sapiens
tgcagcactttaaccctctcttc

SEQ ID NO: 2829994 - DNA, 13 bp, Homo sapiens
tgcagcagaagcc

SEQ ID NO: 2829995 - DNA, 15 bp, Homo sapiens
tgcagcagaagccaa

SEQ ID NO: 2829996 - DNA, 16 bp, Homo sapiens
tgcagcagaagccaaa

SEQ ID NO: 2829997 - DNA, 16 bp, Homo sapiens
tgcagccaaacagagc

SEQ ID NO: 2829998 - DNA, 17 bp, Homo sapiens
tgcagccaaacagagcc

SEQ ID NO: 2829999 - DNA, 23 bp, Homo sapiens
tgcagccagcccagcccagctgg

SEQ ID NO: 2830000 - DNA, 20 bp, Homo sapiens
tgcagcccggcgccaccatc

SEQ ID NO: 2830001 - DNA, 18 bp, Homo sapiens
tgcagcctcaacctcctg

SEQ ID NO: 2830002 - DNA, 19 bp, Homo sapiens
tgcagcctcaacctcctgg

SEQ ID NO: 2830003 - DNA, 22 bp, Homo sapiens
tgcagcctcaacctcctgggct

SEQ ID NO: 2830004 - DNA, 15 bp, Homo sapiens
tgcagcctcctcctg

SEQ ID NO: 2830005 - DNA, 19 bp, Homo sapiens
tgcagcctcctcctgacca

SEQ ID NO: 2830006 - DNA, 17 bp, Homo sapiens
tgcagcttcatcaattt

SEQ ID NO: 2830007 - DNA, 13 bp, Homo sapiens
tgcagcttcctgt

SEQ ID NO: 2830008 - DNA, 15 bp, Homo sapiens
tgcagcttcctgtca

SEQ ID NO: 2830009 - DNA, 22 bp, Homo sapiens
tgcagcttcggggcaagtgaga

SEQ ID NO: 2830010 - DNA, 16 bp, Homo sapiens
tgcagcttgtagccag

SEQ ID NO: 2830011 - DNA, 18 bp, Homo sapiens
tgcagcttgtagccagcc

SEQ ID NO: 2830012 - DNA, 20 bp, Homo sapiens
tgcagcttgtagccagccgg

SEQ ID NO: 2830013 - DNA, 21 bp, Homo sapiens
tgcagcttgtagccagccggg

SEQ ID NO: 2830014 - DNA, 17 bp, Homo sapiens
tgcaggaataaggcctt

SEQ ID NO: 2830015 - DNA, 14 bp, Homo sapiens
tgcaggaatcaaaa

SEQ ID NO: 2830016 - DNA, 19 bp, Homo sapiens
tgcaggaatcaaaaattga

SEQ ID NO: 2830017 - DNA, 16 bp, Homo sapiens
tgcaggacttctgcct

SEQ ID NO: 2830018 - DNA, 20 bp, Homo sapiens
tgcaggccaagagcagaggc

SEQ ID NO: 2830019 - DNA, 22 bp, Homo sapiens
tgcaggccaggttatgcctcat

SEQ ID NO: 2830020 - DNA, 15 bp, Homo sapiens
tgcagtagtctctgt

SEQ ID NO: 2830021 - DNA, 20 bp, Homo sapiens
tgcagtcaacagttcaaaga

SEQ ID NO: 2830022 - DNA, 21 bp, Homo sapiens
tgcagtcaacagttcaaagaa

SEQ ID NO: 2830023 - DNA, 16 bp, Homo sapiens
tgcagtcatcagaagt

SEQ ID NO: 2830024 - DNA, 15 bp, Homo sapiens
tgcagtccagaataa

SEQ ID NO: 2830025 - DNA, 23 bp, Homo sapiens
tgcagtccagaataagtgctgtt

SEQ ID NO: 2830026 - DNA, 17 bp, Homo sapiens
tgcagtggctcacgcct

SEQ ID NO: 2830027 - DNA, 12 bp, Homo sapiens
tgcagtttccaa

SEQ ID NO: 2830028 - DNA, 17 bp, Homo sapiens
tgcatagagccacgtat

SEQ ID NO: 2830029 - DNA, 19 bp, Homo sapiens
tgcatagagccacgtatgt

SEQ ID NO: 2830030 - DNA, 21 bp, Homo sapiens
tgcatagtaccaatcatttta

SEQ ID NO: 2830031 - DNA, 22 bp, Homo sapiens
tgcatagtaccaatcattttaa

SEQ ID NO: 2830032 - DNA, 17 bp, Homo sapiens
tgcatcagaaagggagg

SEQ ID NO: 2830033 - DNA, 21 bp, Homo sapiens
tgcatcagaaagggagggctc

SEQ ID NO: 2830034 - DNA, 19 bp, Homo sapiens
tgcatcatcatagaaaaac

SEQ ID NO: 2830035 - DNA, 18 bp, Homo sapiens
tgcatccattcctcaggg

SEQ ID NO: 2830036 - DNA, 19 bp, Homo sapiens
tgcatccattcctcaggga

SEQ ID NO: 2830037 - DNA, 21 bp, Homo sapiens
tgcatccattcctcagggaca

SEQ ID NO: 2830038 - DNA, 23 bp, Homo sapiens
tgcatctgggattcccaccaagg

SEQ ID NO: 2830039 - DNA, 12 bp, Homo sapiens
tgcatgatttta

SEQ ID NO: 2830040 - DNA, 13 bp, Homo sapiens
tgcatgattttat

SEQ ID NO: 2830041 - DNA, 22 bp, Homo sapiens
tgcatgattttatacatagtca

SEQ ID NO: 2830042 - DNA, 18 bp, Homo sapiens
tgcatgctctctgcagcc

SEQ ID NO: 2830043 - DNA, 23 bp, Homo sapiens
tgcatggacaccccttatccagg

SEQ ID NO: 2830044 - DNA, 14 bp, Homo sapiens
tgcatgtaaaatgc

SEQ ID NO: 2830045 - DNA, 15 bp, Homo sapiens
tgcatgtaaaatgca

SEQ ID NO: 2830046 - DNA, 18 bp, Homo sapiens
tgcatgtaaaatgcagtc

SEQ ID NO: 2830047 - DNA, 22 bp, Homo sapiens
tgcatgtgtgttgtccttcagc

SEQ ID NO: 2830048 - DNA, 22 bp, Homo sapiens
tgcatgttaggaaaatttcaca

SEQ ID NO: 2830049 - DNA, 18 bp, Homo sapiens
tgcattaacttaaaagat

SEQ ID NO: 2830050 - DNA, 15 bp, Homo sapiens
tgcattactgcatgc

SEQ ID NO: 2830051 - DNA, 16 bp, Homo sapiens
tgcattagacagatga

SEQ ID NO: 2830052 - DNA, 16 bp, Homo sapiens
tgcattccatgatttt

SEQ ID NO: 2830053 - DNA, 22 bp, Homo sapiens
tgcattccatgattttacagag

SEQ ID NO: 2830054 - DNA, 14 bp, Homo sapiens
tgcattcccagtgg

SEQ ID NO: 2830055 - DNA, 17 bp, Homo sapiens
tgcattctgaatgaata

SEQ ID NO: 2830056 - DNA, 22 bp, Homo sapiens
tgcattcttaatctccactgtt

SEQ ID NO: 2830057 - DNA, 14 bp, Homo sapiens
tgcattgaatatat

SEQ ID NO: 2830058 - DNA, 17 bp, Homo sapiens
tgcatttataaatgtgt

SEQ ID NO: 2830059 - DNA, 18 bp, Homo sapiens
tggacaccaggagtccct

SEQ ID NO: 2830060 - DNA, 21 bp, Homo sapiens
tggacaccaggagtccctggt

SEQ ID NO: 2830061 - DNA, 23 bp, Homo sapiens
tggacaccccttatccaggactc

SEQ ID NO: 2830062 - DNA, 13 bp, Homo sapiens
tggacacctgccc

SEQ ID NO: 2830063 - DNA, 15 bp, Homo sapiens
tggacacctgccctg

SEQ ID NO: 2830064 - DNA, 17 bp, Homo sapiens
tggacacctgccctgcc

SEQ ID NO: 2830065 - DNA, 14 bp, Homo sapiens
tggacactgtacaa

SEQ ID NO: 2830066 - DNA, 16 bp, Homo sapiens
tggacagctgtgcctc

SEQ ID NO: 2830067 - DNA, 23 bp, Homo sapiens
tggacaggactaacactcagaag

SEQ ID NO: 2830068 - DNA, 22 bp, Homo sapiens
tggacaggcatgttctctgagg

SEQ ID NO: 2830069 - DNA, 12 bp, Homo sapiens
tggacagtcctg

SEQ ID NO: 2830070 - DNA, 13 bp, Homo sapiens
tggacagtcctgg

SEQ ID NO: 2830071 - DNA, 14 bp, Homo sapiens
tggacagtcctggg

SEQ ID NO: 2830072 - DNA, 15 bp, Homo sapiens
tggacagtcctggga

SEQ ID NO: 2830073 - DNA, 16 bp, Homo sapiens
tggacagtcctgggag

SEQ ID NO: 2830074 - DNA, 13 bp, Homo sapiens
tggaccacaggca

SEQ ID NO: 2830075 - DNA, 22 bp, Homo sapiens
tggaccacaggcatctacacag

SEQ ID NO: 2830076 - DNA, 17 bp, Homo sapiens
tggaccaccagccccag

SEQ ID NO: 2830077 - DNA, 19 bp, Homo sapiens
tggaccaccagccccagca

SEQ ID NO: 2830078 - DNA, 19 bp, Homo sapiens
tggaccactgggcaatgat

SEQ ID NO: 2830079 - DNA, 12 bp, Homo sapiens
tggaccagagga

SEQ ID NO: 2830080 - DNA, 19 bp, Homo sapiens
tggaccagaggaagcccct

SEQ ID NO: 2830081 - DNA, 15 bp, Homo sapiens
tggacccgctctgga

SEQ ID NO: 2830082 - DNA, 16 bp, Homo sapiens
tggacccgctctggac

SEQ ID NO: 2830083 - DNA, 15 bp, Homo sapiens
tggacctctgctctg

SEQ ID NO: 2830084 - DNA, 13 bp, Homo sapiens
tggacctgaagga

SEQ ID NO: 2830085 - DNA, 19 bp, Homo sapiens
tggaccttcctgccaccag

SEQ ID NO: 2830086 - DNA, 20 bp, Homo sapiens
tggaccttgaactgggtact

SEQ ID NO: 2830087 - DNA, 17 bp, Homo sapiens
tggacgttcggggcatg

SEQ ID NO: 2830088 - DNA, 14 bp, Homo sapiens
tggactcctcccac

SEQ ID NO: 2830089 - DNA, 13 bp, Homo sapiens
tggactctgcaca

SEQ ID NO: 2830090 - DNA, 14 bp, Homo sapiens
tggactctgcacat

SEQ ID NO: 2830091 - DNA, 15 bp, Homo sapiens
tggactctgcacatg

SEQ ID NO: 2830092 - DNA, 16 bp, Homo sapiens
tggactctgcacatga

SEQ ID NO: 2830093 - DNA, 19 bp, Homo sapiens
tggactctgcacatgtctt

SEQ ID NO: 2830094 - DNA, 13 bp, Homo sapiens
tggactgacattt

SEQ ID NO: 2830095 - DNA, 22 bp, Homo sapiens
tggactttggttctctccagga

SEQ ID NO: 2830096 - DNA, 23 bp, Homo sapiens
tggactttggttctctccaggaa

SEQ ID NO: 2830097 - DNA, 14 bp, Homo sapiens
tggagaaaccctgt

SEQ ID NO: 2830098 - DNA, 19 bp, Homo sapiens
tggagactcctgccctgtt

SEQ ID NO: 2830099 - DNA, 11 bp, Homo sapiens
tggagagaagt

SEQ ID NO: 2830100 - DNA, 13 bp, Homo sapiens
tggagagaagttt

SEQ ID NO: 2830101 - DNA, 14 bp, Homo sapiens
tggagagctaggag

SEQ ID NO: 2830102 - DNA, 22 bp, Homo sapiens
tggagaggagggatgctgcctg

SEQ ID NO: 2830103 - DNA, 14 bp, Homo sapiens
tggagagtgagaat

SEQ ID NO: 2830104 - DNA, 23 bp, Homo sapiens
tggagagtgagaataattgtgta

SEQ ID NO: 2830105 - DNA, 19 bp, Homo sapiens
tggagatatttatgggggg

SEQ ID NO: 2830106 - DNA, 14 bp, Homo sapiens
tggagatgcagagg

SEQ ID NO: 2830107 - DNA, 19 bp, Homo sapiens
tggagcagaaagccagggt

SEQ ID NO: 2830108 - DNA, 11 bp, Homo sapiens
tggagcaggga

SEQ ID NO: 2830109 - DNA, 15 bp, Homo sapiens
tggagcatctgactc

SEQ ID NO: 2830110 - DNA, 15 bp, Homo sapiens
tggagcccttgggtt

SEQ ID NO: 2830111 - DNA, 20 bp, Homo sapiens
tggagcctcggtggccatgc

SEQ ID NO: 2830112 - DNA, 22 bp, Homo sapiens
tggagcgcacctgccccctggt

SEQ ID NO: 2830113 - DNA, 17 bp, Homo sapiens
tggagcggctctcctga

SEQ ID NO: 2830114 - DNA, 18 bp, Homo sapiens
tggagcttgtacatattg

SEQ ID NO: 2830115 - DNA, 12 bp, Homo sapiens
tggaggaacagc

SEQ ID NO: 2830116 - DNA, 11 bp, Homo sapiens
tggaggacagt

SEQ ID NO: 2830117 - DNA, 13 bp, Homo sapiens
tggaggacagtgg

SEQ ID NO: 2830118 - DNA, 20 bp, Homo sapiens
tggaggacctgagcctgccg

SEQ ID NO: 2830119 - DNA, 14 bp, Homo sapiens
tggaggagaagaat

SEQ ID NO: 2830120 - DNA, 14 bp, Homo sapiens
tggaggcagggcct

SEQ ID NO: 2830121 - DNA, 24 bp, Homo sapiens
tggaggccaccgggacagacctgg

SEQ ID NO: 2830122 - DNA, 20 bp, Homo sapiens
tggaggttgcagtgagctga

SEQ ID NO: 2830123 - DNA, 17 bp, Homo sapiens
tggagtgagcagtagaa

SEQ ID NO: 2830124 - DNA, 12 bp, Homo sapiens
tggagtgtcacc

SEQ ID NO: 2830125 - DNA, 14 bp, Homo sapiens
tggagttcttgtgc

SEQ ID NO: 2830126 - DNA, 19 bp, Homo sapiens
tggatatgttgttaaacac

SEQ ID NO: 2830127 - DNA, 17 bp, Homo sapiens
tggatcagcgtggcctt

SEQ ID NO: 2830128 - DNA, 21 bp, Homo sapiens
tggatctccaaggaccaggtt

SEQ ID NO: 2830129 - DNA, 19 bp, Homo sapiens
tggatctgggaccctttcc

SEQ ID NO: 2830130 - DNA, 20 bp, Homo sapiens
tggatctgtccaaggaaact

SEQ ID NO: 2830131 - DNA, 20 bp, Homo sapiens
tggatgagacttccaaacct

SEQ ID NO: 2830132 - DNA, 21 bp, Homo sapiens
tggatgcctggtggcagctgc

SEQ ID NO: 2830133 - DNA, 23 bp, Homo sapiens
tggatgcggaacccaaattacgt

SEQ ID NO: 2830134 - DNA, 22 bp, Homo sapiens
tggattatagagtatactaaaa

SEQ ID NO: 2830135 - DNA, 14 bp, Homo sapiens
tggatttcagaaag

SEQ ID NO: 2830136 - DNA, 18 bp, Homo sapiens
tggatttcctattttaaa

SEQ ID NO: 2830137 - DNA, 21 bp, Homo sapiens
tggatttcctattttaaaacc

SEQ ID NO: 2830138 - DNA, 21 bp, Homo sapiens
tggatttttacaaataaagat

SEQ ID NO: 2830139 - DNA, 23 bp, Homo sapiens
tggattttttccttcaaagttta

SEQ ID NO: 2830140 - DNA, 17 bp, Homo sapiens
tggcaacagagcaagac

SEQ ID NO: 2830141 - DNA, 14 bp, Homo sapiens
tggcaacctgttct

SEQ ID NO: 2830142 - DNA, 14 bp, Homo sapiens
tggcaagtgaattt

SEQ ID NO: 2830143 - DNA, 23 bp, Homo sapiens
tggcacaatggctaattcccaga

SEQ ID NO: 2830144 - DNA, 18 bp, Homo sapiens
tggcacagcccaaagaag

SEQ ID NO: 2830145 - DNA, 16 bp, Homo sapiens
tggcacccggcccctg

SEQ ID NO: 2830146 - DNA, 21 bp, Homo sapiens
tggcacccggcccctgctggt

SEQ ID NO: 2830147 - DNA, 12 bp, Homo sapiens
tggcacctccta

SEQ ID NO: 2830148 - DNA, 19 bp, Homo sapiens
tggcacggtggctcaggcc

SEQ ID NO: 2830149 - DNA, 14 bp, Homo sapiens
tggcactcccctga

SEQ ID NO: 2830150 - DNA, 13 bp, Homo sapiens
tggtttcccaaga

SEQ ID NO: 2830151 - DNA, 17 bp, Homo sapiens
tggtttcccaagagcta

SEQ ID NO: 2830152 - DNA, 19 bp, Homo sapiens
tggtttcctcattcctgaa

SEQ ID NO: 2830153 - DNA, 21 bp, Homo sapiens
tggtttctcagaatccaaaga

SEQ ID NO: 2830154 - DNA, 20 bp, Homo sapiens
tggtttgtcatatattcatg

SEQ ID NO: 2830155 - DNA, 24 bp, Homo sapiens
tggtttttgcaagatttaacacta

SEQ ID NO: 2830156 - DNA, 19 bp, Homo sapiens
tgtaaaagaacagtaaaca

SEQ ID NO: 2830157 - DNA, 22 bp, Homo sapiens
tgtaaaatgcagtccagaataa

SEQ ID NO: 2830158 - DNA, 23 bp, Homo sapiens
tgtaaaatgcagtccagaataag

SEQ ID NO: 2830159 - DNA, 14 bp, Homo sapiens
tgtaaacagtgcct

SEQ ID NO: 2830160 - DNA, 16 bp, Homo sapiens
tgtaaacagtgcctgc

SEQ ID NO: 2830161 - DNA, 17 bp, Homo sapiens
tgtaaacagtgcctgct

SEQ ID NO: 2830162 - DNA, 20 bp, Homo sapiens
tgtaaactcaaaatatttgt

SEQ ID NO: 2830163 - DNA, 13 bp, Homo sapiens
tgtaaatacaaaa

SEQ ID NO: 2830164 - DNA, 12 bp, Homo sapiens
tgtaaatacacc

SEQ ID NO: 2830165 - DNA, 20 bp, Homo sapiens
tgtaaatacatgtgtggatg

SEQ ID NO: 2830166 - DNA, 16 bp, Homo sapiens
tgtaaatagctcaggt

SEQ ID NO: 2830167 - DNA, 17 bp, Homo sapiens
tgtaaatattttaaaga

SEQ ID NO: 2830168 - DNA, 22 bp, Homo sapiens
tgtaaatattttaaagaattgt

SEQ ID NO: 2830169 - DNA, 20 bp, Homo sapiens
tgtaaatcctttttctttat

SEQ ID NO: 2830170 - DNA, 15 bp, Homo sapiens
tgtaaatttggattt

SEQ ID NO: 2830171 - DNA, 14 bp, Homo sapiens
tgtaacaagccaga

SEQ ID NO: 2830172 - DNA, 20 bp, Homo sapiens
tgtaacacaagccacagaag

SEQ ID NO: 2830173 - DNA, 21 bp, Homo sapiens
tgtaacacaagccacagaagc

SEQ ID NO: 2830174 - DNA, 20 bp, Homo sapiens
tgtaacactgcaagaagtct

SEQ ID NO: 2830175 - DNA, 15 bp, Homo sapiens
tgtaacatagattta

SEQ ID NO: 2830176 - DNA, 19 bp, Homo sapiens
tgtaacattaattctacta

SEQ ID NO: 2830177 - DNA, 20 bp, Homo sapiens
tgtaacattaattctactaa

SEQ ID NO: 2830178 - DNA, 15 bp, Homo sapiens
tgtaacttttgtaag

SEQ ID NO: 2830179 - DNA, 20 bp, Homo sapiens
tgtaacttttgtaagacaaa

SEQ ID NO: 2830180 - DNA, 13 bp, Homo sapiens
tgtaagagaattc

SEQ ID NO: 2830181 - DNA, 16 bp, Homo sapiens
tgtaagttgaagcaaa

SEQ ID NO: 2830182 - DNA, 15 bp, Homo sapiens
tgtaagtttattttt

SEQ ID NO: 2830183 - DNA, 20 bp, Homo sapiens
tgtaataaaaatttgtttaa

SEQ ID NO: 2830184 - DNA, 21 bp, Homo sapiens
tgtaataaaaatttgtttaaa

SEQ ID NO: 2830185 - DNA, 12 bp, Homo sapiens
tgtaataaactc

SEQ ID NO: 2830186 - DNA, 15 bp, Homo sapiens
tgtaataaactctct

SEQ ID NO: 2830187 - DNA, 17 bp, Homo sapiens
tgtaatcatataataaa

SEQ ID NO: 2830188 - DNA, 21 bp, Homo sapiens
tgtaatcccagctactcagga

SEQ ID NO: 2830189 - DNA, 20 bp, Homo sapiens
tgtaatcccagctactcggg

SEQ ID NO: 2830190 - DNA, 12 bp, Homo sapiens
tgtaatcctgta

SEQ ID NO: 2830191 - DNA, 19 bp, Homo sapiens
tgtaatcctgtatattatg

SEQ ID NO: 2830192 - DNA, 22 bp, Homo sapiens
tgtaatcctgtatattatggtg

SEQ ID NO: 2830193 - DNA, 14 bp, Homo sapiens
tgtaatcttaaaag

SEQ ID NO: 2830194 - DNA, 12 bp, Homo sapiens
tgtaatgcacaa

SEQ ID NO: 2830195 - DNA, 15 bp, Homo sapiens
tgtaatgcacaattt

SEQ ID NO: 2830196 - DNA, 17 bp, Homo sapiens
tgtaatgcacaatttag

SEQ ID NO: 2830197 - DNA, 20 bp, Homo sapiens
tgtaatgcacaatttagaaa

SEQ ID NO: 2830198 - DNA, 21 bp, Homo sapiens
tgtaatgtatcttatttatat

SEQ ID NO: 2830199 - DNA, 23 bp, Homo sapiens
tgtaatgtcaccaccttcccagc

SEQ ID NO: 2830200 - DNA, 20 bp, Homo sapiens
tgtaattaagtaaaccaaaa

SEQ ID NO: 2830201 - DNA, 15 bp, Homo sapiens
tgtaattctaaatga

SEQ ID NO: 2830202 - DNA, 16 bp, Homo sapiens
tgtaattggtgacaat

SEQ ID NO: 2830203 - DNA, 21 bp, Homo sapiens
tgtacaaagtagagaagtatc

SEQ ID NO: 2830204 - DNA, 14 bp, Homo sapiens
tgtacaatatttaa

SEQ ID NO: 2830205 - DNA, 22 bp, Homo sapiens
tgtacaattgaacttaaataaa

SEQ ID NO: 2830206 - DNA, 18 bp, Homo sapiens
tgtacagaattctgctac

SEQ ID NO: 2830207 - DNA, 20 bp, Homo sapiens
tgtacagacgtatgcttatt

SEQ ID NO: 2830208 - DNA, 15 bp, Homo sapiens
tgtacagttatacat

SEQ ID NO: 2830209 - DNA, 21 bp, Homo sapiens
tgtacagttatctaagttaat

SEQ ID NO: 2830210 - DNA, 13 bp, Homo sapiens
tgtacatatgtaa

SEQ ID NO: 2830211 - DNA, 15 bp, Homo sapiens
tgtacatatgtaaaa

SEQ ID NO: 2830212 - DNA, 19 bp, Homo sapiens
tgtacatatgtaaaataaa

SEQ ID NO: 2830213 - DNA, 15 bp, Homo sapiens
tgtacatgtgtagcc

SEQ ID NO: 2830214 - DNA, 17 bp, Homo sapiens
tgtacatgtgtagcctg

SEQ ID NO: 2830215 - DNA, 21 bp, Homo sapiens
tgtacatgtgtagcctgtgca

SEQ ID NO: 2830216 - DNA, 22 bp, Homo sapiens
tgtacatgtgtagggaaagtta

SEQ ID NO: 2830217 - DNA, 10 bp, Homo sapiens
tgtacatttc

SEQ ID NO: 2830218 - DNA, 21 bp, Homo sapiens
tgtaccagtgtactgctttca

SEQ ID NO: 2830219 - DNA, 22 bp, Homo sapiens
tgtaccagtgtactgctttcaa

SEQ ID NO: 2830220 - DNA, 14 bp, Homo sapiens
tgtaccagtgtgaa

SEQ ID NO: 2830221 - DNA, 19 bp, Homo sapiens
tgtaccgcgtctaccctgg

SEQ ID NO: 2830222 - DNA, 20 bp, Homo sapiens
tgtaccgcgtctaccctggg

SEQ ID NO: 2830223 - DNA, 19 bp, Homo sapiens
tgtacctatggctgcctgc

SEQ ID NO: 2830224 - DNA, 19 bp, Homo sapiens
tgtacgaacccctcccctc

SEQ ID NO: 2830225 - DNA, 15 bp, Homo sapiens
tgtacgtctgacagg

SEQ ID NO: 2830226 - DNA, 12 bp, Homo sapiens
tgtactacaatt

SEQ ID NO: 2830227 - DNA, 17 bp, Homo sapiens
tgtactgagccttgtaa

SEQ ID NO: 2830228 - DNA, 19 bp, Homo sapiens
tgtactgagccttgtaatt

SEQ ID NO: 2830229 - DNA, 16 bp, Homo sapiens
tgtacttaataaattc

SEQ ID NO: 2830230 - DNA, 20 bp, Homo sapiens
tgtacttaataaattcagat

SEQ ID NO: 2830231 - DNA, 16 bp, Homo sapiens
tgtacttgatgacaga

SEQ ID NO: 2830232 - DNA, 16 bp, Homo sapiens
tgtagaatgatttcat

SEQ ID NO: 2830233 - DNA, 17 bp, Homo sapiens
tgtagaatgatttcatg

SEQ ID NO: 2830234 - DNA, 18 bp, Homo sapiens
tgtagaatgatttcatgc

SEQ ID NO: 2830235 - DNA, 12 bp, Homo sapiens
tgtagagccagg

SEQ ID NO: 2830236 - DNA, 18 bp, Homo sapiens
tgtagagccagggtctca

SEQ ID NO: 2830237 - DNA, 17 bp, Homo sapiens
tgtagcatttcttgatg

SEQ ID NO: 2830238 - DNA, 10 bp, Homo sapiens
tgtagccaag

SEQ ID NO: 2830239 - DNA, 14 bp, Homo sapiens
tgtagccagccggg

SEQ ID NO: 2830240 - DNA, 16 bp, Homo sapiens
ttaagtgctttgtaat

SEQ ID NO: 2830241 - DNA, 18 bp, Homo sapiens
ttaagttagggaatggca

SEQ ID NO: 2830242 - DNA, 18 bp, Homo sapiens
ttaataaacgaagataaa

SEQ ID NO: 2830243 - DNA, 16 bp, Homo sapiens
ttaataacttgtccta

SEQ ID NO: 2830244 - DNA, 16 bp, Homo sapiens
ttaataataagataat

SEQ ID NO: 2830245 - DNA, 23 bp, Homo sapiens
ttaataataagataatgatgagt

SEQ ID NO: 2830246 - DNA, 15 bp, Homo sapiens
ttaatagcaaagaat

SEQ ID NO: 2830247 - DNA, 16 bp, Homo sapiens
ttaatagcaaagaatt

SEQ ID NO: 2830248 - DNA, 14 bp, Homo sapiens
ttaatatcctaaac

SEQ ID NO: 2830249 - DNA, 14 bp, Homo sapiens
ttaatatctgagaa

SEQ ID NO: 2830250 - DNA, 16 bp, Homo sapiens
ttaatatggggatgca

SEQ ID NO: 2830251 - DNA, 20 bp, Homo sapiens
ttaatatttgctgacagctg

SEQ ID NO: 2830252 - DNA, 17 bp, Homo sapiens
ttaatcagatagatatt

SEQ ID NO: 2830253 - DNA, 14 bp, Homo sapiens
ttaatcccagccct

SEQ ID NO: 2830254 - DNA, 21 bp, Homo sapiens
ttaatcgaaatgaatttatct

SEQ ID NO: 2830255 - DNA, 13 bp, Homo sapiens
ttaatcttcatgg

SEQ ID NO: 2830256 - DNA, 16 bp, Homo sapiens
ttaatgaactgtgaca

SEQ ID NO: 2830257 - DNA, 14 bp, Homo sapiens
ttaatgacttttta

SEQ ID NO: 2830258 - DNA, 19 bp, Homo sapiens
ttaatgtatagtaaatcac

SEQ ID NO: 2830259 - DNA, 18 bp, Homo sapiens
ttaatgtcacaggcaggt

SEQ ID NO: 2830260 - DNA, 22 bp, Homo sapiens
ttaatgttgggatttatatcta

SEQ ID NO: 2830261 - DNA, 23 bp, Homo sapiens
ttaatgttgggatttatatctat

SEQ ID NO: 2830262 - DNA, 13 bp, Homo sapiens
ttaattaaatgca

SEQ ID NO: 2830263 - DNA, 19 bp, Homo sapiens
ttaattaggggttgctaag

SEQ ID NO: 2830264 - DNA, 17 bp, Homo sapiens
ttaattattattcttca

SEQ ID NO: 2830265 - DNA, 16 bp, Homo sapiens
ttaattcataattaga

SEQ ID NO: 2830266 - DNA, 13 bp, Homo sapiens
ttaattctactaa

SEQ ID NO: 2830267 - DNA, 14 bp, Homo sapiens
ttaattctactaaa

SEQ ID NO: 2830268 - DNA, 15 bp, Homo sapiens
ttaattgtgtgtctt

SEQ ID NO: 2830269 - DNA, 20 bp, Homo sapiens
ttaattgtgtgtcttctatt

SEQ ID NO: 2830270 - DNA, 16 bp, Homo sapiens
ttaatttagaaaactt

SEQ ID NO: 2830271 - DNA, 15 bp, Homo sapiens
ttaatttatgagttt

SEQ ID NO: 2830272 - DNA, 13 bp, Homo sapiens
ttaattttcagta

SEQ ID NO: 2830273 - DNA, 13 bp, Homo sapiens
ttaatttttgata

SEQ ID NO: 2830274 - DNA, 15 bp, Homo sapiens
ttacaaaaggcagcc

SEQ ID NO: 2830275 - DNA, 19 bp, Homo sapiens
ttacaaaaggcagcccttt

SEQ ID NO: 2830276 - DNA, 15 bp, Homo sapiens
ttacaaacatgtggt

SEQ ID NO: 2830277 - DNA, 15 bp, Homo sapiens
ttacactacaagttt

SEQ ID NO: 2830278 - DNA, 22 bp, Homo sapiens
ttacagagaatctgaagctatt

SEQ ID NO: 2830279 - DNA, 13 bp, Homo sapiens
ttacagctgcctg

SEQ ID NO: 2830280 - DNA, 15 bp, Homo sapiens
ttacaggtgtactat

SEQ ID NO: 2830281 - DNA, 13 bp, Homo sapiens
ttacagtgactgt

SEQ ID NO: 2830282 - DNA, 22 bp, Homo sapiens
ttacataatcaaagctacctgt

SEQ ID NO: 2830283 - DNA, 16 bp, Homo sapiens
ttacatccagaaagaa

SEQ ID NO: 2830284 - DNA, 14 bp, Homo sapiens
ttacatctgtttta

SEQ ID NO: 2830285 - DNA, 18 bp, Homo sapiens
ttacatctgttttaaatt

SEQ ID NO: 2830286 - DNA, 21 bp, Homo sapiens
ttacatctgttttaaatttat

SEQ ID NO: 2830287 - DNA, 22 bp, Homo sapiens
ttacatgcattactgcatgcac

SEQ ID NO: 2830288 - DNA, 16 bp, Homo sapiens
ttacatttccaaatga

SEQ ID NO: 2830289 - DNA, 19 bp, Homo sapiens
ttacattttatttattagc

SEQ ID NO: 2830290 - DNA, 22 bp, Homo sapiens
ttacccagagaatatatacatt

SEQ ID NO: 2830291 - DNA, 18 bp, Homo sapiens
ttaccctaaaacatgtgt

SEQ ID NO: 2830292 - DNA, 18 bp, Homo sapiens
ttacctaaacagatataa

SEQ ID NO: 2830293 - DNA, 21 bp, Homo sapiens
ttacctaaacagatataaatg

SEQ ID NO: 2830294 - DNA, 18 bp, Homo sapiens
ttacctaccacagtgtct

SEQ ID NO: 2830295 - DNA, 12 bp, Homo sapiens
ttacctcctgcc

SEQ ID NO: 2830296 - DNA, 13 bp, Homo sapiens
ttacctcctgccc

SEQ ID NO: 2830297 - DNA, 14 bp, Homo sapiens
ttacctcctgccca

SEQ ID NO: 2830298 - DNA, 11 bp, Homo sapiens
ttacctctgat

SEQ ID NO: 2830299 - DNA, 18 bp, Homo sapiens
ttacctgggcattcttgt

SEQ ID NO: 2830300 - DNA, 14 bp, Homo sapiens
ttaccttcaataaa

SEQ ID NO: 2830301 - DNA, 16 bp, Homo sapiens
ttaccttcaataaagt

SEQ ID NO: 2830302 - DNA, 19 bp, Homo sapiens
ttaccttcaataaagtatc

SEQ ID NO: 2830303 - DNA, 15 bp, Homo sapiens
ttacctttcccatgc

SEQ ID NO: 2830304 - DNA, 14 bp, Homo sapiens
ttacgtctttggag

SEQ ID NO: 2830305 - DNA, 12 bp, Homo sapiens
ttacgtgagcca

SEQ ID NO: 2830306 - DNA, 21 bp, Homo sapiens
ttactaaacattttgttattg

SEQ ID NO: 2830307 - DNA, 16 bp, Homo sapiens
ttactaaagcagtgtt

SEQ ID NO: 2830308 - DNA, 22 bp, Homo sapiens
ttactaaagcagtgttttcacc

SEQ ID NO: 2830309 - DNA, 12 bp, Homo sapiens
ttactaaagtca

SEQ ID NO: 2830310 - DNA, 16 bp, Homo sapiens
ttactactattctgtt

SEQ ID NO: 2830311 - DNA, 20 bp, Homo sapiens
ttactacttgttacctttcc

SEQ ID NO: 2830312 - DNA, 19 bp, Homo sapiens
ttactattttacttctaga

SEQ ID NO: 2830313 - DNA, 22 bp, Homo sapiens
ttactcagccctgggccccacc

SEQ ID NO: 2830314 - DNA, 22 bp, Homo sapiens
ttactcctttgcattccatgat

SEQ ID NO: 2830315 - DNA, 15 bp, Homo sapiens
ttactgacagaaatg

SEQ ID NO: 2830316 - DNA, 13 bp, Homo sapiens
ttactgagcttct

SEQ ID NO: 2830317 - DNA, 14 bp, Homo sapiens
ttactgagcttctc

SEQ ID NO: 2830318 - DNA, 20 bp, Homo sapiens
ttactgctgtcattgtccat

SEQ ID NO: 2830319 - DNA, 21 bp, Homo sapiens
ttactggtttcagttgacaaa

SEQ ID NO: 2830320 - DNA, 19 bp, Homo sapiens
ttacttcactttaattctc

SEQ ID NO: 2830321 - DNA, 12 bp, Homo sapiens
ttacttgcacaa

SEQ ID NO: 2830322 - DNA, 16 bp, Homo sapiens
ttacttgcacaagctt

SEQ ID NO: 2830323 - DNA, 18 bp, Homo sapiens
ttactttctgttgccaca

SEQ ID NO: 2830324 - DNA, 14 bp, Homo sapiens
ttactttgtgttca

SEQ ID NO: 2830325 - DNA, 17 bp, Homo sapiens
ttacttttaaacagtga

SEQ ID NO: 2830326 - DNA, 23 bp, Homo sapiens
ttagaaacaaatttttttcttgt

SEQ ID NO: 2830327 - DNA, 13 bp, Homo sapiens
ttagaaagttatt

SEQ ID NO: 2830328 - DNA, 16 bp, Homo sapiens
ttagaaagttattgtg

SEQ ID NO: 2830329 - DNA, 22 bp, Homo sapiens
ttagaacaatagctattgcatg

SEQ ID NO: 2830330 - DNA, 13 bp, Homo sapiens
ttagaagtgtttt

SEQ ID NO: 2830331 - DNA, 17 bp, Homo sapiens
ttcccattttgcaaaat

SEQ ID NO: 2830332 - DNA, 11 bp, Homo sapiens
ttccccacaga

SEQ ID NO: 2830333 - DNA, 13 bp, Homo sapiens
ttccccagactca

SEQ ID NO: 2830334 - DNA, 21 bp, Homo sapiens
ttccccagactcagctccaga

SEQ ID NO: 2830335 - DNA, 15 bp, Homo sapiens
ttccccctcccaggg

SEQ ID NO: 2830336 - DNA, 21 bp, Homo sapiens
ttcccctcgctgtcctgctgt

SEQ ID NO: 2830337 - DNA, 23 bp, Homo sapiens
ttccccttgcccagggctcagcc

SEQ ID NO: 2830338 - DNA, 14 bp, Homo sapiens
ttccccttgccctt

SEQ ID NO: 2830339 - DNA, 22 bp, Homo sapiens
ttccccttgcccttgccctgac

SEQ ID NO: 2830340 - DNA, 12 bp, Homo sapiens
ttcccctttcct

SEQ ID NO: 2830341 - DNA, 21 bp, Homo sapiens
ttccctattatttccgggtgg

SEQ ID NO: 2830342 - DNA, 11 bp, Homo sapiens
ttccctctgag

SEQ ID NO: 2830343 - DNA, 12 bp, Homo sapiens
ttccctggcctg

SEQ ID NO: 2830344 - DNA, 23 bp, Homo sapiens
ttccctgggggcagatatttccc

SEQ ID NO: 2830345 - DNA, 17 bp, Homo sapiens
ttccgtgaagggcaccg

SEQ ID NO: 2830346 - DNA, 17 bp, Homo sapiens
ttcctaagtataaatgg

SEQ ID NO: 2830347 - DNA, 14 bp, Homo sapiens
ttcctagtatatta

SEQ ID NO: 2830348 - DNA, 12 bp, Homo sapiens
ttcctattttaa

SEQ ID NO: 2830349 - DNA, 15 bp, Homo sapiens
ttcctattttaaaac

SEQ ID NO: 2830350 - DNA, 21 bp, Homo sapiens
ttcctattttaaaaccatgca

SEQ ID NO: 2830351 - DNA, 15 bp, Homo sapiens
ttcctcaccaataac

SEQ ID NO: 2830352 - DNA, 23 bp, Homo sapiens
ttcctcaccaataacttcagaga

SEQ ID NO: 2830353 - DNA, 15 bp, Homo sapiens
ttcctcagtcctgga

SEQ ID NO: 2830354 - DNA, 18 bp, Homo sapiens
ttcctccgtctgcaatgt

SEQ ID NO: 2830355 - DNA, 17 bp, Homo sapiens
ttcctcctcctttgcct

SEQ ID NO: 2830356 - DNA, 17 bp, Homo sapiens
ttcctgaaagaaacagt

SEQ ID NO: 2830357 - DNA, 18 bp, Homo sapiens
ttcctgaatattaatccc

SEQ ID NO: 2830358 - DNA, 14 bp, Homo sapiens
ttcctgaatgaaat

SEQ ID NO: 2830359 - DNA, 19 bp, Homo sapiens
ttcctgatactgggtacaa

SEQ ID NO: 2830360 - DNA, 12 bp, Homo sapiens
ttcctgcacccg

SEQ ID NO: 2830361 - DNA, 15 bp, Homo sapiens
ttcctgccaccagtc

SEQ ID NO: 2830362 - DNA, 15 bp, Homo sapiens
ttcctggacagctgt

SEQ ID NO: 2830363 - DNA, 20 bp, Homo sapiens
ttcctggacagctgtgcctc

SEQ ID NO: 2830364 - DNA, 24 bp, Homo sapiens
ttcctggacagctgtgcctcgctc

SEQ ID NO: 2830365 - DNA, 14 bp, Homo sapiens
ttcctggcttctta

SEQ ID NO: 2830366 - DNA, 16 bp, Homo sapiens
ttcctgggtggctact

SEQ ID NO: 2830367 - DNA, 17 bp, Homo sapiens
ttcctgggtggctactc

SEQ ID NO: 2830368 - DNA, 23 bp, Homo sapiens
ttcctggtattatttacaatgca

SEQ ID NO: 2830369 - DNA, 22 bp, Homo sapiens
ttcctgtaacacaagccacaga

SEQ ID NO: 2830370 - DNA, 18 bp, Homo sapiens
ttcctgtagcatcttctg

SEQ ID NO: 2830371 - DNA, 22 bp, Homo sapiens
ttcctgtatttgttcccaagag

SEQ ID NO: 2830372 - DNA, 15 bp, Homo sapiens
ttcctgtcccacctc

SEQ ID NO: 2830373 - DNA, 23 bp, Homo sapiens
ttcctgttaggtattagaaagtg

SEQ ID NO: 2830374 - DNA, 20 bp, Homo sapiens
ttcctgttcaccttatgtat

SEQ ID NO: 2830375 - DNA, 21 bp, Homo sapiens
ttcctgttcaccttatgtatt

SEQ ID NO: 2830376 - DNA, 13 bp, Homo sapiens
ttccttccctggc

SEQ ID NO: 2830377 - DNA, 14 bp, Homo sapiens
ttccttccctggct

SEQ ID NO: 2830378 - DNA, 14 bp, Homo sapiens
ttccttccttccct

SEQ ID NO: 2830379 - DNA, 15 bp, Homo sapiens
ttccttgtatttaaa

SEQ ID NO: 2830380 - DNA, 15 bp, Homo sapiens
ttcctttcctctgca

SEQ ID NO: 2830381 - DNA, 21 bp, Homo sapiens
ttcctttcctctgcagcactt

SEQ ID NO: 2830382 - DNA, 12 bp, Homo sapiens
ttcctttctcag

SEQ ID NO: 2830383 - DNA, 22 bp, Homo sapiens
ttcctttgaatcctctctctgt

SEQ ID NO: 2830384 - DNA, 21 bp, Homo sapiens
ttccttttaaaacacttccat

SEQ ID NO: 2830385 - DNA, 17 bp, Homo sapiens
ttccttttgtgtacagt

SEQ ID NO: 2830386 - DNA, 22 bp, Homo sapiens
ttcgaaacctgtccataaagta

SEQ ID NO: 2830387 - DNA, 15 bp, Homo sapiens
ttcgaatgacactgt

SEQ ID NO: 2830388 - DNA, 17 bp, Homo sapiens
ttcgagaccagcctggc

SEQ ID NO: 2830389 - DNA, 16 bp, Homo sapiens
ttcgcagaacatgagt

SEQ ID NO: 2830390 - DNA, 13 bp, Homo sapiens
ttcgcagccaccc

SEQ ID NO: 2830391 - DNA, 18 bp, Homo sapiens
ttcgcagccaccctgagg

SEQ ID NO: 2830392 - DNA, 13 bp, Homo sapiens
ttcggggctggga

SEQ ID NO: 2830393 - DNA, 17 bp, Homo sapiens
ttcgtgcatttgtgagc

SEQ ID NO: 2830394 - DNA, 17 bp, Homo sapiens
ttcgtggtgatcaatta

SEQ ID NO: 2830395 - DNA, 14 bp, Homo sapiens
ttctaaaatgcctt

SEQ ID NO: 2830396 - DNA, 14 bp, Homo sapiens
ttctaaaatgcttt

SEQ ID NO: 2830397 - DNA, 18 bp, Homo sapiens
ttctaaaatgcttttaat

SEQ ID NO: 2830398 - DNA, 16 bp, Homo sapiens
ttctaagattgtacat

SEQ ID NO: 2830399 - DNA, 22 bp, Homo sapiens
ttctaagattgtacatatggaa

SEQ ID NO: 2830400 - DNA, 14 bp, Homo sapiens
ttctaatagaactc

SEQ ID NO: 2830401 - DNA, 18 bp, Homo sapiens
ttctaatagaactcagtt

SEQ ID NO: 2830402 - DNA, 15 bp, Homo sapiens
ttctacaaccagagc

SEQ ID NO: 2830403 - DNA, 13 bp, Homo sapiens
ttctacacagtaa

SEQ ID NO: 2830404 - DNA, 19 bp, Homo sapiens
ttctacacatatatgtata

SEQ ID NO: 2830405 - DNA, 20 bp, Homo sapiens
ttctacccagagccttctcc

SEQ ID NO: 2830406 - DNA, 22 bp, Homo sapiens
ttctacccagagccttctcctg

SEQ ID NO: 2830407 - DNA, 12 bp, Homo sapiens
ttctacccagcg

SEQ ID NO: 2830408 - DNA, 13 bp, Homo sapiens
ttctactgtgact

SEQ ID NO: 2830409 - DNA, 19 bp, Homo sapiens
ttctactttgatatgactg

SEQ ID NO: 2830410 - DNA, 16 bp, Homo sapiens
ttctagccaaactatt

SEQ ID NO: 2830411 - DNA, 14 bp, Homo sapiens
ttctagctttcaaa

SEQ ID NO: 2830412 - DNA, 14 bp, Homo sapiens
ttctaggtaggaaa

SEQ ID NO: 2830413 - DNA, 18 bp, Homo sapiens
ttctaggtaggaaatgtg

SEQ ID NO: 2830414 - DNA, 22 bp, Homo sapiens
ttctagtctcctttgcactgag

SEQ ID NO: 2830415 - DNA, 23 bp, Homo sapiens
ttctagtctcctttgcactgagg

SEQ ID NO: 2830416 - DNA, 19 bp, Homo sapiens
ttctagtctggtgttctga

SEQ ID NO: 2830417 - DNA, 20 bp, Homo sapiens
ttctagttagctgctttaaa

SEQ ID NO: 2830418 - DNA, 14 bp, Homo sapiens
ttctagttgaaaat

SEQ ID NO: 2830419 - DNA, 14 bp, Homo sapiens
ttctatagccaaaa

SEQ ID NO: 2830420 - DNA, 15 bp, Homo sapiens
ttctatagccaaaaa

SEQ ID NO: 2830421 - DNA, 17 bp, Homo sapiens
ttctatagccaaaaata

SEQ ID NO: 2830422 - DNA, 20 bp, Homo sapiens
ttggcaccttcaatacttca

SEQ ID NO: 2830423 - DNA, 15 bp, Homo sapiens
ttggccaaagtgtta

SEQ ID NO: 2830424 - DNA, 23 bp, Homo sapiens
ttggccaatgcacctaaagaaaa

SEQ ID NO: 2830425 - DNA, 14 bp, Homo sapiens
ttggccaggctggt

SEQ ID NO: 2830426 - DNA, 22 bp, Homo sapiens
ttggccgggtgcggtggctcac

SEQ ID NO: 2830427 - DNA, 22 bp, Homo sapiens
ttggccgtggccatcagggtgg

SEQ ID NO: 2830428 - DNA, 23 bp, Homo sapiens
ttggccgtggccatcagggtggg

SEQ ID NO: 2830429 - DNA, 23 bp, Homo sapiens
ttggctattagagatcaacccct

SEQ ID NO: 2830430 - DNA, 12 bp, Homo sapiens
ttggctcaccca

SEQ ID NO: 2830431 - DNA, 14 bp, Homo sapiens
ttggctgcagggag

SEQ ID NO: 2830432 - DNA, 22 bp, Homo sapiens
ttggcttattttttaaaataat

SEQ ID NO: 2830433 - DNA, 18 bp, Homo sapiens
ttgggaatggatcctgga

SEQ ID NO: 2830434 - DNA, 22 bp, Homo sapiens
ttgggagcactggagtgcaggg

SEQ ID NO: 2830435 - DNA, 19 bp, Homo sapiens
ttgggagcttgggaatgga

SEQ ID NO: 2830436 - DNA, 15 bp, Homo sapiens
ttgggaggctgaggc

SEQ ID NO: 2830437 - DNA, 22 bp, Homo sapiens
ttgggatttatatctatagtag

SEQ ID NO: 2830438 - DNA, 23 bp, Homo sapiens
ttgggcacccccagcctgggcct

SEQ ID NO: 2830439 - DNA, 23 bp, Homo sapiens
ttggggagggggaagagaaattt

SEQ ID NO: 2830440 - DNA, 13 bp, Homo sapiens
ttggggtcagcca

SEQ ID NO: 2830441 - DNA, 21 bp, Homo sapiens
ttggggtgtttcaaaagtgga

SEQ ID NO: 2830442 - DNA, 16 bp, Homo sapiens
ttgggtactactgctg

SEQ ID NO: 2830443 - DNA, 14 bp, Homo sapiens
ttgggtaggcggga

SEQ ID NO: 2830444 - DNA, 23 bp, Homo sapiens
ttgggtgtaacaggtctcctctt

SEQ ID NO: 2830445 - DNA, 21 bp, Homo sapiens
ttggtaggcttatcaaaatct

SEQ ID NO: 2830446 - DNA, 16 bp, Homo sapiens
ttggtatcaagaaagt

SEQ ID NO: 2830447 - DNA, 18 bp, Homo sapiens
ttggtgataagtggaaaa

SEQ ID NO: 2830448 - DNA, 20 bp, Homo sapiens
ttggtgcctggcctggcaca

SEQ ID NO: 2830449 - DNA, 22 bp, Homo sapiens
ttggtgcctggcctggcacaca

SEQ ID NO: 2830450 - DNA, 17 bp, Homo sapiens
ttggtgtaattaataaa

SEQ ID NO: 2830451 - DNA, 18 bp, Homo sapiens
ttggtgtggctgtattca

SEQ ID NO: 2830452 - DNA, 21 bp, Homo sapiens
ttggttttgctacataattat

SEQ ID NO: 2830453 - DNA, 15 bp, Homo sapiens
ttggtttttatattt

SEQ ID NO: 2830454 - DNA, 22 bp, Homo sapiens
ttgtaaaaaaggaacacccgga

SEQ ID NO: 2830455 - DNA, 21 bp, Homo sapiens
ttgtaaaagaacagtaaacat

SEQ ID NO: 2830456 - DNA, 22 bp, Homo sapiens
ttgtaaactcaaaatatttgta

SEQ ID NO: 2830457 - DNA, 11 bp, Homo sapiens
ttgtaaataca

SEQ ID NO: 2830458 - DNA, 12 bp, Homo sapiens
ttgtaaatacac

SEQ ID NO: 2830459 - DNA, 21 bp, Homo sapiens
ttgtaaatttggatttacgac

SEQ ID NO: 2830460 - DNA, 21 bp, Homo sapiens
ttgtaagacaaaggttttcct

SEQ ID NO: 2830461 - DNA, 15 bp, Homo sapiens
ttgtaatgtatctta

SEQ ID NO: 2830462 - DNA, 14 bp, Homo sapiens
ttgtaattctaaat

SEQ ID NO: 2830463 - DNA, 17 bp, Homo sapiens
ttgtaattctaaatgaa

SEQ ID NO: 2830464 - DNA, 13 bp, Homo sapiens
ttgtacagaattt

SEQ ID NO: 2830465 - DNA, 16 bp, Homo sapiens
ttgtacagtggagaaa

SEQ ID NO: 2830466 - DNA, 16 bp, Homo sapiens
ttgtaccagtgtgaat

SEQ ID NO: 2830467 - DNA, 11 bp, Homo sapiens
ttgtacctctc

SEQ ID NO: 2830468 - DNA, 14 bp, Homo sapiens
ttgtactatgttaa

SEQ ID NO: 2830469 - DNA, 19 bp, Homo sapiens
ttgtactcttgctttttca

SEQ ID NO: 2830470 - DNA, 22 bp, Homo sapiens
ttgtagaagggttatattttac

SEQ ID NO: 2830471 - DNA, 12 bp, Homo sapiens
ttgtagccagcc

SEQ ID NO: 2830472 - DNA, 12 bp, Homo sapiens
ttgtatatacat

SEQ ID NO: 2830473 - DNA, 20 bp, Homo sapiens
ttgtatattatggaagattt

SEQ ID NO: 2830474 - DNA, 16 bp, Homo sapiens
ttgtatattgtcagat

SEQ ID NO: 2830475 - DNA, 19 bp, Homo sapiens
ttgtatcatttgaacaact

SEQ ID NO: 2830476 - DNA, 22 bp, Homo sapiens
ttgtatgaaagatggctgtgcc

SEQ ID NO: 2830477 - DNA, 19 bp, Homo sapiens
ttgtatgttaagttacttc

SEQ ID NO: 2830478 - DNA, 16 bp, Homo sapiens
ttgtattttccataca

SEQ ID NO: 2830479 - DNA, 18 bp, Homo sapiens
ttgtattttcttcccatt

SEQ ID NO: 2830480 - DNA, 22 bp, Homo sapiens
ttgtattttcttcccatttgta

SEQ ID NO: 2830481 - DNA, 13 bp, Homo sapiens
ttgtatttttgaa

SEQ ID NO: 2830482 - DNA, 18 bp, Homo sapiens
ttgtatttttgaataaaa

SEQ ID NO: 2830483 - DNA, 15 bp, Homo sapiens
ttgtcactagcagct

SEQ ID NO: 2830484 - DNA, 18 bp, Homo sapiens
ttgtcagactttaaagaa

SEQ ID NO: 2830485 - DNA, 18 bp, Homo sapiens
ttgtcagatatgatatgt

SEQ ID NO: 2830486 - DNA, 16 bp, Homo sapiens
ttgtcatatattcatg

SEQ ID NO: 2830487 - DNA, 17 bp, Homo sapiens
ttgtcatatattcatgt

SEQ ID NO: 2830488 - DNA, 20 bp, Homo sapiens
ttgtcatatattcatgtaat

SEQ ID NO: 2830489 - DNA, 21 bp, Homo sapiens
ttgtcatatattcatgtaata

SEQ ID NO: 2830490 - DNA, 21 bp, Homo sapiens
ttgtcatctttcttctatttt

SEQ ID NO: 2830491 - DNA, 13 bp, Homo sapiens
ttgtcatgtggct

SEQ ID NO: 2830492 - DNA, 23 bp, Homo sapiens
ttgtcattactgcctttggaaga

SEQ ID NO: 2830493 - DNA, 21 bp, Homo sapiens
ttgtcattcaagcctgtgaat

SEQ ID NO: 2830494 - DNA, 13 bp, Homo sapiens
ttgtcatttataa

SEQ ID NO: 2830495 - DNA, 22 bp, Homo sapiens
ttgtccatatcagacctctgat

SEQ ID NO: 2830496 - DNA, 15 bp, Homo sapiens
ttgtcccatttcctt

SEQ ID NO: 2830497 - DNA, 19 bp, Homo sapiens
ttgtcccatttccttggag

SEQ ID NO: 2830498 - DNA, 20 bp, Homo sapiens
ttgtctatgggactcaatgc

SEQ ID NO: 2830499 - DNA, 19 bp, Homo sapiens
ttgtctctatgccagctca

SEQ ID NO: 2830500 - DNA, 12 bp, Homo sapiens
ttgtctctgggc

SEQ ID NO: 2830501 - DNA, 11 bp, Homo sapiens
ttgtctgtgca

SEQ ID NO: 2830502 - DNA, 23 bp, Homo sapiens
ttgtctttgtaatgtcaccacct

SEQ ID NO: 2830503 - DNA, 13 bp, Homo sapiens
ttgtgaaagaagg

SEQ ID NO: 2830504 - DNA, 20 bp, Homo sapiens
ttgtgaaattcaacctgtgt

SEQ ID NO: 2830505 - DNA, 23 bp, Homo sapiens
ttgtgatcagaccataatgttac

SEQ ID NO: 2830506 - DNA, 17 bp, Homo sapiens
ttgtgcaatgtaaatat

SEQ ID NO: 2830507 - DNA, 22 bp, Homo sapiens
ttgtgcaatgtaaatattttaa

SEQ ID NO: 2830508 - DNA, 22 bp, Homo sapiens
ttgtgctgatcgtgctaaattt

SEQ ID NO: 2830509 - DNA, 21 bp, Homo sapiens
ttgtggaattgggagcttggg

SEQ ID NO: 2830510 - DNA, 15 bp, Homo sapiens
ttgtgtagattgtgt

SEQ ID NO: 2830511 - DNA, 20 bp, Homo sapiens
ttgtgtagattgtgtaaatt

SEQ ID NO: 2830512 - DNA, 17 bp, Homo sapiens
ttttcctagccctctca

SEQ ID NO: 2830513 - DNA, 22 bp, Homo sapiens
ttttcctgaatattaatcccag

SEQ ID NO: 2830514 - DNA, 17 bp, Homo sapiens
ttttcgtgcatttgtga

SEQ ID NO: 2830515 - DNA, 14 bp, Homo sapiens
ttttctatgcttat

SEQ ID NO: 2830516 - DNA, 13 bp, Homo sapiens
ttttctcctccca

SEQ ID NO: 2830517 - DNA, 14 bp, Homo sapiens
ttttctcctcccag

SEQ ID NO: 2830518 - DNA, 12 bp, Homo sapiens
ttttctctttaa

SEQ ID NO: 2830519 - DNA, 20 bp, Homo sapiens
ttttctgatgacataataaa

SEQ ID NO: 2830520 - DNA, 22 bp, Homo sapiens
ttttctgatgacataataaaga

SEQ ID NO: 2830521 - DNA, 13 bp, Homo sapiens
ttttcttaaagca

SEQ ID NO: 2830522 - DNA, 16 bp, Homo sapiens
ttttcttcatgcaatg

SEQ ID NO: 2830523 - DNA, 22 bp, Homo sapiens
ttttcttcccatttgtaatgta

SEQ ID NO: 2830524 - DNA, 13 bp, Homo sapiens
ttttcttctaaaa

SEQ ID NO: 2830525 - DNA, 21 bp, Homo sapiens
ttttcttgccaatgaggtctg

SEQ ID NO: 2830526 - DNA, 14 bp, Homo sapiens
ttttctttgaaatt

SEQ ID NO: 2830527 - DNA, 12 bp, Homo sapiens
ttttctttgtgt

SEQ ID NO: 2830528 - DNA, 20 bp, Homo sapiens
ttttgaactaataaaagcat

SEQ ID NO: 2830529 - DNA, 18 bp, Homo sapiens
ttttgaagaagggaaatt

SEQ ID NO: 2830530 - DNA, 22 bp, Homo sapiens
ttttgaataaaaaacatttgta

SEQ ID NO: 2830531 - DNA, 19 bp, Homo sapiens
ttttgacagtgttgaaaat

SEQ ID NO: 2830532 - DNA, 15 bp, Homo sapiens
ttttgatagctttat

SEQ ID NO: 2830533 - DNA, 12 bp, Homo sapiens
ttttgattgaag

SEQ ID NO: 2830534 - DNA, 13 bp, Homo sapiens
ttttgcatttatg

SEQ ID NO: 2830535 - DNA, 19 bp, Homo sapiens
ttttgcatttgaataaagc

SEQ ID NO: 2830536 - DNA, 23 bp, Homo sapiens
ttttgccatgttggccaggctgg

SEQ ID NO: 2830537 - DNA, 15 bp, Homo sapiens
ttttgccattaaact

SEQ ID NO: 2830538 - DNA, 15 bp, Homo sapiens
ttttgcctcttttct

SEQ ID NO: 2830539 - DNA, 16 bp, Homo sapiens
ttttgcttaaaatttt

SEQ ID NO: 2830540 - DNA, 16 bp, Homo sapiens
ttttggccaaagtgtt

SEQ ID NO: 2830541 - DNA, 19 bp, Homo sapiens
ttttgtaagttgaagcaaa

SEQ ID NO: 2830542 - DNA, 14 bp, Homo sapiens
ttttgtaataaact

SEQ ID NO: 2830543 - DNA, 13 bp, Homo sapiens
ttttgtacagaat

SEQ ID NO: 2830544 - DNA, 17 bp, Homo sapiens
ttttgtatagtaaagtg

SEQ ID NO: 2830545 - DNA, 22 bp, Homo sapiens
ttttgtcctttgagaaagaaat

SEQ ID NO: 2830546 - DNA, 13 bp, Homo sapiens
ttttgtgtacagt

SEQ ID NO: 2830547 - DNA, 16 bp, Homo sapiens
ttttgttacctttatg

SEQ ID NO: 2830548 - DNA, 15 bp, Homo sapiens
ttttgttctgtattt

SEQ ID NO: 2830549 - DNA, 11 bp, Homo sapiens
ttttgttttct

SEQ ID NO: 2830550 - DNA, 23 bp, Homo sapiens
tttttaaaaaagcttaaaacttt

SEQ ID NO: 2830551 - DNA, 19 bp, Homo sapiens
tttttaaaaagttgcacat

SEQ ID NO: 2830552 - DNA, 23 bp, Homo sapiens
tttttaaaaatcataaactgtgt

SEQ ID NO: 2830553 - DNA, 14 bp, Homo sapiens
tttttaaaataatt

SEQ ID NO: 2830554 - DNA, 18 bp, Homo sapiens
tttttaagctgtttccat

SEQ ID NO: 2830555 - DNA, 16 bp, Homo sapiens
tttttaagtatttata

SEQ ID NO: 2830556 - DNA, 14 bp, Homo sapiens
tttttaatcattta

SEQ ID NO: 2830557 - DNA, 12 bp, Homo sapiens
tttttaattatt

SEQ ID NO: 2830558 - DNA, 22 bp, Homo sapiens
tttttacctaccacagtgtctg

SEQ ID NO: 2830559 - DNA, 22 bp, Homo sapiens
tttttagacagagtctcactgt

SEQ ID NO: 2830560 - DNA, 17 bp, Homo sapiens
tttttatacatatcaga

SEQ ID NO: 2830561 - DNA, 20 bp, Homo sapiens
tttttatacatatcagaaaa

SEQ ID NO: 2830562 - DNA, 15 bp, Homo sapiens
tttttatttccacat

SEQ ID NO: 2830563 - DNA, 19 bp, Homo sapiens
tttttcaaaaattacacta

SEQ ID NO: 2830564 - DNA, 14 bp, Homo sapiens
tttttcaaccagca

SEQ ID NO: 2830565 - DNA, 15 bp, Homo sapiens
tttttccgtaaaaat

SEQ ID NO: 2830566 - DNA, 16 bp, Homo sapiens
tttttccgtaaaaatg

SEQ ID NO: 2830567 - DNA, 18 bp, Homo sapiens
tttttccttcaaagttta

SEQ ID NO: 2830568 - DNA, 19 bp, Homo sapiens
tttttccttcaaagtttaa

SEQ ID NO: 2830569 - DNA, 17 bp, Homo sapiens
tttttctttataaactt

SEQ ID NO: 2830570 - DNA, 17 bp, Homo sapiens
tttttgaaaaagcgaaa

SEQ ID NO: 2830571 - DNA, 18 bp, Homo sapiens
tttttgatggtaagactg

SEQ ID NO: 2830572 - DNA, 19 bp, Homo sapiens
tttttgtagagccagggtc

SEQ ID NO: 2830573 - DNA, 17 bp, Homo sapiens
ttttttaacacataact

SEQ ID NO: 2830574 - DNA, 12 bp, Homo sapiens
ttttttgaaaac

SEQ ID NO: 2830575 - DNA, 13 bp, Homo sapiens
tttttttgctggt

SEQ ID NO: 2830576 - DNA, 19 bp, Homo sapiens
tccacaagattcccagaga

SEQ ID NO: 2830577 - DNA, 22 bp, Homo sapiens
tccacacacagaggaagagcag

SEQ ID NO: 2830578 - DNA, 19 bp, Homo sapiens
tccacagcggaggagacca

SEQ ID NO: 2830579 - DNA, 22 bp, Homo sapiens
tccacaggagggagagaactta

SEQ ID NO: 2830580 - DNA, 15 bp, Homo sapiens
tccacagtctctggg

SEQ ID NO: 2830581 - DNA, 12 bp, Homo sapiens
tccacataaagg

SEQ ID NO: 2830582 - DNA, 14 bp, Homo sapiens
tccacataaaggta

SEQ ID NO: 2830583 - DNA, 17 bp, Homo sapiens
tccaccattcacatttg

SEQ ID NO: 2830584 - DNA, 17 bp, Homo sapiens
tccacccacctcagcct

SEQ ID NO: 2830585 - DNA, 18 bp, Homo sapiens
tccacccacctcagcctc

SEQ ID NO: 2830586 - DNA, 12 bp, Homo sapiens
tccacccagccc

SEQ ID NO: 2830587 - DNA, 17 bp, Homo sapiens
tccacccagcccattct

SEQ ID NO: 2830588 - DNA, 20 bp, Homo sapiens
tccacccaggagccccgagg

SEQ ID NO: 2830589 - DNA, 13 bp, Homo sapiens
tccaccccaggac

SEQ ID NO: 2830590 - DNA, 18 bp, Homo sapiens
tccccaggtggctgaccc

SEQ ID NO: 2830591 - DNA, 20 bp, Homo sapiens
tccccaggtggctgacccag

SEQ ID NO: 2830592 - DNA, 12 bp, Homo sapiens
tccccagtgtgg

SEQ ID NO: 2830593 - DNA, 23 bp, Homo sapiens
tccccagtgtggccccagcccga

SEQ ID NO: 2830594 - DNA, 17 bp, Homo sapiens
tccccagtttgcagaaa

SEQ ID NO: 2830595 - DNA, 21 bp, Homo sapiens
tccccattagagtcagccttc

SEQ ID NO: 2830596 - DNA, 14 bp, Homo sapiens
tccccattcttcct

SEQ ID NO: 2830597 - DNA, 17 bp, Homo sapiens
tcccccaccacactgaa

SEQ ID NO: 2830598 - DNA, 20 bp, Homo sapiens
tcccccaccccctccccagg

SEQ ID NO: 2830599 - DNA, 21 bp, Homo sapiens
tcccccaccccctccccaggg

SEQ ID NO: 2830600 - DNA, 12 bp, Homo sapiens
tccccccagccc

SEQ ID NO: 2830601 - DNA, 22 bp, Homo sapiens
tccccccagcccctcctcccct

SEQ ID NO: 2830602 - DNA, 16 bp, Homo sapiens
tcccccgctggcagcc

SEQ ID NO: 2830603 - DNA, 13 bp, Homo sapiens
tccccctgcttct

SEQ ID NO: 2830604 - DNA, 22 bp, Homo sapiens
tccccctgggctctgccccagc

SEQ ID NO: 2830605 - DNA, 16 bp, Homo sapiens
tccccggactcaagcc

SEQ ID NO: 2830606 - DNA, 15 bp, Homo sapiens
tccccgggggaggaa

SEQ ID NO: 2830607 - DNA, 20 bp, Homo sapiens
tccccgtgccccgcctcccc

SEQ ID NO: 2830608 - DNA, 21 bp, Homo sapiens
tcccctatccacccagcccat

SEQ ID NO: 2830609 - DNA, 18 bp, Homo sapiens
tcccctcgctgtcctgct

SEQ ID NO: 2830610 - DNA, 20 bp, Homo sapiens
tcccctgacctcacctttgc

SEQ ID NO: 2830611 - DNA, 20 bp, Homo sapiens
tcccctggaactgtctctca

SEQ ID NO: 2830612 - DNA, 15 bp, Homo sapiens
tccccttcctgcacc

SEQ ID NO: 2830613 - DNA, 16 bp, Homo sapiens
tccccttcctgcaccc

SEQ ID NO: 2830614 - DNA, 13 bp, Homo sapiens
tccccttgcccag

SEQ ID NO: 2830615 - DNA, 17 bp, Homo sapiens
tccccttgcccagggct

SEQ ID NO: 2830616 - DNA, 20 bp, Homo sapiens
tccccttgcccagggctcag

SEQ ID NO: 2830617 - DNA, 14 bp, Homo sapiens
tccccttgcccttg

SEQ ID NO: 2830618 - DNA, 18 bp, Homo sapiens
tccccttgcccttgccct

SEQ ID NO: 2830619 - DNA, 21 bp, Homo sapiens
tccccttgcccttgccctgac

SEQ ID NO: 2830620 - DNA, 23 bp, Homo sapiens
tccccttgcccttgccctgacct

SEQ ID NO: 2830621 - DNA, 12 bp, Homo sapiens
tcccctttcctc

SEQ ID NO: 2830622 - DNA, 13 bp, Homo sapiens
tcccctttcctcc

SEQ ID NO: 2830623 - DNA, 18 bp, Homo sapiens
tcccgagtagctgggact

SEQ ID NO: 2830624 - DNA, 20 bp, Homo sapiens
tcccgagtagctgggactac

SEQ ID NO: 2830625 - DNA, 18 bp, Homo sapiens
tcccgcaccaggccgggc

SEQ ID NO: 2830626 - DNA, 21 bp, Homo sapiens
tcccggctgggtgggcctggc

SEQ ID NO: 2830627 - DNA, 18 bp, Homo sapiens
tcccgggagaggagatca

SEQ ID NO: 2830628 - DNA, 15 bp, Homo sapiens
tccctaatcctccaa

SEQ ID NO: 2830629 - DNA, 15 bp, Homo sapiens
tccctacttcctgtg

SEQ ID NO: 2830630 - DNA, 16 bp, Homo sapiens
tccctacttcctgtga

SEQ ID NO: 2830631 - DNA, 18 bp, Homo sapiens
tccctagctgtgacctct

SEQ ID NO: 2830632 - DNA, 10 bp, Homo sapiens
tccctcaccc

SEQ ID NO: 2830633 - DNA, 12 bp, Homo sapiens
tccctcaccccc

SEQ ID NO: 2830634 - DNA, 15 bp, Homo sapiens
tccctcaccccctcc

SEQ ID NO: 2830635 - DNA, 17 bp, Homo sapiens
tccctcaccccctccca

SEQ ID NO: 2830636 - DNA, 16 bp, Homo sapiens
tccctcactgccttcc

SEQ ID NO: 2830637 - DNA, 16 bp, Homo sapiens
tccctcagtgccctca

SEQ ID NO: 2830638 - DNA, 18 bp, Homo sapiens
tccctccaccccaggacg

SEQ ID NO: 2830639 - DNA, 14 bp, Homo sapiens
tccctccagctgga

SEQ ID NO: 2830640 - DNA, 13 bp, Homo sapiens
tccctctcccagg

SEQ ID NO: 2830641 - DNA, 14 bp, Homo sapiens
tccctctcctgcct

SEQ ID NO: 2830642 - DNA, 12 bp, Homo sapiens
tccctctcggaa

SEQ ID NO: 2830643 - DNA, 13 bp, Homo sapiens
tccctctgacctg

SEQ ID NO: 2830644 - DNA, 19 bp, Homo sapiens
tccctctggcactccagaa

SEQ ID NO: 2830645 - DNA, 18 bp, Homo sapiens
tccctctggccctgcctt

SEQ ID NO: 2830646 - DNA, 20 bp, Homo sapiens
tccctctggccctgccttct

SEQ ID NO: 2830647 - DNA, 19 bp, Homo sapiens
tccctctttctttcttttg

SEQ ID NO: 2830648 - DNA, 16 bp, Homo sapiens
tccctgaaaacccaga

SEQ ID NO: 2830649 - DNA, 17 bp, Homo sapiens
tccctgaacatctgtgt

SEQ ID NO: 2830650 - DNA, 18 bp, Homo sapiens
tccctgaacatctgtgtg

SEQ ID NO: 2830651 - DNA, 21 bp, Homo sapiens
tccctgacctccctctaattt

SEQ ID NO: 2830652 - DNA, 16 bp, Homo sapiens
tccctgactctctgtg

SEQ ID NO: 2830653 - DNA, 18 bp, Homo sapiens
tccctgactctctgtgac

SEQ ID NO: 2830654 - DNA, 21 bp, Homo sapiens
tccctgagaaacccaccagcc

SEQ ID NO: 2830655 - DNA, 16 bp, Homo sapiens
tccctgagtcaccagg

SEQ ID NO: 2830656 - DNA, 17 bp, Homo sapiens
tccctgagtcaccagga

SEQ ID NO: 2830657 - DNA, 21 bp, Homo sapiens
tccctgagtcaccaggaatgt

SEQ ID NO: 2830658 - DNA, 13 bp, Homo sapiens
tccctgcacttgc

SEQ ID NO: 2830659 - DNA, 21 bp, Homo sapiens
tccctgccacactcagtcccc

SEQ ID NO: 2830660 - DNA, 17 bp, Homo sapiens
tccctgccctgtcctcc

SEQ ID NO: 2830661 - DNA, 18 bp, Homo sapiens
tccctggctctcagaagg

SEQ ID NO: 2830662 - DNA, 18 bp, Homo sapiens
tccctggcttgtaactcc

SEQ ID NO: 2830663 - DNA, 21 bp, Homo sapiens
tccctgggaaaggggttgtca

SEQ ID NO: 2830664 - DNA, 16 bp, Homo sapiens
tccctgggcagaaagt

SEQ ID NO: 2830665 - DNA, 13 bp, Homo sapiens
tccctgggcctgc

SEQ ID NO: 2830666 - DNA, 14 bp, Homo sapiens
tccctgggcctgct

SEQ ID NO: 2830667 - DNA, 15 bp, Homo sapiens
tccctgggcctgctg

SEQ ID NO: 2830668 - DNA, 17 bp, Homo sapiens
tccctgggcctgctgct

SEQ ID NO: 2830669 - DNA, 20 bp, Homo sapiens
tccctgggcctgctgctgag

SEQ ID NO: 2830670 - DNA, 21 bp, Homo sapiens
tccctggtaataagtactgtg

SEQ ID NO: 2830671 - DNA, 15 bp, Homo sapiens
tccctgtcctcctcg

SEQ ID NO: 2830672 - DNA, 21 bp, Homo sapiens
tcccttaatatcctaaacatc

SEQ ID NO: 2830673 - DNA, 17 bp, Homo sapiens
tcccttgagacctcagc

SEQ ID NO: 2830674 - DNA, 18 bp, Homo sapiens
tcccttgagacctcagcc

SEQ ID NO: 2830675 - DNA, 22 bp, Homo sapiens
tcccttggatgtagtctgaggc

SEQ ID NO: 2830676 - DNA, 23 bp, Homo sapiens
tcccttgtacctatggctgcctg

SEQ ID NO: 2830677 - DNA, 19 bp, Homo sapiens
tccgaagaccttctgaaga

SEQ ID NO: 2830678 - DNA, 17 bp, Homo sapiens
tccgactcttctgagca

SEQ ID NO: 2830679 - DNA, 18 bp, Homo sapiens
tccgatgacagtgctcta

SEQ ID NO: 2830680 - DNA, 16 bp, Homo sapiens
tccgccccagacacac

SEQ ID NO: 2830681 - DNA, 21 bp, Homo sapiens
tcgattagactggacagcttg

SEQ ID NO: 2830682 - DNA, 10 bp, Homo sapiens
tcgcagccac

SEQ ID NO: 2830683 - DNA, 12 bp, Homo sapiens
tcgcagccaccc

SEQ ID NO: 2830684 - DNA, 20 bp, Homo sapiens
tcgcagccaccctgaggagt

SEQ ID NO: 2830685 - DNA, 10 bp, Homo sapiens
tcgccacacc

SEQ ID NO: 2830686 - DNA, 23 bp, Homo sapiens
tcgccacacccggctccccctgc

SEQ ID NO: 2830687 - DNA, 19 bp, Homo sapiens
tcgcccagtctggaatgca

SEQ ID NO: 2830688 - DNA, 23 bp, Homo sapiens
tcgcccagtctggaatgcagtgg

SEQ ID NO: 2830689 - DNA, 15 bp, Homo sapiens
tcgccccagatcacc

SEQ ID NO: 2830690 - DNA, 15 bp, Homo sapiens
tcgccgtctgtgaat

SEQ ID NO: 2830691 - DNA, 14 bp, Homo sapiens
tcgctccccactct

SEQ ID NO: 2830692 - DNA, 20 bp, Homo sapiens
tcgctccccactctgctctg

SEQ ID NO: 2830693 - DNA, 12 bp, Homo sapiens
tcgctcctgtgt

SEQ ID NO: 2830694 - DNA, 17 bp, Homo sapiens
tcgctctgctggcctgg

SEQ ID NO: 2830695 - DNA, 20 bp, Homo sapiens
tcgctctgctggcctggccg

SEQ ID NO: 2830696 - DNA, 21 bp, Homo sapiens
tcgctctgctggcctggccgg

SEQ ID NO: 2830697 - DNA, 16 bp, Homo sapiens
tcgctgccttgccatg

SEQ ID NO: 2830698 - DNA, 17 bp, Homo sapiens
tcgctggacaacccaga

SEQ ID NO: 2830699 - DNA, 18 bp, Homo sapiens
tcgctggacaacccagaa

SEQ ID NO: 2830700 - DNA, 16 bp, Homo sapiens
tcgctgtggttgtttt

SEQ ID NO: 2830701 - DNA, 22 bp, Homo sapiens
tcggaagcagtgccttccataa

SEQ ID NO: 2830702 - DNA, 23 bp, Homo sapiens
tcggaagcagtgccttccataat

SEQ ID NO: 2830703 - DNA, 15 bp, Homo sapiens
tcggagacagtgatc

SEQ ID NO: 2830704 - DNA, 23 bp, Homo sapiens
tcggagagggctgcgagcatttc

SEQ ID NO: 2830705 - DNA, 22 bp, Homo sapiens
tcggagcctcatccgaggcagg

SEQ ID NO: 2830706 - DNA, 20 bp, Homo sapiens
tcggatctggggctctggga

SEQ ID NO: 2830707 - DNA, 12 bp, Homo sapiens
tcggcccacagc

SEQ ID NO: 2830708 - DNA, 15 bp, Homo sapiens
tcgggagcagtgtct

SEQ ID NO: 2830709 - DNA, 16 bp, Homo sapiens
tcgggagcagtgtctt

SEQ ID NO: 2830710 - DNA, 19 bp, Homo sapiens
tcgggagcagtgtcttcca

SEQ ID NO: 2830711 - DNA, 22 bp, Homo sapiens
tcgggagcagtgtcttccataa

SEQ ID NO: 2830712 - DNA, 13 bp, Homo sapiens
tcgggaggctgag

SEQ ID NO: 2830713 - DNA, 14 bp, Homo sapiens
tcgggaggctgagg

SEQ ID NO: 2830714 - DNA, 13 bp, Homo sapiens
tcgggagggtgga

SEQ ID NO: 2830715 - DNA, 16 bp, Homo sapiens
tcggggaactcctgga

SEQ ID NO: 2830716 - DNA, 17 bp, Homo sapiens
tcggggcgacccctcag

SEQ ID NO: 2830717 - DNA, 20 bp, Homo sapiens
tcggggcgacccctcagtgc

SEQ ID NO: 2830718 - DNA, 21 bp, Homo sapiens
tcggtaagttgaatggcctgc

SEQ ID NO: 2830719 - DNA, 12 bp, Homo sapiens
tcggtggccatg

SEQ ID NO: 2830720 - DNA, 15 bp, Homo sapiens
tcggttccacgtccc

SEQ ID NO: 2830721 - DNA, 18 bp, Homo sapiens
tcgtcctccccctgccag

SEQ ID NO: 2830722 - DNA, 18 bp, Homo sapiens
tcgtgcctataaatagta

SEQ ID NO: 2830723 - DNA, 18 bp, Homo sapiens
tcgtgctaaattttcagt

SEQ ID NO: 2830724 - DNA, 12 bp, Homo sapiens
tcgtggacacct

SEQ ID NO: 2830725 - DNA, 15 bp, Homo sapiens
tcgtggacacctgcc

SEQ ID NO: 2830726 - DNA, 16 bp, Homo sapiens
tcgtggacacctgccc

SEQ ID NO: 2830727 - DNA, 19 bp, Homo sapiens
tcgtggacacctgccctgc

SEQ ID NO: 2830728 - DNA, 20 bp, Homo sapiens
tcgtggacacctgccctgcc

SEQ ID NO: 2830729 - DNA, 22 bp, Homo sapiens
tcgtggcagataatcagcctct

SEQ ID NO: 2830730 - DNA, 13 bp, Homo sapiens
tcgtgtttacaaa

SEQ ID NO: 2830731 - DNA, 18 bp, Homo sapiens
tcgttagaggagcaacag

SEQ ID NO: 2830732 - DNA, 19 bp, Homo sapiens
tcgttagtatctaacatgt

SEQ ID NO: 2830733 - DNA, 15 bp, Homo sapiens
tcgttatgtgtgtat

SEQ ID NO: 2830734 - DNA, 21 bp, Homo sapiens
tcgttcctatacatttctgtt

SEQ ID NO: 2830735 - DNA, 14 bp, Homo sapiens
tcgttttttacaaa

SEQ ID NO: 2830736 - DNA, 12 bp, Homo sapiens
tctaaaaataaa

SEQ ID NO: 2830737 - DNA, 17 bp, Homo sapiens
tctaaaaataaaatgat

SEQ ID NO: 2830738 - DNA, 20 bp, Homo sapiens
tctaaacccaaataaatgtg

SEQ ID NO: 2830739 - DNA, 23 bp, Homo sapiens
tctaaacccaaataaatgtgtaa

SEQ ID NO: 2830740 - DNA, 19 bp, Homo sapiens
tctaaagctggtttaatgt

SEQ ID NO: 2830741 - DNA, 19 bp, Homo sapiens
tctaaagttgttcacatat

SEQ ID NO: 2830742 - DNA, 21 bp, Homo sapiens
tctaaatgttggaattttcaa

SEQ ID NO: 2830743 - DNA, 22 bp, Homo sapiens
tctaacccccagtgccacagag

SEQ ID NO: 2830744 - DNA, 14 bp, Homo sapiens
tctaacgcctgagc

SEQ ID NO: 2830745 - DNA, 19 bp, Homo sapiens
tctaactagaaatctgcca

SEQ ID NO: 2830746 - DNA, 17 bp, Homo sapiens
tctaagcctttccataa

SEQ ID NO: 2830747 - DNA, 12 bp, Homo sapiens
tctaagctgcag

SEQ ID NO: 2830748 - DNA, 14 bp, Homo sapiens
tctaagctgcagct

SEQ ID NO: 2830749 - DNA, 19 bp, Homo sapiens
tctaagctgcagcttcctg

SEQ ID NO: 2830750 - DNA, 22 bp, Homo sapiens
tctaagtctccaagaatacaga

SEQ ID NO: 2830751 - DNA, 18 bp, Homo sapiens
tctaagttaatttaaagt

SEQ ID NO: 2830752 - DNA, 17 bp, Homo sapiens
tctaatacctctgtgtg

SEQ ID NO: 2830753 - DNA, 14 bp, Homo sapiens
tctaatatgtaaca

SEQ ID NO: 2830754 - DNA, 15 bp, Homo sapiens
tctaatcaggttgtt

SEQ ID NO: 2830755 - DNA, 20 bp, Homo sapiens
tctaattggaagaaattcct

SEQ ID NO: 2830756 - DNA, 13 bp, Homo sapiens
tctaatttataca

SEQ ID NO: 2830757 - DNA, 15 bp, Homo sapiens
tctaatttatacaaa

SEQ ID NO: 2830758 - DNA, 22 bp, Homo sapiens
tctaatttatcttgtctctggg

SEQ ID NO: 2830759 - DNA, 23 bp, Homo sapiens
tctaatttatcttgtctctgggc

SEQ ID NO: 2830760 - DNA, 16 bp, Homo sapiens
tctacaaccagagccc

SEQ ID NO: 2830761 - DNA, 17 bp, Homo sapiens
tctacacagcctggact

SEQ ID NO: 2830762 - DNA, 21 bp, Homo sapiens
tctacacagcctggactttgg

SEQ ID NO: 2830763 - DNA, 18 bp, Homo sapiens
tctacacagtaaaaactt

SEQ ID NO: 2830764 - DNA, 21 bp, Homo sapiens
tctacacatatatgtatatgt

SEQ ID NO: 2830765 - DNA, 16 bp, Homo sapiens
tctacatattctttaa

SEQ ID NO: 2830766 - DNA, 22 bp, Homo sapiens
tctacccagagccttctcctgc

SEQ ID NO: 2830767 - DNA, 15 bp, Homo sapiens
tctacccatattaca

SEQ ID NO: 2830768 - DNA, 17 bp, Homo sapiens
tctacccggcccagaga

SEQ ID NO: 2830769 - DNA, 16 bp, Homo sapiens
tctacgttatgaaaac

SEQ ID NO: 2830770 - DNA, 15 bp, Homo sapiens
tctactaaaaataca

SEQ ID NO: 2830771 - DNA, 20 bp, Homo sapiens
tctactaaaaatacaaaaat

SEQ ID NO: 2830772 - DNA, 17 bp, Homo sapiens
tctgcctgcccaggccc

SEQ ID NO: 2830773 - DNA, 15 bp, Homo sapiens
tctgcgtctgtgttg

SEQ ID NO: 2830774 - DNA, 17 bp, Homo sapiens
tctgctcacatatctgt

SEQ ID NO: 2830775 - DNA, 19 bp, Homo sapiens
tctgctcacatatctgtca

SEQ ID NO: 2830776 - DNA, 18 bp, Homo sapiens
tctgctcagatagaatga

SEQ ID NO: 2830777 - DNA, 12 bp, Homo sapiens
tctgctcctctc

SEQ ID NO: 2830778 - DNA, 13 bp, Homo sapiens
tctgctcctctcc

SEQ ID NO: 2830779 - DNA, 14 bp, Homo sapiens
tctgctcctctcca

SEQ ID NO: 2830780 - DNA, 15 bp, Homo sapiens
tctgctcctctccag

SEQ ID NO: 2830781 - DNA, 20 bp, Homo sapiens
tctgctctgaggcttccaga

SEQ ID NO: 2830782 - DNA, 14 bp, Homo sapiens
tctgctcttgcctg

SEQ ID NO: 2830783 - DNA, 13 bp, Homo sapiens
tctgctgaaggaa

SEQ ID NO: 2830784 - DNA, 18 bp, Homo sapiens
tctgctgacagacacagg

SEQ ID NO: 2830785 - DNA, 19 bp, Homo sapiens
tctgctgacagacacaggc

SEQ ID NO: 2830786 - DNA, 20 bp, Homo sapiens
tctgctgacagacacaggcc

SEQ ID NO: 2830787 - DNA, 21 bp, Homo sapiens
tctgctgacagacacaggccc

SEQ ID NO: 2830788 - DNA, 21 bp, Homo sapiens
tctgctgccccgcttccccac

SEQ ID NO: 2830789 - DNA, 22 bp, Homo sapiens
tctgctgccccgcttccccaca

SEQ ID NO: 2830790 - DNA, 14 bp, Homo sapiens
tctgctgcccctgc

SEQ ID NO: 2830791 - DNA, 18 bp, Homo sapiens
tctgctggataaaatgag

SEQ ID NO: 2830792 - DNA, 22 bp, Homo sapiens
tctgctggataaaatgaggttc

SEQ ID NO: 2830793 - DNA, 17 bp, Homo sapiens
tctgctggcctggatct

SEQ ID NO: 2830794 - DNA, 18 bp, Homo sapiens
tctgctggcctggatctc

SEQ ID NO: 2830795 - DNA, 16 bp, Homo sapiens
tctgctggcctggccg

SEQ ID NO: 2830796 - DNA, 14 bp, Homo sapiens
tctgcttcagcctc

SEQ ID NO: 2830797 - DNA, 15 bp, Homo sapiens
tctggaaaactcagg

SEQ ID NO: 2830798 - DNA, 15 bp, Homo sapiens
tctggaaaagcactt

SEQ ID NO: 2830799 - DNA, 16 bp, Homo sapiens
tctggaaaagcacttt

SEQ ID NO: 2830800 - DNA, 20 bp, Homo sapiens
tctggaagagaggaatgcct

SEQ ID NO: 2830801 - DNA, 16 bp, Homo sapiens
tctggaatgtaatcaa

SEQ ID NO: 2830802 - DNA, 14 bp, Homo sapiens
tctggacaggcatg

SEQ ID NO: 2830803 - DNA, 18 bp, Homo sapiens
tctggactcctctgtcca

SEQ ID NO: 2830804 - DNA, 15 bp, Homo sapiens
tctggagaagcagtg

SEQ ID NO: 2830805 - DNA, 22 bp, Homo sapiens
tctggagaagcagtgagccgca

SEQ ID NO: 2830806 - DNA, 16 bp, Homo sapiens
tctggagcccttgggt

SEQ ID NO: 2830807 - DNA, 15 bp, Homo sapiens
tctggagctgctgtt

SEQ ID NO: 2830808 - DNA, 19 bp, Homo sapiens
tctggagtctccagtggtt

SEQ ID NO: 2830809 - DNA, 22 bp, Homo sapiens
tctggatctatctgtattttca

SEQ ID NO: 2830810 - DNA, 23 bp, Homo sapiens
tctggatctatctgtattttcat

SEQ ID NO: 2830811 - DNA, 19 bp, Homo sapiens
tctggatggcaccagaggc

SEQ ID NO: 2830812 - DNA, 19 bp, Homo sapiens
tctggcagggtgggatgga

SEQ ID NO: 2830813 - DNA, 14 bp, Homo sapiens
tctggccctgcctt

SEQ ID NO: 2830814 - DNA, 16 bp, Homo sapiens
tctggccctgccttct

SEQ ID NO: 2830815 - DNA, 14 bp, Homo sapiens
tctggctgctgtat

SEQ ID NO: 2830816 - DNA, 22 bp, Homo sapiens
tctggcttccaggtatctccag

SEQ ID NO: 2830817 - DNA, 14 bp, Homo sapiens
tctgggacacagtt

SEQ ID NO: 2830818 - DNA, 16 bp, Homo sapiens
tctgggaccctttcct

SEQ ID NO: 2830819 - DNA, 19 bp, Homo sapiens
tctgggaggctggtctccc

SEQ ID NO: 2830820 - DNA, 22 bp, Homo sapiens
tctgggaggctggtctccctcc

SEQ ID NO: 2830821 - DNA, 23 bp, Homo sapiens
tctgggaggctggtctccctcca

SEQ ID NO: 2830822 - DNA, 18 bp, Homo sapiens
tctgggataagtaagttt

SEQ ID NO: 2830823 - DNA, 17 bp, Homo sapiens
tctgggctgctacccag

SEQ ID NO: 2830824 - DNA, 22 bp, Homo sapiens
tctgggctgctacccagaaatc

SEQ ID NO: 2830825 - DNA, 16 bp, Homo sapiens
tctggggctctgggat

SEQ ID NO: 2830826 - DNA, 16 bp, Homo sapiens
tctggggttcagcccc

SEQ ID NO: 2830827 - DNA, 17 bp, Homo sapiens
tctggggttcagcccct

SEQ ID NO: 2830828 - DNA, 19 bp, Homo sapiens
tctggggttcagcccctcc

SEQ ID NO: 2830829 - DNA, 21 bp, Homo sapiens
tctggggttcagcccctcctc

SEQ ID NO: 2830830 - DNA, 23 bp, Homo sapiens
tctggggttcagcccctcctctg

SEQ ID NO: 2830831 - DNA, 20 bp, Homo sapiens
tctggtagatttttaacgaa

SEQ ID NO: 2830832 - DNA, 21 bp, Homo sapiens
tctggtgttctcaatgctttt

SEQ ID NO: 2830833 - DNA, 14 bp, Homo sapiens
tctgtaaggaactg

SEQ ID NO: 2830834 - DNA, 16 bp, Homo sapiens
tctgtaaggaactgga

SEQ ID NO: 2830835 - DNA, 13 bp, Homo sapiens
tctgtacacgtgt

SEQ ID NO: 2830836 - DNA, 12 bp, Homo sapiens
tctgtactgtaa

SEQ ID NO: 2830837 - DNA, 15 bp, Homo sapiens
tctgtagggctggac

SEQ ID NO: 2830838 - DNA, 18 bp, Homo sapiens
tctgtatcggagacagtg

SEQ ID NO: 2830839 - DNA, 19 bp, Homo sapiens
tctgtatcggagacagtga

SEQ ID NO: 2830840 - DNA, 14 bp, Homo sapiens
tctgtattttcatt

SEQ ID NO: 2830841 - DNA, 23 bp, Homo sapiens
tctgtcatttgagcagggctcag

SEQ ID NO: 2830842 - DNA, 12 bp, Homo sapiens
tctgtccaagga

SEQ ID NO: 2830843 - DNA, 24 bp, Homo sapiens
tctgtccaggcactgctgcccagc

SEQ ID NO: 2830844 - DNA, 15 bp, Homo sapiens
tctgtccagtttcca

SEQ ID NO: 2830845 - DNA, 17 bp, Homo sapiens
tctgtccctcactgcct

SEQ ID NO: 2830846 - DNA, 22 bp, Homo sapiens
tctgtccctcactgccttccag

SEQ ID NO: 2830847 - DNA, 12 bp, Homo sapiens
tctgtccctctt

SEQ ID NO: 2830848 - DNA, 17 bp, Homo sapiens
tctgtccctctttgcct

SEQ ID NO: 2830849 - DNA, 14 bp, Homo sapiens
tctgtcctactctg

SEQ ID NO: 2830850 - DNA, 21 bp, Homo sapiens
tctgtccttttggcactgaga

SEQ ID NO: 2830851 - DNA, 14 bp, Homo sapiens
tctgtcgcccagtc

SEQ ID NO: 2830852 - DNA, 14 bp, Homo sapiens
tctgtctgtcccaa

SEQ ID NO: 2830853 - DNA, 16 bp, Homo sapiens
tctgtcttgccagcca

SEQ ID NO: 2830854 - DNA, 17 bp, Homo sapiens
tctgtgaacgatttaga

SEQ ID NO: 2830855 - DNA, 14 bp, Homo sapiens
tctgtgaagaatga

SEQ ID NO: 2830856 - DNA, 20 bp, Homo sapiens
tctgtgaagaatgaagtgga

SEQ ID NO: 2830857 - DNA, 17 bp, Homo sapiens
tctgtgccagagcctgg

SEQ ID NO: 2830858 - DNA, 23 bp, Homo sapiens
tctgtgccagagcctggggctct

SEQ ID NO: 2830859 - DNA, 15 bp, Homo sapiens
tctgtgcccctgtaa

SEQ ID NO: 2830860 - DNA, 16 bp, Homo sapiens
tctgtggaaatgacag

SEQ ID NO: 2830861 - DNA, 22 bp, Homo sapiens
tctgtggagagtgagaataatt

SEQ ID NO: 2830862 - DNA, 21 bp, Homo sapiens
tctgtggcttcccatgtcttt

SEQ ID NO: 2830863 - DNA, 16 bp, Homo sapiens
tgaaatctcagaattc

SEQ ID NO: 2830864 - DNA, 19 bp, Homo sapiens
tgaaatctcagaattcctt

SEQ ID NO: 2830865 - DNA, 21 bp, Homo sapiens
tgaaatgaggtcagagcctgc

SEQ ID NO: 2830866 - DNA, 16 bp, Homo sapiens
tgaaatggaggtcctt

SEQ ID NO: 2830867 - DNA, 21 bp, Homo sapiens
tgaaattcaacctgtgtctta

SEQ ID NO: 2830868 - DNA, 22 bp, Homo sapiens
tgaaattgtctagcagagcagg

SEQ ID NO: 2830869 - DNA, 18 bp, Homo sapiens
tgaaattgtttaagtgtt

SEQ ID NO: 2830870 - DNA, 23 bp, Homo sapiens
tgaaattgtttaagtgttgtaaa

SEQ ID NO: 2830871 - DNA, 20 bp, Homo sapiens
tgaacaaagaaaaaaatata

SEQ ID NO: 2830872 - DNA, 22 bp, Homo sapiens
tgaacaaagaaaaaaatatatt

SEQ ID NO: 2830873 - DNA, 18 bp, Homo sapiens
tgaacaagaattggaagc

SEQ ID NO: 2830874 - DNA, 18 bp, Homo sapiens
tgaacactggcaacaaca

SEQ ID NO: 2830875 - DNA, 14 bp, Homo sapiens
tgaacactggggga

SEQ ID NO: 2830876 - DNA, 22 bp, Homo sapiens
tgaacactgggggaggggacat

SEQ ID NO: 2830877 - DNA, 13 bp, Homo sapiens
tgaacatctgtgt

SEQ ID NO: 2830878 - DNA, 15 bp, Homo sapiens
tgaacatctgtgtgt

SEQ ID NO: 2830879 - DNA, 17 bp, Homo sapiens
tgaaccaccacacccag

SEQ ID NO: 2830880 - DNA, 20 bp, Homo sapiens
tgaaccaccacacccagccc

SEQ ID NO: 2830881 - DNA, 14 bp, Homo sapiens
tgaaccactttgcc

SEQ ID NO: 2830882 - DNA, 12 bp, Homo sapiens
tgaacccaggac

SEQ ID NO: 2830883 - DNA, 13 bp, Homo sapiens
tgaacccaggagg

SEQ ID NO: 2830884 - DNA, 20 bp, Homo sapiens
tgaacccccgccatccttca

SEQ ID NO: 2830885 - DNA, 21 bp, Homo sapiens
tgaacccccgccatccttcac

SEQ ID NO: 2830886 - DNA, 15 bp, Homo sapiens
tgaaccgacttttct

SEQ ID NO: 2830887 - DNA, 13 bp, Homo sapiens
tgaacggggagaa

SEQ ID NO: 2830888 - DNA, 16 bp, Homo sapiens
tgaactaataaaagca

SEQ ID NO: 2830889 - DNA, 18 bp, Homo sapiens
tgaactcaagctgcgttt

SEQ ID NO: 2830890 - DNA, 11 bp, Homo sapiens
tgaactcctgg

SEQ ID NO: 2830891 - DNA, 14 bp, Homo sapiens
tgaactcttaatca

SEQ ID NO: 2830892 - DNA, 20 bp, Homo sapiens
tgaactgattcacatctcat

SEQ ID NO: 2830893 - DNA, 21 bp, Homo sapiens
tgaactgattcacatctcatt

SEQ ID NO: 2830894 - DNA, 13 bp, Homo sapiens
tgaactgccaaga

SEQ ID NO: 2830895 - DNA, 15 bp, Homo sapiens
tgaactgtgacagga

SEQ ID NO: 2830896 - DNA, 17 bp, Homo sapiens
tgaactgtgacaggaag

SEQ ID NO: 2830897 - DNA, 17 bp, Homo sapiens
tgaacttaaataaatgt

SEQ ID NO: 2830898 - DNA, 17 bp, Homo sapiens
tgaacttgaggacacat

SEQ ID NO: 2830899 - DNA, 20 bp, Homo sapiens
tgaacttgaggacacatgtc

SEQ ID NO: 2830900 - DNA, 13 bp, Homo sapiens
tgaagaacagtaa

SEQ ID NO: 2830901 - DNA, 13 bp, Homo sapiens
tgaagaatgttaa

SEQ ID NO: 2830902 - DNA, 13 bp, Homo sapiens
tgaagacccagca

SEQ ID NO: 2830903 - DNA, 20 bp, Homo sapiens
tgaagactcattcttctgta

SEQ ID NO: 2830904 - DNA, 13 bp, Homo sapiens
tgaagaggaaggg

SEQ ID NO: 2830905 - DNA, 17 bp, Homo sapiens
tgaagagggagaaggga

SEQ ID NO: 2830906 - DNA, 23 bp, Homo sapiens
tgaagaggggaggggcctaggga

SEQ ID NO: 2830907 - DNA, 17 bp, Homo sapiens
tgaagagtgagagggca

SEQ ID NO: 2830908 - DNA, 17 bp, Homo sapiens
tgaagatctcagataaa

SEQ ID NO: 2830909 - DNA, 20 bp, Homo sapiens
tgaagccactgaagctggga

SEQ ID NO: 2830910 - DNA, 21 bp, Homo sapiens
tgaaggaacagtgctgttctg

SEQ ID NO: 2830911 - DNA, 19 bp, Homo sapiens
tgaaggacattgcggacag

SEQ ID NO: 2830912 - DNA, 22 bp, Homo sapiens
tgaaggacattgcggacagcca

SEQ ID NO: 2830913 - DNA, 17 bp, Homo sapiens
tgaaggaggtgagggat

SEQ ID NO: 2830914 - DNA, 22 bp, Homo sapiens
tgaaggcccaggtcaacatcta

SEQ ID NO: 2830915 - DNA, 18 bp, Homo sapiens
tgaagggaaaggatattt

SEQ ID NO: 2830916 - DNA, 20 bp, Homo sapiens
tgaagggaccttgaagggta

SEQ ID NO: 2830917 - DNA, 19 bp, Homo sapiens
tgaagggcaggtgcttcag

SEQ ID NO: 2830918 - DNA, 22 bp, Homo sapiens
tgaaggtcactcttcctgcaag

SEQ ID NO: 2830919 - DNA, 16 bp, Homo sapiens
tgaaggtttctgaaaa

SEQ ID NO: 2830920 - DNA, 18 bp, Homo sapiens
tgaaggtttctgaaaatt

SEQ ID NO: 2830921 - DNA, 17 bp, Homo sapiens
tgaagtaagttctgaaa

SEQ ID NO: 2830922 - DNA, 21 bp, Homo sapiens
tgaagtgggtggatcaccaga

SEQ ID NO: 2830923 - DNA, 18 bp, Homo sapiens
tgaagtgtgtttccttca

SEQ ID NO: 2830924 - DNA, 22 bp, Homo sapiens
tgaagtgtgtttccttcagtgc

SEQ ID NO: 2830925 - DNA, 23 bp, Homo sapiens
tgaagttagctttaacttaaata

SEQ ID NO: 2830926 - DNA, 14 bp, Homo sapiens
tgaataaacttcag

SEQ ID NO: 2830927 - DNA, 17 bp, Homo sapiens
tgaataaacttcagcac

SEQ ID NO: 2830928 - DNA, 14 bp, Homo sapiens
tgaataaagtctga

SEQ ID NO: 2830929 - DNA, 23 bp, Homo sapiens
tgaataattttctggcactggtt

SEQ ID NO: 2830930 - DNA, 19 bp, Homo sapiens
tgaatacagggcatgcatt

SEQ ID NO: 2830931 - DNA, 16 bp, Homo sapiens
tgaatataaacactat

SEQ ID NO: 2830932 - DNA, 14 bp, Homo sapiens
tgaatattaatccc

SEQ ID NO: 2830933 - DNA, 17 bp, Homo sapiens
tgaatattaatcccagc

SEQ ID NO: 2830934 - DNA, 19 bp, Homo sapiens
tgaatatttcaaaataaac

SEQ ID NO: 2830935 - DNA, 22 bp, Homo sapiens
tgaatatttcaaaataaactgg

SEQ ID NO: 2830936 - DNA, 13 bp, Homo sapiens
tgaatcaaagaca

SEQ ID NO: 2830937 - DNA, 17 bp, Homo sapiens
tgaatccatcaggactt

SEQ ID NO: 2830938 - DNA, 14 bp, Homo sapiens
tgaatccatgcttg

SEQ ID NO: 2830939 - DNA, 17 bp, Homo sapiens
tgaatccatgcttgggt

SEQ ID NO: 2830940 - DNA, 16 bp, Homo sapiens
tgaatcctctctctgt

SEQ ID NO: 2830941 - DNA, 15 bp, Homo sapiens
tgaatgacatcaaca

SEQ ID NO: 2830942 - DNA, 18 bp, Homo sapiens
tgaatgatctctctgaat

SEQ ID NO: 2830943 - DNA, 14 bp, Homo sapiens
tgaatgatgtttta

SEQ ID NO: 2830944 - DNA, 19 bp, Homo sapiens
tgaatgatttccaaagaga

SEQ ID NO: 2830945 - DNA, 15 bp, Homo sapiens
tgaatgcaaaccata

SEQ ID NO: 2830946 - DNA, 17 bp, Homo sapiens
tgaatgcctcaatgtga

SEQ ID NO: 2830947 - DNA, 21 bp, Homo sapiens
tgaatggctatgtttttaatg

SEQ ID NO: 2830948 - DNA, 15 bp, Homo sapiens
tgaatggtccagggt

SEQ ID NO: 2830949 - DNA, 22 bp, Homo sapiens
tgaatggttccatgcctgaggg

SEQ ID NO: 2830950 - DNA, 19 bp, Homo sapiens
tgaatgtttacactctttg

SEQ ID NO: 2830951 - DNA, 17 bp, Homo sapiens
tgaattaaataaaccct

SEQ ID NO: 2830952 - DNA, 19 bp, Homo sapiens
tgaattattttgttgtgat

SEQ ID NO: 2830953 - DNA, 20 bp, Homo sapiens
tgatccacccacctcagcct

SEQ ID NO: 2830954 - DNA, 21 bp, Homo sapiens
tgatccctgttacccagagaa

SEQ ID NO: 2830955 - DNA, 22 bp, Homo sapiens
tgatcctcccacctcagcctcc

SEQ ID NO: 2830956 - DNA, 20 bp, Homo sapiens
tgatccttttatgttattta

SEQ ID NO: 2830957 - DNA, 18 bp, Homo sapiens
tgatcggagcctcctctc

SEQ ID NO: 2830958 - DNA, 22 bp, Homo sapiens
tgatcgtgctaaattttcagta

SEQ ID NO: 2830959 - DNA, 19 bp, Homo sapiens
tgatctccatatgttacac

SEQ ID NO: 2830960 - DNA, 14 bp, Homo sapiens
tgatctccctgccg

SEQ ID NO: 2830961 - DNA, 17 bp, Homo sapiens
tgatctccctgccgcct

SEQ ID NO: 2830962 - DNA, 19 bp, Homo sapiens
tgatcttgttaatgcattt

SEQ ID NO: 2830963 - DNA, 16 bp, Homo sapiens
tgatctttgcagacag

SEQ ID NO: 2830964 - DNA, 23 bp, Homo sapiens
tgatgaaatgaggtcagagcctg

SEQ ID NO: 2830965 - DNA, 23 bp, Homo sapiens
tgatgacaaacccaggagtttgt

SEQ ID NO: 2830966 - DNA, 14 bp, Homo sapiens
tgatgacagacact

SEQ ID NO: 2830967 - DNA, 13 bp, Homo sapiens
tgatgacataata

SEQ ID NO: 2830968 - DNA, 16 bp, Homo sapiens
tgatgagctcctcttc

SEQ ID NO: 2830969 - DNA, 19 bp, Homo sapiens
tgatgagggcagcagccag

SEQ ID NO: 2830970 - DNA, 19 bp, Homo sapiens
tgatgatctttgcagacag

SEQ ID NO: 2830971 - DNA, 20 bp, Homo sapiens
tgatgatctttgcagacagg

SEQ ID NO: 2830972 - DNA, 22 bp, Homo sapiens
tgatgatctttgcagacaggca

SEQ ID NO: 2830973 - DNA, 13 bp, Homo sapiens
tgatgatgaccaa

SEQ ID NO: 2830974 - DNA, 15 bp, Homo sapiens
tgatgatgaccaaga

SEQ ID NO: 2830975 - DNA, 17 bp, Homo sapiens
tgatgattaaacacctg

SEQ ID NO: 2830976 - DNA, 22 bp, Homo sapiens
tgatgattaaacacctgacaca

SEQ ID NO: 2830977 - DNA, 21 bp, Homo sapiens
tgatgcatcagaaagggaggg

SEQ ID NO: 2830978 - DNA, 16 bp, Homo sapiens
tgatgctaaataggag

SEQ ID NO: 2830979 - DNA, 14 bp, Homo sapiens
tgatgctcaggctt

SEQ ID NO: 2830980 - DNA, 16 bp, Homo sapiens
tgatggatgagaaaaa

SEQ ID NO: 2830981 - DNA, 19 bp, Homo sapiens
tgatggggtgggcagggct

SEQ ID NO: 2830982 - DNA, 13 bp, Homo sapiens
tgatgtacatgtg

SEQ ID NO: 2830983 - DNA, 13 bp, Homo sapiens
tgatgtccagaag

SEQ ID NO: 2830984 - DNA, 23 bp, Homo sapiens
tgatgtccagaagaatattcagg

SEQ ID NO: 2830985 - DNA, 19 bp, Homo sapiens
tgatgtcccaacttgtaaa

SEQ ID NO: 2830986 - DNA, 13 bp, Homo sapiens
tgatgttaaaaaa

SEQ ID NO: 2830987 - DNA, 10 bp, Homo sapiens
tgatgttaac

SEQ ID NO: 2830988 - DNA, 17 bp, Homo sapiens
tgatgttgagggaacag

SEQ ID NO: 2830989 - DNA, 13 bp, Homo sapiens
tgatgtttccaga

SEQ ID NO: 2830990 - DNA, 18 bp, Homo sapiens
tgatgtttccagaaaata

SEQ ID NO: 2830991 - DNA, 20 bp, Homo sapiens
tgatgtttccagaaaatata

SEQ ID NO: 2830992 - DNA, 21 bp, Homo sapiens
tgattaattcaccttccagtg

SEQ ID NO: 2830993 - DNA, 16 bp, Homo sapiens
tgattcacatctcatt

SEQ ID NO: 2830994 - DNA, 16 bp, Homo sapiens
tgattcataacaatgt

SEQ ID NO: 2830995 - DNA, 17 bp, Homo sapiens
tgattcataacaatgta

SEQ ID NO: 2830996 - DNA, 19 bp, Homo sapiens
tgattcatgccaattagca

SEQ ID NO: 2830997 - DNA, 20 bp, Homo sapiens
tgattcattttaacatctga

SEQ ID NO: 2830998 - DNA, 18 bp, Homo sapiens
tgattccttgagcatttt

SEQ ID NO: 2830999 - DNA, 13 bp, Homo sapiens
tgattctcctgcc

SEQ ID NO: 2831000 - DNA, 15 bp, Homo sapiens
tgattctcctgcctc

SEQ ID NO: 2831001 - DNA, 20 bp, Homo sapiens
tgattctcctgcctcagcct

SEQ ID NO: 2831002 - DNA, 21 bp, Homo sapiens
tgattctcctgcctcagcctc

SEQ ID NO: 2831003 - DNA, 22 bp, Homo sapiens
tgattgaatctgattggacatt

SEQ ID NO: 2831004 - DNA, 19 bp, Homo sapiens
tgattgacacacagcactc

SEQ ID NO: 2831005 - DNA, 23 bp, Homo sapiens
tgattggacattttcttcagaga

SEQ ID NO: 2831006 - DNA, 14 bp, Homo sapiens
tgattgtcttaata

SEQ ID NO: 2831007 - DNA, 16 bp, Homo sapiens
tgattgtttaattgta

SEQ ID NO: 2831008 - DNA, 17 bp, Homo sapiens
tgatttaaaaaataaat

SEQ ID NO: 2831009 - DNA, 14 bp, Homo sapiens
tgatttaagcattt

SEQ ID NO: 2831010 - DNA, 15 bp, Homo sapiens
tgatttaagcatttt

SEQ ID NO: 2831011 - DNA, 16 bp, Homo sapiens
tgatttaagcatttta

SEQ ID NO: 2831012 - DNA, 20 bp, Homo sapiens
tgatttatgatcacttggaa

SEQ ID NO: 2831013 - DNA, 18 bp, Homo sapiens
tgatttcaggatactctg

SEQ ID NO: 2831014 - DNA, 21 bp, Homo sapiens
tgatttctacgttatgaaaac

SEQ ID NO: 2831015 - DNA, 11 bp, Homo sapiens
tgatttctagg

SEQ ID NO: 2831016 - DNA, 18 bp, Homo sapiens
tgatttgtactgaaaaat

SEQ ID NO: 2831017 - DNA, 21 bp, Homo sapiens
tgattttacagagaatctgaa

SEQ ID NO: 2831018 - DNA, 15 bp, Homo sapiens
tgattttatacatag

SEQ ID NO: 2831019 - DNA, 19 bp, Homo sapiens
tgattttcatcaatttaaa

SEQ ID NO: 2831020 - DNA, 18 bp, Homo sapiens
tgattttgtacagaattt

SEQ ID NO: 2831021 - DNA, 21 bp, Homo sapiens
tgattttgtacagaattttta

SEQ ID NO: 2831022 - DNA, 14 bp, Homo sapiens
tgcaaaatttccag

SEQ ID NO: 2831023 - DNA, 14 bp, Homo sapiens
tgcaaacactgtgt

SEQ ID NO: 2831024 - DNA, 20 bp, Homo sapiens
tgcaaacttgtatctgaaga

SEQ ID NO: 2831025 - DNA, 12 bp, Homo sapiens
tgcaaagtgcaa

SEQ ID NO: 2831026 - DNA, 14 bp, Homo sapiens
tgcaaagtgcaaat

SEQ ID NO: 2831027 - DNA, 17 bp, Homo sapiens
tgcaaagtgcaaatact

SEQ ID NO: 2831028 - DNA, 21 bp, Homo sapiens
tgcaaatactccaagcttcaa

SEQ ID NO: 2831029 - DNA, 14 bp, Homo sapiens
tgcaacaggctggg

SEQ ID NO: 2831030 - DNA, 16 bp, Homo sapiens
tgcaacaggctgggct

SEQ ID NO: 2831031 - DNA, 18 bp, Homo sapiens
tgcaacctccgcctcttg

SEQ ID NO: 2831032 - DNA, 13 bp, Homo sapiens
tgcaagaagaata

SEQ ID NO: 2831033 - DNA, 15 bp, Homo sapiens
tgcaagaagtcttga

SEQ ID NO: 2831034 - DNA, 20 bp, Homo sapiens
tgcaagaagtcttgagaaaa

SEQ ID NO: 2831035 - DNA, 14 bp, Homo sapiens
tgcaagagccttgg

SEQ ID NO: 2831036 - DNA, 12 bp, Homo sapiens
tgcaaggaagga

SEQ ID NO: 2831037 - DNA, 19 bp, Homo sapiens
tgcaagtactgctgtaaat

SEQ ID NO: 2831038 - DNA, 15 bp, Homo sapiens
tgcaataaaatagta

SEQ ID NO: 2831039 - DNA, 16 bp, Homo sapiens
tgcaataaaatagtat

SEQ ID NO: 2831040 - DNA, 14 bp, Homo sapiens
tgcaatatgtatta

SEQ ID NO: 2831041 - DNA, 15 bp, Homo sapiens
tgcaatcccttaata

SEQ ID NO: 2831042 - DNA, 13 bp, Homo sapiens
tgcaatggcagcc

SEQ ID NO: 2831043 - DNA, 14 bp, Homo sapiens
tgcaatggcagcct

SEQ ID NO: 2831044 - DNA, 19 bp, Homo sapiens
tgcatagttcccatgttaa

SEQ ID NO: 2831045 - DNA, 18 bp, Homo sapiens
tgcatcagaaagggaggg

SEQ ID NO: 2831046 - DNA, 20 bp, Homo sapiens
tgcatcagaaagggagggct

SEQ ID NO: 2831047 - DNA, 16 bp, Homo sapiens
tgcatccattcctcag

SEQ ID NO: 2831048 - DNA, 20 bp, Homo sapiens
tgcatccattcctcagggac

SEQ ID NO: 2831049 - DNA, 20 bp, Homo sapiens
tgcatccgtagttccctgaa

SEQ ID NO: 2831050 - DNA, 16 bp, Homo sapiens
tgcatctactcaggcc

SEQ ID NO: 2831051 - DNA, 13 bp, Homo sapiens
tgcatgaaggttt

SEQ ID NO: 2831052 - DNA, 19 bp, Homo sapiens
tgcatgaaggtttctgaaa

SEQ ID NO: 2831053 - DNA, 17 bp, Homo sapiens
tgcatgattttatacat

SEQ ID NO: 2831054 - DNA, 21 bp, Homo sapiens
tgcatgattttatacatagtc

SEQ ID NO: 2831055 - DNA, 19 bp, Homo sapiens
tgcatgctctctgcagcca

SEQ ID NO: 2831056 - DNA, 18 bp, Homo sapiens
tgcatggaaatgtcctcc

SEQ ID NO: 2831057 - DNA, 16 bp, Homo sapiens
tgcatgtaaaatgcag

SEQ ID NO: 2831058 - DNA, 20 bp, Homo sapiens
tgcatgtaaaatgcagtcca

SEQ ID NO: 2831059 - DNA, 13 bp, Homo sapiens
tgcatgtatgtct

SEQ ID NO: 2831060 - DNA, 15 bp, Homo sapiens
tgcatgtatgtcttg

SEQ ID NO: 2831061 - DNA, 22 bp, Homo sapiens
tgcatgttgccatgaggccttt

SEQ ID NO: 2831062 - DNA, 17 bp, Homo sapiens
tgcattaacttaaaaga

SEQ ID NO: 2831063 - DNA, 17 bp, Homo sapiens
tgcattactgcatgcac

SEQ ID NO: 2831064 - DNA, 20 bp, Homo sapiens
tgcattagaaatagacagta

SEQ ID NO: 2831065 - DNA, 21 bp, Homo sapiens
tgcattccatgattttacaga

SEQ ID NO: 2831066 - DNA, 23 bp, Homo sapiens
tgcattccatgattttacagaga

SEQ ID NO: 2831067 - DNA, 15 bp, Homo sapiens
tgcattgaatatatt

SEQ ID NO: 2831068 - DNA, 15 bp, Homo sapiens
tgcatttataaatgt

SEQ ID NO: 2831069 - DNA, 16 bp, Homo sapiens
tgcatttataaatgtg

SEQ ID NO: 2831070 - DNA, 18 bp, Homo sapiens
tgcattttgcagcagtga

SEQ ID NO: 2831071 - DNA, 22 bp, Homo sapiens
tgcatttttgatgggaagaaaa

SEQ ID NO: 2831072 - DNA, 16 bp, Homo sapiens
tgccaaaaaaaaatac

SEQ ID NO: 2831073 - DNA, 17 bp, Homo sapiens
tgccaagtccaggtcct

SEQ ID NO: 2831074 - DNA, 14 bp, Homo sapiens
tgccacaccctccc

SEQ ID NO: 2831075 - DNA, 16 bp, Homo sapiens
tgccacaccctcccca

SEQ ID NO: 2831076 - DNA, 17 bp, Homo sapiens
tgccacaccctccccat

SEQ ID NO: 2831077 - DNA, 20 bp, Homo sapiens
tgccacaccctccccattca

SEQ ID NO: 2831078 - DNA, 22 bp, Homo sapiens
tgccacatctgtgtctctggaa

SEQ ID NO: 2831079 - DNA, 19 bp, Homo sapiens
tgccaccatcctgctgctg

SEQ ID NO: 2831080 - DNA, 19 bp, Homo sapiens
tgccaccctggggagaaag

SEQ ID NO: 2831081 - DNA, 17 bp, Homo sapiens
tgccacctcccctatcc

SEQ ID NO: 2831082 - DNA, 13 bp, Homo sapiens
tgccacctgtctg

SEQ ID NO: 2831083 - DNA, 22 bp, Homo sapiens
tgccactacggaatagttggct

SEQ ID NO: 2831084 - DNA, 18 bp, Homo sapiens
tgccactcctgcttctct

SEQ ID NO: 2831085 - DNA, 17 bp, Homo sapiens
tgccactgcctcttcct

SEQ ID NO: 2831086 - DNA, 18 bp, Homo sapiens
tgccagaacagtttgtac

SEQ ID NO: 2831087 - DNA, 19 bp, Homo sapiens
tgccagaacagtttgtaca

SEQ ID NO: 2831088 - DNA, 13 bp, Homo sapiens
tgccagacatgtg

SEQ ID NO: 2831089 - DNA, 14 bp, Homo sapiens
tgccagacttaaat

SEQ ID NO: 2831090 - DNA, 22 bp, Homo sapiens
tgccagagacggaagccttttt

SEQ ID NO: 2831091 - DNA, 11 bp, Homo sapiens
tgccagagcct

SEQ ID NO: 2831092 - DNA, 12 bp, Homo sapiens
tgccagagcctg

SEQ ID NO: 2831093 - DNA, 17 bp, Homo sapiens
tgccagagcctggggct

SEQ ID NO: 2831094 - DNA, 19 bp, Homo sapiens
tgccagagcctggggctct

SEQ ID NO: 2831095 - DNA, 20 bp, Homo sapiens
tgccagccagaagcctctgc

SEQ ID NO: 2831096 - DNA, 21 bp, Homo sapiens
tgccagccgggtacctcagtt

SEQ ID NO: 2831097 - DNA, 12 bp, Homo sapiens
tgccagcctggc

SEQ ID NO: 2831098 - DNA, 17 bp, Homo sapiens
tgccagcctggcttctg

SEQ ID NO: 2831099 - DNA, 21 bp, Homo sapiens
tgccagcctggcttctggagc

SEQ ID NO: 2831100 - DNA, 17 bp, Homo sapiens
tgccagctcagtcccat

SEQ ID NO: 2831101 - DNA, 21 bp, Homo sapiens
tgccaggactccccaggccag

SEQ ID NO: 2831102 - DNA, 22 bp, Homo sapiens
tgccaggactccccaggccagg

SEQ ID NO: 2831103 - DNA, 17 bp, Homo sapiens
tgccaggctaatttttt

SEQ ID NO: 2831104 - DNA, 18 bp, Homo sapiens
tgccaggctagactagga

SEQ ID NO: 2831105 - DNA, 22 bp, Homo sapiens
tgccaggtttttggtctgaccc

SEQ ID NO: 2831106 - DNA, 19 bp, Homo sapiens
tgccagtccccctgcccca

SEQ ID NO: 2831107 - DNA, 11 bp, Homo sapiens
tgccagtgcct

SEQ ID NO: 2831108 - DNA, 13 bp, Homo sapiens
tgccagtgcctta

SEQ ID NO: 2831109 - DNA, 17 bp, Homo sapiens
tgccatagtcacatggc

SEQ ID NO: 2831110 - DNA, 18 bp, Homo sapiens
tgccatagtcacatggcc

SEQ ID NO: 2831111 - DNA, 15 bp, Homo sapiens
tgccatattctgttg

SEQ ID NO: 2831112 - DNA, 16 bp, Homo sapiens
tgccatattctgttgg

SEQ ID NO: 2831113 - DNA, 21 bp, Homo sapiens
tgccatattctgttggccagt

SEQ ID NO: 2831114 - DNA, 13 bp, Homo sapiens
tgccatgaggcct

SEQ ID NO: 2831115 - DNA, 18 bp, Homo sapiens
tgccatgaggcctttccc

SEQ ID NO: 2831116 - DNA, 15 bp, Homo sapiens
tgccatgtgccaggt

SEQ ID NO: 2831117 - DNA, 12 bp, Homo sapiens
tgccatgttggc

SEQ ID NO: 2831118 - DNA, 18 bp, Homo sapiens
tgccatgttggccaggct

SEQ ID NO: 2831119 - DNA, 19 bp, Homo sapiens
tgccatgttggccaggctg

SEQ ID NO: 2831120 - DNA, 21 bp, Homo sapiens
tgccatgttggccaggctggt

SEQ ID NO: 2831121 - DNA, 16 bp, Homo sapiens
tgccatttgcaccctc

SEQ ID NO: 2831122 - DNA, 19 bp, Homo sapiens
tgccatttgcaccctccgc

SEQ ID NO: 2831123 - DNA, 22 bp, Homo sapiens
tgccatttgcaccctccgcctt

SEQ ID NO: 2831124 - DNA, 15 bp, Homo sapiens
tgccatttgtactga

SEQ ID NO: 2831125 - DNA, 17 bp, Homo sapiens
tgccattttaataaaat

SEQ ID NO: 2831126 - DNA, 18 bp, Homo sapiens
tgccattttaataaaatg

SEQ ID NO: 2831127 - DNA, 23 bp, Homo sapiens
tgcccaacctgctctcctcttgc

SEQ ID NO: 2831128 - DNA, 20 bp, Homo sapiens
tgcccacaggatcagtctga

SEQ ID NO: 2831129 - DNA, 18 bp, Homo sapiens
tgcccacagggaccaaga

SEQ ID NO: 2831130 - DNA, 16 bp, Homo sapiens
tgcccacatcccaggc

SEQ ID NO: 2831131 - DNA, 18 bp, Homo sapiens
tgcccacgctggagtgca

SEQ ID NO: 2831132 - DNA, 21 bp, Homo sapiens
tgcccagaattcccagctgtc

SEQ ID NO: 2831133 - DNA, 11 bp, Homo sapiens
tgcccagagat

SEQ ID NO: 2831134 - DNA, 16 bp, Homo sapiens
tgctctgaggcttcca

SEQ ID NO: 2831135 - DNA, 17 bp, Homo sapiens
tgctctgatgcatcaga

SEQ ID NO: 2831136 - DNA, 18 bp, Homo sapiens
tgctctgatgcatcagaa

SEQ ID NO: 2831137 - DNA, 16 bp, Homo sapiens
tgctctgctgacagac

SEQ ID NO: 2831138 - DNA, 21 bp, Homo sapiens
tgctctgctgacagacacagg

SEQ ID NO: 2831139 - DNA, 22 bp, Homo sapiens
tgctctgctgacagacacaggc

SEQ ID NO: 2831140 - DNA, 23 bp, Homo sapiens
tgctctggaaaatgtgacccaga

SEQ ID NO: 2831141 - DNA, 14 bp, Homo sapiens
tgctctggacaggc

SEQ ID NO: 2831142 - DNA, 15 bp, Homo sapiens
tgctctggacaggca

SEQ ID NO: 2831143 - DNA, 12 bp, Homo sapiens
tgctcttagctg

SEQ ID NO: 2831144 - DNA, 13 bp, Homo sapiens
tgctcttcagtgg

SEQ ID NO: 2831145 - DNA, 13 bp, Homo sapiens
tgctcttctctta

SEQ ID NO: 2831146 - DNA, 15 bp, Homo sapiens
tgctcttctgttctc

SEQ ID NO: 2831147 - DNA, 17 bp, Homo sapiens
tgctcttgcctgcaccc

SEQ ID NO: 2831148 - DNA, 18 bp, Homo sapiens
tgctgaaacacctcccag

SEQ ID NO: 2831149 - DNA, 20 bp, Homo sapiens
tgctgaaacacctcccaggg

SEQ ID NO: 2831150 - DNA, 14 bp, Homo sapiens
tgctgaattatttt

SEQ ID NO: 2831151 - DNA, 22 bp, Homo sapiens
tgctgaattattttgttgtgat

SEQ ID NO: 2831152 - DNA, 15 bp, Homo sapiens
tgctgacagacacag

SEQ ID NO: 2831153 - DNA, 23 bp, Homo sapiens
tgctgacagacacaggcccggct

SEQ ID NO: 2831154 - DNA, 21 bp, Homo sapiens
tgctgactaactataagcatg

SEQ ID NO: 2831155 - DNA, 17 bp, Homo sapiens
tgctgagaacctggcct

SEQ ID NO: 2831156 - DNA, 18 bp, Homo sapiens
tgctgagaacctggcctt

SEQ ID NO: 2831157 - DNA, 18 bp, Homo sapiens
tgctgagagacccaagga

SEQ ID NO: 2831158 - DNA, 22 bp, Homo sapiens
tgctgagagacccaaggaggaa

SEQ ID NO: 2831159 - DNA, 15 bp, Homo sapiens
tgctgagctctgaga

SEQ ID NO: 2831160 - DNA, 23 bp, Homo sapiens
tgctgagctctgagaggccctgg

SEQ ID NO: 2831161 - DNA, 21 bp, Homo sapiens
tgctgatgaactcttaatcaa

SEQ ID NO: 2831162 - DNA, 20 bp, Homo sapiens
tgctgcaaagtgcaaatact

SEQ ID NO: 2831163 - DNA, 23 bp, Homo sapiens
tgctgcagccaggaggagaggaa

SEQ ID NO: 2831164 - DNA, 12 bp, Homo sapiens
tgctgccatcca

SEQ ID NO: 2831165 - DNA, 15 bp, Homo sapiens
tgctgccatccaggt

SEQ ID NO: 2831166 - DNA, 22 bp, Homo sapiens
tgctgccatccaggttcagctt

SEQ ID NO: 2831167 - DNA, 14 bp, Homo sapiens
tgctgcccagcctc

SEQ ID NO: 2831168 - DNA, 18 bp, Homo sapiens
tgctgccccgcttcccca

SEQ ID NO: 2831169 - DNA, 14 bp, Homo sapiens
tgctgcccctgcag

SEQ ID NO: 2831170 - DNA, 15 bp, Homo sapiens
tgctgcccctgcagt

SEQ ID NO: 2831171 - DNA, 21 bp, Homo sapiens
tgctgcccgtcttcagcctag

SEQ ID NO: 2831172 - DNA, 22 bp, Homo sapiens
tgctgcccgtcttcagcctagc

SEQ ID NO: 2831173 - DNA, 21 bp, Homo sapiens
tgctgccgcctcccagcctgg

SEQ ID NO: 2831174 - DNA, 14 bp, Homo sapiens
tgctgcctgagtca

SEQ ID NO: 2831175 - DNA, 17 bp, Homo sapiens
tgctgctctctgaggga

SEQ ID NO: 2831176 - DNA, 20 bp, Homo sapiens
tgctgctgagaacctggcct

SEQ ID NO: 2831177 - DNA, 14 bp, Homo sapiens
tgctggactgtcat

SEQ ID NO: 2831178 - DNA, 17 bp, Homo sapiens
tgctggataaaatgagg

SEQ ID NO: 2831179 - DNA, 21 bp, Homo sapiens
tgctggcctcccaataaagct

SEQ ID NO: 2831180 - DNA, 12 bp, Homo sapiens
tgctggcctgga

SEQ ID NO: 2831181 - DNA, 15 bp, Homo sapiens
tgctggcctggatct

SEQ ID NO: 2831182 - DNA, 18 bp, Homo sapiens
tgctggcctggatctccc

SEQ ID NO: 2831183 - DNA, 13 bp, Homo sapiens
tgctggcctggcc

SEQ ID NO: 2831184 - DNA, 22 bp, Homo sapiens
tgctgggaccccagctagggct

SEQ ID NO: 2831185 - DNA, 17 bp, Homo sapiens
tgctgggctctccacct

SEQ ID NO: 2831186 - DNA, 18 bp, Homo sapiens
tgctgggctctccacctc

SEQ ID NO: 2831187 - DNA, 15 bp, Homo sapiens
tgctggggagtccct

SEQ ID NO: 2831188 - DNA, 17 bp, Homo sapiens
tgctggggagtccctgc

SEQ ID NO: 2831189 - DNA, 22 bp, Homo sapiens
tgctggttttcctaaatgcagt

SEQ ID NO: 2831190 - DNA, 20 bp, Homo sapiens
tgctgtcattgtccatgcct

SEQ ID NO: 2831191 - DNA, 21 bp, Homo sapiens
tgctgtcattgtccatgccta

SEQ ID NO: 2831192 - DNA, 14 bp, Homo sapiens
tgctgtcctaggcc

SEQ ID NO: 2831193 - DNA, 14 bp, Homo sapiens
tgctgtggtgggga

SEQ ID NO: 2831194 - DNA, 21 bp, Homo sapiens
tgctgtttgagatgtgatgct

SEQ ID NO: 2831195 - DNA, 20 bp, Homo sapiens
tgctgttttcatctctgcca

SEQ ID NO: 2831196 - DNA, 17 bp, Homo sapiens
tgcttacagtgactgtc

SEQ ID NO: 2831197 - DNA, 13 bp, Homo sapiens
tgcttagaaagtt

SEQ ID NO: 2831198 - DNA, 18 bp, Homo sapiens
tgcttagaaagttattgt

SEQ ID NO: 2831199 - DNA, 21 bp, Homo sapiens
tgcttagtatctcatcaacaa

SEQ ID NO: 2831200 - DNA, 21 bp, Homo sapiens
tgcttatgacatcacttgtac

SEQ ID NO: 2831201 - DNA, 19 bp, Homo sapiens
tgcttatttatattcagag

SEQ ID NO: 2831202 - DNA, 17 bp, Homo sapiens
tgcttattttaaaattt

SEQ ID NO: 2831203 - DNA, 16 bp, Homo sapiens
tgcttcaattaataaa

SEQ ID NO: 2831204 - DNA, 13 bp, Homo sapiens
tgcttcagcctcc

SEQ ID NO: 2831205 - DNA, 16 bp, Homo sapiens
tgcttctctacagact

SEQ ID NO: 2831206 - DNA, 19 bp, Homo sapiens
tgcttcttgccccttgggc

SEQ ID NO: 2831207 - DNA, 13 bp, Homo sapiens
tgcttgaaggaac

SEQ ID NO: 2831208 - DNA, 16 bp, Homo sapiens
tgcttgaaggaacagt

SEQ ID NO: 2831209 - DNA, 19 bp, Homo sapiens
tgcttgaaggaacagtgct

SEQ ID NO: 2831210 - DNA, 20 bp, Homo sapiens
tgcttgaaggaacagtgctg

SEQ ID NO: 2831211 - DNA, 16 bp, Homo sapiens
tgcttgagcccaggag

SEQ ID NO: 2831212 - DNA, 20 bp, Homo sapiens
tgcttggggggtgatgaggg

SEQ ID NO: 2831213 - DNA, 21 bp, Homo sapiens
tgcttgtgatttttgaacaat

SEQ ID NO: 2831214 - DNA, 20 bp, Homo sapiens
tgctttacctttattaatga

SEQ ID NO: 2831215 - DNA, 21 bp, Homo sapiens
tgctttacctttattaatgaa

SEQ ID NO: 2831216 - DNA, 12 bp, Homo sapiens
tgctttcctccc

SEQ ID NO: 2831217 - DNA, 13 bp, Homo sapiens
tgctttctcctgg

SEQ ID NO: 2831218 - DNA, 18 bp, Homo sapiens
tgctttgactcacctgtt

SEQ ID NO: 2831219 - DNA, 22 bp, Homo sapiens
tgctttgactcacctgttactt

SEQ ID NO: 2831220 - DNA, 14 bp, Homo sapiens
tgctttgcttttta

SEQ ID NO: 2831221 - DNA, 16 bp, Homo sapiens
tgctttgtgtgattga

SEQ ID NO: 2831222 - DNA, 21 bp, Homo sapiens
tggaaaaaagagaaaaaccaa

SEQ ID NO: 2831223 - DNA, 23 bp, Homo sapiens
tggaaaaaagagaaaaaccaatg

SEQ ID NO: 2831224 - DNA, 13 bp, Homo sapiens
tggagatgcagag

SEQ ID NO: 2831225 - DNA, 17 bp, Homo sapiens
tggagcaccaggcacga

SEQ ID NO: 2831226 - DNA, 22 bp, Homo sapiens
tggagcagaaagccagggtcct

SEQ ID NO: 2831227 - DNA, 16 bp, Homo sapiens
tggagcatctgactca

SEQ ID NO: 2831228 - DNA, 17 bp, Homo sapiens
tggagccaagggttcag

SEQ ID NO: 2831229 - DNA, 21 bp, Homo sapiens
tggagcgcacctgccccctgg

SEQ ID NO: 2831230 - DNA, 16 bp, Homo sapiens
tggagcggctctcctg

SEQ ID NO: 2831231 - DNA, 13 bp, Homo sapiens
tggagctgctgtt

SEQ ID NO: 2831232 - DNA, 15 bp, Homo sapiens
tggaggaacagctcc

SEQ ID NO: 2831233 - DNA, 22 bp, Homo sapiens
tggaggaagatccaaacagaaa

SEQ ID NO: 2831234 - DNA, 14 bp, Homo sapiens
tggaggacctgagc

SEQ ID NO: 2831235 - DNA, 15 bp, Homo sapiens
tggaggacctgagcc

SEQ ID NO: 2831236 - DNA, 18 bp, Homo sapiens
tggaggacctgagcctgc

SEQ ID NO: 2831237 - DNA, 21 bp, Homo sapiens
tggaggagaagaattttcaga

SEQ ID NO: 2831238 - DNA, 14 bp, Homo sapiens
tggaggagaaggac

SEQ ID NO: 2831239 - DNA, 19 bp, Homo sapiens
tggaggagctcaggacact

SEQ ID NO: 2831240 - DNA, 20 bp, Homo sapiens
tggaggagctcaggacacta

SEQ ID NO: 2831241 - DNA, 22 bp, Homo sapiens
tggaggagcttgggggatgact

SEQ ID NO: 2831242 - DNA, 23 bp, Homo sapiens
tggaggccaccgggacagacctg

SEQ ID NO: 2831243 - DNA, 12 bp, Homo sapiens
tggaggctgctc

SEQ ID NO: 2831244 - DNA, 20 bp, Homo sapiens
tggagggcaaggggtttcca

SEQ ID NO: 2831245 - DNA, 22 bp, Homo sapiens
tggagggcaaggggtttccaca

SEQ ID NO: 2831246 - DNA, 20 bp, Homo sapiens
tggaggtcacattcaggaag

SEQ ID NO: 2831247 - DNA, 22 bp, Homo sapiens
tggaggtcacattcaggaagat

SEQ ID NO: 2831248 - DNA, 17 bp, Homo sapiens
tggagtctccagtggtt

SEQ ID NO: 2831249 - DNA, 12 bp, Homo sapiens
tggagtgagcag

SEQ ID NO: 2831250 - DNA, 14 bp, Homo sapiens
tggagtgcagtgag

SEQ ID NO: 2831251 - DNA, 15 bp, Homo sapiens
tggagttcttgtgcc

SEQ ID NO: 2831252 - DNA, 21 bp, Homo sapiens
tggatatgtaaaacatttatt

SEQ ID NO: 2831253 - DNA, 23 bp, Homo sapiens
tggatcacagaggcttcttcaga

SEQ ID NO: 2831254 - DNA, 16 bp, Homo sapiens
tggatcatgaaaagtg

SEQ ID NO: 2831255 - DNA, 16 bp, Homo sapiens
tggatctaaataatac

SEQ ID NO: 2831256 - DNA, 19 bp, Homo sapiens
tggatctatctgtattttc

SEQ ID NO: 2831257 - DNA, 23 bp, Homo sapiens
tggatctgggaccctttccttcc

SEQ ID NO: 2831258 - DNA, 18 bp, Homo sapiens
tggatctgtccaaggaaa

SEQ ID NO: 2831259 - DNA, 20 bp, Homo sapiens
tggatgaccagaacaaggtt

SEQ ID NO: 2831260 - DNA, 16 bp, Homo sapiens
tggatgtgcccacagg

SEQ ID NO: 2831261 - DNA, 18 bp, Homo sapiens
tggatgtgcccacaggga

SEQ ID NO: 2831262 - DNA, 17 bp, Homo sapiens
tggatgtgtaaatggag

SEQ ID NO: 2831263 - DNA, 13 bp, Homo sapiens
tggattcctaagc

SEQ ID NO: 2831264 - DNA, 15 bp, Homo sapiens
tggatttcctatttt

SEQ ID NO: 2831265 - DNA, 22 bp, Homo sapiens
tggatttcctattttaaaacca

SEQ ID NO: 2831266 - DNA, 23 bp, Homo sapiens
tggatttcctattttaaaaccat

SEQ ID NO: 2831267 - DNA, 13 bp, Homo sapiens
tggcaattttgta

SEQ ID NO: 2831268 - DNA, 19 bp, Homo sapiens
tggcaccactgcactccag

SEQ ID NO: 2831269 - DNA, 21 bp, Homo sapiens
tggcaccactgcactccagcc

SEQ ID NO: 2831270 - DNA, 20 bp, Homo sapiens
tggcaccagaggctgcagaa

SEQ ID NO: 2831271 - DNA, 15 bp, Homo sapiens
tggcacccggcccct

SEQ ID NO: 2831272 - DNA, 19 bp, Homo sapiens
tggcacccggcccctgctg

SEQ ID NO: 2831273 - DNA, 20 bp, Homo sapiens
tggcacccggcccctgctgg

SEQ ID NO: 2831274 - DNA, 20 bp, Homo sapiens
tggcagataatcagcctctt

SEQ ID NO: 2831275 - DNA, 17 bp, Homo sapiens
tggcagccctgtaggga

SEQ ID NO: 2831276 - DNA, 17 bp, Homo sapiens
tggcagccttggcaaac

SEQ ID NO: 2831277 - DNA, 17 bp, Homo sapiens
tggcagctgcggtccac

SEQ ID NO: 2831278 - DNA, 23 bp, Homo sapiens
tggcagctgcggtccacccagga

SEQ ID NO: 2831279 - DNA, 13 bp, Homo sapiens
tggcagctgcttt

SEQ ID NO: 2831280 - DNA, 14 bp, Homo sapiens
tggcaggagaatca

SEQ ID NO: 2831281 - DNA, 16 bp, Homo sapiens
tggcagggtgggatgg

SEQ ID NO: 2831282 - DNA, 17 bp, Homo sapiens
tggcagggtgggatgga

SEQ ID NO: 2831283 - DNA, 16 bp, Homo sapiens
tggcagtccagccagc

SEQ ID NO: 2831284 - DNA, 11 bp, Homo sapiens
tggcagtgtgt

SEQ ID NO: 2831285 - DNA, 20 bp, Homo sapiens
tggcagttggaggacacagt

SEQ ID NO: 2831286 - DNA, 18 bp, Homo sapiens
tggcatcacagggcagag

SEQ ID NO: 2831287 - DNA, 19 bp, Homo sapiens
tggcatgaccatcctgtcc

SEQ ID NO: 2831288 - DNA, 21 bp, Homo sapiens
tggcatgaccatcctgtcctt

SEQ ID NO: 2831289 - DNA, 14 bp, Homo sapiens
tggccaagctgagg

SEQ ID NO: 2831290 - DNA, 17 bp, Homo sapiens
tggccagggtgagagct

SEQ ID NO: 2831291 - DNA, 16 bp, Homo sapiens
tggccatcagggtggg

SEQ ID NO: 2831292 - DNA, 15 bp, Homo sapiens
tggccatgtcgcctg

SEQ ID NO: 2831293 - DNA, 15 bp, Homo sapiens
tggccatttgctttt

SEQ ID NO: 2831294 - DNA, 18 bp, Homo sapiens
tggcccagaattgcattc

SEQ ID NO: 2831295 - DNA, 18 bp, Homo sapiens
tggcccagagctggaaca

SEQ ID NO: 2831296 - DNA, 22 bp, Homo sapiens
tggccccaccctcgtggacacc

SEQ ID NO: 2831297 - DNA, 17 bp, Homo sapiens
tggcccccctccaggca

SEQ ID NO: 2831298 - DNA, 21 bp, Homo sapiens
tggcccccctccaggcatgct

SEQ ID NO: 2831299 - DNA, 20 bp, Homo sapiens
tggcccctgaacaagaattg

SEQ ID NO: 2831300 - DNA, 14 bp, Homo sapiens
tggcccctgcccgg

SEQ ID NO: 2831301 - DNA, 15 bp, Homo sapiens
tggcccctgcccggc

SEQ ID NO: 2831302 - DNA, 20 bp, Homo sapiens
tggcccctgcccggctgcgg

SEQ ID NO: 2831303 - DNA, 14 bp, Homo sapiens
tggccctggcctgc

SEQ ID NO: 2831304 - DNA, 15 bp, Homo sapiens
tggccctggcctgct

SEQ ID NO: 2831305 - DNA, 16 bp, Homo sapiens
tggccctggcctgctg

SEQ ID NO: 2831306 - DNA, 18 bp, Homo sapiens
tggccctggcctgctggg

SEQ ID NO: 2831307 - DNA, 20 bp, Homo sapiens
tggcccttcctggacagctg

SEQ ID NO: 2831308 - DNA, 15 bp, Homo sapiens
tggccgactcaggga

SEQ ID NO: 2831309 - DNA, 21 bp, Homo sapiens
tggccgactcagggacctaag

SEQ ID NO: 2831310 - DNA, 13 bp, Homo sapiens
tggccgcctccag

SEQ ID NO: 2831311 - DNA, 22 bp, Homo sapiens
tggccgtggtccagctcttggc

SEQ ID NO: 2831312 - DNA, 13 bp, Homo sapiens
tggcctatgcaca

SEQ ID NO: 2831313 - DNA, 19 bp, Homo sapiens
tggcctcacgcccagcctc

SEQ ID NO: 2831314 - DNA, 20 bp, Homo sapiens
tgggccactctcccctccct

SEQ ID NO: 2831315 - DNA, 21 bp, Homo sapiens
tgggccactctcccctccctc

SEQ ID NO: 2831316 - DNA, 22 bp, Homo sapiens
tgggccactgcactctagcctg

SEQ ID NO: 2831317 - DNA, 17 bp, Homo sapiens
tgggccccaccacctag

SEQ ID NO: 2831318 - DNA, 23 bp, Homo sapiens
tgggccccaccacctaggccact

SEQ ID NO: 2831319 - DNA, 14 bp, Homo sapiens
tgggccctgcacag

SEQ ID NO: 2831320 - DNA, 19 bp, Homo sapiens
tgggccctggggcctgtac

SEQ ID NO: 2831321 - DNA, 18 bp, Homo sapiens
tgggcctatggagagccc

SEQ ID NO: 2831322 - DNA, 19 bp, Homo sapiens
tgggcctccccccagcccc

SEQ ID NO: 2831323 - DNA, 21 bp, Homo sapiens
tgggcctccccccagcccctc

SEQ ID NO: 2831324 - DNA, 15 bp, Homo sapiens
tgggcctgctgctga

SEQ ID NO: 2831325 - DNA, 18 bp, Homo sapiens
tgggcctgctgctgagaa

SEQ ID NO: 2831326 - DNA, 22 bp, Homo sapiens
tgggcgctctgccctccctggc

SEQ ID NO: 2831327 - DNA, 17 bp, Homo sapiens
tgggctaattaaataaa

SEQ ID NO: 2831328 - DNA, 14 bp, Homo sapiens
tgggctctccacct

SEQ ID NO: 2831329 - DNA, 21 bp, Homo sapiens
tgggctctccacctcagcctt

SEQ ID NO: 2831330 - DNA, 15 bp, Homo sapiens
tgggctctgccccag

SEQ ID NO: 2831331 - DNA, 17 bp, Homo sapiens
tgggctctgccccagct

SEQ ID NO: 2831332 - DNA, 20 bp, Homo sapiens
tgggctgaactgagcctagc

SEQ ID NO: 2831333 - DNA, 20 bp, Homo sapiens
tgggcttcagtggcagctgc

SEQ ID NO: 2831334 - DNA, 21 bp, Homo sapiens
tgggcttcagtggcagctgct

SEQ ID NO: 2831335 - DNA, 22 bp, Homo sapiens
tgggcttcagtggcagctgctt

SEQ ID NO: 2831336 - DNA, 19 bp, Homo sapiens
tgggctttaacaaaacaag

SEQ ID NO: 2831337 - DNA, 14 bp, Homo sapiens
tggggaagactgtg

SEQ ID NO: 2831338 - DNA, 16 bp, Homo sapiens
tggggaagactgtggc

SEQ ID NO: 2831339 - DNA, 15 bp, Homo sapiens
tggggatgagaaagg

SEQ ID NO: 2831340 - DNA, 20 bp, Homo sapiens
tggggcagctcctctgtctc

SEQ ID NO: 2831341 - DNA, 15 bp, Homo sapiens
tggggcaggagtagc

SEQ ID NO: 2831342 - DNA, 18 bp, Homo sapiens
tggggcaggagtagctga

SEQ ID NO: 2831343 - DNA, 22 bp, Homo sapiens
tggggcaggagtagctgagctc

SEQ ID NO: 2831344 - DNA, 19 bp, Homo sapiens
tggggcctgtactgcctgc

SEQ ID NO: 2831345 - DNA, 12 bp, Homo sapiens
tggggccttggt

SEQ ID NO: 2831346 - DNA, 21 bp, Homo sapiens
tggggctcctttctccagcca

SEQ ID NO: 2831347 - DNA, 23 bp, Homo sapiens
tggggctcctttctccagccagc

SEQ ID NO: 2831348 - DNA, 22 bp, Homo sapiens
tggggctctaacgcctgagccc

SEQ ID NO: 2831349 - DNA, 23 bp, Homo sapiens
tggggctctaacgcctgagccca

SEQ ID NO: 2831350 - DNA, 14 bp, Homo sapiens
tggggctgctcctc

SEQ ID NO: 2831351 - DNA, 21 bp, Homo sapiens
tggggctgctcctccagggcc

SEQ ID NO: 2831352 - DNA, 18 bp, Homo sapiens
tggggcttctcctgaccc

SEQ ID NO: 2831353 - DNA, 14 bp, Homo sapiens
tgggggaagccctg

SEQ ID NO: 2831354 - DNA, 15 bp, Homo sapiens
tgggggaagccctgg

SEQ ID NO: 2831355 - DNA, 20 bp, Homo sapiens
tgggggatgactagaggcag

SEQ ID NO: 2831356 - DNA, 16 bp, Homo sapiens
tgggggcctcagtgcc

SEQ ID NO: 2831357 - DNA, 11 bp, Homo sapiens
tgggggcctgg

SEQ ID NO: 2831358 - DNA, 13 bp, Homo sapiens
tgggggcctggct

SEQ ID NO: 2831359 - DNA, 19 bp, Homo sapiens
tgggggcctggctggctga

SEQ ID NO: 2831360 - DNA, 19 bp, Homo sapiens
tggggggtgatgagggcag

SEQ ID NO: 2831361 - DNA, 20 bp, Homo sapiens
tggggggtgatgagggcagc

SEQ ID NO: 2831362 - DNA, 15 bp, Homo sapiens
tgggggttctttctt

SEQ ID NO: 2831363 - DNA, 15 bp, Homo sapiens
tggggtacccactgc

SEQ ID NO: 2831364 - DNA, 17 bp, Homo sapiens
tggggtacccactgctc

SEQ ID NO: 2831365 - DNA, 20 bp, Homo sapiens
tggggtatttaccacagcag

SEQ ID NO: 2831366 - DNA, 13 bp, Homo sapiens
tggggtcagccag

SEQ ID NO: 2831367 - DNA, 21 bp, Homo sapiens
tggggtcagccagggccaggg

SEQ ID NO: 2831368 - DNA, 13 bp, Homo sapiens
tggggtccccatc

SEQ ID NO: 2831369 - DNA, 20 bp, Homo sapiens
tggggtcttgctatattgcc

SEQ ID NO: 2831370 - DNA, 17 bp, Homo sapiens
tggggtggagggtcgcc

SEQ ID NO: 2831371 - DNA, 13 bp, Homo sapiens
tggggtgggcagg

SEQ ID NO: 2831372 - DNA, 22 bp, Homo sapiens
tggggtgggggtggggagacct

SEQ ID NO: 2831373 - DNA, 14 bp, Homo sapiens
tggggttcagcccc

SEQ ID NO: 2831374 - DNA, 17 bp, Homo sapiens
tggggttcagcccctcc

SEQ ID NO: 2831375 - DNA, 16 bp, Homo sapiens
tggggttgcaaccact

SEQ ID NO: 2831376 - DNA, 18 bp, Homo sapiens
tgggtaatgaaacaaaga

SEQ ID NO: 2831377 - DNA, 15 bp, Homo sapiens
tgggtacaagagcca

SEQ ID NO: 2831378 - DNA, 20 bp, Homo sapiens
tgggtactactgctgcaaag

SEQ ID NO: 2831379 - DNA, 21 bp, Homo sapiens
tgggtaggtgttgaaaatgag

SEQ ID NO: 2831380 - DNA, 13 bp, Homo sapiens
tgggtattaaact

SEQ ID NO: 2831381 - DNA, 19 bp, Homo sapiens
tgggtcctgcaatctccag

SEQ ID NO: 2831382 - DNA, 21 bp, Homo sapiens
tgggtcctgcaatctccaggg

SEQ ID NO: 2831383 - DNA, 23 bp, Homo sapiens
tgggtgccccccttgccagacat

SEQ ID NO: 2831384 - DNA, 21 bp, Homo sapiens
tgggtgtcaagagggtctgag

SEQ ID NO: 2831385 - DNA, 23 bp, Homo sapiens
tgggtgtcaagagggtctgagga

SEQ ID NO: 2831386 - DNA, 23 bp, Homo sapiens
tgggttcaagcgattcttctgct

SEQ ID NO: 2831387 - DNA, 16 bp, Homo sapiens
tgggttcactgcaacc

SEQ ID NO: 2831388 - DNA, 18 bp, Homo sapiens
tggtaaaaagattatata

SEQ ID NO: 2831389 - DNA, 21 bp, Homo sapiens
tggtaacatcctttctattga

SEQ ID NO: 2831390 - DNA, 13 bp, Homo sapiens
tggtaagctctgg

SEQ ID NO: 2831391 - DNA, 16 bp, Homo sapiens
tggtacatggccagtg

SEQ ID NO: 2831392 - DNA, 15 bp, Homo sapiens
tggtaccagctcact

SEQ ID NO: 2831393 - DNA, 18 bp, Homo sapiens
tggtacggagatgtttca

SEQ ID NO: 2831394 - DNA, 20 bp, Homo sapiens
tggtactactagatgtcttt

SEQ ID NO: 2831395 - DNA, 19 bp, Homo sapiens
tggtatgaacttgaggaca

SEQ ID NO: 2831396 - DNA, 21 bp, Homo sapiens
tggtatgaacttgaggacaca

SEQ ID NO: 2831397 - DNA, 22 bp, Homo sapiens
tggtatgaacttgaggacacat

SEQ ID NO: 2831398 - DNA, 18 bp, Homo sapiens
tggtatgatcacggctca

SEQ ID NO: 2831399 - DNA, 19 bp, Homo sapiens
tggtatggaactctctcca

SEQ ID NO: 2831400 - DNA, 12 bp, Homo sapiens
tggtatgtgtgt

SEQ ID NO: 2831401 - DNA, 17 bp, Homo sapiens
tggtatgtgtgtgtatg

SEQ ID NO: 2831402 - DNA, 12 bp, Homo sapiens
tggtccagctct

SEQ ID NO: 2831403 - DNA, 13 bp, Homo sapiens
tggtccagctctt

SEQ ID NO: 2831404 - DNA, 16 bp, Homo sapiens
tgtaattttgtttgta

SEQ ID NO: 2831405 - DNA, 17 bp, Homo sapiens
tgtaattttgtttgtaa

SEQ ID NO: 2831406 - DNA, 18 bp, Homo sapiens
tgtaattttgtttgtaat

SEQ ID NO: 2831407 - DNA, 17 bp, Homo sapiens
tgtacaaaataaacaaa

SEQ ID NO: 2831408 - DNA, 22 bp, Homo sapiens
tgtacaaaataaacaaataaca

SEQ ID NO: 2831409 - DNA, 21 bp, Homo sapiens
tgtacaaaatcgattggcttt

SEQ ID NO: 2831410 - DNA, 20 bp, Homo sapiens
tgtacaaagtagagaagtat

SEQ ID NO: 2831411 - DNA, 17 bp, Homo sapiens
tgtacacgtgtcctgta

SEQ ID NO: 2831412 - DNA, 15 bp, Homo sapiens
tgtacagaattttta

SEQ ID NO: 2831413 - DNA, 17 bp, Homo sapiens
tgtacagtggagaaata

SEQ ID NO: 2831414 - DNA, 17 bp, Homo sapiens
tgtacagtgtgtaaagt

SEQ ID NO: 2831415 - DNA, 14 bp, Homo sapiens
tgtacagttataca

SEQ ID NO: 2831416 - DNA, 17 bp, Homo sapiens
tgtacagttatttatgc

SEQ ID NO: 2831417 - DNA, 21 bp, Homo sapiens
tgtacatatggaaatcctgtt

SEQ ID NO: 2831418 - DNA, 15 bp, Homo sapiens
tgtacattcctgata

SEQ ID NO: 2831419 - DNA, 18 bp, Homo sapiens
tgtacattcctgatactg

SEQ ID NO: 2831420 - DNA, 15 bp, Homo sapiens
tgtaccatcaataaa

SEQ ID NO: 2831421 - DNA, 12 bp, Homo sapiens
tgtaccatgtac

SEQ ID NO: 2831422 - DNA, 17 bp, Homo sapiens
tgtaccatgtacatgaa

SEQ ID NO: 2831423 - DNA, 16 bp, Homo sapiens
tgtaccatgttaaaga

SEQ ID NO: 2831424 - DNA, 17 bp, Homo sapiens
tgtaccatgttaaagag

SEQ ID NO: 2831425 - DNA, 19 bp, Homo sapiens
tgtacccaatttaattcca

SEQ ID NO: 2831426 - DNA, 16 bp, Homo sapiens
tgtacccaccgggcca

SEQ ID NO: 2831427 - DNA, 21 bp, Homo sapiens
tgtacccactcctcactgccc

SEQ ID NO: 2831428 - DNA, 16 bp, Homo sapiens
tgtacccttcctacag

SEQ ID NO: 2831429 - DNA, 18 bp, Homo sapiens
tgtaccgcgtctaccctg

SEQ ID NO: 2831430 - DNA, 22 bp, Homo sapiens
tgtaccgcgtctaccctgggat

SEQ ID NO: 2831431 - DNA, 15 bp, Homo sapiens
tgtacgaacccctcc

SEQ ID NO: 2831432 - DNA, 17 bp, Homo sapiens
tgtacgtctgacaggca

SEQ ID NO: 2831433 - DNA, 14 bp, Homo sapiens
tgtacgtctggtgt

SEQ ID NO: 2831434 - DNA, 18 bp, Homo sapiens
tgtactcaggaggctgag

SEQ ID NO: 2831435 - DNA, 15 bp, Homo sapiens
tgtactgtaattttg

SEQ ID NO: 2831436 - DNA, 22 bp, Homo sapiens
tgtacttaataaattcagatat

SEQ ID NO: 2831437 - DNA, 16 bp, Homo sapiens
tgtacttattttccaa

SEQ ID NO: 2831438 - DNA, 20 bp, Homo sapiens
tgtacttattttccaataaa

SEQ ID NO: 2831439 - DNA, 22 bp, Homo sapiens
tgtagaagtaggaagtgaaaat

SEQ ID NO: 2831440 - DNA, 16 bp, Homo sapiens
tgtagagccagggtct

SEQ ID NO: 2831441 - DNA, 14 bp, Homo sapiens
tgtagagcttctgg

SEQ ID NO: 2831442 - DNA, 21 bp, Homo sapiens
tgtagatggaaatcagttgtg

SEQ ID NO: 2831443 - DNA, 20 bp, Homo sapiens
tgtagcaactacagtctaaa

SEQ ID NO: 2831444 - DNA, 18 bp, Homo sapiens
tgtagcatttcttgatgt

SEQ ID NO: 2831445 - DNA, 16 bp, Homo sapiens
tgtagccccagtgaca

SEQ ID NO: 2831446 - DNA, 21 bp, Homo sapiens
tgtagccccagtgacagctag

SEQ ID NO: 2831447 - DNA, 13 bp, Homo sapiens
tgtagcctgtgca

SEQ ID NO: 2831448 - DNA, 16 bp, Homo sapiens
tgtagcctgtgcatgt

SEQ ID NO: 2831449 - DNA, 21 bp, Homo sapiens
tgtagctctatggggggaggg

SEQ ID NO: 2831450 - DNA, 14 bp, Homo sapiens
tgtagctctgtcca

SEQ ID NO: 2831451 - DNA, 14 bp, Homo sapiens
tgtagctggtttcc

SEQ ID NO: 2831452 - DNA, 17 bp, Homo sapiens
tgtagctgtgacctgct

SEQ ID NO: 2831453 - DNA, 22 bp, Homo sapiens
tgtagctgtgacctgctgagct

SEQ ID NO: 2831454 - DNA, 23 bp, Homo sapiens
tgtagctgtgacctgctgagctc

SEQ ID NO: 2831455 - DNA, 15 bp, Homo sapiens
tgtagctttgctctt

SEQ ID NO: 2831456 - DNA, 21 bp, Homo sapiens
tgtaggcccctggtctgccct

SEQ ID NO: 2831457 - DNA, 19 bp, Homo sapiens
tgtaggtgtctgcacccag

SEQ ID NO: 2831458 - DNA, 11 bp, Homo sapiens
tgtaggttgct

SEQ ID NO: 2831459 - DNA, 15 bp, Homo sapiens
tgtagtataaagaaa

SEQ ID NO: 2831460 - DNA, 18 bp, Homo sapiens
tgtagtatggcctgtgtc

SEQ ID NO: 2831461 - DNA, 15 bp, Homo sapiens
tgtagttaggaaata

SEQ ID NO: 2831462 - DNA, 20 bp, Homo sapiens
tgtagttgcgtggactctgc

SEQ ID NO: 2831463 - DNA, 21 bp, Homo sapiens
tgtagttgcgtggactctgca

SEQ ID NO: 2831464 - DNA, 22 bp, Homo sapiens
tgtataagattagaatgaaaat

SEQ ID NO: 2831465 - DNA, 20 bp, Homo sapiens
tgtatagatgcaagatattt

SEQ ID NO: 2831466 - DNA, 23 bp, Homo sapiens
tgtatagtaaagtgataatttct

SEQ ID NO: 2831467 - DNA, 15 bp, Homo sapiens
tgtatagtaaatcac

SEQ ID NO: 2831468 - DNA, 21 bp, Homo sapiens
tgtatagttttataaaactca

SEQ ID NO: 2831469 - DNA, 15 bp, Homo sapiens
tgtatatacaataac

SEQ ID NO: 2831470 - DNA, 17 bp, Homo sapiens
tgtatatacatattata

SEQ ID NO: 2831471 - DNA, 21 bp, Homo sapiens
tgtatatacatattataaata

SEQ ID NO: 2831472 - DNA, 12 bp, Homo sapiens
tgtatatagttt

SEQ ID NO: 2831473 - DNA, 14 bp, Homo sapiens
tgtatatatatata

SEQ ID NO: 2831474 - DNA, 19 bp, Homo sapiens
tgtatatctatatctctaa

SEQ ID NO: 2831475 - DNA, 17 bp, Homo sapiens
tgtatatgtatatctat

SEQ ID NO: 2831476 - DNA, 16 bp, Homo sapiens
tgtatattccaccatt

SEQ ID NO: 2831477 - DNA, 19 bp, Homo sapiens
tgtatattgtcagatattt

SEQ ID NO: 2831478 - DNA, 21 bp, Homo sapiens
tgtatcagagttgcttttcta

SEQ ID NO: 2831479 - DNA, 15 bp, Homo sapiens
tgtatcatagaaatg

SEQ ID NO: 2831480 - DNA, 17 bp, Homo sapiens
tgtatcatttgaacaac

SEQ ID NO: 2831481 - DNA, 19 bp, Homo sapiens
tgtatcccatgagcctcag

SEQ ID NO: 2831482 - DNA, 23 bp, Homo sapiens
tgtatcccatgagcctcagcatc

SEQ ID NO: 2831483 - DNA, 18 bp, Homo sapiens
tgtatctatgcattttct

SEQ ID NO: 2831484 - DNA, 13 bp, Homo sapiens
tgtatcttattta

SEQ ID NO: 2831485 - DNA, 17 bp, Homo sapiens
tgtatcttatttatata

SEQ ID NO: 2831486 - DNA, 21 bp, Homo sapiens
tgtatgaacatggagaggact

SEQ ID NO: 2831487 - DNA, 12 bp, Homo sapiens
tgtatgctggac

SEQ ID NO: 2831488 - DNA, 18 bp, Homo sapiens
tgtatggaaataaatgta

SEQ ID NO: 2831489 - DNA, 23 bp, Homo sapiens
tgtatggaaataaatgtatcata

SEQ ID NO: 2831490 - DNA, 16 bp, Homo sapiens
tgtatggaatacagtg

SEQ ID NO: 2831491 - DNA, 18 bp, Homo sapiens
tgtatggaatacagtgtt

SEQ ID NO: 2831492 - DNA, 19 bp, Homo sapiens
tgtatgtcttggacactgt

SEQ ID NO: 2831493 - DNA, 23 bp, Homo sapiens
tgtatgtgaaagtgtaaaataga

SEQ ID NO: 2831494 - DNA, 23 bp, Homo sapiens
tgtggggaagcaagacgtcctgg

SEQ ID NO: 2831495 - DNA, 12 bp, Homo sapiens
tgtggggccttg

SEQ ID NO: 2831496 - DNA, 18 bp, Homo sapiens
tgtgggggaggtccctgc

SEQ ID NO: 2831497 - DNA, 21 bp, Homo sapiens
tgtggtacaagcattctgtct

SEQ ID NO: 2831498 - DNA, 22 bp, Homo sapiens
tgtggtagggacttaaaaaact

SEQ ID NO: 2831499 - DNA, 17 bp, Homo sapiens
tgtggtggctgtctctg

SEQ ID NO: 2831500 - DNA, 22 bp, Homo sapiens
tgtggtgggttctttggaagga

SEQ ID NO: 2831501 - DNA, 23 bp, Homo sapiens
tgtggtgggttctttggaaggag

SEQ ID NO: 2831502 - DNA, 9 bp, Homo sapiens
tgtgtaaat

SEQ ID NO: 2831503 - DNA, 21 bp, Homo sapiens
tgtgtacagaattctgctacc

SEQ ID NO: 2831504 - DNA, 19 bp, Homo sapiens
tgtgtacagtgtgtaaagt

SEQ ID NO: 2831505 - DNA, 13 bp, Homo sapiens
tgtgtacccactc

SEQ ID NO: 2831506 - DNA, 23 bp, Homo sapiens
tgtgtacccactcctcactgccc

SEQ ID NO: 2831507 - DNA, 19 bp, Homo sapiens
tgtgtacttcagtcttgga

SEQ ID NO: 2831508 - DNA, 15 bp, Homo sapiens
tgtgtagcctgtgca

SEQ ID NO: 2831509 - DNA, 17 bp, Homo sapiens
tgtgtagctctgtccac

SEQ ID NO: 2831510 - DNA, 19 bp, Homo sapiens
tgtgtagctgtgacctgct

SEQ ID NO: 2831511 - DNA, 16 bp, Homo sapiens
tgtgtagggcgggagg

SEQ ID NO: 2831512 - DNA, 21 bp, Homo sapiens
tgtgtatatatatatatatgt

SEQ ID NO: 2831513 - DNA, 14 bp, Homo sapiens
tgtgtatgatccaa

SEQ ID NO: 2831514 - DNA, 14 bp, Homo sapiens
tgtgtattgaagaa

SEQ ID NO: 2831515 - DNA, 17 bp, Homo sapiens
tgtgtcacactgagctg

SEQ ID NO: 2831516 - DNA, 13 bp, Homo sapiens
tgtgtcagcatgc

SEQ ID NO: 2831517 - DNA, 20 bp, Homo sapiens
tgtgtcaggtggggcagctt

SEQ ID NO: 2831518 - DNA, 14 bp, Homo sapiens
tgtgtcatgatttc

SEQ ID NO: 2831519 - DNA, 13 bp, Homo sapiens
tgtgtctgtacac

SEQ ID NO: 2831520 - DNA, 14 bp, Homo sapiens
tgtgtctgtacacg

SEQ ID NO: 2831521 - DNA, 21 bp, Homo sapiens
tgtgtctgtacacgtgtcctg

SEQ ID NO: 2831522 - DNA, 14 bp, Homo sapiens
tgtgtggacaggac

SEQ ID NO: 2831523 - DNA, 14 bp, Homo sapiens
tgtgttatgaagca

SEQ ID NO: 2831524 - DNA, 18 bp, Homo sapiens
tgtgttgtctgtgcagct

SEQ ID NO: 2831525 - DNA, 18 bp, Homo sapiens
tgtgtttctaaaactatg

SEQ ID NO: 2831526 - DNA, 17 bp, Homo sapiens
tgtgtttcttgcctcat

SEQ ID NO: 2831527 - DNA, 13 bp, Homo sapiens
tgtgtttgtgtga

SEQ ID NO: 2831528 - DNA, 18 bp, Homo sapiens
tgttaaaatagacaactc

SEQ ID NO: 2831529 - DNA, 20 bp, Homo sapiens
tgttaaaatattgatttcta

SEQ ID NO: 2831530 - DNA, 21 bp, Homo sapiens
tgttaaagaggcgtcttgtat

SEQ ID NO: 2831531 - DNA, 22 bp, Homo sapiens
tgttaaagaggcgtcttgtatt

SEQ ID NO: 2831532 - DNA, 16 bp, Homo sapiens
tgttaaccagaataaa

SEQ ID NO: 2831533 - DNA, 22 bp, Homo sapiens
tgttaacttaatagtatttatg

SEQ ID NO: 2831534 - DNA, 15 bp, Homo sapiens
tgttaagacttgaca

SEQ ID NO: 2831535 - DNA, 17 bp, Homo sapiens
tgttaagacttgacagt

SEQ ID NO: 2831536 - DNA, 20 bp, Homo sapiens
tgttaagacttgacagtgga

SEQ ID NO: 2831537 - DNA, 14 bp, Homo sapiens
tgttaataataaga

SEQ ID NO: 2831538 - DNA, 17 bp, Homo sapiens
tgttaatggtttgaata

SEQ ID NO: 2831539 - DNA, 18 bp, Homo sapiens
tgttaatgttgggattta

SEQ ID NO: 2831540 - DNA, 15 bp, Homo sapiens
tgttaatttttgata

SEQ ID NO: 2831541 - DNA, 18 bp, Homo sapiens
tgttacaggtgtactatg

SEQ ID NO: 2831542 - DNA, 15 bp, Homo sapiens
tgttacattattatc

SEQ ID NO: 2831543 - DNA, 22 bp, Homo sapiens
tgttacctttcccatgctgaat

SEQ ID NO: 2831544 - DNA, 22 bp, Homo sapiens
tgttactaaagtcacatataaa

SEQ ID NO: 2831545 - DNA, 14 bp, Homo sapiens
tgttagctgttatt

SEQ ID NO: 2831546 - DNA, 12 bp, Homo sapiens
tgttaggggaaa

SEQ ID NO: 2831547 - DNA, 16 bp, Homo sapiens
tgttaggggaaaatag

SEQ ID NO: 2831548 - DNA, 15 bp, Homo sapiens
tgttattatcctgca

SEQ ID NO: 2831549 - DNA, 22 bp, Homo sapiens
tgttattattacttatttttga

SEQ ID NO: 2831550 - DNA, 14 bp, Homo sapiens
tgttatttaaagaa

SEQ ID NO: 2831551 - DNA, 22 bp, Homo sapiens
tgttatttttatatcagcctga

SEQ ID NO: 2831552 - DNA, 21 bp, Homo sapiens
tgttatttttgtttcttccaa

SEQ ID NO: 2831553 - DNA, 16 bp, Homo sapiens
tgttcacttttcctcc

SEQ ID NO: 2831554 - DNA, 15 bp, Homo sapiens
tgttcagctccagct

SEQ ID NO: 2831555 - DNA, 21 bp, Homo sapiens
tgttcagctccagctcaccag

SEQ ID NO: 2831556 - DNA, 13 bp, Homo sapiens
tgttcagttgact

SEQ ID NO: 2831557 - DNA, 14 bp, Homo sapiens
tgttcatggcagat

SEQ ID NO: 2831558 - DNA, 13 bp, Homo sapiens
tgttcatttcctc

SEQ ID NO: 2831559 - DNA, 22 bp, Homo sapiens
tgttcccaagagcatcatgcct

SEQ ID NO: 2831560 - DNA, 18 bp, Homo sapiens
tgttccccatggccactt

SEQ ID NO: 2831561 - DNA, 18 bp, Homo sapiens
tgttcccccgctggcagc

SEQ ID NO: 2831562 - DNA, 16 bp, Homo sapiens
tgttcctgatgtgcca

SEQ ID NO: 2831563 - DNA, 19 bp, Homo sapiens
tgttctgagtacttgattt

SEQ ID NO: 2831564 - DNA, 15 bp, Homo sapiens
tgttctgataatgaa

SEQ ID NO: 2831565 - DNA, 18 bp, Homo sapiens
tgttctgtccagtttcca

SEQ ID NO: 2831566 - DNA, 22 bp, Homo sapiens
tgttcttacctgtatgtctcca

SEQ ID NO: 2831567 - DNA, 23 bp, Homo sapiens
tgttgaaaaaaaagtttcagaga

SEQ ID NO: 2831568 - DNA, 16 bp, Homo sapiens
tgttgaagaagagttt

SEQ ID NO: 2831569 - DNA, 20 bp, Homo sapiens
tgttgaagaagagtttgcaa

SEQ ID NO: 2831570 - DNA, 21 bp, Homo sapiens
tgttgaagaagagtttgcaaa

SEQ ID NO: 2831571 - DNA, 22 bp, Homo sapiens
tgttgaatgcccacaggcaaat

SEQ ID NO: 2831572 - DNA, 19 bp, Homo sapiens
tgttgataaattccactgg

SEQ ID NO: 2831573 - DNA, 12 bp, Homo sapiens
tgttgatcccaa

SEQ ID NO: 2831574 - DNA, 13 bp, Homo sapiens
tgttgattaaaac

SEQ ID NO: 2831575 - DNA, 22 bp, Homo sapiens
tgttgattacataatcaaagct

SEQ ID NO: 2831576 - DNA, 16 bp, Homo sapiens
tgttgccatgaggcct

SEQ ID NO: 2831577 - DNA, 16 bp, Homo sapiens
tgttgcccaggcaggt

SEQ ID NO: 2831578 - DNA, 13 bp, Homo sapiens
tgttgcccaggct

SEQ ID NO: 2831579 - DNA, 19 bp, Homo sapiens
tgttgccttagcacttctt

SEQ ID NO: 2831580 - DNA, 21 bp, Homo sapiens
tgttgctcaaatctattcaga

SEQ ID NO: 2831581 - DNA, 14 bp, Homo sapiens
tgttgctgaaacac

SEQ ID NO: 2831582 - DNA, 14 bp, Homo sapiens
tgttgcttggacta

SEQ ID NO: 2831583 - DNA, 13 bp, Homo sapiens
tgttggaaaagaa

SEQ ID NO: 2831584 - DNA, 11 bp, Homo sapiens
tgttggccagg

SEQ ID NO: 2831585 - DNA, 13 bp, Homo sapiens
ttacgctctctgt

SEQ ID NO: 2831586 - DNA, 12 bp, Homo sapiens
ttactaaaagaa

SEQ ID NO: 2831587 - DNA, 14 bp, Homo sapiens
ttactacaaaattt

SEQ ID NO: 2831588 - DNA, 13 bp, Homo sapiens
ttactacatgcac

SEQ ID NO: 2831589 - DNA, 13 bp, Homo sapiens
ttactactgtgga

SEQ ID NO: 2831590 - DNA, 19 bp, Homo sapiens
ttactacttgttacctttc

SEQ ID NO: 2831591 - DNA, 21 bp, Homo sapiens
ttactacttgttacctttccc

SEQ ID NO: 2831592 - DNA, 14 bp, Homo sapiens
ttactcagccctgg

SEQ ID NO: 2831593 - DNA, 19 bp, Homo sapiens
ttactctccaacctggaca

SEQ ID NO: 2831594 - DNA, 14 bp, Homo sapiens
ttactcttcagttt

SEQ ID NO: 2831595 - DNA, 18 bp, Homo sapiens
ttactgagcttctctgtg

SEQ ID NO: 2831596 - DNA, 21 bp, Homo sapiens
ttactgcctttggaagaaaca

SEQ ID NO: 2831597 - DNA, 14 bp, Homo sapiens
ttactgctgtcatt

SEQ ID NO: 2831598 - DNA, 18 bp, Homo sapiens
ttactgtctgtaagagaa

SEQ ID NO: 2831599 - DNA, 18 bp, Homo sapiens
ttacttaaagcttgtttg

SEQ ID NO: 2831600 - DNA, 14 bp, Homo sapiens
ttacttaaatagca

SEQ ID NO: 2831601 - DNA, 11 bp, Homo sapiens
ttacttctgct

SEQ ID NO: 2831602 - DNA, 12 bp, Homo sapiens
ttacttctgcta

SEQ ID NO: 2831603 - DNA, 19 bp, Homo sapiens
ttacttgcacaagcttgta

SEQ ID NO: 2831604 - DNA, 18 bp, Homo sapiens
ttacttggtgtaattaat

SEQ ID NO: 2831605 - DNA, 20 bp, Homo sapiens
ttacttttgttctgtatttt

SEQ ID NO: 2831606 - DNA, 14 bp, Homo sapiens
ttagaaaactttaa

SEQ ID NO: 2831607 - DNA, 22 bp, Homo sapiens
ttagaaagaagcccaatattat

SEQ ID NO: 2831608 - DNA, 22 bp, Homo sapiens
ttagaacaggcaagtgaagaaa

SEQ ID NO: 2831609 - DNA, 13 bp, Homo sapiens
ttagaagtgttaa

SEQ ID NO: 2831610 - DNA, 14 bp, Homo sapiens
ttagaagtgtttta

SEQ ID NO: 2831611 - DNA, 13 bp, Homo sapiens
ttagacagagtct

SEQ ID NO: 2831612 - DNA, 12 bp, Homo sapiens
ttagacctcagc

SEQ ID NO: 2831613 - DNA, 14 bp, Homo sapiens
ttagacctcagcct

SEQ ID NO: 2831614 - DNA, 16 bp, Homo sapiens
ttagacctcagcctgt

SEQ ID NO: 2831615 - DNA, 16 bp, Homo sapiens
ttagactagttgaaca

SEQ ID NO: 2831616 - DNA, 16 bp, Homo sapiens
ttagactggaacttga

SEQ ID NO: 2831617 - DNA, 17 bp, Homo sapiens
ttagactggacagcttg

SEQ ID NO: 2831618 - DNA, 13 bp, Homo sapiens
ttagagatgaatt

SEQ ID NO: 2831619 - DNA, 16 bp, Homo sapiens
ttagagattaatttgt

SEQ ID NO: 2831620 - DNA, 18 bp, Homo sapiens
ttagagattaatttgtgt

SEQ ID NO: 2831621 - DNA, 18 bp, Homo sapiens
ttagaggaaaaaaatgac

SEQ ID NO: 2831622 - DNA, 21 bp, Homo sapiens
ttagagtatgcaagaagaata

SEQ ID NO: 2831623 - DNA, 15 bp, Homo sapiens
ttagatgttttacaa

SEQ ID NO: 2831624 - DNA, 18 bp, Homo sapiens
ttagattttgtgcagtta

SEQ ID NO: 2831625 - DNA, 19 bp, Homo sapiens
ttagcaaagagttaatata

SEQ ID NO: 2831626 - DNA, 22 bp, Homo sapiens
ttagcaaagatatctcatctct

SEQ ID NO: 2831627 - DNA, 15 bp, Homo sapiens
ttagcacaatttata

SEQ ID NO: 2831628 - DNA, 20 bp, Homo sapiens
ttagccactggtttctcaga

SEQ ID NO: 2831629 - DNA, 21 bp, Homo sapiens
ttagccttctctgttcatttc

SEQ ID NO: 2831630 - DNA, 21 bp, Homo sapiens
ttagcgtagctaagtgaaaag

SEQ ID NO: 2831631 - DNA, 19 bp, Homo sapiens
ttagctctggaccagcctg

SEQ ID NO: 2831632 - DNA, 13 bp, Homo sapiens
ttagctttaactt

SEQ ID NO: 2831633 - DNA, 21 bp, Homo sapiens
ttaggaaataaaacctttcaa

SEQ ID NO: 2831634 - DNA, 14 bp, Homo sapiens
ttaggaacagagta

SEQ ID NO: 2831635 - DNA, 18 bp, Homo sapiens
ttaggaagcaagcttaat

SEQ ID NO: 2831636 - DNA, 14 bp, Homo sapiens
ttaggggaaaatag

SEQ ID NO: 2831637 - DNA, 16 bp, Homo sapiens
ttaggggaaaatagta

SEQ ID NO: 2831638 - DNA, 16 bp, Homo sapiens
ttaggttataagaaac

SEQ ID NO: 2831639 - DNA, 22 bp, Homo sapiens
ttagtacagtagcttaaataaa

SEQ ID NO: 2831640 - DNA, 15 bp, Homo sapiens
ttagtatctaacatg

SEQ ID NO: 2831641 - DNA, 23 bp, Homo sapiens
ttagtatctaacatgtatcccaa

SEQ ID NO: 2831642 - DNA, 22 bp, Homo sapiens
ttagtatttatttaatgttatg

SEQ ID NO: 2831643 - DNA, 17 bp, Homo sapiens
ttagtgcggacaagttt

SEQ ID NO: 2831644 - DNA, 19 bp, Homo sapiens
ttagtgcggacaagtttta

SEQ ID NO: 2831645 - DNA, 14 bp, Homo sapiens
ttagtgtcacttac

SEQ ID NO: 2831646 - DNA, 18 bp, Homo sapiens
ttagtgtgttgtctgtgc

SEQ ID NO: 2831647 - DNA, 19 bp, Homo sapiens
ttagtgtgttgtctgtgca

SEQ ID NO: 2831648 - DNA, 22 bp, Homo sapiens
ttagtgtgttgtctgtgcagct

SEQ ID NO: 2831649 - DNA, 20 bp, Homo sapiens
ttagttgtatctcttttgaa

SEQ ID NO: 2831650 - DNA, 17 bp, Homo sapiens
ttagttttagttgcaga

SEQ ID NO: 2831651 - DNA, 12 bp, Homo sapiens
ttataaaaagtt

SEQ ID NO: 2831652 - DNA, 17 bp, Homo sapiens
ttataaactagatctcc

SEQ ID NO: 2831653 - DNA, 13 bp, Homo sapiens
ttataaataaatg

SEQ ID NO: 2831654 - DNA, 18 bp, Homo sapiens
ttataactcatcataaaa

SEQ ID NO: 2831655 - DNA, 22 bp, Homo sapiens
ttataactcatcataaaataaa

SEQ ID NO: 2831656 - DNA, 16 bp, Homo sapiens
ttataagcagatttaa

SEQ ID NO: 2831657 - DNA, 14 bp, Homo sapiens
ttataataatgttc

SEQ ID NO: 2831658 - DNA, 13 bp, Homo sapiens
ttataatgggtaa

SEQ ID NO: 2831659 - DNA, 21 bp, Homo sapiens
ttataatgtggatttcctatt

SEQ ID NO: 2831660 - DNA, 17 bp, Homo sapiens
ttatacaaaataattta

SEQ ID NO: 2831661 - DNA, 21 bp, Homo sapiens
ttatacaaaataatttaacta

SEQ ID NO: 2831662 - DNA, 18 bp, Homo sapiens
ttatacagctcagctttt

SEQ ID NO: 2831663 - DNA, 17 bp, Homo sapiens
ttatacatagtcacaaa

SEQ ID NO: 2831664 - DNA, 17 bp, Homo sapiens
ttatacatatcagaaaa

SEQ ID NO: 2831665 - DNA, 20 bp, Homo sapiens
ttatacgagtaatatgcctg

SEQ ID NO: 2831666 - DNA, 22 bp, Homo sapiens
ttatactctagaacatgcacat

SEQ ID NO: 2831667 - DNA, 18 bp, Homo sapiens
ttatatagtttactattt

SEQ ID NO: 2831668 - DNA, 16 bp, Homo sapiens
ttatatatatatgtat

SEQ ID NO: 2831669 - DNA, 17 bp, Homo sapiens
ttatatatcataaagta

SEQ ID NO: 2831670 - DNA, 12 bp, Homo sapiens
ttatatatgaag

SEQ ID NO: 2831671 - DNA, 17 bp, Homo sapiens
ttatatatgtatttata

SEQ ID NO: 2831672 - DNA, 22 bp, Homo sapiens
ttatatattggtaacatccttt

SEQ ID NO: 2831673 - DNA, 14 bp, Homo sapiens
ttatatatttataa

SEQ ID NO: 2831674 - DNA, 20 bp, Homo sapiens
ttatatatttataactcatc

SEQ ID NO: 2831675 - DNA, 23 bp, Homo sapiens
ttatatatttataactcatcata

SEQ ID NO: 2831676 - DNA, 15 bp, Homo sapiens
ttccacctgctttct

SEQ ID NO: 2831677 - DNA, 14 bp, Homo sapiens
ttccacgatgaaaa

SEQ ID NO: 2831678 - DNA, 19 bp, Homo sapiens
ttccacgtccccctggggc

SEQ ID NO: 2831679 - DNA, 18 bp, Homo sapiens
ttccactgccaaaacaat

SEQ ID NO: 2831680 - DNA, 19 bp, Homo sapiens
ttccactgccaaaacaatg

SEQ ID NO: 2831681 - DNA, 22 bp, Homo sapiens
ttccactggacttgagcttggc

SEQ ID NO: 2831682 - DNA, 17 bp, Homo sapiens
ttccagaaaaccccagc

SEQ ID NO: 2831683 - DNA, 12 bp, Homo sapiens
ttccagaaaata

SEQ ID NO: 2831684 - DNA, 23 bp, Homo sapiens
ttccagaaaatataaatgcatga

SEQ ID NO: 2831685 - DNA, 14 bp, Homo sapiens
ttccagacctgaag

SEQ ID NO: 2831686 - DNA, 17 bp, Homo sapiens
ttccagacctgaagaat

SEQ ID NO: 2831687 - DNA, 20 bp, Homo sapiens
ttccagaggctattattttc

SEQ ID NO: 2831688 - DNA, 14 bp, Homo sapiens
ttccagattgttct

SEQ ID NO: 2831689 - DNA, 14 bp, Homo sapiens
ttccaggccaccgc

SEQ ID NO: 2831690 - DNA, 14 bp, Homo sapiens
ttccagggcaatca

SEQ ID NO: 2831691 - DNA, 19 bp, Homo sapiens
ttccaggtatctccaggat

SEQ ID NO: 2831692 - DNA, 17 bp, Homo sapiens
ttccagtacctttgtca

SEQ ID NO: 2831693 - DNA, 19 bp, Homo sapiens
ttccagtacctttgtcaca

SEQ ID NO: 2831694 - DNA, 21 bp, Homo sapiens
ttccagtgagcttatcatgct

SEQ ID NO: 2831695 - DNA, 19 bp, Homo sapiens
ttccagttctgacacacgt

SEQ ID NO: 2831696 - DNA, 15 bp, Homo sapiens
ttccataaacaccca

SEQ ID NO: 2831697 - DNA, 22 bp, Homo sapiens
ttccataatctggactcctctg

SEQ ID NO: 2831698 - DNA, 23 bp, Homo sapiens
ttccataatctggactcctctgt

SEQ ID NO: 2831699 - DNA, 12 bp, Homo sapiens
ttccataattat

SEQ ID NO: 2831700 - DNA, 13 bp, Homo sapiens
ttccataattatg

SEQ ID NO: 2831701 - DNA, 18 bp, Homo sapiens
ttccatatattagcattt

SEQ ID NO: 2831702 - DNA, 18 bp, Homo sapiens
ttccatgaagaccacatc

SEQ ID NO: 2831703 - DNA, 18 bp, Homo sapiens
ttccatgagaacagcagg

SEQ ID NO: 2831704 - DNA, 14 bp, Homo sapiens
ttccatgattttac

SEQ ID NO: 2831705 - DNA, 14 bp, Homo sapiens
ttccatgcctgagg

SEQ ID NO: 2831706 - DNA, 18 bp, Homo sapiens
ttccatgcctgagggtgg

SEQ ID NO: 2831707 - DNA, 17 bp, Homo sapiens
ttccatgtcgcctctgc

SEQ ID NO: 2831708 - DNA, 20 bp, Homo sapiens
ttccatgtcgcctctgcatt

SEQ ID NO: 2831709 - DNA, 21 bp, Homo sapiens
ttccatgtcgcctctgcattc

SEQ ID NO: 2831710 - DNA, 19 bp, Homo sapiens
ttccatttcttcctcacta

SEQ ID NO: 2831711 - DNA, 19 bp, Homo sapiens
ttccatttttactaaagca

SEQ ID NO: 2831712 - DNA, 16 bp, Homo sapiens
ttcccaagctctgctc

SEQ ID NO: 2831713 - DNA, 18 bp, Homo sapiens
ttcccaagctctgctcct

SEQ ID NO: 2831714 - DNA, 12 bp, Homo sapiens
ttcccaataaaa

SEQ ID NO: 2831715 - DNA, 14 bp, Homo sapiens
ttcccaataaaagt

SEQ ID NO: 2831716 - DNA, 15 bp, Homo sapiens
ttcccaataaaagtg

SEQ ID NO: 2831717 - DNA, 15 bp, Homo sapiens
ttcccagagacagga

SEQ ID NO: 2831718 - DNA, 22 bp, Homo sapiens
ttcccagagacaggaaaatcct

SEQ ID NO: 2831719 - DNA, 23 bp, Homo sapiens
ttcccagagcaaaataattttaa

SEQ ID NO: 2831720 - DNA, 18 bp, Homo sapiens
ttcccagctctccctctg

SEQ ID NO: 2831721 - DNA, 19 bp, Homo sapiens
ttcccagctctccctctgg

SEQ ID NO: 2831722 - DNA, 15 bp, Homo sapiens
ttcccataattttct

SEQ ID NO: 2831723 - DNA, 15 bp, Homo sapiens
ttcccatccccagcg

SEQ ID NO: 2831724 - DNA, 14 bp, Homo sapiens
ttcccatgctgaat

SEQ ID NO: 2831725 - DNA, 16 bp, Homo sapiens
ttcccatgctgaatta

SEQ ID NO: 2831726 - DNA, 13 bp, Homo sapiens
ttcccatgttaaa

SEQ ID NO: 2831727 - DNA, 14 bp, Homo sapiens
ttcccatttgtaat

SEQ ID NO: 2831728 - DNA, 18 bp, Homo sapiens
ttcccatttgtaatgtat

SEQ ID NO: 2831729 - DNA, 19 bp, Homo sapiens
ttcccattttgcaaaattt

SEQ ID NO: 2831730 - DNA, 22 bp, Homo sapiens
ttccccagactcagctccagaa

SEQ ID NO: 2831731 - DNA, 11 bp, Homo sapiens
ttccccagtgt

SEQ ID NO: 2831732 - DNA, 23 bp, Homo sapiens
ttccccagtgtggccccagcccg

SEQ ID NO: 2831733 - DNA, 21 bp, Homo sapiens
ttcccccatcccctttcctcc

SEQ ID NO: 2831734 - DNA, 23 bp, Homo sapiens
ttcccccatcccctttcctcccc

SEQ ID NO: 2831735 - DNA, 19 bp, Homo sapiens
ttcccctaacctcattccc

SEQ ID NO: 2831736 - DNA, 17 bp, Homo sapiens
ttcccctcgctgtcctg

SEQ ID NO: 2831737 - DNA, 19 bp, Homo sapiens
ttcccctcgctgtcctgct

SEQ ID NO: 2831738 - DNA, 17 bp, Homo sapiens
ttcccctttccccactc

SEQ ID NO: 2831739 - DNA, 13 bp, Homo sapiens
ttccctacttcct

SEQ ID NO: 2831740 - DNA, 15 bp, Homo sapiens
ttccctatcaaaaca

SEQ ID NO: 2831741 - DNA, 18 bp, Homo sapiens
ttccctatcaaaacatat

SEQ ID NO: 2831742 - DNA, 23 bp, Homo sapiens
ttccctatcaaaacatatcaatt

SEQ ID NO: 2831743 - DNA, 13 bp, Homo sapiens
ttccctatctttt

SEQ ID NO: 2831744 - DNA, 12 bp, Homo sapiens
ttccctcacccc

SEQ ID NO: 2831745 - DNA, 18 bp, Homo sapiens
ttccctcaccccctccca

SEQ ID NO: 2831746 - DNA, 22 bp, Homo sapiens
ttccctcaccccctcccacccc

SEQ ID NO: 2831747 - DNA, 13 bp, Homo sapiens
ttccctcccggga

SEQ ID NO: 2831748 - DNA, 14 bp, Homo sapiens
ttccctctcccagg

SEQ ID NO: 2831749 - DNA, 15 bp, Homo sapiens
ttccctctcccaggc

SEQ ID NO: 2831750 - DNA, 16 bp, Homo sapiens
ttccctctcttgcctt

SEQ ID NO: 2831751 - DNA, 23 bp, Homo sapiens
ttccctctcttgcctttcttatt

SEQ ID NO: 2831752 - DNA, 22 bp, Homo sapiens
ttccctctgagaattccaagga

SEQ ID NO: 2831753 - DNA, 23 bp, Homo sapiens
ttccctctgagaattccaaggag

SEQ ID NO: 2831754 - DNA, 20 bp, Homo sapiens
ttccctgaaaacccagagag

SEQ ID NO: 2831755 - DNA, 18 bp, Homo sapiens
ttccctgaacatctgtgt

SEQ ID NO: 2831756 - DNA, 18 bp, Homo sapiens
ttccctgactcctctaag

SEQ ID NO: 2831757 - DNA, 21 bp, Homo sapiens
ttccctggcctggctctcctg

SEQ ID NO: 2831758 - DNA, 23 bp, Homo sapiens
ttccctggcttgtaactccacca

SEQ ID NO: 2831759 - DNA, 19 bp, Homo sapiens
ttccgtctccctaaaataa

SEQ ID NO: 2831760 - DNA, 16 bp, Homo sapiens
ttccgtgaagggcacc

SEQ ID NO: 2831761 - DNA, 18 bp, Homo sapiens
ttccgtgacgtcactgga

SEQ ID NO: 2831762 - DNA, 16 bp, Homo sapiens
ttcctacccaaccact

SEQ ID NO: 2831763 - DNA, 22 bp, Homo sapiens
ttcctatatagtttattgacaa

SEQ ID NO: 2831764 - DNA, 14 bp, Homo sapiens
ttcctcaccaataa

SEQ ID NO: 2831765 - DNA, 16 bp, Homo sapiens
ttcctcaccaataact

SEQ ID NO: 2831766 - DNA, 19 bp, Homo sapiens
ttgcccagggctcagcctg

SEQ ID NO: 2831767 - DNA, 13 bp, Homo sapiens
ttgccccttgggc

SEQ ID NO: 2831768 - DNA, 22 bp, Homo sapiens
ttgccccttgggcctcccccca

SEQ ID NO: 2831769 - DNA, 19 bp, Homo sapiens
ttgcccggattctgggagg

SEQ ID NO: 2831770 - DNA, 21 bp, Homo sapiens
ttgccctgacctcccagccct

SEQ ID NO: 2831771 - DNA, 16 bp, Homo sapiens
ttgcccttcacagtgt

SEQ ID NO: 2831772 - DNA, 19 bp, Homo sapiens
ttgcctaataaacatcctt

SEQ ID NO: 2831773 - DNA, 15 bp, Homo sapiens
ttgcctgccagggcc

SEQ ID NO: 2831774 - DNA, 14 bp, Homo sapiens
ttgcctgtaacaag

SEQ ID NO: 2831775 - DNA, 20 bp, Homo sapiens
ttgcctgtgtgagcatctct

SEQ ID NO: 2831776 - DNA, 22 bp, Homo sapiens
ttgccttagcacttctttcctc

SEQ ID NO: 2831777 - DNA, 19 bp, Homo sapiens
ttgccttcttcacccagct

SEQ ID NO: 2831778 - DNA, 15 bp, Homo sapiens
ttgcctttccacctg

SEQ ID NO: 2831779 - DNA, 23 bp, Homo sapiens
ttgcgctggtggaccacaggcat

SEQ ID NO: 2831780 - DNA, 18 bp, Homo sapiens
ttgcgtggactctgcaca

SEQ ID NO: 2831781 - DNA, 16 bp, Homo sapiens
ttgctaattaaaaagt

SEQ ID NO: 2831782 - DNA, 13 bp, Homo sapiens
ttgctacataatt

SEQ ID NO: 2831783 - DNA, 16 bp, Homo sapiens
ttgctacataattatc

SEQ ID NO: 2831784 - DNA, 13 bp, Homo sapiens
ttgctattggaat

SEQ ID NO: 2831785 - DNA, 14 bp, Homo sapiens
ttgctgctctctga

SEQ ID NO: 2831786 - DNA, 21 bp, Homo sapiens
ttgctgttgatgaggcctctt

SEQ ID NO: 2831787 - DNA, 14 bp, Homo sapiens
ttgcttatttatat

SEQ ID NO: 2831788 - DNA, 18 bp, Homo sapiens
ttgcttgagcccaggagt

SEQ ID NO: 2831789 - DNA, 23 bp, Homo sapiens
ttgctttaaagtacctgtagtga

SEQ ID NO: 2831790 - DNA, 15 bp, Homo sapiens
ttgctttttcaccag

SEQ ID NO: 2831791 - DNA, 22 bp, Homo sapiens
ttggaaccgtgtccagcacaga

SEQ ID NO: 2831792 - DNA, 18 bp, Homo sapiens
ttggaactctaccctggt

SEQ ID NO: 2831793 - DNA, 17 bp, Homo sapiens
ttggaagtgttccctga

SEQ ID NO: 2831794 - DNA, 16 bp, Homo sapiens
ttggaagttttcagga

SEQ ID NO: 2831795 - DNA, 18 bp, Homo sapiens
ttggacattttcttcaga

SEQ ID NO: 2831796 - DNA, 15 bp, Homo sapiens
ttggacccgctctgg

SEQ ID NO: 2831797 - DNA, 14 bp, Homo sapiens
ttggacctctgctc

SEQ ID NO: 2831798 - DNA, 18 bp, Homo sapiens
ttggacctctgctctgag

SEQ ID NO: 2831799 - DNA, 21 bp, Homo sapiens
ttggacctctgctctgaggct

SEQ ID NO: 2831800 - DNA, 13 bp, Homo sapiens
ttggactattata

SEQ ID NO: 2831801 - DNA, 14 bp, Homo sapiens
ttggactcctccca

SEQ ID NO: 2831802 - DNA, 18 bp, Homo sapiens
ttggagaaaatgaagaaa

SEQ ID NO: 2831803 - DNA, 13 bp, Homo sapiens
ttggagactctgt

SEQ ID NO: 2831804 - DNA, 21 bp, Homo sapiens
ttggagagggacgaagaaagg

SEQ ID NO: 2831805 - DNA, 15 bp, Homo sapiens
ttggaggacagtggg

SEQ ID NO: 2831806 - DNA, 21 bp, Homo sapiens
ttggatgggagtgagacagaa

SEQ ID NO: 2831807 - DNA, 15 bp, Homo sapiens
ttggcacagaaacac

SEQ ID NO: 2831808 - DNA, 14 bp, Homo sapiens
ttggcagtgtgtca

SEQ ID NO: 2831809 - DNA, 16 bp, Homo sapiens
ttggcagtgtgtcaca

SEQ ID NO: 2831810 - DNA, 24 bp, Homo sapiens
ttggccaaagccaaagctaggcct

SEQ ID NO: 2831811 - DNA, 22 bp, Homo sapiens
ttggccaatgcacctaaagaaa

SEQ ID NO: 2831812 - DNA, 24 bp, Homo sapiens
ttggcctggtggccatgtcgcctg

SEQ ID NO: 2831813 - DNA, 20 bp, Homo sapiens
ttggcgggcagcccagcctc

SEQ ID NO: 2831814 - DNA, 22 bp, Homo sapiens
ttggctgggggcctcagtgcca

SEQ ID NO: 2831815 - DNA, 13 bp, Homo sapiens
ttggcttattttt

SEQ ID NO: 2831816 - DNA, 22 bp, Homo sapiens
ttggctttaaacacccttcaca

SEQ ID NO: 2831817 - DNA, 17 bp, Homo sapiens
ttgggaattgcatgcca

SEQ ID NO: 2831818 - DNA, 16 bp, Homo sapiens
ttgggagcactggagt

SEQ ID NO: 2831819 - DNA, 12 bp, Homo sapiens
ttgggaggctga

SEQ ID NO: 2831820 - DNA, 15 bp, Homo sapiens
ttgggatatctcctg

SEQ ID NO: 2831821 - DNA, 21 bp, Homo sapiens
ttgggattttaaaaacatgag

SEQ ID NO: 2831822 - DNA, 20 bp, Homo sapiens
ttgggcacccccagcctggg

SEQ ID NO: 2831823 - DNA, 20 bp, Homo sapiens
ttgggcagaagggagaagga

SEQ ID NO: 2831824 - DNA, 13 bp, Homo sapiens
ttgggccctgcac

SEQ ID NO: 2831825 - DNA, 17 bp, Homo sapiens
ttggggtacccactgct

SEQ ID NO: 2831826 - DNA, 22 bp, Homo sapiens
ttggggtacccactgctctggt

SEQ ID NO: 2831827 - DNA, 16 bp, Homo sapiens
ttggggtctgccacca

SEQ ID NO: 2831828 - DNA, 16 bp, Homo sapiens
ttgggtggatgcctgg

SEQ ID NO: 2831829 - DNA, 19 bp, Homo sapiens
ttgggtgtaacaggtctcc

SEQ ID NO: 2831830 - DNA, 20 bp, Homo sapiens
ttgggtgtaacaggtctcct

SEQ ID NO: 2831831 - DNA, 21 bp, Homo sapiens
ttgggtgtaacaggtctcctc

SEQ ID NO: 2831832 - DNA, 16 bp, Homo sapiens
ttgggttcatctgagc

SEQ ID NO: 2831833 - DNA, 20 bp, Homo sapiens
ttggtacatggccagtgtga

SEQ ID NO: 2831834 - DNA, 18 bp, Homo sapiens
ttggtaggcttatcaaaa

SEQ ID NO: 2831835 - DNA, 17 bp, Homo sapiens
ttggtatcaagaaagtc

SEQ ID NO: 2831836 - DNA, 14 bp, Homo sapiens
ttggtctcagcttc

SEQ ID NO: 2831837 - DNA, 17 bp, Homo sapiens
ttggtgataagtggaaa

SEQ ID NO: 2831838 - DNA, 14 bp, Homo sapiens
ttggtggccacata

SEQ ID NO: 2831839 - DNA, 13 bp, Homo sapiens
ttggtgttgacat

SEQ ID NO: 2831840 - DNA, 17 bp, Homo sapiens
ttggttagaacctccta

SEQ ID NO: 2831841 - DNA, 14 bp, Homo sapiens
ttggttcccttgtg

SEQ ID NO: 2831842 - DNA, 15 bp, Homo sapiens
ttggttctaatagaa

SEQ ID NO: 2831843 - DNA, 22 bp, Homo sapiens
ttggttgtcaatattaaataca

SEQ ID NO: 2831844 - DNA, 12 bp, Homo sapiens
ttgtaaaaaagg

SEQ ID NO: 2831845 - DNA, 23 bp, Homo sapiens
ttgtaaaagaacagtaaacattg

SEQ ID NO: 2831846 - DNA, 17 bp, Homo sapiens
ttgtaaatagctcaggt

SEQ ID NO: 2831847 - DNA, 13 bp, Homo sapiens
ttgtaaatattgt

SEQ ID NO: 2831848 - DNA, 12 bp, Homo sapiens
ttgtaaatattt

SEQ ID NO: 2831849 - DNA, 18 bp, Homo sapiens
ttgtaagacaaaggtttt

SEQ ID NO: 2831850 - DNA, 20 bp, Homo sapiens
ttgtaagagtggaaccaaca

SEQ ID NO: 2831851 - DNA, 12 bp, Homo sapiens
ttgtaataaact

SEQ ID NO: 2831852 - DNA, 13 bp, Homo sapiens
ttgtaataaactc

SEQ ID NO: 2831853 - DNA, 16 bp, Homo sapiens
ttgtaataaactctct

SEQ ID NO: 2831854 - DNA, 19 bp, Homo sapiens
ttgtaatcctgtatattat

SEQ ID NO: 2831855 - DNA, 23 bp, Homo sapiens
ttgtaattctaaatgaatgttta

SEQ ID NO: 2831856 - DNA, 23 bp, Homo sapiens
ttgtacaaaataaacaaataaca

SEQ ID NO: 2831857 - DNA, 12 bp, Homo sapiens
tttatttgttga

SEQ ID NO: 2831858 - DNA, 14 bp, Homo sapiens
tttatttgttgaga

SEQ ID NO: 2831859 - DNA, 18 bp, Homo sapiens
tttatttgttgagagtgt

SEQ ID NO: 2831860 - DNA, 23 bp, Homo sapiens
tttatttttgaacccctgtgtcc

SEQ ID NO: 2831861 - DNA, 21 bp, Homo sapiens
tttcaaaaattgtgtttagat

SEQ ID NO: 2831862 - DNA, 13 bp, Homo sapiens
tttcaaaagtgga

SEQ ID NO: 2831863 - DNA, 14 bp, Homo sapiens
tttcaaatttcaca

SEQ ID NO: 2831864 - DNA, 15 bp, Homo sapiens
tttcaaccagcattt

SEQ ID NO: 2831865 - DNA, 18 bp, Homo sapiens
tttcaaccagcattttac

SEQ ID NO: 2831866 - DNA, 15 bp, Homo sapiens
tttcaacttaaatca

SEQ ID NO: 2831867 - DNA, 13 bp, Homo sapiens
tttcaagaaaact

SEQ ID NO: 2831868 - DNA, 19 bp, Homo sapiens
tttcaagaaactgaggaat

SEQ ID NO: 2831869 - DNA, 14 bp, Homo sapiens
tttcaagagaagaa

SEQ ID NO: 2831870 - DNA, 21 bp, Homo sapiens
tttcaatgattgtttaattgt

SEQ ID NO: 2831871 - DNA, 21 bp, Homo sapiens
tttcaatggtttgcaaggaag

SEQ ID NO: 2831872 - DNA, 22 bp, Homo sapiens
tttcaattccacctgcaatcaa

SEQ ID NO: 2831873 - DNA, 14 bp, Homo sapiens
tttcaatttccaag

SEQ ID NO: 2831874 - DNA, 17 bp, Homo sapiens
tttcactatgattttct

SEQ ID NO: 2831875 - DNA, 18 bp, Homo sapiens
tttcactatgattttcta

SEQ ID NO: 2831876 - DNA, 24 bp, Homo sapiens
tttcactgtagaatgatttcatgc

SEQ ID NO: 2831877 - DNA, 14 bp, Homo sapiens
tttcagaccccagc

SEQ ID NO: 2831878 - DNA, 17 bp, Homo sapiens
tttcagaggctgcagga

SEQ ID NO: 2831879 - DNA, 19 bp, Homo sapiens
tttcaggatactctgtcag

SEQ ID NO: 2831880 - DNA, 21 bp, Homo sapiens
tttcaggggtcgtcaccacct

SEQ ID NO: 2831881 - DNA, 19 bp, Homo sapiens
tttcaggttttgtaaagat

SEQ ID NO: 2831882 - DNA, 17 bp, Homo sapiens
tttcagtgaaagcatca

SEQ ID NO: 2831883 - DNA, 13 bp, Homo sapiens
tttcatataaagt

SEQ ID NO: 2831884 - DNA, 23 bp, Homo sapiens
tttcatccctatgggattcagtg

SEQ ID NO: 2831885 - DNA, 16 bp, Homo sapiens
tttcatctatttctga

SEQ ID NO: 2831886 - DNA, 18 bp, Homo sapiens
tttcatctatttctgaga

SEQ ID NO: 2831887 - DNA, 12 bp, Homo sapiens
tttcatctcatt

SEQ ID NO: 2831888 - DNA, 21 bp, Homo sapiens
tttcatctcatttaagggaaa

SEQ ID NO: 2831889 - DNA, 19 bp, Homo sapiens
tttcatgataatgaacaga

SEQ ID NO: 2831890 - DNA, 16 bp, Homo sapiens
tttcatgctatctctg

SEQ ID NO: 2831891 - DNA, 14 bp, Homo sapiens
tttcattaaaaatg

SEQ ID NO: 2831892 - DNA, 14 bp, Homo sapiens
tttcattaaagcat

SEQ ID NO: 2831893 - DNA, 22 bp, Homo sapiens
tttccacaagattcccagagac

SEQ ID NO: 2831894 - DNA, 21 bp, Homo sapiens
tttccagaaaatataaatgca

SEQ ID NO: 2831895 - DNA, 22 bp, Homo sapiens
tttccagaaaatataaatgcat

SEQ ID NO: 2831896 - DNA, 23 bp, Homo sapiens
tttccagaaaatataaatgcatg

SEQ ID NO: 2831897 - DNA, 24 bp, Homo sapiens
tttccagaaaatataaatgcatga

SEQ ID NO: 2831898 - DNA, 15 bp, Homo sapiens
tttccagttctgaca

SEQ ID NO: 2831899 - DNA, 23 bp, Homo sapiens
tttccatctgcttgtattttcca

SEQ ID NO: 2831900 - DNA, 13 bp, Homo sapiens
tttcccaccacct

SEQ ID NO: 2831901 - DNA, 12 bp, Homo sapiens
tttcccataatt

SEQ ID NO: 2831902 - DNA, 13 bp, Homo sapiens
tttcccatgctga

SEQ ID NO: 2831903 - DNA, 15 bp, Homo sapiens
tttccctcaccccct

SEQ ID NO: 2831904 - DNA, 14 bp, Homo sapiens
tttccctcccggga

SEQ ID NO: 2831905 - DNA, 13 bp, Homo sapiens
tttccctgacctc

SEQ ID NO: 2831906 - DNA, 15 bp, Homo sapiens
tttccgtctccctaa

SEQ ID NO: 2831907 - DNA, 23 bp, Homo sapiens
tttccgtgaagggcaccgagaac

SEQ ID NO: 2831908 - DNA, 17 bp, Homo sapiens
tttcctaaatgcagtga

SEQ ID NO: 2831909 - DNA, 17 bp, Homo sapiens
tttcctagccctctcac

SEQ ID NO: 2831910 - DNA, 13 bp, Homo sapiens
tttcctattttaa

SEQ ID NO: 2831911 - DNA, 14 bp, Homo sapiens
tttcctccccacct

SEQ ID NO: 2831912 - DNA, 12 bp, Homo sapiens
tttcctgtgtct

SEQ ID NO: 2831913 - DNA, 16 bp, Homo sapiens
tttcgtgcatttgtga

SEQ ID NO: 2831914 - DNA, 13 bp, Homo sapiens
tttctaaaactat

SEQ ID NO: 2831915 - DNA, 19 bp, Homo sapiens
tttctaaagctctgaacaa

SEQ ID NO: 2831916 - DNA, 14 bp, Homo sapiens
tttctaaagttgtt

SEQ ID NO: 2831917 - DNA, 15 bp, Homo sapiens
tttctaatgtgtgaa

SEQ ID NO: 2831918 - DNA, 17 bp, Homo sapiens
tttctaggtaggaaatg

SEQ ID NO: 2831919 - DNA, 21 bp, Homo sapiens
tttctaggtaggaaatgtggt

SEQ ID NO: 2831920 - DNA, 18 bp, Homo sapiens
tttctatagccaaaaata

SEQ ID NO: 2831921 - DNA, 22 bp, Homo sapiens
tttctatagccaaaaatagcta

SEQ ID NO: 2831922 - DNA, 13 bp, Homo sapiens
tttctatagctct

SEQ ID NO: 2831923 - DNA, 14 bp, Homo sapiens
tttctatcacatat

SEQ ID NO: 2831924 - DNA, 17 bp, Homo sapiens
tttctattgaaaaatca

SEQ ID NO: 2831925 - DNA, 19 bp, Homo sapiens
tttctcagaatccaaagat

SEQ ID NO: 2831926 - DNA, 23 bp, Homo sapiens
tttctcagccgcttctgactgct

SEQ ID NO: 2831927 - DNA, 15 bp, Homo sapiens
tttctcctcccagga

SEQ ID NO: 2831928 - DNA, 20 bp, Homo sapiens
tttctctccagcctgacttg

SEQ ID NO: 2831929 - DNA, 14 bp, Homo sapiens
tttctgaccaaaga

SEQ ID NO: 2831930 - DNA, 16 bp, Homo sapiens
tttctgagaaggtcct

SEQ ID NO: 2831931 - DNA, 19 bp, Homo sapiens
tttctgagaaggtccttaa

SEQ ID NO: 2831932 - DNA, 16 bp, Homo sapiens
tttctgaggagaaaca

SEQ ID NO: 2831933 - DNA, 16 bp, Homo sapiens
tttctgagttcctgca

SEQ ID NO: 2831934 - DNA, 17 bp, Homo sapiens
tttctgatgacataata

SEQ ID NO: 2831935 - DNA, 14 bp, Homo sapiens
tttctgttcatctt

SEQ ID NO: 2831936 - DNA, 16 bp, Homo sapiens
tttcttaaacaaatgt

SEQ ID NO: 2831937 - DNA, 12 bp, Homo sapiens
tttcttaaataa

SEQ ID NO: 2831938 - DNA, 18 bp, Homo sapiens
tttcttaaataagaaact

SEQ ID NO: 2831939 - DNA, 17 bp, Homo sapiens
tttcttatcttctgcaa

SEQ ID NO: 2831940 - DNA, 17 bp, Homo sapiens
tttcttattttgtaata

SEQ ID NO: 2831941 - DNA, 20 bp, Homo sapiens
tttcttattttgtaataaac

SEQ ID NO: 2831942 - DNA, 16 bp, Homo sapiens
tttcttcatgcaatga

SEQ ID NO: 2831943 - DNA, 14 bp, Homo sapiens
tttcttcccatcac

SEQ ID NO: 2831944 - DNA, 22 bp, Homo sapiens
tttcttcccatttgtaatgtat

SEQ ID NO: 2831945 - DNA, 22 bp, Homo sapiens
tttcttgactcttgttttcagt

SEQ ID NO: 2831946 - DNA, 12 bp, Homo sapiens
tttcttgcctca

SEQ ID NO: 2831947 - DNA, 13 bp, Homo sapiens
tttcttgcctcat

SEQ ID NO: 2831948 - DNA, 17 bp, Homo sapiens
aaattataacttaaaat

SEQ ID NO: 2831949 - DNA, 19 bp, Homo sapiens
aaattataacttaaaatat

SEQ ID NO: 2831950 - DNA, 16 bp, Homo sapiens
aaattatggtgaaatt

SEQ ID NO: 2831951 - DNA, 12 bp, Homo sapiens
aaattatttaaa

SEQ ID NO: 2831952 - DNA, 13 bp, Homo sapiens
aaattcaaaccat

SEQ ID NO: 2831953 - DNA, 20 bp, Homo sapiens
aaattcaacctgtgtcttat

SEQ ID NO: 2831954 - DNA, 13 bp, Homo sapiens
aaattcacactgt

SEQ ID NO: 2831955 - DNA, 20 bp, Homo sapiens
aaattcagatatatttttca

SEQ ID NO: 2831956 - DNA, 13 bp, Homo sapiens
aaattcctgttgt

SEQ ID NO: 2831957 - DNA, 22 bp, Homo sapiens
aaattccttagcttagacctca

SEQ ID NO: 2831958 - DNA, 11 bp, Homo sapiens
aaattcttttt

SEQ ID NO: 2831959 - DNA, 12 bp, Homo sapiens
aaattgaagaga

SEQ ID NO: 2831960 - DNA, 12 bp, Homo sapiens
aaattgcacaat

SEQ ID NO: 2831961 - DNA, 14 bp, Homo sapiens
aaattgctccttga

SEQ ID NO: 2831962 - DNA, 15 bp, Homo sapiens
aaattggaattttct

SEQ ID NO: 2831963 - DNA, 14 bp, Homo sapiens
aaattggtgtttct

SEQ ID NO: 2831964 - DNA, 21 bp, Homo sapiens
aaattgtcttttgtcatgtgg

SEQ ID NO: 2831965 - DNA, 13 bp, Homo sapiens
aaattgttcctga

SEQ ID NO: 2831966 - DNA, 22 bp, Homo sapiens
aaattgtttaagtgttgtaaat

SEQ ID NO: 2831967 - DNA, 14 bp, Homo sapiens
aaatttaaactata

SEQ ID NO: 2831968 - DNA, 15 bp, Homo sapiens
aaatttaattttgca

SEQ ID NO: 2831969 - DNA, 22 bp, Homo sapiens
aaatttccagtacctttgtcac

SEQ ID NO: 2831970 - DNA, 16 bp, Homo sapiens
aaatttggttctaata

SEQ ID NO: 2831971 - DNA, 19 bp, Homo sapiens
aaattttactgacagaaat

SEQ ID NO: 2831972 - DNA, 18 bp, Homo sapiens
aaattttggccaaagtgt

SEQ ID NO: 2831973 - DNA, 19 bp, Homo sapiens
aacaaaaacactaaaaata

SEQ ID NO: 2831974 - DNA, 14 bp, Homo sapiens
aacaaaaccagctg

SEQ ID NO: 2831975 - DNA, 14 bp, Homo sapiens
aacaaagaaatatt

SEQ ID NO: 2831976 - DNA, 23 bp, Homo sapiens
aacaaagagttcaagaaataagt

SEQ ID NO: 2831977 - DNA, 18 bp, Homo sapiens
aacaaatatttatatatt

SEQ ID NO: 2831978 - DNA, 13 bp, Homo sapiens
aacaacatgtata

SEQ ID NO: 2831979 - DNA, 17 bp, Homo sapiens
aacaactaatcaagagt

SEQ ID NO: 2831980 - DNA, 17 bp, Homo sapiens
aacaacttctttgtaat

SEQ ID NO: 2831981 - DNA, 17 bp, Homo sapiens
aacaagaaagaaacgta

SEQ ID NO: 2831982 - DNA, 12 bp, Homo sapiens
aacaagaattgg

SEQ ID NO: 2831983 - DNA, 19 bp, Homo sapiens
aacaagatctttcaggaaa

SEQ ID NO: 2831984 - DNA, 16 bp, Homo sapiens
aacaaggtagttttta

SEQ ID NO: 2831985 - DNA, 16 bp, Homo sapiens
aacaaggttcttctaa

SEQ ID NO: 2831986 - DNA, 15 bp, Homo sapiens
aacaataaagagctc

SEQ ID NO: 2831987 - DNA, 22 bp, Homo sapiens
aacaatagctattgcatgtaaa

SEQ ID NO: 2831988 - DNA, 12 bp, Homo sapiens
aacaattctaaa

SEQ ID NO: 2831989 - DNA, 17 bp, Homo sapiens
aacacaagccacagaag

SEQ ID NO: 2831990 - DNA, 22 bp, Homo sapiens
aacacagcctgggaccagggca

SEQ ID NO: 2831991 - DNA, 15 bp, Homo sapiens
aacacaggcaaaatc

SEQ ID NO: 2831992 - DNA, 22 bp, Homo sapiens
aacacattacttgcacaagctt

SEQ ID NO: 2831993 - DNA, 15 bp, Homo sapiens
aacaccactttgtct

SEQ ID NO: 2831994 - DNA, 20 bp, Homo sapiens
aacacccagtctgttcccca

SEQ ID NO: 2831995 - DNA, 21 bp, Homo sapiens
aacacccatgaatcaaagaca

SEQ ID NO: 2831996 - DNA, 23 bp, Homo sapiens
aacacctcccaggagacagttca

SEQ ID NO: 2831997 - DNA, 14 bp, Homo sapiens
aacacctgacacat

SEQ ID NO: 2831998 - DNA, 17 bp, Homo sapiens
aacacctgacacatctt

SEQ ID NO: 2831999 - DNA, 14 bp, Homo sapiens
aacacgcattgtac

SEQ ID NO: 2832000 - DNA, 15 bp, Homo sapiens
aacactaaaaataaa

SEQ ID NO: 2832001 - DNA, 18 bp, Homo sapiens
aacactatatggcagtgt

SEQ ID NO: 2832002 - DNA, 20 bp, Homo sapiens
aacactatatggcagtgtct

SEQ ID NO: 2832003 - DNA, 17 bp, Homo sapiens
aacactcagaagcctgg

SEQ ID NO: 2832004 - DNA, 19 bp, Homo sapiens
aacactcagaagcctgggg

SEQ ID NO: 2832005 - DNA, 14 bp, Homo sapiens
aacactgcaagaag

SEQ ID NO: 2832006 - DNA, 16 bp, Homo sapiens
aacactgtaatcttaa

SEQ ID NO: 2832007 - DNA, 20 bp, Homo sapiens
aacacttctcatcatattgt

SEQ ID NO: 2832008 - DNA, 18 bp, Homo sapiens
aacagaacatagacagaa

SEQ ID NO: 2832009 - DNA, 16 bp, Homo sapiens
aacagaagcttccatt

SEQ ID NO: 2832010 - DNA, 18 bp, Homo sapiens
aacagacaaaaacagcct

SEQ ID NO: 2832011 - DNA, 19 bp, Homo sapiens
aacagacaccatcttttgt

SEQ ID NO: 2832012 - DNA, 11 bp, Homo sapiens
aacagacagga

SEQ ID NO: 2832013 - DNA, 14 bp, Homo sapiens
aacagacaggagaa

SEQ ID NO: 2832014 - DNA, 16 bp, Homo sapiens
aacagagaaggcagga

SEQ ID NO: 2832015 - DNA, 13 bp, Homo sapiens
aacagagatgtga

SEQ ID NO: 2832016 - DNA, 12 bp, Homo sapiens
aacagagcaaga

SEQ ID NO: 2832017 - DNA, 16 bp, Homo sapiens
aacagagccttcacaa

SEQ ID NO: 2832018 - DNA, 17 bp, Homo sapiens
aacagaggccatggcag

SEQ ID NO: 2832019 - DNA, 20 bp, Homo sapiens
aacagaggcgtctcacattt

SEQ ID NO: 2832020 - DNA, 14 bp, Homo sapiens
aacagagtatatat

SEQ ID NO: 2832021 - DNA, 15 bp, Homo sapiens
aacagagtatatatg

SEQ ID NO: 2832022 - DNA, 18 bp, Homo sapiens
aacagagtatatatgtac

SEQ ID NO: 2832023 - DNA, 19 bp, Homo sapiens
aacagagtgagaccctgtc

SEQ ID NO: 2832024 - DNA, 20 bp, Homo sapiens
aacagatataaatggctggt

SEQ ID NO: 2832025 - DNA, 16 bp, Homo sapiens
aacagattgtttgcaa

SEQ ID NO: 2832026 - DNA, 16 bp, Homo sapiens
aacagcagaggttctt

SEQ ID NO: 2832027 - DNA, 21 bp, Homo sapiens
aacagcagggtagtctggttt

SEQ ID NO: 2832028 - DNA, 20 bp, Homo sapiens
aacagccgctcctgtctgcc

SEQ ID NO: 2832029 - DNA, 13 bp, Homo sapiens
aacagcctcacag

SEQ ID NO: 2832030 - DNA, 15 bp, Homo sapiens
aacaggaatctcaga

SEQ ID NO: 2832031 - DNA, 18 bp, Homo sapiens
aacaggctactctcctcg

SEQ ID NO: 2832032 - DNA, 20 bp, Homo sapiens
aacaggctcaatattcctga

SEQ ID NO: 2832033 - DNA, 22 bp, Homo sapiens
aacagggaaggcaggcagggct

SEQ ID NO: 2832034 - DNA, 14 bp, Homo sapiens
aacagggagactgc

SEQ ID NO: 2832035 - DNA, 17 bp, Homo sapiens
aacaggggatcaaagtt

SEQ ID NO: 2832036 - DNA, 18 bp, Homo sapiens
aacaggggatcaaagttc

SEQ ID NO: 2832037 - DNA, 13 bp, Homo sapiens
aacaggtctcctc

SEQ ID NO: 2832038 - DNA, 20 bp, Homo sapiens
aacaggtctcctcttaaaaa

SEQ ID NO: 2832039 - DNA, 16 bp, Homo sapiens
aagagttcaagaaata

SEQ ID NO: 2832040 - DNA, 21 bp, Homo sapiens
aagagttctttaggtgcctcc

SEQ ID NO: 2832041 - DNA, 21 bp, Homo sapiens
aagataacaagatctttcagg

SEQ ID NO: 2832042 - DNA, 21 bp, Homo sapiens
aagataggtttgagttcaaat

SEQ ID NO: 2832043 - DNA, 22 bp, Homo sapiens
aagatcaaaagcttattcatct

SEQ ID NO: 2832044 - DNA, 20 bp, Homo sapiens
aagatcgcgccactgcactc

SEQ ID NO: 2832045 - DNA, 15 bp, Homo sapiens
aagatcttgtctcca

SEQ ID NO: 2832046 - DNA, 18 bp, Homo sapiens
aagatgagagaactggag

SEQ ID NO: 2832047 - DNA, 18 bp, Homo sapiens
aagatggctgtgcctctg

SEQ ID NO: 2832048 - DNA, 21 bp, Homo sapiens
aagatggcttatttgtataat

SEQ ID NO: 2832049 - DNA, 15 bp, Homo sapiens
aagatgtaaggaatt

SEQ ID NO: 2832050 - DNA, 21 bp, Homo sapiens
aagatgtaaggaattgaagat

SEQ ID NO: 2832051 - DNA, 15 bp, Homo sapiens
aagatgtcaaatatc

SEQ ID NO: 2832052 - DNA, 17 bp, Homo sapiens
aagattaaaattagtga

SEQ ID NO: 2832053 - DNA, 18 bp, Homo sapiens
aagattaaaattagtgag

SEQ ID NO: 2832054 - DNA, 16 bp, Homo sapiens
aagattaaaggaagga

SEQ ID NO: 2832055 - DNA, 19 bp, Homo sapiens
aagattaaaggaaggaaaa

SEQ ID NO: 2832056 - DNA, 15 bp, Homo sapiens
aagattatatatcat

SEQ ID NO: 2832057 - DNA, 20 bp, Homo sapiens
aagattatatatcataaagt

SEQ ID NO: 2832058 - DNA, 14 bp, Homo sapiens
aagattcccagaga

SEQ ID NO: 2832059 - DNA, 13 bp, Homo sapiens
aagattgtacata

SEQ ID NO: 2832060 - DNA, 21 bp, Homo sapiens
aagatttgttttgtcaagtgt

SEQ ID NO: 2832061 - DNA, 13 bp, Homo sapiens
aagattttaaatt

SEQ ID NO: 2832062 - DNA, 23 bp, Homo sapiens
aagattttggagggtcctccaca

SEQ ID NO: 2832063 - DNA, 16 bp, Homo sapiens
aagattttttaataat

SEQ ID NO: 2832064 - DNA, 16 bp, Homo sapiens
aagcaaataaatatca

SEQ ID NO: 2832065 - DNA, 17 bp, Homo sapiens
aagcaaatcgaatgaaa

SEQ ID NO: 2832066 - DNA, 14 bp, Homo sapiens
aagcaacaggtttt

SEQ ID NO: 2832067 - DNA, 21 bp, Homo sapiens
aagcaagacgtcctggaatga

SEQ ID NO: 2832068 - DNA, 23 bp, Homo sapiens
aagcaagacgtcctggaatgaag

SEQ ID NO: 2832069 - DNA, 18 bp, Homo sapiens
aagcaagccaatttggaa

SEQ ID NO: 2832070 - DNA, 13 bp, Homo sapiens
aagcaagcttaat

SEQ ID NO: 2832071 - DNA, 19 bp, Homo sapiens
aagcaccagcttctccagg

SEQ ID NO: 2832072 - DNA, 21 bp, Homo sapiens
aagcaccagcttctccaggct

SEQ ID NO: 2832073 - DNA, 13 bp, Homo sapiens
aagcaccctgttc

SEQ ID NO: 2832074 - DNA, 17 bp, Homo sapiens
aagcaccgcagcatgtg

SEQ ID NO: 2832075 - DNA, 19 bp, Homo sapiens
aagcaccgcctccaaatgc

SEQ ID NO: 2832076 - DNA, 13 bp, Homo sapiens
aagcacctgccga

SEQ ID NO: 2832077 - DNA, 17 bp, Homo sapiens
aagcacctgccgacctc

SEQ ID NO: 2832078 - DNA, 20 bp, Homo sapiens
aagcacctgccgacctcgtc

SEQ ID NO: 2832079 - DNA, 19 bp, Homo sapiens
aagcaccttagctggcatt

SEQ ID NO: 2832080 - DNA, 19 bp, Homo sapiens
aagcactgctaggcgagtg

SEQ ID NO: 2832081 - DNA, 22 bp, Homo sapiens
aagcactgtttaactgggagtg

SEQ ID NO: 2832082 - DNA, 11 bp, Homo sapiens
aagcacttttt

SEQ ID NO: 2832083 - DNA, 16 bp, Homo sapiens
aagcactttttaaaaa

SEQ ID NO: 2832084 - DNA, 18 bp, Homo sapiens
aagcagcctttctgtgga

SEQ ID NO: 2832085 - DNA, 20 bp, Homo sapiens
aagcagtgccttccataatt

SEQ ID NO: 2832086 - DNA, 18 bp, Homo sapiens
aagcatcacctcaggcca

SEQ ID NO: 2832087 - DNA, 23 bp, Homo sapiens
aagcatcacctcaggccaggtgc

SEQ ID NO: 2832088 - DNA, 12 bp, Homo sapiens
aagcatgaaatg

SEQ ID NO: 2832089 - DNA, 21 bp, Homo sapiens
aagcatgatcttgttaatgca

SEQ ID NO: 2832090 - DNA, 13 bp, Homo sapiens
aagcattgaatgg

SEQ ID NO: 2832091 - DNA, 21 bp, Homo sapiens
aagcattttactgtctgtaag

SEQ ID NO: 2832092 - DNA, 19 bp, Homo sapiens
aagcattttgtaagttgaa

SEQ ID NO: 2832093 - DNA, 15 bp, Homo sapiens
aagccaaattttttg

SEQ ID NO: 2832094 - DNA, 17 bp, Homo sapiens
aagccaacttgtaaata

SEQ ID NO: 2832095 - DNA, 13 bp, Homo sapiens
aagccactgaagc

SEQ ID NO: 2832096 - DNA, 17 bp, Homo sapiens
aagccactgaagctggg

SEQ ID NO: 2832097 - DNA, 21 bp, Homo sapiens
aagccagctgccgaccagagc

SEQ ID NO: 2832098 - DNA, 18 bp, Homo sapiens
aagccaggagcaaatgtt

SEQ ID NO: 2832099 - DNA, 17 bp, Homo sapiens
aagcccaaatggctctg

SEQ ID NO: 2832100 - DNA, 16 bp, Homo sapiens
aagcccaacctcctga

SEQ ID NO: 2832101 - DNA, 17 bp, Homo sapiens
aagcccaacctcctgac

SEQ ID NO: 2832102 - DNA, 16 bp, Homo sapiens
aagcccagctctttgt

SEQ ID NO: 2832103 - DNA, 19 bp, Homo sapiens
aagcccagctctttgttca

SEQ ID NO: 2832104 - DNA, 20 bp, Homo sapiens
aagcccccacttctctccag

SEQ ID NO: 2832105 - DNA, 21 bp, Homo sapiens
aagccccttgctctcccctgc

SEQ ID NO: 2832106 - DNA, 20 bp, Homo sapiens
aagccctgtcgagacacttg

SEQ ID NO: 2832107 - DNA, 20 bp, Homo sapiens
aagcccttccatgtcgcctc

SEQ ID NO: 2832108 - DNA, 14 bp, Homo sapiens
aagccgggaacaga

SEQ ID NO: 2832109 - DNA, 11 bp, Homo sapiens
aagcctctgct

SEQ ID NO: 2832110 - DNA, 14 bp, Homo sapiens
aagcctctgctgcc

SEQ ID NO: 2832111 - DNA, 13 bp, Homo sapiens
aagcctctggaaa

SEQ ID NO: 2832112 - DNA, 23 bp, Homo sapiens
aagcctgcctaggaattcccagc

SEQ ID NO: 2832113 - DNA, 17 bp, Homo sapiens
aagcctgggattgacag

SEQ ID NO: 2832114 - DNA, 23 bp, Homo sapiens
aagcctgggggcctggctggctg

SEQ ID NO: 2832115 - DNA, 15 bp, Homo sapiens
aagcctttccataag

SEQ ID NO: 2832116 - DNA, 17 bp, Homo sapiens
aagcgattcttctgctt

SEQ ID NO: 2832117 - DNA, 21 bp, Homo sapiens
aagcggaggttgcagggagcc

SEQ ID NO: 2832118 - DNA, 21 bp, Homo sapiens
aagctaacagggaaggcaggc

SEQ ID NO: 2832119 - DNA, 14 bp, Homo sapiens
aagctaggaatgaa

SEQ ID NO: 2832120 - DNA, 12 bp, Homo sapiens
aagctaggcctg

SEQ ID NO: 2832121 - DNA, 16 bp, Homo sapiens
aagctaggcctggcca

SEQ ID NO: 2832122 - DNA, 20 bp, Homo sapiens
aagctccatctccactccag

SEQ ID NO: 2832123 - DNA, 19 bp, Homo sapiens
aagctcctggtcttgagat

SEQ ID NO: 2832124 - DNA, 13 bp, Homo sapiens
aagctgaggtgcc

SEQ ID NO: 2832125 - DNA, 19 bp, Homo sapiens
aagctgaggtgcccaggag

SEQ ID NO: 2832126 - DNA, 20 bp, Homo sapiens
aagctgaggtgcccaggaga

SEQ ID NO: 2832127 - DNA, 15 bp, Homo sapiens
aagctgcctgtagtt

SEQ ID NO: 2832128 - DNA, 21 bp, Homo sapiens
aagctgcctgtagttaggaaa

SEQ ID NO: 2832129 - DNA, 14 bp, Homo sapiens
aatgaaattaactg

SEQ ID NO: 2832130 - DNA, 17 bp, Homo sapiens
aatgaaattactacaaa

SEQ ID NO: 2832131 - DNA, 14 bp, Homo sapiens
aatgaacagaacat

SEQ ID NO: 2832132 - DNA, 15 bp, Homo sapiens
aatgaacagaacata

SEQ ID NO: 2832133 - DNA, 15 bp, Homo sapiens
aatgaactgtgacag

SEQ ID NO: 2832134 - DNA, 21 bp, Homo sapiens
aatgaactgtgacaggaagcc

SEQ ID NO: 2832135 - DNA, 22 bp, Homo sapiens
aatgaagaaaaaggctggctga

SEQ ID NO: 2832136 - DNA, 13 bp, Homo sapiens
aatgaagcatgta

SEQ ID NO: 2832137 - DNA, 12 bp, Homo sapiens
aatgaatgacct

SEQ ID NO: 2832138 - DNA, 17 bp, Homo sapiens
aatgaattaaataaacc

SEQ ID NO: 2832139 - DNA, 22 bp, Homo sapiens
aatgaattctctctaaaaataa

SEQ ID NO: 2832140 - DNA, 11 bp, Homo sapiens
aatgacactgt

SEQ ID NO: 2832141 - DNA, 13 bp, Homo sapiens
aatgacatcttca

SEQ ID NO: 2832142 - DNA, 13 bp, Homo sapiens
aatgacatttttg

SEQ ID NO: 2832143 - DNA, 16 bp, Homo sapiens
aatgacctcaagatgt

SEQ ID NO: 2832144 - DNA, 17 bp, Homo sapiens
aatgagatcccgcctct

SEQ ID NO: 2832145 - DNA, 12 bp, Homo sapiens
aatgagctcctg

SEQ ID NO: 2832146 - DNA, 13 bp, Homo sapiens
aatgagctcctgc

SEQ ID NO: 2832147 - DNA, 14 bp, Homo sapiens
aatgagctcctgcg

SEQ ID NO: 2832148 - DNA, 14 bp, Homo sapiens
aatgagggccaaga

SEQ ID NO: 2832149 - DNA, 18 bp, Homo sapiens
aatgaggtcagagcctgc

SEQ ID NO: 2832150 - DNA, 17 bp, Homo sapiens
aatgatgagtaacttaa

SEQ ID NO: 2832151 - DNA, 15 bp, Homo sapiens
aatgatgattaaaca

SEQ ID NO: 2832152 - DNA, 17 bp, Homo sapiens
aatgatgattaaacacc

SEQ ID NO: 2832153 - DNA, 19 bp, Homo sapiens
aatgatggcaattttgtaa

SEQ ID NO: 2832154 - DNA, 19 bp, Homo sapiens
aatgatgtatgatttgttg

SEQ ID NO: 2832155 - DNA, 15 bp, Homo sapiens
aatgatgtccagaag

SEQ ID NO: 2832156 - DNA, 15 bp, Homo sapiens
aatgattgtagtaat

SEQ ID NO: 2832157 - DNA, 20 bp, Homo sapiens
aatgatttaagcattttact

SEQ ID NO: 2832158 - DNA, 18 bp, Homo sapiens
aatgcaaacactgtgtat

SEQ ID NO: 2832159 - DNA, 12 bp, Homo sapiens
aatgcacaattt

SEQ ID NO: 2832160 - DNA, 18 bp, Homo sapiens
aatgcacaatttagaaaa

SEQ ID NO: 2832161 - DNA, 13 bp, Homo sapiens
aatgcacactagc

SEQ ID NO: 2832162 - DNA, 15 bp, Homo sapiens
aatgcagtccagaat

SEQ ID NO: 2832163 - DNA, 17 bp, Homo sapiens
aatgcagtccagaataa

SEQ ID NO: 2832164 - DNA, 18 bp, Homo sapiens
aatgcagtccagaataag

SEQ ID NO: 2832165 - DNA, 14 bp, Homo sapiens
aatgcataaatgca

SEQ ID NO: 2832166 - DNA, 19 bp, Homo sapiens
aatgcatccattcctcagg

SEQ ID NO: 2832167 - DNA, 17 bp, Homo sapiens
aatgcatgattttatac

SEQ ID NO: 2832168 - DNA, 18 bp, Homo sapiens
aatgcatgattttataca

SEQ ID NO: 2832169 - DNA, 21 bp, Homo sapiens
aatgcatgattttatacatag

SEQ ID NO: 2832170 - DNA, 17 bp, Homo sapiens
aatgcattattttgaat

SEQ ID NO: 2832171 - DNA, 22 bp, Homo sapiens
aatgccagagacggaagccttt

SEQ ID NO: 2832172 - DNA, 21 bp, Homo sapiens
aatgccatggacagaagaagg

SEQ ID NO: 2832173 - DNA, 21 bp, Homo sapiens
aatgctggctgttggctgggg

SEQ ID NO: 2832174 - DNA, 20 bp, Homo sapiens
aatgcttgtggattgagggt

SEQ ID NO: 2832175 - DNA, 12 bp, Homo sapiens
aatgctttcctc

SEQ ID NO: 2832176 - DNA, 14 bp, Homo sapiens
aatgctttcctccc

SEQ ID NO: 2832177 - DNA, 12 bp, Homo sapiens
aatgcttttcta

SEQ ID NO: 2832178 - DNA, 15 bp, Homo sapiens
aatggagaagctctg

SEQ ID NO: 2832179 - DNA, 17 bp, Homo sapiens
aatggcacagcccaaag

SEQ ID NO: 2832180 - DNA, 16 bp, Homo sapiens
aatggcagccttggca

SEQ ID NO: 2832181 - DNA, 16 bp, Homo sapiens
aatggctatgttttta

SEQ ID NO: 2832182 - DNA, 15 bp, Homo sapiens
aatgggctttaacaa

SEQ ID NO: 2832183 - DNA, 15 bp, Homo sapiens
aatggtatgagctga

SEQ ID NO: 2832184 - DNA, 13 bp, Homo sapiens
aatggtccagggt

SEQ ID NO: 2832185 - DNA, 16 bp, Homo sapiens
aatggtccagggttga

SEQ ID NO: 2832186 - DNA, 15 bp, Homo sapiens
aatggtcgcccagga

SEQ ID NO: 2832187 - DNA, 16 bp, Homo sapiens
aatggtgccttcattt

SEQ ID NO: 2832188 - DNA, 18 bp, Homo sapiens
aatggtggtttgtcatat

SEQ ID NO: 2832189 - DNA, 17 bp, Homo sapiens
aatggtgttactaaagt

SEQ ID NO: 2832190 - DNA, 18 bp, Homo sapiens
aatggtgttactaaagtc

SEQ ID NO: 2832191 - DNA, 20 bp, Homo sapiens
aatggtttactgctgtcatt

SEQ ID NO: 2832192 - DNA, 14 bp, Homo sapiens
aatggtttgaatat

SEQ ID NO: 2832193 - DNA, 20 bp, Homo sapiens
aatgtaaatattttaaagaa

SEQ ID NO: 2832194 - DNA, 15 bp, Homo sapiens
aatgtaacttttgta

SEQ ID NO: 2832195 - DNA, 22 bp, Homo sapiens
aatgtaacttttgtaagacaaa

SEQ ID NO: 2832196 - DNA, 14 bp, Homo sapiens
aatgtaattgaata

SEQ ID NO: 2832197 - DNA, 16 bp, Homo sapiens
aatgtacactggatat

SEQ ID NO: 2832198 - DNA, 23 bp, Homo sapiens
aatgtagtggagagatcatagct

SEQ ID NO: 2832199 - DNA, 13 bp, Homo sapiens
aatgtatagtaaa

SEQ ID NO: 2832200 - DNA, 16 bp, Homo sapiens
aatgtatcatagaaat

SEQ ID NO: 2832201 - DNA, 19 bp, Homo sapiens
aatgtatcatagaaatgta

SEQ ID NO: 2832202 - DNA, 14 bp, Homo sapiens
aatgtatcctgata

SEQ ID NO: 2832203 - DNA, 14 bp, Homo sapiens
aatgtatcttattt

SEQ ID NO: 2832204 - DNA, 18 bp, Homo sapiens
aatgtatcttatttatat

SEQ ID NO: 2832205 - DNA, 20 bp, Homo sapiens
aatgtatcttatttatatat

SEQ ID NO: 2832206 - DNA, 12 bp, Homo sapiens
aatgtatgtgaa

SEQ ID NO: 2832207 - DNA, 17 bp, Homo sapiens
aatgtatgtgaaagtgt

SEQ ID NO: 2832208 - DNA, 19 bp, Homo sapiens
aatgtatgtgaaagtgtaa

SEQ ID NO: 2832209 - DNA, 20 bp, Homo sapiens
aatgtatgtgaaagtgtaaa

SEQ ID NO: 2832210 - DNA, 18 bp, Homo sapiens
aatgtattgaacttggaa

SEQ ID NO: 2832211 - DNA, 13 bp, Homo sapiens
aatgtcaaaatca

SEQ ID NO: 2832212 - DNA, 21 bp, Homo sapiens
aatgtcacaatcctgtccctc

SEQ ID NO: 2832213 - DNA, 13 bp, Homo sapiens
aatgtcacaggca

SEQ ID NO: 2832214 - DNA, 15 bp, Homo sapiens
aatgtcacaggcagg

SEQ ID NO: 2832215 - DNA, 23 bp, Homo sapiens
aatgtcagaaactcgatgaatgt

SEQ ID NO: 2832216 - DNA, 23 bp, Homo sapiens
aatgtgaatcagaccctacccca

SEQ ID NO: 2832217 - DNA, 17 bp, Homo sapiens
aatgtgaccaggggtga

SEQ ID NO: 2832218 - DNA, 17 bp, Homo sapiens
aatgtggcctaaaaatg

SEQ ID NO: 2832219 - DNA, 17 bp, Homo sapiens
aatgtgtggtgctaact

SEQ ID NO: 2832220 - DNA, 22 bp, Homo sapiens
acacccctcaaaaaaagccttt

SEQ ID NO: 2832221 - DNA, 16 bp, Homo sapiens
acacccctcccctgcc

SEQ ID NO: 2832222 - DNA, 17 bp, Homo sapiens
acaccccttatccagga

SEQ ID NO: 2832223 - DNA, 20 bp, Homo sapiens
acaccccttatccaggactc

SEQ ID NO: 2832224 - DNA, 14 bp, Homo sapiens
acacccggctcccc

SEQ ID NO: 2832225 - DNA, 16 bp, Homo sapiens
acaccgggcactcaga

SEQ ID NO: 2832226 - DNA, 23 bp, Homo sapiens
acacctcccaggggctccacctg

SEQ ID NO: 2832227 - DNA, 13 bp, Homo sapiens
acacctccctgaa

SEQ ID NO: 2832228 - DNA, 15 bp, Homo sapiens
acacctgcacctccc

SEQ ID NO: 2832229 - DNA, 13 bp, Homo sapiens
acacctgccctgc

SEQ ID NO: 2832230 - DNA, 15 bp, Homo sapiens
acacctgccctgccc

SEQ ID NO: 2832231 - DNA, 16 bp, Homo sapiens
acacctgtgcacccca

SEQ ID NO: 2832232 - DNA, 15 bp, Homo sapiens
acaccttagcagctc

SEQ ID NO: 2832233 - DNA, 14 bp, Homo sapiens
acaccttgacaggg

SEQ ID NO: 2832234 - DNA, 15 bp, Homo sapiens
acaccttgacagggc

SEQ ID NO: 2832235 - DNA, 15 bp, Homo sapiens
acacgcgtgcacaca

SEQ ID NO: 2832236 - DNA, 17 bp, Homo sapiens
acacgcgtgcacacacc

SEQ ID NO: 2832237 - DNA, 19 bp, Homo sapiens
acacgtatttatatttgga

SEQ ID NO: 2832238 - DNA, 23 bp, Homo sapiens
acacgtatttatatttggaaaga

SEQ ID NO: 2832239 - DNA, 12 bp, Homo sapiens
acacgtgtcctg

SEQ ID NO: 2832240 - DNA, 19 bp, Homo sapiens
acactaaccacgctggacc

SEQ ID NO: 2832241 - DNA, 17 bp, Homo sapiens
acactacaagtttataa

SEQ ID NO: 2832242 - DNA, 18 bp, Homo sapiens
acactacaagtttataag

SEQ ID NO: 2832243 - DNA, 16 bp, Homo sapiens
acactaccttatcagg

SEQ ID NO: 2832244 - DNA, 20 bp, Homo sapiens
acactaccttatcaggcaaa

SEQ ID NO: 2832245 - DNA, 18 bp, Homo sapiens
acactagttttgtgccag

SEQ ID NO: 2832246 - DNA, 15 bp, Homo sapiens
acactcagaagcctg

SEQ ID NO: 2832247 - DNA, 16 bp, Homo sapiens
acactcagaagcctgg

SEQ ID NO: 2832248 - DNA, 19 bp, Homo sapiens
acactcagaagcctggggg

SEQ ID NO: 2832249 - DNA, 18 bp, Homo sapiens
acactcagtcccccacca

SEQ ID NO: 2832250 - DNA, 15 bp, Homo sapiens
acactccagcctgag

SEQ ID NO: 2832251 - DNA, 17 bp, Homo sapiens
acactcccccagactgc

SEQ ID NO: 2832252 - DNA, 21 bp, Homo sapiens
acactgagcaagatcttgtct

SEQ ID NO: 2832253 - DNA, 15 bp, Homo sapiens
acactgcaagaagtc

SEQ ID NO: 2832254 - DNA, 14 bp, Homo sapiens
acactggatatgtt

SEQ ID NO: 2832255 - DNA, 15 bp, Homo sapiens
acactgggggagggg

SEQ ID NO: 2832256 - DNA, 16 bp, Homo sapiens
acactgggggagggga

SEQ ID NO: 2832257 - DNA, 17 bp, Homo sapiens
acactggtggaggagct

SEQ ID NO: 2832258 - DNA, 16 bp, Homo sapiens
acactgttactccaca

SEQ ID NO: 2832259 - DNA, 18 bp, Homo sapiens
acactgttactccacagc

SEQ ID NO: 2832260 - DNA, 20 bp, Homo sapiens
acacttaagggttttagaaa

SEQ ID NO: 2832261 - DNA, 16 bp, Homo sapiens
acacttcatggaccaa

SEQ ID NO: 2832262 - DNA, 19 bp, Homo sapiens
acacttcatggaccaagaa

SEQ ID NO: 2832263 - DNA, 20 bp, Homo sapiens
acacttctcaggacacaggc

SEQ ID NO: 2832264 - DNA, 19 bp, Homo sapiens
acacttctcatcatattgt

SEQ ID NO: 2832265 - DNA, 12 bp, Homo sapiens
acagaagaaaca

SEQ ID NO: 2832266 - DNA, 13 bp, Homo sapiens
acagaagccagga

SEQ ID NO: 2832267 - DNA, 16 bp, Homo sapiens
acagaagccaggagca

SEQ ID NO: 2832268 - DNA, 17 bp, Homo sapiens
acagaattctgctacct

SEQ ID NO: 2832269 - DNA, 14 bp, Homo sapiens
acagaatttttaat

SEQ ID NO: 2832270 - DNA, 15 bp, Homo sapiens
acagaatttttaatg

SEQ ID NO: 2832271 - DNA, 16 bp, Homo sapiens
acagaatttttaatga

SEQ ID NO: 2832272 - DNA, 14 bp, Homo sapiens
acagacacaggccc

SEQ ID NO: 2832273 - DNA, 23 bp, Homo sapiens
acagacacaggcccggctccagg

SEQ ID NO: 2832274 - DNA, 18 bp, Homo sapiens
acagacactaagttatag

SEQ ID NO: 2832275 - DNA, 15 bp, Homo sapiens
acagacaggagaaat

SEQ ID NO: 2832276 - DNA, 21 bp, Homo sapiens
acagacaggagaaatgcatcc

SEQ ID NO: 2832277 - DNA, 19 bp, Homo sapiens
acagacagggcctagcttt

SEQ ID NO: 2832278 - DNA, 19 bp, Homo sapiens
acagaccacctgcttctga

SEQ ID NO: 2832279 - DNA, 23 bp, Homo sapiens
acagaccacctgcttctgaactc

SEQ ID NO: 2832280 - DNA, 11 bp, Homo sapiens
acagactgcaa

SEQ ID NO: 2832281 - DNA, 23 bp, Homo sapiens
acagactgcgatttgtcccaggt

SEQ ID NO: 2832282 - DNA, 21 bp, Homo sapiens
acagactggaagcacagcttc

SEQ ID NO: 2832283 - DNA, 22 bp, Homo sapiens
acagactggaagcacagcttca

SEQ ID NO: 2832284 - DNA, 11 bp, Homo sapiens
acagagaaagt

SEQ ID NO: 2832285 - DNA, 18 bp, Homo sapiens
acagagaaagtacttctc

SEQ ID NO: 2832286 - DNA, 19 bp, Homo sapiens
acagagaatctgaagctat

SEQ ID NO: 2832287 - DNA, 14 bp, Homo sapiens
acagagacacctgc

SEQ ID NO: 2832288 - DNA, 16 bp, Homo sapiens
acagagacacctgcac

SEQ ID NO: 2832289 - DNA, 21 bp, Homo sapiens
acagagacaggcccaagagat

SEQ ID NO: 2832290 - DNA, 22 bp, Homo sapiens
acagagacccagatctcatgga

SEQ ID NO: 2832291 - DNA, 17 bp, Homo sapiens
acagagcctgcctcagc

SEQ ID NO: 2832292 - DNA, 14 bp, Homo sapiens
acagaggcagcccc

SEQ ID NO: 2832293 - DNA, 17 bp, Homo sapiens
acagaggccatgggcct

SEQ ID NO: 2832294 - DNA, 23 bp, Homo sapiens
acagaggccatgggcctcctgtg

SEQ ID NO: 2832295 - DNA, 13 bp, Homo sapiens
acagagtatatat

SEQ ID NO: 2832296 - DNA, 16 bp, Homo sapiens
acagagtatatatgta

SEQ ID NO: 2832297 - DNA, 22 bp, Homo sapiens
acagagtatatatgtacagtta

SEQ ID NO: 2832298 - DNA, 12 bp, Homo sapiens
acagagtctcac

SEQ ID NO: 2832299 - DNA, 23 bp, Homo sapiens
acagagtctcactgttgcccagg

SEQ ID NO: 2832300 - DNA, 20 bp, Homo sapiens
acagagttttcactcttatt

SEQ ID NO: 2832301 - DNA, 14 bp, Homo sapiens
acagataatttatt

SEQ ID NO: 2832302 - DNA, 22 bp, Homo sapiens
acagataatttattttgtattt

SEQ ID NO: 2832303 - DNA, 17 bp, Homo sapiens
acagatataaatggctg

SEQ ID NO: 2832304 - DNA, 23 bp, Homo sapiens
acagatcccatccatcagctccc

SEQ ID NO: 2832305 - DNA, 14 bp, Homo sapiens
acagatgcacccca

SEQ ID NO: 2832306 - DNA, 16 bp, Homo sapiens
acagatggcttagtta

SEQ ID NO: 2832307 - DNA, 18 bp, Homo sapiens
acagcaaaactccatctc

SEQ ID NO: 2832308 - DNA, 16 bp, Homo sapiens
acagcagctcaggcac

SEQ ID NO: 2832309 - DNA, 22 bp, Homo sapiens
acagcagggtagtctggtttct

SEQ ID NO: 2832310 - DNA, 17 bp, Homo sapiens
acagcattcctccatct

SEQ ID NO: 2832311 - DNA, 14 bp, Homo sapiens
accagctgccaaaa

SEQ ID NO: 2832312 - DNA, 11 bp, Homo sapiens
accagctgcta

SEQ ID NO: 2832313 - DNA, 15 bp, Homo sapiens
accagcttctccagg

SEQ ID NO: 2832314 - DNA, 15 bp, Homo sapiens
accaggacaggacca

SEQ ID NO: 2832315 - DNA, 20 bp, Homo sapiens
accaggactatagcccaggt

SEQ ID NO: 2832316 - DNA, 21 bp, Homo sapiens
accaggactatagcccaggtc

SEQ ID NO: 2832317 - DNA, 17 bp, Homo sapiens
accaggcaccaaaagaa

SEQ ID NO: 2832318 - DNA, 21 bp, Homo sapiens
accaggcacgaacccacctgc

SEQ ID NO: 2832319 - DNA, 21 bp, Homo sapiens
accaggccgggcttgggccct

SEQ ID NO: 2832320 - DNA, 22 bp, Homo sapiens
accagggcatattaaaggcttt

SEQ ID NO: 2832321 - DNA, 24 bp, Homo sapiens
accaggggtgatttcagagagggc

SEQ ID NO: 2832322 - DNA, 16 bp, Homo sapiens
accagtgaaccaaaga

SEQ ID NO: 2832323 - DNA, 19 bp, Homo sapiens
accagtgccgcctgtgccc

SEQ ID NO: 2832324 - DNA, 19 bp, Homo sapiens
accagtgtactgctttcaa

SEQ ID NO: 2832325 - DNA, 19 bp, Homo sapiens
accagttgggagcactgga

SEQ ID NO: 2832326 - DNA, 12 bp, Homo sapiens
accatcaataaa

SEQ ID NO: 2832327 - DNA, 13 bp, Homo sapiens
accatcaataaag

SEQ ID NO: 2832328 - DNA, 16 bp, Homo sapiens
accatcatgtctggct

SEQ ID NO: 2832329 - DNA, 16 bp, Homo sapiens
accatcctgcagcctc

SEQ ID NO: 2832330 - DNA, 17 bp, Homo sapiens
accatcgcgtgcaatga

SEQ ID NO: 2832331 - DNA, 21 bp, Homo sapiens
accatctgtcttgccagccag

SEQ ID NO: 2832332 - DNA, 21 bp, Homo sapiens
accatgagaagagggcctgtg

SEQ ID NO: 2832333 - DNA, 19 bp, Homo sapiens
accatgcagcttcatcaat

SEQ ID NO: 2832334 - DNA, 20 bp, Homo sapiens
accatgccaggctaattttt

SEQ ID NO: 2832335 - DNA, 17 bp, Homo sapiens
accatggacggccccgt

SEQ ID NO: 2832336 - DNA, 19 bp, Homo sapiens
accatgtttgagctcagac

SEQ ID NO: 2832337 - DNA, 16 bp, Homo sapiens
accatttaattcataa

SEQ ID NO: 2832338 - DNA, 17 bp, Homo sapiens
accatttaattcataat

SEQ ID NO: 2832339 - DNA, 22 bp, Homo sapiens
accattttagttcctttattta

SEQ ID NO: 2832340 - DNA, 21 bp, Homo sapiens
accattttggggtacccactg

SEQ ID NO: 2832341 - DNA, 13 bp, Homo sapiens
acccaaataaatg

SEQ ID NO: 2832342 - DNA, 15 bp, Homo sapiens
acccaaggaggaaaa

SEQ ID NO: 2832343 - DNA, 20 bp, Homo sapiens
acccaagtatacaataaagt

SEQ ID NO: 2832344 - DNA, 13 bp, Homo sapiens
acccacagcctct

SEQ ID NO: 2832345 - DNA, 13 bp, Homo sapiens
acccacagggcta

SEQ ID NO: 2832346 - DNA, 15 bp, Homo sapiens
acccacatgtgacac

SEQ ID NO: 2832347 - DNA, 12 bp, Homo sapiens
acccaccagcct

SEQ ID NO: 2832348 - DNA, 15 bp, Homo sapiens
acccaccagcctaag

SEQ ID NO: 2832349 - DNA, 13 bp, Homo sapiens
acccacctcagcc

SEQ ID NO: 2832350 - DNA, 11 bp, Homo sapiens
acccacctgct

SEQ ID NO: 2832351 - DNA, 13 bp, Homo sapiens
acccacctgctga

SEQ ID NO: 2832352 - DNA, 13 bp, Homo sapiens
acccactgctctg

SEQ ID NO: 2832353 - DNA, 18 bp, Homo sapiens
acccactgtgcttacagt

SEQ ID NO: 2832354 - DNA, 18 bp, Homo sapiens
acccagagccttctcctg

SEQ ID NO: 2832355 - DNA, 20 bp, Homo sapiens
acccagagccttctcctgcc

SEQ ID NO: 2832356 - DNA, 15 bp, Homo sapiens
acccagcccacttct

SEQ ID NO: 2832357 - DNA, 16 bp, Homo sapiens
acccagcccacttctg

SEQ ID NO: 2832358 - DNA, 18 bp, Homo sapiens
acccagcccacttctgcc

SEQ ID NO: 2832359 - DNA, 16 bp, Homo sapiens
acccagcgagccctgg

SEQ ID NO: 2832360 - DNA, 24 bp, Homo sapiens
acccagcgagccctggtggcagtg

SEQ ID NO: 2832361 - DNA, 14 bp, Homo sapiens
acccaggacaagca

SEQ ID NO: 2832362 - DNA, 16 bp, Homo sapiens
acccaggacaagcatg

SEQ ID NO: 2832363 - DNA, 14 bp, Homo sapiens
acccaggaggtgga

SEQ ID NO: 2832364 - DNA, 23 bp, Homo sapiens
acccaggaggtggaggttgcagt

SEQ ID NO: 2832365 - DNA, 13 bp, Homo sapiens
acccaggggtggg

SEQ ID NO: 2832366 - DNA, 18 bp, Homo sapiens
  misc_feature (7)..(7): n is a, c, g or t
acccagnagggcgtcgct

SEQ ID NO: 2832367 - DNA, 17 bp, Homo sapiens
acccagtaactcatctg

SEQ ID NO: 2832368 - DNA, 14 bp, Homo sapiens
acccagtccctggg

SEQ ID NO: 2832369 - DNA, 15 bp, Homo sapiens
acccagtccctgggg

SEQ ID NO: 2832370 - DNA, 22 bp, Homo sapiens
acccagtgtaaagaataaatga

SEQ ID NO: 2832371 - DNA, 17 bp, Homo sapiens
acccatagatcttctga

SEQ ID NO: 2832372 - DNA, 15 bp, Homo sapiens
acccatagcttccat

SEQ ID NO: 2832373 - DNA, 19 bp, Homo sapiens
acccatcagaaggagaagg

SEQ ID NO: 2832374 - DNA, 13 bp, Homo sapiens
acccatctccccc

SEQ ID NO: 2832375 - DNA, 20 bp, Homo sapiens
acccatgaagacaggacagt

SEQ ID NO: 2832376 - DNA, 14 bp, Homo sapiens
acccatgaatcaaa

SEQ ID NO: 2832377 - DNA, 22 bp, Homo sapiens
acccattcgtggtgatcaatta

SEQ ID NO: 2832378 - DNA, 22 bp, Homo sapiens
accccaccacgatgtggccctg

SEQ ID NO: 2832379 - DNA, 12 bp, Homo sapiens
accccaccccct

SEQ ID NO: 2832380 - DNA, 18 bp, Homo sapiens
accccaccttgccaagct

SEQ ID NO: 2832381 - DNA, 14 bp, Homo sapiens
accccagacactgg

SEQ ID NO: 2832382 - DNA, 15 bp, Homo sapiens
accccagctagggct

SEQ ID NO: 2832383 - DNA, 21 bp, Homo sapiens
accccagctagggctggactc

SEQ ID NO: 2832384 - DNA, 23 bp, Homo sapiens
accccagctccctaggagaccaa

SEQ ID NO: 2832385 - DNA, 20 bp, Homo sapiens
accccagttctgctcctctc

SEQ ID NO: 2832386 - DNA, 21 bp, Homo sapiens
accccagttctgctcctctcc

SEQ ID NO: 2832387 - DNA, 17 bp, Homo sapiens
acccccactctcattcc

SEQ ID NO: 2832388 - DNA, 18 bp, Homo sapiens
acccccactctcattccc

SEQ ID NO: 2832389 - DNA, 22 bp, Homo sapiens
acccccactctcattccccagg

SEQ ID NO: 2832390 - DNA, 21 bp, Homo sapiens
acccccagccccgactccagc

SEQ ID NO: 2832391 - DNA, 22 bp, Homo sapiens
acccccagccccgactccagcc

SEQ ID NO: 2832392 - DNA, 12 bp, Homo sapiens
acccccagcctg

SEQ ID NO: 2832393 - DNA, 16 bp, Homo sapiens
acccccagcctgggcc

SEQ ID NO: 2832394 - DNA, 14 bp, Homo sapiens
acccccagctttgc

SEQ ID NO: 2832395 - DNA, 16 bp, Homo sapiens
acccccagtgccacag

SEQ ID NO: 2832396 - DNA, 18 bp, Homo sapiens
acccccatttctatttat

SEQ ID NO: 2832397 - DNA, 14 bp, Homo sapiens
accccccaagctgt

SEQ ID NO: 2832398 - DNA, 13 bp, Homo sapiens
accccccacctgc

SEQ ID NO: 2832399 - DNA, 19 bp, Homo sapiens
acccccgtggtctttgaat

SEQ ID NO: 2832400 - DNA, 22 bp, Homo sapiens
acccccgtggtctttgaataaa

SEQ ID NO: 2832401 - DNA, 17 bp, Homo sapiens
accccctcattcccctc

SEQ ID NO: 2832402 - DNA, 14 bp, Homo sapiens
accccctccccagg

SEQ ID NO: 2832403 - DNA, 19 bp, Homo sapiens
accccctctttgtgtactt

SEQ ID NO: 2832404 - DNA, 23 bp, Homo sapiens
accccctgaaagtgacagagacc

SEQ ID NO: 2832405 - DNA, 18 bp, Homo sapiens
acccccttctactgagcc

SEQ ID NO: 2832406 - DNA, 23 bp, Homo sapiens
accccgtctggggttcagcccct

SEQ ID NO: 2832407 - DNA, 19 bp, Homo sapiens
acccctccatgtgggctag

SEQ ID NO: 2832408 - DNA, 20 bp, Homo sapiens
acccctccccattcacagag

SEQ ID NO: 2832409 - DNA, 15 bp, Homo sapiens
acccctcccctcccc

SEQ ID NO: 2832410 - DNA, 12 bp, Homo sapiens
acccctgcacca

SEQ ID NO: 2832411 - DNA, 10 bp, Homo sapiens
acccctgtgt

SEQ ID NO: 2832412 - DNA, 17 bp, Homo sapiens
accccttatccaggact

SEQ ID NO: 2832413 - DNA, 12 bp, Homo sapiens
accccttcctgt

SEQ ID NO: 2832414 - DNA, 12 bp, Homo sapiens
accccttccttt

SEQ ID NO: 2832415 - DNA, 17 bp, Homo sapiens
accccttcctttcctct

SEQ ID NO: 2832416 - DNA, 17 bp, Homo sapiens
acccctttctggctctc

SEQ ID NO: 2832417 - DNA, 14 bp, Homo sapiens
acccgactgtgaaa

SEQ ID NO: 2832418 - DNA, 17 bp, Homo sapiens
acccgaggctgcccact

SEQ ID NO: 2832419 - DNA, 24 bp, Homo sapiens
acccgaggctgcccactatggtca

SEQ ID NO: 2832420 - DNA, 12 bp, Homo sapiens
acccgctctgga

SEQ ID NO: 2832421 - DNA, 16 bp, Homo sapiens
acccggcaccccctgc

SEQ ID NO: 2832422 - DNA, 18 bp, Homo sapiens
acccggcaccccctgcag

SEQ ID NO: 2832423 - DNA, 14 bp, Homo sapiens
acccggcccagaga

SEQ ID NO: 2832424 - DNA, 14 bp, Homo sapiens
acccggcccctgct

SEQ ID NO: 2832425 - DNA, 16 bp, Homo sapiens
acccggcccctgctgg

SEQ ID NO: 2832426 - DNA, 19 bp, Homo sapiens
acccgtacccccgtggtct

SEQ ID NO: 2832427 - DNA, 21 bp, Homo sapiens
acccgtacccccgtggtcttt

SEQ ID NO: 2832428 - DNA, 22 bp, Homo sapiens
acccgtgccaagtccaggtcct

SEQ ID NO: 2832429 - DNA, 22 bp, Homo sapiens
acccgttctgctggcctggatc

SEQ ID NO: 2832430 - DNA, 14 bp, Homo sapiens
accctacttctttt

SEQ ID NO: 2832431 - DNA, 18 bp, Homo sapiens
accctacttcttttgctc

SEQ ID NO: 2832432 - DNA, 23 bp, Homo sapiens
accctatattttgcatagtacca

SEQ ID NO: 2832433 - DNA, 9 bp, Homo sapiens
accctcact

SEQ ID NO: 2832434 - DNA, 12 bp, Homo sapiens
accctcagcctt

SEQ ID NO: 2832435 - DNA, 20 bp, Homo sapiens
accctcccaccatgcgctgc

SEQ ID NO: 2832436 - DNA, 19 bp, Homo sapiens
accctcgtggacacctgcc

SEQ ID NO: 2832437 - DNA, 13 bp, Homo sapiens
accctctcttccc

SEQ ID NO: 2832438 - DNA, 21 bp, Homo sapiens
accctctgaatggtccagggt

SEQ ID NO: 2832439 - DNA, 16 bp, Homo sapiens
accctgagcctgacct

SEQ ID NO: 2832440 - DNA, 14 bp, Homo sapiens
accctgaggagtct

SEQ ID NO: 2832441 - DNA, 19 bp, Homo sapiens
accctgaggagtctgaggt

SEQ ID NO: 2832442 - DNA, 14 bp, Homo sapiens
accctgcagagcac

SEQ ID NO: 2832443 - DNA, 19 bp, Homo sapiens
accctgcgaaggggccctg

SEQ ID NO: 2832444 - DNA, 22 bp, Homo sapiens
accctgcgaaggggccctggtc

SEQ ID NO: 2832445 - DNA, 23 bp, Homo sapiens
accctgctgggaccccagctagg

SEQ ID NO: 2832446 - DNA, 11 bp, Homo sapiens
accctggctct

SEQ ID NO: 2832447 - DNA, 13 bp, Homo sapiens
accctggctcttc

SEQ ID NO: 2832448 - DNA, 18 bp, Homo sapiens
accctggtgtctcctcca

SEQ ID NO: 2832449 - DNA, 21 bp, Homo sapiens
accctgtgggggcggctgtgg

SEQ ID NO: 2832450 - DNA, 22 bp, Homo sapiens
acccttcctcctcctttgccta

SEQ ID NO: 2832451 - DNA, 19 bp, Homo sapiens
acccttctttaaatcaaaa

SEQ ID NO: 2832452 - DNA, 21 bp, Homo sapiens
accctttccttccttccctgg

SEQ ID NO: 2832453 - DNA, 23 bp, Homo sapiens
accctttccttccttccctggct

SEQ ID NO: 2832454 - DNA, 12 bp, Homo sapiens
accgaattttat

SEQ ID NO: 2832455 - DNA, 17 bp, Homo sapiens
accgaattttattttac

SEQ ID NO: 2832456 - DNA, 18 bp, Homo sapiens
accgaattttattttaca

SEQ ID NO: 2832457 - DNA, 17 bp, Homo sapiens
accgagagtagccgaga

SEQ ID NO: 2832458 - DNA, 18 bp, Homo sapiens
accgagcgctttctggaa

SEQ ID NO: 2832459 - DNA, 23 bp, Homo sapiens
accgcagccagccggtgcctggc

SEQ ID NO: 2832460 - DNA, 19 bp, Homo sapiens
accgcgtctaccctgggat

SEQ ID NO: 2832461 - DNA, 14 bp, Homo sapiens
accgctacaccact

SEQ ID NO: 2832462 - DNA, 20 bp, Homo sapiens
accgctacaccactctggca

SEQ ID NO: 2832463 - DNA, 19 bp, Homo sapiens
accgctgcctaagtggctg

SEQ ID NO: 2832464 - DNA, 12 bp, Homo sapiens
accggccctgcc

SEQ ID NO: 2832465 - DNA, 14 bp, Homo sapiens
accgggacagacct

SEQ ID NO: 2832466 - DNA, 19 bp, Homo sapiens
accgggacagacctggaca

SEQ ID NO: 2832467 - DNA, 15 bp, Homo sapiens
accgggccacagaga

SEQ ID NO: 2832468 - DNA, 12 bp, Homo sapiens
accgggccactc

SEQ ID NO: 2832469 - DNA, 20 bp, Homo sapiens
accgggccactccttcctgc

SEQ ID NO: 2832470 - DNA, 21 bp, Homo sapiens
accgggctgggagctctgcag

SEQ ID NO: 2832471 - DNA, 23 bp, Homo sapiens
accgggctgggagctctgcagag

SEQ ID NO: 2832472 - DNA, 16 bp, Homo sapiens
accgtctgtttttaaa

SEQ ID NO: 2832473 - DNA, 18 bp, Homo sapiens
accgtggaccttcctgcc

SEQ ID NO: 2832474 - DNA, 17 bp, Homo sapiens
accgtggcccttcctgg

SEQ ID NO: 2832475 - DNA, 22 bp, Homo sapiens
accgtggcccttcctggacagc

SEQ ID NO: 2832476 - DNA, 16 bp, Homo sapiens
accgtgtccagcacag

SEQ ID NO: 2832477 - DNA, 23 bp, Homo sapiens
accgtgtccagcacagaaggaat

SEQ ID NO: 2832478 - DNA, 23 bp, Homo sapiens
accgtttttcaagaaaactggaa

SEQ ID NO: 2832479 - DNA, 23 bp, Homo sapiens
acctaaacatagaaattgcctga

SEQ ID NO: 2832480 - DNA, 12 bp, Homo sapiens
acctaaagaaaa

SEQ ID NO: 2832481 - DNA, 13 bp, Homo sapiens
acctaaagaaaaa

SEQ ID NO: 2832482 - DNA, 17 bp, Homo sapiens
acctaacccctttcctg

SEQ ID NO: 2832483 - DNA, 17 bp, Homo sapiens
acctaatcaggctgagg

SEQ ID NO: 2832484 - DNA, 14 bp, Homo sapiens
acctacatccccag

SEQ ID NO: 2832485 - DNA, 19 bp, Homo sapiens
acctacatccccaggtctc

SEQ ID NO: 2832486 - DNA, 15 bp, Homo sapiens
acctaccacagtgtc

SEQ ID NO: 2832487 - DNA, 16 bp, Homo sapiens
acctaccacagtgtct

SEQ ID NO: 2832488 - DNA, 19 bp, Homo sapiens
acctaccacagtgtctgta

SEQ ID NO: 2832489 - DNA, 18 bp, Homo sapiens
acctaccaccccttcctg

SEQ ID NO: 2832490 - DNA, 21 bp, Homo sapiens
acctaccaccccttcctgtcc

SEQ ID NO: 2832491 - DNA, 16 bp, Homo sapiens
acctactgactgatga

SEQ ID NO: 2832492 - DNA, 13 bp, Homo sapiens
acctagccttaga

SEQ ID NO: 2832493 - DNA, 14 bp, Homo sapiens
actaaaatatttat

SEQ ID NO: 2832494 - DNA, 23 bp, Homo sapiens
actaaactggtttgttgcagcca

SEQ ID NO: 2832495 - DNA, 15 bp, Homo sapiens
actaaatcttttata

SEQ ID NO: 2832496 - DNA, 15 bp, Homo sapiens
actaacactcagaag

SEQ ID NO: 2832497 - DNA, 20 bp, Homo sapiens
actaacactcagaagcctgg

SEQ ID NO: 2832498 - DNA, 17 bp, Homo sapiens
actaagttatagtatat

SEQ ID NO: 2832499 - DNA, 19 bp, Homo sapiens
actaatcgaactatgaact

SEQ ID NO: 2832500 - DNA, 20 bp, Homo sapiens
actaattggcctctttaaga

SEQ ID NO: 2832501 - DNA, 21 bp, Homo sapiens
actaatttaaaccagcagaaa

SEQ ID NO: 2832502 - DNA, 13 bp, Homo sapiens
actacaaaatttg

SEQ ID NO: 2832503 - DNA, 16 bp, Homo sapiens
actacaaaatttgaaa

SEQ ID NO: 2832504 - DNA, 22 bp, Homo sapiens
actacacactgtgtactgcagt

SEQ ID NO: 2832505 - DNA, 23 bp, Homo sapiens
actacaccatgtttgagctcaga

SEQ ID NO: 2832506 - DNA, 18 bp, Homo sapiens
actacactccagcctgag

SEQ ID NO: 2832507 - DNA, 15 bp, Homo sapiens
actacagccagaagc

SEQ ID NO: 2832508 - DNA, 11 bp, Homo sapiens
actacaggcac

SEQ ID NO: 2832509 - DNA, 15 bp, Homo sapiens
actacaggcacccac

SEQ ID NO: 2832510 - DNA, 15 bp, Homo sapiens
actactattctgtta

SEQ ID NO: 2832511 - DNA, 16 bp, Homo sapiens
actactgctgcaaagt

SEQ ID NO: 2832512 - DNA, 17 bp, Homo sapiens
actactgctgcaaagtg

SEQ ID NO: 2832513 - DNA, 19 bp, Homo sapiens
actactgctgcaaagtgca

SEQ ID NO: 2832514 - DNA, 22 bp, Homo sapiens
actactgctgcaaagtgcaaat

SEQ ID NO: 2832515 - DNA, 19 bp, Homo sapiens
actactgtggaaaaatatt

SEQ ID NO: 2832516 - DNA, 17 bp, Homo sapiens
actacttgttacctttc

SEQ ID NO: 2832517 - DNA, 20 bp, Homo sapiens
actacttttgtaccagtgtg

SEQ ID NO: 2832518 - DNA, 16 bp, Homo sapiens
actactttttatactc

SEQ ID NO: 2832519 - DNA, 22 bp, Homo sapiens
actactttttatactccataca

SEQ ID NO: 2832520 - DNA, 15 bp, Homo sapiens
actagaatttattca

SEQ ID NO: 2832521 - DNA, 17 bp, Homo sapiens
actagaatttgtatttt

SEQ ID NO: 2832522 - DNA, 16 bp, Homo sapiens
actagaggcagggagg

SEQ ID NO: 2832523 - DNA, 21 bp, Homo sapiens
actagaggtgagaaatttaaa

SEQ ID NO: 2832524 - DNA, 23 bp, Homo sapiens
actagatctcctatttttcagaa

SEQ ID NO: 2832525 - DNA, 15 bp, Homo sapiens
actagatctcctgta

SEQ ID NO: 2832526 - DNA, 16 bp, Homo sapiens
actagatctcctgtaa

SEQ ID NO: 2832527 - DNA, 18 bp, Homo sapiens
actagatctcctgtaatt

SEQ ID NO: 2832528 - DNA, 15 bp, Homo sapiens
actagcctctccagg

SEQ ID NO: 2832529 - DNA, 23 bp, Homo sapiens
actagctagaagtgggccaggac

SEQ ID NO: 2832530 - DNA, 21 bp, Homo sapiens
actagttgaacatctcacttt

SEQ ID NO: 2832531 - DNA, 17 bp, Homo sapiens
actagttgatgaaggag

SEQ ID NO: 2832532 - DNA, 17 bp, Homo sapiens
actataaccatcagtta

SEQ ID NO: 2832533 - DNA, 20 bp, Homo sapiens
actataaccatcagttactg

SEQ ID NO: 2832534 - DNA, 14 bp, Homo sapiens
actatagcccaggt

SEQ ID NO: 2832535 - DNA, 14 bp, Homo sapiens
actatcacatacaa

SEQ ID NO: 2832536 - DNA, 15 bp, Homo sapiens
actatcacatacaat

SEQ ID NO: 2832537 - DNA, 17 bp, Homo sapiens
actatcacatacaattt

SEQ ID NO: 2832538 - DNA, 18 bp, Homo sapiens
actatcacatacaatttg

SEQ ID NO: 2832539 - DNA, 21 bp, Homo sapiens
actatcacatacaatttgcac

SEQ ID NO: 2832540 - DNA, 20 bp, Homo sapiens
actatcttactatttcacaa

SEQ ID NO: 2832541 - DNA, 16 bp, Homo sapiens
actatcttggtgaatt

SEQ ID NO: 2832542 - DNA, 16 bp, Homo sapiens
actatctttctgataa

SEQ ID NO: 2832543 - DNA, 14 bp, Homo sapiens
actatgatctcagg

SEQ ID NO: 2832544 - DNA, 15 bp, Homo sapiens
actatggttcccaat

SEQ ID NO: 2832545 - DNA, 17 bp, Homo sapiens
actatggttcccaataa

SEQ ID NO: 2832546 - DNA, 19 bp, Homo sapiens
actatggttcccaataaaa

SEQ ID NO: 2832547 - DNA, 22 bp, Homo sapiens
actatgtgggacacctcaaata

SEQ ID NO: 2832548 - DNA, 15 bp, Homo sapiens
actatgtgtcatgat

SEQ ID NO: 2832549 - DNA, 15 bp, Homo sapiens
actatgttgcccagg

SEQ ID NO: 2832550 - DNA, 17 bp, Homo sapiens
actatgttgcccaggca

SEQ ID NO: 2832551 - DNA, 23 bp, Homo sapiens
actatgttgcccaggcaggtctt

SEQ ID NO: 2832552 - DNA, 17 bp, Homo sapiens
actcaaaatatttgtac

SEQ ID NO: 2832553 - DNA, 17 bp, Homo sapiens
actcaagaggctgaggc

SEQ ID NO: 2832554 - DNA, 15 bp, Homo sapiens
actcaataaaatcat

SEQ ID NO: 2832555 - DNA, 21 bp, Homo sapiens
actcacaagaagaccagactg

SEQ ID NO: 2832556 - DNA, 12 bp, Homo sapiens
actcacacaggc

SEQ ID NO: 2832557 - DNA, 13 bp, Homo sapiens
actcacacaggca

SEQ ID NO: 2832558 - DNA, 19 bp, Homo sapiens
actcacacaggcatttcct

SEQ ID NO: 2832559 - DNA, 23 bp, Homo sapiens
actcacacaggcatttcctgggt

SEQ ID NO: 2832560 - DNA, 20 bp, Homo sapiens
actcacatttattctgctca

SEQ ID NO: 2832561 - DNA, 21 bp, Homo sapiens
actcacatttattctgctcac

SEQ ID NO: 2832562 - DNA, 15 bp, Homo sapiens
actcaccatgtaaaa

SEQ ID NO: 2832563 - DNA, 21 bp, Homo sapiens
actcacccatgtgccaaggtg

SEQ ID NO: 2832564 - DNA, 20 bp, Homo sapiens
actcagaaaagaaaaccatt

SEQ ID NO: 2832565 - DNA, 15 bp, Homo sapiens
actcagaagacactg

SEQ ID NO: 2832566 - DNA, 18 bp, Homo sapiens
actcagaagacactgatg

SEQ ID NO: 2832567 - DNA, 13 bp, Homo sapiens
actcagaagcctg

SEQ ID NO: 2832568 - DNA, 17 bp, Homo sapiens
actcagaagcctgaggc

SEQ ID NO: 2832569 - DNA, 17 bp, Homo sapiens
actcagaagcctggggg

SEQ ID NO: 2832570 - DNA, 22 bp, Homo sapiens
actcagaagcctgggggcctgg

SEQ ID NO: 2832571 - DNA, 14 bp, Homo sapiens
actcagcagccctc

SEQ ID NO: 2832572 - DNA, 18 bp, Homo sapiens
actcagcagccctcctca

SEQ ID NO: 2832573 - DNA, 23 bp, Homo sapiens
actcagcagccctcctcaccccg

SEQ ID NO: 2832574 - DNA, 15 bp, Homo sapiens
actcagccctgggcc

SEQ ID NO: 2832575 - DNA, 17 bp, Homo sapiens
actcaggaggctgaggc

SEQ ID NO: 2832576 - DNA, 18 bp, Homo sapiens
actcaggaggctgagggg

SEQ ID NO: 2832577 - DNA, 18 bp, Homo sapiens
actcaggatccagtccct

SEQ ID NO: 2832578 - DNA, 14 bp, Homo sapiens
actcagtcccccac

SEQ ID NO: 2832579 - DNA, 22 bp, Homo sapiens
actcagttttaactagaattta

SEQ ID NO: 2832580 - DNA, 9 bp, Homo sapiens
actcatcat

SEQ ID NO: 2832581 - DNA, 15 bp, Homo sapiens
actcatcataaaata

SEQ ID NO: 2832582 - DNA, 20 bp, Homo sapiens
actcatctgttatcctgcta

SEQ ID NO: 2832583 - DNA, 12 bp, Homo sapiens
actgcaggcccc

SEQ ID NO: 2832584 - DNA, 21 bp, Homo sapiens
actgcaggccccgcttgtcca

SEQ ID NO: 2832585 - DNA, 16 bp, Homo sapiens
actgcagggactgcca

SEQ ID NO: 2832586 - DNA, 18 bp, Homo sapiens
actgcagggactgccagt

SEQ ID NO: 2832587 - DNA, 16 bp, Homo sapiens
actgccaaaacaatgc

SEQ ID NO: 2832588 - DNA, 12 bp, Homo sapiens
actgccaagaaa

SEQ ID NO: 2832589 - DNA, 14 bp, Homo sapiens
actgccaggaggga

SEQ ID NO: 2832590 - DNA, 19 bp, Homo sapiens
actgccagtccccctgccc

SEQ ID NO: 2832591 - DNA, 12 bp, Homo sapiens
actgccccacca

SEQ ID NO: 2832592 - DNA, 20 bp, Homo sapiens
actgccccaccagccacctc

SEQ ID NO: 2832593 - DNA, 19 bp, Homo sapiens
actgcctagaaaatgcaaa

SEQ ID NO: 2832594 - DNA, 9 bp, Homo sapiens
actgcctgc

SEQ ID NO: 2832595 - DNA, 14 bp, Homo sapiens
actgcctgcttggg

SEQ ID NO: 2832596 - DNA, 11 bp, Homo sapiens
actgccttcca

SEQ ID NO: 2832597 - DNA, 17 bp, Homo sapiens
actgccttccaggagca

SEQ ID NO: 2832598 - DNA, 12 bp, Homo sapiens
actgcctttgga

SEQ ID NO: 2832599 - DNA, 19 bp, Homo sapiens
actgcgatcttcagagcag

SEQ ID NO: 2832600 - DNA, 22 bp, Homo sapiens
actgcgggatggtcctggggct

SEQ ID NO: 2832601 - DNA, 23 bp, Homo sapiens
actgctacaaatactcttaggaa

SEQ ID NO: 2832602 - DNA, 18 bp, Homo sapiens
actgctacaccttagcag

SEQ ID NO: 2832603 - DNA, 16 bp, Homo sapiens
actgctcaagaagaca

SEQ ID NO: 2832604 - DNA, 18 bp, Homo sapiens
actgctcaagaagacatg

SEQ ID NO: 2832605 - DNA, 12 bp, Homo sapiens
actgctctcagc

SEQ ID NO: 2832606 - DNA, 15 bp, Homo sapiens
actgctgcaaagtgc

SEQ ID NO: 2832607 - DNA, 17 bp, Homo sapiens
actgctgcaaagtgcaa

SEQ ID NO: 2832608 - DNA, 22 bp, Homo sapiens
actgctgtgtccgctttcatga

SEQ ID NO: 2832609 - DNA, 18 bp, Homo sapiens
actgcttgtgtttttaac

SEQ ID NO: 2832610 - DNA, 23 bp, Homo sapiens
actgctttcaacttaaatcactg

SEQ ID NO: 2832611 - DNA, 20 bp, Homo sapiens
actgcttttggtctgtgtga

SEQ ID NO: 2832612 - DNA, 15 bp, Homo sapiens
actggaaccagggag

SEQ ID NO: 2832613 - DNA, 17 bp, Homo sapiens
actggaacttgaactga

SEQ ID NO: 2832614 - DNA, 18 bp, Homo sapiens
actggaacttgaactgat

SEQ ID NO: 2832615 - DNA, 15 bp, Homo sapiens
actggaagcacagct

SEQ ID NO: 2832616 - DNA, 20 bp, Homo sapiens
actggaagcatgtaggagaa

SEQ ID NO: 2832617 - DNA, 13 bp, Homo sapiens
actggaagttttg

SEQ ID NO: 2832618 - DNA, 18 bp, Homo sapiens
actggaatcgatctgtac

SEQ ID NO: 2832619 - DNA, 15 bp, Homo sapiens
actggacagcttgtg

SEQ ID NO: 2832620 - DNA, 16 bp, Homo sapiens
actggaccactgggca

SEQ ID NO: 2832621 - DNA, 20 bp, Homo sapiens
actggaccactgggcaatga

SEQ ID NO: 2832622 - DNA, 22 bp, Homo sapiens
actggacttgagcttggcagct

SEQ ID NO: 2832623 - DNA, 14 bp, Homo sapiens
actggagcatctga

SEQ ID NO: 2832624 - DNA, 16 bp, Homo sapiens
actggagcatctgact

SEQ ID NO: 2832625 - DNA, 12 bp, Homo sapiens
actggagcccag

SEQ ID NO: 2832626 - DNA, 19 bp, Homo sapiens
actggaggtcacattcagg

SEQ ID NO: 2832627 - DNA, 20 bp, Homo sapiens
actggaggtcacattcagga

SEQ ID NO: 2832628 - DNA, 23 bp, Homo sapiens
actggaggtcacattcaggaaga

SEQ ID NO: 2832629 - DNA, 13 bp, Homo sapiens
actggagtagttg

SEQ ID NO: 2832630 - DNA, 18 bp, Homo sapiens
actggagtgcagggagga

SEQ ID NO: 2832631 - DNA, 16 bp, Homo sapiens
actggccaagctgagg

SEQ ID NO: 2832632 - DNA, 17 bp, Homo sapiens
actggccaagctgaggt

SEQ ID NO: 2832633 - DNA, 15 bp, Homo sapiens
actggcctcaaagca

SEQ ID NO: 2832634 - DNA, 17 bp, Homo sapiens
actggcctcaaagcaag

SEQ ID NO: 2832635 - DNA, 22 bp, Homo sapiens
actggctgcaaagggtatcagg

SEQ ID NO: 2832636 - DNA, 16 bp, Homo sapiens
actggctggctgcagt

SEQ ID NO: 2832637 - DNA, 17 bp, Homo sapiens
actggctggctgcagtg

SEQ ID NO: 2832638 - DNA, 18 bp, Homo sapiens
actgggcaatgatggcaa

SEQ ID NO: 2832639 - DNA, 14 bp, Homo sapiens
actggggtgcgaga

SEQ ID NO: 2832640 - DNA, 15 bp, Homo sapiens
actgggtacttgtgg

SEQ ID NO: 2832641 - DNA, 18 bp, Homo sapiens
actgggtacttgtggaca

SEQ ID NO: 2832642 - DNA, 23 bp, Homo sapiens
actggtgctataggctggagaag

SEQ ID NO: 2832643 - DNA, 16 bp, Homo sapiens
actggttgtgaataat

SEQ ID NO: 2832644 - DNA, 18 bp, Homo sapiens
actggtttcagttgacaa

SEQ ID NO: 2832645 - DNA, 15 bp, Homo sapiens
actggtttctcagaa

SEQ ID NO: 2832646 - DNA, 17 bp, Homo sapiens
actggtttgaagaatgt

SEQ ID NO: 2832647 - DNA, 22 bp, Homo sapiens
actggtttgttgcagccaaaga

SEQ ID NO: 2832648 - DNA, 12 bp, Homo sapiens
actgtaaataca

SEQ ID NO: 2832649 - DNA, 17 bp, Homo sapiens
actgtaaatacaaaata

SEQ ID NO: 2832650 - DNA, 14 bp, Homo sapiens
actgtaatcttaaa

SEQ ID NO: 2832651 - DNA, 18 bp, Homo sapiens
actgtaatcttaaaagtg

SEQ ID NO: 2832652 - DNA, 20 bp, Homo sapiens
actgtaattggtgacaatgt

SEQ ID NO: 2832653 - DNA, 21 bp, Homo sapiens
actgtaattttgtttgtaatc

SEQ ID NO: 2832654 - DNA, 18 bp, Homo sapiens
actgtacttaataaattc

SEQ ID NO: 2832655 - DNA, 17 bp, Homo sapiens
actgtacttattttcca

SEQ ID NO: 2832656 - DNA, 23 bp, Homo sapiens
actgtacttattttccaataaaa

SEQ ID NO: 2832657 - DNA, 15 bp, Homo sapiens
actgtcactgttcct

SEQ ID NO: 2832658 - DNA, 20 bp, Homo sapiens
actgtccctcaaatgaccca

SEQ ID NO: 2832659 - DNA, 14 bp, Homo sapiens
actgtcgctgcttc

SEQ ID NO: 2832660 - DNA, 17 bp, Homo sapiens
actgtcgctgcttcgtg

SEQ ID NO: 2832661 - DNA, 19 bp, Homo sapiens
actgtcgtgtttacaaaag

SEQ ID NO: 2832662 - DNA, 20 bp, Homo sapiens
actgtgaaagtatgtgatat

SEQ ID NO: 2832663 - DNA, 18 bp, Homo sapiens
actgtgaacctggagggc

SEQ ID NO: 2832664 - DNA, 18 bp, Homo sapiens
actgtgatggggtgggca

SEQ ID NO: 2832665 - DNA, 16 bp, Homo sapiens
actgtgccatgtgcca

SEQ ID NO: 2832666 - DNA, 18 bp, Homo sapiens
actgtgccatgtgccagg

SEQ ID NO: 2832667 - DNA, 23 bp, Homo sapiens
actgtgcttacagtgactgtcgt

SEQ ID NO: 2832668 - DNA, 14 bp, Homo sapiens
actgtggaaaaata

SEQ ID NO: 2832669 - DNA, 17 bp, Homo sapiens
actgtggaaaaatattt

SEQ ID NO: 2832670 - DNA, 17 bp, Homo sapiens
actgtggcgttctgctg

SEQ ID NO: 2832671 - DNA, 19 bp, Homo sapiens
actgtggctgcagagacct

SEQ ID NO: 2832672 - DNA, 12 bp, Homo sapiens
actgtgtgaaga

SEQ ID NO: 2832673 - DNA, 13 bp, Homo sapiens
actgtgtgaagaa

SEQ ID NO: 2832674 - DNA, 14 bp, Homo sapiens
agactgtggctgct

SEQ ID NO: 2832675 - DNA, 14 bp, Homo sapiens
agactgttgctcaa

SEQ ID NO: 2832676 - DNA, 19 bp, Homo sapiens
agacttcaagcatggctat

SEQ ID NO: 2832677 - DNA, 21 bp, Homo sapiens
agacttcacactgcaagagcc

SEQ ID NO: 2832678 - DNA, 16 bp, Homo sapiens
agacttcagtcctggt

SEQ ID NO: 2832679 - DNA, 18 bp, Homo sapiens
agacttcagtcctggtct

SEQ ID NO: 2832680 - DNA, 19 bp, Homo sapiens
agacttccaaacctgacag

SEQ ID NO: 2832681 - DNA, 19 bp, Homo sapiens
agacttccctgaatgtatt

SEQ ID NO: 2832682 - DNA, 20 bp, Homo sapiens
agacttcgactcaggatcca

SEQ ID NO: 2832683 - DNA, 17 bp, Homo sapiens
agacttctctttcttat

SEQ ID NO: 2832684 - DNA, 12 bp, Homo sapiens
agacttgacagt

SEQ ID NO: 2832685 - DNA, 14 bp, Homo sapiens
agacttgacagtgg

SEQ ID NO: 2832686 - DNA, 13 bp, Homo sapiens
agactttagctta

SEQ ID NO: 2832687 - DNA, 14 bp, Homo sapiens
agactttctcagtg

SEQ ID NO: 2832688 - DNA, 18 bp, Homo sapiens
agacttttatcaaaatcc

SEQ ID NO: 2832689 - DNA, 18 bp, Homo sapiens
agagaaacatttatggaa

SEQ ID NO: 2832690 - DNA, 15 bp, Homo sapiens
agagaaagaaaatga

SEQ ID NO: 2832691 - DNA, 16 bp, Homo sapiens
agagaaagaaaatgaa

SEQ ID NO: 2832692 - DNA, 12 bp, Homo sapiens
agagaaggcagg

SEQ ID NO: 2832693 - DNA, 13 bp, Homo sapiens
agagaaggcagga

SEQ ID NO: 2832694 - DNA, 14 bp, Homo sapiens
agagaaggcttcct

SEQ ID NO: 2832695 - DNA, 21 bp, Homo sapiens
agagaagtatccaattatgtg

SEQ ID NO: 2832696 - DNA, 19 bp, Homo sapiens
agagaataaagacttcatg

SEQ ID NO: 2832697 - DNA, 17 bp, Homo sapiens
agagaatatatttttga

SEQ ID NO: 2832698 - DNA, 19 bp, Homo sapiens
agagacaaacacctcccag

SEQ ID NO: 2832699 - DNA, 20 bp, Homo sapiens
agagacaaacacctcccagg

SEQ ID NO: 2832700 - DNA, 15 bp, Homo sapiens
agagacaataaaaca

SEQ ID NO: 2832701 - DNA, 16 bp, Homo sapiens
agagacaataaaacat

SEQ ID NO: 2832702 - DNA, 14 bp, Homo sapiens
agagacacctgcac

SEQ ID NO: 2832703 - DNA, 15 bp, Homo sapiens
agagacacctgcacc

SEQ ID NO: 2832704 - DNA, 15 bp, Homo sapiens
agagacaggcccaag

SEQ ID NO: 2832705 - DNA, 20 bp, Homo sapiens
agagacaggcccaagagatg

SEQ ID NO: 2832706 - DNA, 18 bp, Homo sapiens
agagacattaactcatta

SEQ ID NO: 2832707 - DNA, 23 bp, Homo sapiens
agagacattaactcattagactg

SEQ ID NO: 2832708 - DNA, 16 bp, Homo sapiens
agagacccaaggagga

SEQ ID NO: 2832709 - DNA, 21 bp, Homo sapiens
agagacccaaggaggaaaaac

SEQ ID NO: 2832710 - DNA, 17 bp, Homo sapiens
agagacccagatctcat

SEQ ID NO: 2832711 - DNA, 19 bp, Homo sapiens
agagaccccttcctttcct

SEQ ID NO: 2832712 - DNA, 21 bp, Homo sapiens
agagaccctcactgctgggga

SEQ ID NO: 2832713 - DNA, 19 bp, Homo sapiens
agagactcagggccccagc

SEQ ID NO: 2832714 - DNA, 11 bp, Homo sapiens
agagagaagcc

SEQ ID NO: 2832715 - DNA, 16 bp, Homo sapiens
agagagaccacttttc

SEQ ID NO: 2832716 - DNA, 14 bp, Homo sapiens
agagagaccctcac

SEQ ID NO: 2832717 - DNA, 23 bp, Homo sapiens
agagagaccctcactgctgggga

SEQ ID NO: 2832718 - DNA, 15 bp, Homo sapiens
agagagagaccctca

SEQ ID NO: 2832719 - DNA, 14 bp, Homo sapiens
agagagagtgtttg

SEQ ID NO: 2832720 - DNA, 14 bp, Homo sapiens
agagaggccttttg

SEQ ID NO: 2832721 - DNA, 17 bp, Homo sapiens
agagaggggacatttcc

SEQ ID NO: 2832722 - DNA, 19 bp, Homo sapiens
agagaggggacatttccct

SEQ ID NO: 2832723 - DNA, 22 bp, Homo sapiens
agagagggtggtgacctctgcc

SEQ ID NO: 2832724 - DNA, 17 bp, Homo sapiens
agagaggtggagaactg

SEQ ID NO: 2832725 - DNA, 23 bp, Homo sapiens
agagagtgctgagaaggacacct

SEQ ID NO: 2832726 - DNA, 15 bp, Homo sapiens
agagagttgaaccta

SEQ ID NO: 2832727 - DNA, 16 bp, Homo sapiens
agagataccttgaaaa

SEQ ID NO: 2832728 - DNA, 15 bp, Homo sapiens
agagatatatctgaa

SEQ ID NO: 2832729 - DNA, 19 bp, Homo sapiens
agagatatatctgaaaact

SEQ ID NO: 2832730 - DNA, 23 bp, Homo sapiens
agagatatatctgaaaactggaa

SEQ ID NO: 2832731 - DNA, 22 bp, Homo sapiens
agagatcaaccccttcgctcct

SEQ ID NO: 2832732 - DNA, 19 bp, Homo sapiens
agagatgaagagtgagagg

SEQ ID NO: 2832733 - DNA, 18 bp, Homo sapiens
agagatgactgagtcctc

SEQ ID NO: 2832734 - DNA, 12 bp, Homo sapiens
agagatgcctcc

SEQ ID NO: 2832735 - DNA, 17 bp, Homo sapiens
agagatgcctccaccgc

SEQ ID NO: 2832736 - DNA, 20 bp, Homo sapiens
agagatgtaccatgttaaag

SEQ ID NO: 2832737 - DNA, 13 bp, Homo sapiens
agagattaatttg

SEQ ID NO: 2832738 - DNA, 16 bp, Homo sapiens
agagatttcaacatat

SEQ ID NO: 2832739 - DNA, 18 bp, Homo sapiens
agagcaaaataattttaa

SEQ ID NO: 2832740 - DNA, 14 bp, Homo sapiens
agagcagaggcagc

SEQ ID NO: 2832741 - DNA, 18 bp, Homo sapiens
agagcaggcacatggagg

SEQ ID NO: 2832742 - DNA, 14 bp, Homo sapiens
agagcatcatgcct

SEQ ID NO: 2832743 - DNA, 18 bp, Homo sapiens
agagcatcatgcctctga

SEQ ID NO: 2832744 - DNA, 22 bp, Homo sapiens
agagcatcatgcctctgaggcc

SEQ ID NO: 2832745 - DNA, 20 bp, Homo sapiens
agagcattacgtgagccagg

SEQ ID NO: 2832746 - DNA, 17 bp, Homo sapiens
agagccagccctccctg

SEQ ID NO: 2832747 - DNA, 12 bp, Homo sapiens
agagccagctct

SEQ ID NO: 2832748 - DNA, 16 bp, Homo sapiens
agagccagctctctct

SEQ ID NO: 2832749 - DNA, 19 bp, Homo sapiens
agagcccaccttggctcaa

SEQ ID NO: 2832750 - DNA, 21 bp, Homo sapiens
agagcccagcagggcctcaaa

SEQ ID NO: 2832751 - DNA, 14 bp, Homo sapiens
agagcccagccatt

SEQ ID NO: 2832752 - DNA, 14 bp, Homo sapiens
agagcccatgctca

SEQ ID NO: 2832753 - DNA, 14 bp, Homo sapiens
agagccccacacgg

SEQ ID NO: 2832754 - DNA, 15 bp, Homo sapiens
agagccccacacgga

SEQ ID NO: 2832755 - DNA, 14 bp, Homo sapiens
agagccccccacaa

SEQ ID NO: 2832756 - DNA, 15 bp, Homo sapiens
agagccctgggaccg

SEQ ID NO: 2832757 - DNA, 18 bp, Homo sapiens
agagcctgactgtgttca

SEQ ID NO: 2832758 - DNA, 15 bp, Homo sapiens
agagcctgctccccc

SEQ ID NO: 2832759 - DNA, 20 bp, Homo sapiens
agagcctgctcccccacccc

SEQ ID NO: 2832760 - DNA, 15 bp, Homo sapiens
agagcctggagaagc

SEQ ID NO: 2832761 - DNA, 16 bp, Homo sapiens
agagcctggggcatcc

SEQ ID NO: 2832762 - DNA, 16 bp, Homo sapiens
agagcctggggctcta

SEQ ID NO: 2832763 - DNA, 22 bp, Homo sapiens
agagccttcacaaccagccaca

SEQ ID NO: 2832764 - DNA, 20 bp, Homo sapiens
agagccttctcctgcctaca

SEQ ID NO: 2832765 - DNA, 19 bp, Homo sapiens
agcatgtggggaagcaaga

SEQ ID NO: 2832766 - DNA, 17 bp, Homo sapiens
agcattacgtgagccag

SEQ ID NO: 2832767 - DNA, 22 bp, Homo sapiens
agcattagctacttttcagaat

SEQ ID NO: 2832768 - DNA, 13 bp, Homo sapiens
agcattgcatgga

SEQ ID NO: 2832769 - DNA, 15 bp, Homo sapiens
agcatttactttgaa

SEQ ID NO: 2832770 - DNA, 17 bp, Homo sapiens
agcatttactttgaatt

SEQ ID NO: 2832771 - DNA, 21 bp, Homo sapiens
agcatttagtccaatgtcttt

SEQ ID NO: 2832772 - DNA, 17 bp, Homo sapiens
agcatttgtttctactt

SEQ ID NO: 2832773 - DNA, 20 bp, Homo sapiens
agcattttactacttgttac

SEQ ID NO: 2832774 - DNA, 19 bp, Homo sapiens
agcattttactgtctgtaa

SEQ ID NO: 2832775 - DNA, 23 bp, Homo sapiens
agcattttactgtctgtaagaga

SEQ ID NO: 2832776 - DNA, 19 bp, Homo sapiens
agcattttatatccacatc

SEQ ID NO: 2832777 - DNA, 14 bp, Homo sapiens
agccaaacagagcc

SEQ ID NO: 2832778 - DNA, 20 bp, Homo sapiens
agccaaagctaggcctggcc

SEQ ID NO: 2832779 - DNA, 18 bp, Homo sapiens
agccaagggttcagagac

SEQ ID NO: 2832780 - DNA, 12 bp, Homo sapiens
agccacacagag

SEQ ID NO: 2832781 - DNA, 15 bp, Homo sapiens
agccacacagagcct

SEQ ID NO: 2832782 - DNA, 17 bp, Homo sapiens
agccacacttctcagga

SEQ ID NO: 2832783 - DNA, 20 bp, Homo sapiens
agccacacttctcaggacac

SEQ ID NO: 2832784 - DNA, 17 bp, Homo sapiens
agccacagaagccagga

SEQ ID NO: 2832785 - DNA, 16 bp, Homo sapiens
agccacagaccacctg

SEQ ID NO: 2832786 - DNA, 18 bp, Homo sapiens
agccacagaccacctgct

SEQ ID NO: 2832787 - DNA, 11 bp, Homo sapiens
agccacatccc

SEQ ID NO: 2832788 - DNA, 14 bp, Homo sapiens
agccaccccctccc

SEQ ID NO: 2832789 - DNA, 12 bp, Homo sapiens
agccaccctgag

SEQ ID NO: 2832790 - DNA, 20 bp, Homo sapiens
agccaccctgaggagtctga

SEQ ID NO: 2832791 - DNA, 21 bp, Homo sapiens
agccaccctgaggagtctgag

SEQ ID NO: 2832792 - DNA, 22 bp, Homo sapiens
agccaccctgaggagtctgagg

SEQ ID NO: 2832793 - DNA, 16 bp, Homo sapiens
agccaccttccagtga

SEQ ID NO: 2832794 - DNA, 14 bp, Homo sapiens
agccacggccaggc

SEQ ID NO: 2832795 - DNA, 16 bp, Homo sapiens
agccacggccaggcca

SEQ ID NO: 2832796 - DNA, 17 bp, Homo sapiens
agccacggccaggccag

SEQ ID NO: 2832797 - DNA, 18 bp, Homo sapiens
agccacggccaggccaga

SEQ ID NO: 2832798 - DNA, 18 bp, Homo sapiens
agccacgttccttactgc

SEQ ID NO: 2832799 - DNA, 15 bp, Homo sapiens
agccactcaggaggc

SEQ ID NO: 2832800 - DNA, 22 bp, Homo sapiens
agccactcaggaggctgaggca

SEQ ID NO: 2832801 - DNA, 20 bp, Homo sapiens
agccactgcaccgggccaca

SEQ ID NO: 2832802 - DNA, 21 bp, Homo sapiens
agccactgcaccgggccacag

SEQ ID NO: 2832803 - DNA, 18 bp, Homo sapiens
agccactggtttctcaga

SEQ ID NO: 2832804 - DNA, 16 bp, Homo sapiens
agccacttaccttcaa

SEQ ID NO: 2832805 - DNA, 17 bp, Homo sapiens
agccacttaccttcaat

SEQ ID NO: 2832806 - DNA, 21 bp, Homo sapiens
agccacttaccttcaataaag

SEQ ID NO: 2832807 - DNA, 22 bp, Homo sapiens
agccagaaggggcacgcctgcc

SEQ ID NO: 2832808 - DNA, 23 bp, Homo sapiens
agccagaaggggcacgcctgccc

SEQ ID NO: 2832809 - DNA, 22 bp, Homo sapiens
agccagattttttaaaatttat

SEQ ID NO: 2832810 - DNA, 23 bp, Homo sapiens
agccagattttttaaaatttata

SEQ ID NO: 2832811 - DNA, 23 bp, Homo sapiens
agccagcaatgatgtccagaaga

SEQ ID NO: 2832812 - DNA, 11 bp, Homo sapiens
agccagcagcc

SEQ ID NO: 2832813 - DNA, 14 bp, Homo sapiens
agccagcagccagc

SEQ ID NO: 2832814 - DNA, 16 bp, Homo sapiens
agccagcccagcccag

SEQ ID NO: 2832815 - DNA, 20 bp, Homo sapiens
agccagccctccctgtcctc

SEQ ID NO: 2832816 - DNA, 20 bp, Homo sapiens
agccagccctgcctggagga

SEQ ID NO: 2832817 - DNA, 24 bp, Homo sapiens
agccagccctgcctggaggacctg

SEQ ID NO: 2832818 - DNA, 16 bp, Homo sapiens
agccagccggggcgag

SEQ ID NO: 2832819 - DNA, 15 bp, Homo sapiens
agccagccggtgcct

SEQ ID NO: 2832820 - DNA, 19 bp, Homo sapiens
agccagctcctgggcagct

SEQ ID NO: 2832821 - DNA, 16 bp, Homo sapiens
agccagctctgcatta

SEQ ID NO: 2832822 - DNA, 18 bp, Homo sapiens
agccagctgcaggaatca

SEQ ID NO: 2832823 - DNA, 17 bp, Homo sapiens
agccaggctgagtgagc

SEQ ID NO: 2832824 - DNA, 14 bp, Homo sapiens
agccagggccaggg

SEQ ID NO: 2832825 - DNA, 19 bp, Homo sapiens
agccagggtcctgagtggc

SEQ ID NO: 2832826 - DNA, 20 bp, Homo sapiens
agccagggtcctgagtggct

SEQ ID NO: 2832827 - DNA, 18 bp, Homo sapiens
agccatcaacaagagttg

SEQ ID NO: 2832828 - DNA, 20 bp, Homo sapiens
agccatcatgtgcctggaaa

SEQ ID NO: 2832829 - DNA, 22 bp, Homo sapiens
agccatctctctactcctacct

SEQ ID NO: 2832830 - DNA, 18 bp, Homo sapiens
agccatgaggagttgctg

SEQ ID NO: 2832831 - DNA, 20 bp, Homo sapiens
agccattaccatggagacaa

SEQ ID NO: 2832832 - DNA, 16 bp, Homo sapiens
agcccaagcagagtga

SEQ ID NO: 2832833 - DNA, 15 bp, Homo sapiens
agcccaatattataa

SEQ ID NO: 2832834 - DNA, 20 bp, Homo sapiens
agcccaatattataattttt

SEQ ID NO: 2832835 - DNA, 13 bp, Homo sapiens
agcccaccttggc

SEQ ID NO: 2832836 - DNA, 12 bp, Homo sapiens
agcccagcactg

SEQ ID NO: 2832837 - DNA, 24 bp, Homo sapiens
agcccagcactgtgaagacccagc

SEQ ID NO: 2832838 - DNA, 15 bp, Homo sapiens
agcccagcagggcct

SEQ ID NO: 2832839 - DNA, 21 bp, Homo sapiens
agcccagccattaccatggag

SEQ ID NO: 2832840 - DNA, 21 bp, Homo sapiens
agcccagcctctgtccctctt

SEQ ID NO: 2832841 - DNA, 13 bp, Homo sapiens
agcccagctggtg

SEQ ID NO: 2832842 - DNA, 16 bp, Homo sapiens
agcccagctggtggga

SEQ ID NO: 2832843 - DNA, 19 bp, Homo sapiens
agcccatgctcaaccactg

SEQ ID NO: 2832844 - DNA, 15 bp, Homo sapiens
agcccattctctctc

SEQ ID NO: 2832845 - DNA, 16 bp, Homo sapiens
agcccattctctctcc

SEQ ID NO: 2832846 - DNA, 18 bp, Homo sapiens
agcccattctctctcctg

SEQ ID NO: 2832847 - DNA, 17 bp, Homo sapiens
agccccagtgacagcta

SEQ ID NO: 2832848 - DNA, 13 bp, Homo sapiens
agccccattctgc

SEQ ID NO: 2832849 - DNA, 22 bp, Homo sapiens
agccccattctgcctgcccagg

SEQ ID NO: 2832850 - DNA, 23 bp, Homo sapiens
agccccattctgcctgcccaggc

SEQ ID NO: 2832851 - DNA, 16 bp, Homo sapiens
agccccgactccagcc

SEQ ID NO: 2832852 - DNA, 21 bp, Homo sapiens
agccccgactccagccagcgc

SEQ ID NO: 2832853 - DNA, 14 bp, Homo sapiens
agcccctcctcccc

SEQ ID NO: 2832854 - DNA, 16 bp, Homo sapiens
agcccctcctcccctt

SEQ ID NO: 2832855 - DNA, 19 bp, Homo sapiens
aggcacgtttggcatttct

SEQ ID NO: 2832856 - DNA, 15 bp, Homo sapiens
aggcagacagcagct

SEQ ID NO: 2832857 - DNA, 20 bp, Homo sapiens
aggcagacagcagctcaggc

SEQ ID NO: 2832858 - DNA, 21 bp, Homo sapiens
aggcagacagcagctcaggca

SEQ ID NO: 2832859 - DNA, 13 bp, Homo sapiens
aggcagagaaaga

SEQ ID NO: 2832860 - DNA, 15 bp, Homo sapiens
aggcagagaaagaag

SEQ ID NO: 2832861 - DNA, 17 bp, Homo sapiens
aggcagagaaagaagag

SEQ ID NO: 2832862 - DNA, 19 bp, Homo sapiens
aggcagagaaagaagagac

SEQ ID NO: 2832863 - DNA, 22 bp, Homo sapiens
aggcagagaaagaagagacagg

SEQ ID NO: 2832864 - DNA, 14 bp, Homo sapiens
aggcagagaatcat

SEQ ID NO: 2832865 - DNA, 22 bp, Homo sapiens
aggcagagaatcatacttagca

SEQ ID NO: 2832866 - DNA, 14 bp, Homo sapiens
aggcagagacaata

SEQ ID NO: 2832867 - DNA, 20 bp, Homo sapiens
aggcagagacaataaaacat

SEQ ID NO: 2832868 - DNA, 13 bp, Homo sapiens
aggcagatacagg

SEQ ID NO: 2832869 - DNA, 18 bp, Homo sapiens
aggcagcaaggcccgagc

SEQ ID NO: 2832870 - DNA, 17 bp, Homo sapiens
aggcagccccattctgc

SEQ ID NO: 2832871 - DNA, 20 bp, Homo sapiens
aggcagccccattctgcctg

SEQ ID NO: 2832872 - DNA, 15 bp, Homo sapiens
aggcagccctttggg

SEQ ID NO: 2832873 - DNA, 14 bp, Homo sapiens
aggcagcgggatct

SEQ ID NO: 2832874 - DNA, 13 bp, Homo sapiens
aggcaggcagggc

SEQ ID NO: 2832875 - DNA, 12 bp, Homo sapiens
aggcagggaggg

SEQ ID NO: 2832876 - DNA, 13 bp, Homo sapiens
aggcagggagggg

SEQ ID NO: 2832877 - DNA, 23 bp, Homo sapiens
aggcagggccttgcccagagatg

SEQ ID NO: 2832878 - DNA, 16 bp, Homo sapiens
aggcaggggtgggaga

SEQ ID NO: 2832879 - DNA, 20 bp, Homo sapiens
aggcagggtcaggagagggg

SEQ ID NO: 2832880 - DNA, 23 bp, Homo sapiens
aggcagggtcaggagaggggcag

SEQ ID NO: 2832881 - DNA, 12 bp, Homo sapiens
aggcagggtctc

SEQ ID NO: 2832882 - DNA, 19 bp, Homo sapiens
aggcagggtctcactctgt

SEQ ID NO: 2832883 - DNA, 22 bp, Homo sapiens
aggcagggtctcactctgtcgc

SEQ ID NO: 2832884 - DNA, 22 bp, Homo sapiens
aggcaggtcttgaactcctggc

SEQ ID NO: 2832885 - DNA, 13 bp, Homo sapiens
aggcatcccaggg

SEQ ID NO: 2832886 - DNA, 22 bp, Homo sapiens
aggcatctacacagcctggact

SEQ ID NO: 2832887 - DNA, 23 bp, Homo sapiens
aggcatgagggatcacagggccc

SEQ ID NO: 2832888 - DNA, 14 bp, Homo sapiens
aggcatgctggcct

SEQ ID NO: 2832889 - DNA, 16 bp, Homo sapiens
aggcatgctggcctcc

SEQ ID NO: 2832890 - DNA, 18 bp, Homo sapiens
aggcatggagacagcgaa

SEQ ID NO: 2832891 - DNA, 12 bp, Homo sapiens
aggcatgttctc

SEQ ID NO: 2832892 - DNA, 18 bp, Homo sapiens
aggcatgttctctgagga

SEQ ID NO: 2832893 - DNA, 22 bp, Homo sapiens
aggcattaaattttagcaaaga

SEQ ID NO: 2832894 - DNA, 20 bp, Homo sapiens
aggcatttcctgggtggcta

SEQ ID NO: 2832895 - DNA, 23 bp, Homo sapiens
aggccaaaattaccaaaaatctt

SEQ ID NO: 2832896 - DNA, 18 bp, Homo sapiens
aggccaagagcagaggca

SEQ ID NO: 2832897 - DNA, 18 bp, Homo sapiens
aggccaagtcaggccctt

SEQ ID NO: 2832898 - DNA, 15 bp, Homo sapiens
aggccacatgtcacc

SEQ ID NO: 2832899 - DNA, 21 bp, Homo sapiens
aggccacatgtcaccgtggac

SEQ ID NO: 2832900 - DNA, 12 bp, Homo sapiens
aggccaccagga

SEQ ID NO: 2832901 - DNA, 14 bp, Homo sapiens
aggccaccgggaca

SEQ ID NO: 2832902 - DNA, 20 bp, Homo sapiens
aggccaccgggacagacctg

SEQ ID NO: 2832903 - DNA, 20 bp, Homo sapiens
aggccagagggagtgacaga

SEQ ID NO: 2832904 - DNA, 13 bp, Homo sapiens
aggccagcctggc

SEQ ID NO: 2832905 - DNA, 14 bp, Homo sapiens
aggccagcctggcc

SEQ ID NO: 2832906 - DNA, 18 bp, Homo sapiens
aggccagcctggcctcct

SEQ ID NO: 2832907 - DNA, 19 bp, Homo sapiens
aggccagcctggcctcctg

SEQ ID NO: 2832908 - DNA, 20 bp, Homo sapiens
aggccagcctggcctcctgc

SEQ ID NO: 2832909 - DNA, 14 bp, Homo sapiens
aggccaggccacca

SEQ ID NO: 2832910 - DNA, 14 bp, Homo sapiens
aggccaggtgcagt

SEQ ID NO: 2832911 - DNA, 15 bp, Homo sapiens
aggccatggcagaat

SEQ ID NO: 2832912 - DNA, 16 bp, Homo sapiens
aggccatgggcctcct

SEQ ID NO: 2832913 - DNA, 23 bp, Homo sapiens
aggcccaggaatcggagcgaagc

SEQ ID NO: 2832914 - DNA, 16 bp, Homo sapiens
aggccccccgcagcac

SEQ ID NO: 2832915 - DNA, 17 bp, Homo sapiens
aggccccgcttgtccag

SEQ ID NO: 2832916 - DNA, 18 bp, Homo sapiens
aggcccctgccaccctgg

SEQ ID NO: 2832917 - DNA, 14 bp, Homo sapiens
aggcccgagcagct

SEQ ID NO: 2832918 - DNA, 21 bp, Homo sapiens
aggcccgagcagctgagcagg

SEQ ID NO: 2832919 - DNA, 13 bp, Homo sapiens
aggcccggctcca

SEQ ID NO: 2832920 - DNA, 15 bp, Homo sapiens
aggcccggctccagg

SEQ ID NO: 2832921 - DNA, 17 bp, Homo sapiens
aggcccggctccaggct

SEQ ID NO: 2832922 - DNA, 15 bp, Homo sapiens
aggcccggggctggc

SEQ ID NO: 2832923 - DNA, 21 bp, Homo sapiens
aggccctaccagagggaacac

SEQ ID NO: 2832924 - DNA, 13 bp, Homo sapiens
aggccctggatca

SEQ ID NO: 2832925 - DNA, 21 bp, Homo sapiens
aggccctggatgtgcccacag

SEQ ID NO: 2832926 - DNA, 22 bp, Homo sapiens
aggccctggatgtgcccacagg

SEQ ID NO: 2832927 - DNA, 20 bp, Homo sapiens
aggcccttattttcaagaaa

SEQ ID NO: 2832928 - DNA, 20 bp, Homo sapiens
aggccgctgttcacccacag

SEQ ID NO: 2832929 - DNA, 17 bp, Homo sapiens
aggccgggcttgggccc

SEQ ID NO: 2832930 - DNA, 17 bp, Homo sapiens
aggcctaaaagtaaaca

SEQ ID NO: 2832931 - DNA, 14 bp, Homo sapiens
aggcctatcaacct

SEQ ID NO: 2832932 - DNA, 21 bp, Homo sapiens
aggcctcttggacctctgctc

SEQ ID NO: 2832933 - DNA, 13 bp, Homo sapiens
aggcctgcctgtt

SEQ ID NO: 2832934 - DNA, 12 bp, Homo sapiens
aggcctggccag

SEQ ID NO: 2832935 - DNA, 21 bp, Homo sapiens
aggcctggccagatgcaccag

SEQ ID NO: 2832936 - DNA, 22 bp, Homo sapiens
aggcctggccagatgcaccagc

SEQ ID NO: 2832937 - DNA, 13 bp, Homo sapiens
aggcctggccagg

SEQ ID NO: 2832938 - DNA, 16 bp, Homo sapiens
aggcctggccaggcac

SEQ ID NO: 2832939 - DNA, 20 bp, Homo sapiens
aggcctggggtgacccggca

SEQ ID NO: 2832940 - DNA, 20 bp, Homo sapiens
aggcctgtgtagctgtgacc

SEQ ID NO: 2832941 - DNA, 17 bp, Homo sapiens
aggccttctctgaagga

SEQ ID NO: 2832942 - DNA, 15 bp, Homo sapiens
aggcctttccccagt

SEQ ID NO: 2832943 - DNA, 17 bp, Homo sapiens
aggcctttccccagtgt

SEQ ID NO: 2832944 - DNA, 17 bp, Homo sapiens
aggcgagtgccaggact

SEQ ID NO: 2832945 - DNA, 18 bp, Homo sapiens
aggcgagtgccaggactc

SEQ ID NO: 2832946 - DNA, 23 bp, Homo sapiens
agggttttgccatgttggccagg

SEQ ID NO: 2832947 - DNA, 17 bp, Homo sapiens
aggtaaaagtgtgagca

SEQ ID NO: 2832948 - DNA, 16 bp, Homo sapiens
aggtacaagaagcatt

SEQ ID NO: 2832949 - DNA, 16 bp, Homo sapiens
aggtacacagctctag

SEQ ID NO: 2832950 - DNA, 15 bp, Homo sapiens
aggtagaacctcacc

SEQ ID NO: 2832951 - DNA, 14 bp, Homo sapiens
aggtagaatgtaaa

SEQ ID NO: 2832952 - DNA, 19 bp, Homo sapiens
aggtagaatgtaaagcttg

SEQ ID NO: 2832953 - DNA, 21 bp, Homo sapiens
aggtagaatgtaaagcttgtc

SEQ ID NO: 2832954 - DNA, 17 bp, Homo sapiens
aggtagagtttgaagga

SEQ ID NO: 2832955 - DNA, 23 bp, Homo sapiens
aggtagagtttgaaggaggtgag

SEQ ID NO: 2832956 - DNA, 15 bp, Homo sapiens
aggtagcccagcact

SEQ ID NO: 2832957 - DNA, 20 bp, Homo sapiens
aggtaggtggatcacctgag

SEQ ID NO: 2832958 - DNA, 18 bp, Homo sapiens
aggtagtgggtgaatgtg

SEQ ID NO: 2832959 - DNA, 11 bp, Homo sapiens
aggtataattt

SEQ ID NO: 2832960 - DNA, 23 bp, Homo sapiens
aggtatgaccttctaggaagctc

SEQ ID NO: 2832961 - DNA, 17 bp, Homo sapiens
aggtcaacagagaaggc

SEQ ID NO: 2832962 - DNA, 21 bp, Homo sapiens
aggtcaatgccagagacggaa

SEQ ID NO: 2832963 - DNA, 21 bp, Homo sapiens
aggtcactcttcctgcaagga

SEQ ID NO: 2832964 - DNA, 12 bp, Homo sapiens
aggtcagagatg

SEQ ID NO: 2832965 - DNA, 18 bp, Homo sapiens
aggtcagagatgggctga

SEQ ID NO: 2832966 - DNA, 15 bp, Homo sapiens
aggtcaggagttcct

SEQ ID NO: 2832967 - DNA, 20 bp, Homo sapiens
aggtcaggagttcctaacca

SEQ ID NO: 2832968 - DNA, 23 bp, Homo sapiens
aggtcatctcctttcatccccac

SEQ ID NO: 2832969 - DNA, 12 bp, Homo sapiens
aggtcccaggca

SEQ ID NO: 2832970 - DNA, 21 bp, Homo sapiens
aggtcctcagtgtcctcaggg

SEQ ID NO: 2832971 - DNA, 13 bp, Homo sapiens
aggtcctgagcac

SEQ ID NO: 2832972 - DNA, 16 bp, Homo sapiens
aggtcctgagcactgc

SEQ ID NO: 2832973 - DNA, 18 bp, Homo sapiens
aggtcctgagcactgcca

SEQ ID NO: 2832974 - DNA, 20 bp, Homo sapiens
aggtcctgagcactgccagg

SEQ ID NO: 2832975 - DNA, 16 bp, Homo sapiens
aggtctagactttctc

SEQ ID NO: 2832976 - DNA, 12 bp, Homo sapiens
aggtctcctctt

SEQ ID NO: 2832977 - DNA, 13 bp, Homo sapiens
aggtctcctctta

SEQ ID NO: 2832978 - DNA, 14 bp, Homo sapiens
aggtctcctcttaa

SEQ ID NO: 2832979 - DNA, 14 bp, Homo sapiens
aggtctctccactg

SEQ ID NO: 2832980 - DNA, 21 bp, Homo sapiens
aggtctgaaatggaggtcctt

SEQ ID NO: 2832981 - DNA, 18 bp, Homo sapiens
aggtcttgaactcctggc

SEQ ID NO: 2832982 - DNA, 14 bp, Homo sapiens
aggtcttggccgac

SEQ ID NO: 2832983 - DNA, 21 bp, Homo sapiens
aggtcttggccgactcaggga

SEQ ID NO: 2832984 - DNA, 14 bp, Homo sapiens
aggtgaccccaggg

SEQ ID NO: 2832985 - DNA, 17 bp, Homo sapiens
aggtgaccccagggcac

SEQ ID NO: 2832986 - DNA, 15 bp, Homo sapiens
aggtgagcagaggag

SEQ ID NO: 2832987 - DNA, 13 bp, Homo sapiens
aggtgagggatgt

SEQ ID NO: 2832988 - DNA, 20 bp, Homo sapiens
aggtgatccacccacctcag

SEQ ID NO: 2832989 - DNA, 21 bp, Homo sapiens
aggtgatccacccacctcagc

SEQ ID NO: 2832990 - DNA, 21 bp, Homo sapiens
aggtgcatctggggaactaga

SEQ ID NO: 2832991 - DNA, 13 bp, Homo sapiens
aggtgcccaggag

SEQ ID NO: 2832992 - DNA, 17 bp, Homo sapiens
aggtgcctgtgaggcag

SEQ ID NO: 2832993 - DNA, 21 bp, Homo sapiens
aggtgcctgtgaggcaggggc

SEQ ID NO: 2832994 - DNA, 23 bp, Homo sapiens
aggtgctaaatggtcgcccagga

SEQ ID NO: 2832995 - DNA, 18 bp, Homo sapiens
aggtggaaaaacatctga

SEQ ID NO: 2832996 - DNA, 11 bp, Homo sapiens
aggtggaagcc

SEQ ID NO: 2832997 - DNA, 13 bp, Homo sapiens
aggtggaagccct

SEQ ID NO: 2832998 - DNA, 14 bp, Homo sapiens
aggtggaagccctc

SEQ ID NO: 2832999 - DNA, 15 bp, Homo sapiens
aggtggaagccctcc

SEQ ID NO: 2833000 - DNA, 16 bp, Homo sapiens
aggtggaagccctcct

SEQ ID NO: 2833001 - DNA, 14 bp, Homo sapiens
aggtggacacacaa

SEQ ID NO: 2833002 - DNA, 22 bp, Homo sapiens
aggtggagaactgggatttgaa

SEQ ID NO: 2833003 - DNA, 16 bp, Homo sapiens
aggtggatcacagagg

SEQ ID NO: 2833004 - DNA, 19 bp, Homo sapiens
aggtggcaggaccaggact

SEQ ID NO: 2833005 - DNA, 14 bp, Homo sapiens
aggtggctctccag

SEQ ID NO: 2833006 - DNA, 17 bp, Homo sapiens
aggtggctctccagtta

SEQ ID NO: 2833007 - DNA, 17 bp, Homo sapiens
aggtgggctgagccctg

SEQ ID NO: 2833008 - DNA, 19 bp, Homo sapiens
aggtgggctgagccctggc

SEQ ID NO: 2833009 - DNA, 19 bp, Homo sapiens
aggtgggttttcttcccat

SEQ ID NO: 2833010 - DNA, 21 bp, Homo sapiens
aggtgtctgcacccaggggtg

SEQ ID NO: 2833011 - DNA, 23 bp, Homo sapiens
aggtgtgaaccaccacacccagc

SEQ ID NO: 2833012 - DNA, 14 bp, Homo sapiens
aggtgtgagtcacc

SEQ ID NO: 2833013 - DNA, 13 bp, Homo sapiens
aggtgtgccaaac

SEQ ID NO: 2833014 - DNA, 12 bp, Homo sapiens
aggtgtgctctg

SEQ ID NO: 2833015 - DNA, 15 bp, Homo sapiens
aggtgtgctctgatc

SEQ ID NO: 2833016 - DNA, 20 bp, Homo sapiens
aggtgtgctctgatcatcca

SEQ ID NO: 2833017 - DNA, 17 bp, Homo sapiens
aggttaccctgtaacat

SEQ ID NO: 2833018 - DNA, 12 bp, Homo sapiens
aggttataagaa

SEQ ID NO: 2833019 - DNA, 17 bp, Homo sapiens
aggttccggtgtctgga

SEQ ID NO: 2833020 - DNA, 24 bp, Homo sapiens
aggttcctaagacttcagtcctgg

SEQ ID NO: 2833021 - DNA, 17 bp, Homo sapiens
aggttcttagtgtcact

SEQ ID NO: 2833022 - DNA, 12 bp, Homo sapiens
aggttgaaagac

SEQ ID NO: 2833023 - DNA, 12 bp, Homo sapiens
aggttgcaggga

SEQ ID NO: 2833024 - DNA, 18 bp, Homo sapiens
aggttgcagggagccgag

SEQ ID NO: 2833025 - DNA, 17 bp, Homo sapiens
aggttgcagtgagctga

SEQ ID NO: 2833026 - DNA, 19 bp, Homo sapiens
aggttgcagtgagctgaga

SEQ ID NO: 2833027 - DNA, 16 bp, Homo sapiens
aggtttatgaaaaaga

SEQ ID NO: 2833028 - DNA, 23 bp, Homo sapiens
aggtttggggagggggaagagaa

SEQ ID NO: 2833029 - DNA, 22 bp, Homo sapiens
aggtttggtgtgtggagatgca

SEQ ID NO: 2833030 - DNA, 12 bp, Homo sapiens
aggtttgtatat

SEQ ID NO: 2833031 - DNA, 20 bp, Homo sapiens
aggtttgtatattgtcagat

SEQ ID NO: 2833032 - DNA, 13 bp, Homo sapiens
aggttttgtacaa

SEQ ID NO: 2833033 - DNA, 21 bp, Homo sapiens
aggtttttttgtatagtaaag

SEQ ID NO: 2833034 - DNA, 19 bp, Homo sapiens
agtaaaaaacaacttcttt

SEQ ID NO: 2833035 - DNA, 14 bp, Homo sapiens
agtaaaacttgctg

SEQ ID NO: 2833036 - DNA, 13 bp, Homo sapiens
agtaaaagctaat

SEQ ID NO: 2833037 - DNA, 15 bp, Homo sapiens
agtgagttttttagt

SEQ ID NO: 2833038 - DNA, 19 bp, Homo sapiens
agtgagttttttagtgcgt

SEQ ID NO: 2833039 - DNA, 15 bp, Homo sapiens
agtgatatatgtatt

SEQ ID NO: 2833040 - DNA, 17 bp, Homo sapiens
agtgatatatgtattta

SEQ ID NO: 2833041 - DNA, 22 bp, Homo sapiens
agtgatatatgtatttattgtc

SEQ ID NO: 2833042 - DNA, 15 bp, Homo sapiens
agtgatcctcccacc

SEQ ID NO: 2833043 - DNA, 15 bp, Homo sapiens
agtgattctcctgcc

SEQ ID NO: 2833044 - DNA, 20 bp, Homo sapiens
agtgattctcctgcctcagc

SEQ ID NO: 2833045 - DNA, 24 bp, Homo sapiens
agtgattctcctgcctcagcctcc

SEQ ID NO: 2833046 - DNA, 16 bp, Homo sapiens
agtgattgacacacag

SEQ ID NO: 2833047 - DNA, 17 bp, Homo sapiens
agtgattgacacacagc

SEQ ID NO: 2833048 - DNA, 19 bp, Homo sapiens
agtgcaaatactccaagct

SEQ ID NO: 2833049 - DNA, 20 bp, Homo sapiens
agtgcaaatactccaagctt

SEQ ID NO: 2833050 - DNA, 22 bp, Homo sapiens
agtgcagtggtgcgatcttggc

SEQ ID NO: 2833051 - DNA, 16 bp, Homo sapiens
agtgcatgctctctgc

SEQ ID NO: 2833052 - DNA, 22 bp, Homo sapiens
agtgcatgctctctgcagccag

SEQ ID NO: 2833053 - DNA, 22 bp, Homo sapiens
agtgcatttatgagctcttcat

SEQ ID NO: 2833054 - DNA, 12 bp, Homo sapiens
agtgccacagag

SEQ ID NO: 2833055 - DNA, 14 bp, Homo sapiens
agtgccacagagaa

SEQ ID NO: 2833056 - DNA, 19 bp, Homo sapiens
agtgccaggactccccagg

SEQ ID NO: 2833057 - DNA, 23 bp, Homo sapiens
agtgccaggactccccaggccag

SEQ ID NO: 2833058 - DNA, 14 bp, Homo sapiens
agtgcccacaggat

SEQ ID NO: 2833059 - DNA, 17 bp, Homo sapiens
agtgccctccacagccg

SEQ ID NO: 2833060 - DNA, 16 bp, Homo sapiens
agtgccttccataatt

SEQ ID NO: 2833061 - DNA, 21 bp, Homo sapiens
agtgccttggagcagaaagcc

SEQ ID NO: 2833062 - DNA, 22 bp, Homo sapiens
agtgccttggagcagaaagcca

SEQ ID NO: 2833063 - DNA, 15 bp, Homo sapiens
agtgctcggcagtca

SEQ ID NO: 2833064 - DNA, 16 bp, Homo sapiens
agtgctcggcagtcat

SEQ ID NO: 2833065 - DNA, 17 bp, Homo sapiens
agtgctctaggctgccc

SEQ ID NO: 2833066 - DNA, 18 bp, Homo sapiens
agtgctctaggctgcccc

SEQ ID NO: 2833067 - DNA, 22 bp, Homo sapiens
agtgctgcgagatcgctggcag

SEQ ID NO: 2833068 - DNA, 14 bp, Homo sapiens
agtgctgtggcctg

SEQ ID NO: 2833069 - DNA, 17 bp, Homo sapiens
agtgctgttctggagct

SEQ ID NO: 2833070 - DNA, 18 bp, Homo sapiens
agtgctgttctggagctg

SEQ ID NO: 2833071 - DNA, 21 bp, Homo sapiens
agtgctgtttgagatgtgatg

SEQ ID NO: 2833072 - DNA, 12 bp, Homo sapiens
agtgcttagaaa

SEQ ID NO: 2833073 - DNA, 14 bp, Homo sapiens
agtgcttcagcctg

SEQ ID NO: 2833074 - DNA, 14 bp, Homo sapiens
agtgcttctctaca

SEQ ID NO: 2833075 - DNA, 19 bp, Homo sapiens
agtgcttgagtttggggaa

SEQ ID NO: 2833076 - DNA, 20 bp, Homo sapiens
agtgcttgccaccaccagat

SEQ ID NO: 2833077 - DNA, 23 bp, Homo sapiens
agtgcttgggtggtgggtgctgg

SEQ ID NO: 2833078 - DNA, 23 bp, Homo sapiens
agtggaaaaaagagaaaaaccaa

SEQ ID NO: 2833079 - DNA, 22 bp, Homo sapiens
agtggacaccaggagtccctgg

SEQ ID NO: 2833080 - DNA, 14 bp, Homo sapiens
agtggaccaggaca

SEQ ID NO: 2833081 - DNA, 15 bp, Homo sapiens
agtggaccaggacag

SEQ ID NO: 2833082 - DNA, 19 bp, Homo sapiens
agtggaccaggacaggacc

SEQ ID NO: 2833083 - DNA, 14 bp, Homo sapiens
agtggagaaatatt

SEQ ID NO: 2833084 - DNA, 18 bp, Homo sapiens
agtggagaaatatttata

SEQ ID NO: 2833085 - DNA, 14 bp, Homo sapiens
agtggctcacgcct

SEQ ID NO: 2833086 - DNA, 15 bp, Homo sapiens
agtgggacccataga

SEQ ID NO: 2833087 - DNA, 22 bp, Homo sapiens
agtgggacccatagatcttctg

SEQ ID NO: 2833088 - DNA, 15 bp, Homo sapiens
agtgggccaggacag

SEQ ID NO: 2833089 - DNA, 20 bp, Homo sapiens
agtgggccaggacaggcccg

SEQ ID NO: 2833090 - DNA, 21 bp, Homo sapiens
agtgggccaggacaggcccgg

SEQ ID NO: 2833091 - DNA, 22 bp, Homo sapiens
agtgggggtgatgatgaccaag

SEQ ID NO: 2833092 - DNA, 18 bp, Homo sapiens
agtggggtctccctctcc

SEQ ID NO: 2833093 - DNA, 18 bp, Homo sapiens
agtgggtggtggatctgt

SEQ ID NO: 2833094 - DNA, 19 bp, Homo sapiens
agtggtaagctctggcttt

SEQ ID NO: 2833095 - DNA, 18 bp, Homo sapiens
agtggtaccagctcactc

SEQ ID NO: 2833096 - DNA, 22 bp, Homo sapiens
agtggtcaaaccgcactcaccc

SEQ ID NO: 2833097 - DNA, 16 bp, Homo sapiens
agtggtgcgatctggg

SEQ ID NO: 2833098 - DNA, 17 bp, Homo sapiens
agtgtaaaatagaatgt

SEQ ID NO: 2833099 - DNA, 17 bp, Homo sapiens
agtgtaaagaataaatg

SEQ ID NO: 2833100 - DNA, 23 bp, Homo sapiens
agtgtaccgcgtctaccctggga

SEQ ID NO: 2833101 - DNA, 15 bp, Homo sapiens
agtgtactgctttca

SEQ ID NO: 2833102 - DNA, 15 bp, Homo sapiens
agtgtagaacctaat

SEQ ID NO: 2833103 - DNA, 20 bp, Homo sapiens
agtgtagaacctaattcaat

SEQ ID NO: 2833104 - DNA, 16 bp, Homo sapiens
agtgtatggaaataaa

SEQ ID NO: 2833105 - DNA, 21 bp, Homo sapiens
agtgtatggaaataaatgtat

SEQ ID NO: 2833106 - DNA, 22 bp, Homo sapiens
agtgtatggaaataaatgtatc

SEQ ID NO: 2833107 - DNA, 14 bp, Homo sapiens
agtgtctaaaaaca

SEQ ID NO: 2833108 - DNA, 23 bp, Homo sapiens
agtgtgacaaggattgctactgt

SEQ ID NO: 2833109 - DNA, 21 bp, Homo sapiens
agtgtgagcagtgagttacag

SEQ ID NO: 2833110 - DNA, 15 bp, Homo sapiens
agtgtgggaagggag

SEQ ID NO: 2833111 - DNA, 11 bp, Homo sapiens
agtgtgtaaag

SEQ ID NO: 2833112 - DNA, 23 bp, Homo sapiens
agtgtgtgtgatgggatctgtaa

SEQ ID NO: 2833113 - DNA, 19 bp, Homo sapiens
agtgtgtttccttcagtgc

SEQ ID NO: 2833114 - DNA, 18 bp, Homo sapiens
agtgttccctgagaaacc

SEQ ID NO: 2833115 - DNA, 18 bp, Homo sapiens
agtgttccctttcctact

SEQ ID NO: 2833116 - DNA, 23 bp, Homo sapiens
agtgttgaagaagagtttgcaaa

SEQ ID NO: 2833117 - DNA, 19 bp, Homo sapiens
agtgtttagaagagcctga

SEQ ID NO: 2833118 - DNA, 16 bp, Homo sapiens
agtgtttcccataatt

SEQ ID NO: 2833119 - DNA, 20 bp, Homo sapiens
agtgttttaagataaattat

SEQ ID NO: 2833120 - DNA, 22 bp, Homo sapiens
agttaaaagtgttgattacata

SEQ ID NO: 2833121 - DNA, 19 bp, Homo sapiens
agttaacattaacatctat

SEQ ID NO: 2833122 - DNA, 14 bp, Homo sapiens
agttaagagtagca

SEQ ID NO: 2833123 - DNA, 15 bp, Homo sapiens
agttaagcagccttt

SEQ ID NO: 2833124 - DNA, 14 bp, Homo sapiens
agttacaaaaatag

SEQ ID NO: 2833125 - DNA, 18 bp, Homo sapiens
agttacagatgcacccca

SEQ ID NO: 2833126 - DNA, 17 bp, Homo sapiens
agttacagcgagaggca

SEQ ID NO: 2833127 - DNA, 15 bp, Homo sapiens
ataaaaataccttaa

SEQ ID NO: 2833128 - DNA, 16 bp, Homo sapiens
ataaaaatgatctaaa

SEQ ID NO: 2833129 - DNA, 18 bp, Homo sapiens
ataaaactcagttaaaat

SEQ ID NO: 2833130 - DNA, 13 bp, Homo sapiens
ataaaagtgactc

SEQ ID NO: 2833131 - DNA, 16 bp, Homo sapiens
ataaaataaagtatat

SEQ ID NO: 2833132 - DNA, 14 bp, Homo sapiens
ataaaataatttta

SEQ ID NO: 2833133 - DNA, 18 bp, Homo sapiens
ataaaatcatgtacattt

SEQ ID NO: 2833134 - DNA, 13 bp, Homo sapiens
ataaaattttcaa

SEQ ID NO: 2833135 - DNA, 16 bp, Homo sapiens
ataaacaacttaatgt

SEQ ID NO: 2833136 - DNA, 12 bp, Homo sapiens
ataaacattaaa

SEQ ID NO: 2833137 - DNA, 16 bp, Homo sapiens
ataaacattaaaagaa

SEQ ID NO: 2833138 - DNA, 14 bp, Homo sapiens
ataaacattaaaca

SEQ ID NO: 2833139 - DNA, 15 bp, Homo sapiens
ataaacattaaacac

SEQ ID NO: 2833140 - DNA, 18 bp, Homo sapiens
ataaacattaaacactgt

SEQ ID NO: 2833141 - DNA, 14 bp, Homo sapiens
ataaactgtgtgca

SEQ ID NO: 2833142 - DNA, 15 bp, Homo sapiens
ataaacttaattttg

SEQ ID NO: 2833143 - DNA, 12 bp, Homo sapiens
ataaacttcagc

SEQ ID NO: 2833144 - DNA, 15 bp, Homo sapiens
ataaacttcagcacc

SEQ ID NO: 2833145 - DNA, 15 bp, Homo sapiens
ataaagaacaaggta

SEQ ID NO: 2833146 - DNA, 18 bp, Homo sapiens
ataaagatggctgacttt

SEQ ID NO: 2833147 - DNA, 13 bp, Homo sapiens
ataaaggtattta

SEQ ID NO: 2833148 - DNA, 21 bp, Homo sapiens
ataaaggtatttagaatatat

SEQ ID NO: 2833149 - DNA, 19 bp, Homo sapiens
ataaaggtggtatgtgtgt

SEQ ID NO: 2833150 - DNA, 17 bp, Homo sapiens
ataaagtctgagtgggc

SEQ ID NO: 2833151 - DNA, 13 bp, Homo sapiens
ataaagtgtaata

SEQ ID NO: 2833152 - DNA, 21 bp, Homo sapiens
ataaagttctgagtgttttta

SEQ ID NO: 2833153 - DNA, 17 bp, Homo sapiens
ataaagttgataaagat

SEQ ID NO: 2833154 - DNA, 20 bp, Homo sapiens
ataaatctgagcctaaatct

SEQ ID NO: 2833155 - DNA, 23 bp, Homo sapiens
ataaatctgagcctaaatctaat

SEQ ID NO: 2833156 - DNA, 22 bp, Homo sapiens
ataaatgcaatatgtattaata

SEQ ID NO: 2833157 - DNA, 16 bp, Homo sapiens
ataaatgcatgatttt

SEQ ID NO: 2833158 - DNA, 21 bp, Homo sapiens
ataaatgcatgattttataca

SEQ ID NO: 2833159 - DNA, 22 bp, Homo sapiens
ataaatgcatgattttatacat

SEQ ID NO: 2833160 - DNA, 21 bp, Homo sapiens
ataaatgccctctctgaatgt

SEQ ID NO: 2833161 - DNA, 15 bp, Homo sapiens
ataaatgtacattaa

SEQ ID NO: 2833162 - DNA, 21 bp, Homo sapiens
ataaatgtatcatagaaatgt

SEQ ID NO: 2833163 - DNA, 13 bp, Homo sapiens
ataaatgtgtaaa

SEQ ID NO: 2833164 - DNA, 16 bp, Homo sapiens
ataaatgtgtaaatgt

SEQ ID NO: 2833165 - DNA, 21 bp, Homo sapiens
ataaatgtgtggtgctaactg

SEQ ID NO: 2833166 - DNA, 16 bp, Homo sapiens
ataaattcagatatat

SEQ ID NO: 2833167 - DNA, 16 bp, Homo sapiens
ataaattgctccttga

SEQ ID NO: 2833168 - DNA, 18 bp, Homo sapiens
ataaattggtgataagtg

SEQ ID NO: 2833169 - DNA, 21 bp, Homo sapiens
ataaattggtgataagtggaa

SEQ ID NO: 2833170 - DNA, 22 bp, Homo sapiens
ataaattggtgataagtggaaa

SEQ ID NO: 2833171 - DNA, 15 bp, Homo sapiens
ataacaaaatcacaa

SEQ ID NO: 2833172 - DNA, 22 bp, Homo sapiens
ataacaaaatcacaagcaataa

SEQ ID NO: 2833173 - DNA, 14 bp, Homo sapiens
ataacaatgtatgt

SEQ ID NO: 2833174 - DNA, 14 bp, Homo sapiens
ataacacaatatga

SEQ ID NO: 2833175 - DNA, 23 bp, Homo sapiens
ataacactataaaggttgacaat

SEQ ID NO: 2833176 - DNA, 16 bp, Homo sapiens
ataaccatcagttact

SEQ ID NO: 2833177 - DNA, 12 bp, Homo sapiens
ataaccccacct

SEQ ID NO: 2833178 - DNA, 16 bp, Homo sapiens
ataaccttcatgatga

SEQ ID NO: 2833179 - DNA, 15 bp, Homo sapiens
ataactagaaacctg

SEQ ID NO: 2833180 - DNA, 13 bp, Homo sapiens
ataactagatctc

SEQ ID NO: 2833181 - DNA, 14 bp, Homo sapiens
ataactagatctcc

SEQ ID NO: 2833182 - DNA, 18 bp, Homo sapiens
ataactagatctcctgta

SEQ ID NO: 2833183 - DNA, 17 bp, Homo sapiens
ataactcatcataaaat

SEQ ID NO: 2833184 - DNA, 18 bp, Homo sapiens
ataactcatcataaaata

SEQ ID NO: 2833185 - DNA, 17 bp, Homo sapiens
ataactgaaaattattt

SEQ ID NO: 2833186 - DNA, 15 bp, Homo sapiens
ataacttcagagaag

SEQ ID NO: 2833187 - DNA, 21 bp, Homo sapiens
ataagaaacttttttatttaa

SEQ ID NO: 2833188 - DNA, 13 bp, Homo sapiens
ataagaagaatgc

SEQ ID NO: 2833189 - DNA, 19 bp, Homo sapiens
ataagaagaatgcttaatc

SEQ ID NO: 2833190 - DNA, 20 bp, Homo sapiens
ataagaagaatgcttaatca

SEQ ID NO: 2833191 - DNA, 22 bp, Homo sapiens
ataagaatgctggttttcctaa

SEQ ID NO: 2833192 - DNA, 14 bp, Homo sapiens
ataagagaaagaaa

SEQ ID NO: 2833193 - DNA, 18 bp, Homo sapiens
ataagagaaagaaaatga

SEQ ID NO: 2833194 - DNA, 23 bp, Homo sapiens
ataagcaaagggagcactgggtt

SEQ ID NO: 2833195 - DNA, 16 bp, Homo sapiens
ataagcaagaaggcaa

SEQ ID NO: 2833196 - DNA, 16 bp, Homo sapiens
ataagcagatttaaca

SEQ ID NO: 2833197 - DNA, 21 bp, Homo sapiens
ataagcctccatttagttctt

SEQ ID NO: 2833198 - DNA, 22 bp, Homo sapiens
ataaggatcagaacagcagagg

SEQ ID NO: 2833199 - DNA, 16 bp, Homo sapiens
ataaggccttaatatg

SEQ ID NO: 2833200 - DNA, 17 bp, Homo sapiens
ataaggccttaatatgt

SEQ ID NO: 2833201 - DNA, 18 bp, Homo sapiens
ataaggccttaatatgtt

SEQ ID NO: 2833202 - DNA, 13 bp, Homo sapiens
ataagtactgtgt

SEQ ID NO: 2833203 - DNA, 17 bp, Homo sapiens
ataagtggaaaaaagag

SEQ ID NO: 2833204 - DNA, 18 bp, Homo sapiens
ataagtggaaaaaagaga

SEQ ID NO: 2833205 - DNA, 15 bp, Homo sapiens
ataataaatgtacat

SEQ ID NO: 2833206 - DNA, 21 bp, Homo sapiens
ataataactagatctcctgta

SEQ ID NO: 2833207 - DNA, 17 bp, Homo sapiens
ataataatgttctctgg

SEQ ID NO: 2833208 - DNA, 12 bp, Homo sapiens
ataatagaagaa

SEQ ID NO: 2833209 - DNA, 15 bp, Homo sapiens
ataatatctgtgagg

SEQ ID NO: 2833210 - DNA, 17 bp, Homo sapiens
ataatatcttgaagaat

SEQ ID NO: 2833211 - DNA, 19 bp, Homo sapiens
ataatatcttgaagaatat

SEQ ID NO: 2833212 - DNA, 21 bp, Homo sapiens
ataatatgctgccaaattttg

SEQ ID NO: 2833213 - DNA, 14 bp, Homo sapiens
ataatcagcctctt

SEQ ID NO: 2833214 - DNA, 12 bp, Homo sapiens
ataatctagaac

SEQ ID NO: 2833215 - DNA, 13 bp, Homo sapiens
ataatctttgggt

SEQ ID NO: 2833216 - DNA, 19 bp, Homo sapiens
ataatgatttaagcatttt

SEQ ID NO: 2833217 - DNA, 21 bp, Homo sapiens
ataatggtgttactaaagtca

SEQ ID NO: 2833218 - DNA, 19 bp, Homo sapiens
atcacttgaggtcaggagt

SEQ ID NO: 2833219 - DNA, 14 bp, Homo sapiens
atcacttgtacaaa

SEQ ID NO: 2833220 - DNA, 14 bp, Homo sapiens
atcactttgttaaa

SEQ ID NO: 2833221 - DNA, 19 bp, Homo sapiens
atcactttgttaaaaatat

SEQ ID NO: 2833222 - DNA, 12 bp, Homo sapiens
atcagaaaagta

SEQ ID NO: 2833223 - DNA, 23 bp, Homo sapiens
atcagaaaagtagaattatatct

SEQ ID NO: 2833224 - DNA, 16 bp, Homo sapiens
atcagaaagggagggc

SEQ ID NO: 2833225 - DNA, 14 bp, Homo sapiens
atcagaacagcaga

SEQ ID NO: 2833226 - DNA, 12 bp, Homo sapiens
atcagaaggaga

SEQ ID NO: 2833227 - DNA, 14 bp, Homo sapiens
atcagaattttacc

SEQ ID NO: 2833228 - DNA, 18 bp, Homo sapiens
atcagaccctaccccacc

SEQ ID NO: 2833229 - DNA, 13 bp, Homo sapiens
atcagacctctga

SEQ ID NO: 2833230 - DNA, 15 bp, Homo sapiens
atcagacctctgatc

SEQ ID NO: 2833231 - DNA, 18 bp, Homo sapiens
atcagacctctgatccct

SEQ ID NO: 2833232 - DNA, 22 bp, Homo sapiens
atcagactagtgacaagctcct

SEQ ID NO: 2833233 - DNA, 16 bp, Homo sapiens
atcagcgtggccttgt

SEQ ID NO: 2833234 - DNA, 16 bp, Homo sapiens
atcagctgtttgtcat

SEQ ID NO: 2833235 - DNA, 15 bp, Homo sapiens
atcaggctatgtatg

SEQ ID NO: 2833236 - DNA, 23 bp, Homo sapiens
atcaggcttggaatgaattctct

SEQ ID NO: 2833237 - DNA, 20 bp, Homo sapiens
atcagggtgggccactctcc

SEQ ID NO: 2833238 - DNA, 14 bp, Homo sapiens
atcaggtgctgcca

SEQ ID NO: 2833239 - DNA, 16 bp, Homo sapiens
atcagtctcagaatgt

SEQ ID NO: 2833240 - DNA, 13 bp, Homo sapiens
atcagttactggt

SEQ ID NO: 2833241 - DNA, 14 bp, Homo sapiens
atcataaactgtgt

SEQ ID NO: 2833242 - DNA, 16 bp, Homo sapiens
atcataaactgtgtgc

SEQ ID NO: 2833243 - DNA, 12 bp, Homo sapiens
atcataaagtat

SEQ ID NO: 2833244 - DNA, 22 bp, Homo sapiens
atcatactaccggctacatcaa

SEQ ID NO: 2833245 - DNA, 22 bp, Homo sapiens
atcatatcctttgccccaaggc

SEQ ID NO: 2833246 - DNA, 16 bp, Homo sapiens
atcatattgtatgtaa

SEQ ID NO: 2833247 - DNA, 20 bp, Homo sapiens
atcatcagcatacctttatt

SEQ ID NO: 2833248 - DNA, 23 bp, Homo sapiens
atcatccactgtgccatgtgcca

SEQ ID NO: 2833249 - DNA, 13 bp, Homo sapiens
atcatgaaacact

SEQ ID NO: 2833250 - DNA, 15 bp, Homo sapiens
atcatgcctctgagg

SEQ ID NO: 2833251 - DNA, 17 bp, Homo sapiens
atcatgcctctgaggcc

SEQ ID NO: 2833252 - DNA, 16 bp, Homo sapiens
atcatgtaaatgatta

SEQ ID NO: 2833253 - DNA, 20 bp, Homo sapiens
atcattataactgaaggaga

SEQ ID NO: 2833254 - DNA, 22 bp, Homo sapiens
atcattataactgaaggagaag

SEQ ID NO: 2833255 - DNA, 13 bp, Homo sapiens
atccaaacagaaa

SEQ ID NO: 2833256 - DNA, 23 bp, Homo sapiens
atccaaacagaaaagtgcaaagt

SEQ ID NO: 2833257 - DNA, 13 bp, Homo sapiens
atccaaaggaatc

SEQ ID NO: 2833258 - DNA, 13 bp, Homo sapiens
atccaaggagaaa

SEQ ID NO: 2833259 - DNA, 19 bp, Homo sapiens
atccaaggagaaacagaga

SEQ ID NO: 2833260 - DNA, 13 bp, Homo sapiens
atccaattatgtg

SEQ ID NO: 2833261 - DNA, 22 bp, Homo sapiens
atccaattatgtgacaaccttt

SEQ ID NO: 2833262 - DNA, 16 bp, Homo sapiens
atccacacacagagga

SEQ ID NO: 2833263 - DNA, 23 bp, Homo sapiens
atccacacacagaggaagagcag

SEQ ID NO: 2833264 - DNA, 19 bp, Homo sapiens
atccacacacgcaggaact

SEQ ID NO: 2833265 - DNA, 15 bp, Homo sapiens
atccacccacctcag

SEQ ID NO: 2833266 - DNA, 16 bp, Homo sapiens
atccacccacctcagc

SEQ ID NO: 2833267 - DNA, 15 bp, Homo sapiens
atccagaaagaaaaa

SEQ ID NO: 2833268 - DNA, 20 bp, Homo sapiens
atccagaattgaccttttga

SEQ ID NO: 2833269 - DNA, 15 bp, Homo sapiens
atccaggactctgtc

SEQ ID NO: 2833270 - DNA, 15 bp, Homo sapiens
atccaggttcagctt

SEQ ID NO: 2833271 - DNA, 17 bp, Homo sapiens
atccaggttcagcttgt

SEQ ID NO: 2833272 - DNA, 19 bp, Homo sapiens
atccagttgcaataaaata

SEQ ID NO: 2833273 - DNA, 15 bp, Homo sapiens
atccagtttcccacc

SEQ ID NO: 2833274 - DNA, 21 bp, Homo sapiens
atccatcagctcccttttctt

SEQ ID NO: 2833275 - DNA, 17 bp, Homo sapiens
cctgcctatccatcctg

SEQ ID NO: 2833276 - DNA, 16 bp, Homo sapiens
cctgcctcagcctccc

SEQ ID NO: 2833277 - DNA, 23 bp, Homo sapiens
cctgcctcgaactggctgcaaag

SEQ ID NO: 2833278 - DNA, 21 bp, Homo sapiens
cctgcctctactgggaaggct

SEQ ID NO: 2833279 - DNA, 13 bp, Homo sapiens
cctgcctggagga

SEQ ID NO: 2833280 - DNA, 23 bp, Homo sapiens
cctgcctggaggacctgagcctg

SEQ ID NO: 2833281 - DNA, 13 bp, Homo sapiens
cctgccttgaagc

SEQ ID NO: 2833282 - DNA, 19 bp, Homo sapiens
cctgccttgaagccactga

SEQ ID NO: 2833283 - DNA, 22 bp, Homo sapiens
cctgccttgaagccactgaagc

SEQ ID NO: 2833284 - DNA, 15 bp, Homo sapiens
cctgcgaaggggccc

SEQ ID NO: 2833285 - DNA, 18 bp, Homo sapiens
cctgcggagccggcacct

SEQ ID NO: 2833286 - DNA, 15 bp, Homo sapiens
cctgcgggagtagtt

SEQ ID NO: 2833287 - DNA, 21 bp, Homo sapiens
cctgcgggcttttccccggtc

SEQ ID NO: 2833288 - DNA, 17 bp, Homo sapiens
cctgcgtctgtttttaa

SEQ ID NO: 2833289 - DNA, 22 bp, Homo sapiens
cctgcgttttggaagctctgaa

SEQ ID NO: 2833290 - DNA, 16 bp, Homo sapiens
cctgctagctgtagaa

SEQ ID NO: 2833291 - DNA, 13 bp, Homo sapiens
cctgctcccagca

SEQ ID NO: 2833292 - DNA, 16 bp, Homo sapiens
cctgctcccccacccc

SEQ ID NO: 2833293 - DNA, 23 bp, Homo sapiens
cctgctcccccaccccctcccca

SEQ ID NO: 2833294 - DNA, 18 bp, Homo sapiens
cctgctcgtccccaagtg

SEQ ID NO: 2833295 - DNA, 21 bp, Homo sapiens
cctgctctccgaccagacacc

SEQ ID NO: 2833296 - DNA, 19 bp, Homo sapiens
cctgctctcctcttgccac

SEQ ID NO: 2833297 - DNA, 17 bp, Homo sapiens
cctgctgagagacccaa

SEQ ID NO: 2833298 - DNA, 17 bp, Homo sapiens
cctgctgagctctgaga

SEQ ID NO: 2833299 - DNA, 21 bp, Homo sapiens
cctgctgagctctgagaggcc

SEQ ID NO: 2833300 - DNA, 14 bp, Homo sapiens
cctgctgccgcctc

SEQ ID NO: 2833301 - DNA, 15 bp, Homo sapiens
cctgctgctgagaac

SEQ ID NO: 2833302 - DNA, 16 bp, Homo sapiens
cctgctgggctctcca

SEQ ID NO: 2833303 - DNA, 17 bp, Homo sapiens
cctgctgggctctccac

SEQ ID NO: 2833304 - DNA, 19 bp, Homo sapiens
cctgctgggctctccacct

SEQ ID NO: 2833305 - DNA, 21 bp, Homo sapiens
cctgctgggctctccacctca

SEQ ID NO: 2833306 - DNA, 22 bp, Homo sapiens
cctgctgggctctccacctcag

SEQ ID NO: 2833307 - DNA, 17 bp, Homo sapiens
cctgcttcatgctcagc

SEQ ID NO: 2833308 - DNA, 15 bp, Homo sapiens
cctgcttctgaactc

SEQ ID NO: 2833309 - DNA, 15 bp, Homo sapiens
cctgcttgtccctgc

SEQ ID NO: 2833310 - DNA, 17 bp, Homo sapiens
cctggaaaggctcagtc

SEQ ID NO: 2833311 - DNA, 20 bp, Homo sapiens
cctggaaaggctcagtctca

SEQ ID NO: 2833312 - DNA, 21 bp, Homo sapiens
cctggaaaggctcagtctcag

SEQ ID NO: 2833313 - DNA, 18 bp, Homo sapiens
cctggaactgtctctcat

SEQ ID NO: 2833314 - DNA, 23 bp, Homo sapiens
cctggaagcatttgtttctactt

SEQ ID NO: 2833315 - DNA, 13 bp, Homo sapiens
cctggaagctgtg

SEQ ID NO: 2833316 - DNA, 18 bp, Homo sapiens
cctggaatgaagcatgta

SEQ ID NO: 2833317 - DNA, 19 bp, Homo sapiens
cctggacagctgtgcctcg

SEQ ID NO: 2833318 - DNA, 20 bp, Homo sapiens
cctggacagctgtgcctcgc

SEQ ID NO: 2833319 - DNA, 18 bp, Homo sapiens
cctggaccaccagcccca

SEQ ID NO: 2833320 - DNA, 21 bp, Homo sapiens
cctggactttggttctctcca

SEQ ID NO: 2833321 - DNA, 11 bp, Homo sapiens
cctggagaagc

SEQ ID NO: 2833322 - DNA, 15 bp, Homo sapiens
cctggaggacctgag

SEQ ID NO: 2833323 - DNA, 16 bp, Homo sapiens
cctggaggacctgagc

SEQ ID NO: 2833324 - DNA, 18 bp, Homo sapiens
cctggaggacctgagcct

SEQ ID NO: 2833325 - DNA, 20 bp, Homo sapiens
cctggaggacctgagcctgc

SEQ ID NO: 2833326 - DNA, 20 bp, Homo sapiens
cctggatcagcgtggccttg

SEQ ID NO: 2833327 - DNA, 18 bp, Homo sapiens
cctggatgtgcccacagg

SEQ ID NO: 2833328 - DNA, 12 bp, Homo sapiens
cctggcacacat

SEQ ID NO: 2833329 - DNA, 19 bp, Homo sapiens
cctggcacccggcccctgc

SEQ ID NO: 2833330 - DNA, 22 bp, Homo sapiens
cctggcatgaccatcctgtcct

SEQ ID NO: 2833331 - DNA, 20 bp, Homo sapiens
cctggccagatgcaccagcc

SEQ ID NO: 2833332 - DNA, 13 bp, Homo sapiens
cctggccaggcac

SEQ ID NO: 2833333 - DNA, 21 bp, Homo sapiens
cctggccaggcaccccctgga

SEQ ID NO: 2833334 - DNA, 12 bp, Homo sapiens
cctggccccagc

SEQ ID NO: 2833335 - DNA, 12 bp, Homo sapiens
cctggccccatg

SEQ ID NO: 2833336 - DNA, 20 bp, Homo sapiens
cctggccccatgtctctcag

SEQ ID NO: 2833337 - DNA, 21 bp, Homo sapiens
cctggccccatgtctctcaga

SEQ ID NO: 2833338 - DNA, 16 bp, Homo sapiens
cctggcccccctccag

SEQ ID NO: 2833339 - DNA, 20 bp, Homo sapiens
cctggcccccctccaggcat

SEQ ID NO: 2833340 - DNA, 23 bp, Homo sapiens
cctggcccccctccaggcatgct

SEQ ID NO: 2833341 - DNA, 19 bp, Homo sapiens
cctggccgcctccaggagc

SEQ ID NO: 2833342 - DNA, 20 bp, Homo sapiens
cctggccgcctccaggagcc

SEQ ID NO: 2833343 - DNA, 19 bp, Homo sapiens
cctggccggcaaccccagt

SEQ ID NO: 2833344 - DNA, 21 bp, Homo sapiens
cctggccggcaaccccagttc

SEQ ID NO: 2833345 - DNA, 23 bp, Homo sapiens
cctggccggcaaccccagttctg

SEQ ID NO: 2833346 - DNA, 22 bp, Homo sapiens
cctggcctcaagtgattctcct

SEQ ID NO: 2833347 - DNA, 14 bp, Homo sapiens
cctggcctcctgcc

SEQ ID NO: 2833348 - DNA, 15 bp, Homo sapiens
cctggcctggcacac

SEQ ID NO: 2833349 - DNA, 12 bp, Homo sapiens
cctggcctggct

SEQ ID NO: 2833350 - DNA, 16 bp, Homo sapiens
cctggcctggctctcc

SEQ ID NO: 2833351 - DNA, 12 bp, Homo sapiens
cctggctcttct

SEQ ID NO: 2833352 - DNA, 22 bp, Homo sapiens
cctggctgaccccaaagagcct

SEQ ID NO: 2833353 - DNA, 17 bp, Homo sapiens
cctggctggctgagggc

SEQ ID NO: 2833354 - DNA, 19 bp, Homo sapiens
cctggctggctgagggcag

SEQ ID NO: 2833355 - DNA, 19 bp, Homo sapiens
cctggcttcccatccccag

SEQ ID NO: 2833356 - DNA, 20 bp, Homo sapiens
cctggcttcccatccccagc

SEQ ID NO: 2833357 - DNA, 22 bp, Homo sapiens
cctggcttcccatccccagcga

SEQ ID NO: 2833358 - DNA, 14 bp, Homo sapiens
cctggcttctggag

SEQ ID NO: 2833359 - DNA, 16 bp, Homo sapiens
cctggcttctggagcc

SEQ ID NO: 2833360 - DNA, 21 bp, Homo sapiens
cctggcttctggagcccttgg

SEQ ID NO: 2833361 - DNA, 22 bp, Homo sapiens
cctggcttctggagcccttggg

SEQ ID NO: 2833362 - DNA, 18 bp, Homo sapiens
cctggcttgtaactccac

SEQ ID NO: 2833363 - DNA, 20 bp, Homo sapiens
cctggcttgtaactccacca

SEQ ID NO: 2833364 - DNA, 19 bp, Homo sapiens
cctgggaaaggggttgtca

SEQ ID NO: 2833365 - DNA, 17 bp, Homo sapiens
cggagccggcacctaca

SEQ ID NO: 2833366 - DNA, 20 bp, Homo sapiens
cggagcctcatccgaggcag

SEQ ID NO: 2833367 - DNA, 13 bp, Homo sapiens
cggaggagaccag

SEQ ID NO: 2833368 - DNA, 21 bp, Homo sapiens
cggaggagaccagctcagagg

SEQ ID NO: 2833369 - DNA, 13 bp, Homo sapiens
cggatttgacaaa

SEQ ID NO: 2833370 - DNA, 23 bp, Homo sapiens
cggcaaccccagttctgctcctc

SEQ ID NO: 2833371 - DNA, 22 bp, Homo sapiens
cggcacagaggcagctgtgtgg

SEQ ID NO: 2833372 - DNA, 19 bp, Homo sapiens
cggcaccccctgcagcttg

SEQ ID NO: 2833373 - DNA, 21 bp, Homo sapiens
cggcacctacatccccaggtc

SEQ ID NO: 2833374 - DNA, 23 bp, Homo sapiens
cggcacctgggccctggggcctg

SEQ ID NO: 2833375 - DNA, 16 bp, Homo sapiens
cggcagcctcaggggc

SEQ ID NO: 2833376 - DNA, 22 bp, Homo sapiens
cggcagcctcaggggcctcagg

SEQ ID NO: 2833377 - DNA, 11 bp, Homo sapiens
cggccaggcca

SEQ ID NO: 2833378 - DNA, 20 bp, Homo sapiens
cggccaggccagagggagtg

SEQ ID NO: 2833379 - DNA, 20 bp, Homo sapiens
cggcccagagaccccttcct

SEQ ID NO: 2833380 - DNA, 13 bp, Homo sapiens
cggccccatcaga

SEQ ID NO: 2833381 - DNA, 20 bp, Homo sapiens
cggccccatcagaggctggg

SEQ ID NO: 2833382 - DNA, 15 bp, Homo sapiens
cggccgcattccctg

SEQ ID NO: 2833383 - DNA, 16 bp, Homo sapiens
cggccgcattccctga

SEQ ID NO: 2833384 - DNA, 18 bp, Homo sapiens
cggccgcattccctgagt

SEQ ID NO: 2833385 - DNA, 17 bp, Homo sapiens
cggcctatgacttgggc

SEQ ID NO: 2833386 - DNA, 13 bp, Homo sapiens
cggcctgctccca

SEQ ID NO: 2833387 - DNA, 18 bp, Homo sapiens
cggcctgctcccagcagc

SEQ ID NO: 2833388 - DNA, 19 bp, Homo sapiens
cggccttcaactgaaaaga

SEQ ID NO: 2833389 - DNA, 15 bp, Homo sapiens
cggcgccaccatcct

SEQ ID NO: 2833390 - DNA, 14 bp, Homo sapiens
cggctactcagcag

SEQ ID NO: 2833391 - DNA, 16 bp, Homo sapiens
cggctactcagcagcc

SEQ ID NO: 2833392 - DNA, 18 bp, Homo sapiens
cggctactcagcagccct

SEQ ID NO: 2833393 - DNA, 15 bp, Homo sapiens
cggctcactgcagcc

SEQ ID NO: 2833394 - DNA, 13 bp, Homo sapiens
cggctccaggctc

SEQ ID NO: 2833395 - DNA, 22 bp, Homo sapiens
cggctccagtttccccatgggg

SEQ ID NO: 2833396 - DNA, 15 bp, Homo sapiens
cggctccccctgctt

SEQ ID NO: 2833397 - DNA, 23 bp, Homo sapiens
cggctgagtcatgatctccctgc

SEQ ID NO: 2833398 - DNA, 23 bp, Homo sapiens
cggcttagacttcgactcaggat

SEQ ID NO: 2833399 - DNA, 13 bp, Homo sapiens
cgggaacagtgtt

SEQ ID NO: 2833400 - DNA, 22 bp, Homo sapiens
cgggaacagtgtttcccataat

SEQ ID NO: 2833401 - DNA, 12 bp, Homo sapiens
cgggaaggaggg

SEQ ID NO: 2833402 - DNA, 15 bp, Homo sapiens
cgggacagacctgga

SEQ ID NO: 2833403 - DNA, 22 bp, Homo sapiens
cgggagcatctcttgaggccag

SEQ ID NO: 2833404 - DNA, 17 bp, Homo sapiens
cgggccacagagaaagt

SEQ ID NO: 2833405 - DNA, 15 bp, Homo sapiens
cgggcctgcctctga

SEQ ID NO: 2833406 - DNA, 17 bp, Homo sapiens
cgggcctgcctctgact

SEQ ID NO: 2833407 - DNA, 20 bp, Homo sapiens
cgggctgggagctctgcaga

SEQ ID NO: 2833408 - DNA, 14 bp, Homo sapiens
cggggaactcctgg

SEQ ID NO: 2833409 - DNA, 15 bp, Homo sapiens
cggggaactcctgga

SEQ ID NO: 2833410 - DNA, 15 bp, Homo sapiens
cggggaactggccaa

SEQ ID NO: 2833411 - DNA, 17 bp, Homo sapiens
cggggaactggccaagc

SEQ ID NO: 2833412 - DNA, 20 bp, Homo sapiens
cggggaactggccaagctga

SEQ ID NO: 2833413 - DNA, 22 bp, Homo sapiens
cggggaaggtttttatgtgcct

SEQ ID NO: 2833414 - DNA, 23 bp, Homo sapiens
cggggacagctccttctgtccta

SEQ ID NO: 2833415 - DNA, 19 bp, Homo sapiens
cggggcgacccctcagtgc

SEQ ID NO: 2833416 - DNA, 16 bp, Homo sapiens
cggggtgcacaggagg

SEQ ID NO: 2833417 - DNA, 15 bp, Homo sapiens
cggggtgctgtggtg

SEQ ID NO: 2833418 - DNA, 17 bp, Homo sapiens
cgggtccccagctcccc

SEQ ID NO: 2833419 - DNA, 16 bp, Homo sapiens
cgggttgtgtgtctgt

SEQ ID NO: 2833420 - DNA, 21 bp, Homo sapiens
cggtcccccctcactccacac

SEQ ID NO: 2833421 - DNA, 22 bp, Homo sapiens
cggtcccttgagacctcagcca

SEQ ID NO: 2833422 - DNA, 19 bp, Homo sapiens
cggtgcctgggtggggctg

SEQ ID NO: 2833423 - DNA, 20 bp, Homo sapiens
cggtgtctggaaaagcactt

SEQ ID NO: 2833424 - DNA, 20 bp, Homo sapiens
cggtgtgcctgcagccccgc

SEQ ID NO: 2833425 - DNA, 16 bp, Homo sapiens
cggttaacttgtatat

SEQ ID NO: 2833426 - DNA, 21 bp, Homo sapiens
cggttgagttttgactgcttg

SEQ ID NO: 2833427 - DNA, 19 bp, Homo sapiens
cggtttcaaaccaggattt

SEQ ID NO: 2833428 - DNA, 20 bp, Homo sapiens
cgtacccccgtggtctttga

SEQ ID NO: 2833429 - DNA, 21 bp, Homo sapiens
cgtacccccgtggtctttgaa

SEQ ID NO: 2833430 - DNA, 14 bp, Homo sapiens
cgtacttaactgtg

SEQ ID NO: 2833431 - DNA, 23 bp, Homo sapiens
cgtacttaactgtgtgaagaaat

SEQ ID NO: 2833432 - DNA, 22 bp, Homo sapiens
cgtagttccctgaaaacccaga

SEQ ID NO: 2833433 - DNA, 21 bp, Homo sapiens
cgtatctttaaaaagcagtcc

SEQ ID NO: 2833434 - DNA, 23 bp, Homo sapiens
cgtatgtcggcacgtcccatgtg

SEQ ID NO: 2833435 - DNA, 15 bp, Homo sapiens
cgtatttaatagcaa

SEQ ID NO: 2833436 - DNA, 23 bp, Homo sapiens
cgtatttaatagcaaagaattga

SEQ ID NO: 2833437 - DNA, 21 bp, Homo sapiens
cgtcaaaacagattgtttgca

SEQ ID NO: 2833438 - DNA, 24 bp, Homo sapiens
cgtcagtagtttgagaccagcctg

SEQ ID NO: 2833439 - DNA, 19 bp, Homo sapiens
cgtccaggagcctgtgcct

SEQ ID NO: 2833440 - DNA, 22 bp, Homo sapiens
cgtccccccccaacctttccct

SEQ ID NO: 2833441 - DNA, 13 bp, Homo sapiens
cgtcctccccctg

SEQ ID NO: 2833442 - DNA, 16 bp, Homo sapiens
cgtcctccccctgcca

SEQ ID NO: 2833443 - DNA, 21 bp, Homo sapiens
cgtcctggaatgaagcatgta

SEQ ID NO: 2833444 - DNA, 17 bp, Homo sapiens
cgtccttactcctgtgg

SEQ ID NO: 2833445 - DNA, 21 bp, Homo sapiens
cgtccttactcctgtgggagc

SEQ ID NO: 2833446 - DNA, 15 bp, Homo sapiens
cgtctccctaaaata

SEQ ID NO: 2833447 - DNA, 16 bp, Homo sapiens
cgtctccctaaaataa

SEQ ID NO: 2833448 - DNA, 13 bp, Homo sapiens
cgtctgacaggca

SEQ ID NO: 2833449 - DNA, 19 bp, Homo sapiens
cgtctggggttcagcccct

SEQ ID NO: 2833450 - DNA, 13 bp, Homo sapiens
cgtcttgtatttt

SEQ ID NO: 2833451 - DNA, 18 bp, Homo sapiens
cgtctttggaggaacagc

SEQ ID NO: 2833452 - DNA, 21 bp, Homo sapiens
cgtctttggaggaacagctcc

SEQ ID NO: 2833453 - DNA, 17 bp, Homo sapiens
cgtgaatgcttacctgt

SEQ ID NO: 2833454 - DNA, 12 bp, Homo sapiens
cgtgacaacact

SEQ ID NO: 2833455 - DNA, 13 bp, Homo sapiens
ctcacacaggcat

SEQ ID NO: 2833456 - DNA, 22 bp, Homo sapiens
ctcacacaggcatttcctgggt

SEQ ID NO: 2833457 - DNA, 22 bp, Homo sapiens
ctcacacttgggcgctctgccc

SEQ ID NO: 2833458 - DNA, 23 bp, Homo sapiens
ctcacacttgggcgctctgccct

SEQ ID NO: 2833459 - DNA, 13 bp, Homo sapiens
ctcacagaagaat

SEQ ID NO: 2833460 - DNA, 13 bp, Homo sapiens
ctcacagttcctc

SEQ ID NO: 2833461 - DNA, 23 bp, Homo sapiens
ctcacagttcctcgccctgggtc

SEQ ID NO: 2833462 - DNA, 19 bp, Homo sapiens
ctcacatttattctgctca

SEQ ID NO: 2833463 - DNA, 13 bp, Homo sapiens
ctcaccagcccca

SEQ ID NO: 2833464 - DNA, 15 bp, Homo sapiens
ctcaccagccccagt

SEQ ID NO: 2833465 - DNA, 21 bp, Homo sapiens
ctcaccagccccagtgcccac

SEQ ID NO: 2833466 - DNA, 14 bp, Homo sapiens
ctcacccccagctt

SEQ ID NO: 2833467 - DNA, 18 bp, Homo sapiens
ctcacccccagctttgct

SEQ ID NO: 2833468 - DNA, 19 bp, Homo sapiens
ctcacccccagctttgcta

SEQ ID NO: 2833469 - DNA, 14 bp, Homo sapiens
ctcaccccctccca

SEQ ID NO: 2833470 - DNA, 18 bp, Homo sapiens
ctcaccccctcccacccc

SEQ ID NO: 2833471 - DNA, 21 bp, Homo sapiens
ctcaccccctcccacccccag

SEQ ID NO: 2833472 - DNA, 13 bp, Homo sapiens
ctcacctctgcct

SEQ ID NO: 2833473 - DNA, 15 bp, Homo sapiens
ctcacctctgcctca

SEQ ID NO: 2833474 - DNA, 18 bp, Homo sapiens
ctcacctctgcctcaatg

SEQ ID NO: 2833475 - DNA, 19 bp, Homo sapiens
ctcacctctgcctcaatgt

SEQ ID NO: 2833476 - DNA, 21 bp, Homo sapiens
ctcaccttgtgctggggacag

SEQ ID NO: 2833477 - DNA, 16 bp, Homo sapiens
ctcacctttgcaaagt

SEQ ID NO: 2833478 - DNA, 18 bp, Homo sapiens
ctcacgcccagcctcctc

SEQ ID NO: 2833479 - DNA, 21 bp, Homo sapiens
ctcacgcctataatcccagca

SEQ ID NO: 2833480 - DNA, 20 bp, Homo sapiens
ctcacgcctatgatcccagc

SEQ ID NO: 2833481 - DNA, 21 bp, Homo sapiens
ctcacgcctgtaatcccagca

SEQ ID NO: 2833482 - DNA, 23 bp, Homo sapiens
ctcacgcctgtaatcccagcagt

SEQ ID NO: 2833483 - DNA, 11 bp, Homo sapiens
ctcactatgac

SEQ ID NO: 2833484 - DNA, 14 bp, Homo sapiens
ctcactccacactg

SEQ ID NO: 2833485 - DNA, 12 bp, Homo sapiens
ctcactccacca

SEQ ID NO: 2833486 - DNA, 17 bp, Homo sapiens
ctcactccaccacccaa

SEQ ID NO: 2833487 - DNA, 15 bp, Homo sapiens
ctcactccctgggaa

SEQ ID NO: 2833488 - DNA, 21 bp, Homo sapiens
ctcactctgtcgcccagtctg

SEQ ID NO: 2833489 - DNA, 22 bp, Homo sapiens
ctcactgatatattttccaggg

SEQ ID NO: 2833490 - DNA, 13 bp, Homo sapiens
ctcactgcagcct

SEQ ID NO: 2833491 - DNA, 15 bp, Homo sapiens
ctcactgcagcctca

SEQ ID NO: 2833492 - DNA, 22 bp, Homo sapiens
ctcactgccccaccagccacct

SEQ ID NO: 2833493 - DNA, 19 bp, Homo sapiens
ctcactgctcaagaagaca

SEQ ID NO: 2833494 - DNA, 18 bp, Homo sapiens
ctcactgttgcccaggct

SEQ ID NO: 2833495 - DNA, 20 bp, Homo sapiens
ctcactgttgcccaggctgg

SEQ ID NO: 2833496 - DNA, 21 bp, Homo sapiens
ctcactgttgcccaggctggc

SEQ ID NO: 2833497 - DNA, 19 bp, Homo sapiens
ctcagaaaagaaaaccatt

SEQ ID NO: 2833498 - DNA, 22 bp, Homo sapiens
ctcagaagacactgatgggcaa

SEQ ID NO: 2833499 - DNA, 17 bp, Homo sapiens
ctcagaagcctgggggc

SEQ ID NO: 2833500 - DNA, 20 bp, Homo sapiens
ctcagaagcctgggggcctg

SEQ ID NO: 2833501 - DNA, 23 bp, Homo sapiens
ctcagaagcctgggggcctggct

SEQ ID NO: 2833502 - DNA, 13 bp, Homo sapiens
ctcagaaggtatt

SEQ ID NO: 2833503 - DNA, 21 bp, Homo sapiens
ctcagaccaactctctcctgt

SEQ ID NO: 2833504 - DNA, 18 bp, Homo sapiens
ctcagaggcccaggaatc

SEQ ID NO: 2833505 - DNA, 22 bp, Homo sapiens
ctcagaggctatagctgggaac

SEQ ID NO: 2833506 - DNA, 16 bp, Homo sapiens
ctcagatagaatgaca

SEQ ID NO: 2833507 - DNA, 12 bp, Homo sapiens
ctcagcagccct

SEQ ID NO: 2833508 - DNA, 15 bp, Homo sapiens
ctcagcagccctcct

SEQ ID NO: 2833509 - DNA, 19 bp, Homo sapiens
ctcagcagccctcctcacc

SEQ ID NO: 2833510 - DNA, 16 bp, Homo sapiens
ctcagcatacctgctg

SEQ ID NO: 2833511 - DNA, 15 bp, Homo sapiens
ctcagccatgaggag

SEQ ID NO: 2833512 - DNA, 19 bp, Homo sapiens
ctcagccccgggcctgcct

SEQ ID NO: 2833513 - DNA, 20 bp, Homo sapiens
ctcagccccgggcctgcctc

SEQ ID NO: 2833514 - DNA, 19 bp, Homo sapiens
ctcagccctgactggtgct

SEQ ID NO: 2833515 - DNA, 15 bp, Homo sapiens
ctcagccctgggccc

SEQ ID NO: 2833516 - DNA, 14 bp, Homo sapiens
ctcagcctcccaaa

SEQ ID NO: 2833517 - DNA, 13 bp, Homo sapiens
ctcagcctcccga

SEQ ID NO: 2833518 - DNA, 18 bp, Homo sapiens
ctcagcctggtgggcctc

SEQ ID NO: 2833519 - DNA, 13 bp, Homo sapiens
ctcagcctgtgct

SEQ ID NO: 2833520 - DNA, 16 bp, Homo sapiens
ctcagcctgtgctgcc

SEQ ID NO: 2833521 - DNA, 18 bp, Homo sapiens
ctcagccttgaaaaacaa

SEQ ID NO: 2833522 - DNA, 16 bp, Homo sapiens
ctcagcggggacagct

SEQ ID NO: 2833523 - DNA, 15 bp, Homo sapiens
ctcagctcccaaggc

SEQ ID NO: 2833524 - DNA, 19 bp, Homo sapiens
ctcagctcccaaggctctg

SEQ ID NO: 2833525 - DNA, 14 bp, Homo sapiens
ctcagctgctcgca

SEQ ID NO: 2833526 - DNA, 23 bp, Homo sapiens
ctcagcttcatttccgtgaaggg

SEQ ID NO: 2833527 - DNA, 17 bp, Homo sapiens
ctcagctttttgtcttt

SEQ ID NO: 2833528 - DNA, 14 bp, Homo sapiens
ctcagcttttttct

SEQ ID NO: 2833529 - DNA, 13 bp, Homo sapiens
ctcaggacacagg

SEQ ID NO: 2833530 - DNA, 14 bp, Homo sapiens
ctcaggacacaggc

SEQ ID NO: 2833531 - DNA, 17 bp, Homo sapiens
ctcaggacacaggcctg

SEQ ID NO: 2833532 - DNA, 18 bp, Homo sapiens
ctcaggacacaggcctgt

SEQ ID NO: 2833533 - DNA, 22 bp, Homo sapiens
ctcaggagcttgcaagaagcag

SEQ ID NO: 2833534 - DNA, 20 bp, Homo sapiens
ctcaggaggctgaggcagga

SEQ ID NO: 2833535 - DNA, 22 bp, Homo sapiens
ctcaggaggctgaggcaggagg

SEQ ID NO: 2833536 - DNA, 23 bp, Homo sapiens
ctcaggaggctgaggcaggagga

SEQ ID NO: 2833537 - DNA, 20 bp, Homo sapiens
ctcaggcccccacctggctc

SEQ ID NO: 2833538 - DNA, 20 bp, Homo sapiens
ctcagggacagagacacctg

SEQ ID NO: 2833539 - DNA, 22 bp, Homo sapiens
ctcagggacagagacacctgca

SEQ ID NO: 2833540 - DNA, 16 bp, Homo sapiens
ctcagggccccagcac

SEQ ID NO: 2833541 - DNA, 16 bp, Homo sapiens
ctcagggtccagaccc

SEQ ID NO: 2833542 - DNA, 18 bp, Homo sapiens
ctcaggtccctgcagggc

SEQ ID NO: 2833543 - DNA, 23 bp, Homo sapiens
ctcaggtgatccacccacctcag

SEQ ID NO: 2833544 - DNA, 19 bp, Homo sapiens
ctcaggtgtccctgcactt

SEQ ID NO: 2833545 - DNA, 14 bp, Homo sapiens
ctgtgcctctgcct

SEQ ID NO: 2833546 - DNA, 16 bp, Homo sapiens
cttaaataaattcaaa

SEQ ID NO: 2833547 - DNA, 16 bp, Homo sapiens
cttaaataagaaactt

SEQ ID NO: 2833548 - DNA, 14 bp, Homo sapiens
cttaaatagcatct

SEQ ID NO: 2833549 - DNA, 23 bp, Homo sapiens
cttaaatcactgaggcattttta

SEQ ID NO: 2833550 - DNA, 17 bp, Homo sapiens
cttaacattctgtaaaa

SEQ ID NO: 2833551 - DNA, 15 bp, Homo sapiens
cttaacattgattta

SEQ ID NO: 2833552 - DNA, 12 bp, Homo sapiens
cttaaccagcac

SEQ ID NO: 2833553 - DNA, 15 bp, Homo sapiens
cttaacggctccagg

SEQ ID NO: 2833554 - DNA, 11 bp, Homo sapiens
cttaactgtgt

SEQ ID NO: 2833555 - DNA, 18 bp, Homo sapiens
cttaactgtgtgaagaaa

SEQ ID NO: 2833556 - DNA, 18 bp, Homo sapiens
cttaaggaggtagctccc

SEQ ID NO: 2833557 - DNA, 17 bp, Homo sapiens
cttaagtcagaacagca

SEQ ID NO: 2833558 - DNA, 16 bp, Homo sapiens
cttaagtgctgcaatt

SEQ ID NO: 2833559 - DNA, 16 bp, Homo sapiens
cttaatagtatttatg

SEQ ID NO: 2833560 - DNA, 21 bp, Homo sapiens
cttaatcagatagatattcct

SEQ ID NO: 2833561 - DNA, 22 bp, Homo sapiens
cttaatcaggtcctcagagaat

SEQ ID NO: 2833562 - DNA, 12 bp, Homo sapiens
cttaatgagata

SEQ ID NO: 2833563 - DNA, 17 bp, Homo sapiens
cttaatgctttcctccc

SEQ ID NO: 2833564 - DNA, 20 bp, Homo sapiens
cttaatggctgataatttta

SEQ ID NO: 2833565 - DNA, 15 bp, Homo sapiens
cttaattctgagctg

SEQ ID NO: 2833566 - DNA, 14 bp, Homo sapiens
cttaattttcagta

SEQ ID NO: 2833567 - DNA, 15 bp, Homo sapiens
cttacattgtgaaac

SEQ ID NO: 2833568 - DNA, 22 bp, Homo sapiens
cttacccggagaaggccgctgc

SEQ ID NO: 2833569 - DNA, 21 bp, Homo sapiens
cttacctaaacagatataaat

SEQ ID NO: 2833570 - DNA, 15 bp, Homo sapiens
cttacctcctgccca

SEQ ID NO: 2833571 - DNA, 17 bp, Homo sapiens
cttacctcctgcccagg

SEQ ID NO: 2833572 - DNA, 18 bp, Homo sapiens
cttacctcctgcccagga

SEQ ID NO: 2833573 - DNA, 12 bp, Homo sapiens
cttacctgtgag

SEQ ID NO: 2833574 - DNA, 15 bp, Homo sapiens
cttaccttcaataaa

SEQ ID NO: 2833575 - DNA, 16 bp, Homo sapiens
cttaccttcaataaag

SEQ ID NO: 2833576 - DNA, 21 bp, Homo sapiens
cttaccttcaataaagtatct

SEQ ID NO: 2833577 - DNA, 14 bp, Homo sapiens
cttactcctgtggg

SEQ ID NO: 2833578 - DNA, 16 bp, Homo sapiens
cttactcctgtgggag

SEQ ID NO: 2833579 - DNA, 17 bp, Homo sapiens
cttagaagtcacacagt

SEQ ID NO: 2833580 - DNA, 12 bp, Homo sapiens
cttagacctcag

SEQ ID NO: 2833581 - DNA, 14 bp, Homo sapiens
cttagacctcagcc

SEQ ID NO: 2833582 - DNA, 18 bp, Homo sapiens
cttagacctcagcctgtg

SEQ ID NO: 2833583 - DNA, 20 bp, Homo sapiens
cttagacctcagcctgtgct

SEQ ID NO: 2833584 - DNA, 20 bp, Homo sapiens
cttagattagctctggacca

SEQ ID NO: 2833585 - DNA, 21 bp, Homo sapiens
cttagcagggaaacagctaat

SEQ ID NO: 2833586 - DNA, 18 bp, Homo sapiens
cttagcatgtgttgaaaa

SEQ ID NO: 2833587 - DNA, 17 bp, Homo sapiens
cttagcttagacctcag

SEQ ID NO: 2833588 - DNA, 22 bp, Homo sapiens
cttagcttagacctcagcctgt

SEQ ID NO: 2833589 - DNA, 14 bp, Homo sapiens
cttagctttccaca

SEQ ID NO: 2833590 - DNA, 22 bp, Homo sapiens
cttaggaagagaaaccagggag

SEQ ID NO: 2833591 - DNA, 20 bp, Homo sapiens
cttaggtaaaaatataagaa

SEQ ID NO: 2833592 - DNA, 19 bp, Homo sapiens
cttagtatctcatcaacaa

SEQ ID NO: 2833593 - DNA, 20 bp, Homo sapiens
cttatagaatatttattacc

SEQ ID NO: 2833594 - DNA, 20 bp, Homo sapiens
cttatatagtttactatttt

SEQ ID NO: 2833595 - DNA, 12 bp, Homo sapiens
cttatccaggac

SEQ ID NO: 2833596 - DNA, 22 bp, Homo sapiens
cttatgacatcacttgtacaaa

SEQ ID NO: 2833597 - DNA, 13 bp, Homo sapiens
cttatgagatggg

SEQ ID NO: 2833598 - DNA, 13 bp, Homo sapiens
cttatgtattatt

SEQ ID NO: 2833599 - DNA, 17 bp, Homo sapiens
cttatgtattattttct

SEQ ID NO: 2833600 - DNA, 18 bp, Homo sapiens
cttatgtctctacatggt

SEQ ID NO: 2833601 - DNA, 11 bp, Homo sapiens
cttattagaac

SEQ ID NO: 2833602 - DNA, 13 bp, Homo sapiens
cttattgtacctc

SEQ ID NO: 2833603 - DNA, 18 bp, Homo sapiens
cttattgtacctctctta

SEQ ID NO: 2833604 - DNA, 14 bp, Homo sapiens
cttatttatatatg

SEQ ID NO: 2833605 - DNA, 15 bp, Homo sapiens
cttatttatatatga

SEQ ID NO: 2833606 - DNA, 15 bp, Homo sapiens
cttatttgcaataaa

SEQ ID NO: 2833607 - DNA, 12 bp, Homo sapiens
cttattttcaag

SEQ ID NO: 2833608 - DNA, 15 bp, Homo sapiens
cttattttcaagaaa

SEQ ID NO: 2833609 - DNA, 18 bp, Homo sapiens
cttattttcaagaaactg

SEQ ID NO: 2833610 - DNA, 16 bp, Homo sapiens
cttattttccaataaa

SEQ ID NO: 2833611 - DNA, 18 bp, Homo sapiens
cttattttgtaataaact

SEQ ID NO: 2833612 - DNA, 23 bp, Homo sapiens
cttattttgtaataaactctcta

SEQ ID NO: 2833613 - DNA, 17 bp, Homo sapiens
cttatttttgacagtgt

SEQ ID NO: 2833614 - DNA, 18 bp, Homo sapiens
cttcaaagcttgaagatc

SEQ ID NO: 2833615 - DNA, 17 bp, Homo sapiens
cttcaaattgtcttttg

SEQ ID NO: 2833616 - DNA, 13 bp, Homo sapiens
cttcaaccctcag

SEQ ID NO: 2833617 - DNA, 15 bp, Homo sapiens
cttcaaccctcagcc

SEQ ID NO: 2833618 - DNA, 23 bp, Homo sapiens
cttcaactgaccagcctccatgc

SEQ ID NO: 2833619 - DNA, 18 bp, Homo sapiens
cttcaagtgatatatgta

SEQ ID NO: 2833620 - DNA, 16 bp, Homo sapiens
cttcaagttagctcag

SEQ ID NO: 2833621 - DNA, 19 bp, Homo sapiens
cttcaagttagctcaggag

SEQ ID NO: 2833622 - DNA, 20 bp, Homo sapiens
cttcaagttagctcaggagg

SEQ ID NO: 2833623 - DNA, 15 bp, Homo sapiens
cttcaattaataaaa

SEQ ID NO: 2833624 - DNA, 16 bp, Homo sapiens
cttcaattcctgggcc

SEQ ID NO: 2833625 - DNA, 17 bp, Homo sapiens
cttcacaaccagccaca

SEQ ID NO: 2833626 - DNA, 22 bp, Homo sapiens
cttcacaaccagccacacagag

SEQ ID NO: 2833627 - DNA, 23 bp, Homo sapiens
cttcacaaccagccacacagagc

SEQ ID NO: 2833628 - DNA, 16 bp, Homo sapiens
cttcacacacaggcaa

SEQ ID NO: 2833629 - DNA, 15 bp, Homo sapiens
cttcacactgcaaga

SEQ ID NO: 2833630 - DNA, 21 bp, Homo sapiens
cttcacactgcaagagccttg

SEQ ID NO: 2833631 - DNA, 12 bp, Homo sapiens
cttcacagtgtt

SEQ ID NO: 2833632 - DNA, 19 bp, Homo sapiens
cttcactccggtgtgcctg

SEQ ID NO: 2833633 - DNA, 16 bp, Homo sapiens
cttcactttaattctc

SEQ ID NO: 2833634 - DNA, 21 bp, Homo sapiens
cttcactttaattctcatgtg

SEQ ID NO: 2833635 - DNA, 19 bp, Homo sapiens
cttcagacttttatcaaaa

SEQ ID NO: 2833636 - DNA, 10 bp, Homo sapiens
cttcagcacc

SEQ ID NO: 2833637 - DNA, 15 bp, Homo sapiens
cttcagccacctctc

SEQ ID NO: 2833638 - DNA, 14 bp, Homo sapiens
cttcagccatcaac

SEQ ID NO: 2833639 - DNA, 13 bp, Homo sapiens
cttcagccctggc

SEQ ID NO: 2833640 - DNA, 21 bp, Homo sapiens
cttcagcctagccgacctcag

SEQ ID NO: 2833641 - DNA, 23 bp, Homo sapiens
cttcagcctagccgacctcagcc

SEQ ID NO: 2833642 - DNA, 20 bp, Homo sapiens
cttcagcctccccaccttct

SEQ ID NO: 2833643 - DNA, 14 bp, Homo sapiens
cttcagcctgaggc

SEQ ID NO: 2833644 - DNA, 16 bp, Homo sapiens
cttcagcctgaggctg

SEQ ID NO: 2833645 - DNA, 20 bp, Homo sapiens
cttcagcctgaggctgagac

SEQ ID NO: 2833646 - DNA, 22 bp, Homo sapiens
cttcagcctgaggctgagactg

SEQ ID NO: 2833647 - DNA, 16 bp, Homo sapiens
cttcaggtggaaaaac

SEQ ID NO: 2833648 - DNA, 15 bp, Homo sapiens
cttcagtgcccacca

SEQ ID NO: 2833649 - DNA, 17 bp, Homo sapiens
cttcagtgcccaccaac

SEQ ID NO: 2833650 - DNA, 18 bp, Homo sapiens
cttcagtggcagctgctt

SEQ ID NO: 2833651 - DNA, 17 bp, Homo sapiens
cttcagtgtatggaaat

SEQ ID NO: 2833652 - DNA, 20 bp, Homo sapiens
cttcatcaatttttatacat

SEQ ID NO: 2833653 - DNA, 21 bp, Homo sapiens
cttcatcaatttttatacata

SEQ ID NO: 2833654 - DNA, 11 bp, Homo sapiens
cttcatcctct

SEQ ID NO: 2833655 - DNA, 23 bp, Homo sapiens
cttcatgaggaggtcagcccatt

SEQ ID NO: 2833656 - DNA, 13 bp, Homo sapiens
cttcatgcaatga

SEQ ID NO: 2833657 - DNA, 22 bp, Homo sapiens
cttcatgcaatgacatcttcaa

SEQ ID NO: 2833658 - DNA, 15 bp, Homo sapiens
cttcatgctcagccc

SEQ ID NO: 2833659 - DNA, 21 bp, Homo sapiens
cttcatggaactcagctgtct

SEQ ID NO: 2833660 - DNA, 22 bp, Homo sapiens
cttcatggaccaagaatgagct

SEQ ID NO: 2833661 - DNA, 18 bp, Homo sapiens
cttcatttcctgtgtctt

SEQ ID NO: 2833662 - DNA, 14 bp, Homo sapiens
cttcatttggagat

SEQ ID NO: 2833663 - DNA, 13 bp, Homo sapiens
cttccaaagcaca

SEQ ID NO: 2833664 - DNA, 18 bp, Homo sapiens
cttccagctagtgaccca

SEQ ID NO: 2833665 - DNA, 15 bp, Homo sapiens
cttccagtgcatgtt

SEQ ID NO: 2833666 - DNA, 16 bp, Homo sapiens
cttccagtgcatgttg

SEQ ID NO: 2833667 - DNA, 22 bp, Homo sapiens
cttccagtgcatgttgccatga

SEQ ID NO: 2833668 - DNA, 16 bp, Homo sapiens
cttccagtggtaccag

SEQ ID NO: 2833669 - DNA, 14 bp, Homo sapiens
cttccagtttgctt

SEQ ID NO: 2833670 - DNA, 11 bp, Homo sapiens
cttccataatg

SEQ ID NO: 2833671 - DNA, 17 bp, Homo sapiens
cttccatgagaacagca

SEQ ID NO: 2833672 - DNA, 17 bp, Homo sapiens
cttccatgtcgcctctg

SEQ ID NO: 2833673 - DNA, 19 bp, Homo sapiens
cttccatgtcgcctctgca

SEQ ID NO: 2833674 - DNA, 20 bp, Homo sapiens
cttccatgtcgcctctgcat

SEQ ID NO: 2833675 - DNA, 18 bp, Homo sapiens
cttcccatcactggagca

SEQ ID NO: 2833676 - DNA, 14 bp, Homo sapiens
cttcccatccccag

SEQ ID NO: 2833677 - DNA, 17 bp, Homo sapiens
cttcccatgatgccgct

SEQ ID NO: 2833678 - DNA, 21 bp, Homo sapiens
cttcccatgtctttctccaaa

SEQ ID NO: 2833679 - DNA, 13 bp, Homo sapiens
cttcccatttgta

SEQ ID NO: 2833680 - DNA, 21 bp, Homo sapiens
cttcccatttgtaatgtatct

SEQ ID NO: 2833681 - DNA, 12 bp, Homo sapiens
cttccccagact

SEQ ID NO: 2833682 - DNA, 13 bp, Homo sapiens
cttcccccatccc

SEQ ID NO: 2833683 - DNA, 23 bp, Homo sapiens
cttcccccatcccctttcctccc

SEQ ID NO: 2833684 - DNA, 16 bp, Homo sapiens
cttccccctcccaggg

SEQ ID NO: 2833685 - DNA, 17 bp, Homo sapiens
cttcccctcgctgtcct

SEQ ID NO: 2833686 - DNA, 13 bp, Homo sapiens
cttccccttgccc

SEQ ID NO: 2833687 - DNA, 22 bp, Homo sapiens
cttccccttgcccttgccctga

SEQ ID NO: 2833688 - DNA, 22 bp, Homo sapiens
cttccctaatcctccaagtctt

SEQ ID NO: 2833689 - DNA, 11 bp, Homo sapiens
cttccctggct

SEQ ID NO: 2833690 - DNA, 17 bp, Homo sapiens
cttccgatgacagtgct

SEQ ID NO: 2833691 - DNA, 17 bp, Homo sapiens
cttcctaccaaatataa

SEQ ID NO: 2833692 - DNA, 22 bp, Homo sapiens
cttcctaccaaatataaacttg

SEQ ID NO: 2833693 - DNA, 15 bp, Homo sapiens
cttcctccctcattc

SEQ ID NO: 2833694 - DNA, 12 bp, Homo sapiens
cttcctctgctg

SEQ ID NO: 2833695 - DNA, 13 bp, Homo sapiens
cttcctgccacca

SEQ ID NO: 2833696 - DNA, 21 bp, Homo sapiens
cttcctgccaccagtcactgt

SEQ ID NO: 2833697 - DNA, 15 bp, Homo sapiens
cttcctggacagctg

SEQ ID NO: 2833698 - DNA, 13 bp, Homo sapiens
cttccttcatttc

SEQ ID NO: 2833699 - DNA, 12 bp, Homo sapiens
cttccttccccc

SEQ ID NO: 2833700 - DNA, 14 bp, Homo sapiens
cttccttccctggc

SEQ ID NO: 2833701 - DNA, 17 bp, Homo sapiens
cttccttccctggcttg

SEQ ID NO: 2833702 - DNA, 19 bp, Homo sapiens
cttccttggcatcacaggg

SEQ ID NO: 2833703 - DNA, 14 bp, Homo sapiens
cttccttgtgagga

SEQ ID NO: 2833704 - DNA, 12 bp, Homo sapiens
cttcctttcctc

SEQ ID NO: 2833705 - DNA, 13 bp, Homo sapiens
cttcctttcctct

SEQ ID NO: 2833706 - DNA, 23 bp, Homo sapiens
cttcgaggtggatcacagaggct

SEQ ID NO: 2833707 - DNA, 14 bp, Homo sapiens
cttcggggctggga

SEQ ID NO: 2833708 - DNA, 15 bp, Homo sapiens
cttcggggctgggaa

SEQ ID NO: 2833709 - DNA, 20 bp, Homo sapiens
cttctaaaatgcttttaatt

SEQ ID NO: 2833710 - DNA, 15 bp, Homo sapiens
cttctacaaccagag

SEQ ID NO: 2833711 - DNA, 21 bp, Homo sapiens
cttctacttttaagttgctga

SEQ ID NO: 2833712 - DNA, 13 bp, Homo sapiens
cttctaggaagct

SEQ ID NO: 2833713 - DNA, 19 bp, Homo sapiens
cttctagtctggtgttctg

SEQ ID NO: 2833714 - DNA, 13 bp, Homo sapiens
cttctattttatt

SEQ ID NO: 2833715 - DNA, 16 bp, Homo sapiens
cttctattttgtaaac

SEQ ID NO: 2833716 - DNA, 17 bp, Homo sapiens
cttctattttgtaaact

SEQ ID NO: 2833717 - DNA, 20 bp, Homo sapiens
cttctcagccccgggcctgc

SEQ ID NO: 2833718 - DNA, 19 bp, Homo sapiens
cttctcaggacacaggcct

SEQ ID NO: 2833719 - DNA, 20 bp, Homo sapiens
cttctcaggacacaggcctg

SEQ ID NO: 2833720 - DNA, 22 bp, Homo sapiens
cttctcaggacacaggcctgtg

SEQ ID NO: 2833721 - DNA, 20 bp, Homo sapiens
cttctcattttttaaaaaag

SEQ ID NO: 2833722 - DNA, 17 bp, Homo sapiens
cttctccaccctgctct

SEQ ID NO: 2833723 - DNA, 15 bp, Homo sapiens
cttctcctgcctaca

SEQ ID NO: 2833724 - DNA, 14 bp, Homo sapiens
cttctccttggagg

SEQ ID NO: 2833725 - DNA, 15 bp, Homo sapiens
cttctccttggagga

SEQ ID NO: 2833726 - DNA, 16 bp, Homo sapiens
cttctccttggaggac

SEQ ID NO: 2833727 - DNA, 23 bp, Homo sapiens
cttctccttggaggacagtggga

SEQ ID NO: 2833728 - DNA, 18 bp, Homo sapiens
cttctcgcattttctcta

SEQ ID NO: 2833729 - DNA, 11 bp, Homo sapiens
cttctctacag

SEQ ID NO: 2833730 - DNA, 11 bp, Homo sapiens
cttctctccag

SEQ ID NO: 2833731 - DNA, 21 bp, Homo sapiens
cttctctccaggctgtttctt

SEQ ID NO: 2833732 - DNA, 23 bp, Homo sapiens
cttctctcggggcgacccctcag

SEQ ID NO: 2833733 - DNA, 13 bp, Homo sapiens
cttctctgaagga

SEQ ID NO: 2833734 - DNA, 22 bp, Homo sapiens
cttctctgggggcctctttctg

SEQ ID NO: 2833735 - DNA, 21 bp, Homo sapiens
cttctctgtgaacgatttaga

SEQ ID NO: 2833736 - DNA, 21 bp, Homo sapiens
cttctctgtgcccctgtaaat

SEQ ID NO: 2833737 - DNA, 14 bp, Homo sapiens
cttctcttcctgta

SEQ ID NO: 2833738 - DNA, 13 bp, Homo sapiens
cttctctttctta

SEQ ID NO: 2833739 - DNA, 22 bp, Homo sapiens
cttctctttcttattttgtaat

SEQ ID NO: 2833740 - DNA, 13 bp, Homo sapiens
cttctctttgcct

SEQ ID NO: 2833741 - DNA, 15 bp, Homo sapiens
cttctgccatattct

SEQ ID NO: 2833742 - DNA, 17 bp, Homo sapiens
cttctgctggataaaat

SEQ ID NO: 2833743 - DNA, 13 bp, Homo sapiens
cttctgcttcagc

SEQ ID NO: 2833744 - DNA, 18 bp, Homo sapiens
cttctgcttcagcctccc

SEQ ID NO: 2833745 - DNA, 18 bp, Homo sapiens
cttctggagtctccagtg

SEQ ID NO: 2833746 - DNA, 21 bp, Homo sapiens
cttctgggaagacaactagga

SEQ ID NO: 2833747 - DNA, 14 bp, Homo sapiens
cttctgtacgtctg

SEQ ID NO: 2833748 - DNA, 15 bp, Homo sapiens
cttctgtacgtctga

SEQ ID NO: 2833749 - DNA, 18 bp, Homo sapiens
cttctgtatactgtggag

SEQ ID NO: 2833750 - DNA, 21 bp, Homo sapiens
cttctgtcatcccgctcctgc

SEQ ID NO: 2833751 - DNA, 22 bp, Homo sapiens
cttctgtcatcccgctcctgct

SEQ ID NO: 2833752 - DNA, 21 bp, Homo sapiens
cttcttacaataattctatga

SEQ ID NO: 2833753 - DNA, 22 bp, Homo sapiens
cttcttacttggaactgaaggg

SEQ ID NO: 2833754 - DNA, 14 bp, Homo sapiens
cttcttcacccagc

SEQ ID NO: 2833755 - DNA, 17 bp, Homo sapiens
cttcttcagccacctct

SEQ ID NO: 2833756 - DNA, 17 bp, Homo sapiens
cttcttcggggaactcc

SEQ ID NO: 2833757 - DNA, 13 bp, Homo sapiens
cttcttcttcaga

SEQ ID NO: 2833758 - DNA, 14 bp, Homo sapiens
cttcttgccccttg

SEQ ID NO: 2833759 - DNA, 15 bp, Homo sapiens
cttcttgccccttgg

SEQ ID NO: 2833760 - DNA, 19 bp, Homo sapiens
cttctttaaatcaaaagct

SEQ ID NO: 2833761 - DNA, 19 bp, Homo sapiens
cttcttttaaaccattttc

SEQ ID NO: 2833762 - DNA, 17 bp, Homo sapiens
cttctttttttgtgatg

SEQ ID NO: 2833763 - DNA, 20 bp, Homo sapiens
cttgaaaattttattaaaaa

SEQ ID NO: 2833764 - DNA, 22 bp, Homo sapiens
cttgaaataccagtgaaccaaa

SEQ ID NO: 2833765 - DNA, 20 bp, Homo sapiens
cttgaaattatatctgtggt

SEQ ID NO: 2833766 - DNA, 16 bp, Homo sapiens
cttgaacactggggga

SEQ ID NO: 2833767 - DNA, 13 bp, Homo sapiens
cttgaactcctgg

SEQ ID NO: 2833768 - DNA, 14 bp, Homo sapiens
cttgaactcctggc

SEQ ID NO: 2833769 - DNA, 18 bp, Homo sapiens
cttgaagaatattgttaa

SEQ ID NO: 2833770 - DNA, 16 bp, Homo sapiens
cttgaagccactgaag

SEQ ID NO: 2833771 - DNA, 18 bp, Homo sapiens
cttgaagccactgaagct

SEQ ID NO: 2833772 - DNA, 22 bp, Homo sapiens
cttgaaggaacagtgctgttct

SEQ ID NO: 2833773 - DNA, 23 bp, Homo sapiens
cttgaaggaacagtgctgttctg

SEQ ID NO: 2833774 - DNA, 23 bp, Homo sapiens
cttgaaggatctgtttttaaaaa

SEQ ID NO: 2833775 - DNA, 20 bp, Homo sapiens
cttgaatttctaaaaaacag

SEQ ID NO: 2833776 - DNA, 12 bp, Homo sapiens
cttgacagggca

SEQ ID NO: 2833777 - DNA, 15 bp, Homo sapiens
cttgacagggcacac

SEQ ID NO: 2833778 - DNA, 20 bp, Homo sapiens
cttgacagggcacaccgggc

SEQ ID NO: 2833779 - DNA, 14 bp, Homo sapiens
cttgacattcaagg

SEQ ID NO: 2833780 - DNA, 20 bp, Homo sapiens
cttgactaaaaaaaaaagaa

SEQ ID NO: 2833781 - DNA, 18 bp, Homo sapiens
cttgactatcacatacaa

SEQ ID NO: 2833782 - DNA, 11 bp, Homo sapiens
cttgagaaacc

SEQ ID NO: 2833783 - DNA, 12 bp, Homo sapiens
cttgagaaacct

SEQ ID NO: 2833784 - DNA, 15 bp, Homo sapiens
cttgagacctcagcc

SEQ ID NO: 2833785 - DNA, 11 bp, Homo sapiens
cttgagcctgt

SEQ ID NO: 2833786 - DNA, 12 bp, Homo sapiens
cttgagcctgtc

SEQ ID NO: 2833787 - DNA, 14 bp, Homo sapiens
cttgaggacacatg

SEQ ID NO: 2833788 - DNA, 15 bp, Homo sapiens
cttgatctgtatata

SEQ ID NO: 2833789 - DNA, 20 bp, Homo sapiens
cttgatctgtatatacaata

SEQ ID NO: 2833790 - DNA, 22 bp, Homo sapiens
cttgatctgtatatacaataac

SEQ ID NO: 2833791 - DNA, 17 bp, Homo sapiens
cttgcaatggcagcctt

SEQ ID NO: 2833792 - DNA, 16 bp, Homo sapiens
cttgcacaagcttgta

SEQ ID NO: 2833793 - DNA, 19 bp, Homo sapiens
cttgcacagcccacacatg

SEQ ID NO: 2833794 - DNA, 18 bp, Homo sapiens
cttgccaagctttcttct

SEQ ID NO: 2833795 - DNA, 21 bp, Homo sapiens
cttgccacatctgtgtctctg

SEQ ID NO: 2833796 - DNA, 23 bp, Homo sapiens
cttgccaccaccagatgagaagt

SEQ ID NO: 2833797 - DNA, 14 bp, Homo sapiens
cttgccactgcctc

SEQ ID NO: 2833798 - DNA, 16 bp, Homo sapiens
cttgccagacatgtgg

SEQ ID NO: 2833799 - DNA, 23 bp, Homo sapiens
cttgccagccagaagcctctgcc

SEQ ID NO: 2833800 - DNA, 19 bp, Homo sapiens
cttgcccagagatgcctcc

SEQ ID NO: 2833801 - DNA, 19 bp, Homo sapiens
cttgcccagggctcagcct

SEQ ID NO: 2833802 - DNA, 21 bp, Homo sapiens
cttgcccagggctcagcctgg

SEQ ID NO: 2833803 - DNA, 14 bp, Homo sapiens
cttgccccttgggc

SEQ ID NO: 2833804 - DNA, 17 bp, Homo sapiens
cttgccccttgggcctc

SEQ ID NO: 2833805 - DNA, 12 bp, Homo sapiens
cttgccctgacc

SEQ ID NO: 2833806 - DNA, 13 bp, Homo sapiens
cttgccctgacct

SEQ ID NO: 2833807 - DNA, 15 bp, Homo sapiens
cttgccctgacctcc

SEQ ID NO: 2833808 - DNA, 17 bp, Homo sapiens
cttgccctgacctccca

SEQ ID NO: 2833809 - DNA, 18 bp, Homo sapiens
cttgccctgacctcccag

SEQ ID NO: 2833810 - DNA, 19 bp, Homo sapiens
cttgccctgacctcccagc

SEQ ID NO: 2833811 - DNA, 16 bp, Homo sapiens
cttgcccttgccctga

SEQ ID NO: 2833812 - DNA, 17 bp, Homo sapiens
cttgcctgccagggccc

SEQ ID NO: 2833813 - DNA, 15 bp, Homo sapiens
cttgcctttccacct

SEQ ID NO: 2833814 - DNA, 17 bp, Homo sapiens
cttgcctttccacctgc

SEQ ID NO: 2833815 - DNA, 17 bp, Homo sapiens
cttgccttttaaaagaa

SEQ ID NO: 2833816 - DNA, 20 bp, Homo sapiens
cttgctctcccctgccctgc

SEQ ID NO: 2833817 - DNA, 19 bp, Homo sapiens
cttgctcttcagtgggaga

SEQ ID NO: 2833818 - DNA, 13 bp, Homo sapiens
cttgctttttcaa

SEQ ID NO: 2833819 - DNA, 17 bp, Homo sapiens
ctttcagcactcagaaa

SEQ ID NO: 2833820 - DNA, 20 bp, Homo sapiens
ctttcagggaatttcaggaa

SEQ ID NO: 2833821 - DNA, 16 bp, Homo sapiens
ctttcatccccacctt

SEQ ID NO: 2833822 - DNA, 13 bp, Homo sapiens
ctttccatctgct

SEQ ID NO: 2833823 - DNA, 16 bp, Homo sapiens
ctttcccaccagcatg

SEQ ID NO: 2833824 - DNA, 24 bp, Homo sapiens
ctttcccaccagcatgtcactccc

SEQ ID NO: 2833825 - DNA, 21 bp, Homo sapiens
ctttcccatgctgaattattt

SEQ ID NO: 2833826 - DNA, 23 bp, Homo sapiens
ctttccccagtgtggccccagcc

SEQ ID NO: 2833827 - DNA, 18 bp, Homo sapiens
ctttccccgggggaggaa

SEQ ID NO: 2833828 - DNA, 23 bp, Homo sapiens
ctttccctaagaggcgacttcct

SEQ ID NO: 2833829 - DNA, 11 bp, Homo sapiens
ctttccctcac

SEQ ID NO: 2833830 - DNA, 14 bp, Homo sapiens
ctttccctcacccc

SEQ ID NO: 2833831 - DNA, 18 bp, Homo sapiens
ctttccctcaccccctcc

SEQ ID NO: 2833832 - DNA, 12 bp, Homo sapiens
ctttcctcccca

SEQ ID NO: 2833833 - DNA, 19 bp, Homo sapiens
ctttcctccccaccttccc

SEQ ID NO: 2833834 - DNA, 18 bp, Homo sapiens
ctttcctctccaattgta

SEQ ID NO: 2833835 - DNA, 18 bp, Homo sapiens
ctttcctctgcagcactt

SEQ ID NO: 2833836 - DNA, 19 bp, Homo sapiens
ctttcctgggggatgtgca

SEQ ID NO: 2833837 - DNA, 23 bp, Homo sapiens
ctttcctgtatttgttcccaaga

SEQ ID NO: 2833838 - DNA, 23 bp, Homo sapiens
ctttctagctgttgagctgtttt

SEQ ID NO: 2833839 - DNA, 20 bp, Homo sapiens
ctttctagtcctattctatt

SEQ ID NO: 2833840 - DNA, 18 bp, Homo sapiens
ctttctagttgaaaataa

SEQ ID NO: 2833841 - DNA, 21 bp, Homo sapiens
ctttctagttgaaaataaagt

SEQ ID NO: 2833842 - DNA, 22 bp, Homo sapiens
ctttctcagccgcttctgactg

SEQ ID NO: 2833843 - DNA, 17 bp, Homo sapiens
ctttctgagtgacatgg

SEQ ID NO: 2833844 - DNA, 20 bp, Homo sapiens
ctttctgagtgacatgggtg

SEQ ID NO: 2833845 - DNA, 16 bp, Homo sapiens
ctttctgtaaccataa

SEQ ID NO: 2833846 - DNA, 19 bp, Homo sapiens
ctttctgtccttttggcac

SEQ ID NO: 2833847 - DNA, 14 bp, Homo sapiens
ctttcttatttgca

SEQ ID NO: 2833848 - DNA, 19 bp, Homo sapiens
ctttcttattttgtaataa

SEQ ID NO: 2833849 - DNA, 21 bp, Homo sapiens
ctttcttattttgtaataaac

SEQ ID NO: 2833850 - DNA, 11 bp, Homo sapiens
ctttcttcctc

SEQ ID NO: 2833851 - DNA, 13 bp, Homo sapiens
ctttcttcctctg

SEQ ID NO: 2833852 - DNA, 16 bp, Homo sapiens
ctttcttcctctgctg

SEQ ID NO: 2833853 - DNA, 15 bp, Homo sapiens
ctttctttacctgag

SEQ ID NO: 2833854 - DNA, 18 bp, Homo sapiens
ctttcttttgtgttggat

SEQ ID NO: 2833855 - DNA, 22 bp, Homo sapiens
ctttgaaacaagataactgaga

SEQ ID NO: 2833856 - DNA, 15 bp, Homo sapiens
ctttgaaattgttta

SEQ ID NO: 2833857 - DNA, 16 bp, Homo sapiens
ctttgactcacctgtt

SEQ ID NO: 2833858 - DNA, 19 bp, Homo sapiens
ctttgactcacctgttact

SEQ ID NO: 2833859 - DNA, 14 bp, Homo sapiens
ctttgagaaagaaa

SEQ ID NO: 2833860 - DNA, 17 bp, Homo sapiens
ctttgaggacaaagaga

SEQ ID NO: 2833861 - DNA, 14 bp, Homo sapiens
ctttgattcagaca

SEQ ID NO: 2833862 - DNA, 18 bp, Homo sapiens
ctttgcacagctctccgg

SEQ ID NO: 2833863 - DNA, 13 bp, Homo sapiens
ctttgcactgagg

SEQ ID NO: 2833864 - DNA, 16 bp, Homo sapiens
ctttgccccaaggctg

SEQ ID NO: 2833865 - DNA, 19 bp, Homo sapiens
ctttgccccaaggctgctc

SEQ ID NO: 2833866 - DNA, 11 bp, Homo sapiens
ctttgcctgct

SEQ ID NO: 2833867 - DNA, 14 bp, Homo sapiens
ctttgcctgtgtga

SEQ ID NO: 2833868 - DNA, 17 bp, Homo sapiens
ctttgcctgtgtgagca

SEQ ID NO: 2833869 - DNA, 21 bp, Homo sapiens
ctttgcctgtgtgagcatctc

SEQ ID NO: 2833870 - DNA, 20 bp, Homo sapiens
ctttgcttcaaatccatcca

SEQ ID NO: 2833871 - DNA, 19 bp, Homo sapiens
ctttggctattagagatca

SEQ ID NO: 2833872 - DNA, 17 bp, Homo sapiens
ctttgggaggctgaggc

SEQ ID NO: 2833873 - DNA, 20 bp, Homo sapiens
ctttggggcttttacaccag

SEQ ID NO: 2833874 - DNA, 21 bp, Homo sapiens
ctttggggcttttacaccagt

SEQ ID NO: 2833875 - DNA, 19 bp, Homo sapiens
ctttgggtactactgctgc

SEQ ID NO: 2833876 - DNA, 23 bp, Homo sapiens
ctttgggtactactgctgcaaag

SEQ ID NO: 2833877 - DNA, 19 bp, Homo sapiens
ctttggttctctccaggaa

SEQ ID NO: 2833878 - DNA, 19 bp, Homo sapiens
ctttgtaatcgttatgtgt

SEQ ID NO: 2833879 - DNA, 21 bp, Homo sapiens
ctttgtaatcgttatgtgtgt

SEQ ID NO: 2833880 - DNA, 17 bp, Homo sapiens
ctttgtaatgtcaccac

SEQ ID NO: 2833881 - DNA, 21 bp, Homo sapiens
ctttgtaatgtcaccaccttc

SEQ ID NO: 2833882 - DNA, 18 bp, Homo sapiens
ctttgtcatctttcttct

SEQ ID NO: 2833883 - DNA, 22 bp, Homo sapiens
ctttgtgtaataaaaatttgtt

SEQ ID NO: 2833884 - DNA, 17 bp, Homo sapiens
cttttaaaaaggcagta

SEQ ID NO: 2833885 - DNA, 18 bp, Homo sapiens
cttttaaaacacttccat

SEQ ID NO: 2833886 - DNA, 14 bp, Homo sapiens
cttttaaaagaaaa

SEQ ID NO: 2833887 - DNA, 22 bp, Homo sapiens
cttttaacatttatctaaaaga

SEQ ID NO: 2833888 - DNA, 13 bp, Homo sapiens
cttttacaaaaca

SEQ ID NO: 2833889 - DNA, 17 bp, Homo sapiens
cttttactcctttgcat

SEQ ID NO: 2833890 - DNA, 21 bp, Homo sapiens
cttttagtaaagtcaaggaga

SEQ ID NO: 2833891 - DNA, 18 bp, Homo sapiens
cttttagttgtatctctt

SEQ ID NO: 2833892 - DNA, 22 bp, Homo sapiens
cttttataactagtcctttact

SEQ ID NO: 2833893 - DNA, 16 bp, Homo sapiens
cttttatcaaaatccc

SEQ ID NO: 2833894 - DNA, 17 bp, Homo sapiens
cttttatccacttacct

SEQ ID NO: 2833895 - DNA, 13 bp, Homo sapiens
cttttatttggaa

SEQ ID NO: 2833896 - DNA, 21 bp, Homo sapiens
cttttcaagttgagaacaaaa

SEQ ID NO: 2833897 - DNA, 16 bp, Homo sapiens
cttttctagcaactgt

SEQ ID NO: 2833898 - DNA, 16 bp, Homo sapiens
cttttctgaccaaaga

SEQ ID NO: 2833899 - DNA, 15 bp, Homo sapiens
cttttctgcagaggg

SEQ ID NO: 2833900 - DNA, 13 bp, Homo sapiens
cttttctttttcc

SEQ ID NO: 2833901 - DNA, 21 bp, Homo sapiens
cttttgaatccatgcttgggt

SEQ ID NO: 2833902 - DNA, 18 bp, Homo sapiens
cttttgacttaaagcaga

SEQ ID NO: 2833903 - DNA, 16 bp, Homo sapiens
cttttggtctgtgtga

SEQ ID NO: 2833904 - DNA, 10 bp, Homo sapiens
cttttgtaag

SEQ ID NO: 2833905 - DNA, 20 bp, Homo sapiens
cttttgtaagacaaaggttt

SEQ ID NO: 2833906 - DNA, 16 bp, Homo sapiens
cttttgtaccagtgtg

SEQ ID NO: 2833907 - DNA, 19 bp, Homo sapiens
cttttgtaccagtgtgaat

SEQ ID NO: 2833908 - DNA, 18 bp, Homo sapiens
cttttgtctatgggactc

SEQ ID NO: 2833909 - DNA, 16 bp, Homo sapiens
gaaatgaatttatctg

SEQ ID NO: 2833910 - DNA, 22 bp, Homo sapiens
gaaatgaatttatctgaatata

SEQ ID NO: 2833911 - DNA, 18 bp, Homo sapiens
gaaatgaggtcagagcct

SEQ ID NO: 2833912 - DNA, 14 bp, Homo sapiens
gaaatgctgttggt

SEQ ID NO: 2833913 - DNA, 22 bp, Homo sapiens
gaaatgcttgtggattgagggt

SEQ ID NO: 2833914 - DNA, 16 bp, Homo sapiens
gaaatggtatgagctg

SEQ ID NO: 2833915 - DNA, 23 bp, Homo sapiens
gaaatgtggtagcctcactttta

SEQ ID NO: 2833916 - DNA, 21 bp, Homo sapiens
gaaatgttattttttaattat

SEQ ID NO: 2833917 - DNA, 17 bp, Homo sapiens
gaaattacacccaaaga

SEQ ID NO: 2833918 - DNA, 18 bp, Homo sapiens
gaaattactacaaaattt

SEQ ID NO: 2833919 - DNA, 13 bp, Homo sapiens
gaaattagccggg

SEQ ID NO: 2833920 - DNA, 15 bp, Homo sapiens
gaaattatatctgtg

SEQ ID NO: 2833921 - DNA, 19 bp, Homo sapiens
gaaattatatctgtggtct

SEQ ID NO: 2833922 - DNA, 21 bp, Homo sapiens
gaaattcaacctgtgtcttat

SEQ ID NO: 2833923 - DNA, 16 bp, Homo sapiens
gaaattcacactgtgc

SEQ ID NO: 2833924 - DNA, 12 bp, Homo sapiens
gaaattcctgta

SEQ ID NO: 2833925 - DNA, 19 bp, Homo sapiens
gaaattcctgtagcatctt

SEQ ID NO: 2833926 - DNA, 21 bp, Homo sapiens
gaaattgtctagcagagcagg

SEQ ID NO: 2833927 - DNA, 13 bp, Homo sapiens
gaaatttaaacta

SEQ ID NO: 2833928 - DNA, 23 bp, Homo sapiens
gaaatttaaactataagcaagaa

SEQ ID NO: 2833929 - DNA, 22 bp, Homo sapiens
gaaatttaatatagctattttt

SEQ ID NO: 2833930 - DNA, 11 bp, Homo sapiens
gaaatttcaga

SEQ ID NO: 2833931 - DNA, 18 bp, Homo sapiens
gaaattttactgacagaa

SEQ ID NO: 2833932 - DNA, 21 bp, Homo sapiens
gaacaaaagttcgaaagaaaa

SEQ ID NO: 2833933 - DNA, 21 bp, Homo sapiens
gaacaaagaaaaaaatatatt

SEQ ID NO: 2833934 - DNA, 20 bp, Homo sapiens
gaacaaagggattctccagg

SEQ ID NO: 2833935 - DNA, 15 bp, Homo sapiens
gaacaaatctgggca

SEQ ID NO: 2833936 - DNA, 19 bp, Homo sapiens
gaacaactaggcttcagca

SEQ ID NO: 2833937 - DNA, 21 bp, Homo sapiens
gaacaactaggcttcagcata

SEQ ID NO: 2833938 - DNA, 18 bp, Homo sapiens
gaacaactatttataaac

SEQ ID NO: 2833939 - DNA, 23 bp, Homo sapiens
gaacaactatttataaactagat

SEQ ID NO: 2833940 - DNA, 19 bp, Homo sapiens
gaacaagttgtttcattga

SEQ ID NO: 2833941 - DNA, 21 bp, Homo sapiens
gaacaagttgtttcattgact

SEQ ID NO: 2833942 - DNA, 21 bp, Homo sapiens
gaacaatagctattgcatgta

SEQ ID NO: 2833943 - DNA, 23 bp, Homo sapiens
gaacaatagctattgcatgtaaa

SEQ ID NO: 2833944 - DNA, 13 bp, Homo sapiens
gaacaatgaatgc

SEQ ID NO: 2833945 - DNA, 16 bp, Homo sapiens
gaacaccaacttttat

SEQ ID NO: 2833946 - DNA, 18 bp, Homo sapiens
gaacacccggaaagactg

SEQ ID NO: 2833947 - DNA, 17 bp, Homo sapiens
gaacactgggggagggg

SEQ ID NO: 2833948 - DNA, 12 bp, Homo sapiens
gaacagaaggat

SEQ ID NO: 2833949 - DNA, 17 bp, Homo sapiens
gaacagacaacagaagt

SEQ ID NO: 2833950 - DNA, 16 bp, Homo sapiens
gaacagacaggagaaa

SEQ ID NO: 2833951 - DNA, 22 bp, Homo sapiens
gaacagccaaatgcatggtgca

SEQ ID NO: 2833952 - DNA, 18 bp, Homo sapiens
gaacagccgctcctgtct

SEQ ID NO: 2833953 - DNA, 21 bp, Homo sapiens
gaacagtcatgaggcagcttt

SEQ ID NO: 2833954 - DNA, 17 bp, Homo sapiens
gaacagtgtttcccata

SEQ ID NO: 2833955 - DNA, 16 bp, Homo sapiens
gaacatagacagaaga

SEQ ID NO: 2833956 - DNA, 14 bp, Homo sapiens
gaacatctgtgtgt

SEQ ID NO: 2833957 - DNA, 19 bp, Homo sapiens
gaacatgcacatttatata

SEQ ID NO: 2833958 - DNA, 20 bp, Homo sapiens
gaacatgccctcagctaagc

SEQ ID NO: 2833959 - DNA, 20 bp, Homo sapiens
gaacatgcctgattttaaaa

SEQ ID NO: 2833960 - DNA, 19 bp, Homo sapiens
gaacatgtcggagtagaaa

SEQ ID NO: 2833961 - DNA, 15 bp, Homo sapiens
gaaccaacactaaca

SEQ ID NO: 2833962 - DNA, 18 bp, Homo sapiens
gaaccaccacacccagcc

SEQ ID NO: 2833963 - DNA, 18 bp, Homo sapiens
gaaccagggagaccgagc

SEQ ID NO: 2833964 - DNA, 12 bp, Homo sapiens
gaacccacctgc

SEQ ID NO: 2833965 - DNA, 14 bp, Homo sapiens
gaacccacctgctg

SEQ ID NO: 2833966 - DNA, 19 bp, Homo sapiens
gaacccacctgctgagaga

SEQ ID NO: 2833967 - DNA, 12 bp, Homo sapiens
gaacccaggaca

SEQ ID NO: 2833968 - DNA, 13 bp, Homo sapiens
gaacccaggacaa

SEQ ID NO: 2833969 - DNA, 14 bp, Homo sapiens
gaacctggccttca

SEQ ID NO: 2833970 - DNA, 14 bp, Homo sapiens
gaacggggagaaaa

SEQ ID NO: 2833971 - DNA, 22 bp, Homo sapiens
gaactattggagggtgggagag

SEQ ID NO: 2833972 - DNA, 16 bp, Homo sapiens
gaactcaactttgaca

SEQ ID NO: 2833973 - DNA, 21 bp, Homo sapiens
gaactcagctgtctgtggctt

SEQ ID NO: 2833974 - DNA, 16 bp, Homo sapiens
gaactcgaagcccttc

SEQ ID NO: 2833975 - DNA, 22 bp, Homo sapiens
gaactcgaagcccttccagtgg

SEQ ID NO: 2833976 - DNA, 20 bp, Homo sapiens
gaactctaccctggtaggaa

SEQ ID NO: 2833977 - DNA, 17 bp, Homo sapiens
gaactctctccacccta

SEQ ID NO: 2833978 - DNA, 16 bp, Homo sapiens
gaactctggcttccag

SEQ ID NO: 2833979 - DNA, 17 bp, Homo sapiens
gaactctggcttccagg

SEQ ID NO: 2833980 - DNA, 19 bp, Homo sapiens
gaactctggcttccaggta

SEQ ID NO: 2833981 - DNA, 13 bp, Homo sapiens
gaactcttaatca

SEQ ID NO: 2833982 - DNA, 19 bp, Homo sapiens
gaactgaacgtcctgcagc

SEQ ID NO: 2833983 - DNA, 19 bp, Homo sapiens
gaactgagcctagctacct

SEQ ID NO: 2833984 - DNA, 21 bp, Homo sapiens
gaactgattcacatctcattt

SEQ ID NO: 2833985 - DNA, 23 bp, Homo sapiens
gaactgattcacatctcattttt

SEQ ID NO: 2833986 - DNA, 14 bp, Homo sapiens
gaactgccaagaaa

SEQ ID NO: 2833987 - DNA, 15 bp, Homo sapiens
gaactggaacacaca

SEQ ID NO: 2833988 - DNA, 14 bp, Homo sapiens
gaactggagggtga

SEQ ID NO: 2833989 - DNA, 14 bp, Homo sapiens
gaactggccaagct

SEQ ID NO: 2833990 - DNA, 15 bp, Homo sapiens
gaactggccaagctg

SEQ ID NO: 2833991 - DNA, 18 bp, Homo sapiens
gaactggccaagctgagg

SEQ ID NO: 2833992 - DNA, 11 bp, Homo sapiens
gaactggctgc

SEQ ID NO: 2833993 - DNA, 17 bp, Homo sapiens
gaactgtctctcatgaa

SEQ ID NO: 2833994 - DNA, 15 bp, Homo sapiens
gaactgtgacaggaa

SEQ ID NO: 2833995 - DNA, 15 bp, Homo sapiens
gaacttaaataaatg

SEQ ID NO: 2833996 - DNA, 18 bp, Homo sapiens
gaacttgaggacacatgt

SEQ ID NO: 2833997 - DNA, 21 bp, Homo sapiens
gaacttgaggacacatgtcca

SEQ ID NO: 2833998 - DNA, 13 bp, Homo sapiens
gaagaaaagcact

SEQ ID NO: 2833999 - DNA, 22 bp, Homo sapiens
gaataaataaatgtatcttatt

SEQ ID NO: 2834000 - DNA, 22 bp, Homo sapiens
gaataaccacttaaaaaatgtc

SEQ ID NO: 2834001 - DNA, 13 bp, Homo sapiens
gaataagccatga

SEQ ID NO: 2834002 - DNA, 23 bp, Homo sapiens
gaataaggtacaagaagcatttt

SEQ ID NO: 2834003 - DNA, 18 bp, Homo sapiens
gaataagtgctgtttgag

SEQ ID NO: 2834004 - DNA, 21 bp, Homo sapiens
gaataagtgctgtttgagatg

SEQ ID NO: 2834005 - DNA, 22 bp, Homo sapiens
gaataataattatccagagttt

SEQ ID NO: 2834006 - DNA, 12 bp, Homo sapiens
gaataatagaag

SEQ ID NO: 2834007 - DNA, 19 bp, Homo sapiens
gaataatatgctgccaaat

SEQ ID NO: 2834008 - DNA, 17 bp, Homo sapiens
gaataattgtgtacaaa

SEQ ID NO: 2834009 - DNA, 14 bp, Homo sapiens
gaatacagaaaatg

SEQ ID NO: 2834010 - DNA, 23 bp, Homo sapiens
gaatacagggcatgcattttgca

SEQ ID NO: 2834011 - DNA, 21 bp, Homo sapiens
gaatacagtaagctgctctat

SEQ ID NO: 2834012 - DNA, 14 bp, Homo sapiens
gaatataaacacta

SEQ ID NO: 2834013 - DNA, 21 bp, Homo sapiens
gaatataaacactatatggca

SEQ ID NO: 2834014 - DNA, 20 bp, Homo sapiens
gaatataattgttttatctg

SEQ ID NO: 2834015 - DNA, 14 bp, Homo sapiens
gaatataggaagca

SEQ ID NO: 2834016 - DNA, 14 bp, Homo sapiens
gaatatgacagctg

SEQ ID NO: 2834017 - DNA, 15 bp, Homo sapiens
gaatatgactgtttt

SEQ ID NO: 2834018 - DNA, 16 bp, Homo sapiens
gaatatggacaaagaa

SEQ ID NO: 2834019 - DNA, 13 bp, Homo sapiens
gaatattaatccc

SEQ ID NO: 2834020 - DNA, 12 bp, Homo sapiens
gaatattcagga

SEQ ID NO: 2834021 - DNA, 15 bp, Homo sapiens
gaatattcaggactt

SEQ ID NO: 2834022 - DNA, 18 bp, Homo sapiens
gaatatttattacctctg

SEQ ID NO: 2834023 - DNA, 15 bp, Homo sapiens
gaatcaaaactctcc

SEQ ID NO: 2834024 - DNA, 20 bp, Homo sapiens
gaatcaagatgtcagactgg

SEQ ID NO: 2834025 - DNA, 19 bp, Homo sapiens
gaatcagacttcacactgc

SEQ ID NO: 2834026 - DNA, 19 bp, Homo sapiens
gaatccatcaggacttggg

SEQ ID NO: 2834027 - DNA, 18 bp, Homo sapiens
gaatcccacccacatgtg

SEQ ID NO: 2834028 - DNA, 20 bp, Homo sapiens
gaatcctaggctccacccca

SEQ ID NO: 2834029 - DNA, 14 bp, Homo sapiens
gaatcctgtcgatt

SEQ ID NO: 2834030 - DNA, 22 bp, Homo sapiens
gaatcctgtcgattagactgga

SEQ ID NO: 2834031 - DNA, 14 bp, Homo sapiens
gaatctcagagaca

SEQ ID NO: 2834032 - DNA, 12 bp, Homo sapiens
gaatctcccctc

SEQ ID NO: 2834033 - DNA, 14 bp, Homo sapiens
gaatgaaagggccc

SEQ ID NO: 2834034 - DNA, 21 bp, Homo sapiens
gaatgaaagggcccagagagg

SEQ ID NO: 2834035 - DNA, 15 bp, Homo sapiens
gaatgaagcatgtag

SEQ ID NO: 2834036 - DNA, 12 bp, Homo sapiens
gaatgacactgt

SEQ ID NO: 2834037 - DNA, 22 bp, Homo sapiens
gaatgacatcaacattccccca

SEQ ID NO: 2834038 - DNA, 14 bp, Homo sapiens
gaatgagagtgtga

SEQ ID NO: 2834039 - DNA, 14 bp, Homo sapiens
gaatgaggtcccag

SEQ ID NO: 2834040 - DNA, 22 bp, Homo sapiens
gaatgaggtcccaggcagagaa

SEQ ID NO: 2834041 - DNA, 22 bp, Homo sapiens
gaatgatttccaaagagaaaaa

SEQ ID NO: 2834042 - DNA, 21 bp, Homo sapiens
gaatgcctcaatgtgaccagg

SEQ ID NO: 2834043 - DNA, 21 bp, Homo sapiens
gaatgcggccgcattccctga

SEQ ID NO: 2834044 - DNA, 22 bp, Homo sapiens
gaatgctcaagtttttcagaaa

SEQ ID NO: 2834045 - DNA, 18 bp, Homo sapiens
gaatgctggttttcctaa

SEQ ID NO: 2834046 - DNA, 22 bp, Homo sapiens
gaatgctggttttcctaaatgc

SEQ ID NO: 2834047 - DNA, 17 bp, Homo sapiens
gaatggctatgttttta

SEQ ID NO: 2834048 - DNA, 11 bp, Homo sapiens
gaatgtaatca

SEQ ID NO: 2834049 - DNA, 16 bp, Homo sapiens
gaatgtaatcaatgtt

SEQ ID NO: 2834050 - DNA, 18 bp, Homo sapiens
gaatgtaatcaatgtttc

SEQ ID NO: 2834051 - DNA, 16 bp, Homo sapiens
gaatgttaaagtcagt

SEQ ID NO: 2834052 - DNA, 17 bp, Homo sapiens
gaatgttacattgtttg

SEQ ID NO: 2834053 - DNA, 22 bp, Homo sapiens
gaatgtttgaactgccaagaaa

SEQ ID NO: 2834054 - DNA, 17 bp, Homo sapiens
gaatgtttgcctctgcc

SEQ ID NO: 2834055 - DNA, 22 bp, Homo sapiens
gaattaccttagattagctctg

SEQ ID NO: 2834056 - DNA, 23 bp, Homo sapiens
gaattatatctaatttatacaaa

SEQ ID NO: 2834057 - DNA, 12 bp, Homo sapiens
gaattattttgt

SEQ ID NO: 2834058 - DNA, 12 bp, Homo sapiens
gaattcccaggt

SEQ ID NO: 2834059 - DNA, 20 bp, Homo sapiens
gaattctaagattgtacata

SEQ ID NO: 2834060 - DNA, 23 bp, Homo sapiens
gaattctaggcatcccaggggac

SEQ ID NO: 2834061 - DNA, 18 bp, Homo sapiens
gaattctgctacctcact

SEQ ID NO: 2834062 - DNA, 19 bp, Homo sapiens
gaattctgctacctcactg

SEQ ID NO: 2834063 - DNA, 16 bp, Homo sapiens
gaattctgtgaagaat

SEQ ID NO: 2834064 - DNA, 18 bp, Homo sapiens
gaattctgtgaagaatga

SEQ ID NO: 2834065 - DNA, 19 bp, Homo sapiens
gaattgaaggagaaaatgc

SEQ ID NO: 2834066 - DNA, 20 bp, Homo sapiens
gaattgaaggagaaaatgca

SEQ ID NO: 2834067 - DNA, 15 bp, Homo sapiens
gaattgagtgtttaa

SEQ ID NO: 2834068 - DNA, 16 bp, Homo sapiens
gaattgcctgcagaga

SEQ ID NO: 2834069 - DNA, 22 bp, Homo sapiens
gaattggaccatcctatttaac

SEQ ID NO: 2834070 - DNA, 13 bp, Homo sapiens
gaattgggaagct

SEQ ID NO: 2834071 - DNA, 16 bp, Homo sapiens
gaattgggagcttggg

SEQ ID NO: 2834072 - DNA, 14 bp, Homo sapiens
gaatttaattaatc

SEQ ID NO: 2834073 - DNA, 13 bp, Homo sapiens
gaatttattcaat

SEQ ID NO: 2834074 - DNA, 17 bp, Homo sapiens
gaatttctaaaaaacag

SEQ ID NO: 2834075 - DNA, 21 bp, Homo sapiens
gaatttggtgtggctgtattc

SEQ ID NO: 2834076 - DNA, 14 bp, Homo sapiens
gaatttgtattttg

SEQ ID NO: 2834077 - DNA, 15 bp, Homo sapiens
gaatttttaatgact

SEQ ID NO: 2834078 - DNA, 22 bp, Homo sapiens
gaatttttttttcctagccctc

SEQ ID NO: 2834079 - DNA, 19 bp, Homo sapiens
gacaaacacctcccaggag

SEQ ID NO: 2834080 - DNA, 18 bp, Homo sapiens
gacaaagggaaggctgct

SEQ ID NO: 2834081 - DNA, 18 bp, Homo sapiens
gacaaaggttttcctctt

SEQ ID NO: 2834082 - DNA, 23 bp, Homo sapiens
gacaacaggttttcaccatagcc

SEQ ID NO: 2834083 - DNA, 22 bp, Homo sapiens
gacaacatttctatagccaaaa

SEQ ID NO: 2834084 - DNA, 12 bp, Homo sapiens
gacaacccagaa

SEQ ID NO: 2834085 - DNA, 13 bp, Homo sapiens
gacaacctttgtg

SEQ ID NO: 2834086 - DNA, 15 bp, Homo sapiens
gacaagaagctgcta

SEQ ID NO: 2834087 - DNA, 21 bp, Homo sapiens
gacaagcatggtcccacatcc

SEQ ID NO: 2834088 - DNA, 23 bp, Homo sapiens
gacaagccaacttgtaaatacac

SEQ ID NO: 2834089 - DNA, 13 bp, Homo sapiens
gactcctcccaca

SEQ ID NO: 2834090 - DNA, 11 bp, Homo sapiens
gactcctctgt

SEQ ID NO: 2834091 - DNA, 16 bp, Homo sapiens
gactcctgtgcaactt

SEQ ID NO: 2834092 - DNA, 21 bp, Homo sapiens
gactctacagaggccatgggc

SEQ ID NO: 2834093 - DNA, 19 bp, Homo sapiens
gactctgaggctctttctg

SEQ ID NO: 2834094 - DNA, 22 bp, Homo sapiens
gactctgaggctctttctgggc

SEQ ID NO: 2834095 - DNA, 12 bp, Homo sapiens
gactctgcacat

SEQ ID NO: 2834096 - DNA, 19 bp, Homo sapiens
gactctgtctcaaaaaaac

SEQ ID NO: 2834097 - DNA, 14 bp, Homo sapiens
gactcttgcctttc

SEQ ID NO: 2834098 - DNA, 20 bp, Homo sapiens
gactcttgcctttccacctg

SEQ ID NO: 2834099 - DNA, 21 bp, Homo sapiens
gactcttgcctttccacctgc

SEQ ID NO: 2834100 - DNA, 9 bp, Homo sapiens
gactcttgt

SEQ ID NO: 2834101 - DNA, 15 bp, Homo sapiens
gactgagcacctgct

SEQ ID NO: 2834102 - DNA, 16 bp, Homo sapiens
gactgagcacctgctt

SEQ ID NO: 2834103 - DNA, 22 bp, Homo sapiens
gactgagtcctcgtagccatct

SEQ ID NO: 2834104 - DNA, 19 bp, Homo sapiens
gactgatgacaaacccagg

SEQ ID NO: 2834105 - DNA, 20 bp, Homo sapiens
gactgccagtccccctgccc

SEQ ID NO: 2834106 - DNA, 21 bp, Homo sapiens
gactgcgggatggtcctgggg

SEQ ID NO: 2834107 - DNA, 15 bp, Homo sapiens
gactgctagggagtg

SEQ ID NO: 2834108 - DNA, 15 bp, Homo sapiens
gactggaaccaggga

SEQ ID NO: 2834109 - DNA, 15 bp, Homo sapiens
gactggaagcacagc

SEQ ID NO: 2834110 - DNA, 18 bp, Homo sapiens
gactggaagcacagcttc

SEQ ID NO: 2834111 - DNA, 14 bp, Homo sapiens
gactggacagcttg

SEQ ID NO: 2834112 - DNA, 14 bp, Homo sapiens
gactggctggctgc

SEQ ID NO: 2834113 - DNA, 19 bp, Homo sapiens
gactggtgctataggctgg

SEQ ID NO: 2834114 - DNA, 23 bp, Homo sapiens
gactggtgctataggctggagaa

SEQ ID NO: 2834115 - DNA, 17 bp, Homo sapiens
gactgtacttattttcc

SEQ ID NO: 2834116 - DNA, 16 bp, Homo sapiens
gactgtcgtgtttaca

SEQ ID NO: 2834117 - DNA, 11 bp, Homo sapiens
gactgtgaaag

SEQ ID NO: 2834118 - DNA, 20 bp, Homo sapiens
gactgtgaaagtatgtgata

SEQ ID NO: 2834119 - DNA, 20 bp, Homo sapiens
gactgtgttcagtgccttgg

SEQ ID NO: 2834120 - DNA, 19 bp, Homo sapiens
gactgtttttcggacagtt

SEQ ID NO: 2834121 - DNA, 16 bp, Homo sapiens
gacttaacggctccag

SEQ ID NO: 2834122 - DNA, 22 bp, Homo sapiens
gacttactgtttcttaccttaa

SEQ ID NO: 2834123 - DNA, 22 bp, Homo sapiens
gacttcacactgcaagagcctt

SEQ ID NO: 2834124 - DNA, 19 bp, Homo sapiens
gacttcagtcctggtctgc

SEQ ID NO: 2834125 - DNA, 13 bp, Homo sapiens
gacttcatgttca

SEQ ID NO: 2834126 - DNA, 15 bp, Homo sapiens
gacttcgactcagga

SEQ ID NO: 2834127 - DNA, 14 bp, Homo sapiens
gacttctctttctt

SEQ ID NO: 2834128 - DNA, 18 bp, Homo sapiens
gacttctctttgcctcaa

SEQ ID NO: 2834129 - DNA, 16 bp, Homo sapiens
gacttgacagaacact

SEQ ID NO: 2834130 - DNA, 21 bp, Homo sapiens
gacttgagcctccatttctgg

SEQ ID NO: 2834131 - DNA, 16 bp, Homo sapiens
gacttggaagctccgc

SEQ ID NO: 2834132 - DNA, 20 bp, Homo sapiens
gacttggggagatggagttc

SEQ ID NO: 2834133 - DNA, 14 bp, Homo sapiens
gactttaattgtgt

SEQ ID NO: 2834134 - DNA, 21 bp, Homo sapiens
gactttatctaatacctctgt

SEQ ID NO: 2834135 - DNA, 18 bp, Homo sapiens
gagaaacccaccagccta

SEQ ID NO: 2834136 - DNA, 13 bp, Homo sapiens
gagaaacctccgg

SEQ ID NO: 2834137 - DNA, 12 bp, Homo sapiens
gagaaagaaata

SEQ ID NO: 2834138 - DNA, 22 bp, Homo sapiens
gagaaagtacttctccaccctg

SEQ ID NO: 2834139 - DNA, 20 bp, Homo sapiens
gagaagaattttcagacccc

SEQ ID NO: 2834140 - DNA, 19 bp, Homo sapiens
gagaagagggcctgtggga

SEQ ID NO: 2834141 - DNA, 18 bp, Homo sapiens
gagaagcagtgagccgca

SEQ ID NO: 2834142 - DNA, 14 bp, Homo sapiens
gagaaggaaggaga

SEQ ID NO: 2834143 - DNA, 13 bp, Homo sapiens
gagaaggcaggaa

SEQ ID NO: 2834144 - DNA, 19 bp, Homo sapiens
gagaagggggattggaggg

SEQ ID NO: 2834145 - DNA, 21 bp, Homo sapiens
gagaagtatccaattatgtga

SEQ ID NO: 2834146 - DNA, 16 bp, Homo sapiens
gagaagtttctggccc

SEQ ID NO: 2834147 - DNA, 19 bp, Homo sapiens
gagaataattgtgtacaaa

SEQ ID NO: 2834148 - DNA, 21 bp, Homo sapiens
gagaatcatacttagcaaagt

SEQ ID NO: 2834149 - DNA, 18 bp, Homo sapiens
gagaatcgacctcactgt

SEQ ID NO: 2834150 - DNA, 22 bp, Homo sapiens
gagaatctatatttaacaagat

SEQ ID NO: 2834151 - DNA, 16 bp, Homo sapiens
gagaatctgaagctat

SEQ ID NO: 2834152 - DNA, 13 bp, Homo sapiens
gagaatgagcctc

SEQ ID NO: 2834153 - DNA, 17 bp, Homo sapiens
gagaattgggattacat

SEQ ID NO: 2834154 - DNA, 15 bp, Homo sapiens
gagaattgtatcatt

SEQ ID NO: 2834155 - DNA, 21 bp, Homo sapiens
gagaatttctaccatttcaga

SEQ ID NO: 2834156 - DNA, 15 bp, Homo sapiens
gagaattttaaatta

SEQ ID NO: 2834157 - DNA, 15 bp, Homo sapiens
gagacacctgcacct

SEQ ID NO: 2834158 - DNA, 18 bp, Homo sapiens
gagacacctgcacctccc

SEQ ID NO: 2834159 - DNA, 21 bp, Homo sapiens
gagacacctgcacctcccccc

SEQ ID NO: 2834160 - DNA, 9 bp, Homo sapiens
gagacagag

SEQ ID NO: 2834161 - DNA, 16 bp, Homo sapiens
gagacaggacctgact

SEQ ID NO: 2834162 - DNA, 16 bp, Homo sapiens
gagacattaactcatt

SEQ ID NO: 2834163 - DNA, 14 bp, Homo sapiens
gagaccaacctgac

SEQ ID NO: 2834164 - DNA, 23 bp, Homo sapiens
gagaccaagactctgaaatctca

SEQ ID NO: 2834165 - DNA, 16 bp, Homo sapiens
gagaccagcctgggca

SEQ ID NO: 2834166 - DNA, 14 bp, Homo sapiens
gagaccagctcaga

SEQ ID NO: 2834167 - DNA, 20 bp, Homo sapiens
gagaccagttgggagcactg

SEQ ID NO: 2834168 - DNA, 22 bp, Homo sapiens
gagaccagttgggagcactgga

SEQ ID NO: 2834169 - DNA, 13 bp, Homo sapiens
gagacccagatct

SEQ ID NO: 2834170 - DNA, 12 bp, Homo sapiens
gagaccccttcc

SEQ ID NO: 2834171 - DNA, 15 bp, Homo sapiens
gagaccccttccttt

SEQ ID NO: 2834172 - DNA, 17 bp, Homo sapiens
gagaccctacaggagag

SEQ ID NO: 2834173 - DNA, 14 bp, Homo sapiens
gagacctcagccat

SEQ ID NO: 2834174 - DNA, 10 bp, Homo sapiens
gagacctggt

SEQ ID NO: 2834175 - DNA, 21 bp, Homo sapiens
gagacggaggttgcagtgagc

SEQ ID NO: 2834176 - DNA, 15 bp, Homo sapiens
gagactaagccctgt

SEQ ID NO: 2834177 - DNA, 15 bp, Homo sapiens
gagactcacctctgc

SEQ ID NO: 2834178 - DNA, 23 bp, Homo sapiens
gagactcacctctgcctcaatgt

SEQ ID NO: 2834179 - DNA, 12 bp, Homo sapiens
gagactctgtgg

SEQ ID NO: 2834180 - DNA, 15 bp, Homo sapiens
gagtgaaccatcatt

SEQ ID NO: 2834181 - DNA, 15 bp, Homo sapiens
gagtgacagaggcag

SEQ ID NO: 2834182 - DNA, 15 bp, Homo sapiens
gagtgactcgagggt

SEQ ID NO: 2834183 - DNA, 13 bp, Homo sapiens
gagtgagaccctg

SEQ ID NO: 2834184 - DNA, 14 bp, Homo sapiens
gagtgagactctgt

SEQ ID NO: 2834185 - DNA, 13 bp, Homo sapiens
gagtgagccacag

SEQ ID NO: 2834186 - DNA, 20 bp, Homo sapiens
gagtgccaggactccccagg

SEQ ID NO: 2834187 - DNA, 17 bp, Homo sapiens
gagtggatctccaagga

SEQ ID NO: 2834188 - DNA, 19 bp, Homo sapiens
gagtggatctccaaggacc

SEQ ID NO: 2834189 - DNA, 22 bp, Homo sapiens
gagtggatctccaaggaccagg

SEQ ID NO: 2834190 - DNA, 15 bp, Homo sapiens
gagtggccggggaag

SEQ ID NO: 2834191 - DNA, 21 bp, Homo sapiens
gagtgggggctgtgccgtgaa

SEQ ID NO: 2834192 - DNA, 11 bp, Homo sapiens
gagtgtagtga

SEQ ID NO: 2834193 - DNA, 12 bp, Homo sapiens
gagtgtgggaag

SEQ ID NO: 2834194 - DNA, 18 bp, Homo sapiens
gagttagtttctttggga

SEQ ID NO: 2834195 - DNA, 16 bp, Homo sapiens
gagttataaaaataca

SEQ ID NO: 2834196 - DNA, 20 bp, Homo sapiens
gagttcataccctgttacca

SEQ ID NO: 2834197 - DNA, 17 bp, Homo sapiens
gagttccatgaagacca

SEQ ID NO: 2834198 - DNA, 20 bp, Homo sapiens
gagttctttaggtgcctcct

SEQ ID NO: 2834199 - DNA, 22 bp, Homo sapiens
gagttctttaggtgcctcctgt

SEQ ID NO: 2834200 - DNA, 23 bp, Homo sapiens
gagttgacttgacagaacactgt

SEQ ID NO: 2834201 - DNA, 16 bp, Homo sapiens
gagttgtggaaagcct

SEQ ID NO: 2834202 - DNA, 15 bp, Homo sapiens
gagtttcgaggtaga

SEQ ID NO: 2834203 - DNA, 22 bp, Homo sapiens
gagtttgaaggaggtgagggat

SEQ ID NO: 2834204 - DNA, 18 bp, Homo sapiens
gagtttttatggggctga

SEQ ID NO: 2834205 - DNA, 18 bp, Homo sapiens
gataaataatcggcccac

SEQ ID NO: 2834206 - DNA, 13 bp, Homo sapiens
gataacaaaatca

SEQ ID NO: 2834207 - DNA, 17 bp, Homo sapiens
gataacaaaatcacaag

SEQ ID NO: 2834208 - DNA, 21 bp, Homo sapiens
gataactgaaaattatttaaa

SEQ ID NO: 2834209 - DNA, 12 bp, Homo sapiens
gataagtggaaa

SEQ ID NO: 2834210 - DNA, 13 bp, Homo sapiens
gataagtggaaaa

SEQ ID NO: 2834211 - DNA, 19 bp, Homo sapiens
gataagtggaaaaaagaga

SEQ ID NO: 2834212 - DNA, 22 bp, Homo sapiens
gataagtggaaaaaagagaaaa

SEQ ID NO: 2834213 - DNA, 14 bp, Homo sapiens
gataatatctgtga

SEQ ID NO: 2834214 - DNA, 16 bp, Homo sapiens
gataatcagcctctta

SEQ ID NO: 2834215 - DNA, 14 bp, Homo sapiens
gataatgaacagaa

SEQ ID NO: 2834216 - DNA, 19 bp, Homo sapiens
gataatgctgttgcctcat

SEQ ID NO: 2834217 - DNA, 14 bp, Homo sapiens
gataattataatat

SEQ ID NO: 2834218 - DNA, 18 bp, Homo sapiens
gataattttaaattctct

SEQ ID NO: 2834219 - DNA, 12 bp, Homo sapiens
gatacattccct

SEQ ID NO: 2834220 - DNA, 20 bp, Homo sapiens
gataccaggttgaaagacct

SEQ ID NO: 2834221 - DNA, 13 bp, Homo sapiens
gatactctgtcag

SEQ ID NO: 2834222 - DNA, 20 bp, Homo sapiens
gatactggaagttttgcatt

SEQ ID NO: 2834223 - DNA, 12 bp, Homo sapiens
gatagaatgaca

SEQ ID NO: 2834224 - DNA, 20 bp, Homo sapiens
gatagctttattttttaagt

SEQ ID NO: 2834225 - DNA, 23 bp, Homo sapiens
gatagggaagagagaaacattta

SEQ ID NO: 2834226 - DNA, 18 bp, Homo sapiens
gatagtagcatacattta

SEQ ID NO: 2834227 - DNA, 13 bp, Homo sapiens
gatagtgctttat

SEQ ID NO: 2834228 - DNA, 15 bp, Homo sapiens
gatatagaaagctgt

SEQ ID NO: 2834229 - DNA, 14 bp, Homo sapiens
gatatatctgaaaa

SEQ ID NO: 2834230 - DNA, 11 bp, Homo sapiens
gatatatgtat

SEQ ID NO: 2834231 - DNA, 12 bp, Homo sapiens
gatatatgtatt

SEQ ID NO: 2834232 - DNA, 13 bp, Homo sapiens
gatatatgtattt

SEQ ID NO: 2834233 - DNA, 23 bp, Homo sapiens
gatatatgtatttattgtcatta

SEQ ID NO: 2834234 - DNA, 17 bp, Homo sapiens
gatatatttttcacagt

SEQ ID NO: 2834235 - DNA, 13 bp, Homo sapiens
gatatctcatctc

SEQ ID NO: 2834236 - DNA, 15 bp, Homo sapiens
gatatgaaaaatatg

SEQ ID NO: 2834237 - DNA, 19 bp, Homo sapiens
gatatgtaaaacatttatt

SEQ ID NO: 2834238 - DNA, 19 bp, Homo sapiens
gatatttattgagtgccca

SEQ ID NO: 2834239 - DNA, 19 bp, Homo sapiens
gatatttccatttcttcct

SEQ ID NO: 2834240 - DNA, 22 bp, Homo sapiens
gatatttccatttcttcctcac

SEQ ID NO: 2834241 - DNA, 22 bp, Homo sapiens
gatcaaaccccgaccacctgcc

SEQ ID NO: 2834242 - DNA, 14 bp, Homo sapiens
gatcaaagttcctg

SEQ ID NO: 2834243 - DNA, 21 bp, Homo sapiens
gatcaaccccttcgctcctgt

SEQ ID NO: 2834244 - DNA, 15 bp, Homo sapiens
gatcaattaaatgta

SEQ ID NO: 2834245 - DNA, 13 bp, Homo sapiens
gatcacagggccc

SEQ ID NO: 2834246 - DNA, 20 bp, Homo sapiens
gatcacagggccccagaagg

SEQ ID NO: 2834247 - DNA, 15 bp, Homo sapiens
gatcaccagcccggc

SEQ ID NO: 2834248 - DNA, 20 bp, Homo sapiens
gatcaccagcccggcctgct

SEQ ID NO: 2834249 - DNA, 15 bp, Homo sapiens
gatcacggctcactg

SEQ ID NO: 2834250 - DNA, 16 bp, Homo sapiens
gatcacggctcactgc

SEQ ID NO: 2834251 - DNA, 20 bp, Homo sapiens
gatcacggctcactgcagcc

SEQ ID NO: 2834252 - DNA, 16 bp, Homo sapiens
gatcagctgtttgtca

SEQ ID NO: 2834253 - DNA, 17 bp, Homo sapiens
gatcagctgtttgtcat

SEQ ID NO: 2834254 - DNA, 18 bp, Homo sapiens
gatcagttataagtagca

SEQ ID NO: 2834255 - DNA, 16 bp, Homo sapiens
gatcatccactgtgcc

SEQ ID NO: 2834256 - DNA, 13 bp, Homo sapiens
gatcatgaaaagt

SEQ ID NO: 2834257 - DNA, 14 bp, Homo sapiens
gatcatgaaaagtg

SEQ ID NO: 2834258 - DNA, 19 bp, Homo sapiens
gatccaagctggtcccact

SEQ ID NO: 2834259 - DNA, 17 bp, Homo sapiens
gatccacacacagagga

SEQ ID NO: 2834260 - DNA, 18 bp, Homo sapiens
gatccacccacctcagcc

SEQ ID NO: 2834261 - DNA, 20 bp, Homo sapiens
gatcccatccatcagctccc

SEQ ID NO: 2834262 - DNA, 20 bp, Homo sapiens
gatccctgttacccagagaa

SEQ ID NO: 2834263 - DNA, 18 bp, Homo sapiens
gatcctattctcaccagg

SEQ ID NO: 2834264 - DNA, 21 bp, Homo sapiens
gatcctcccacctcagcctcc

SEQ ID NO: 2834265 - DNA, 20 bp, Homo sapiens
gatcctgtctttaaggaaaa

SEQ ID NO: 2834266 - DNA, 16 bp, Homo sapiens
gatcgtattaattatc

SEQ ID NO: 2834267 - DNA, 23 bp, Homo sapiens
gatcgtgccgttactctccaacc

SEQ ID NO: 2834268 - DNA, 20 bp, Homo sapiens
gatctagaatgtgttttctg

SEQ ID NO: 2834269 - DNA, 14 bp, Homo sapiens
gatctatgcaattt

SEQ ID NO: 2834270 - DNA, 22 bp, Homo sapiens
gatctatgcaatttttaaacta

SEQ ID NO: 2834271 - DNA, 16 bp, Homo sapiens
gcacgcctgcccagcc

SEQ ID NO: 2834272 - DNA, 13 bp, Homo sapiens
gcacggcagcttg

SEQ ID NO: 2834273 - DNA, 20 bp, Homo sapiens
gcacggcagcttgagcctgt

SEQ ID NO: 2834274 - DNA, 19 bp, Homo sapiens
gcacgtttgtgagaagaaa

SEQ ID NO: 2834275 - DNA, 17 bp, Homo sapiens
gcactaaggtgtgctct

SEQ ID NO: 2834276 - DNA, 19 bp, Homo sapiens
gcactcaaccaacctcccc

SEQ ID NO: 2834277 - DNA, 14 bp, Homo sapiens
gcactcacatgccg

SEQ ID NO: 2834278 - DNA, 17 bp, Homo sapiens
gcactcacccatgtgcc

SEQ ID NO: 2834279 - DNA, 22 bp, Homo sapiens
gcactcagaaaagaaaaccatt

SEQ ID NO: 2834280 - DNA, 12 bp, Homo sapiens
gcactccagcct

SEQ ID NO: 2834281 - DNA, 14 bp, Homo sapiens
gcactccagcctgg

SEQ ID NO: 2834282 - DNA, 17 bp, Homo sapiens
gcactccagcctgggca

SEQ ID NO: 2834283 - DNA, 17 bp, Homo sapiens
gcactccggcctgatga

SEQ ID NO: 2834284 - DNA, 17 bp, Homo sapiens
gcactcctctgtctctg

SEQ ID NO: 2834285 - DNA, 19 bp, Homo sapiens
gcactctctaaatcttcct

SEQ ID NO: 2834286 - DNA, 22 bp, Homo sapiens
gcactctctaaatcttccttgt

SEQ ID NO: 2834287 - DNA, 21 bp, Homo sapiens
gcactgagatatttattgttt

SEQ ID NO: 2834288 - DNA, 12 bp, Homo sapiens
gcactgagggcc

SEQ ID NO: 2834289 - DNA, 16 bp, Homo sapiens
gcactgagggccacac

SEQ ID NO: 2834290 - DNA, 24 bp, Homo sapiens
gcactgagggccacactattacca

SEQ ID NO: 2834291 - DNA, 21 bp, Homo sapiens
gcactgctaggcgagtgccag

SEQ ID NO: 2834292 - DNA, 22 bp, Homo sapiens
gcactgctaggcgagtgccagg

SEQ ID NO: 2834293 - DNA, 23 bp, Homo sapiens
gcactgctaggcgagtgccagga

SEQ ID NO: 2834294 - DNA, 14 bp, Homo sapiens
gcactgctgcccag

SEQ ID NO: 2834295 - DNA, 15 bp, Homo sapiens
gcactggccccaccc

SEQ ID NO: 2834296 - DNA, 13 bp, Homo sapiens
gcacttggagcca

SEQ ID NO: 2834297 - DNA, 15 bp, Homo sapiens
gcacttggctgcata

SEQ ID NO: 2834298 - DNA, 16 bp, Homo sapiens
gcactttaaccctctc

SEQ ID NO: 2834299 - DNA, 18 bp, Homo sapiens
gcactttaaccctctctt

SEQ ID NO: 2834300 - DNA, 21 bp, Homo sapiens
gcactttaaccctctcttccc

SEQ ID NO: 2834301 - DNA, 22 bp, Homo sapiens
gcactttaaccctctcttccct

SEQ ID NO: 2834302 - DNA, 16 bp, Homo sapiens
gcactttgggaggctg

SEQ ID NO: 2834303 - DNA, 17 bp, Homo sapiens
gcagaaaagcacctgcc

SEQ ID NO: 2834304 - DNA, 23 bp, Homo sapiens
gcagaaaagtgcttagaaagtta

SEQ ID NO: 2834305 - DNA, 23 bp, Homo sapiens
gcagaacagccgctcctgtctgc

SEQ ID NO: 2834306 - DNA, 18 bp, Homo sapiens
gcagaataatctttgggt

SEQ ID NO: 2834307 - DNA, 23 bp, Homo sapiens
gcagaatcctaggctccacccca

SEQ ID NO: 2834308 - DNA, 20 bp, Homo sapiens
gcagacacctgtgcacccca

SEQ ID NO: 2834309 - DNA, 13 bp, Homo sapiens
gcagacagcagct

SEQ ID NO: 2834310 - DNA, 14 bp, Homo sapiens
gcagacagcagctc

SEQ ID NO: 2834311 - DNA, 15 bp, Homo sapiens
gcagactcagctctg

SEQ ID NO: 2834312 - DNA, 17 bp, Homo sapiens
gcagactcagtttgtca

SEQ ID NO: 2834313 - DNA, 18 bp, Homo sapiens
gcagactcagtttgtcag

SEQ ID NO: 2834314 - DNA, 15 bp, Homo sapiens
gcagactctacagag

SEQ ID NO: 2834315 - DNA, 19 bp, Homo sapiens
gcagactctacagaggcca

SEQ ID NO: 2834316 - DNA, 18 bp, Homo sapiens
gcagagaaagaagagaca

SEQ ID NO: 2834317 - DNA, 14 bp, Homo sapiens
gcagagaaggcttc

SEQ ID NO: 2834318 - DNA, 20 bp, Homo sapiens
gcagagaatcatacttagca

SEQ ID NO: 2834319 - DNA, 19 bp, Homo sapiens
gcagagaatgaaagggccc

SEQ ID NO: 2834320 - DNA, 23 bp, Homo sapiens
gcagagaatgaaagggcccagag

SEQ ID NO: 2834321 - DNA, 14 bp, Homo sapiens
gcagagaccttgcg

SEQ ID NO: 2834322 - DNA, 12 bp, Homo sapiens
gcagagagaagc

SEQ ID NO: 2834323 - DNA, 21 bp, Homo sapiens
gcagagaggtggagaactggg

SEQ ID NO: 2834324 - DNA, 22 bp, Homo sapiens
gcagagaggtggagaactggga

SEQ ID NO: 2834325 - DNA, 14 bp, Homo sapiens
gcagagcacacagg

SEQ ID NO: 2834326 - DNA, 18 bp, Homo sapiens
gcagaggagtccagggcg

SEQ ID NO: 2834327 - DNA, 12 bp, Homo sapiens
gcagaggcagcg

SEQ ID NO: 2834328 - DNA, 11 bp, Homo sapiens
gcagaggctgg

SEQ ID NO: 2834329 - DNA, 18 bp, Homo sapiens
gcagagggcagaggctgg

SEQ ID NO: 2834330 - DNA, 19 bp, Homo sapiens
gcagaggggtaggcagagc

SEQ ID NO: 2834331 - DNA, 23 bp, Homo sapiens
gcagaggtaaaagtgtgagcagt

SEQ ID NO: 2834332 - DNA, 18 bp, Homo sapiens
gcagaggtgagcagagga

SEQ ID NO: 2834333 - DNA, 19 bp, Homo sapiens
gcagaggtgagcagaggag

SEQ ID NO: 2834334 - DNA, 17 bp, Homo sapiens
gcagataatcagcctct

SEQ ID NO: 2834335 - DNA, 15 bp, Homo sapiens
gcagatggaaagaaa

SEQ ID NO: 2834336 - DNA, 14 bp, Homo sapiens
gcagatgtaggagg

SEQ ID NO: 2834337 - DNA, 15 bp, Homo sapiens
gcagatgtaggaggg

SEQ ID NO: 2834338 - DNA, 23 bp, Homo sapiens
gcagattattttagtctgtcatc

SEQ ID NO: 2834339 - DNA, 15 bp, Homo sapiens
gcagatttcctgtgt

SEQ ID NO: 2834340 - DNA, 19 bp, Homo sapiens
gcagcactttaaccctctc

SEQ ID NO: 2834341 - DNA, 11 bp, Homo sapiens
gcagcagccag

SEQ ID NO: 2834342 - DNA, 14 bp, Homo sapiens
gcagcagccagccc

SEQ ID NO: 2834343 - DNA, 15 bp, Homo sapiens
gcagcagccagccct

SEQ ID NO: 2834344 - DNA, 16 bp, Homo sapiens
gcagcagccagccctg

SEQ ID NO: 2834345 - DNA, 21 bp, Homo sapiens
gcagcagccagccctgcctgg

SEQ ID NO: 2834346 - DNA, 22 bp, Homo sapiens
gcagcagccagccctgcctgga

SEQ ID NO: 2834347 - DNA, 20 bp, Homo sapiens
gcagcagctcagcctccccc

SEQ ID NO: 2834348 - DNA, 21 bp, Homo sapiens
gcagcagctcagcctcccccc

SEQ ID NO: 2834349 - DNA, 17 bp, Homo sapiens
gcagcaggaggctagca

SEQ ID NO: 2834350 - DNA, 17 bp, Homo sapiens
gcagcagtgagtctctt

SEQ ID NO: 2834351 - DNA, 15 bp, Homo sapiens
gcagcatctgctaat

SEQ ID NO: 2834352 - DNA, 17 bp, Homo sapiens
gcagcatgtggggaagc

SEQ ID NO: 2834353 - DNA, 21 bp, Homo sapiens
gcagcatgtggggaagcaaga

SEQ ID NO: 2834354 - DNA, 16 bp, Homo sapiens
gcagccaaacagagcc

SEQ ID NO: 2834355 - DNA, 22 bp, Homo sapiens
gcagccacacttctcaggacac

SEQ ID NO: 2834356 - DNA, 16 bp, Homo sapiens
gcagccaccctgagga

SEQ ID NO: 2834357 - DNA, 15 bp, Homo sapiens
gcagccagccctgcc

SEQ ID NO: 2834358 - DNA, 18 bp, Homo sapiens
gcagccagccctgcctgg

SEQ ID NO: 2834359 - DNA, 20 bp, Homo sapiens
gcagccagccctgcctggag

SEQ ID NO: 2834360 - DNA, 19 bp, Homo sapiens
gcagccagccggtgcctgg

SEQ ID NO: 2834361 - DNA, 13 bp, Homo sapiens
gccactccttcct

SEQ ID NO: 2834362 - DNA, 17 bp, Homo sapiens
gccactccttcctgccc

SEQ ID NO: 2834363 - DNA, 15 bp, Homo sapiens
gccactgaagctggg

SEQ ID NO: 2834364 - DNA, 20 bp, Homo sapiens
gccactgcaccgggccacag

SEQ ID NO: 2834365 - DNA, 22 bp, Homo sapiens
gccactgcaccgggccacagag

SEQ ID NO: 2834366 - DNA, 23 bp, Homo sapiens
gccactgcaccgggccacagaga

SEQ ID NO: 2834367 - DNA, 22 bp, Homo sapiens
gccactgcactccagcctgggc

SEQ ID NO: 2834368 - DNA, 17 bp, Homo sapiens
gccactggtttctcaga

SEQ ID NO: 2834369 - DNA, 19 bp, Homo sapiens
gccacttaccttcaataaa

SEQ ID NO: 2834370 - DNA, 23 bp, Homo sapiens
gccactttggtacatggccagtg

SEQ ID NO: 2834371 - DNA, 18 bp, Homo sapiens
gccagaacagtttgtaca

SEQ ID NO: 2834372 - DNA, 13 bp, Homo sapiens
gccagaacttcga

SEQ ID NO: 2834373 - DNA, 21 bp, Homo sapiens
gccagaagtttgtcaagtcaa

SEQ ID NO: 2834374 - DNA, 13 bp, Homo sapiens
gccagagcctggg

SEQ ID NO: 2834375 - DNA, 19 bp, Homo sapiens
gccagagcctggggcatcc

SEQ ID NO: 2834376 - DNA, 17 bp, Homo sapiens
gccagagggagtgacag

SEQ ID NO: 2834377 - DNA, 15 bp, Homo sapiens
gccagatgcaccagc

SEQ ID NO: 2834378 - DNA, 17 bp, Homo sapiens
gccagatgcaccagccc

SEQ ID NO: 2834379 - DNA, 16 bp, Homo sapiens
gccagattttttaaaa

SEQ ID NO: 2834380 - DNA, 23 bp, Homo sapiens
gccagattttttaaaatttatat

SEQ ID NO: 2834381 - DNA, 16 bp, Homo sapiens
gccagcagccagctct

SEQ ID NO: 2834382 - DNA, 17 bp, Homo sapiens
gccagcagccagctctc

SEQ ID NO: 2834383 - DNA, 19 bp, Homo sapiens
gccagcagccagctctcag

SEQ ID NO: 2834384 - DNA, 22 bp, Homo sapiens
gccagcagccagctctcagcca

SEQ ID NO: 2834385 - DNA, 23 bp, Homo sapiens
gccagcagccagctctcagccaa

SEQ ID NO: 2834386 - DNA, 10 bp, Homo sapiens
gccagccctc

SEQ ID NO: 2834387 - DNA, 15 bp, Homo sapiens
gccagccctccctgt

SEQ ID NO: 2834388 - DNA, 21 bp, Homo sapiens
gccagccctccctgtcctcct

SEQ ID NO: 2834389 - DNA, 23 bp, Homo sapiens
gccagccctccctgtcctcctcg

SEQ ID NO: 2834390 - DNA, 14 bp, Homo sapiens
gccagccctgcctg

SEQ ID NO: 2834391 - DNA, 23 bp, Homo sapiens
gccagccctgcctggaggacctg

SEQ ID NO: 2834392 - DNA, 12 bp, Homo sapiens
gccagcctggcc

SEQ ID NO: 2834393 - DNA, 13 bp, Homo sapiens
gccagcctggcct

SEQ ID NO: 2834394 - DNA, 17 bp, Homo sapiens
gccagcctggcctcctg

SEQ ID NO: 2834395 - DNA, 12 bp, Homo sapiens
gccagcctggct

SEQ ID NO: 2834396 - DNA, 18 bp, Homo sapiens
gccagcctggcttctgga

SEQ ID NO: 2834397 - DNA, 15 bp, Homo sapiens
gccagcgcctccctc

SEQ ID NO: 2834398 - DNA, 16 bp, Homo sapiens
gccagcgcctccctcc

SEQ ID NO: 2834399 - DNA, 15 bp, Homo sapiens
gccagctctcagcca

SEQ ID NO: 2834400 - DNA, 20 bp, Homo sapiens
gccagctgcaggaatcaaaa

SEQ ID NO: 2834401 - DNA, 18 bp, Homo sapiens
gccagctgcatctactca

SEQ ID NO: 2834402 - DNA, 15 bp, Homo sapiens
gccaggactccccag

SEQ ID NO: 2834403 - DNA, 21 bp, Homo sapiens
gccaggactccccaggccagg

SEQ ID NO: 2834404 - DNA, 15 bp, Homo sapiens
gccaggagcaaatgt

SEQ ID NO: 2834405 - DNA, 22 bp, Homo sapiens
gccaggagcaaatgtttctgca

SEQ ID NO: 2834406 - DNA, 22 bp, Homo sapiens
gccaggcaggggtgggagagcc

SEQ ID NO: 2834407 - DNA, 16 bp, Homo sapiens
gccaggccaccaggat

SEQ ID NO: 2834408 - DNA, 19 bp, Homo sapiens
gccaggccaccaggatggc

SEQ ID NO: 2834409 - DNA, 22 bp, Homo sapiens
gccaggcgcggtggctcacgcc

SEQ ID NO: 2834410 - DNA, 13 bp, Homo sapiens
gccagggccctgc

SEQ ID NO: 2834411 - DNA, 17 bp, Homo sapiens
gccagggccctgcagag

SEQ ID NO: 2834412 - DNA, 19 bp, Homo sapiens
gccagggccctgcagaggg

SEQ ID NO: 2834413 - DNA, 18 bp, Homo sapiens
gccaggttatgcctcatg

SEQ ID NO: 2834414 - DNA, 22 bp, Homo sapiens
gccaggtttctgcccacattgg

SEQ ID NO: 2834415 - DNA, 17 bp, Homo sapiens
gccaggtttttggtctg

SEQ ID NO: 2834416 - DNA, 17 bp, Homo sapiens
gccagtgccttacctcc

SEQ ID NO: 2834417 - DNA, 20 bp, Homo sapiens
gccagtgtgatcccaagtgc

SEQ ID NO: 2834418 - DNA, 18 bp, Homo sapiens
gccagtgtttagaagagc

SEQ ID NO: 2834419 - DNA, 17 bp, Homo sapiens
gccatcaacaagagttg

SEQ ID NO: 2834420 - DNA, 16 bp, Homo sapiens
gccatcatgtgcctgg

SEQ ID NO: 2834421 - DNA, 20 bp, Homo sapiens
gccatcatgtgcctggaaat

SEQ ID NO: 2834422 - DNA, 19 bp, Homo sapiens
gccatccaggttcagcttg

SEQ ID NO: 2834423 - DNA, 20 bp, Homo sapiens
gccatccaggttcagcttgt

SEQ ID NO: 2834424 - DNA, 15 bp, Homo sapiens
gccatctccaccctg

SEQ ID NO: 2834425 - DNA, 16 bp, Homo sapiens
gccatctccaccctga

SEQ ID NO: 2834426 - DNA, 23 bp, Homo sapiens
gccatctccaccctgagcctgac

SEQ ID NO: 2834427 - DNA, 14 bp, Homo sapiens
gccatgccaccctg

SEQ ID NO: 2834428 - DNA, 15 bp, Homo sapiens
gccatgcttcttgcc

SEQ ID NO: 2834429 - DNA, 18 bp, Homo sapiens
gccatgcttcttgcccct

SEQ ID NO: 2834430 - DNA, 21 bp, Homo sapiens
gccatgcttcttgccccttgg

SEQ ID NO: 2834431 - DNA, 15 bp, Homo sapiens
gccatgggcctcctg

SEQ ID NO: 2834432 - DNA, 16 bp, Homo sapiens
gccatgggcctcctgt

SEQ ID NO: 2834433 - DNA, 15 bp, Homo sapiens
gccatgttggccagg

SEQ ID NO: 2834434 - DNA, 19 bp, Homo sapiens
gccatgttggccaggctgg

SEQ ID NO: 2834435 - DNA, 24 bp, Homo sapiens
gccatgttggccaggctggtctca

SEQ ID NO: 2834436 - DNA, 16 bp, Homo sapiens
gccattaccatggaga

SEQ ID NO: 2834437 - DNA, 18 bp, Homo sapiens
gccattaccatggagaca

SEQ ID NO: 2834438 - DNA, 15 bp, Homo sapiens
gccatttgctttttc

SEQ ID NO: 2834439 - DNA, 18 bp, Homo sapiens
gccattttaataaaatga

SEQ ID NO: 2834440 - DNA, 14 bp, Homo sapiens
gcccaaatggctct

SEQ ID NO: 2834441 - DNA, 23 bp, Homo sapiens
gcccaaatggctctgtgaaatca

SEQ ID NO: 2834442 - DNA, 23 bp, Homo sapiens
gcccaacagacaccatcttttgt

SEQ ID NO: 2834443 - DNA, 18 bp, Homo sapiens
gcccacagacagatccca

SEQ ID NO: 2834444 - DNA, 19 bp, Homo sapiens
gcccacagctcccacccca

SEQ ID NO: 2834445 - DNA, 19 bp, Homo sapiens
gcccacaggatcagtctga

SEQ ID NO: 2834446 - DNA, 17 bp, Homo sapiens
gcccacagggaccaaga

SEQ ID NO: 2834447 - DNA, 14 bp, Homo sapiens
gcccacatcccagg

SEQ ID NO: 2834448 - DNA, 17 bp, Homo sapiens
gcccaccttggctcaag

SEQ ID NO: 2834449 - DNA, 16 bp, Homo sapiens
gcccacgctggagtgc

SEQ ID NO: 2834450 - DNA, 17 bp, Homo sapiens
gcccacgctggagtgca

SEQ ID NO: 2834451 - DNA, 14 bp, Homo sapiens
gcctaaaaatgcaa

SEQ ID NO: 2834452 - DNA, 16 bp, Homo sapiens
gcctaagtggctgctg

SEQ ID NO: 2834453 - DNA, 15 bp, Homo sapiens
gcctaataaacaatt

SEQ ID NO: 2834454 - DNA, 17 bp, Homo sapiens
gcctacattccctggcc

SEQ ID NO: 2834455 - DNA, 14 bp, Homo sapiens
gcctaccccctgaa

SEQ ID NO: 2834456 - DNA, 15 bp, Homo sapiens
gcctaccccctgaaa

SEQ ID NO: 2834457 - DNA, 15 bp, Homo sapiens
gcctagcctgagcca

SEQ ID NO: 2834458 - DNA, 22 bp, Homo sapiens
gcctagctaccttctctaccca

SEQ ID NO: 2834459 - DNA, 17 bp, Homo sapiens
gcctaggaattcccagc

SEQ ID NO: 2834460 - DNA, 20 bp, Homo sapiens
gcctagggagccgcaccttg

SEQ ID NO: 2834461 - DNA, 14 bp, Homo sapiens
gcctaggtgacaga

SEQ ID NO: 2834462 - DNA, 15 bp, Homo sapiens
gcctaggtgacagag

SEQ ID NO: 2834463 - DNA, 19 bp, Homo sapiens
gcctagtggggtctccctc

SEQ ID NO: 2834464 - DNA, 13 bp, Homo sapiens
gcctataatccca

SEQ ID NO: 2834465 - DNA, 16 bp, Homo sapiens
gcctatccatcctgcg

SEQ ID NO: 2834466 - DNA, 19 bp, Homo sapiens
gcctatccatcctgcgagc

SEQ ID NO: 2834467 - DNA, 17 bp, Homo sapiens
gcctatgacttgggcac

SEQ ID NO: 2834468 - DNA, 15 bp, Homo sapiens
gcctatgatcccagc

SEQ ID NO: 2834469 - DNA, 23 bp, Homo sapiens
gcctatgcacatatggactctgc

SEQ ID NO: 2834470 - DNA, 21 bp, Homo sapiens
gcctatggagagccctgggac

SEQ ID NO: 2834471 - DNA, 22 bp, Homo sapiens
gcctcaaagcaagcattcagaa

SEQ ID NO: 2834472 - DNA, 14 bp, Homo sapiens
gcctcaacctcctg

SEQ ID NO: 2834473 - DNA, 21 bp, Homo sapiens
gcctcaagtgattctcctgcc

SEQ ID NO: 2834474 - DNA, 22 bp, Homo sapiens
gcctcaatttctgaacaccata

SEQ ID NO: 2834475 - DNA, 17 bp, Homo sapiens
gcctcacgcccagcctc

SEQ ID NO: 2834476 - DNA, 19 bp, Homo sapiens
gcctcacgcccagcctcct

SEQ ID NO: 2834477 - DNA, 22 bp, Homo sapiens
gcctcactgatatattttccag

SEQ ID NO: 2834478 - DNA, 17 bp, Homo sapiens
gcctcagcatcctggca

SEQ ID NO: 2834479 - DNA, 21 bp, Homo sapiens
gcctcagcatcctggcacccg

SEQ ID NO: 2834480 - DNA, 14 bp, Homo sapiens
gcctcagcctccca

SEQ ID NO: 2834481 - DNA, 22 bp, Homo sapiens
gcctcagcctcccaaagtgctg

SEQ ID NO: 2834482 - DNA, 23 bp, Homo sapiens
gcctcagcctcccaaagtgctgg

SEQ ID NO: 2834483 - DNA, 19 bp, Homo sapiens
gcctcagctgctcgcacag

SEQ ID NO: 2834484 - DNA, 18 bp, Homo sapiens
gcctcatccgaggcaggg

SEQ ID NO: 2834485 - DNA, 22 bp, Homo sapiens
gcctcatctataacatgcattt

SEQ ID NO: 2834486 - DNA, 19 bp, Homo sapiens
gcctcatgaccctcctgtc

SEQ ID NO: 2834487 - DNA, 21 bp, Homo sapiens
gcctcatttttttccttgcaa

SEQ ID NO: 2834488 - DNA, 11 bp, Homo sapiens
gcctccatgct

SEQ ID NO: 2834489 - DNA, 23 bp, Homo sapiens
gcctccatttctggcttctagtc

SEQ ID NO: 2834490 - DNA, 19 bp, Homo sapiens
gcctcccaataaagctgga

SEQ ID NO: 2834491 - DNA, 18 bp, Homo sapiens
gcctccccccagcccctc

SEQ ID NO: 2834492 - DNA, 21 bp, Homo sapiens
gcctccccccagcccctcctc

SEQ ID NO: 2834493 - DNA, 19 bp, Homo sapiens
gcctcccgaatagctggga

SEQ ID NO: 2834494 - DNA, 19 bp, Homo sapiens
gcctcccgagtagctggga

SEQ ID NO: 2834495 - DNA, 15 bp, Homo sapiens
gcctccctccacccc

SEQ ID NO: 2834496 - DNA, 19 bp, Homo sapiens
gcctccctccaccccagga

SEQ ID NO: 2834497 - DNA, 21 bp, Homo sapiens
gcctccctctgacctgcaggc

SEQ ID NO: 2834498 - DNA, 14 bp, Homo sapiens
gcctcctcaccccc

SEQ ID NO: 2834499 - DNA, 17 bp, Homo sapiens
gcctcctcacccccagc

SEQ ID NO: 2834500 - DNA, 21 bp, Homo sapiens
gcctcctcacccccagctttg

SEQ ID NO: 2834501 - DNA, 15 bp, Homo sapiens
gcctcctcctgacca

SEQ ID NO: 2834502 - DNA, 16 bp, Homo sapiens
gcctcctctgtccagg

SEQ ID NO: 2834503 - DNA, 13 bp, Homo sapiens
gcctcctgcctct

SEQ ID NO: 2834504 - DNA, 13 bp, Homo sapiens
gcctcctgtctta

SEQ ID NO: 2834505 - DNA, 19 bp, Homo sapiens
gcctcctgtgtgtgcgcct

SEQ ID NO: 2834506 - DNA, 13 bp, Homo sapiens
gcctcgaactggc

SEQ ID NO: 2834507 - DNA, 12 bp, Homo sapiens
gcctcgcaaccc

SEQ ID NO: 2834508 - DNA, 20 bp, Homo sapiens
gcctcgcaacccgtgccaag

SEQ ID NO: 2834509 - DNA, 14 bp, Homo sapiens
gcctcgctccccac

SEQ ID NO: 2834510 - DNA, 14 bp, Homo sapiens
gcctcggagcctca

SEQ ID NO: 2834511 - DNA, 14 bp, Homo sapiens
gcctcggtggccat

SEQ ID NO: 2834512 - DNA, 16 bp, Homo sapiens
gcctcggtggccatgc

SEQ ID NO: 2834513 - DNA, 18 bp, Homo sapiens
gcctcggtggccatgctt

SEQ ID NO: 2834514 - DNA, 20 bp, Homo sapiens
gcctcggtggccatgcttct

SEQ ID NO: 2834515 - DNA, 16 bp, Homo sapiens
gcctctactgggaagg

SEQ ID NO: 2834516 - DNA, 13 bp, Homo sapiens
gcctctcccaccc

SEQ ID NO: 2834517 - DNA, 16 bp, Homo sapiens
gcctctcccgcaccag

SEQ ID NO: 2834518 - DNA, 18 bp, Homo sapiens
gcctctcccgcaccaggc

SEQ ID NO: 2834519 - DNA, 13 bp, Homo sapiens
gcctctgaggcca

SEQ ID NO: 2834520 - DNA, 16 bp, Homo sapiens
gcctctgaggccagcc

SEQ ID NO: 2834521 - DNA, 23 bp, Homo sapiens
gcctctgaggccagcctggcctc

SEQ ID NO: 2834522 - DNA, 12 bp, Homo sapiens
gcctctgcattc

SEQ ID NO: 2834523 - DNA, 12 bp, Homo sapiens
gcctctgcctct

SEQ ID NO: 2834524 - DNA, 13 bp, Homo sapiens
gcctctgcctctg

SEQ ID NO: 2834525 - DNA, 12 bp, Homo sapiens
gcctctgcctgt

SEQ ID NO: 2834526 - DNA, 13 bp, Homo sapiens
gcctctgcctgtc

SEQ ID NO: 2834527 - DNA, 13 bp, Homo sapiens
gcctctgtccctc

SEQ ID NO: 2834528 - DNA, 22 bp, Homo sapiens
gcctcttcctccctcattccac

SEQ ID NO: 2834529 - DNA, 15 bp, Homo sapiens
gcctcttcttcttca

SEQ ID NO: 2834530 - DNA, 20 bp, Homo sapiens
gcctcttcttcttcagaaga

SEQ ID NO: 2834531 - DNA, 17 bp, Homo sapiens
gcctcttggacctctgc

SEQ ID NO: 2834532 - DNA, 20 bp, Homo sapiens
gcctgaatccatcaggactt

SEQ ID NO: 2834533 - DNA, 17 bp, Homo sapiens
gcctgaggctgagactg

SEQ ID NO: 2834534 - DNA, 18 bp, Homo sapiens
gcctgaggctgagactgc

SEQ ID NO: 2834535 - DNA, 14 bp, Homo sapiens
gcctgaggctggga

SEQ ID NO: 2834536 - DNA, 18 bp, Homo sapiens
gcctgcacccttcctcct

SEQ ID NO: 2834537 - DNA, 11 bp, Homo sapiens
gcctgcagaga

SEQ ID NO: 2834538 - DNA, 18 bp, Homo sapiens
gcctgcagcggcacaaat

SEQ ID NO: 2834539 - DNA, 15 bp, Homo sapiens
gcctgccagggcccc

SEQ ID NO: 2834540 - DNA, 11 bp, Homo sapiens
gcctgcccagg

SEQ ID NO: 2834541 - DNA, 14 bp, Homo sapiens
gcctgcccaggccc

SEQ ID NO: 2834542 - DNA, 14 bp, Homo sapiens
gctcggtggaccca

SEQ ID NO: 2834543 - DNA, 17 bp, Homo sapiens
gctcggtggacccaggg

SEQ ID NO: 2834544 - DNA, 13 bp, Homo sapiens
gctctaacgcctg

SEQ ID NO: 2834545 - DNA, 14 bp, Homo sapiens
gctctaacgcctga

SEQ ID NO: 2834546 - DNA, 16 bp, Homo sapiens
gctctaacgcctgagc

SEQ ID NO: 2834547 - DNA, 14 bp, Homo sapiens
gctctagcctgggc

SEQ ID NO: 2834548 - DNA, 13 bp, Homo sapiens
gctctagttcaaa

SEQ ID NO: 2834549 - DNA, 13 bp, Homo sapiens
gctctcagcctcc

SEQ ID NO: 2834550 - DNA, 15 bp, Homo sapiens
gtcagccagggccag

SEQ ID NO: 2834551 - DNA, 16 bp, Homo sapiens
gtcagccgagccgggc

SEQ ID NO: 2834552 - DNA, 22 bp, Homo sapiens
gtcagccttccccctcccaggg

SEQ ID NO: 2834553 - DNA, 13 bp, Homo sapiens
gtcaggagttcct

SEQ ID NO: 2834554 - DNA, 22 bp, Homo sapiens
gtcaggcccttattttcaagaa

SEQ ID NO: 2834555 - DNA, 12 bp, Homo sapiens
gtcaggctccat

SEQ ID NO: 2834556 - DNA, 17 bp, Homo sapiens
gtcaggtggggcagctt

SEQ ID NO: 2834557 - DNA, 22 bp, Homo sapiens
gtcatctttttctctaaaatag

SEQ ID NO: 2834558 - DNA, 14 bp, Homo sapiens
gtcatgaagcccaa

SEQ ID NO: 2834559 - DNA, 17 bp, Homo sapiens
gtcatgatctccctgcc

SEQ ID NO: 2834560 - DNA, 18 bp, Homo sapiens
gtcatgatctccctgccg

SEQ ID NO: 2834561 - DNA, 12 bp, Homo sapiens
gtcatgtggcta

SEQ ID NO: 2834562 - DNA, 14 bp, Homo sapiens
gtcatttataaaac

SEQ ID NO: 2834563 - DNA, 13 bp, Homo sapiens
gtccacccaggag

SEQ ID NO: 2834564 - DNA, 15 bp, Homo sapiens
gtccacccaggagcc

SEQ ID NO: 2834565 - DNA, 23 bp, Homo sapiens
gtccacccaggagccccgaggcc

SEQ ID NO: 2834566 - DNA, 21 bp, Homo sapiens
gtccacctggccccatgtctc

SEQ ID NO: 2834567 - DNA, 19 bp, Homo sapiens
gtccagaagaatattcagg

SEQ ID NO: 2834568 - DNA, 15 bp, Homo sapiens
gtccagcacagaagg

SEQ ID NO: 2834569 - DNA, 13 bp, Homo sapiens
gtccagccagctc

SEQ ID NO: 2834570 - DNA, 14 bp, Homo sapiens
gtccagccagctcc

SEQ ID NO: 2834571 - DNA, 22 bp, Homo sapiens
gtccagccagctcctgggcagc

SEQ ID NO: 2834572 - DNA, 14 bp, Homo sapiens
gtccagctcttggc

SEQ ID NO: 2834573 - DNA, 19 bp, Homo sapiens
gtccagctcttggcccctg

SEQ ID NO: 2834574 - DNA, 14 bp, Homo sapiens
gtccagcttgctct

SEQ ID NO: 2834575 - DNA, 17 bp, Homo sapiens
gtccagggccctgagct

SEQ ID NO: 2834576 - DNA, 22 bp, Homo sapiens
gtccaggtcctggtggggcagc

SEQ ID NO: 2834577 - DNA, 24 bp, Homo sapiens
gtccagtgggaggtgagaccacct

SEQ ID NO: 2834578 - DNA, 12 bp, Homo sapiens
gtccataaagta

SEQ ID NO: 2834579 - DNA, 20 bp, Homo sapiens
gtccatatcagacctctgat

SEQ ID NO: 2834580 - DNA, 15 bp, Homo sapiens
gtccatgcctacaga

SEQ ID NO: 2834581 - DNA, 13 bp, Homo sapiens
gtcccacatccct

SEQ ID NO: 2834582 - DNA, 21 bp, Homo sapiens
gtcccacatccctgggcctgc

SEQ ID NO: 2834583 - DNA, 19 bp, Homo sapiens
gtcccacctcttctcttcc

SEQ ID NO: 2834584 - DNA, 14 bp, Homo sapiens
gtcccaccttggct

SEQ ID NO: 2834585 - DNA, 21 bp, Homo sapiens
gtcccaccttggctgcaggga

SEQ ID NO: 2834586 - DNA, 23 bp, Homo sapiens
gtcccaccttggctgcagggagt

SEQ ID NO: 2834587 - DNA, 15 bp, Homo sapiens
gtcccactcagtcca

SEQ ID NO: 2834588 - DNA, 22 bp, Homo sapiens
gtcccagctactcagaagcctg

SEQ ID NO: 2834589 - DNA, 16 bp, Homo sapiens
gtcccatgtgcatgga

SEQ ID NO: 2834590 - DNA, 13 bp, Homo sapiens
gtcccatttcctt

SEQ ID NO: 2834591 - DNA, 13 bp, Homo sapiens
gtccccagctccc

SEQ ID NO: 2834592 - DNA, 19 bp, Homo sapiens
gtccccagtttgcagaaaa

SEQ ID NO: 2834593 - DNA, 17 bp, Homo sapiens
gtccccatcatcccagc

SEQ ID NO: 2834594 - DNA, 19 bp, Homo sapiens
gtccccatcatcccagctg

SEQ ID NO: 2834595 - DNA, 20 bp, Homo sapiens
gtccccatcatcccagctgc

SEQ ID NO: 2834596 - DNA, 15 bp, Homo sapiens
gtcccccctcactcc

SEQ ID NO: 2834597 - DNA, 19 bp, Homo sapiens
gtccccgggagcacacgaa

SEQ ID NO: 2834598 - DNA, 15 bp, Homo sapiens
gtccccgtgccccgc

SEQ ID NO: 2834599 - DNA, 23 bp, Homo sapiens
gtccctcaaatgacccaaagacc

SEQ ID NO: 2834600 - DNA, 17 bp, Homo sapiens
gtccctgactctctgtg

SEQ ID NO: 2834601 - DNA, 17 bp, Homo sapiens
gtccctgccacactcag

SEQ ID NO: 2834602 - DNA, 24 bp, Homo sapiens
gtccctgccacactcagtccccca

SEQ ID NO: 2834603 - DNA, 16 bp, Homo sapiens
gtcccttgagacctca

SEQ ID NO: 2834604 - DNA, 17 bp, Homo sapiens
gtcccttgagacctcag

SEQ ID NO: 2834605 - DNA, 21 bp, Homo sapiens
gtcccttgagacctcagccat

SEQ ID NO: 2834606 - DNA, 22 bp, Homo sapiens
gtcccttgagacctcagccatg

SEQ ID NO: 2834607 - DNA, 20 bp, Homo sapiens
gtcccttgtttccagctaga

SEQ ID NO: 2834608 - DNA, 14 bp, Homo sapiens
gtccgtttactcca

SEQ ID NO: 2834609 - DNA, 13 bp, Homo sapiens
gtcctacccaccc

SEQ ID NO: 2834610 - DNA, 16 bp, Homo sapiens
gtcctacccaccctcc

SEQ ID NO: 2834611 - DNA, 12 bp, Homo sapiens
gtcctactctgt

SEQ ID NO: 2834612 - DNA, 23 bp, Homo sapiens
gtcctactctgtgtcaggtgggg

SEQ ID NO: 2834613 - DNA, 19 bp, Homo sapiens
gtcctagccactcaggagg

SEQ ID NO: 2834614 - DNA, 22 bp, Homo sapiens
gtcctaggccacaccatctcct

SEQ ID NO: 2834615 - DNA, 22 bp, Homo sapiens
gtcctaggggccgagggaaatg

SEQ ID NO: 2834616 - DNA, 15 bp, Homo sapiens
gtcctccagcttccc

SEQ ID NO: 2834617 - DNA, 19 bp, Homo sapiens
gtcctccccctgccagtgc

SEQ ID NO: 2834618 - DNA, 21 bp, Homo sapiens
gtcctcctcggatcaccgaga

SEQ ID NO: 2834619 - DNA, 14 bp, Homo sapiens
gtcctgagcactgc

SEQ ID NO: 2834620 - DNA, 17 bp, Homo sapiens
gtcctgagcactgccag

SEQ ID NO: 2834621 - DNA, 18 bp, Homo sapiens
gtcctgagcactgccagg

SEQ ID NO: 2834622 - DNA, 20 bp, Homo sapiens
gtcctgagcactgccaggag

SEQ ID NO: 2834623 - DNA, 22 bp, Homo sapiens
gtcctgagcactgccaggaggg

SEQ ID NO: 2834624 - DNA, 20 bp, Homo sapiens
gtcctggaatgaagcatgta

SEQ ID NO: 2834625 - DNA, 19 bp, Homo sapiens
gtcctgggagaacctcagg

SEQ ID NO: 2834626 - DNA, 16 bp, Homo sapiens
gtcctgggagtgagct

SEQ ID NO: 2834627 - DNA, 14 bp, Homo sapiens
gtcctggggcctcg

SEQ ID NO: 2834628 - DNA, 22 bp, Homo sapiens
gtcctggggcctcggagcctca

SEQ ID NO: 2834629 - DNA, 17 bp, Homo sapiens
gtcctggggctctgtgc

SEQ ID NO: 2834630 - DNA, 19 bp, Homo sapiens
gtcctggtctgctcaggaa

SEQ ID NO: 2834631 - DNA, 22 bp, Homo sapiens
gtcctggtggggcagctcctct

SEQ ID NO: 2834632 - DNA, 21 bp, Homo sapiens
gtcctgttaacgtcatctcag

SEQ ID NO: 2834633 - DNA, 15 bp, Homo sapiens
gtccttgcacctgca

SEQ ID NO: 2834634 - DNA, 14 bp, Homo sapiens
gtccttggtgtgac

SEQ ID NO: 2834635 - DNA, 22 bp, Homo sapiens
gtccttggtgtgaccctctgaa

SEQ ID NO: 2834636 - DNA, 15 bp, Homo sapiens
gtccttttcactaca

SEQ ID NO: 2834637 - DNA, 22 bp, Homo sapiens
gtccttttgtaccatggtgtga

SEQ ID NO: 2834638 - DNA, 16 bp, Homo sapiens
gtcgactttgagctgg

SEQ ID NO: 2834639 - DNA, 12 bp, Homo sapiens
gtcgagacactt

SEQ ID NO: 2834640 - DNA, 19 bp, Homo sapiens
gtgcagttgacagcaggtg

SEQ ID NO: 2834641 - DNA, 22 bp, Homo sapiens
gtgcatgttgccatgaggcctt

SEQ ID NO: 2834642 - DNA, 23 bp, Homo sapiens
gtgcatttgtgagccaaagagaa

SEQ ID NO: 2834643 - DNA, 22 bp, Homo sapiens
gtgccaaactaccgttcccaaa

SEQ ID NO: 2834644 - DNA, 19 bp, Homo sapiens
gtgccaagtccaggtcctg

SEQ ID NO: 2834645 - DNA, 12 bp, Homo sapiens
gtgccagagcct

SEQ ID NO: 2834646 - DNA, 21 bp, Homo sapiens
gtgccaggactccccaggcca

SEQ ID NO: 2834647 - DNA, 23 bp, Homo sapiens
gtgccaggactccccaggccagg

SEQ ID NO: 2834648 - DNA, 12 bp, Homo sapiens
gtgccaggcccg

SEQ ID NO: 2834649 - DNA, 19 bp, Homo sapiens
gtgccaggcccggggctgg

SEQ ID NO: 2834650 - DNA, 20 bp, Homo sapiens
gtgccaggcccggggctggc

SEQ ID NO: 2834651 - DNA, 18 bp, Homo sapiens
gtgccagtcttgtgtctg

SEQ ID NO: 2834652 - DNA, 17 bp, Homo sapiens
gtgccctgacccctgca

SEQ ID NO: 2834653 - DNA, 13 bp, Homo sapiens
gtgccgcctgtgc

SEQ ID NO: 2834654 - DNA, 21 bp, Homo sapiens
gtgccgttactctccaacctg

SEQ ID NO: 2834655 - DNA, 22 bp, Homo sapiens
gtgccgttactctccaacctgg

SEQ ID NO: 2834656 - DNA, 20 bp, Homo sapiens
gtgcctcgctccccactctg

SEQ ID NO: 2834657 - DNA, 21 bp, Homo sapiens
gtgcctcgctccccactctgc

SEQ ID NO: 2834658 - DNA, 13 bp, Homo sapiens
gtgcctctgcctg

SEQ ID NO: 2834659 - DNA, 12 bp, Homo sapiens
gtgcctggcctg

SEQ ID NO: 2834660 - DNA, 19 bp, Homo sapiens
gtgcctggcctggcacaca

SEQ ID NO: 2834661 - DNA, 20 bp, Homo sapiens
gtgcctgggtggggctgctc

SEQ ID NO: 2834662 - DNA, 22 bp, Homo sapiens
gtgcctgggtggggctgctcct

SEQ ID NO: 2834663 - DNA, 22 bp, Homo sapiens
gtgccttccataattatgacag

SEQ ID NO: 2834664 - DNA, 20 bp, Homo sapiens
gtgcgacttcacaaaatgca

SEQ ID NO: 2834665 - DNA, 20 bp, Homo sapiens
gtgcgagagaggtgggcagc

SEQ ID NO: 2834666 - DNA, 21 bp, Homo sapiens
gtgcgagagaggtgggcagca

SEQ ID NO: 2834667 - DNA, 14 bp, Homo sapiens
gtgcgcctacagga

SEQ ID NO: 2834668 - DNA, 14 bp, Homo sapiens
gtgcggccaccacc

SEQ ID NO: 2834669 - DNA, 15 bp, Homo sapiens
gtgcggtggctcacg

SEQ ID NO: 2834670 - DNA, 13 bp, Homo sapiens
gtgctaactgtat

SEQ ID NO: 2834671 - DNA, 12 bp, Homo sapiens
gtgctcggcagt

SEQ ID NO: 2834672 - DNA, 15 bp, Homo sapiens
gtgctcggcagtcat

SEQ ID NO: 2834673 - DNA, 17 bp, Homo sapiens
gtgctctaggctgcccc

SEQ ID NO: 2834674 - DNA, 14 bp, Homo sapiens
gtgctctggacagg

SEQ ID NO: 2834675 - DNA, 16 bp, Homo sapiens
gtgctctggacaggca

SEQ ID NO: 2834676 - DNA, 18 bp, Homo sapiens
gtgctcttctgttctcaa

SEQ ID NO: 2834677 - DNA, 23 bp, Homo sapiens
gtgctgagttggtgttgacatgt

SEQ ID NO: 2834678 - DNA, 22 bp, Homo sapiens
gtgctgccatccaggttcagct

SEQ ID NO: 2834679 - DNA, 20 bp, Homo sapiens
gtgctggaggattttccagt

SEQ ID NO: 2834680 - DNA, 22 bp, Homo sapiens
gtgctgggattacaagcgtgag

SEQ ID NO: 2834681 - DNA, 15 bp, Homo sapiens
gtgctgtggccaggg

SEQ ID NO: 2834682 - DNA, 18 bp, Homo sapiens
gtgctgtggccagggtga

SEQ ID NO: 2834683 - DNA, 23 bp, Homo sapiens
gtgctgtggccagggtgagagct

SEQ ID NO: 2834684 - DNA, 15 bp, Homo sapiens
gtgctgtttgagatg

SEQ ID NO: 2834685 - DNA, 15 bp, Homo sapiens
gtgcttgtcatctgc

SEQ ID NO: 2834686 - DNA, 15 bp, Homo sapiens
gtggaaaaaagagaa

SEQ ID NO: 2834687 - DNA, 23 bp, Homo sapiens
gtggaaagcctctgctgccatgg

SEQ ID NO: 2834688 - DNA, 16 bp, Homo sapiens
gtggaagccctccttc

SEQ ID NO: 2834689 - DNA, 17 bp, Homo sapiens
gtggaagccctccttcc

SEQ ID NO: 2834690 - DNA, 15 bp, Homo sapiens
gtggacacagctctt

SEQ ID NO: 2834691 - DNA, 24 bp, Homo sapiens
gtggacacagctcttctccaggct

SEQ ID NO: 2834692 - DNA, 14 bp, Homo sapiens
gtggacacctgccc

SEQ ID NO: 2834693 - DNA, 16 bp, Homo sapiens
gtggacagtcctggga

SEQ ID NO: 2834694 - DNA, 18 bp, Homo sapiens
gtggaccaggacaggacc

SEQ ID NO: 2834695 - DNA, 23 bp, Homo sapiens
gtggactgaaccgacttttctaa

SEQ ID NO: 2834696 - DNA, 15 bp, Homo sapiens
gtggagagtgagaat

SEQ ID NO: 2834697 - DNA, 16 bp, Homo sapiens
gtggaggagctcagga

SEQ ID NO: 2834698 - DNA, 20 bp, Homo sapiens
gtggaggagctcaggacact

SEQ ID NO: 2834699 - DNA, 22 bp, Homo sapiens
gtggaggttgcagtgagctgag

SEQ ID NO: 2834700 - DNA, 16 bp, Homo sapiens
gtggatcacagaggct

SEQ ID NO: 2834701 - DNA, 16 bp, Homo sapiens
gtggatcatgaaaagt

SEQ ID NO: 2834702 - DNA, 16 bp, Homo sapiens
gtggatgcctggtggc

SEQ ID NO: 2834703 - DNA, 20 bp, Homo sapiens
gtggatgcctggtggcagct

SEQ ID NO: 2834704 - DNA, 21 bp, Homo sapiens
gtggatgcctggtggcagctg

SEQ ID NO: 2834705 - DNA, 18 bp, Homo sapiens
gtggatttcctattttaa

SEQ ID NO: 2834706 - DNA, 22 bp, Homo sapiens
gtggcacacgcctgtaatccca

SEQ ID NO: 2834707 - DNA, 17 bp, Homo sapiens
gtggcagctgcggtcca

SEQ ID NO: 2834708 - DNA, 21 bp, Homo sapiens
gtggcagctgcggtccaccca

SEQ ID NO: 2834709 - DNA, 13 bp, Homo sapiens
gtggcagctgctt

SEQ ID NO: 2834710 - DNA, 15 bp, Homo sapiens
gtggcaggaccagga

SEQ ID NO: 2834711 - DNA, 17 bp, Homo sapiens
gtggcaggaccaggact

SEQ ID NO: 2834712 - DNA, 16 bp, Homo sapiens
gtggcagtgggagctg

SEQ ID NO: 2834713 - DNA, 21 bp, Homo sapiens
gtggccagcgagggcgtgtct

SEQ ID NO: 2834714 - DNA, 12 bp, Homo sapiens
gtggccatgctt

SEQ ID NO: 2834715 - DNA, 16 bp, Homo sapiens
gtggccatgcttcttg

SEQ ID NO: 2834716 - DNA, 19 bp, Homo sapiens
gtggccatgcttcttgccc

SEQ ID NO: 2834717 - DNA, 18 bp, Homo sapiens
gtggcccttcctggacag

SEQ ID NO: 2834718 - DNA, 19 bp, Homo sapiens
gtggccggggaagctggca

SEQ ID NO: 2834719 - DNA, 17 bp, Homo sapiens
gtggcggtgcctgggtg

SEQ ID NO: 2834720 - DNA, 18 bp, Homo sapiens
gtggctactctgtgccag

SEQ ID NO: 2834721 - DNA, 20 bp, Homo sapiens
gtggctactctgtgccagag

SEQ ID NO: 2834722 - DNA, 22 bp, Homo sapiens
gtggctactctgtgccagagcc

SEQ ID NO: 2834723 - DNA, 15 bp, Homo sapiens
gtggctgacccagtc

SEQ ID NO: 2834724 - DNA, 21 bp, Homo sapiens
gtggctgtctctgtccctcac

SEQ ID NO: 2834725 - DNA, 22 bp, Homo sapiens
gtggcttaaaacaacactcaca

SEQ ID NO: 2834726 - DNA, 17 bp, Homo sapiens
gtgggaacgtgactgcc

SEQ ID NO: 2834727 - DNA, 21 bp, Homo sapiens
gtgggacaaaccagagcagag

SEQ ID NO: 2834728 - DNA, 13 bp, Homo sapiens
gtgggagagccca

SEQ ID NO: 2834729 - DNA, 15 bp, Homo sapiens
gtgggagagcccagc

SEQ ID NO: 2834730 - DNA, 18 bp, Homo sapiens
gttttctccaagagctac

SEQ ID NO: 2834731 - DNA, 16 bp, Homo sapiens
gttttctcctcccagg

SEQ ID NO: 2834732 - DNA, 21 bp, Homo sapiens
gttttctcctcccaggaactg

SEQ ID NO: 2834733 - DNA, 17 bp, Homo sapiens
gttttgaactaataaaa

SEQ ID NO: 2834734 - DNA, 16 bp, Homo sapiens
gttttggaagctctga

SEQ ID NO: 2834735 - DNA, 17 bp, Homo sapiens
gttttgtcccatttcct

SEQ ID NO: 2834736 - DNA, 19 bp, Homo sapiens
gttttgtggaggagctcag

SEQ ID NO: 2834737 - DNA, 15 bp, Homo sapiens
gtttttaactcaata

SEQ ID NO: 2834738 - DNA, 13 bp, Homo sapiens
gtttttaagctgt

SEQ ID NO: 2834739 - DNA, 12 bp, Homo sapiens
gtttttaatgta

SEQ ID NO: 2834740 - DNA, 16 bp, Homo sapiens
gtttttactacagttg

SEQ ID NO: 2834741 - DNA, 19 bp, Homo sapiens
gtttttccttgtatttaaa

SEQ ID NO: 2834742 - DNA, 20 bp, Homo sapiens
gtttttgaagaagggaaatt

SEQ ID NO: 2834743 - DNA, 13 bp, Homo sapiens
gttttttgcctaa

SEQ ID NO: 2834744 - DNA, 15 bp, Homo sapiens
gtttttttcttgtgc

SEQ ID NO: 2834745 - DNA, 18 bp, Homo sapiens
gttttttttaaataaaag

SEQ ID NO: 2834746 - DNA, 14 bp, Homo sapiens
taaaaaaatacagt

SEQ ID NO: 2834747 - DNA, 18 bp, Homo sapiens
taaaaaaatacagtaaag

SEQ ID NO: 2834748 - DNA, 13 bp, Homo sapiens
taaaaaacatttg

SEQ ID NO: 2834749 - DNA, 19 bp, Homo sapiens
taaaaaactaaaaactaga

SEQ ID NO: 2834750 - DNA, 19 bp, Homo sapiens
taaaaaagcttaaaacttt

SEQ ID NO: 2834751 - DNA, 22 bp, Homo sapiens
taaaaaatacaccacgaatttg

SEQ ID NO: 2834752 - DNA, 15 bp, Homo sapiens
taaaaaatggaaaga

SEQ ID NO: 2834753 - DNA, 21 bp, Homo sapiens
taaaaaatgtctatagagaaa

SEQ ID NO: 2834754 - DNA, 15 bp, Homo sapiens
taaaaacataaaata

SEQ ID NO: 2834755 - DNA, 12 bp, Homo sapiens
taaaaacatgag

SEQ ID NO: 2834756 - DNA, 16 bp, Homo sapiens
taaaaacatgagaaat

SEQ ID NO: 2834757 - DNA, 19 bp, Homo sapiens
taaaaacatgagaaatgtg

SEQ ID NO: 2834758 - DNA, 11 bp, Homo sapiens
taaaaacattc

SEQ ID NO: 2834759 - DNA, 17 bp, Homo sapiens
taaaaacttgtactatg

SEQ ID NO: 2834760 - DNA, 19 bp, Homo sapiens
taaaaagattatatatcat

SEQ ID NO: 2834761 - DNA, 17 bp, Homo sapiens
taaaaagtgcttttgtg

SEQ ID NO: 2834762 - DNA, 12 bp, Homo sapiens
taaaaagttaat

SEQ ID NO: 2834763 - DNA, 17 bp, Homo sapiens
taaaaataaatttggtt

SEQ ID NO: 2834764 - DNA, 16 bp, Homo sapiens
taaaaatgatttcagt

SEQ ID NO: 2834765 - DNA, 14 bp, Homo sapiens
taaaaatttgttta

SEQ ID NO: 2834766 - DNA, 13 bp, Homo sapiens
taaaacacagctt

SEQ ID NO: 2834767 - DNA, 20 bp, Homo sapiens
taaaacattatagattttca

SEQ ID NO: 2834768 - DNA, 12 bp, Homo sapiens
taaaaccatgca

SEQ ID NO: 2834769 - DNA, 15 bp, Homo sapiens
taaaaccatgcagct

SEQ ID NO: 2834770 - DNA, 21 bp, Homo sapiens
taaaaccatgcagcttcatca

SEQ ID NO: 2834771 - DNA, 22 bp, Homo sapiens
taaaaccatgcagcttcatcaa

SEQ ID NO: 2834772 - DNA, 21 bp, Homo sapiens
taaaacctttcaaatttcaca

SEQ ID NO: 2834773 - DNA, 15 bp, Homo sapiens
taaaactttgaagtt

SEQ ID NO: 2834774 - DNA, 12 bp, Homo sapiens
taaaagaaaaag

SEQ ID NO: 2834775 - DNA, 17 bp, Homo sapiens
taaaagaacagtaaaca

SEQ ID NO: 2834776 - DNA, 14 bp, Homo sapiens
taaaagaatttaaa

SEQ ID NO: 2834777 - DNA, 20 bp, Homo sapiens
taaaagattcactaaagcag

SEQ ID NO: 2834778 - DNA, 19 bp, Homo sapiens
taaaagcaaaaaagaaaac

SEQ ID NO: 2834779 - DNA, 23 bp, Homo sapiens
taaaagcaaaaaagaaaaccttt

SEQ ID NO: 2834780 - DNA, 21 bp, Homo sapiens
taaaagcagcatctgctaata

SEQ ID NO: 2834781 - DNA, 15 bp, Homo sapiens
taaaagcataaatgc

SEQ ID NO: 2834782 - DNA, 11 bp, Homo sapiens
taaaagctaat

SEQ ID NO: 2834783 - DNA, 12 bp, Homo sapiens
taaaagtaaaca

SEQ ID NO: 2834784 - DNA, 19 bp, Homo sapiens
taaaagtgttgattacata

SEQ ID NO: 2834785 - DNA, 12 bp, Homo sapiens
taaaagttactt

SEQ ID NO: 2834786 - DNA, 14 bp, Homo sapiens
taaaataatgattt

SEQ ID NO: 2834787 - DNA, 15 bp, Homo sapiens
taaaataatgattta

SEQ ID NO: 2834788 - DNA, 18 bp, Homo sapiens
taaaataattttaaaagt

SEQ ID NO: 2834789 - DNA, 23 bp, Homo sapiens
taaaatagccacttaccttcaat

SEQ ID NO: 2834790 - DNA, 14 bp, Homo sapiens
taaaatatacaaac

SEQ ID NO: 2834791 - DNA, 15 bp, Homo sapiens
taaaatatacaaaca

SEQ ID NO: 2834792 - DNA, 18 bp, Homo sapiens
taaaatatacaaacatgt

SEQ ID NO: 2834793 - DNA, 20 bp, Homo sapiens
taaaatatacaaacatgtgg

SEQ ID NO: 2834794 - DNA, 13 bp, Homo sapiens
taaaatattcctg

SEQ ID NO: 2834795 - DNA, 14 bp, Homo sapiens
taaaatcaggattt

SEQ ID NO: 2834796 - DNA, 20 bp, Homo sapiens
taaaatctggcaaagttata

SEQ ID NO: 2834797 - DNA, 21 bp, Homo sapiens
taaaatctggcaaagttatat

SEQ ID NO: 2834798 - DNA, 20 bp, Homo sapiens
taaaatcttggcacagaaac

SEQ ID NO: 2834799 - DNA, 17 bp, Homo sapiens
taaaatgcagtccagaa

SEQ ID NO: 2834800 - DNA, 19 bp, Homo sapiens
taaaatgcagtccagaata

SEQ ID NO: 2834801 - DNA, 21 bp, Homo sapiens
taaaatgcagtccagaataag

SEQ ID NO: 2834802 - DNA, 19 bp, Homo sapiens
taaaatgtacactggatat

SEQ ID NO: 2834803 - DNA, 20 bp, Homo sapiens
taaaattagtgagatttgta

SEQ ID NO: 2834804 - DNA, 14 bp, Homo sapiens
taaaattatggtga

SEQ ID NO: 2834805 - DNA, 15 bp, Homo sapiens
taaaattatggtgaa

SEQ ID NO: 2834806 - DNA, 17 bp, Homo sapiens
taaaatttatattgtaa

SEQ ID NO: 2834807 - DNA, 23 bp, Homo sapiens
taaaatttattgcttgatacttt

SEQ ID NO: 2834808 - DNA, 17 bp, Homo sapiens
taaaattttatctctta

SEQ ID NO: 2834809 - DNA, 22 bp, Homo sapiens
taaacaaaaacacattgagttt

SEQ ID NO: 2834810 - DNA, 18 bp, Homo sapiens
taaacacccttcacatac

SEQ ID NO: 2834811 - DNA, 13 bp, Homo sapiens
taaacacctgaca

SEQ ID NO: 2834812 - DNA, 16 bp, Homo sapiens
taaacacgtgtctata

SEQ ID NO: 2834813 - DNA, 14 bp, Homo sapiens
taaacactgtaatc

SEQ ID NO: 2834814 - DNA, 20 bp, Homo sapiens
taaacagtgagcctgaattt

SEQ ID NO: 2834815 - DNA, 23 bp, Homo sapiens
taaacagtgagcctgaattttgt

SEQ ID NO: 2834816 - DNA, 15 bp, Homo sapiens
taaacataattcttg

SEQ ID NO: 2834817 - DNA, 15 bp, Homo sapiens
taaacatagatagtg

SEQ ID NO: 2834818 - DNA, 17 bp, Homo sapiens
taaacatccttcaagaa

SEQ ID NO: 2834819 - DNA, 21 bp, Homo sapiens
taaacattaaaagaagactgg

SEQ ID NO: 2834820 - DNA, 19 bp, Homo sapiens
taaacattaaacactgtaa

SEQ ID NO: 2834821 - DNA, 20 bp, Homo sapiens
taattaggatctatgcaatt

SEQ ID NO: 2834822 - DNA, 18 bp, Homo sapiens
taattaggggttgctaag

SEQ ID NO: 2834823 - DNA, 12 bp, Homo sapiens
taattatctgat

SEQ ID NO: 2834824 - DNA, 13 bp, Homo sapiens
taattattattta

SEQ ID NO: 2834825 - DNA, 14 bp, Homo sapiens
taattattatttat

SEQ ID NO: 2834826 - DNA, 12 bp, Homo sapiens
taattcataatt

SEQ ID NO: 2834827 - DNA, 17 bp, Homo sapiens
taattcataattagaac

SEQ ID NO: 2834828 - DNA, 18 bp, Homo sapiens
taattcataattagaaca

SEQ ID NO: 2834829 - DNA, 21 bp, Homo sapiens
taattcataattagaacaata

SEQ ID NO: 2834830 - DNA, 19 bp, Homo sapiens
taattcccattttgcaaaa

SEQ ID NO: 2834831 - DNA, 21 bp, Homo sapiens
taattcccattttgcaaaatt

SEQ ID NO: 2834832 - DNA, 18 bp, Homo sapiens
taattctaaatgaatgtt

SEQ ID NO: 2834833 - DNA, 15 bp, Homo sapiens
taattctatgagata

SEQ ID NO: 2834834 - DNA, 20 bp, Homo sapiens
taattctcatgtgatccttt

SEQ ID NO: 2834835 - DNA, 19 bp, Homo sapiens
taattcttaataggcttta

SEQ ID NO: 2834836 - DNA, 18 bp, Homo sapiens
taattgcatttctgctct

SEQ ID NO: 2834837 - DNA, 15 bp, Homo sapiens
taattggaattctgg

SEQ ID NO: 2834838 - DNA, 17 bp, Homo sapiens
taattggtgacaatgtc

SEQ ID NO: 2834839 - DNA, 15 bp, Homo sapiens
taattgtagatggaa

SEQ ID NO: 2834840 - DNA, 17 bp, Homo sapiens
taattgtagatggaaat

SEQ ID NO: 2834841 - DNA, 11 bp, Homo sapiens
taattgtgtac

SEQ ID NO: 2834842 - DNA, 12 bp, Homo sapiens
taatttaaacca

SEQ ID NO: 2834843 - DNA, 14 bp, Homo sapiens
taatttaaaccagc

SEQ ID NO: 2834844 - DNA, 22 bp, Homo sapiens
taatttaaaccagcagaaaagt

SEQ ID NO: 2834845 - DNA, 16 bp, Homo sapiens
taatttaactaattta

SEQ ID NO: 2834846 - DNA, 21 bp, Homo sapiens
taatttaactaatttaaacca

SEQ ID NO: 2834847 - DNA, 15 bp, Homo sapiens
taatttagaaaactt

SEQ ID NO: 2834848 - DNA, 16 bp, Homo sapiens
taatttagaaaacttt

SEQ ID NO: 2834849 - DNA, 17 bp, Homo sapiens
taatttagaaaacttta

SEQ ID NO: 2834850 - DNA, 21 bp, Homo sapiens
taatttagaaaactttaaagc

SEQ ID NO: 2834851 - DNA, 15 bp, Homo sapiens
taatttagaaatcat

SEQ ID NO: 2834852 - DNA, 21 bp, Homo sapiens
taatttagacttcaagcatgg

SEQ ID NO: 2834853 - DNA, 16 bp, Homo sapiens
taatttatacaaaata

SEQ ID NO: 2834854 - DNA, 19 bp, Homo sapiens
taatttatacaaaataatt

SEQ ID NO: 2834855 - DNA, 14 bp, Homo sapiens
taatttatgagttt

SEQ ID NO: 2834856 - DNA, 20 bp, Homo sapiens
taatttattgtttttccttg

SEQ ID NO: 2834857 - DNA, 13 bp, Homo sapiens
taatttattttgt

SEQ ID NO: 2834858 - DNA, 14 bp, Homo sapiens
taatttattttgta

SEQ ID NO: 2834859 - DNA, 19 bp, Homo sapiens
taatttcttactaaacatt

SEQ ID NO: 2834860 - DNA, 22 bp, Homo sapiens
taatttgaggacaaccattcca

SEQ ID NO: 2834861 - DNA, 18 bp, Homo sapiens
taattttaaaagttggga

SEQ ID NO: 2834862 - DNA, 14 bp, Homo sapiens
taattttaaacaaa

SEQ ID NO: 2834863 - DNA, 13 bp, Homo sapiens
taattttcctcct

SEQ ID NO: 2834864 - DNA, 23 bp, Homo sapiens
taattttcttcatgcaatgacat

SEQ ID NO: 2834865 - DNA, 19 bp, Homo sapiens
taattttgtagtagttgat

SEQ ID NO: 2834866 - DNA, 20 bp, Homo sapiens
taattttgtttgtaatcctg

SEQ ID NO: 2834867 - DNA, 23 bp, Homo sapiens
taatttttgatactaagcattga

SEQ ID NO: 2834868 - DNA, 16 bp, Homo sapiens
tacaaaataatttaac

SEQ ID NO: 2834869 - DNA, 17 bp, Homo sapiens
tacaaaataatttaact

SEQ ID NO: 2834870 - DNA, 18 bp, Homo sapiens
tacaaaataatttaacta

SEQ ID NO: 2834871 - DNA, 15 bp, Homo sapiens
tacaaacatatttgt

SEQ ID NO: 2834872 - DNA, 13 bp, Homo sapiens
tacaaataaagat

SEQ ID NO: 2834873 - DNA, 21 bp, Homo sapiens
tacaaatttaattttgcagat

SEQ ID NO: 2834874 - DNA, 13 bp, Homo sapiens
tacaaccagagcc

SEQ ID NO: 2834875 - DNA, 15 bp, Homo sapiens
tacaaccagagcccc

SEQ ID NO: 2834876 - DNA, 21 bp, Homo sapiens
tacaaccagagccccccacaa

SEQ ID NO: 2834877 - DNA, 17 bp, Homo sapiens
tacaactagatcaagga

SEQ ID NO: 2834878 - DNA, 14 bp, Homo sapiens
tacaagaagcattt

SEQ ID NO: 2834879 - DNA, 15 bp, Homo sapiens
tacaagaagcatttt

SEQ ID NO: 2834880 - DNA, 18 bp, Homo sapiens
tacaagagccatgtacca

SEQ ID NO: 2834881 - DNA, 20 bp, Homo sapiens
tacaagcgtgagccactgca

SEQ ID NO: 2834882 - DNA, 15 bp, Homo sapiens
tacaagtttataagc

SEQ ID NO: 2834883 - DNA, 15 bp, Homo sapiens
tacaatgcagaattt

SEQ ID NO: 2834884 - DNA, 13 bp, Homo sapiens
tacaatttgcact

SEQ ID NO: 2834885 - DNA, 18 bp, Homo sapiens
tacacaaaaaagtataga

SEQ ID NO: 2834886 - DNA, 14 bp, Homo sapiens
tacacaagtaaaca

SEQ ID NO: 2834887 - DNA, 21 bp, Homo sapiens
tacacacacacgcgtgcacac

SEQ ID NO: 2834888 - DNA, 19 bp, Homo sapiens
tacacagcagtatgaatga

SEQ ID NO: 2834889 - DNA, 15 bp, Homo sapiens
tacacagcctggact

SEQ ID NO: 2834890 - DNA, 22 bp, Homo sapiens
tacacagtaaaaacttgtacta

SEQ ID NO: 2834891 - DNA, 11 bp, Homo sapiens
tacacagttgc

SEQ ID NO: 2834892 - DNA, 18 bp, Homo sapiens
tacacatccccagccaga

SEQ ID NO: 2834893 - DNA, 19 bp, Homo sapiens
tacacatccccagccagaa

SEQ ID NO: 2834894 - DNA, 12 bp, Homo sapiens
tacaccactctg

SEQ ID NO: 2834895 - DNA, 21 bp, Homo sapiens
tacaccactctggcagccaca

SEQ ID NO: 2834896 - DNA, 24 bp, Homo sapiens
tacaccatgtttgagctcagaccc

SEQ ID NO: 2834897 - DNA, 21 bp, Homo sapiens
tacacctatgtcatttcattt

SEQ ID NO: 2834898 - DNA, 15 bp, Homo sapiens
tacaccttagcagct

SEQ ID NO: 2834899 - DNA, 13 bp, Homo sapiens
tacacgtgtcctg

SEQ ID NO: 2834900 - DNA, 17 bp, Homo sapiens
tacactccagcctgagc

SEQ ID NO: 2834901 - DNA, 12 bp, Homo sapiens
tacactcttata

SEQ ID NO: 2834902 - DNA, 20 bp, Homo sapiens
tacactgaagttaacagaga

SEQ ID NO: 2834903 - DNA, 21 bp, Homo sapiens
tacagaaagatggatgtgctt

SEQ ID NO: 2834904 - DNA, 17 bp, Homo sapiens
tacagaaattagccggg

SEQ ID NO: 2834905 - DNA, 13 bp, Homo sapiens
tacagaatgaatc

SEQ ID NO: 2834906 - DNA, 18 bp, Homo sapiens
tacagaatttttaatgac

SEQ ID NO: 2834907 - DNA, 20 bp, Homo sapiens
tacagaatttttaatgactt

SEQ ID NO: 2834908 - DNA, 11 bp, Homo sapiens
tacagacacta

SEQ ID NO: 2834909 - DNA, 15 bp, Homo sapiens
tacagacttctccag

SEQ ID NO: 2834910 - DNA, 16 bp, Homo sapiens
tacagagaatctgaag

SEQ ID NO: 2834911 - DNA, 17 bp, Homo sapiens
tacagagcttgaaaact

SEQ ID NO: 2834912 - DNA, 22 bp, Homo sapiens
tagaagtgttttaatttctaca

SEQ ID NO: 2834913 - DNA, 16 bp, Homo sapiens
tagaataaagaaaaac

SEQ ID NO: 2834914 - DNA, 18 bp, Homo sapiens
tagaatataattatcgga

SEQ ID NO: 2834915 - DNA, 15 bp, Homo sapiens
tagaatatttattac

SEQ ID NO: 2834916 - DNA, 12 bp, Homo sapiens
tagaatgaaaat

SEQ ID NO: 2834917 - DNA, 20 bp, Homo sapiens
tagaatgaaaattgtatgtt

SEQ ID NO: 2834918 - DNA, 21 bp, Homo sapiens
tagaatgatttcatgctatct

SEQ ID NO: 2834919 - DNA, 16 bp, Homo sapiens
tagaatggcagctgga

SEQ ID NO: 2834920 - DNA, 23 bp, Homo sapiens
tagaatggcagctggaatttaag

SEQ ID NO: 2834921 - DNA, 13 bp, Homo sapiens
tagaatgtgtttt

SEQ ID NO: 2834922 - DNA, 15 bp, Homo sapiens
tagaattatatctaa

SEQ ID NO: 2834923 - DNA, 16 bp, Homo sapiens
tagaattatatctaat

SEQ ID NO: 2834924 - DNA, 23 bp, Homo sapiens
tagaattatatctaatttataca

SEQ ID NO: 2834925 - DNA, 19 bp, Homo sapiens
tagaattgagtgtttaaag

SEQ ID NO: 2834926 - DNA, 22 bp, Homo sapiens
tagaatttattcaattcctctg

SEQ ID NO: 2834927 - DNA, 18 bp, Homo sapiens
tagacaactcttccattt

SEQ ID NO: 2834928 - DNA, 15 bp, Homo sapiens
tagacagaagaaaca

SEQ ID NO: 2834929 - DNA, 14 bp, Homo sapiens
tagaccaaaataaa

SEQ ID NO: 2834930 - DNA, 23 bp, Homo sapiens
tagactaggaggttccggtgtct

SEQ ID NO: 2834931 - DNA, 18 bp, Homo sapiens
tagactggacagcttgtg

SEQ ID NO: 2834932 - DNA, 22 bp, Homo sapiens
tagacttcaagcatggctattt

SEQ ID NO: 2834933 - DNA, 19 bp, Homo sapiens
tagactttctcagtgggac

SEQ ID NO: 2834934 - DNA, 16 bp, Homo sapiens
tagagagagaccactt

SEQ ID NO: 2834935 - DNA, 17 bp, Homo sapiens
tagagatgactgagtcc

SEQ ID NO: 2834936 - DNA, 17 bp, Homo sapiens
tagagcacactgtagca

SEQ ID NO: 2834937 - DNA, 17 bp, Homo sapiens
tagaggaaaaaaatgac

SEQ ID NO: 2834938 - DNA, 17 bp, Homo sapiens
tagaggcaaacatttct

SEQ ID NO: 2834939 - DNA, 19 bp, Homo sapiens
tagaggcagggaggggact

SEQ ID NO: 2834940 - DNA, 17 bp, Homo sapiens
tagaggcttccttcatt

SEQ ID NO: 2834941 - DNA, 17 bp, Homo sapiens
tagaggtgagaaattta

SEQ ID NO: 2834942 - DNA, 17 bp, Homo sapiens
tagagtagaagtctctt

SEQ ID NO: 2834943 - DNA, 14 bp, Homo sapiens
tagagtcagccttc

SEQ ID NO: 2834944 - DNA, 22 bp, Homo sapiens
tagagtgcccttaaaataatga

SEQ ID NO: 2834945 - DNA, 18 bp, Homo sapiens
tagagtggcccagaattg

SEQ ID NO: 2834946 - DNA, 19 bp, Homo sapiens
tagatcaaggagcccagaa

SEQ ID NO: 2834947 - DNA, 14 bp, Homo sapiens
tagatcaattaatt

SEQ ID NO: 2834948 - DNA, 12 bp, Homo sapiens
tagatcttctga

SEQ ID NO: 2834949 - DNA, 21 bp, Homo sapiens
tagatgtctttaggcagcagc

SEQ ID NO: 2834950 - DNA, 16 bp, Homo sapiens
tagattagctctggac

SEQ ID NO: 2834951 - DNA, 19 bp, Homo sapiens
tagattctccaaatgattt

SEQ ID NO: 2834952 - DNA, 17 bp, Homo sapiens
tagattttatgaaaaac

SEQ ID NO: 2834953 - DNA, 13 bp, Homo sapiens
tagattttctgct

SEQ ID NO: 2834954 - DNA, 14 bp, Homo sapiens
tagcaaaagaagaa

SEQ ID NO: 2834955 - DNA, 16 bp, Homo sapiens
tagcaaaagaagaagt

SEQ ID NO: 2834956 - DNA, 17 bp, Homo sapiens
tagcaaagatatctcat

SEQ ID NO: 2834957 - DNA, 21 bp, Homo sapiens
tagcaagttctagagaagagg

SEQ ID NO: 2834958 - DNA, 17 bp, Homo sapiens
tagcaatgtaacattaa

SEQ ID NO: 2834959 - DNA, 20 bp, Homo sapiens
tagcactgggaactctggct

SEQ ID NO: 2834960 - DNA, 20 bp, Homo sapiens
tagcagattttaattttgaa

SEQ ID NO: 2834961 - DNA, 19 bp, Homo sapiens
tagcagctcttcccctttc

SEQ ID NO: 2834962 - DNA, 11 bp, Homo sapiens
tagcagctgca

SEQ ID NO: 2834963 - DNA, 15 bp, Homo sapiens
tagcaggaaatagtg

SEQ ID NO: 2834964 - DNA, 22 bp, Homo sapiens
tagcaggtggtcctgagacctg

SEQ ID NO: 2834965 - DNA, 23 bp, Homo sapiens
tagcagtccaaagaacaagaaat

SEQ ID NO: 2834966 - DNA, 16 bp, Homo sapiens
tagcatcttctggagt

SEQ ID NO: 2834967 - DNA, 23 bp, Homo sapiens
tagcatcttctggagtctccagt

SEQ ID NO: 2834968 - DNA, 22 bp, Homo sapiens
tagcatttagtccaatgtcttt

SEQ ID NO: 2834969 - DNA, 22 bp, Homo sapiens
tagccacttaccttcaataaag

SEQ ID NO: 2834970 - DNA, 15 bp, Homo sapiens
tagcccagcactgtg

SEQ ID NO: 2834971 - DNA, 20 bp, Homo sapiens
tagcccagcactgtgaagac

SEQ ID NO: 2834972 - DNA, 17 bp, Homo sapiens
tagccccagtgacagct

SEQ ID NO: 2834973 - DNA, 13 bp, Homo sapiens
tagccccataatt

SEQ ID NO: 2834974 - DNA, 14 bp, Homo sapiens
tagccgacctcagc

SEQ ID NO: 2834975 - DNA, 20 bp, Homo sapiens
tagccttagaagtcacacag

SEQ ID NO: 2834976 - DNA, 14 bp, Homo sapiens
tagccttctctgtt

SEQ ID NO: 2834977 - DNA, 16 bp, Homo sapiens
tagccttctctgttca

SEQ ID NO: 2834978 - DNA, 20 bp, Homo sapiens
tagccttctctgttcatttc

SEQ ID NO: 2834979 - DNA, 22 bp, Homo sapiens
tagccttgccttttaaaagaaa

SEQ ID NO: 2834980 - DNA, 21 bp, Homo sapiens
tagcgctgccgcaccccagag

SEQ ID NO: 2834981 - DNA, 15 bp, Homo sapiens
tagctacttttcaga

SEQ ID NO: 2834982 - DNA, 14 bp, Homo sapiens
tagctagaagtggg

SEQ ID NO: 2834983 - DNA, 19 bp, Homo sapiens
tagctagaagtgggccagg

SEQ ID NO: 2834984 - DNA, 18 bp, Homo sapiens
tagctattgcatgtaaaa

SEQ ID NO: 2834985 - DNA, 19 bp, Homo sapiens
tagctatttttatggaatt

SEQ ID NO: 2834986 - DNA, 16 bp, Homo sapiens
tagctcaggtgtccct

SEQ ID NO: 2834987 - DNA, 21 bp, Homo sapiens
tagctcaggtgtccctgcact

SEQ ID NO: 2834988 - DNA, 14 bp, Homo sapiens
tagctctgatcagc

SEQ ID NO: 2834989 - DNA, 17 bp, Homo sapiens
tagctcttctatttaaa

SEQ ID NO: 2834990 - DNA, 12 bp, Homo sapiens
tagctgagctca

SEQ ID NO: 2834991 - DNA, 14 bp, Homo sapiens
tagctgatcagttt

SEQ ID NO: 2834992 - DNA, 21 bp, Homo sapiens
tagctgtaaatacatgtgtgg

SEQ ID NO: 2834993 - DNA, 21 bp, Homo sapiens
tagctgtctgctcagacagaa

SEQ ID NO: 2834994 - DNA, 13 bp, Homo sapiens
tagctgtgacctg

SEQ ID NO: 2834995 - DNA, 22 bp, Homo sapiens
tagctgtgacctgctgagctct

SEQ ID NO: 2834996 - DNA, 17 bp, Homo sapiens
tagctgttgagctgttt

SEQ ID NO: 2834997 - DNA, 17 bp, Homo sapiens
tagcttaaataaattca

SEQ ID NO: 2834998 - DNA, 19 bp, Homo sapiens
tagcttagacctcagcctg

SEQ ID NO: 2834999 - DNA, 12 bp, Homo sapiens
tagcttccatga

SEQ ID NO: 2835000 - DNA, 11 bp, Homo sapiens
tagctttgctc

SEQ ID NO: 2835001 - DNA, 15 bp, Homo sapiens
tagctttgctctttg

SEQ ID NO: 2835002 - DNA, 16 bp, Homo sapiens
tatgagctcttcatgt

SEQ ID NO: 2835003 - DNA, 21 bp, Homo sapiens
tatgagtttttgatagcttta

SEQ ID NO: 2835004 - DNA, 21 bp, Homo sapiens
tatgatcacggctcactgcag

SEQ ID NO: 2835005 - DNA, 21 bp, Homo sapiens
tatgatgggtgtttttagcag

SEQ ID NO: 2835006 - DNA, 17 bp, Homo sapiens
tatgatttaaaaaataa

SEQ ID NO: 2835007 - DNA, 18 bp, Homo sapiens
tatgattttctatttttc

SEQ ID NO: 2835008 - DNA, 21 bp, Homo sapiens
tatgattttctatttttcttc

SEQ ID NO: 2835009 - DNA, 23 bp, Homo sapiens
tatgcaatttttaaactagtaat

SEQ ID NO: 2835010 - DNA, 20 bp, Homo sapiens
tatgcacatatggactctgc

SEQ ID NO: 2835011 - DNA, 18 bp, Homo sapiens
tatgcaccttgtgtctgt

SEQ ID NO: 2835012 - DNA, 22 bp, Homo sapiens
tatgcaccttgtgtctgtacac

SEQ ID NO: 2835013 - DNA, 20 bp, Homo sapiens
tatgccctcagatggagaca

SEQ ID NO: 2835014 - DNA, 17 bp, Homo sapiens
tatgccttgtctgggga

SEQ ID NO: 2835015 - DNA, 22 bp, Homo sapiens
tatgctgagtatgttaagctct

SEQ ID NO: 2835016 - DNA, 22 bp, Homo sapiens
tatgctgccaaattttggccaa

SEQ ID NO: 2835017 - DNA, 12 bp, Homo sapiens
tatggaaatata

SEQ ID NO: 2835018 - DNA, 15 bp, Homo sapiens
tatggaaatcctgtt

SEQ ID NO: 2835019 - DNA, 14 bp, Homo sapiens
tatggaatacagtg

SEQ ID NO: 2835020 - DNA, 23 bp, Homo sapiens
tatggaatacagtgttattttct

SEQ ID NO: 2835021 - DNA, 21 bp, Homo sapiens
tatggcacttattatgaggct

SEQ ID NO: 2835022 - DNA, 13 bp, Homo sapiens
tatggcagtgtct

SEQ ID NO: 2835023 - DNA, 13 bp, Homo sapiens
tatggcctgtgtc

SEQ ID NO: 2835024 - DNA, 14 bp, Homo sapiens
tatggcctgtgtca

SEQ ID NO: 2835025 - DNA, 22 bp, Homo sapiens
tatgggtgtgtgtttgtgtgag

SEQ ID NO: 2835026 - DNA, 14 bp, Homo sapiens
tatggtatttgagt

SEQ ID NO: 2835027 - DNA, 16 bp, Homo sapiens
tatggtgtaatgcaca

SEQ ID NO: 2835028 - DNA, 18 bp, Homo sapiens
tatggtgtaatgcacaat

SEQ ID NO: 2835029 - DNA, 20 bp, Homo sapiens
tatggtgtaatgcacaattt

SEQ ID NO: 2835030 - DNA, 12 bp, Homo sapiens
tatgtaaaataa

SEQ ID NO: 2835031 - DNA, 19 bp, Homo sapiens
tatgtaaaataaaattatg

SEQ ID NO: 2835032 - DNA, 18 bp, Homo sapiens
tatgtaaacataattctt

SEQ ID NO: 2835033 - DNA, 14 bp, Homo sapiens
tatgtacagttata

SEQ ID NO: 2835034 - DNA, 14 bp, Homo sapiens
tatgtatatatata

SEQ ID NO: 2835035 - DNA, 14 bp, Homo sapiens
tatgtatatgtata

SEQ ID NO: 2835036 - DNA, 16 bp, Homo sapiens
tatgtatatgtatata

SEQ ID NO: 2835037 - DNA, 18 bp, Homo sapiens
tatgtatatgtatatcta

SEQ ID NO: 2835038 - DNA, 20 bp, Homo sapiens
tatgtatggaatacagtgtt

SEQ ID NO: 2835039 - DNA, 16 bp, Homo sapiens
tatgtattattttcta

SEQ ID NO: 2835040 - DNA, 19 bp, Homo sapiens
tatgtcatcatacatgact

SEQ ID NO: 2835041 - DNA, 17 bp, Homo sapiens
tatgtcttggacactgt

SEQ ID NO: 2835042 - DNA, 21 bp, Homo sapiens
tatgtgaaagtgtaaaataga

SEQ ID NO: 2835043 - DNA, 20 bp, Homo sapiens
tatgtgatatctgaacacat

SEQ ID NO: 2835044 - DNA, 19 bp, Homo sapiens
tatgtggtttccacgatga

SEQ ID NO: 2835045 - DNA, 12 bp, Homo sapiens
tatgtgtgtata

SEQ ID NO: 2835046 - DNA, 12 bp, Homo sapiens
tatgtgtgtgta

SEQ ID NO: 2835047 - DNA, 14 bp, Homo sapiens
tatgttaagctctt

SEQ ID NO: 2835048 - DNA, 22 bp, Homo sapiens
tatgttacatctgttttaaatt

SEQ ID NO: 2835049 - DNA, 20 bp, Homo sapiens
tatgttcattaaattttcta

SEQ ID NO: 2835050 - DNA, 22 bp, Homo sapiens
tatgttcattaaattttctatg

SEQ ID NO: 2835051 - DNA, 13 bp, Homo sapiens
tatgttgctgaaa

SEQ ID NO: 2835052 - DNA, 14 bp, Homo sapiens
tatgtttaaaaaca

SEQ ID NO: 2835053 - DNA, 17 bp, Homo sapiens
tatgttttaagaggcag

SEQ ID NO: 2835054 - DNA, 17 bp, Homo sapiens
tattaaacttgtcagaa

SEQ ID NO: 2835055 - DNA, 12 bp, Homo sapiens
tattaaaggctt

SEQ ID NO: 2835056 - DNA, 17 bp, Homo sapiens
tattaaatacagacact

SEQ ID NO: 2835057 - DNA, 19 bp, Homo sapiens
tattaatcaactttcctta

SEQ ID NO: 2835058 - DNA, 13 bp, Homo sapiens
tattaatgaactg

SEQ ID NO: 2835059 - DNA, 14 bp, Homo sapiens
tattaattatctga

SEQ ID NO: 2835060 - DNA, 19 bp, Homo sapiens
tattaccaaaaaagtattt

SEQ ID NO: 2835061 - DNA, 20 bp, Homo sapiens
tattaccaaaaaagtatttt

SEQ ID NO: 2835062 - DNA, 14 bp, Homo sapiens
tattacctcaaatt

SEQ ID NO: 2835063 - DNA, 13 bp, Homo sapiens
tattacctctgat

SEQ ID NO: 2835064 - DNA, 23 bp, Homo sapiens
tattacttatttttgacagtgtt

SEQ ID NO: 2835065 - DNA, 13 bp, Homo sapiens
tattacttctgct

SEQ ID NO: 2835066 - DNA, 21 bp, Homo sapiens
tattagagtgcccttaaaata

SEQ ID NO: 2835067 - DNA, 21 bp, Homo sapiens
tattagtttgatttaatatct

SEQ ID NO: 2835068 - DNA, 18 bp, Homo sapiens
tattataaataaatgcca

SEQ ID NO: 2835069 - DNA, 19 bp, Homo sapiens
tattatgaggctattaaaa

SEQ ID NO: 2835070 - DNA, 20 bp, Homo sapiens
tattatgaggctattaaaag

SEQ ID NO: 2835071 - DNA, 19 bp, Homo sapiens
tattatggtgtaatgcaca

SEQ ID NO: 2835072 - DNA, 20 bp, Homo sapiens
tattatggtgtaatgcacaa

SEQ ID NO: 2835073 - DNA, 15 bp, Homo sapiens
tattattgtgtgtta

SEQ ID NO: 2835074 - DNA, 16 bp, Homo sapiens
tattattttcacctgt

SEQ ID NO: 2835075 - DNA, 16 bp, Homo sapiens
tattcaattcctctgg

SEQ ID NO: 2835076 - DNA, 14 bp, Homo sapiens
tattcagacaagca

SEQ ID NO: 2835077 - DNA, 19 bp, Homo sapiens
tattcagagatgtaccatg

SEQ ID NO: 2835078 - DNA, 20 bp, Homo sapiens
tattcagatcgtattaatta

SEQ ID NO: 2835079 - DNA, 14 bp, Homo sapiens
tattcagtaaaaaa

SEQ ID NO: 2835080 - DNA, 15 bp, Homo sapiens
tattcagtgctgtgg

SEQ ID NO: 2835081 - DNA, 18 bp, Homo sapiens
tattcagtgctgtggcct

SEQ ID NO: 2835082 - DNA, 13 bp, Homo sapiens
tattcatgtaata

SEQ ID NO: 2835083 - DNA, 20 bp, Homo sapiens
tattcatgtaataaatctga

SEQ ID NO: 2835084 - DNA, 18 bp, Homo sapiens
tattccatatattagcat

SEQ ID NO: 2835085 - DNA, 18 bp, Homo sapiens
tattccatccatatactt

SEQ ID NO: 2835086 - DNA, 22 bp, Homo sapiens
tattccatttttactaaagcag

SEQ ID NO: 2835087 - DNA, 23 bp, Homo sapiens
tattcccaagctctagtgggaag

SEQ ID NO: 2835088 - DNA, 17 bp, Homo sapiens
tattccccatcttccaa

SEQ ID NO: 2835089 - DNA, 22 bp, Homo sapiens
tattcctatatagtttattgac

SEQ ID NO: 2835090 - DNA, 14 bp, Homo sapiens
tattcctattgtgc

SEQ ID NO: 2835091 - DNA, 20 bp, Homo sapiens
tattcctggtattatttaca

SEQ ID NO: 2835092 - DNA, 19 bp, Homo sapiens
tcactcccagaccacctcc

SEQ ID NO: 2835093 - DNA, 19 bp, Homo sapiens
tcactccggtgtgcctgca

SEQ ID NO: 2835094 - DNA, 20 bp, Homo sapiens
tcactccggtgtgcctgcag

SEQ ID NO: 2835095 - DNA, 23 bp, Homo sapiens
tcactccggtgtgcctgcagccc

SEQ ID NO: 2835096 - DNA, 10 bp, Homo sapiens
tcactcctgt

SEQ ID NO: 2835097 - DNA, 18 bp, Homo sapiens
tcactcttcctgcaagga

SEQ ID NO: 2835098 - DNA, 22 bp, Homo sapiens
tcactgaatgcctcaatgtgac

SEQ ID NO: 2835099 - DNA, 18 bp, Homo sapiens
tcactgcaacctccgcct

SEQ ID NO: 2835100 - DNA, 13 bp, Homo sapiens
tcactgcagcctc

SEQ ID NO: 2835101 - DNA, 18 bp, Homo sapiens
tcactgccccaccagcca

SEQ ID NO: 2835102 - DNA, 20 bp, Homo sapiens
tcactgccccaccagccacc

SEQ ID NO: 2835103 - DNA, 23 bp, Homo sapiens
tcactgccccaccagccacctct

SEQ ID NO: 2835104 - DNA, 17 bp, Homo sapiens
tcactggagcaccaggc

SEQ ID NO: 2835105 - DNA, 22 bp, Homo sapiens
tcactggagcaccaggcacgaa

SEQ ID NO: 2835106 - DNA, 14 bp, Homo sapiens
tcactggagcccag

SEQ ID NO: 2835107 - DNA, 16 bp, Homo sapiens
tcactggcaatgaaaa

SEQ ID NO: 2835108 - DNA, 22 bp, Homo sapiens
tcactggcgaggtgcggccacc

SEQ ID NO: 2835109 - DNA, 15 bp, Homo sapiens
tcactgggctaccgt

SEQ ID NO: 2835110 - DNA, 20 bp, Homo sapiens
tcactgtagaatgatttcat

SEQ ID NO: 2835111 - DNA, 15 bp, Homo sapiens
tcactgttgcccagg

SEQ ID NO: 2835112 - DNA, 17 bp, Homo sapiens
tcacttacctagattta

SEQ ID NO: 2835113 - DNA, 16 bp, Homo sapiens
tcacttcattgaccaa

SEQ ID NO: 2835114 - DNA, 18 bp, Homo sapiens
tcacttgaacccgggagg

SEQ ID NO: 2835115 - DNA, 13 bp, Homo sapiens
tcacttgtacaaa

SEQ ID NO: 2835116 - DNA, 14 bp, Homo sapiens
tcacttgtacaaaa

SEQ ID NO: 2835117 - DNA, 16 bp, Homo sapiens
tcactttaattctcat

SEQ ID NO: 2835118 - DNA, 17 bp, Homo sapiens
tcagaaaagaaaaccat

SEQ ID NO: 2835119 - DNA, 20 bp, Homo sapiens
tcagaaaagtagaattatat

SEQ ID NO: 2835120 - DNA, 19 bp, Homo sapiens
tcagaaagggagggctctg

SEQ ID NO: 2835121 - DNA, 22 bp, Homo sapiens
tcagaaagggagggctctgagg

SEQ ID NO: 2835122 - DNA, 12 bp, Homo sapiens
tcagaaatatgt

SEQ ID NO: 2835123 - DNA, 15 bp, Homo sapiens
tcagaacatcctcca

SEQ ID NO: 2835124 - DNA, 16 bp, Homo sapiens
tcagaacatcctccaa

SEQ ID NO: 2835125 - DNA, 13 bp, Homo sapiens
tcagaagaaaaag

SEQ ID NO: 2835126 - DNA, 16 bp, Homo sapiens
tcagaagaaaaagaag

SEQ ID NO: 2835127 - DNA, 17 bp, Homo sapiens
tcagaagaaaaagaagc

SEQ ID NO: 2835128 - DNA, 13 bp, Homo sapiens
tcagaagacactg

SEQ ID NO: 2835129 - DNA, 20 bp, Homo sapiens
tcagaagcctgaggctggga

SEQ ID NO: 2835130 - DNA, 21 bp, Homo sapiens
tcagaagcctgggggcctggc

SEQ ID NO: 2835131 - DNA, 23 bp, Homo sapiens
tcagaagcctgggggcctggctg

SEQ ID NO: 2835132 - DNA, 12 bp, Homo sapiens
tcagaaggagaa

SEQ ID NO: 2835133 - DNA, 14 bp, Homo sapiens
tcagaaggagaagg

SEQ ID NO: 2835134 - DNA, 13 bp, Homo sapiens
tcagaagtgcaaa

SEQ ID NO: 2835135 - DNA, 19 bp, Homo sapiens
tcagaagtttctcagctcc

SEQ ID NO: 2835136 - DNA, 15 bp, Homo sapiens
tcagaatccaaagat

SEQ ID NO: 2835137 - DNA, 22 bp, Homo sapiens
tcagacagcttatggggtattt

SEQ ID NO: 2835138 - DNA, 20 bp, Homo sapiens
tcagaccaactctctcctgt

SEQ ID NO: 2835139 - DNA, 18 bp, Homo sapiens
tcagacccccactctcat

SEQ ID NO: 2835140 - DNA, 22 bp, Homo sapiens
tcagacccccactctcattccc

SEQ ID NO: 2835141 - DNA, 17 bp, Homo sapiens
tcagacctctgatccct

SEQ ID NO: 2835142 - DNA, 14 bp, Homo sapiens
tcagactgctggga

SEQ ID NO: 2835143 - DNA, 17 bp, Homo sapiens
tcagactttaaagaata

SEQ ID NO: 2835144 - DNA, 23 bp, Homo sapiens
tcagactttaaagaataatatgc

SEQ ID NO: 2835145 - DNA, 14 bp, Homo sapiens
tcagagactcaggg

SEQ ID NO: 2835146 - DNA, 17 bp, Homo sapiens
tcagagactcagggccc

SEQ ID NO: 2835147 - DNA, 14 bp, Homo sapiens
tcagagagagtgtt

SEQ ID NO: 2835148 - DNA, 22 bp, Homo sapiens
tcagagagcgagcgctacccac

SEQ ID NO: 2835149 - DNA, 12 bp, Homo sapiens
tcagagcctgca

SEQ ID NO: 2835150 - DNA, 14 bp, Homo sapiens
tcagaggcagcagg

SEQ ID NO: 2835151 - DNA, 21 bp, Homo sapiens
tcagagggaaagtaaatattt

SEQ ID NO: 2835152 - DNA, 17 bp, Homo sapiens
tcagagttgcttttcta

SEQ ID NO: 2835153 - DNA, 17 bp, Homo sapiens
tcagatagaatgacagt

SEQ ID NO: 2835154 - DNA, 18 bp, Homo sapiens
tcagatatatttttcaca

SEQ ID NO: 2835155 - DNA, 22 bp, Homo sapiens
tcagatcgtattaattatctga

SEQ ID NO: 2835156 - DNA, 18 bp, Homo sapiens
tcagatgggaagacatga

SEQ ID NO: 2835157 - DNA, 19 bp, Homo sapiens
tcagattcccagagcaaaa

SEQ ID NO: 2835158 - DNA, 14 bp, Homo sapiens
tcagcagccctcct

SEQ ID NO: 2835159 - DNA, 17 bp, Homo sapiens
tcagcagccctcctcac

SEQ ID NO: 2835160 - DNA, 17 bp, Homo sapiens
tcagcatacctttattg

SEQ ID NO: 2835161 - DNA, 17 bp, Homo sapiens
tcagcatcctggcaccc

SEQ ID NO: 2835162 - DNA, 16 bp, Homo sapiens
tcagcatttaataaat

SEQ ID NO: 2835163 - DNA, 22 bp, Homo sapiens
tcagccaaatgtaattgaataa

SEQ ID NO: 2835164 - DNA, 21 bp, Homo sapiens
tcagccaacgagtaatttatt

SEQ ID NO: 2835165 - DNA, 21 bp, Homo sapiens
tcagcccctcctctgccacct

SEQ ID NO: 2835166 - DNA, 12 bp, Homo sapiens
tcagccctgggc

SEQ ID NO: 2835167 - DNA, 21 bp, Homo sapiens
tcagccctgggccccaccacc

SEQ ID NO: 2835168 - DNA, 23 bp, Homo sapiens
tcagccctgggccccaccaccta

SEQ ID NO: 2835169 - DNA, 22 bp, Homo sapiens
tcagcctagccgacctcagcct

SEQ ID NO: 2835170 - DNA, 21 bp, Homo sapiens
tcagcctcccaaagtgctggg

SEQ ID NO: 2835171 - DNA, 22 bp, Homo sapiens
tcagcctcccaaagtgctggga

SEQ ID NO: 2835172 - DNA, 20 bp, Homo sapiens
tcagcctcctgagtagctgg

SEQ ID NO: 2835173 - DNA, 21 bp, Homo sapiens
tcagcctcttaaagctgcctg

SEQ ID NO: 2835174 - DNA, 16 bp, Homo sapiens
tcagcctgagtctcct

SEQ ID NO: 2835175 - DNA, 14 bp, Homo sapiens
tcagcctggtgggc

SEQ ID NO: 2835176 - DNA, 18 bp, Homo sapiens
tcagcctggtgggcctcc

SEQ ID NO: 2835177 - DNA, 19 bp, Homo sapiens
tcagcctggtgggcctcct

SEQ ID NO: 2835178 - DNA, 16 bp, Homo sapiens
tcagcctgtgctgccc

SEQ ID NO: 2835179 - DNA, 17 bp, Homo sapiens
tcagcctgtgctgcccg

SEQ ID NO: 2835180 - DNA, 21 bp, Homo sapiens
tcagccttccccctcccaggg

SEQ ID NO: 2835181 - DNA, 17 bp, Homo sapiens
tcagccttgaaaaacaa

SEQ ID NO: 2835182 - DNA, 15 bp, Homo sapiens
ctgggagaacctcag

SEQ ID NO: 2835183 - DNA, 14 bp, Homo sapiens
ctgggagctctgca

SEQ ID NO: 2835184 - DNA, 15 bp, Homo sapiens
ctgggaggaagcagg

SEQ ID NO: 2835185 - DNA, 14 bp, Homo sapiens
ctgggatgtttctg

SEQ ID NO: 2835186 - DNA, 17 bp, Homo sapiens
ctgggattacaggtgtg

SEQ ID NO: 2835187 - DNA, 23 bp, Homo sapiens
ctgggattcaggaaaaggcctgg

SEQ ID NO: 2835188 - DNA, 17 bp, Homo sapiens
ctgggattcccaccaag

SEQ ID NO: 2835189 - DNA, 23 bp, Homo sapiens
ctgggcaggtctcctctgggagg

SEQ ID NO: 2835190 - DNA, 15 bp, Homo sapiens
ctgggccctggggcc

SEQ ID NO: 2835191 - DNA, 17 bp, Homo sapiens
ctgggccctggggcctg

SEQ ID NO: 2835192 - DNA, 22 bp, Homo sapiens
ctgggcctatggagagccctgg

SEQ ID NO: 2835193 - DNA, 12 bp, Homo sapiens
ctgggcctgctg

SEQ ID NO: 2835194 - DNA, 17 bp, Homo sapiens
ctgggcctgctgctgag

SEQ ID NO: 2835195 - DNA, 20 bp, Homo sapiens
ctgggcctgctgctgagaac

SEQ ID NO: 2835196 - DNA, 22 bp, Homo sapiens
ctgggcctgctgctgagaacct

SEQ ID NO: 2835197 - DNA, 14 bp, Homo sapiens
ctgggctcatcagc

SEQ ID NO: 2835198 - DNA, 13 bp, Homo sapiens
ctgggctctccac

SEQ ID NO: 2835199 - DNA, 16 bp, Homo sapiens
ctgggctctccacctc

SEQ ID NO: 2835200 - DNA, 18 bp, Homo sapiens
ctgggctctgccccagct

SEQ ID NO: 2835201 - DNA, 23 bp, Homo sapiens
ctgggctctgccccagctctggc

SEQ ID NO: 2835202 - DNA, 19 bp, Homo sapiens
ctgggcttcagcctctccc

SEQ ID NO: 2835203 - DNA, 18 bp, Homo sapiens
ctgggcttcagtggcagc

SEQ ID NO: 2835204 - DNA, 21 bp, Homo sapiens
ctgggcttcagtggcagctgc

SEQ ID NO: 2835205 - DNA, 23 bp, Homo sapiens
ctgggcttcagtggcagctgctt

SEQ ID NO: 2835206 - DNA, 13 bp, Homo sapiens
ctggggagaaagt

SEQ ID NO: 2835207 - DNA, 20 bp, Homo sapiens
ctggggagcgaaagtttctt

SEQ ID NO: 2835208 - DNA, 19 bp, Homo sapiens
ctggggcctcggagcctca

SEQ ID NO: 2835209 - DNA, 20 bp, Homo sapiens
ctggggcctcggagcctcat

SEQ ID NO: 2835210 - DNA, 16 bp, Homo sapiens
ctggggcctgtactgc

SEQ ID NO: 2835211 - DNA, 17 bp, Homo sapiens
ctggggcctgtactgcc

SEQ ID NO: 2835212 - DNA, 19 bp, Homo sapiens
ctggggcctgtactgcctg

SEQ ID NO: 2835213 - DNA, 22 bp, Homo sapiens
ctggggcctgtactgcctgctt

SEQ ID NO: 2835214 - DNA, 20 bp, Homo sapiens
ctggggctcctttctccagc

SEQ ID NO: 2835215 - DNA, 20 bp, Homo sapiens
ctggggctctaacgcctgag

SEQ ID NO: 2835216 - DNA, 22 bp, Homo sapiens
ctggggctctaacgcctgagcc

SEQ ID NO: 2835217 - DNA, 16 bp, Homo sapiens
ctggggcttctcctga

SEQ ID NO: 2835218 - DNA, 15 bp, Homo sapiens
ctgggggcctggctg

SEQ ID NO: 2835219 - DNA, 16 bp, Homo sapiens
ctgggggcgggggagc

SEQ ID NO: 2835220 - DNA, 18 bp, Homo sapiens
ctgggggctagcagaagt

SEQ ID NO: 2835221 - DNA, 12 bp, Homo sapiens
ctggggtacagg

SEQ ID NO: 2835222 - DNA, 16 bp, Homo sapiens
ctggggtacaggtttg

SEQ ID NO: 2835223 - DNA, 21 bp, Homo sapiens
ctggggtgacccggcaccccc

SEQ ID NO: 2835224 - DNA, 23 bp, Homo sapiens
ctggggtgggggtggggagacct

SEQ ID NO: 2835225 - DNA, 23 bp, Homo sapiens
ctggggttcagcccctcctctgc

SEQ ID NO: 2835226 - DNA, 23 bp, Homo sapiens
ctgggtacttgtggacacagctc

SEQ ID NO: 2835227 - DNA, 20 bp, Homo sapiens
ctgggtaggtgttgaaaatg

SEQ ID NO: 2835228 - DNA, 23 bp, Homo sapiens
ctgggtgacagagcaagactctg

SEQ ID NO: 2835229 - DNA, 14 bp, Homo sapiens
ctgggttcactgca

SEQ ID NO: 2835230 - DNA, 20 bp, Homo sapiens
ctgggttcactgcaacctcc

SEQ ID NO: 2835231 - DNA, 15 bp, Homo sapiens
ctgggttggagggtg

SEQ ID NO: 2835232 - DNA, 22 bp, Homo sapiens
ctgggtttattacatggcagtg

SEQ ID NO: 2835233 - DNA, 18 bp, Homo sapiens
ctggtagaattgggaagc

SEQ ID NO: 2835234 - DNA, 20 bp, Homo sapiens
ctggtagaattgggaagctg

SEQ ID NO: 2835235 - DNA, 22 bp, Homo sapiens
ctggtatgaacttgaggacaca

SEQ ID NO: 2835236 - DNA, 19 bp, Homo sapiens
ctggtattatttacaatgc

SEQ ID NO: 2835237 - DNA, 16 bp, Homo sapiens
ctggtcaggcccactg

SEQ ID NO: 2835238 - DNA, 14 bp, Homo sapiens
ctggtcccactcag

SEQ ID NO: 2835239 - DNA, 18 bp, Homo sapiens
ctggtcccactcagtcca

SEQ ID NO: 2835240 - DNA, 16 bp, Homo sapiens
ctggtccttccaggcc

SEQ ID NO: 2835241 - DNA, 17 bp, Homo sapiens
ctggtccttccaggccc

SEQ ID NO: 2835242 - DNA, 17 bp, Homo sapiens
ctggtctccctccagct

SEQ ID NO: 2835243 - DNA, 18 bp, Homo sapiens
ctggtctccctccagctg

SEQ ID NO: 2835244 - DNA, 14 bp, Homo sapiens
ctggtcttgagatg

SEQ ID NO: 2835245 - DNA, 19 bp, Homo sapiens
ctggtgcactggccccacc

SEQ ID NO: 2835246 - DNA, 17 bp, Homo sapiens
ctggtgctgtggccagg

SEQ ID NO: 2835247 - DNA, 18 bp, Homo sapiens
ctggtgctgtggccaggg

SEQ ID NO: 2835248 - DNA, 15 bp, Homo sapiens
ctggtggacagtcct

SEQ ID NO: 2835249 - DNA, 16 bp, Homo sapiens
ctggtggacagtcctg

SEQ ID NO: 2835250 - DNA, 19 bp, Homo sapiens
ctggtggacagtcctggga

SEQ ID NO: 2835251 - DNA, 21 bp, Homo sapiens
ctggtggacagtcctgggaga

SEQ ID NO: 2835252 - DNA, 16 bp, Homo sapiens
ctggtggaccacaggc

SEQ ID NO: 2835253 - DNA, 15 bp, Homo sapiens
ctggtggcagctgcg

SEQ ID NO: 2835254 - DNA, 18 bp, Homo sapiens
ctggtggcagtgggagct

SEQ ID NO: 2835255 - DNA, 21 bp, Homo sapiens
ctggtggccatgtcgcctgcc

SEQ ID NO: 2835256 - DNA, 17 bp, Homo sapiens
ctggtgggcctcctctg

SEQ ID NO: 2835257 - DNA, 22 bp, Homo sapiens
ctggtgttctcaatgcttttct

SEQ ID NO: 2835258 - DNA, 14 bp, Homo sapiens
ctggttagaaatgc

SEQ ID NO: 2835259 - DNA, 20 bp, Homo sapiens
ctggttcagggttggcccct

SEQ ID NO: 2835260 - DNA, 19 bp, Homo sapiens
ctggttggccgtggtccag

SEQ ID NO: 2835261 - DNA, 21 bp, Homo sapiens
ctggtttgtcaaacaacatgt

SEQ ID NO: 2835262 - DNA, 18 bp, Homo sapiens
ctggttttcctaaatgca

SEQ ID NO: 2835263 - DNA, 17 bp, Homo sapiens
ctgtaaatacaaaataa

SEQ ID NO: 2835264 - DNA, 19 bp, Homo sapiens
ctgtaaatagttttaaata

SEQ ID NO: 2835265 - DNA, 21 bp, Homo sapiens
ctgtaaatagttttaaatatg

SEQ ID NO: 2835266 - DNA, 22 bp, Homo sapiens
ctgtaacacaagccacagaagc

SEQ ID NO: 2835267 - DNA, 16 bp, Homo sapiens
ctgtaatcccagcact

SEQ ID NO: 2835268 - DNA, 20 bp, Homo sapiens
ctgtaatcccagcatgctga

SEQ ID NO: 2835269 - DNA, 16 bp, Homo sapiens
ctgtacaatatttaaa

SEQ ID NO: 2835270 - DNA, 21 bp, Homo sapiens
ctgtacaatatttaaaattta

SEQ ID NO: 2835271 - DNA, 13 bp, Homo sapiens
ctgtacactgcac

SEQ ID NO: 2835272 - DNA, 13 bp, Homo sapiens
ctgctctcagcct

SEQ ID NO: 2835273 - DNA, 14 bp, Homo sapiens
ctgctctcctcttg

SEQ ID NO: 2835274 - DNA, 20 bp, Homo sapiens
ctgctctcctcttgccactg

SEQ ID NO: 2835275 - DNA, 16 bp, Homo sapiens
ctgctctctgagggag

SEQ ID NO: 2835276 - DNA, 13 bp, Homo sapiens
ctgctctgaggct

SEQ ID NO: 2835277 - DNA, 20 bp, Homo sapiens
ctgctctgaggcttccagag

SEQ ID NO: 2835278 - DNA, 17 bp, Homo sapiens
ctgctcttccaaagctc

SEQ ID NO: 2835279 - DNA, 13 bp, Homo sapiens
ctgctcttgcctg

SEQ ID NO: 2835280 - DNA, 16 bp, Homo sapiens
ctgctcttgcctgcac

SEQ ID NO: 2835281 - DNA, 17 bp, Homo sapiens
ctgctgaaacacctccc

SEQ ID NO: 2835282 - DNA, 18 bp, Homo sapiens
ctgctgaaggaataaatt

SEQ ID NO: 2835283 - DNA, 22 bp, Homo sapiens
ctgctgaatgatttccaaagag

SEQ ID NO: 2835284 - DNA, 18 bp, Homo sapiens
ctgctgacagacacaggc

SEQ ID NO: 2835285 - DNA, 12 bp, Homo sapiens
ctgctgacagtg

SEQ ID NO: 2835286 - DNA, 15 bp, Homo sapiens
ctgctgacagtgttg

SEQ ID NO: 2835287 - DNA, 16 bp, Homo sapiens
ctgctgagaacctggc

SEQ ID NO: 2835288 - DNA, 20 bp, Homo sapiens
ctgctgagaacctggccttc

SEQ ID NO: 2835289 - DNA, 15 bp, Homo sapiens
ctgctgagagaccca

SEQ ID NO: 2835290 - DNA, 14 bp, Homo sapiens
ctgctgagctctga

SEQ ID NO: 2835291 - DNA, 15 bp, Homo sapiens
ctgctgagctctgag

SEQ ID NO: 2835292 - DNA, 12 bp, Homo sapiens
ctgctgcaaagt

SEQ ID NO: 2835293 - DNA, 15 bp, Homo sapiens
ctgctgcaaagtgca

SEQ ID NO: 2835294 - DNA, 16 bp, Homo sapiens
ctgctgcaaagtgcaa

SEQ ID NO: 2835295 - DNA, 15 bp, Homo sapiens
ctgctgcccagcctc

SEQ ID NO: 2835296 - DNA, 22 bp, Homo sapiens
ctgctgcccagcctccaagctc

SEQ ID NO: 2835297 - DNA, 16 bp, Homo sapiens
ctgctgccccgcttcc

SEQ ID NO: 2835298 - DNA, 20 bp, Homo sapiens
ctgctgccccgcttccccac

SEQ ID NO: 2835299 - DNA, 14 bp, Homo sapiens
ctgctgccgcctcc

SEQ ID NO: 2835300 - DNA, 20 bp, Homo sapiens
ctgctgccgcctcccagcct

SEQ ID NO: 2835301 - DNA, 21 bp, Homo sapiens
ctgctgctgagaacctggcct

SEQ ID NO: 2835302 - DNA, 23 bp, Homo sapiens
ctgctgctgagaacctggccttc

SEQ ID NO: 2835303 - DNA, 13 bp, Homo sapiens
ctgctggcctgga

SEQ ID NO: 2835304 - DNA, 14 bp, Homo sapiens
ctgctggcctggat

SEQ ID NO: 2835305 - DNA, 13 bp, Homo sapiens
ctgctggcctggc

SEQ ID NO: 2835306 - DNA, 17 bp, Homo sapiens
ctgctgggctctccacc

SEQ ID NO: 2835307 - DNA, 23 bp, Homo sapiens
ctgctgggctctccacctcagcc

SEQ ID NO: 2835308 - DNA, 12 bp, Homo sapiens
ctgctggggagt

SEQ ID NO: 2835309 - DNA, 22 bp, Homo sapiens
ctgctggtgcagagctgaagat

SEQ ID NO: 2835310 - DNA, 23 bp, Homo sapiens
ctgctggttcagggttggcccct

SEQ ID NO: 2835311 - DNA, 22 bp, Homo sapiens
ctgctgtcattgtccatgccta

SEQ ID NO: 2835312 - DNA, 10 bp, Homo sapiens
ctgctgtgta

SEQ ID NO: 2835313 - DNA, 18 bp, Homo sapiens
ctgctgtgtagctctgtc

SEQ ID NO: 2835314 - DNA, 22 bp, Homo sapiens
ctgctgtgtccgctttcatgaa

SEQ ID NO: 2835315 - DNA, 19 bp, Homo sapiens
ctgctgtgtgaattcccag

SEQ ID NO: 2835316 - DNA, 20 bp, Homo sapiens
ctgctgtgtgaattcccagg

SEQ ID NO: 2835317 - DNA, 23 bp, Homo sapiens
ctgctgttaattgattaaaatct

SEQ ID NO: 2835318 - DNA, 17 bp, Homo sapiens
ctgcttactagccctgc

SEQ ID NO: 2835319 - DNA, 23 bp, Homo sapiens
ctgcttatcaataaacctgtttg

SEQ ID NO: 2835320 - DNA, 23 bp, Homo sapiens
ctgcttcagcctcccgagtagct

SEQ ID NO: 2835321 - DNA, 24 bp, Homo sapiens
ctgcttccaattttctggaataca

SEQ ID NO: 2835322 - DNA, 18 bp, Homo sapiens
ctgcttgactatcacata

SEQ ID NO: 2835323 - DNA, 21 bp, Homo sapiens
ctgcttgactatcacatacaa

SEQ ID NO: 2835324 - DNA, 21 bp, Homo sapiens
ctgctttcaacttaaatcact

SEQ ID NO: 2835325 - DNA, 23 bp, Homo sapiens
ctgctttcaacttaaatcactga

SEQ ID NO: 2835326 - DNA, 14 bp, Homo sapiens
ctgctttctcctgg

SEQ ID NO: 2835327 - DNA, 15 bp, Homo sapiens
ctgcttttggtctgt

SEQ ID NO: 2835328 - DNA, 14 bp, Homo sapiens
ctgctttttgacat

SEQ ID NO: 2835329 - DNA, 17 bp, Homo sapiens
ctggaaaactcaggatt

SEQ ID NO: 2835330 - DNA, 14 bp, Homo sapiens
ctggaaaagaggag

SEQ ID NO: 2835331 - DNA, 18 bp, Homo sapiens
ctggaaaatgtgacccag

SEQ ID NO: 2835332 - DNA, 20 bp, Homo sapiens
ctggaaaggctcagtctcag

SEQ ID NO: 2835333 - DNA, 21 bp, Homo sapiens
ctggaaaggctcagtctcagg

SEQ ID NO: 2835334 - DNA, 23 bp, Homo sapiens
ctggaaaggctcagtctcaggag

SEQ ID NO: 2835335 - DNA, 20 bp, Homo sapiens
ctggaaatctggattttcag

SEQ ID NO: 2835336 - DNA, 16 bp, Homo sapiens
ctggaactgtctctca

SEQ ID NO: 2835337 - DNA, 12 bp, Homo sapiens
ctggaagagagg

SEQ ID NO: 2835338 - DNA, 13 bp, Homo sapiens
ctggaagagagga

SEQ ID NO: 2835339 - DNA, 18 bp, Homo sapiens
ctggaagcacagcttcat

SEQ ID NO: 2835340 - DNA, 23 bp, Homo sapiens
ctggaagcatgtaggagaatcca

SEQ ID NO: 2835341 - DNA, 12 bp, Homo sapiens
ctggaagctgtg

SEQ ID NO: 2835342 - DNA, 17 bp, Homo sapiens
ctggaatcgatctgtac

SEQ ID NO: 2835343 - DNA, 20 bp, Homo sapiens
ctggaatgaagcatgtagct

SEQ ID NO: 2835344 - DNA, 14 bp, Homo sapiens
ctggaatgcagtgg

SEQ ID NO: 2835345 - DNA, 20 bp, Homo sapiens
ctggaatgtaatcaatgttt

SEQ ID NO: 2835346 - DNA, 15 bp, Homo sapiens
ctggaattgctgctc

SEQ ID NO: 2835347 - DNA, 23 bp, Homo sapiens
ctggaatttaaggagggacaaga

SEQ ID NO: 2835348 - DNA, 13 bp, Homo sapiens
ctggacaacccag

SEQ ID NO: 2835349 - DNA, 19 bp, Homo sapiens
ctggacaagaagctgctat

SEQ ID NO: 2835350 - DNA, 11 bp, Homo sapiens
ctggacaagcc

SEQ ID NO: 2835351 - DNA, 14 bp, Homo sapiens
ctggacagctgtgc

SEQ ID NO: 2835352 - DNA, 17 bp, Homo sapiens
ctggacagctgtgcctc

SEQ ID NO: 2835353 - DNA, 14 bp, Homo sapiens
ctggacaggcatgt

SEQ ID NO: 2835354 - DNA, 17 bp, Homo sapiens
ctggaccaccagcccca

SEQ ID NO: 2835355 - DNA, 21 bp, Homo sapiens
ctggaccaccagccccagcaa

SEQ ID NO: 2835356 - DNA, 16 bp, Homo sapiens
ctggaccttgaactgg

SEQ ID NO: 2835357 - DNA, 19 bp, Homo sapiens
ctggacggcattcctgctt

SEQ ID NO: 2835358 - DNA, 17 bp, Homo sapiens
ctggactcctctgtcca

SEQ ID NO: 2835359 - DNA, 22 bp, Homo sapiens
ctggactcctctgtccaggcac

SEQ ID NO: 2835360 - DNA, 14 bp, Homo sapiens
ctggactctggcac

SEQ ID NO: 2835361 - DNA, 20 bp, Homo sapiens
ctggactgtcatagaaatta

SEQ ID NO: 2835362 - DNA, 15 bp, Homo sapiens
ctggacttgagcttg

SEQ ID NO: 2835363 - DNA, 18 bp, Homo sapiens
ctggagaagctcacccaa

SEQ ID NO: 2835364 - DNA, 19 bp, Homo sapiens
ctggagaagctcacccaat

SEQ ID NO: 2835365 - DNA, 17 bp, Homo sapiens
ctggagaagctgatgct

SEQ ID NO: 2835366 - DNA, 19 bp, Homo sapiens
ctggagaagctgatgcttt

SEQ ID NO: 2835367 - DNA, 23 bp, Homo sapiens
ctggagaggagggatgctgcctg

SEQ ID NO: 2835368 - DNA, 14 bp, Homo sapiens
ctggagcaccaggc

SEQ ID NO: 2835369 - DNA, 14 bp, Homo sapiens
ctggagctgctgtt

SEQ ID NO: 2835370 - DNA, 15 bp, Homo sapiens
ctggaggaagaagac

SEQ ID NO: 2835371 - DNA, 12 bp, Homo sapiens
ctggaggacctg

SEQ ID NO: 2835372 - DNA, 17 bp, Homo sapiens
ctggaggacctgagcct

SEQ ID NO: 2835373 - DNA, 18 bp, Homo sapiens
ctggaggacctgagcctg

SEQ ID NO: 2835374 - DNA, 20 bp, Homo sapiens
ctggaggacctgagcctgcc

SEQ ID NO: 2835375 - DNA, 19 bp, Homo sapiens
ctggaggcagggccttgcc

SEQ ID NO: 2835376 - DNA, 22 bp, Homo sapiens
ctggaggcagggccttgcccag

SEQ ID NO: 2835377 - DNA, 21 bp, Homo sapiens
ctggaggtcacattcaggaag

SEQ ID NO: 2835378 - DNA, 22 bp, Homo sapiens
ctggaggtcacattcaggaaga

SEQ ID NO: 2835379 - DNA, 12 bp, Homo sapiens
ctggagtgcagg

SEQ ID NO: 2835380 - DNA, 16 bp, Homo sapiens
ctggagtgcagggagg

SEQ ID NO: 2835381 - DNA, 14 bp, Homo sapiens
ctggagtgcagtga

SEQ ID NO: 2835382 - DNA, 16 bp, Homo sapiens
ctggagtgcagtgagc

SEQ ID NO: 2835383 - DNA, 14 bp, Homo sapiens
ctggatcagcgtgg

SEQ ID NO: 2835384 - DNA, 16 bp, Homo sapiens
ctggatcagcgtggcc

SEQ ID NO: 2835385 - DNA, 13 bp, Homo sapiens
ctggatgagactt

SEQ ID NO: 2835386 - DNA, 22 bp, Homo sapiens
ctggatttttacaaataaagat

SEQ ID NO: 2835387 - DNA, 21 bp, Homo sapiens
ctggcacacatcaggagttca

SEQ ID NO: 2835388 - DNA, 19 bp, Homo sapiens
ctggcacccggcccctgct

SEQ ID NO: 2835389 - DNA, 14 bp, Homo sapiens
ctggcacttggaga

SEQ ID NO: 2835390 - DNA, 21 bp, Homo sapiens
ctggcacttggagacttgtat

SEQ ID NO: 2835391 - DNA, 19 bp, Homo sapiens
ctggcagcactcagtgagg

SEQ ID NO: 2835392 - DNA, 20 bp, Homo sapiens
ctggcaggatgaccctgcga

SEQ ID NO: 2835393 - DNA, 20 bp, Homo sapiens
ctggcagtttatatttaact

SEQ ID NO: 2835394 - DNA, 16 bp, Homo sapiens
ctggcattacagctgg

SEQ ID NO: 2835395 - DNA, 13 bp, Homo sapiens
ctggccaagctga

SEQ ID NO: 2835396 - DNA, 17 bp, Homo sapiens
ctggccaagctgaggtg

SEQ ID NO: 2835397 - DNA, 22 bp, Homo sapiens
ctggccaagctgaggtgcccag

SEQ ID NO: 2835398 - DNA, 14 bp, Homo sapiens
ctggccagatgcac

SEQ ID NO: 2835399 - DNA, 18 bp, Homo sapiens
ctggccagatgcaccagc

SEQ ID NO: 2835400 - DNA, 13 bp, Homo sapiens
ctggccaggggtc

SEQ ID NO: 2835401 - DNA, 12 bp, Homo sapiens
ctggccccaccc

SEQ ID NO: 2835402 - DNA, 23 bp, Homo sapiens
ctggccccaccctcgtggacacc

SEQ ID NO: 2835403 - DNA, 15 bp, Homo sapiens
ctggccccagccccc

SEQ ID NO: 2835404 - DNA, 17 bp, Homo sapiens
ctggccccagcccccac

SEQ ID NO: 2835405 - DNA, 16 bp, Homo sapiens
ctggccccatgtctct

SEQ ID NO: 2835406 - DNA, 21 bp, Homo sapiens
ctggccccatgtctctcagaa

SEQ ID NO: 2835407 - DNA, 14 bp, Homo sapiens
ctggccctgccttc

SEQ ID NO: 2835408 - DNA, 12 bp, Homo sapiens
ctggccctggct

SEQ ID NO: 2835409 - DNA, 13 bp, Homo sapiens
ctggccgcctcca

SEQ ID NO: 2835410 - DNA, 18 bp, Homo sapiens
ctggcctcacgcccagcc

SEQ ID NO: 2835411 - DNA, 22 bp, Homo sapiens
ctggcctcacgcccagcctcct

SEQ ID NO: 2835412 - DNA, 19 bp, Homo sapiens
ctggcctcccaataaagct

SEQ ID NO: 2835413 - DNA, 22 bp, Homo sapiens
ctggcctcccaataaagctgga

SEQ ID NO: 2835414 - DNA, 13 bp, Homo sapiens
ctggcctcctgcc

SEQ ID NO: 2835415 - DNA, 16 bp, Homo sapiens
ctggcctcctgcctct

SEQ ID NO: 2835416 - DNA, 15 bp, Homo sapiens
ctggcctgctgggct

SEQ ID NO: 2835417 - DNA, 16 bp, Homo sapiens
ctggcctggcacacat

SEQ ID NO: 2835418 - DNA, 18 bp, Homo sapiens
ctggcctggcacacatca

SEQ ID NO: 2835419 - DNA, 14 bp, Homo sapiens
ctggcctggccggc

SEQ ID NO: 2835420 - DNA, 16 bp, Homo sapiens
ctggctaactggaagc

SEQ ID NO: 2835421 - DNA, 22 bp, Homo sapiens
ctggctactgggaaattactta

SEQ ID NO: 2835422 - DNA, 20 bp, Homo sapiens
ctggctccgtccaggagcct

SEQ ID NO: 2835423 - DNA, 13 bp, Homo sapiens
ctggctcctccag

SEQ ID NO: 2835424 - DNA, 14 bp, Homo sapiens
ctggctcctccagg

SEQ ID NO: 2835425 - DNA, 20 bp, Homo sapiens
ctggctctcccatttcctga

SEQ ID NO: 2835426 - DNA, 15 bp, Homo sapiens
ctggctgaaaatcac

SEQ ID NO: 2835427 - DNA, 22 bp, Homo sapiens
ctggctgaccccaaagagcctg

SEQ ID NO: 2835428 - DNA, 22 bp, Homo sapiens
ctggctgaggatttcaagcctg

SEQ ID NO: 2835429 - DNA, 23 bp, Homo sapiens
ctggctgagggcagttcgcagcc

SEQ ID NO: 2835430 - DNA, 13 bp, Homo sapiens
ctggctgcagtga

SEQ ID NO: 2835431 - DNA, 17 bp, Homo sapiens
ctggctggctgagggca

SEQ ID NO: 2835432 - DNA, 15 bp, Homo sapiens
ctggctggctgcagt

SEQ ID NO: 2835433 - DNA, 14 bp, Homo sapiens
ctggctgggcatgg

SEQ ID NO: 2835434 - DNA, 17 bp, Homo sapiens
ctggctgggcatggacg

SEQ ID NO: 2835435 - DNA, 17 bp, Homo sapiens
ctggctgttggctgggg

SEQ ID NO: 2835436 - DNA, 12 bp, Homo sapiens
ctggcttccagg

SEQ ID NO: 2835437 - DNA, 15 bp, Homo sapiens
ctggcttccaggtat

SEQ ID NO: 2835438 - DNA, 23 bp, Homo sapiens
ctggcttccaggtatctccagga

SEQ ID NO: 2835439 - DNA, 20 bp, Homo sapiens
ctggcttcccatccccagcg

SEQ ID NO: 2835440 - DNA, 22 bp, Homo sapiens
ctggcttcccatccccagcgat

SEQ ID NO: 2835441 - DNA, 22 bp, Homo sapiens
ctggcttctagtctggtgttct

SEQ ID NO: 2835442 - DNA, 14 bp, Homo sapiens
ctggcttctggagc

SEQ ID NO: 2835443 - DNA, 20 bp, Homo sapiens
ctggcttgtaactccaccaa

SEQ ID NO: 2835444 - DNA, 21 bp, Homo sapiens
ctgggaaaggggttgtcaaga

SEQ ID NO: 2835445 - DNA, 17 bp, Homo sapiens
ctgggaaccatgaagct

SEQ ID NO: 2835446 - DNA, 20 bp, Homo sapiens
ctgggaaccatgaagctgga

SEQ ID NO: 2835447 - DNA, 16 bp, Homo sapiens
ctgggaaggctacttc

SEQ ID NO: 2835448 - DNA, 16 bp, Homo sapiens
ctgggaccgctacacc

SEQ ID NO: 2835449 - DNA, 17 bp, Homo sapiens
ctgggaccgctacacca

SEQ ID NO: 2835450 - DNA, 22 bp, Homo sapiens
ctgggaccgctacaccactctg

SEQ ID NO: 2835451 - DNA, 14 bp, Homo sapiens
ctgggagaacctca

SEQ ID NO: 2835452 - DNA, 19 bp, Homo sapiens
ctcctcttaaaaaataaaa

SEQ ID NO: 2835453 - DNA, 20 bp, Homo sapiens
ctcctcttaaaaaataaaaa

SEQ ID NO: 2835454 - DNA, 18 bp, Homo sapiens
ctcctcttgccactgcct

SEQ ID NO: 2835455 - DNA, 22 bp, Homo sapiens
ctcctgaaaaggtttatgaaaa

SEQ ID NO: 2835456 - DNA, 12 bp, Homo sapiens
ctcctgcccagg

SEQ ID NO: 2835457 - DNA, 13 bp, Homo sapiens
ctcctgcccagga

SEQ ID NO: 2835458 - DNA, 14 bp, Homo sapiens
ctcctgcccaggag

SEQ ID NO: 2835459 - DNA, 22 bp, Homo sapiens
ctcctgcccaggagagccagcc

SEQ ID NO: 2835460 - DNA, 13 bp, Homo sapiens
ctcctgccctgtt

SEQ ID NO: 2835461 - DNA, 13 bp, Homo sapiens
ctcctgcctactc

SEQ ID NO: 2835462 - DNA, 16 bp, Homo sapiens
ctcctgcctactcacg

SEQ ID NO: 2835463 - DNA, 14 bp, Homo sapiens
ctcctgcctcagcc

SEQ ID NO: 2835464 - DNA, 21 bp, Homo sapiens
ctcctgcctcgaactggctgc

SEQ ID NO: 2835465 - DNA, 22 bp, Homo sapiens
ctcctgcctcgaactggctgca

SEQ ID NO: 2835466 - DNA, 19 bp, Homo sapiens
ctcctgcgtctgtttttaa

SEQ ID NO: 2835467 - DNA, 17 bp, Homo sapiens
ctcctggaaaggctcag

SEQ ID NO: 2835468 - DNA, 19 bp, Homo sapiens
ctcctggaaaggctcagtc

SEQ ID NO: 2835469 - DNA, 23 bp, Homo sapiens
ctcctggaaaggctcagtctcag

SEQ ID NO: 2835470 - DNA, 24 bp, Homo sapiens
ctcctggaaaggctcagtctcagg

SEQ ID NO: 2835471 - DNA, 15 bp, Homo sapiens
ctcctggaagctgtg

SEQ ID NO: 2835472 - DNA, 20 bp, Homo sapiens
ctcctggaagctgtgtcctt

SEQ ID NO: 2835473 - DNA, 21 bp, Homo sapiens
ctcctggcttcccatccccag

SEQ ID NO: 2835474 - DNA, 23 bp, Homo sapiens
ctcctggcttcccatccccagcg

SEQ ID NO: 2835475 - DNA, 11 bp, Homo sapiens
ctcctgggaga

SEQ ID NO: 2835476 - DNA, 23 bp, Homo sapiens
ctcctgggggttctttcttcctc

SEQ ID NO: 2835477 - DNA, 18 bp, Homo sapiens
ctcctgtacgaacccctc

SEQ ID NO: 2835478 - DNA, 20 bp, Homo sapiens
ctcctgtataaccccacctt

SEQ ID NO: 2835479 - DNA, 13 bp, Homo sapiens
ctcctgtctgcca

SEQ ID NO: 2835480 - DNA, 16 bp, Homo sapiens
ctcctgtctgccagcc

SEQ ID NO: 2835481 - DNA, 23 bp, Homo sapiens
ctcctgtctgccagccagcagcc

SEQ ID NO: 2835482 - DNA, 14 bp, Homo sapiens
ctcctgtgcccaca

SEQ ID NO: 2835483 - DNA, 21 bp, Homo sapiens
ctcctgtgcccacatcccagg

SEQ ID NO: 2835484 - DNA, 22 bp, Homo sapiens
ctcctgtgcccacatcccaggc

SEQ ID NO: 2835485 - DNA, 16 bp, Homo sapiens
ctcctgtgggagcctc

SEQ ID NO: 2835486 - DNA, 17 bp, Homo sapiens
ctcctgtgggagcctcg

SEQ ID NO: 2835487 - DNA, 23 bp, Homo sapiens
ctcctgtgtcttgcaatggcagc

SEQ ID NO: 2835488 - DNA, 11 bp, Homo sapiens
ctcctgtgtgt

SEQ ID NO: 2835489 - DNA, 19 bp, Homo sapiens
ctcctgtgtgtgcgcctac

SEQ ID NO: 2835490 - DNA, 20 bp, Homo sapiens
ctcctgtgtgtgcgcctaca

SEQ ID NO: 2835491 - DNA, 23 bp, Homo sapiens
ctcctgtgtgtgcgcctacagga

SEQ ID NO: 2835492 - DNA, 20 bp, Homo sapiens
ctccttcctcagtcctggaa

SEQ ID NO: 2835493 - DNA, 22 bp, Homo sapiens
ctccttcctcagtcctggaagc

SEQ ID NO: 2835494 - DNA, 13 bp, Homo sapiens
ctccttcctgccc

SEQ ID NO: 2835495 - DNA, 21 bp, Homo sapiens
ctccttcctgccccaactcct

SEQ ID NO: 2835496 - DNA, 14 bp, Homo sapiens
ctccttctgtccta

SEQ ID NO: 2835497 - DNA, 13 bp, Homo sapiens
ctccttcttgctt

SEQ ID NO: 2835498 - DNA, 21 bp, Homo sapiens
ctccttgattttagccttctc

SEQ ID NO: 2835499 - DNA, 14 bp, Homo sapiens
ctccttggtgcctg

SEQ ID NO: 2835500 - DNA, 22 bp, Homo sapiens
ctccttggtgcctggcctggca

SEQ ID NO: 2835501 - DNA, 14 bp, Homo sapiens
ctcctttagcaggt

SEQ ID NO: 2835502 - DNA, 16 bp, Homo sapiens
ctcctttagcgcccag

SEQ ID NO: 2835503 - DNA, 22 bp, Homo sapiens
ctcctttagcgcccagttgggt

SEQ ID NO: 2835504 - DNA, 18 bp, Homo sapiens
ctcctttctccagccagc

SEQ ID NO: 2835505 - DNA, 15 bp, Homo sapiens
ctcctttgcactgag

SEQ ID NO: 2835506 - DNA, 16 bp, Homo sapiens
ctcctttgcactgagg

SEQ ID NO: 2835507 - DNA, 15 bp, Homo sapiens
ctcgagcgccctgca

SEQ ID NO: 2835508 - DNA, 16 bp, Homo sapiens
ctcgagcgccctgcag

SEQ ID NO: 2835509 - DNA, 18 bp, Homo sapiens
ctcgagcgccctgcagac

SEQ ID NO: 2835510 - DNA, 19 bp, Homo sapiens
ctcgagcgccctgcagacc

SEQ ID NO: 2835511 - DNA, 21 bp, Homo sapiens
ctcgagcgccctgcagaccct

SEQ ID NO: 2835512 - DNA, 16 bp, Homo sapiens
ctcgcaacccgtgcca

SEQ ID NO: 2835513 - DNA, 12 bp, Homo sapiens
ctcgccctgggt

SEQ ID NO: 2835514 - DNA, 15 bp, Homo sapiens
ctcgctccccactct

SEQ ID NO: 2835515 - DNA, 21 bp, Homo sapiens
ctcgctccccactctgctctg

SEQ ID NO: 2835516 - DNA, 16 bp, Homo sapiens
ctcgctgtcctgctgt

SEQ ID NO: 2835517 - DNA, 14 bp, Homo sapiens
ctcgcttagctgaa

SEQ ID NO: 2835518 - DNA, 20 bp, Homo sapiens
ctcggaaggctggctgggca

SEQ ID NO: 2835519 - DNA, 13 bp, Homo sapiens
ctcggagcctcat

SEQ ID NO: 2835520 - DNA, 16 bp, Homo sapiens
ctcggccccctccatc

SEQ ID NO: 2835521 - DNA, 17 bp, Homo sapiens
ctcggccccctccatcg

SEQ ID NO: 2835522 - DNA, 14 bp, Homo sapiens
ctcggcctccaagg

SEQ ID NO: 2835523 - DNA, 19 bp, Homo sapiens
ctcggggcgacccctcagt

SEQ ID NO: 2835524 - DNA, 20 bp, Homo sapiens
ctcggggcgacccctcagtg

SEQ ID NO: 2835525 - DNA, 16 bp, Homo sapiens
ctcggggtgcacagga

SEQ ID NO: 2835526 - DNA, 14 bp, Homo sapiens
ctcggtggacccag

SEQ ID NO: 2835527 - DNA, 18 bp, Homo sapiens
ctcggtggacccagggat

SEQ ID NO: 2835528 - DNA, 13 bp, Homo sapiens
ctcggtggccatg

SEQ ID NO: 2835529 - DNA, 14 bp, Homo sapiens
ctcggtggccatgc

SEQ ID NO: 2835530 - DNA, 20 bp, Homo sapiens
ctcgtatatgtctcaggtcc

SEQ ID NO: 2835531 - DNA, 17 bp, Homo sapiens
ctcgtcctccccctgcc

SEQ ID NO: 2835532 - DNA, 18 bp, Homo sapiens
ctcgtcctccccctgcca

SEQ ID NO: 2835533 - DNA, 19 bp, Homo sapiens
ctctaaacccaaataaatg

SEQ ID NO: 2835534 - DNA, 23 bp, Homo sapiens
ctctaacccccagtgccacagag

SEQ ID NO: 2835535 - DNA, 13 bp, Homo sapiens
ctctaacgcctga

SEQ ID NO: 2835536 - DNA, 16 bp, Homo sapiens
ctctaacgcctgagcc

SEQ ID NO: 2835537 - DNA, 20 bp, Homo sapiens
ctctaacgcctgagcccagg

SEQ ID NO: 2835538 - DNA, 21 bp, Homo sapiens
ctctaacgcctgagcccaggg

SEQ ID NO: 2835539 - DNA, 22 bp, Homo sapiens
ctgctcgtccccaagtgaccta

SEQ ID NO: 2835540 - DNA, 11 bp, Homo sapiens
aaaaaagtata

SEQ ID NO: 2835541 - DNA, 13 bp, Homo sapiens
aaaaaataaatat

SEQ ID NO: 2835542 - DNA, 11 bp, Homo sapiens
aaaaaatgtcc

SEQ ID NO: 2835543 - DNA, 22 bp, Homo sapiens
aaaaaattagaaattggctgga

SEQ ID NO: 2835544 - DNA, 14 bp, Homo sapiens
aaaaacacaaaagt

SEQ ID NO: 2835545 - DNA, 15 bp, Homo sapiens
aaaaacatttgtaca

SEQ ID NO: 2835546 - DNA, 17 bp, Homo sapiens
aaaaacatttgtacatt

SEQ ID NO: 2835547 - DNA, 20 bp, Homo sapiens
aaaaactctgggaaataaga

SEQ ID NO: 2835548 - DNA, 12 bp, Homo sapiens
aaaaacttgtaa

SEQ ID NO: 2835549 - DNA, 18 bp, Homo sapiens
aaaaacttgtaaatgctg

SEQ ID NO: 2835550 - DNA, 15 bp, Homo sapiens
aaaaagaaaggaggg

SEQ ID NO: 2835551 - DNA, 18 bp, Homo sapiens
aaaaagcgaaaaaatcag

SEQ ID NO: 2835552 - DNA, 12 bp, Homo sapiens
aaaaagcttaaa

SEQ ID NO: 2835553 - DNA, 19 bp, Homo sapiens
aaaaagggctgtccatgta

SEQ ID NO: 2835554 - DNA, 21 bp, Homo sapiens
aaaaagtaagtaccactcagg

SEQ ID NO: 2835555 - DNA, 11 bp, Homo sapiens
aaaaagtatat

SEQ ID NO: 2835556 - DNA, 13 bp, Homo sapiens
aaaaagtatatat

SEQ ID NO: 2835557 - DNA, 17 bp, Homo sapiens
aaaaagtatatattcta

SEQ ID NO: 2835558 - DNA, 20 bp, Homo sapiens
aaaaagtcagactgctggga

SEQ ID NO: 2835559 - DNA, 13 bp, Homo sapiens
aaaaagtggctaa

SEQ ID NO: 2835560 - DNA, 18 bp, Homo sapiens
aaaaagtttgccagaagt

SEQ ID NO: 2835561 - DNA, 21 bp, Homo sapiens
aaaaataaaaactgactcctt

SEQ ID NO: 2835562 - DNA, 12 bp, Homo sapiens
aaaaataaaatg

SEQ ID NO: 2835563 - DNA, 13 bp, Homo sapiens
aaaaataaatata

SEQ ID NO: 2835564 - DNA, 22 bp, Homo sapiens
aaaaataaatataattgggatt

SEQ ID NO: 2835565 - DNA, 21 bp, Homo sapiens
aaaaataaatttggttctaat

SEQ ID NO: 2835566 - DNA, 12 bp, Homo sapiens
aaaaatacagta

SEQ ID NO: 2835567 - DNA, 23 bp, Homo sapiens
aaaaatagtttggatatgtaaaa

SEQ ID NO: 2835568 - DNA, 18 bp, Homo sapiens
aaaaatatatatctatct

SEQ ID NO: 2835569 - DNA, 15 bp, Homo sapiens
aaaaatattctccat

SEQ ID NO: 2835570 - DNA, 19 bp, Homo sapiens
aaaaattaagagatacatt

SEQ ID NO: 2835571 - DNA, 13 bp, Homo sapiens
aaaaattagctga

SEQ ID NO: 2835572 - DNA, 10 bp, Homo sapiens
aaaaattgca

SEQ ID NO: 2835573 - DNA, 22 bp, Homo sapiens
aaaaattgtgtttagattttat

SEQ ID NO: 2835574 - DNA, 15 bp, Homo sapiens
aaaaatttgtttaaa

SEQ ID NO: 2835575 - DNA, 15 bp, Homo sapiens
aaaacaaaaaacttt

SEQ ID NO: 2835576 - DNA, 13 bp, Homo sapiens
aaaacaatgaaga

SEQ ID NO: 2835577 - DNA, 21 bp, Homo sapiens
aaaacactaaaaataaaaatg

SEQ ID NO: 2835578 - DNA, 17 bp, Homo sapiens
aaaacataaaatataca

SEQ ID NO: 2835579 - DNA, 14 bp, Homo sapiens
aaaacataatatct

SEQ ID NO: 2835580 - DNA, 17 bp, Homo sapiens
aaaacatacccagtgtt

SEQ ID NO: 2835581 - DNA, 11 bp, Homo sapiens
aaaacatatca

SEQ ID NO: 2835582 - DNA, 22 bp, Homo sapiens
aaaacatatcaattcaacacat

SEQ ID NO: 2835583 - DNA, 19 bp, Homo sapiens
aaaacatgagaaatgtgaa

SEQ ID NO: 2835584 - DNA, 21 bp, Homo sapiens
aaaacatgagaaatgtgaact

SEQ ID NO: 2835585 - DNA, 16 bp, Homo sapiens
aaaacatggtagaatt

SEQ ID NO: 2835586 - DNA, 16 bp, Homo sapiens
aaaacatttattttga

SEQ ID NO: 2835587 - DNA, 11 bp, Homo sapiens
aaaacatttgt

SEQ ID NO: 2835588 - DNA, 13 bp, Homo sapiens
aaaaccaaataag

SEQ ID NO: 2835589 - DNA, 14 bp, Homo sapiens
aaaaccaatgattc

SEQ ID NO: 2835590 - DNA, 18 bp, Homo sapiens
aaaaccactgaacatttg

SEQ ID NO: 2835591 - DNA, 20 bp, Homo sapiens
aaaaccactgaacatttgct

SEQ ID NO: 2835592 - DNA, 20 bp, Homo sapiens
aaaaccatcaaaaatattcc

SEQ ID NO: 2835593 - DNA, 14 bp, Homo sapiens
aaaaccatgcagct

SEQ ID NO: 2835594 - DNA, 22 bp, Homo sapiens
aaaaccatgcagcttcatcaat

SEQ ID NO: 2835595 - DNA, 15 bp, Homo sapiens
aaaaccattttagtt

SEQ ID NO: 2835596 - DNA, 13 bp, Homo sapiens
aaaacctttcaaa

SEQ ID NO: 2835597 - DNA, 20 bp, Homo sapiens
aaaacctttcaaatttcaca

SEQ ID NO: 2835598 - DNA, 12 bp, Homo sapiens
aaaactatggtt

SEQ ID NO: 2835599 - DNA, 13 bp, Homo sapiens
aaaactcaggatt

SEQ ID NO: 2835600 - DNA, 12 bp, Homo sapiens
aaaactgtttat

SEQ ID NO: 2835601 - DNA, 22 bp, Homo sapiens
aaaacttgtactatgttaataa

SEQ ID NO: 2835602 - DNA, 12 bp, Homo sapiens
aaaagaaacttt

SEQ ID NO: 2835603 - DNA, 23 bp, Homo sapiens
aaaagaatttgtgacattttaaa

SEQ ID NO: 2835604 - DNA, 16 bp, Homo sapiens
aaaagagaaaaaccaa

SEQ ID NO: 2835605 - DNA, 18 bp, Homo sapiens
aaaagagaaaaaccaatg

SEQ ID NO: 2835606 - DNA, 13 bp, Homo sapiens
aaaagatttgttt

SEQ ID NO: 2835607 - DNA, 17 bp, Homo sapiens
aaaagatttgttttgtc

SEQ ID NO: 2835608 - DNA, 12 bp, Homo sapiens
aaaagcaagact

SEQ ID NO: 2835609 - DNA, 14 bp, Homo sapiens
aaaagcaagactgt

SEQ ID NO: 2835610 - DNA, 22 bp, Homo sapiens
aaaagcagtcctcttattccta

SEQ ID NO: 2835611 - DNA, 23 bp, Homo sapiens
aaaagctgcttgactatcacata

SEQ ID NO: 2835612 - DNA, 23 bp, Homo sapiens
aaaagggacagtattctcagtgc

SEQ ID NO: 2835613 - DNA, 18 bp, Homo sapiens
aaaagggcaataaatgcc

SEQ ID NO: 2835614 - DNA, 15 bp, Homo sapiens
aaaaggtattaaatt

SEQ ID NO: 2835615 - DNA, 19 bp, Homo sapiens
aaaaggtttatgaaaaaga

SEQ ID NO: 2835616 - DNA, 15 bp, Homo sapiens
aaaagtagaattata

SEQ ID NO: 2835617 - DNA, 11 bp, Homo sapiens
aaaagtatata

SEQ ID NO: 2835618 - DNA, 15 bp, Homo sapiens
aaaagtcaaaaggtg

SEQ ID NO: 2835619 - DNA, 16 bp, Homo sapiens
aaaagtcacacagaca

SEQ ID NO: 2835620 - DNA, 20 bp, Homo sapiens
aaaagtgcttagaaagttat

SEQ ID NO: 2835621 - DNA, 18 bp, Homo sapiens
aaaagtggattttcctga

SEQ ID NO: 2835622 - DNA, 21 bp, Homo sapiens
aaaagtggctaattcaattta

SEQ ID NO: 2835623 - DNA, 16 bp, Homo sapiens
aaaagttaaactactt

SEQ ID NO: 2835624 - DNA, 19 bp, Homo sapiens
aaaagttacatgtttgcac

SEQ ID NO: 2835625 - DNA, 14 bp, Homo sapiens
aaaagttagctgag

SEQ ID NO: 2835626 - DNA, 16 bp, Homo sapiens
aaaagttgcacattag

SEQ ID NO: 2835627 - DNA, 16 bp, Homo sapiens
aaaagtttgccagaag

SEQ ID NO: 2835628 - DNA, 20 bp, Homo sapiens
aaaataaaaaaatacagtaa

SEQ ID NO: 2835629 - DNA, 15 bp, Homo sapiens
aaaataaaaaccaga

SEQ ID NO: 2835630 - DNA, 13 bp, Homo sapiens
aaaataaaaatgg

SEQ ID NO: 2835631 - DNA, 12 bp, Homo sapiens
aaaataaacaaa

SEQ ID NO: 2835632 - DNA, 21 bp, Homo sapiens
aaaggatgtaaacagtgcctg

SEQ ID NO: 2835633 - DNA, 18 bp, Homo sapiens
aaaggattcatgtggaat

SEQ ID NO: 2835634 - DNA, 13 bp, Homo sapiens
aaaggcctggggt

SEQ ID NO: 2835635 - DNA, 19 bp, Homo sapiens
aaaggctaggtacacagct

SEQ ID NO: 2835636 - DNA, 20 bp, Homo sapiens
aaaggctctgaaagccagct

SEQ ID NO: 2835637 - DNA, 19 bp, Homo sapiens
aaaggctggctgaaaatca

SEQ ID NO: 2835638 - DNA, 22 bp, Homo sapiens
aaaggctggctgaaaatcacta

SEQ ID NO: 2835639 - DNA, 23 bp, Homo sapiens
aaaggctggctgaaaatcactat

SEQ ID NO: 2835640 - DNA, 17 bp, Homo sapiens
aaagggagggctctgag

SEQ ID NO: 2835641 - DNA, 18 bp, Homo sapiens
aaagggagggctctgagg

SEQ ID NO: 2835642 - DNA, 22 bp, Homo sapiens
aaagggagggctctgaggcgcc

SEQ ID NO: 2835643 - DNA, 13 bp, Homo sapiens
aaagggcaataaa

SEQ ID NO: 2835644 - DNA, 15 bp, Homo sapiens
aaagggcagtaaagt

SEQ ID NO: 2835645 - DNA, 23 bp, Homo sapiens
aaagggtctgataaacacagagg

SEQ ID NO: 2835646 - DNA, 19 bp, Homo sapiens
aaaggtggtatgtgtgtgt

SEQ ID NO: 2835647 - DNA, 22 bp, Homo sapiens
aaaggtggtatgtgtgtgtatg

SEQ ID NO: 2835648 - DNA, 17 bp, Homo sapiens
aaaggttgactcaagtt

SEQ ID NO: 2835649 - DNA, 18 bp, Homo sapiens
aaaggtttatgaaaaaga

SEQ ID NO: 2835650 - DNA, 22 bp, Homo sapiens
aaaggtttatgaaaaagaagaa

SEQ ID NO: 2835651 - DNA, 14 bp, Homo sapiens
aaaggttttcctct

SEQ ID NO: 2835652 - DNA, 23 bp, Homo sapiens
aaagtactctttaagagtgaaat

SEQ ID NO: 2835653 - DNA, 20 bp, Homo sapiens
aaagtacttctccaccctgc

SEQ ID NO: 2835654 - DNA, 21 bp, Homo sapiens
aaagtacttctccaccctgct

SEQ ID NO: 2835655 - DNA, 19 bp, Homo sapiens
aaagtagaattatatctaa

SEQ ID NO: 2835656 - DNA, 21 bp, Homo sapiens
aaagtagaattatatctaatt

SEQ ID NO: 2835657 - DNA, 15 bp, Homo sapiens
aaagtagagaacagt

SEQ ID NO: 2835658 - DNA, 18 bp, Homo sapiens
aaagtatatatagaatct

SEQ ID NO: 2835659 - DNA, 15 bp, Homo sapiens
aaagtatatattcta

SEQ ID NO: 2835660 - DNA, 21 bp, Homo sapiens
aaagtatgccttcctgtttaa

SEQ ID NO: 2835661 - DNA, 20 bp, Homo sapiens
aaagtcaaaaggtgcctgtg

SEQ ID NO: 2835662 - DNA, 14 bp, Homo sapiens
aaagtcacacagac

SEQ ID NO: 2835663 - DNA, 14 bp, Homo sapiens
aaagtgaataaact

SEQ ID NO: 2835664 - DNA, 15 bp, Homo sapiens
aaagtgacagagacc

SEQ ID NO: 2835665 - DNA, 22 bp, Homo sapiens
aaagtgacagagacccagatct

SEQ ID NO: 2835666 - DNA, 11 bp, Homo sapiens
aaagtgctggg

SEQ ID NO: 2835667 - DNA, 19 bp, Homo sapiens
aaagtgcttagaaagttat

SEQ ID NO: 2835668 - DNA, 18 bp, Homo sapiens
aaagtggattttcctgaa

SEQ ID NO: 2835669 - DNA, 22 bp, Homo sapiens
aaagtggctaattcaatttatg

SEQ ID NO: 2835670 - DNA, 15 bp, Homo sapiens
aaagtgtaaaataga

SEQ ID NO: 2835671 - DNA, 16 bp, Homo sapiens
aaagttacaaattcaa

SEQ ID NO: 2835672 - DNA, 18 bp, Homo sapiens
aaagttattgtgttgcct

SEQ ID NO: 2835673 - DNA, 20 bp, Homo sapiens
aaagttattgtgttgcctta

SEQ ID NO: 2835674 - DNA, 19 bp, Homo sapiens
aaagttcctgttcacctta

SEQ ID NO: 2835675 - DNA, 16 bp, Homo sapiens
aaagttggtgacagat

SEQ ID NO: 2835676 - DNA, 23 bp, Homo sapiens
aaagtttctcttttcaaaacatt

SEQ ID NO: 2835677 - DNA, 15 bp, Homo sapiens
aaagtttgccagaag

SEQ ID NO: 2835678 - DNA, 18 bp, Homo sapiens
aaataaaaaaatacagta

SEQ ID NO: 2835679 - DNA, 19 bp, Homo sapiens
aaataaaaaaatacagtaa

SEQ ID NO: 2835680 - DNA, 20 bp, Homo sapiens
aaataaaaaccagaatcata

SEQ ID NO: 2835681 - DNA, 16 bp, Homo sapiens
aaataaaaagtgcttt

SEQ ID NO: 2835682 - DNA, 14 bp, Homo sapiens
aaataaaaccagct

SEQ ID NO: 2835683 - DNA, 13 bp, Homo sapiens
aaataaaaccttt

SEQ ID NO: 2835684 - DNA, 17 bp, Homo sapiens
aaataaaacctttcaaa

SEQ ID NO: 2835685 - DNA, 12 bp, Homo sapiens
aaataaaatgat

SEQ ID NO: 2835686 - DNA, 13 bp, Homo sapiens
aaataaaattatg

SEQ ID NO: 2835687 - DNA, 18 bp, Homo sapiens
aaataaacaaataacaat

SEQ ID NO: 2835688 - DNA, 13 bp, Homo sapiens
aaataaagtatat

SEQ ID NO: 2835689 - DNA, 18 bp, Homo sapiens
aaataaagttggtgacag

SEQ ID NO: 2835690 - DNA, 12 bp, Homo sapiens
aaataaatatca

SEQ ID NO: 2835691 - DNA, 16 bp, Homo sapiens
aaataaatgtatcata

SEQ ID NO: 2835692 - DNA, 11 bp, Homo sapiens
aaataaatgtg

SEQ ID NO: 2835693 - DNA, 15 bp, Homo sapiens
aaataaatgtgtaaa

SEQ ID NO: 2835694 - DNA, 19 bp, Homo sapiens
aaataaattggtgataagt

SEQ ID NO: 2835695 - DNA, 12 bp, Homo sapiens
aaataacatttg

SEQ ID NO: 2835696 - DNA, 12 bp, Homo sapiens
aaataagaaact

SEQ ID NO: 2835697 - DNA, 15 bp, Homo sapiens
aaataagaaactttt

SEQ ID NO: 2835698 - DNA, 12 bp, Homo sapiens
aaataagagaga

SEQ ID NO: 2835699 - DNA, 15 bp, Homo sapiens
aaataatcggcccac

SEQ ID NO: 2835700 - DNA, 11 bp, Homo sapiens
aaataatttaa

SEQ ID NO: 2835701 - DNA, 14 bp, Homo sapiens
aaataatttaacta

SEQ ID NO: 2835702 - DNA, 18 bp, Homo sapiens
aaataatttaactaattt

SEQ ID NO: 2835703 - DNA, 18 bp, Homo sapiens
aaataattttaaacaaag

SEQ ID NO: 2835704 - DNA, 23 bp, Homo sapiens
aaatacacagatgattaaacaga

SEQ ID NO: 2835705 - DNA, 14 bp, Homo sapiens
aaatacagacacta

SEQ ID NO: 2835706 - DNA, 16 bp, Homo sapiens
aaatacagacactaag

SEQ ID NO: 2835707 - DNA, 17 bp, Homo sapiens
aaatacagacactaagt

SEQ ID NO: 2835708 - DNA, 20 bp, Homo sapiens
aaatacagtaaagtttaaaa

SEQ ID NO: 2835709 - DNA, 13 bp, Homo sapiens
aaatacatgctaa

SEQ ID NO: 2835710 - DNA, 21 bp, Homo sapiens
aaatacatgtgtggatgtgta

SEQ ID NO: 2835711 - DNA, 17 bp, Homo sapiens
aaataccagtgtggttt

SEQ ID NO: 2835712 - DNA, 16 bp, Homo sapiens
aaatactccaagcttc

SEQ ID NO: 2835713 - DNA, 17 bp, Homo sapiens
aaatactccaagcttca

SEQ ID NO: 2835714 - DNA, 19 bp, Homo sapiens
aaatactccaagcttcaag

SEQ ID NO: 2835715 - DNA, 23 bp, Homo sapiens
aaatactccaagcttcaagtgat

SEQ ID NO: 2835716 - DNA, 22 bp, Homo sapiens
aaatactgcctagaaaatgcaa

SEQ ID NO: 2835717 - DNA, 15 bp, Homo sapiens
aaatagacagtatat

SEQ ID NO: 2835718 - DNA, 16 bp, Homo sapiens
aaatagtattgaaagt

SEQ ID NO: 2835719 - DNA, 12 bp, Homo sapiens
aaatagtatttc

SEQ ID NO: 2835720 - DNA, 15 bp, Homo sapiens
aaatagtgttctttt

SEQ ID NO: 2835721 - DNA, 17 bp, Homo sapiens
aaatagtgttcttttta

SEQ ID NO: 2835722 - DNA, 21 bp, Homo sapiens
aaatagtgttctttttaaaaa

SEQ ID NO: 2835723 - DNA, 17 bp, Homo sapiens
actgttactccacagcg

SEQ ID NO: 2835724 - DNA, 13 bp, Homo sapiens
actgttgcccagg

SEQ ID NO: 2835725 - DNA, 22 bp, Homo sapiens
actgtttgccttctacttttaa

SEQ ID NO: 2835726 - DNA, 15 bp, Homo sapiens
actgtttttgaagaa

SEQ ID NO: 2835727 - DNA, 17 bp, Homo sapiens
acttaaaaaaatgacag

SEQ ID NO: 2835728 - DNA, 18 bp, Homo sapiens
ttattttttaagtattta

SEQ ID NO: 2835729 - DNA, 14 bp, Homo sapiens
ttcaaaaaaacact

SEQ ID NO: 2835730 - DNA, 17 bp, Homo sapiens
ttcaaaaaaacactagt

SEQ ID NO: 2835731 - DNA, 21 bp, Homo sapiens
ttcaaaagaatcagaaacagg

SEQ ID NO: 2835732 - DNA, 16 bp, Homo sapiens
ttcaaaatggagggaa

SEQ ID NO: 2835733 - DNA, 15 bp, Homo sapiens
ttcaaaccatttaat

SEQ ID NO: 2835734 - DNA, 13 bp, Homo sapiens
ttcaaagaagtca

SEQ ID NO: 2835735 - DNA, 16 bp, Homo sapiens
ttcaaagcatgaaatg

SEQ ID NO: 2835736 - DNA, 23 bp, Homo sapiens
ttcaaagctgtgtgtttggaaga

SEQ ID NO: 2835737 - DNA, 22 bp, Homo sapiens
ttcaaagctttttccagaggct

SEQ ID NO: 2835738 - DNA, 14 bp, Homo sapiens
ttcaaagtttaata

SEQ ID NO: 2835739 - DNA, 14 bp, Homo sapiens
ttcaacaattctaa

SEQ ID NO: 2835740 - DNA, 15 bp, Homo sapiens
ttcaacaattctaaa

SEQ ID NO: 2835741 - DNA, 19 bp, Homo sapiens
ttcaacaattctaaaatga

SEQ ID NO: 2835742 - DNA, 21 bp, Homo sapiens
ttcaacatgttatttgtaata

SEQ ID NO: 2835743 - DNA, 16 bp, Homo sapiens
ttcaaccagcatttta

SEQ ID NO: 2835744 - DNA, 16 bp, Homo sapiens
ttcaaccctcagcctt

SEQ ID NO: 2835745 - DNA, 17 bp, Homo sapiens
ttcaagaaaactggaaa

SEQ ID NO: 2835746 - DNA, 12 bp, Homo sapiens
ttcaagaaactg

SEQ ID NO: 2835747 - DNA, 16 bp, Homo sapiens
ttcaagagaagaaaaa

SEQ ID NO: 2835748 - DNA, 21 bp, Homo sapiens
ttcaagcaccctgttccctct

SEQ ID NO: 2835749 - DNA, 21 bp, Homo sapiens
ttcaagcgattcttctgcttc

SEQ ID NO: 2835750 - DNA, 17 bp, Homo sapiens
ttcaagtgatatatgta

SEQ ID NO: 2835751 - DNA, 19 bp, Homo sapiens
ttcaagtgatatatgtatt

SEQ ID NO: 2835752 - DNA, 20 bp, Homo sapiens
ttcaagtgatatatgtattt

SEQ ID NO: 2835753 - DNA, 17 bp, Homo sapiens
ttcaagttaaattttat

SEQ ID NO: 2835754 - DNA, 19 bp, Homo sapiens
ttcaataaagtatctacat

SEQ ID NO: 2835755 - DNA, 18 bp, Homo sapiens
ttcaataaatgtctgttg

SEQ ID NO: 2835756 - DNA, 20 bp, Homo sapiens
ttcaatggtttgcaaggaag

SEQ ID NO: 2835757 - DNA, 23 bp, Homo sapiens
ttcaatggtttgcaaggaagcca

SEQ ID NO: 2835758 - DNA, 15 bp, Homo sapiens
ttcaattcaaagctg

SEQ ID NO: 2835759 - DNA, 13 bp, Homo sapiens
ttcaattcagtgc

SEQ ID NO: 2835760 - DNA, 12 bp, Homo sapiens
ttcaattcctct

SEQ ID NO: 2835761 - DNA, 13 bp, Homo sapiens
ttcaattcctggg

SEQ ID NO: 2835762 - DNA, 16 bp, Homo sapiens
ttcaattcctgggccc

SEQ ID NO: 2835763 - DNA, 22 bp, Homo sapiens
ttcacaacagcctgacaacatt

SEQ ID NO: 2835764 - DNA, 16 bp, Homo sapiens
ttcacactgtgcgttt

SEQ ID NO: 2835765 - DNA, 22 bp, Homo sapiens
ttcacagtgtttcgacagctga

SEQ ID NO: 2835766 - DNA, 17 bp, Homo sapiens
ttcacataccctccccc

SEQ ID NO: 2835767 - DNA, 13 bp, Homo sapiens
ttcacatctcatt

SEQ ID NO: 2835768 - DNA, 14 bp, Homo sapiens
ttcaccaaatcttg

SEQ ID NO: 2835769 - DNA, 13 bp, Homo sapiens
ttcaccttatgta

SEQ ID NO: 2835770 - DNA, 15 bp, Homo sapiens
ttcaccttatgtatt

SEQ ID NO: 2835771 - DNA, 17 bp, Homo sapiens
ttcaccttatgtattat

SEQ ID NO: 2835772 - DNA, 23 bp, Homo sapiens
ttcaccttatgtattattttcta

SEQ ID NO: 2835773 - DNA, 13 bp, Homo sapiens
ttcactgtaagtt

SEQ ID NO: 2835774 - DNA, 13 bp, Homo sapiens
ttcactttaattc

SEQ ID NO: 2835775 - DNA, 12 bp, Homo sapiens
ttcagaagagat

SEQ ID NO: 2835776 - DNA, 20 bp, Homo sapiens
ttcagacaagcaacaggttt

SEQ ID NO: 2835777 - DNA, 10 bp, Homo sapiens
ttcagacccc

SEQ ID NO: 2835778 - DNA, 12 bp, Homo sapiens
ttcagactcaga

SEQ ID NO: 2835779 - DNA, 13 bp, Homo sapiens
ttcagactcagac

SEQ ID NO: 2835780 - DNA, 12 bp, Homo sapiens
ttcagagaagtc

SEQ ID NO: 2835781 - DNA, 23 bp, Homo sapiens
ttcagagaagtcagttggagaaa

SEQ ID NO: 2835782 - DNA, 21 bp, Homo sapiens
ttcagagactcagggccccag

SEQ ID NO: 2835783 - DNA, 23 bp, Homo sapiens
ttcccatcactggagcaccaggc

SEQ ID NO: 2835784 - DNA, 17 bp, Homo sapiens
ttcccatccccagcgat

SEQ ID NO: 2835785 - DNA, 17 bp, Homo sapiens
ttcccatgctgaattat

SEQ ID NO: 2835786 - DNA, 13 bp, Homo sapiens
ttcccatttgtaa

SEQ ID NO: 2835787 - DNA, 15 bp, Homo sapiens
ttccccaaagtctta

SEQ ID NO: 2835788 - DNA, 18 bp, Homo sapiens
ttccccaaccacttcatt

SEQ ID NO: 2835789 - DNA, 19 bp, Homo sapiens
ttccccagactcagctcca

SEQ ID NO: 2835790 - DNA, 22 bp, Homo sapiens
ttccccagacttctctttctta

SEQ ID NO: 2835791 - DNA, 17 bp, Homo sapiens
ttccccatggggctgcg

SEQ ID NO: 2835792 - DNA, 20 bp, Homo sapiens
ttcccccgctggcagccacc

SEQ ID NO: 2835793 - DNA, 16 bp, Homo sapiens
ttccccggtcccttga

SEQ ID NO: 2835794 - DNA, 17 bp, Homo sapiens
ttccccggtcccttgag

SEQ ID NO: 2835795 - DNA, 15 bp, Homo sapiens
ttcccctcgctgtcc

SEQ ID NO: 2835796 - DNA, 22 bp, Homo sapiens
ttccccttgcccagggctcagc

SEQ ID NO: 2835797 - DNA, 20 bp, Homo sapiens
ttccccttgcccttgccctg

SEQ ID NO: 2835798 - DNA, 23 bp, Homo sapiens
ttccccttgcccttgccctgacc

SEQ ID NO: 2835799 - DNA, 14 bp, Homo sapiens
ttcccctttcccca

SEQ ID NO: 2835800 - DNA, 13 bp, Homo sapiens
ttcccctttcctg

SEQ ID NO: 2835801 - DNA, 14 bp, Homo sapiens
ttccctacttcctg

SEQ ID NO: 2835802 - DNA, 16 bp, Homo sapiens
ttccctacttcctgtg

SEQ ID NO: 2835803 - DNA, 16 bp, Homo sapiens
ttccctatcaaaacat

SEQ ID NO: 2835804 - DNA, 17 bp, Homo sapiens
ttccctatcaaaacata

SEQ ID NO: 2835805 - DNA, 14 bp, Homo sapiens
ttccctcaccccct

SEQ ID NO: 2835806 - DNA, 19 bp, Homo sapiens
ttccctcaccccctcccac

SEQ ID NO: 2835807 - DNA, 17 bp, Homo sapiens
ttccctgaaaacccaga

SEQ ID NO: 2835808 - DNA, 19 bp, Homo sapiens
ttccctgaaaacccagaga

SEQ ID NO: 2835809 - DNA, 15 bp, Homo sapiens
ttccctgaatgtatt

SEQ ID NO: 2835810 - DNA, 21 bp, Homo sapiens
ttccctgagaaacccaccagc

SEQ ID NO: 2835811 - DNA, 23 bp, Homo sapiens
ttccctgagaaacccaccagcct

SEQ ID NO: 2835812 - DNA, 18 bp, Homo sapiens
ttccctgagtcaccagga

SEQ ID NO: 2835813 - DNA, 19 bp, Homo sapiens
ttccctgagtcaccaggaa

SEQ ID NO: 2835814 - DNA, 17 bp, Homo sapiens
ttcccttggatgtagtc

SEQ ID NO: 2835815 - DNA, 19 bp, Homo sapiens
ttccgaagaccttctgaag

SEQ ID NO: 2835816 - DNA, 21 bp, Homo sapiens
ttccgaagaccttctgaagat

SEQ ID NO: 2835817 - DNA, 20 bp, Homo sapiens
ttccgtctccctaaaataaa

SEQ ID NO: 2835818 - DNA, 13 bp, Homo sapiens
ttcctaaatgcag

SEQ ID NO: 2835819 - DNA, 16 bp, Homo sapiens
ttcctacaaagatgtt

SEQ ID NO: 2835820 - DNA, 17 bp, Homo sapiens
ttcctacagatagtcaa

SEQ ID NO: 2835821 - DNA, 18 bp, Homo sapiens
ttcctacagatagtcaaa

SEQ ID NO: 2835822 - DNA, 14 bp, Homo sapiens
ttcctagccctctc

SEQ ID NO: 2835823 - DNA, 18 bp, Homo sapiens
ttcctagccctctcacat

SEQ ID NO: 2835824 - DNA, 19 bp, Homo sapiens
ttcctatatagtttattga

SEQ ID NO: 2835825 - DNA, 21 bp, Homo sapiens
ttcctatatagtttattgaca

SEQ ID NO: 2835826 - DNA, 15 bp, Homo sapiens
ttcctatttcttata

SEQ ID NO: 2835827 - DNA, 16 bp, Homo sapiens
ttcctattttaaaacc

SEQ ID NO: 2835828 - DNA, 22 bp, Homo sapiens
ttcctcaccaataacttcagag

SEQ ID NO: 2835829 - DNA, 15 bp, Homo sapiens
ttcctcactatgaca

SEQ ID NO: 2835830 - DNA, 16 bp, Homo sapiens
ttcctcattcctgaaa

SEQ ID NO: 2835831 - DNA, 19 bp, Homo sapiens
ttcctccccaccttcccca

SEQ ID NO: 2835832 - DNA, 21 bp, Homo sapiens
ttcctccccattagagtcagc

SEQ ID NO: 2835833 - DNA, 16 bp, Homo sapiens
ttcctccctcatgagc

SEQ ID NO: 2835834 - DNA, 13 bp, Homo sapiens
ttcctccctggca

SEQ ID NO: 2835835 - DNA, 17 bp, Homo sapiens
ttcctcgcctctcccac

SEQ ID NO: 2835836 - DNA, 18 bp, Homo sapiens
ttcctctccaattgtaaa

SEQ ID NO: 2835837 - DNA, 21 bp, Homo sapiens
ttcctgatactgggtacaaga

SEQ ID NO: 2835838 - DNA, 11 bp, Homo sapiens
ttcctgcaccc

SEQ ID NO: 2835839 - DNA, 16 bp, Homo sapiens
ttcctgcatttgtgaa

SEQ ID NO: 2835840 - DNA, 18 bp, Homo sapiens
ttcctgcatttgtgaaat

SEQ ID NO: 2835841 - DNA, 18 bp, Homo sapiens
ttcctgccaccagtcact

SEQ ID NO: 2835842 - DNA, 23 bp, Homo sapiens
ttcctgccccaactccttccagc

SEQ ID NO: 2835843 - DNA, 18 bp, Homo sapiens
ttcctgccgcaacagttt

SEQ ID NO: 2835844 - DNA, 17 bp, Homo sapiens
ttcctggacagctgtgc

SEQ ID NO: 2835845 - DNA, 20 bp, Homo sapiens
ttcctggggtggattcctaa

SEQ ID NO: 2835846 - DNA, 22 bp, Homo sapiens
ttcctgggtggctactctgtgc

SEQ ID NO: 2835847 - DNA, 14 bp, Homo sapiens
ttcctgtcccacct

SEQ ID NO: 2835848 - DNA, 19 bp, Homo sapiens
ttcctgttcaccttatgta

SEQ ID NO: 2835849 - DNA, 23 bp, Homo sapiens
ttcctgttcaccttatgtattat

SEQ ID NO: 2835850 - DNA, 19 bp, Homo sapiens
ttccttaagtcagaacagc

SEQ ID NO: 2835851 - DNA, 16 bp, Homo sapiens
ttccttactgcagaat

SEQ ID NO: 2835852 - DNA, 23 bp, Homo sapiens
ttccttagcttagacctcagcct

SEQ ID NO: 2835853 - DNA, 22 bp, Homo sapiens
ttccttcagtgcatctgggaag

SEQ ID NO: 2835854 - DNA, 17 bp, Homo sapiens
ttccttcatttcctccg

SEQ ID NO: 2835855 - DNA, 16 bp, Homo sapiens
ttccttccttccctgg

SEQ ID NO: 2835856 - DNA, 20 bp, Homo sapiens
ttccttgctgtcctaggcca

SEQ ID NO: 2835857 - DNA, 14 bp, Homo sapiens
ttccttggaggcca

SEQ ID NO: 2835858 - DNA, 18 bp, Homo sapiens
ttccttggaggccaccgg

SEQ ID NO: 2835859 - DNA, 16 bp, Homo sapiens
ttccttgtcactggta

SEQ ID NO: 2835860 - DNA, 20 bp, Homo sapiens
ttccttttaaaacacttcca

SEQ ID NO: 2835861 - DNA, 22 bp, Homo sapiens
ttccttttaaaacacttccata

SEQ ID NO: 2835862 - DNA, 18 bp, Homo sapiens
ttcgagaccaacctgacc

SEQ ID NO: 2835863 - DNA, 20 bp, Homo sapiens
ttcgatgggcccaattctta

SEQ ID NO: 2835864 - DNA, 14 bp, Homo sapiens
ttcgcagccaccct

SEQ ID NO: 2835865 - DNA, 24 bp, Homo sapiens
ttcgcagccaccctgaggagtctg

SEQ ID NO: 2835866 - DNA, 15 bp, Homo sapiens
ttcgctcctgtgtct

SEQ ID NO: 2835867 - DNA, 19 bp, Homo sapiens
ttcgctcctgtgtcttgca

SEQ ID NO: 2835868 - DNA, 19 bp, Homo sapiens
ttcggacagtttatttgtt

SEQ ID NO: 2835869 - DNA, 20 bp, Homo sapiens
ttcggacagtttatttgttg

SEQ ID NO: 2835870 - DNA, 17 bp, Homo sapiens
ttcggggctgggaagtc

SEQ ID NO: 2835871 - DNA, 11 bp, Homo sapiens
ttcgtgcattt

SEQ ID NO: 2835872 - DNA, 15 bp, Homo sapiens
ttcgtgcatttgtga

SEQ ID NO: 2835873 - DNA, 22 bp, Homo sapiens
ttcgtggtgatcaattaaatgt

SEQ ID NO: 2835874 - DNA, 13 bp, Homo sapiens
ttctaaaaaacag

SEQ ID NO: 2835875 - DNA, 13 bp, Homo sapiens
ttctaaaattgaa

SEQ ID NO: 2835876 - DNA, 16 bp, Homo sapiens
ttctaaaattgaagag

SEQ ID NO: 2835877 - DNA, 13 bp, Homo sapiens
ttctaaatagcaa

SEQ ID NO: 2835878 - DNA, 12 bp, Homo sapiens
ttctaaatgaat

SEQ ID NO: 2835879 - DNA, 15 bp, Homo sapiens
ttctaaatgaatgtt

SEQ ID NO: 2835880 - DNA, 18 bp, Homo sapiens
ttctaaatgaatgtttac

SEQ ID NO: 2835881 - DNA, 21 bp, Homo sapiens
ttctaaatgaatgtttacact

SEQ ID NO: 2835882 - DNA, 22 bp, Homo sapiens
ttctaaatgttggaattttcaa

SEQ ID NO: 2835883 - DNA, 22 bp, Homo sapiens
ttctaaggaaatggagaagctc

SEQ ID NO: 2835884 - DNA, 12 bp, Homo sapiens
ttctaatagaac

SEQ ID NO: 2835885 - DNA, 23 bp, Homo sapiens
ttctaatcttgttaaattgctta

SEQ ID NO: 2835886 - DNA, 23 bp, Homo sapiens
ttctaatgtgtgaatcagagcac

SEQ ID NO: 2835887 - DNA, 13 bp, Homo sapiens
ttctacaaccaga

SEQ ID NO: 2835888 - DNA, 14 bp, Homo sapiens
ttctacaaccagag

SEQ ID NO: 2835889 - DNA, 16 bp, Homo sapiens
ttctacaaccagagcc

SEQ ID NO: 2835890 - DNA, 18 bp, Homo sapiens
ttctacacatatatgtat

SEQ ID NO: 2835891 - DNA, 18 bp, Homo sapiens
ttctaccatttcagagag

SEQ ID NO: 2835892 - DNA, 20 bp, Homo sapiens
ttctacccagcgagccctgg

SEQ ID NO: 2835893 - DNA, 22 bp, Homo sapiens
ttctacgtataaatatgaaatg

SEQ ID NO: 2835894 - DNA, 15 bp, Homo sapiens
ttctactcatatata

SEQ ID NO: 2835895 - DNA, 12 bp, Homo sapiens
ttctagagaaga

SEQ ID NO: 2835896 - DNA, 14 bp, Homo sapiens
ttctagagaagagg

SEQ ID NO: 2835897 - DNA, 14 bp, Homo sapiens
ttctagcaactgtt

SEQ ID NO: 2835898 - DNA, 20 bp, Homo sapiens
ttctagctgttgagctgttt

SEQ ID NO: 2835899 - DNA, 20 bp, Homo sapiens
ttctagtctggtgttctgag

SEQ ID NO: 2835900 - DNA, 18 bp, Homo sapiens
ttctagtgtaacactgca

SEQ ID NO: 2835901 - DNA, 22 bp, Homo sapiens
ttctagttagctgctttaaatc

SEQ ID NO: 2835902 - DNA, 23 bp, Homo sapiens
ttctagttagctgctttaaatct

SEQ ID NO: 2835903 - DNA, 23 bp, Homo sapiens
ttctatagccaaaaatagctaaa

SEQ ID NO: 2835904 - DNA, 20 bp, Homo sapiens
ttctattctctcctcagact

SEQ ID NO: 2835905 - DNA, 13 bp, Homo sapiens
ttctattgaaaaa

SEQ ID NO: 2835906 - DNA, 14 bp, Homo sapiens
ttctattgaaaaat

SEQ ID NO: 2835907 - DNA, 12 bp, Homo sapiens
ttctattgtaaa

SEQ ID NO: 2835908 - DNA, 14 bp, Homo sapiens
agaagggaaattca

SEQ ID NO: 2835909 - DNA, 20 bp, Homo sapiens
agaaggttgctctagattga

SEQ ID NO: 2835910 - DNA, 13 bp, Homo sapiens
agaagtaaaagct

SEQ ID NO: 2835911 - DNA, 15 bp, Homo sapiens
agaagtatccaatta

SEQ ID NO: 2835912 - DNA, 16 bp, Homo sapiens
agaagtatccaattat

SEQ ID NO: 2835913 - DNA, 17 bp, Homo sapiens
agaagtcaaagtaaaac

SEQ ID NO: 2835914 - DNA, 14 bp, Homo sapiens
agaagtcacacagt

SEQ ID NO: 2835915 - DNA, 13 bp, Homo sapiens
agaagtcatgaag

SEQ ID NO: 2835916 - DNA, 19 bp, Homo sapiens
agaagtgggccaggacagg

SEQ ID NO: 2835917 - DNA, 12 bp, Homo sapiens
agaagtgtatat

SEQ ID NO: 2835918 - DNA, 20 bp, Homo sapiens
agaagttaagcagcctttct

SEQ ID NO: 2835919 - DNA, 19 bp, Homo sapiens
agaagttgccaagagttct

SEQ ID NO: 2835920 - DNA, 16 bp, Homo sapiens
agaagtttctggccct

SEQ ID NO: 2835921 - DNA, 14 bp, Homo sapiens
agaataaatgaatc

SEQ ID NO: 2835922 - DNA, 16 bp, Homo sapiens
agaataagagaaagaa

SEQ ID NO: 2835923 - DNA, 20 bp, Homo sapiens
agaataagtgctgtttgaga

SEQ ID NO: 2835924 - DNA, 23 bp, Homo sapiens
agaataatatgctgccaaatttt

SEQ ID NO: 2835925 - DNA, 14 bp, Homo sapiens
agaataattgtgta

SEQ ID NO: 2835926 - DNA, 16 bp, Homo sapiens
agaataattgtgtaca

SEQ ID NO: 2835927 - DNA, 15 bp, Homo sapiens
agaatacttctcatt

SEQ ID NO: 2835928 - DNA, 13 bp, Homo sapiens
agaatatatacat

SEQ ID NO: 2835929 - DNA, 14 bp, Homo sapiens
agaatcaaaactct

SEQ ID NO: 2835930 - DNA, 14 bp, Homo sapiens
agaatcatacttag

SEQ ID NO: 2835931 - DNA, 13 bp, Homo sapiens
agaatccaaagat

SEQ ID NO: 2835932 - DNA, 12 bp, Homo sapiens
agaatccctgca

SEQ ID NO: 2835933 - DNA, 16 bp, Homo sapiens
agaatccctgcagcct

SEQ ID NO: 2835934 - DNA, 20 bp, Homo sapiens
agaatcgacctcactgtcag

SEQ ID NO: 2835935 - DNA, 18 bp, Homo sapiens
agaatgaaagggcccaga

SEQ ID NO: 2835936 - DNA, 12 bp, Homo sapiens
agaatgagcctc

SEQ ID NO: 2835937 - DNA, 14 bp, Homo sapiens
agaatgcttaatca

SEQ ID NO: 2835938 - DNA, 17 bp, Homo sapiens
agaatgtaaagcttgtc

SEQ ID NO: 2835939 - DNA, 18 bp, Homo sapiens
agaatgtgttttctgaat

SEQ ID NO: 2835940 - DNA, 23 bp, Homo sapiens
agaatgttactttggaatgacta

SEQ ID NO: 2835941 - DNA, 15 bp, Homo sapiens
agaattatatctaat

SEQ ID NO: 2835942 - DNA, 18 bp, Homo sapiens
agaattatatctaattta

SEQ ID NO: 2835943 - DNA, 17 bp, Homo sapiens
agaattatttttgtgtt

SEQ ID NO: 2835944 - DNA, 20 bp, Homo sapiens
agaattccaaggagttccat

SEQ ID NO: 2835945 - DNA, 15 bp, Homo sapiens
agaattctagaaaat

SEQ ID NO: 2835946 - DNA, 13 bp, Homo sapiens
agaattctgctac

SEQ ID NO: 2835947 - DNA, 22 bp, Homo sapiens
agaattctgctacctcactggg

SEQ ID NO: 2835948 - DNA, 13 bp, Homo sapiens
agaattctttcaa

SEQ ID NO: 2835949 - DNA, 17 bp, Homo sapiens
agaattgaacccaggag

SEQ ID NO: 2835950 - DNA, 19 bp, Homo sapiens
agaattgaaggagaaaatg

SEQ ID NO: 2835951 - DNA, 20 bp, Homo sapiens
agaattgtgtcagactgttt

SEQ ID NO: 2835952 - DNA, 21 bp, Homo sapiens
agaatttattcaattcctctg

SEQ ID NO: 2835953 - DNA, 16 bp, Homo sapiens
agaatttctaccattt

SEQ ID NO: 2835954 - DNA, 13 bp, Homo sapiens
agaatttcttggt

SEQ ID NO: 2835955 - DNA, 15 bp, Homo sapiens
agaatttgtattttg

SEQ ID NO: 2835956 - DNA, 18 bp, Homo sapiens
agaatttgtattttgctt

SEQ ID NO: 2835957 - DNA, 15 bp, Homo sapiens
agaattttaaattat

SEQ ID NO: 2835958 - DNA, 21 bp, Homo sapiens
agaattttcagaccccagcgg

SEQ ID NO: 2835959 - DNA, 21 bp, Homo sapiens
agaatttttaatgacttttta

SEQ ID NO: 2835960 - DNA, 21 bp, Homo sapiens
agaattttttgagtaattcta

SEQ ID NO: 2835961 - DNA, 21 bp, Homo sapiens
agacaaaacttcctgtttgtg

SEQ ID NO: 2835962 - DNA, 15 bp, Homo sapiens
agacaacagaagtca

SEQ ID NO: 2835963 - DNA, 12 bp, Homo sapiens
agacacaggccc

SEQ ID NO: 2835964 - DNA, 22 bp, Homo sapiens
agacacaggcccggctccaggc

SEQ ID NO: 2835965 - DNA, 23 bp, Homo sapiens
agacacaggcccggctccaggct

SEQ ID NO: 2835966 - DNA, 21 bp, Homo sapiens
agacaccaaattccaaacttc

SEQ ID NO: 2835967 - DNA, 17 bp, Homo sapiens
agacacctgcacctccc

SEQ ID NO: 2835968 - DNA, 15 bp, Homo sapiens
agacacttgccttct

SEQ ID NO: 2835969 - DNA, 20 bp, Homo sapiens
agacaggaaaatcctctggc

SEQ ID NO: 2835970 - DNA, 21 bp, Homo sapiens
agacaggaaaatcctctggct

SEQ ID NO: 2835971 - DNA, 18 bp, Homo sapiens
agacaggcccaagagatg

SEQ ID NO: 2835972 - DNA, 15 bp, Homo sapiens
agacaggtctagact

SEQ ID NO: 2835973 - DNA, 18 bp, Homo sapiens
agacagtatatttatagt

SEQ ID NO: 2835974 - DNA, 12 bp, Homo sapiens
agacagtgatct

SEQ ID NO: 2835975 - DNA, 15 bp, Homo sapiens
agacagtgatctcca

SEQ ID NO: 2835976 - DNA, 17 bp, Homo sapiens
agacagtgatctccata

SEQ ID NO: 2835977 - DNA, 18 bp, Homo sapiens
agacagtggatcatgaaa

SEQ ID NO: 2835978 - DNA, 22 bp, Homo sapiens
agacagtggatcatgaaaagtg

SEQ ID NO: 2835979 - DNA, 21 bp, Homo sapiens
agacatattcttggagaactt

SEQ ID NO: 2835980 - DNA, 13 bp, Homo sapiens
agacatggagact

SEQ ID NO: 2835981 - DNA, 22 bp, Homo sapiens
agacattaactcattagactgg

SEQ ID NO: 2835982 - DNA, 14 bp, Homo sapiens
agaccaacctgacc

SEQ ID NO: 2835983 - DNA, 17 bp, Homo sapiens
agaccaagactctgaaa

SEQ ID NO: 2835984 - DNA, 23 bp, Homo sapiens
agaccaaggcgggagcatctctt

SEQ ID NO: 2835985 - DNA, 15 bp, Homo sapiens
ttagctgtctgctca

SEQ ID NO: 2835986 - DNA, 17 bp, Homo sapiens
ttagctgttatttctat

SEQ ID NO: 2835987 - DNA, 19 bp, Homo sapiens
ttagctgttatttctattt

SEQ ID NO: 2835988 - DNA, 21 bp, Homo sapiens
ttagcttagacctcagcctgt

SEQ ID NO: 2835989 - DNA, 19 bp, Homo sapiens
ttaggaaataaaacctttc

SEQ ID NO: 2835990 - DNA, 20 bp, Homo sapiens
ttaggaaataaaacctttca

SEQ ID NO: 2835991 - DNA, 17 bp, Homo sapiens
ttaggaacagagtatat

SEQ ID NO: 2835992 - DNA, 19 bp, Homo sapiens
ttaggatctatgcaatttt

SEQ ID NO: 2835993 - DNA, 20 bp, Homo sapiens
ttaggatctatgcaattttt

SEQ ID NO: 2835994 - DNA, 18 bp, Homo sapiens
ttaggcttaccttggtca

SEQ ID NO: 2835995 - DNA, 13 bp, Homo sapiens
ttaggtgcctcct

SEQ ID NO: 2835996 - DNA, 16 bp, Homo sapiens
ttaggttttgtacaat

SEQ ID NO: 2835997 - DNA, 19 bp, Homo sapiens
ttaggtttttttgtatagt

SEQ ID NO: 2835998 - DNA, 14 bp, Homo sapiens
ttagtagagacagg

SEQ ID NO: 2835999 - DNA, 17 bp, Homo sapiens
ttagtagagacagggtt

SEQ ID NO: 2836000 - DNA, 15 bp, Homo sapiens
ttagtatcctgttag

SEQ ID NO: 2836001 - DNA, 17 bp, Homo sapiens
ttagtatctaacatgta

SEQ ID NO: 2836002 - DNA, 17 bp, Homo sapiens
ttagttaggtgtgccaa

SEQ ID NO: 2836003 - DNA, 22 bp, Homo sapiens
ttataaaaccatcaaaaatatt

SEQ ID NO: 2836004 - DNA, 15 bp, Homo sapiens
ttataaataaatgcc

SEQ ID NO: 2836005 - DNA, 16 bp, Homo sapiens
ttataaataaatgcca

SEQ ID NO: 2836006 - DNA, 12 bp, Homo sapiens
ttataaatgtgt

SEQ ID NO: 2836007 - DNA, 14 bp, Homo sapiens
ttataaatgtgtgg

SEQ ID NO: 2836008 - DNA, 16 bp, Homo sapiens
ttataactcatcataa

SEQ ID NO: 2836009 - DNA, 15 bp, Homo sapiens
ttataacttaaaaaa

SEQ ID NO: 2836010 - DNA, 19 bp, Homo sapiens
ttataataatgttctctgg

SEQ ID NO: 2836011 - DNA, 13 bp, Homo sapiens
ttataatatacta

SEQ ID NO: 2836012 - DNA, 20 bp, Homo sapiens
ttataatcttccatacttct

SEQ ID NO: 2836013 - DNA, 19 bp, Homo sapiens
ttataatgtggatttccta

SEQ ID NO: 2836014 - DNA, 16 bp, Homo sapiens
ttataatttttttcaa

SEQ ID NO: 2836015 - DNA, 22 bp, Homo sapiens
ttatacatagtcacaaaaatgg

SEQ ID NO: 2836016 - DNA, 14 bp, Homo sapiens
ttatacatatcaga

SEQ ID NO: 2836017 - DNA, 18 bp, Homo sapiens
ttatacatatcagaaaag

SEQ ID NO: 2836018 - DNA, 14 bp, Homo sapiens
ttatagaaagttca

SEQ ID NO: 2836019 - DNA, 15 bp, Homo sapiens
ttatagaatatttat

SEQ ID NO: 2836020 - DNA, 15 bp, Homo sapiens
ttatagacaaataat

SEQ ID NO: 2836021 - DNA, 22 bp, Homo sapiens
ttatagccacatccctttgaaa

SEQ ID NO: 2836022 - DNA, 16 bp, Homo sapiens
ttataggatcatttgt

SEQ ID NO: 2836023 - DNA, 18 bp, Homo sapiens
ttataggatttatttaaa

SEQ ID NO: 2836024 - DNA, 18 bp, Homo sapiens
ttatagtatatctggaca

SEQ ID NO: 2836025 - DNA, 14 bp, Homo sapiens
ttatatatatatgt

SEQ ID NO: 2836026 - DNA, 12 bp, Homo sapiens
ttatatatcata

SEQ ID NO: 2836027 - DNA, 14 bp, Homo sapiens
ttatatatcataaa

SEQ ID NO: 2836028 - DNA, 14 bp, Homo sapiens
ttatatatgaagta

SEQ ID NO: 2836029 - DNA, 15 bp, Homo sapiens
ttatatatttataac

SEQ ID NO: 2836030 - DNA, 16 bp, Homo sapiens
ttatatcagcctgagt

SEQ ID NO: 2836031 - DNA, 21 bp, Homo sapiens
ttatatcatcagcataccttt

SEQ ID NO: 2836032 - DNA, 20 bp, Homo sapiens
ttatatctaatttatacaaa

SEQ ID NO: 2836033 - DNA, 13 bp, Homo sapiens
ttatatggaaatt

SEQ ID NO: 2836034 - DNA, 23 bp, Homo sapiens
ttatattcagagatgtaccatgt

SEQ ID NO: 2836035 - DNA, 21 bp, Homo sapiens
ttatattccatatattagcat

SEQ ID NO: 2836036 - DNA, 13 bp, Homo sapiens
ttatatttaactc

SEQ ID NO: 2836037 - DNA, 17 bp, Homo sapiens
ttatatttggaaagaga

SEQ ID NO: 2836038 - DNA, 15 bp, Homo sapiens
ttatatttttataga

SEQ ID NO: 2836039 - DNA, 16 bp, Homo sapiens
ttatcaaaactttctt

SEQ ID NO: 2836040 - DNA, 15 bp, Homo sapiens
ttatcacttttctgt

SEQ ID NO: 2836041 - DNA, 17 bp, Homo sapiens
ttatcagttaacattaa

SEQ ID NO: 2836042 - DNA, 16 bp, Homo sapiens
ttatcatgctgtcttt

SEQ ID NO: 2836043 - DNA, 16 bp, Homo sapiens
ttatcattttcaaaat

SEQ ID NO: 2836044 - DNA, 21 bp, Homo sapiens
ttatcctgctagctgtagaaa

SEQ ID NO: 2836045 - DNA, 16 bp, Homo sapiens
ttatcggaagcagtgc

SEQ ID NO: 2836046 - DNA, 16 bp, Homo sapiens
ttatcgggaacagtgt

SEQ ID NO: 2836047 - DNA, 17 bp, Homo sapiens
ttatcgggaacagtgtt

SEQ ID NO: 2836048 - DNA, 23 bp, Homo sapiens
ttatcgggaacagtgtttcccat

SEQ ID NO: 2836049 - DNA, 18 bp, Homo sapiens
ttatcgggagcagtgtct

SEQ ID NO: 2836050 - DNA, 21 bp, Homo sapiens
ttatcgggagcagtgtcttcc

SEQ ID NO: 2836051 - DNA, 23 bp, Homo sapiens
ttatcgggagcagtgtcttccat

SEQ ID NO: 2836052 - DNA, 17 bp, Homo sapiens
ttatctgaatttttaaa

SEQ ID NO: 2836053 - DNA, 21 bp, Homo sapiens
ttatctgaatttttaaacaag

SEQ ID NO: 2836054 - DNA, 15 bp, Homo sapiens
ttatctgtgttgtct

SEQ ID NO: 2836055 - DNA, 17 bp, Homo sapiens
ttatcttgtctctgggc

SEQ ID NO: 2836056 - DNA, 16 bp, Homo sapiens
ttatctttacttttaa

SEQ ID NO: 2836057 - DNA, 17 bp, Homo sapiens
ttatgaaaaagaagaat

SEQ ID NO: 2836058 - DNA, 18 bp, Homo sapiens
ttatgaaaaagaagaatc

SEQ ID NO: 2836059 - DNA, 11 bp, Homo sapiens
ttatgaaatgg

SEQ ID NO: 2836060 - DNA, 14 bp, Homo sapiens
ttatgacagttata

SEQ ID NO: 2836061 - DNA, 21 bp, Homo sapiens
ttatgacatcacttgtacaaa

SEQ ID NO: 2836062 - DNA, 20 bp, Homo sapiens
ttatgactgtaaacatagat

SEQ ID NO: 2836063 - DNA, 13 bp, Homo sapiens
ttatgagtttttg

SEQ ID NO: 2836064 - DNA, 23 bp, Homo sapiens
ttatgagtttttgatagctttat

SEQ ID NO: 2836065 - DNA, 20 bp, Homo sapiens
ttatgatttaaaaaataaat

SEQ ID NO: 2836066 - DNA, 17 bp, Homo sapiens
ttatgcaaggaaggaaa

SEQ ID NO: 2836067 - DNA, 16 bp, Homo sapiens
ttatggaaatatagtt

SEQ ID NO: 2836068 - DNA, 23 bp, Homo sapiens
ttatgggaaccccttcatcctct

SEQ ID NO: 2836069 - DNA, 22 bp, Homo sapiens
ttatggggtattttaagcattc

SEQ ID NO: 2836070 - DNA, 10 bp, Homo sapiens
ttatggtgaa

SEQ ID NO: 2836071 - DNA, 14 bp, Homo sapiens
ttatggtgaaatta

SEQ ID NO: 2836072 - DNA, 15 bp, Homo sapiens
ttatggtgtaatgca

SEQ ID NO: 2836073 - DNA, 17 bp, Homo sapiens
ttatggtgtgttcctaa

SEQ ID NO: 2836074 - DNA, 17 bp, Homo sapiens
ttatgtcatcatacatg

SEQ ID NO: 2836075 - DNA, 17 bp, Homo sapiens
ttatgtctgtggatttt

SEQ ID NO: 2836076 - DNA, 20 bp, Homo sapiens
agaaaaaaatatattttatg

SEQ ID NO: 2836077 - DNA, 23 bp, Homo sapiens
agaaaaaaatatattttatgatt

SEQ ID NO: 2836078 - DNA, 11 bp, Homo sapiens
agaaaaaatac

SEQ ID NO: 2836079 - DNA, 16 bp, Homo sapiens
agaaaaaccaatgatt

SEQ ID NO: 2836080 - DNA, 19 bp, Homo sapiens
agaaaaaccaatgattcat

SEQ ID NO: 2836081 - DNA, 17 bp, Homo sapiens
agaaaacacttgtaagt

SEQ ID NO: 2836082 - DNA, 16 bp, Homo sapiens
agaaaaccattttagt

SEQ ID NO: 2836083 - DNA, 16 bp, Homo sapiens
agaaaacccttttcta

SEQ ID NO: 2836084 - DNA, 21 bp, Homo sapiens
agaaaacggagagtgcttggg

SEQ ID NO: 2836085 - DNA, 13 bp, Homo sapiens
agaaaactggaaa

SEQ ID NO: 2836086 - DNA, 22 bp, Homo sapiens
agaaaactggaaatctggattt

SEQ ID NO: 2836087 - DNA, 16 bp, Homo sapiens
agaaaagaaaaccatt

SEQ ID NO: 2836088 - DNA, 15 bp, Homo sapiens
agaaaagatttaagt

SEQ ID NO: 2836089 - DNA, 13 bp, Homo sapiens
agaaaaggcatgg

SEQ ID NO: 2836090 - DNA, 15 bp, Homo sapiens
agaaaagtagaatta

SEQ ID NO: 2836091 - DNA, 17 bp, Homo sapiens
agaaaagtagaattata

SEQ ID NO: 2836092 - DNA, 19 bp, Homo sapiens
agaaaagtagaattatatc

SEQ ID NO: 2836093 - DNA, 17 bp, Homo sapiens
agaaaagtgcttagaaa

SEQ ID NO: 2836094 - DNA, 19 bp, Homo sapiens
agaaaagtgcttagaaagt

SEQ ID NO: 2836095 - DNA, 16 bp, Homo sapiens
agaaaatataaatgca

SEQ ID NO: 2836096 - DNA, 18 bp, Homo sapiens
agaaaatgcaaaatgaaa

SEQ ID NO: 2836097 - DNA, 19 bp, Homo sapiens
agaaacacaaatgtaaaat

SEQ ID NO: 2836098 - DNA, 14 bp, Homo sapiens
agaaacagagacag

SEQ ID NO: 2836099 - DNA, 13 bp, Homo sapiens
agaaacagttaac

SEQ ID NO: 2836100 - DNA, 14 bp, Homo sapiens
agaaacatggtttt

SEQ ID NO: 2836101 - DNA, 21 bp, Homo sapiens
agaaaccagttatgtgaatga

SEQ ID NO: 2836102 - DNA, 17 bp, Homo sapiens
agaaacccaccagccta

SEQ ID NO: 2836103 - DNA, 18 bp, Homo sapiens
agaaacccaccagcctaa

SEQ ID NO: 2836104 - DNA, 17 bp, Homo sapiens
agaaaccgtaattttat

SEQ ID NO: 2836105 - DNA, 20 bp, Homo sapiens
agaaaccttattgtacctct

SEQ ID NO: 2836106 - DNA, 19 bp, Homo sapiens
agaaactcgatgaatgtgt

SEQ ID NO: 2836107 - DNA, 13 bp, Homo sapiens
agaaactgaggaa

SEQ ID NO: 2836108 - DNA, 16 bp, Homo sapiens
agaaactgaggaattt

SEQ ID NO: 2836109 - DNA, 22 bp, Homo sapiens
agaaacttcctttgagaattgt

SEQ ID NO: 2836110 - DNA, 15 bp, Homo sapiens
agaaactttctttct

SEQ ID NO: 2836111 - DNA, 23 bp, Homo sapiens
agaaagagagagaattctttcaa

SEQ ID NO: 2836112 - DNA, 20 bp, Homo sapiens
agaaagaggtgaccccaggg

SEQ ID NO: 2836113 - DNA, 23 bp, Homo sapiens
agaaagaggtgaccccagggcac

SEQ ID NO: 2836114 - DNA, 18 bp, Homo sapiens
agaaagcacctgttttta

SEQ ID NO: 2836115 - DNA, 14 bp, Homo sapiens
agaaagcataaaat

SEQ ID NO: 2836116 - DNA, 16 bp, Homo sapiens
agaaagctctgcatgt

SEQ ID NO: 2836117 - DNA, 21 bp, Homo sapiens
agaaagctctgcatgtgtgtt

SEQ ID NO: 2836118 - DNA, 13 bp, Homo sapiens
agaaagggagggc

SEQ ID NO: 2836119 - DNA, 14 bp, Homo sapiens
agaaagggagggct

SEQ ID NO: 2836120 - DNA, 15 bp, Homo sapiens
agaaagggagggctc

SEQ ID NO: 2836121 - DNA, 18 bp, Homo sapiens
agaaagggagggctctga

SEQ ID NO: 2836122 - DNA, 19 bp, Homo sapiens
agaaagggagggctctgag

SEQ ID NO: 2836123 - DNA, 20 bp, Homo sapiens
agaaagggagggctctgagg

SEQ ID NO: 2836124 - DNA, 23 bp, Homo sapiens
agaaagggtctgataaacacaga

SEQ ID NO: 2836125 - DNA, 22 bp, Homo sapiens
agaaagttattgtgttgcctta

SEQ ID NO: 2836126 - DNA, 19 bp, Homo sapiens
agaaataaagttggtgaca

SEQ ID NO: 2836127 - DNA, 21 bp, Homo sapiens
agaaataaagttggtgacaga

SEQ ID NO: 2836128 - DNA, 14 bp, Homo sapiens
agaaataagttttt

SEQ ID NO: 2836129 - DNA, 16 bp, Homo sapiens
agaaataagtttttgt

SEQ ID NO: 2836130 - DNA, 23 bp, Homo sapiens
agaaataagtttttgtttcacag

SEQ ID NO: 2836131 - DNA, 22 bp, Homo sapiens
agaaatcattttgcaatccctt

SEQ ID NO: 2836132 - DNA, 15 bp, Homo sapiens
agaaattagccgggc

SEQ ID NO: 2836133 - DNA, 14 bp, Homo sapiens
agaaattggctgga

SEQ ID NO: 2836134 - DNA, 16 bp, Homo sapiens
agaaattgttcctgat

SEQ ID NO: 2836135 - DNA, 19 bp, Homo sapiens
agaacaaacctctatatgt

SEQ ID NO: 2836136 - DNA, 19 bp, Homo sapiens
agaacaatagctattgcat

SEQ ID NO: 2836137 - DNA, 17 bp, Homo sapiens
agaacaatgtcagaaac

SEQ ID NO: 2836138 - DNA, 19 bp, Homo sapiens
agaacagccgctcctgtct

SEQ ID NO: 2836139 - DNA, 17 bp, Homo sapiens
agaacccctacatgaaa

SEQ ID NO: 2836140 - DNA, 15 bp, Homo sapiens
agaacctaattcaat

SEQ ID NO: 2836141 - DNA, 22 bp, Homo sapiens
agaacgtattggtccagcttgc

SEQ ID NO: 2836142 - DNA, 22 bp, Homo sapiens
agaactcgaagcccttccagtg

SEQ ID NO: 2836143 - DNA, 23 bp, Homo sapiens
agaactctccatcttattttcat

SEQ ID NO: 2836144 - DNA, 20 bp, Homo sapiens
agaactctgggctgctaccc

SEQ ID NO: 2836145 - DNA, 22 bp, Homo sapiens
agaacttcgaccctttctctga

SEQ ID NO: 2836146 - DNA, 17 bp, Homo sapiens
agaagaaaaaattaaga

SEQ ID NO: 2836147 - DNA, 13 bp, Homo sapiens
agaagaaaaagaa

SEQ ID NO: 2836148 - DNA, 13 bp, Homo sapiens
agaagaaggcagc

SEQ ID NO: 2836149 - DNA, 14 bp, Homo sapiens
agaagaaggcagca

SEQ ID NO: 2836150 - DNA, 22 bp, Homo sapiens
agaagaatctcatctcagtgaa

SEQ ID NO: 2836151 - DNA, 12 bp, Homo sapiens
agaagacactgc

SEQ ID NO: 2836152 - DNA, 22 bp, Homo sapiens
agaagacatggagactcctgcc

SEQ ID NO: 2836153 - DNA, 12 bp, Homo sapiens
agaagagacagg

SEQ ID NO: 2836154 - DNA, 14 bp, Homo sapiens
agaagagcctgact

SEQ ID NO: 2836155 - DNA, 16 bp, Homo sapiens
agaagagggcctgtgg

SEQ ID NO: 2836156 - DNA, 18 bp, Homo sapiens
agaagagggcctgtggga

SEQ ID NO: 2836157 - DNA, 24 bp, Homo sapiens
agaagagggcctgtgggagcctgc

SEQ ID NO: 2836158 - DNA, 19 bp, Homo sapiens
agaagcattttgtaagttg

SEQ ID NO: 2836159 - DNA, 15 bp, Homo sapiens
agaagccaaattttt

SEQ ID NO: 2836160 - DNA, 16 bp, Homo sapiens
agaagccaaatttttt

SEQ ID NO: 2836161 - DNA, 17 bp, Homo sapiens
agaagcctgaggctggg

SEQ ID NO: 2836162 - DNA, 14 bp, Homo sapiens
agaagcctgggggc

SEQ ID NO: 2836163 - DNA, 19 bp, Homo sapiens
agaagcctgggggcctggc

SEQ ID NO: 2836164 - DNA, 21 bp, Homo sapiens
agaagcctgggggcctggctg

SEQ ID NO: 2836165 - DNA, 16 bp, Homo sapiens
agaagcctgttttgtt

SEQ ID NO: 2836166 - DNA, 11 bp, Homo sapiens
taatcagcctc

SEQ ID NO: 2836167 - DNA, 13 bp, Homo sapiens
taatcagcctctt

SEQ ID NO: 2836168 - DNA, 15 bp, Homo sapiens
taatcagcctcttaa

SEQ ID NO: 2836169 - DNA, 15 bp, Homo sapiens
taatcatataataaa

SEQ ID NO: 2836170 - DNA, 13 bp, Homo sapiens
taatcccagcact

SEQ ID NO: 2836171 - DNA, 19 bp, Homo sapiens
taatcctattaaaacacag

SEQ ID NO: 2836172 - DNA, 14 bp, Homo sapiens
taatcgaaatgaat

SEQ ID NO: 2836173 - DNA, 15 bp, Homo sapiens
taatcggcccacagc

SEQ ID NO: 2836174 - DNA, 19 bp, Homo sapiens
taatcgttatgtgtgtata

SEQ ID NO: 2836175 - DNA, 22 bp, Homo sapiens
taatctagaacacaggcaaaat

SEQ ID NO: 2836176 - DNA, 18 bp, Homo sapiens
taatctcctcttttatct

SEQ ID NO: 2836177 - DNA, 17 bp, Homo sapiens
taatctggactcctctg

SEQ ID NO: 2836178 - DNA, 21 bp, Homo sapiens
taatctttctttacctgagac

SEQ ID NO: 2836179 - DNA, 23 bp, Homo sapiens
taatctttctttacctgagacca

SEQ ID NO: 2836180 - DNA, 14 bp, Homo sapiens
taatgaaaatgtca

SEQ ID NO: 2836181 - DNA, 16 bp, Homo sapiens
taatgaaacaaagagt

SEQ ID NO: 2836182 - DNA, 14 bp, Homo sapiens
taatgaacaaatgg

SEQ ID NO: 2836183 - DNA, 12 bp, Homo sapiens
taatgaatgcta

SEQ ID NO: 2836184 - DNA, 19 bp, Homo sapiens
taatgactttttataatgt

SEQ ID NO: 2836185 - DNA, 15 bp, Homo sapiens
taatgagggactgga

SEQ ID NO: 2836186 - DNA, 20 bp, Homo sapiens
taatgatttaagcattttac

SEQ ID NO: 2836187 - DNA, 15 bp, Homo sapiens
taatgcacaatttag

SEQ ID NO: 2836188 - DNA, 18 bp, Homo sapiens
taatgcacaatttagaaa

SEQ ID NO: 2836189 - DNA, 19 bp, Homo sapiens
taatgcacaatttagaaaa

SEQ ID NO: 2836190 - DNA, 20 bp, Homo sapiens
taatgcacaatttagaaaac

SEQ ID NO: 2836191 - DNA, 22 bp, Homo sapiens
taatgcatcatcatagaaaaac

SEQ ID NO: 2836192 - DNA, 21 bp, Homo sapiens
taatgcatgttaggaaaattt

SEQ ID NO: 2836193 - DNA, 16 bp, Homo sapiens
taatgcctctcccgca

SEQ ID NO: 2836194 - DNA, 17 bp, Homo sapiens
taatgctgttgcctcat

SEQ ID NO: 2836195 - DNA, 19 bp, Homo sapiens
taatgggccaattaaaata

SEQ ID NO: 2836196 - DNA, 15 bp, Homo sapiens
taatggggcggtgag

SEQ ID NO: 2836197 - DNA, 19 bp, Homo sapiens
taatggtgttactaaagtc

SEQ ID NO: 2836198 - DNA, 17 bp, Homo sapiens
taatggtttactgctgt

SEQ ID NO: 2836199 - DNA, 20 bp, Homo sapiens
taatgtaagaaaatttgaag

SEQ ID NO: 2836200 - DNA, 21 bp, Homo sapiens
taatgtatcttatttatatat

SEQ ID NO: 2836201 - DNA, 18 bp, Homo sapiens
taatgtcaaaatcatgaa

SEQ ID NO: 2836202 - DNA, 21 bp, Homo sapiens
taatgtcaccaccttcccagc

SEQ ID NO: 2836203 - DNA, 16 bp, Homo sapiens
taatgtggatttccta

SEQ ID NO: 2836204 - DNA, 18 bp, Homo sapiens
taatgtggatttcctatt

SEQ ID NO: 2836205 - DNA, 20 bp, Homo sapiens
taatgttctgaataatttct

SEQ ID NO: 2836206 - DNA, 12 bp, Homo sapiens
taatgtttgcta

SEQ ID NO: 2836207 - DNA, 15 bp, Homo sapiens
taattaataaacgaa

SEQ ID NO: 2836208 - DNA, 15 bp, Homo sapiens
taattacatccagaa

SEQ ID NO: 2836209 - DNA, 22 bp, Homo sapiens
taattaggatctatgcaatttt

SEQ ID NO: 2836210 - DNA, 18 bp, Homo sapiens
taattatcgggaacagtg

SEQ ID NO: 2836211 - DNA, 21 bp, Homo sapiens
taattatcgggaacagtgttt

SEQ ID NO: 2836212 - DNA, 21 bp, Homo sapiens
taattatgacagttatactgt

SEQ ID NO: 2836213 - DNA, 12 bp, Homo sapiens
taattattattt

SEQ ID NO: 2836214 - DNA, 17 bp, Homo sapiens
taattattatttatata

SEQ ID NO: 2836215 - DNA, 19 bp, Homo sapiens
taattcaattcaaagctgt

SEQ ID NO: 2836216 - DNA, 14 bp, Homo sapiens
taattcattaaatt

SEQ ID NO: 2836217 - DNA, 11 bp, Homo sapiens
taattctaaat

SEQ ID NO: 2836218 - DNA, 16 bp, Homo sapiens
taattcttgtatatta

SEQ ID NO: 2836219 - DNA, 14 bp, Homo sapiens
taattgatttcaag

SEQ ID NO: 2836220 - DNA, 17 bp, Homo sapiens
taattgcatttctgctc

SEQ ID NO: 2836221 - DNA, 18 bp, Homo sapiens
taattggtgacaatgtca

SEQ ID NO: 2836222 - DNA, 16 bp, Homo sapiens
taattgttgctaatct

SEQ ID NO: 2836223 - DNA, 15 bp, Homo sapiens
taatttaaaccagca

SEQ ID NO: 2836224 - DNA, 17 bp, Homo sapiens
taatttaaaccagcaga

SEQ ID NO: 2836225 - DNA, 18 bp, Homo sapiens
taatttaaaccagcagaa

SEQ ID NO: 2836226 - DNA, 14 bp, Homo sapiens
taatttaactaatt

SEQ ID NO: 2836227 - DNA, 15 bp, Homo sapiens
taatttaactaattt

SEQ ID NO: 2836228 - DNA, 21 bp, Homo sapiens
taatttaatgcatgttaggaa

SEQ ID NO: 2836229 - DNA, 14 bp, Homo sapiens
taatttagaaatca

SEQ ID NO: 2836230 - DNA, 22 bp, Homo sapiens
taatttagcagtccaaagaaca

SEQ ID NO: 2836231 - DNA, 17 bp, Homo sapiens
taatttagtttcatata

SEQ ID NO: 2836232 - DNA, 15 bp, Homo sapiens
taatttattttgtat

SEQ ID NO: 2836233 - DNA, 13 bp, Homo sapiens
taattttaaattc

SEQ ID NO: 2836234 - DNA, 15 bp, Homo sapiens
taattttgaataaat

SEQ ID NO: 2836235 - DNA, 14 bp, Homo sapiens
taattttgtttgta

SEQ ID NO: 2836236 - DNA, 16 bp, Homo sapiens
taattttgtttgtaat

SEQ ID NO: 2836237 - DNA, 22 bp, Homo sapiens
taatttttttcaatatttatta

SEQ ID NO: 2836238 - DNA, 22 bp, Homo sapiens
taattttttttttccttttaaa

SEQ ID NO: 2836239 - DNA, 22 bp, Homo sapiens
tacaaaaatagtagaacaagca

SEQ ID NO: 2836240 - DNA, 18 bp, Homo sapiens
tacaaaaattagccggac

SEQ ID NO: 2836241 - DNA, 18 bp, Homo sapiens
tacaaaataaaattatgg

SEQ ID NO: 2836242 - DNA, 19 bp, Homo sapiens
tacaaaatttgaaatttag

SEQ ID NO: 2836243 - DNA, 15 bp, Homo sapiens
tacaaagtagagaag

SEQ ID NO: 2836244 - DNA, 18 bp, Homo sapiens
tacaaagtagagaagtat

SEQ ID NO: 2836245 - DNA, 14 bp, Homo sapiens
tacaaataaagatg

SEQ ID NO: 2836246 - DNA, 15 bp, Homo sapiens
tacaaatatatttaa

SEQ ID NO: 2836247 - DNA, 16 bp, Homo sapiens
tacaaattcaaggaga

SEQ ID NO: 2836248 - DNA, 12 bp, Homo sapiens
tacaaccagagc

SEQ ID NO: 2836249 - DNA, 14 bp, Homo sapiens
tacaaccagagccc

SEQ ID NO: 2836250 - DNA, 14 bp, Homo sapiens
tacaacttcaagtg

SEQ ID NO: 2836251 - DNA, 19 bp, Homo sapiens
tacaagaagcattttgtaa

SEQ ID NO: 2836252 - DNA, 19 bp, Homo sapiens
tacaagcgtgagccactgc

SEQ ID NO: 2836253 - DNA, 21 bp, Homo sapiens
tacaagcgtgagccactgcac

SEQ ID NO: 2836254 - DNA, 22 bp, Homo sapiens
tacaagtagaatggcagctgga

SEQ ID NO: 2836255 - DNA, 20 bp, Homo sapiens
tacaataaaatcttgaaaat

SEQ ID NO: 2836256 - DNA, 14 bp, Homo sapiens
tacaataaatattc

SEQ ID NO: 2836257 - DNA, 17 bp, Homo sapiens
tagcaagacacatccct

SEQ ID NO: 2836258 - DNA, 18 bp, Homo sapiens
tagcaagacacatcccta

SEQ ID NO: 2836259 - DNA, 13 bp, Homo sapiens
tagcacaagttat

SEQ ID NO: 2836260 - DNA, 19 bp, Homo sapiens
tagcacaagttatttaaat

SEQ ID NO: 2836261 - DNA, 16 bp, Homo sapiens
tagcacaatttatatt

SEQ ID NO: 2836262 - DNA, 15 bp, Homo sapiens
tagcagagtcattgt

SEQ ID NO: 2836263 - DNA, 19 bp, Homo sapiens
tagcagagtcattgttaca

SEQ ID NO: 2836264 - DNA, 14 bp, Homo sapiens
tagcagattttaat

SEQ ID NO: 2836265 - DNA, 20 bp, Homo sapiens
tagcagctcttcccctttcc

SEQ ID NO: 2836266 - DNA, 22 bp, Homo sapiens
tagcagctcttcccctttcctg

SEQ ID NO: 2836267 - DNA, 22 bp, Homo sapiens
tagcaggactgaattgtcccca

SEQ ID NO: 2836268 - DNA, 23 bp, Homo sapiens
tagcaggtggtcctgagacctga

SEQ ID NO: 2836269 - DNA, 15 bp, Homo sapiens
tagcatctgctcttc

SEQ ID NO: 2836270 - DNA, 20 bp, Homo sapiens
tagcatctgctcttctctta

SEQ ID NO: 2836271 - DNA, 13 bp, Homo sapiens
tagcatcttctgg

SEQ ID NO: 2836272 - DNA, 22 bp, Homo sapiens
tagcatcttctggagtctccag

SEQ ID NO: 2836273 - DNA, 21 bp, Homo sapiens
tagccaaaaatagctaaatac

SEQ ID NO: 2836274 - DNA, 23 bp, Homo sapiens
tagccaaggtgggctgagccctg

SEQ ID NO: 2836275 - DNA, 13 bp, Homo sapiens
tagccactcagga

SEQ ID NO: 2836276 - DNA, 17 bp, Homo sapiens
tagccacttaccttcaa

SEQ ID NO: 2836277 - DNA, 23 bp, Homo sapiens
tagccagccggggcgagtggcac

SEQ ID NO: 2836278 - DNA, 19 bp, Homo sapiens
tagcccagcactgtgaaga

SEQ ID NO: 2836279 - DNA, 13 bp, Homo sapiens
tagccccagtgac

SEQ ID NO: 2836280 - DNA, 18 bp, Homo sapiens
tagccctgcggagccggc

SEQ ID NO: 2836281 - DNA, 17 bp, Homo sapiens
tagccgacctcagcctt

SEQ ID NO: 2836282 - DNA, 14 bp, Homo sapiens
tagccgagagcctg

SEQ ID NO: 2836283 - DNA, 17 bp, Homo sapiens
tagccgagagcctgctc

SEQ ID NO: 2836284 - DNA, 16 bp, Homo sapiens
tagcctaggtgacaga

SEQ ID NO: 2836285 - DNA, 20 bp, Homo sapiens
tagcctcgccgtctgtgaat

SEQ ID NO: 2836286 - DNA, 15 bp, Homo sapiens
tagccttctctgttc

SEQ ID NO: 2836287 - DNA, 22 bp, Homo sapiens
tagccttgcccggattctggga

SEQ ID NO: 2836288 - DNA, 21 bp, Homo sapiens
tagccttgccttttaaaagaa

SEQ ID NO: 2836289 - DNA, 22 bp, Homo sapiens
tagcgctgccgcaccccagagt

SEQ ID NO: 2836290 - DNA, 20 bp, Homo sapiens
tagctatcatttcttttcca

SEQ ID NO: 2836291 - DNA, 17 bp, Homo sapiens
tagctattgcatgtaaa

SEQ ID NO: 2836292 - DNA, 16 bp, Homo sapiens
tagctatttttatgga

SEQ ID NO: 2836293 - DNA, 17 bp, Homo sapiens
tagctatttttatggaa

SEQ ID NO: 2836294 - DNA, 13 bp, Homo sapiens
tagctctgtccac

SEQ ID NO: 2836295 - DNA, 14 bp, Homo sapiens
tagctctgttcttt

SEQ ID NO: 2836296 - DNA, 21 bp, Homo sapiens
tagctcttctatttaaaaaat

SEQ ID NO: 2836297 - DNA, 19 bp, Homo sapiens
tagctgaaacctaaggcaa

SEQ ID NO: 2836298 - DNA, 23 bp, Homo sapiens
tagctgacccagccccttgagaa

SEQ ID NO: 2836299 - DNA, 11 bp, Homo sapiens
tagctgcagaa

SEQ ID NO: 2836300 - DNA, 13 bp, Homo sapiens
tagctgctttaaa

SEQ ID NO: 2836301 - DNA, 22 bp, Homo sapiens
tagctgctttaaatctatctat

SEQ ID NO: 2836302 - DNA, 11 bp, Homo sapiens
tagctgggact

SEQ ID NO: 2836303 - DNA, 17 bp, Homo sapiens
tagctgggactacaggc

SEQ ID NO: 2836304 - DNA, 19 bp, Homo sapiens
tagctgggactacaggcac

SEQ ID NO: 2836305 - DNA, 20 bp, Homo sapiens
tagctgggactacaggcacc

SEQ ID NO: 2836306 - DNA, 22 bp, Homo sapiens
tagctggtttcctcattcctga

SEQ ID NO: 2836307 - DNA, 19 bp, Homo sapiens
tagctgtaaatacatgtgt

SEQ ID NO: 2836308 - DNA, 20 bp, Homo sapiens
tagctgtaaatacatgtgtg

SEQ ID NO: 2836309 - DNA, 16 bp, Homo sapiens
tagctgtgacctctcc

SEQ ID NO: 2836310 - DNA, 15 bp, Homo sapiens
tagctgtgacctgct

SEQ ID NO: 2836311 - DNA, 17 bp, Homo sapiens
tagctgtgacctgctga

SEQ ID NO: 2836312 - DNA, 20 bp, Homo sapiens
tagctgtgacctgctgagct

SEQ ID NO: 2836313 - DNA, 24 bp, Homo sapiens
tagctgtgacctgctgagctctga

SEQ ID NO: 2836314 - DNA, 18 bp, Homo sapiens
tagctgtggtgaggtggg

SEQ ID NO: 2836315 - DNA, 13 bp, Homo sapiens
tagctgttgagct

SEQ ID NO: 2836316 - DNA, 16 bp, Homo sapiens
tagcttaaataaattc

SEQ ID NO: 2836317 - DNA, 18 bp, Homo sapiens
tagcttaaataaattcaa

SEQ ID NO: 2836318 - DNA, 21 bp, Homo sapiens
tagcttacagtcaattttaca

SEQ ID NO: 2836319 - DNA, 17 bp, Homo sapiens
tagcttagacctcagcc

SEQ ID NO: 2836320 - DNA, 15 bp, Homo sapiens
tagcttggaaactgg

SEQ ID NO: 2836321 - DNA, 20 bp, Homo sapiens
tagcttggaaactggatgag

SEQ ID NO: 2836322 - DNA, 22 bp, Homo sapiens
tagctttattttttaagtattt

SEQ ID NO: 2836323 - DNA, 23 bp, Homo sapiens
taggaaagcaccgcagcatgtgg

SEQ ID NO: 2836324 - DNA, 16 bp, Homo sapiens
taggaaataaaacctt

SEQ ID NO: 2836325 - DNA, 17 bp, Homo sapiens
taggaaataaaaccttt

SEQ ID NO: 2836326 - DNA, 13 bp, Homo sapiens
taggaagaaaaat

SEQ ID NO: 2836327 - DNA, 17 bp, Homo sapiens
taggaagaaaaatgttt

SEQ ID NO: 2836328 - DNA, 14 bp, Homo sapiens
taggaagtgaccga

SEQ ID NO: 2836329 - DNA, 23 bp, Homo sapiens
taggaatgcttttattcaagaca

SEQ ID NO: 2836330 - DNA, 20 bp, Homo sapiens
taggacataaattagaggtc

SEQ ID NO: 2836331 - DNA, 14 bp, Homo sapiens
taggactctgaggc

SEQ ID NO: 2836332 - DNA, 18 bp, Homo sapiens
taggactctgaggctctt

SEQ ID NO: 2836333 - DNA, 17 bp, Homo sapiens
taggacttgagcctcca

SEQ ID NO: 2836334 - DNA, 16 bp, Homo sapiens
taggagcaaagcctgt

SEQ ID NO: 2836335 - DNA, 17 bp, Homo sapiens
taggagcaaagcctgtt

SEQ ID NO: 2836336 - DNA, 18 bp, Homo sapiens
taggagctgggaggaaaa

SEQ ID NO: 2836337 - DNA, 23 bp, Homo sapiens
taggagggactgtcgctgcttcg

SEQ ID NO: 2836338 - DNA, 20 bp, Homo sapiens
taggatctatgcaattttta

SEQ ID NO: 2836339 - DNA, 13 bp, Homo sapiens
taggatgtttttc

SEQ ID NO: 2836340 - DNA, 19 bp, Homo sapiens
taggatgtttttcatgaaa

SEQ ID NO: 2836341 - DNA, 16 bp, Homo sapiens
taggatttatttaaaa

SEQ ID NO: 2836342 - DNA, 14 bp, Homo sapiens
taggcctggccaga

SEQ ID NO: 2836343 - DNA, 14 bp, Homo sapiens
taggcgagtgccag

SEQ ID NO: 2836344 - DNA, 21 bp, Homo sapiens
taggctggagaagctcaccca

SEQ ID NO: 2836345 - DNA, 16 bp, Homo sapiens
tagggaaaagttcata

SEQ ID NO: 2836346 - DNA, 18 bp, Homo sapiens
tagggcttatggccaggg

SEQ ID NO: 2836347 - DNA, 14 bp, Homo sapiens
tcaccccgtctggg

SEQ ID NO: 2836348 - DNA, 17 bp, Homo sapiens
tcaccctacctgtgcct

SEQ ID NO: 2836349 - DNA, 20 bp, Homo sapiens
tcaccgagagtagccgagag

SEQ ID NO: 2836350 - DNA, 14 bp, Homo sapiens
tcaccggagctttc

SEQ ID NO: 2836351 - DNA, 17 bp, Homo sapiens
tcaccgtggaccttcct

SEQ ID NO: 2836352 - DNA, 19 bp, Homo sapiens
tcaccgtggaccttcctgc

SEQ ID NO: 2836353 - DNA, 21 bp, Homo sapiens
tcaccgtggaccttcctgcca

SEQ ID NO: 2836354 - DNA, 19 bp, Homo sapiens
tcacctgaagactcattct

SEQ ID NO: 2836355 - DNA, 17 bp, Homo sapiens
tcacctgaggtcgggag

SEQ ID NO: 2836356 - DNA, 20 bp, Homo sapiens
tcacctgcctgccctcccct

SEQ ID NO: 2836357 - DNA, 15 bp, Homo sapiens
tcacctggaatcaga

SEQ ID NO: 2836358 - DNA, 19 bp, Homo sapiens
tcacctgtttttaagctgt

SEQ ID NO: 2836359 - DNA, 14 bp, Homo sapiens
tcaccttatgtatt

SEQ ID NO: 2836360 - DNA, 15 bp, Homo sapiens
tcaccttatgtatta

SEQ ID NO: 2836361 - DNA, 16 bp, Homo sapiens
tcacgcccagcctcct

SEQ ID NO: 2836362 - DNA, 12 bp, Homo sapiens
catgcttaaata

SEQ ID NO: 2836363 - DNA, 21 bp, Homo sapiens
catgcttcttgccccttgggc

SEQ ID NO: 2836364 - DNA, 15 bp, Homo sapiens
catgctttcccacca

SEQ ID NO: 2836365 - DNA, 12 bp, Homo sapiens
catgctttgttt

SEQ ID NO: 2836366 - DNA, 23 bp, Homo sapiens
catggaaggcggcacagaggcag

SEQ ID NO: 2836367 - DNA, 15 bp, Homo sapiens
catggagaaaccctg

SEQ ID NO: 2836368 - DNA, 21 bp, Homo sapiens
catggcagaataatctttggg

SEQ ID NO: 2836369 - DNA, 19 bp, Homo sapiens
catggcagatgtaggaggg

SEQ ID NO: 2836370 - DNA, 20 bp, Homo sapiens
catggcagatgtaggaggga

SEQ ID NO: 2836371 - DNA, 17 bp, Homo sapiens
catggcctatgcacata

SEQ ID NO: 2836372 - DNA, 19 bp, Homo sapiens
catggcgtgtccctctcgg

SEQ ID NO: 2836373 - DNA, 12 bp, Homo sapiens
catggctatctg

SEQ ID NO: 2836374 - DNA, 16 bp, Homo sapiens
catgggcctcctgtgt

SEQ ID NO: 2836375 - DNA, 18 bp, Homo sapiens
catgggcctcctgtgtgt

SEQ ID NO: 2836376 - DNA, 16 bp, Homo sapiens
catggtcccacatccc

SEQ ID NO: 2836377 - DNA, 20 bp, Homo sapiens
catggtcccacatccctggg

SEQ ID NO: 2836378 - DNA, 23 bp, Homo sapiens
catggtcccacatccctgggcct

SEQ ID NO: 2836379 - DNA, 21 bp, Homo sapiens
catggtgcagttgacagcagg

SEQ ID NO: 2836380 - DNA, 17 bp, Homo sapiens
catggtggcgcaagcct

SEQ ID NO: 2836381 - DNA, 23 bp, Homo sapiens
catggtgtgaaagtcagatgccc

SEQ ID NO: 2836382 - DNA, 16 bp, Homo sapiens
catgtaaaagagtcat

SEQ ID NO: 2836383 - DNA, 14 bp, Homo sapiens
catgtaaaatgcag

SEQ ID NO: 2836384 - DNA, 16 bp, Homo sapiens
catgtaacatagattt

SEQ ID NO: 2836385 - DNA, 16 bp, Homo sapiens
cattctctctcctgtc

SEQ ID NO: 2836386 - DNA, 23 bp, Homo sapiens
cattctgattcgaatgacactgt

SEQ ID NO: 2836387 - DNA, 16 bp, Homo sapiens
cattctgcctgcccag

SEQ ID NO: 2836388 - DNA, 23 bp, Homo sapiens
cattcttctgtacgtctgacagg

SEQ ID NO: 2836389 - DNA, 18 bp, Homo sapiens
cattctttatcttgacat

SEQ ID NO: 2836390 - DNA, 19 bp, Homo sapiens
cattgaaagagaaccagtt

SEQ ID NO: 2836391 - DNA, 22 bp, Homo sapiens
cattgaatggctatgtttttaa

SEQ ID NO: 2836392 - DNA, 20 bp, Homo sapiens
cattgagtttaagtctctga

SEQ ID NO: 2836393 - DNA, 19 bp, Homo sapiens
cattgatatgaaaaatatg

SEQ ID NO: 2836394 - DNA, 21 bp, Homo sapiens
cattgcgctctagcctgggca

SEQ ID NO: 2836395 - DNA, 18 bp, Homo sapiens
cattgggtgggtaaattc

SEQ ID NO: 2836396 - DNA, 16 bp, Homo sapiens
cattgtagagcttctg

SEQ ID NO: 2836397 - DNA, 17 bp, Homo sapiens
cattgtagagcttctgg

SEQ ID NO: 2836398 - DNA, 15 bp, Homo sapiens
cattgtccatgccta

SEQ ID NO: 2836399 - DNA, 22 bp, Homo sapiens
cattgtgccatgtcaaacaaat

SEQ ID NO: 2836400 - DNA, 17 bp, Homo sapiens
cattgtgtgagcttcta

SEQ ID NO: 2836401 - DNA, 17 bp, Homo sapiens
cattgttggccaaagcc

SEQ ID NO: 2836402 - DNA, 18 bp, Homo sapiens
cattgttggccaaagcca

SEQ ID NO: 2836403 - DNA, 16 bp, Homo sapiens
catttaagggaaaaat

SEQ ID NO: 2836404 - DNA, 22 bp, Homo sapiens
catttaagggaaaaatatatat

SEQ ID NO: 2836405 - DNA, 12 bp, Homo sapiens
catttaattcat

SEQ ID NO: 2836406 - DNA, 16 bp, Homo sapiens
tatttactgagcttct

SEQ ID NO: 2836407 - DNA, 23 bp, Homo sapiens
tatttactgagcttctctgtgaa

SEQ ID NO: 2836408 - DNA, 17 bp, Homo sapiens
tatttagattgttaaaa

SEQ ID NO: 2836409 - DNA, 19 bp, Homo sapiens
tatttagattgttaaaata

SEQ ID NO: 2836410 - DNA, 17 bp, Homo sapiens
tatttataaatatattt

SEQ ID NO: 2836411 - DNA, 15 bp, Homo sapiens
tatttatactctaga

SEQ ID NO: 2836412 - DNA, 23 bp, Homo sapiens
tatttatactctagaacatgcac

SEQ ID NO: 2836413 - DNA, 13 bp, Homo sapiens
tatttatatatga

SEQ ID NO: 2836414 - DNA, 20 bp, Homo sapiens
tatttatatattggtaacat

SEQ ID NO: 2836415 - DNA, 13 bp, Homo sapiens
tatttatatattt

SEQ ID NO: 2836416 - DNA, 17 bp, Homo sapiens
tatttatatatttataa

SEQ ID NO: 2836417 - DNA, 14 bp, Homo sapiens
tatttatatatttg

SEQ ID NO: 2836418 - DNA, 15 bp, Homo sapiens
tatttatatatttga

SEQ ID NO: 2836419 - DNA, 15 bp, Homo sapiens
tatttatattagagt

SEQ ID NO: 2836420 - DNA, 14 bp, Homo sapiens
tatttatatttgga

SEQ ID NO: 2836421 - DNA, 15 bp, Homo sapiens
tatttatcagtgaca

SEQ ID NO: 2836422 - DNA, 20 bp, Homo sapiens
tatttatctgtgcaaatcct

SEQ ID NO: 2836423 - DNA, 19 bp, Homo sapiens
tatttattattttcacctg

SEQ ID NO: 2836424 - DNA, 17 bp, Homo sapiens
tatttattgtcattact

SEQ ID NO: 2836425 - DNA, 11 bp, Homo sapiens
tatttatttaa

SEQ ID NO: 2836426 - DNA, 16 bp, Homo sapiens
tatttatttaagctta

SEQ ID NO: 2836427 - DNA, 13 bp, Homo sapiens
tatttatttactg

SEQ ID NO: 2836428 - DNA, 20 bp, Homo sapiens
tatttattttttttaagtat

SEQ ID NO: 2836429 - DNA, 15 bp, Homo sapiens
tatttcacaacagcc

SEQ ID NO: 2836430 - DNA, 11 bp, Homo sapiens
tatttctgaga

SEQ ID NO: 2836431 - DNA, 16 bp, Homo sapiens
tatttctgagaaggtc

SEQ ID NO: 2836432 - DNA, 15 bp, Homo sapiens
tatttgaatatcatt

SEQ ID NO: 2836433 - DNA, 23 bp, Homo sapiens
tatttgctaattaaaaagttaat

SEQ ID NO: 2836434 - DNA, 15 bp, Homo sapiens
tatttgcttatttat

SEQ ID NO: 2836435 - DNA, 18 bp, Homo sapiens
tatttggaataataattt

SEQ ID NO: 2836436 - DNA, 19 bp, Homo sapiens
tattttaaaaccatgcagc

SEQ ID NO: 2836437 - DNA, 16 bp, Homo sapiens
tattttaaagaattgt

SEQ ID NO: 2836438 - DNA, 16 bp, Homo sapiens
tattttactactgtgg

SEQ ID NO: 2836439 - DNA, 18 bp, Homo sapiens
tattttacttctagagat

SEQ ID NO: 2836440 - DNA, 18 bp, Homo sapiens
tattttatatgaaatgtt

SEQ ID NO: 2836441 - DNA, 15 bp, Homo sapiens
tattttatctgtgtt

SEQ ID NO: 2836442 - DNA, 10 bp, Homo sapiens
tattttatga

SEQ ID NO: 2836443 - DNA, 19 bp, Homo sapiens
tattttattccctttcaca

SEQ ID NO: 2836444 - DNA, 16 bp, Homo sapiens
tattttcaagaaactg

SEQ ID NO: 2836445 - DNA, 18 bp, Homo sapiens
tattttccaataaaattt

SEQ ID NO: 2836446 - DNA, 20 bp, Homo sapiens
tattttccctctcttgcctt

SEQ ID NO: 2836447 - DNA, 18 bp, Homo sapiens
tattttcgtgcatttgtg

SEQ ID NO: 2836448 - DNA, 19 bp, Homo sapiens
tattttcgtgcatttgtga

SEQ ID NO: 2836449 - DNA, 13 bp, Homo sapiens
tattttctgaatt

SEQ ID NO: 2836450 - DNA, 19 bp, Homo sapiens
tattttcttcccatttgta

SEQ ID NO: 2836451 - DNA, 13 bp, Homo sapiens
tattttcttggat

SEQ ID NO: 2836452 - DNA, 13 bp, Homo sapiens
tattttgtaaact

SEQ ID NO: 2836453 - DNA, 22 bp, Homo sapiens
tattttgtaataaactctctag

SEQ ID NO: 2836454 - DNA, 17 bp, Homo sapiens
tattttgttacactaaa

SEQ ID NO: 2836455 - DNA, 15 bp, Homo sapiens
tatttttcacagttt

SEQ ID NO: 2836456 - DNA, 15 bp, Homo sapiens
tatttttgtgtttct

SEQ ID NO: 2836457 - DNA, 16 bp, Homo sapiens
tatttttgtgtttcta

SEQ ID NO: 2836458 - DNA, 20 bp, Homo sapiens
tatttttgtttcttccaaag

SEQ ID NO: 2836459 - DNA, 13 bp, Homo sapiens
tattttttaagta

SEQ ID NO: 2836460 - DNA, 13 bp, Homo sapiens
tattttttctaca

SEQ ID NO: 2836461 - DNA, 14 bp, Homo sapiens
tcaaaaaaacacta

SEQ ID NO: 2836462 - DNA, 16 bp, Homo sapiens
tcaaaaaaacactagt

SEQ ID NO: 2836463 - DNA, 20 bp, Homo sapiens
tcaaaaattacactacaagt

SEQ ID NO: 2836464 - DNA, 18 bp, Homo sapiens
tcaaaaattgaagagaga

SEQ ID NO: 2836465 - DNA, 21 bp, Homo sapiens
tcaaaaattgaagagagatat

SEQ ID NO: 2836466 - DNA, 13 bp, Homo sapiens
tcaaaacatatca

SEQ ID NO: 2836467 - DNA, 14 bp, Homo sapiens
tcaaaacatatcaa

SEQ ID NO: 2836468 - DNA, 21 bp, Homo sapiens
tcaaaacatatcaattcaaca

SEQ ID NO: 2836469 - DNA, 20 bp, Homo sapiens
tcaaaacctttcaaatatca

SEQ ID NO: 2836470 - DNA, 19 bp, Homo sapiens
tcaaaagaatcagaaacag

SEQ ID NO: 2836471 - DNA, 20 bp, Homo sapiens
tcaaaagtggattttcctga

SEQ ID NO: 2836472 - DNA, 16 bp, Homo sapiens
tcaaaataaattgaaa

SEQ ID NO: 2836473 - DNA, 18 bp, Homo sapiens
tcaaaatatttgtacata

SEQ ID NO: 2836474 - DNA, 13 bp, Homo sapiens
tcaaaccaggatt

SEQ ID NO: 2836475 - DNA, 14 bp, Homo sapiens
tcaaaccaggattt

SEQ ID NO: 2836476 - DNA, 16 bp, Homo sapiens
tcaaaccataaacttc

SEQ ID NO: 2836477 - DNA, 18 bp, Homo sapiens
tcaaaccataaacttcat

SEQ ID NO: 2836478 - DNA, 14 bp, Homo sapiens
tcaaaccatttaat

SEQ ID NO: 2836479 - DNA, 16 bp, Homo sapiens
tcaaaccatttaattc

SEQ ID NO: 2836480 - DNA, 19 bp, Homo sapiens
tcaaaccccgaccacctgc

SEQ ID NO: 2836481 - DNA, 22 bp, Homo sapiens
tcaaactcttgacctcaggtga

SEQ ID NO: 2836482 - DNA, 13 bp, Homo sapiens
tcaaactgctcca

SEQ ID NO: 2836483 - DNA, 16 bp, Homo sapiens
tcaaactgctccaagt

SEQ ID NO: 2836484 - DNA, 21 bp, Homo sapiens
tcaaactttactctaagtctc

SEQ ID NO: 2836485 - DNA, 13 bp, Homo sapiens
tcaaagcaagcat

SEQ ID NO: 2836486 - DNA, 20 bp, Homo sapiens
tcaaagcccccacttctctc

SEQ ID NO: 2836487 - DNA, 22 bp, Homo sapiens
tcaaagcccccacttctctcca

SEQ ID NO: 2836488 - DNA, 23 bp, Homo sapiens
tcaaagcccccacttctctccag

SEQ ID NO: 2836489 - DNA, 20 bp, Homo sapiens
tcaaagcttgaagatcgtta

SEQ ID NO: 2836490 - DNA, 14 bp, Homo sapiens
tcaaagtaaaactt

SEQ ID NO: 2836491 - DNA, 14 bp, Homo sapiens
tcaaagttcctgtt

SEQ ID NO: 2836492 - DNA, 15 bp, Homo sapiens
tcaaatattaccaaa

SEQ ID NO: 2836493 - DNA, 13 bp, Homo sapiens
tcaaatctattca

SEQ ID NO: 2836494 - DNA, 15 bp, Homo sapiens
tcaaatctattcaga

SEQ ID NO: 2836495 - DNA, 17 bp, Homo sapiens
tcaaatctattcagaca

SEQ ID NO: 2836496 - DNA, 19 bp, Homo sapiens
tcaaatgacccaaagacca

SEQ ID NO: 2836497 - DNA, 15 bp, Homo sapiens
tcaatttctgaacac

SEQ ID NO: 2836498 - DNA, 16 bp, Homo sapiens
tcaatttgtatatcat

SEQ ID NO: 2836499 - DNA, 13 bp, Homo sapiens
tcaatttttatac

SEQ ID NO: 2836500 - DNA, 15 bp, Homo sapiens
tcaatttttatacat

SEQ ID NO: 2836501 - DNA, 16 bp, Homo sapiens
tcaatttttatacata

SEQ ID NO: 2836502 - DNA, 21 bp, Homo sapiens
tcaatttttatacatatcaga

SEQ ID NO: 2836503 - DNA, 17 bp, Homo sapiens
tcacaaaacctggcaca

SEQ ID NO: 2836504 - DNA, 16 bp, Homo sapiens
tcacaacaacctggtc

SEQ ID NO: 2836505 - DNA, 15 bp, Homo sapiens
tcacaaccagccaca

SEQ ID NO: 2836506 - DNA, 19 bp, Homo sapiens
tcacaaccagccacacaga

SEQ ID NO: 2836507 - DNA, 20 bp, Homo sapiens
tcacaaccagccacacagag

SEQ ID NO: 2836508 - DNA, 19 bp, Homo sapiens
tcacaactgtttttgaaga

SEQ ID NO: 2836509 - DNA, 21 bp, Homo sapiens
tcacaactgtttttgaagaag

SEQ ID NO: 2836510 - DNA, 14 bp, Homo sapiens
tcacaagcaataat

SEQ ID NO: 2836511 - DNA, 16 bp, Homo sapiens
tcacaagcaataatta

SEQ ID NO: 2836512 - DNA, 14 bp, Homo sapiens
tcacaagcacaaag

SEQ ID NO: 2836513 - DNA, 17 bp, Homo sapiens
tcacaagcacaaagctc

SEQ ID NO: 2836514 - DNA, 18 bp, Homo sapiens
tcacaagcacaaagctca

SEQ ID NO: 2836515 - DNA, 18 bp, Homo sapiens
tcacaaggcagcaaggcc

SEQ ID NO: 2836516 - DNA, 23 bp, Homo sapiens
tcacaaggcagcaaggcccgagc

SEQ ID NO: 2836517 - DNA, 18 bp, Homo sapiens
tcacaatcctgtccctca

SEQ ID NO: 2836518 - DNA, 22 bp, Homo sapiens
tcacaatgaaatgctctccttt

SEQ ID NO: 2836519 - DNA, 20 bp, Homo sapiens
tcacacacaggcaactgagg

SEQ ID NO: 2836520 - DNA, 21 bp, Homo sapiens
tcacacacaggcaactgaggc

SEQ ID NO: 2836521 - DNA, 13 bp, Homo sapiens
tcacacacccctc

SEQ ID NO: 2836522 - DNA, 21 bp, Homo sapiens
tcacacacccctcaaaaaaag

SEQ ID NO: 2836523 - DNA, 20 bp, Homo sapiens
tcacacaggcatttcctggg

SEQ ID NO: 2836524 - DNA, 21 bp, Homo sapiens
tcacacagtattacttctgct

SEQ ID NO: 2836525 - DNA, 22 bp, Homo sapiens
tcacacccaacttggttttgct

SEQ ID NO: 2836526 - DNA, 13 bp, Homo sapiens
tcacactctgggt

SEQ ID NO: 2836527 - DNA, 11 bp, Homo sapiens
tcacactgatg

SEQ ID NO: 2836528 - DNA, 20 bp, Homo sapiens
tcacactgcaagagccttgg

SEQ ID NO: 2836529 - DNA, 11 bp, Homo sapiens
tcacactgtgc

SEQ ID NO: 2836530 - DNA, 20 bp, Homo sapiens
tcacactgttactccacagc

SEQ ID NO: 2836531 - DNA, 21 bp, Homo sapiens
tcacactgttactccacagcg

SEQ ID NO: 2836532 - DNA, 12 bp, Homo sapiens
tcacaggcaggt

SEQ ID NO: 2836533 - DNA, 19 bp, Homo sapiens
tcacaggcaggtccagggt

SEQ ID NO: 2836534 - DNA, 18 bp, Homo sapiens
tcacagggcagagccggg

SEQ ID NO: 2836535 - DNA, 23 bp, Homo sapiens
tcacagggccccagaaggcaggg

SEQ ID NO: 2836536 - DNA, 14 bp, Homo sapiens
tcacagtgtttgca

SEQ ID NO: 2836537 - DNA, 20 bp, Homo sapiens
tcacagttcctcgccctggg

SEQ ID NO: 2836538 - DNA, 22 bp, Homo sapiens
tcacagttgccatgtagacccc

SEQ ID NO: 2836539 - DNA, 14 bp, Homo sapiens
tcacataatgaatg

SEQ ID NO: 2836540 - DNA, 14 bp, Homo sapiens
tcacatacaatttg

SEQ ID NO: 2836541 - DNA, 15 bp, Homo sapiens
tcacatacaatttgc

SEQ ID NO: 2836542 - DNA, 16 bp, Homo sapiens
tcacatacaatttgca

SEQ ID NO: 2836543 - DNA, 21 bp, Homo sapiens
tcacatacaatttgcactgtt

SEQ ID NO: 2836544 - DNA, 15 bp, Homo sapiens
tcacataccctcccc

SEQ ID NO: 2836545 - DNA, 16 bp, Homo sapiens
tcacataccctccccc

SEQ ID NO: 2836546 - DNA, 21 bp, Homo sapiens
tcacatataaaagttaaacta

SEQ ID NO: 2836547 - DNA, 15 bp, Homo sapiens
tcacatatctgtcat

SEQ ID NO: 2836548 - DNA, 14 bp, Homo sapiens
tcacatattctagt

SEQ ID NO: 2836549 - DNA, 21 bp, Homo sapiens
tcacatggcctatgcacatat

SEQ ID NO: 2836550 - DNA, 19 bp, Homo sapiens
tcacattaatatttgctga

SEQ ID NO: 2836551 - DNA, 20 bp, Homo sapiens
tcacattaatatttgctgac

SEQ ID NO: 2836552 - DNA, 15 bp, Homo sapiens
tcacattatttgcat

SEQ ID NO: 2836553 - DNA, 18 bp, Homo sapiens
tcacatttgatgtacatg

SEQ ID NO: 2836554 - DNA, 19 bp, Homo sapiens
tcacatttgatgtacatgt

SEQ ID NO: 2836555 - DNA, 19 bp, Homo sapiens
tcacatttttacttggtgt

SEQ ID NO: 2836556 - DNA, 12 bp, Homo sapiens
tcaccaagctca

SEQ ID NO: 2836557 - DNA, 22 bp, Homo sapiens
tcaccaagctcacagttcctcg

SEQ ID NO: 2836558 - DNA, 17 bp, Homo sapiens
tcaccaataacttcaga

SEQ ID NO: 2836559 - DNA, 16 bp, Homo sapiens
tcaccacatgtgcaca

SEQ ID NO: 2836560 - DNA, 16 bp, Homo sapiens
tcaccaccttcccagc

SEQ ID NO: 2836561 - DNA, 18 bp, Homo sapiens
tcaccaccttcccagctc

SEQ ID NO: 2836562 - DNA, 18 bp, Homo sapiens
tcaccagagcccatgctc

SEQ ID NO: 2836563 - DNA, 17 bp, Homo sapiens
tcaccagaggtcaggag

SEQ ID NO: 2836564 - DNA, 21 bp, Homo sapiens
tcaccagatttgctaatttat

SEQ ID NO: 2836565 - DNA, 17 bp, Homo sapiens
tcaccagccccagtgcc

SEQ ID NO: 2836566 - DNA, 19 bp, Homo sapiens
tcacccaagcaaggccaaa

SEQ ID NO: 2836567 - DNA, 11 bp, Homo sapiens
tcacccacagg

SEQ ID NO: 2836568 - DNA, 15 bp, Homo sapiens
tcacccacagggcta

SEQ ID NO: 2836569 - DNA, 22 bp, Homo sapiens
tcacccacagggctaagagcta

SEQ ID NO: 2836570 - DNA, 17 bp, Homo sapiens
tcacccagctaatctgt

SEQ ID NO: 2836571 - DNA, 18 bp, Homo sapiens
tcacccccagctttgcta

SEQ ID NO: 2836572 - DNA, 15 bp, Homo sapiens
aaataaattcaaacc

SEQ ID NO: 2836573 - DNA, 19 bp, Homo sapiens
aaataaatttggttctaat

SEQ ID NO: 2836574 - DNA, 17 bp, Homo sapiens
aaataacaatgtgctct

SEQ ID NO: 2836575 - DNA, 15 bp, Homo sapiens
aaataagaagaatgc

SEQ ID NO: 2836576 - DNA, 20 bp, Homo sapiens
aaataagaagaatgcttaat

SEQ ID NO: 2836577 - DNA, 13 bp, Homo sapiens
aaataagtttttg

SEQ ID NO: 2836578 - DNA, 16 bp, Homo sapiens
aaataagtttttgttt

SEQ ID NO: 2836579 - DNA, 18 bp, Homo sapiens
aaataatgttctgtcacg

SEQ ID NO: 2836580 - DNA, 16 bp, Homo sapiens
aaataatttaactaat

SEQ ID NO: 2836581 - DNA, 17 bp, Homo sapiens
aaataatttaactaatt

SEQ ID NO: 2836582 - DNA, 14 bp, Homo sapiens
aaataattttaaac

SEQ ID NO: 2836583 - DNA, 20 bp, Homo sapiens
aaataattttaaacaaaggt

SEQ ID NO: 2836584 - DNA, 17 bp, Homo sapiens
aaatacaaaataaaatt

SEQ ID NO: 2836585 - DNA, 21 bp, Homo sapiens
aaatacaccacctcactcctg

SEQ ID NO: 2836586 - DNA, 18 bp, Homo sapiens
aaatacatgctaagagaa

SEQ ID NO: 2836587 - DNA, 14 bp, Homo sapiens
aaatacatgtgtgg

SEQ ID NO: 2836588 - DNA, 18 bp, Homo sapiens
aaataccagtgaaccaaa

SEQ ID NO: 2836589 - DNA, 18 bp, Homo sapiens
aaatactccaagcttcaa

SEQ ID NO: 2836590 - DNA, 22 bp, Homo sapiens
aaatagaagaatacaaacatat

SEQ ID NO: 2836591 - DNA, 21 bp, Homo sapiens
aaatagaatgttactttggaa

SEQ ID NO: 2836592 - DNA, 21 bp, Homo sapiens
aaatagccacttaccttcaat

SEQ ID NO: 2836593 - DNA, 13 bp, Homo sapiens
aaatagctctttc

SEQ ID NO: 2836594 - DNA, 21 bp, Homo sapiens
aaatagtaggaccaatgttgt

SEQ ID NO: 2836595 - DNA, 13 bp, Homo sapiens
aaatagttcagta

SEQ ID NO: 2836596 - DNA, 14 bp, Homo sapiens
aaatagtttggata

SEQ ID NO: 2836597 - DNA, 18 bp, Homo sapiens
aaatagttttaaatatga

SEQ ID NO: 2836598 - DNA, 11 bp, Homo sapiens
aaatataaact

SEQ ID NO: 2836599 - DNA, 13 bp, Homo sapiens
aaatataaacttg

SEQ ID NO: 2836600 - DNA, 20 bp, Homo sapiens
aaatataattgggattttaa

SEQ ID NO: 2836601 - DNA, 22 bp, Homo sapiens
aaatataattgggattttaaaa

SEQ ID NO: 2836602 - DNA, 20 bp, Homo sapiens
aaatatacaaacatgtggca

SEQ ID NO: 2836603 - DNA, 13 bp, Homo sapiens
aaatatagtagca

SEQ ID NO: 2836604 - DNA, 20 bp, Homo sapiens
aaatatataatggtttactg

SEQ ID NO: 2836605 - DNA, 16 bp, Homo sapiens
aaatatatataaatat

SEQ ID NO: 2836606 - DNA, 20 bp, Homo sapiens
aaatatatataaatatatat

SEQ ID NO: 2836607 - DNA, 12 bp, Homo sapiens
aaatatatttaa

SEQ ID NO: 2836608 - DNA, 14 bp, Homo sapiens
aaatatatttaatt

SEQ ID NO: 2836609 - DNA, 22 bp, Homo sapiens
aaatatattttatgatttaaaa

SEQ ID NO: 2836610 - DNA, 15 bp, Homo sapiens
aaatatcttgaaagg

SEQ ID NO: 2836611 - DNA, 23 bp, Homo sapiens
aaatattattgtggaaatgaata

SEQ ID NO: 2836612 - DNA, 23 bp, Homo sapiens
aaatattccatccatatactttg

SEQ ID NO: 2836613 - DNA, 12 bp, Homo sapiens
aaatatttaaga

SEQ ID NO: 2836614 - DNA, 19 bp, Homo sapiens
aaatatttaagtatatagt

SEQ ID NO: 2836615 - DNA, 20 bp, Homo sapiens
aaatatttaagtatatagta

SEQ ID NO: 2836616 - DNA, 15 bp, Homo sapiens
aaatatttacatatg

SEQ ID NO: 2836617 - DNA, 17 bp, Homo sapiens
aaatatttacatatgaa

SEQ ID NO: 2836618 - DNA, 19 bp, Homo sapiens
aaatatttacatatgaaat

SEQ ID NO: 2836619 - DNA, 21 bp, Homo sapiens
aaatatttacatatgaaattt

SEQ ID NO: 2836620 - DNA, 13 bp, Homo sapiens
aaatatttatttt

SEQ ID NO: 2836621 - DNA, 15 bp, Homo sapiens
aaatatttgtacata

SEQ ID NO: 2836622 - DNA, 22 bp, Homo sapiens
aaatatttgtacatagttattt

SEQ ID NO: 2836623 - DNA, 15 bp, Homo sapiens
aaatattttaaagaa

SEQ ID NO: 2836624 - DNA, 18 bp, Homo sapiens
aaatattttaaagaattg

SEQ ID NO: 2836625 - DNA, 15 bp, Homo sapiens
aaatcaaaagctgct

SEQ ID NO: 2836626 - DNA, 16 bp, Homo sapiens
aaatcaaaagctgctt

SEQ ID NO: 2836627 - DNA, 15 bp, Homo sapiens
aaatcacaagcaata

SEQ ID NO: 2836628 - DNA, 19 bp, Homo sapiens
aaatcacaagcaataatta

SEQ ID NO: 2836629 - DNA, 20 bp, Homo sapiens
aaatcagaagtgcaaaggtg

SEQ ID NO: 2836630 - DNA, 19 bp, Homo sapiens
aaatcagcgatgtgtcacc

SEQ ID NO: 2836631 - DNA, 14 bp, Homo sapiens
aaatcagtcttgga

SEQ ID NO: 2836632 - DNA, 17 bp, Homo sapiens
aaatcatgaatatttca

SEQ ID NO: 2836633 - DNA, 16 bp, Homo sapiens
aaatcatgtacatttc

SEQ ID NO: 2836634 - DNA, 19 bp, Homo sapiens
aaatcattaatactcttct

SEQ ID NO: 2836635 - DNA, 11 bp, Homo sapiens
aaatcctctgg

SEQ ID NO: 2836636 - DNA, 18 bp, Homo sapiens
aaatcctgttacttaaat

SEQ ID NO: 2836637 - DNA, 23 bp, Homo sapiens
aaatcggatctggggctctggga

SEQ ID NO: 2836638 - DNA, 22 bp, Homo sapiens
aaatctcagaattccttttcta

SEQ ID NO: 2836639 - DNA, 18 bp, Homo sapiens
aaatctgagcctaaatct

SEQ ID NO: 2836640 - DNA, 21 bp, Homo sapiens
aaatctgagcctaaatctaat

SEQ ID NO: 2836641 - DNA, 17 bp, Homo sapiens
aaatctggcaaagttat

SEQ ID NO: 2836642 - DNA, 17 bp, Homo sapiens
aaatcttggcacagaaa

SEQ ID NO: 2836643 - DNA, 20 bp, Homo sapiens
aaatcttggttgatgccaaa

SEQ ID NO: 2836644 - DNA, 11 bp, Homo sapiens
aaatgaaaatt

SEQ ID NO: 2836645 - DNA, 18 bp, Homo sapiens
aaatgaaagcatgtctca

SEQ ID NO: 2836646 - DNA, 15 bp, Homo sapiens
aaatgaaagcatgtg

SEQ ID NO: 2836647 - DNA, 20 bp, Homo sapiens
aaatgaaagccaaatttata

SEQ ID NO: 2836648 - DNA, 14 bp, Homo sapiens
aaatgaagaaaaag

SEQ ID NO: 2836649 - DNA, 11 bp, Homo sapiens
aaatgaagtgc

SEQ ID NO: 2836650 - DNA, 20 bp, Homo sapiens
aaatgaagtgcaaatttgat

SEQ ID NO: 2836651 - DNA, 15 bp, Homo sapiens
aaatgaatgttgtct

SEQ ID NO: 2836652 - DNA, 16 bp, Homo sapiens
aaatgaatttatctga

SEQ ID NO: 2836653 - DNA, 13 bp, Homo sapiens
aaatgacattttg

SEQ ID NO: 2836654 - DNA, 17 bp, Homo sapiens
aaatgaggtcagagcct

SEQ ID NO: 2836655 - DNA, 18 bp, Homo sapiens
aaatgataaagatgtcaa

SEQ ID NO: 2836656 - DNA, 17 bp, Homo sapiens
aaatgatgtatgatttg

SEQ ID NO: 2836657 - DNA, 14 bp, Homo sapiens
aaatgattgtagta

SEQ ID NO: 2836658 - DNA, 17 bp, Homo sapiens
aaatgcaaacacacaaa

SEQ ID NO: 2836659 - DNA, 21 bp, Homo sapiens
aaatgcaaacacacaaaggta

SEQ ID NO: 2836660 - DNA, 16 bp, Homo sapiens
aaatgcaaacactgtg

SEQ ID NO: 2836661 - DNA, 21 bp, Homo sapiens
aaatgcaaacactgtgtattt

SEQ ID NO: 2836662 - DNA, 14 bp, Homo sapiens
aaatgcaagatttt

SEQ ID NO: 2836663 - DNA, 21 bp, Homo sapiens
aaatgcagcgaaccaatattt

SEQ ID NO: 2836664 - DNA, 23 bp, Homo sapiens
aaatgcagcgaaccaatatttgt

SEQ ID NO: 2836665 - DNA, 16 bp, Homo sapiens
aaatgcatccattcct

SEQ ID NO: 2836666 - DNA, 23 bp, Homo sapiens
aaatgcatccattcctcagggac

SEQ ID NO: 2836667 - DNA, 13 bp, Homo sapiens
aaatgcatgattt

SEQ ID NO: 2836668 - DNA, 20 bp, Homo sapiens
aaatgcatgattttatacat

SEQ ID NO: 2836669 - DNA, 13 bp, Homo sapiens
aaatgcatggagg

SEQ ID NO: 2836670 - DNA, 15 bp, Homo sapiens
aaatgccaacatacc

SEQ ID NO: 2836671 - DNA, 14 bp, Homo sapiens
aaatgccctctctg

SEQ ID NO: 2836672 - DNA, 15 bp, Homo sapiens
aaatgcctaataaac

SEQ ID NO: 2836673 - DNA, 20 bp, Homo sapiens
aaatgctgttggtgagaatc

SEQ ID NO: 2836674 - DNA, 20 bp, Homo sapiens
aaatggagcttgtacatatt

SEQ ID NO: 2836675 - DNA, 16 bp, Homo sapiens
aaatggtcgcccagga

SEQ ID NO: 2836676 - DNA, 18 bp, Homo sapiens
aaatggtcgcccaggaga

SEQ ID NO: 2836677 - DNA, 19 bp, Homo sapiens
aaatggtggtttgtcatat

SEQ ID NO: 2836678 - DNA, 17 bp, Homo sapiens
aaatgtaacttttgtaa

SEQ ID NO: 2836679 - DNA, 16 bp, Homo sapiens
aaatgtaggtatgaat

SEQ ID NO: 2836680 - DNA, 17 bp, Homo sapiens
aaatgtcatcaaatatt

SEQ ID NO: 2836681 - DNA, 21 bp, Homo sapiens
aaatgtctctttaatgtcaca

SEQ ID NO: 2836682 - DNA, 15 bp, Homo sapiens
aaatgtggctcctgg

SEQ ID NO: 2836683 - DNA, 15 bp, Homo sapiens
aaatgtgtcagcatg

SEQ ID NO: 2836684 - DNA, 21 bp, Homo sapiens
aaatgttcagaaggttgctct

SEQ ID NO: 2836685 - DNA, 15 bp, Homo sapiens
aaatgttctttgggg

SEQ ID NO: 2836686 - DNA, 13 bp, Homo sapiens
aaattaacactgc

SEQ ID NO: 2836687 - DNA, 20 bp, Homo sapiens
aaattaactgggtaatgaaa

SEQ ID NO: 2836688 - DNA, 20 bp, Homo sapiens
aaattatgttacatctgttt

SEQ ID NO: 2836689 - DNA, 13 bp, Homo sapiens
aaattatttaaac

SEQ ID NO: 2836690 - DNA, 23 bp, Homo sapiens
aaattcaaaccatttaattcata

SEQ ID NO: 2836691 - DNA, 14 bp, Homo sapiens
aaattcacactgtg

SEQ ID NO: 2836692 - DNA, 19 bp, Homo sapiens
aaattccaaacttctaaat

SEQ ID NO: 2836693 - DNA, 13 bp, Homo sapiens
aaattccactgga

SEQ ID NO: 2836694 - DNA, 12 bp, Homo sapiens
aaattcctgttg

SEQ ID NO: 2836695 - DNA, 14 bp, Homo sapiens
aaattcctgttgtc

SEQ ID NO: 2836696 - DNA, 23 bp, Homo sapiens
aaattccttagcttagacctcag

SEQ ID NO: 2836697 - DNA, 15 bp, Homo sapiens
aaattctgctcagat

SEQ ID NO: 2836698 - DNA, 21 bp, Homo sapiens
aaattgaagagagatatatct

SEQ ID NO: 2836699 - DNA, 15 bp, Homo sapiens
aaattgaatgcaaac

SEQ ID NO: 2836700 - DNA, 14 bp, Homo sapiens
aaattgcacaattt

SEQ ID NO: 2836701 - DNA, 23 bp, Homo sapiens
aaattgtcgtttttttcttgtgc

SEQ ID NO: 2836702 - DNA, 19 bp, Homo sapiens
aaattgtgtttagatttta

SEQ ID NO: 2836703 - DNA, 20 bp, Homo sapiens
aaatttaatatagctatttt

SEQ ID NO: 2836704 - DNA, 14 bp, Homo sapiens
aaatttatataaaa

SEQ ID NO: 2836705 - DNA, 16 bp, Homo sapiens
aaatttatattgtaaa

SEQ ID NO: 2836706 - DNA, 15 bp, Homo sapiens
aaatttgtttaaagt

SEQ ID NO: 2836707 - DNA, 12 bp, Homo sapiens
aaattttggcca

SEQ ID NO: 2836708 - DNA, 17 bp, Homo sapiens
aacaaaacaagaaagaa

SEQ ID NO: 2836709 - DNA, 13 bp, Homo sapiens
aacaaaatcacaa

SEQ ID NO: 2836710 - DNA, 22 bp, Homo sapiens
aacaaaatcacaagcaataatt

SEQ ID NO: 2836711 - DNA, 21 bp, Homo sapiens
aacaaacctctatatgttgct

SEQ ID NO: 2836712 - DNA, 20 bp, Homo sapiens
aacaaactcgttttttacaa

SEQ ID NO: 2836713 - DNA, 17 bp, Homo sapiens
aacaaagaaaaaaatat

SEQ ID NO: 2836714 - DNA, 12 bp, Homo sapiens
aacaaagaaata

SEQ ID NO: 2836715 - DNA, 17 bp, Homo sapiens
aacaaagagttcaagaa

SEQ ID NO: 2836716 - DNA, 16 bp, Homo sapiens
aacaaaggttgagatg

SEQ ID NO: 2836717 - DNA, 16 bp, Homo sapiens
aacaaatagtctatca

SEQ ID NO: 2836718 - DNA, 20 bp, Homo sapiens
aacaaattatgttacatctg

SEQ ID NO: 2836719 - DNA, 24 bp, Homo sapiens
aacaacatgtgagcatggtcacaa

SEQ ID NO: 2836720 - DNA, 19 bp, Homo sapiens
aacaagaaattgtttcttt

SEQ ID NO: 2836721 - DNA, 17 bp, Homo sapiens
aacaagatctttcagga

SEQ ID NO: 2836722 - DNA, 21 bp, Homo sapiens
aacaagcatttcccccaggga

SEQ ID NO: 2836723 - DNA, 22 bp, Homo sapiens
aacaaggttcttctaaaattga

SEQ ID NO: 2836724 - DNA, 20 bp, Homo sapiens
aacaagtatttgttaattta

SEQ ID NO: 2836725 - DNA, 23 bp, Homo sapiens
aacaagtatttgttaatttagaa

SEQ ID NO: 2836726 - DNA, 13 bp, Homo sapiens
aacaataaagagc

SEQ ID NO: 2836727 - DNA, 19 bp, Homo sapiens
aacaatagctattgcatgt

SEQ ID NO: 2836728 - DNA, 21 bp, Homo sapiens
aacaatagctattgcatgtaa

SEQ ID NO: 2836729 - DNA, 11 bp, Homo sapiens
aacaatgaatg

SEQ ID NO: 2836730 - DNA, 12 bp, Homo sapiens
aacaatggagat

SEQ ID NO: 2836731 - DNA, 16 bp, Homo sapiens
aacaatgtcagaaact

SEQ ID NO: 2836732 - DNA, 14 bp, Homo sapiens
aacacaagccacag

SEQ ID NO: 2836733 - DNA, 16 bp, Homo sapiens
aacacaagccacagaa

SEQ ID NO: 2836734 - DNA, 18 bp, Homo sapiens
aacacaagctggaagcac

SEQ ID NO: 2836735 - DNA, 12 bp, Homo sapiens
aacacagtgctg

SEQ ID NO: 2836736 - DNA, 21 bp, Homo sapiens
aacacataactagaaacctga

SEQ ID NO: 2836737 - DNA, 23 bp, Homo sapiens
aacacattgagtttaagtctctg

SEQ ID NO: 2836738 - DNA, 18 bp, Homo sapiens
aacaccactttgtctctg

SEQ ID NO: 2836739 - DNA, 20 bp, Homo sapiens
aacaccataggtagaatgta

SEQ ID NO: 2836740 - DNA, 16 bp, Homo sapiens
aacaccctatattttg

SEQ ID NO: 2836741 - DNA, 16 bp, Homo sapiens
aacacgtgtctataat

SEQ ID NO: 2836742 - DNA, 18 bp, Homo sapiens
aacactaacatataatgt

SEQ ID NO: 2836743 - DNA, 15 bp, Homo sapiens
aacactataaaggtt

SEQ ID NO: 2836744 - DNA, 16 bp, Homo sapiens
aacactcagaagcctg

SEQ ID NO: 2836745 - DNA, 20 bp, Homo sapiens
aacactcagaagcctggggg

SEQ ID NO: 2836746 - DNA, 14 bp, Homo sapiens
aacactgcttgtgt

SEQ ID NO: 2836747 - DNA, 16 bp, Homo sapiens
aacactgggggagggg

SEQ ID NO: 2836748 - DNA, 16 bp, Homo sapiens
aacactgtcttgaaga

SEQ ID NO: 2836749 - DNA, 11 bp, Homo sapiens
aacacttccat

SEQ ID NO: 2836750 - DNA, 14 bp, Homo sapiens
aacagaagcttcca

SEQ ID NO: 2836751 - DNA, 13 bp, Homo sapiens
aacagaaggatga

SEQ ID NO: 2836752 - DNA, 21 bp, Homo sapiens
aacagacaaaaacagcctcac

SEQ ID NO: 2836753 - DNA, 23 bp, Homo sapiens
aacccaccagcctaagaagctct

SEQ ID NO: 2836754 - DNA, 12 bp, Homo sapiens
aacccagagagg

SEQ ID NO: 2836755 - DNA, 18 bp, Homo sapiens
aacccaggacctctggac

SEQ ID NO: 2836756 - DNA, 15 bp, Homo sapiens
aacccatcagaagga

SEQ ID NO: 2836757 - DNA, 17 bp, Homo sapiens
aacccatcagaaggaga

SEQ ID NO: 2836758 - DNA, 19 bp, Homo sapiens
aacccatttttgagccaag

SEQ ID NO: 2836759 - DNA, 17 bp, Homo sapiens
aaccccagggcccccac

SEQ ID NO: 2836760 - DNA, 12 bp, Homo sapiens
aaccccagttct

SEQ ID NO: 2836761 - DNA, 22 bp, Homo sapiens
aaccccagttctgctcctctcc

SEQ ID NO: 2836762 - DNA, 15 bp, Homo sapiens
aacccccagcctgct

SEQ ID NO: 2836763 - DNA, 20 bp, Homo sapiens
aacccccagtgccacagaga

SEQ ID NO: 2836764 - DNA, 21 bp, Homo sapiens
aacccctacatgaaacagaaa

SEQ ID NO: 2836765 - DNA, 15 bp, Homo sapiens
aaccctctcttccct

SEQ ID NO: 2836766 - DNA, 16 bp, Homo sapiens
aaccctctcttcccta

SEQ ID NO: 2836767 - DNA, 22 bp, Homo sapiens
aaccctgttttatactgtactt

SEQ ID NO: 2836768 - DNA, 23 bp, Homo sapiens
aaccctgttttatactgtactta

SEQ ID NO: 2836769 - DNA, 12 bp, Homo sapiens
aaccgacttttc

SEQ ID NO: 2836770 - DNA, 11 bp, Homo sapiens
aaccgtggccc

SEQ ID NO: 2836771 - DNA, 18 bp, Homo sapiens
aaccgtggcccttcctgg

SEQ ID NO: 2836772 - DNA, 18 bp, Homo sapiens
aacctaaggcaacatttc

SEQ ID NO: 2836773 - DNA, 22 bp, Homo sapiens
aacctaaggcaacatttccgaa

SEQ ID NO: 2836774 - DNA, 18 bp, Homo sapiens
aacctcaggcttccttgg

SEQ ID NO: 2836775 - DNA, 14 bp, Homo sapiens
aacctcagtaattt

SEQ ID NO: 2836776 - DNA, 18 bp, Homo sapiens
aacctcatgacagccaga

SEQ ID NO: 2836777 - DNA, 14 bp, Homo sapiens
aacctcattcccca

SEQ ID NO: 2836778 - DNA, 16 bp, Homo sapiens
aacctcatttaccata

SEQ ID NO: 2836779 - DNA, 21 bp, Homo sapiens
aacctccacagtagcatttct

SEQ ID NO: 2836780 - DNA, 14 bp, Homo sapiens
aacctctatatgtt

SEQ ID NO: 2836781 - DNA, 23 bp, Homo sapiens
aacctgacagatgtcagccgagc

SEQ ID NO: 2836782 - DNA, 18 bp, Homo sapiens
aacctgatgttaaaattc

SEQ ID NO: 2836783 - DNA, 20 bp, Homo sapiens
aacctgctctcctcttgcca

SEQ ID NO: 2836784 - DNA, 11 bp, Homo sapiens
aacctggcctt

SEQ ID NO: 2836785 - DNA, 23 bp, Homo sapiens
aacctggtcacaggactctgcct

SEQ ID NO: 2836786 - DNA, 16 bp, Homo sapiens
aacctgtccataaagt

SEQ ID NO: 2836787 - DNA, 20 bp, Homo sapiens
aacctgttcttcctaccaaa

SEQ ID NO: 2836788 - DNA, 19 bp, Homo sapiens
aaccttgtctctatgccag

SEQ ID NO: 2836789 - DNA, 11 bp, Homo sapiens
aacctttccct

SEQ ID NO: 2836790 - DNA, 16 bp, Homo sapiens
aacctttcttcaccaa

SEQ ID NO: 2836791 - DNA, 18 bp, Homo sapiens
aacctttcttcaccaaat

SEQ ID NO: 2836792 - DNA, 13 bp, Homo sapiens
aacctttgtgtaa

SEQ ID NO: 2836793 - DNA, 17 bp, Homo sapiens
aacctttgtgtaataaa

SEQ ID NO: 2836794 - DNA, 23 bp, Homo sapiens
aacgacaaagccaaactctgcca

SEQ ID NO: 2836795 - DNA, 18 bp, Homo sapiens
aacgcaaagggctgaaag

SEQ ID NO: 2836796 - DNA, 12 bp, Homo sapiens
aacgcctgagcc

SEQ ID NO: 2836797 - DNA, 19 bp, Homo sapiens
aacgcctgagcccagggag

SEQ ID NO: 2836798 - DNA, 17 bp, Homo sapiens
aacgggctgccctgcca

SEQ ID NO: 2836799 - DNA, 15 bp, Homo sapiens
aacggggtccttcaa

SEQ ID NO: 2836800 - DNA, 15 bp, Homo sapiens
aacgtcatctcaggg

SEQ ID NO: 2836801 - DNA, 15 bp, Homo sapiens
aacgttaaaagacag

SEQ ID NO: 2836802 - DNA, 15 bp, Homo sapiens
aactaataaaagcat

SEQ ID NO: 2836803 - DNA, 13 bp, Homo sapiens
aactaatcaagag

SEQ ID NO: 2836804 - DNA, 14 bp, Homo sapiens
aactaatcaagagt

SEQ ID NO: 2836805 - DNA, 17 bp, Homo sapiens
aactaatttaaaccagc

SEQ ID NO: 2836806 - DNA, 21 bp, Homo sapiens
aactaatttaaaccagcagaa

SEQ ID NO: 2836807 - DNA, 17 bp, Homo sapiens
aactactttttatactc

SEQ ID NO: 2836808 - DNA, 16 bp, Homo sapiens
aactagaaatctgcca

SEQ ID NO: 2836809 - DNA, 12 bp, Homo sapiens
aactagaagaaa

SEQ ID NO: 2836810 - DNA, 22 bp, Homo sapiens
aactagaatttattcaattcct

SEQ ID NO: 2836811 - DNA, 23 bp, Homo sapiens
aactagatcaaggagcccagaaa

SEQ ID NO: 2836812 - DNA, 12 bp, Homo sapiens
aactagatctcc

SEQ ID NO: 2836813 - DNA, 16 bp, Homo sapiens
aactagatctcctgta

SEQ ID NO: 2836814 - DNA, 11 bp, Homo sapiens
aactatcttgg

SEQ ID NO: 2836815 - DNA, 18 bp, Homo sapiens
aactatcttggtgaattt

SEQ ID NO: 2836816 - DNA, 17 bp, Homo sapiens
aactatggttcccaata

SEQ ID NO: 2836817 - DNA, 23 bp, Homo sapiens
aactatggttcccaataaaagtg

SEQ ID NO: 2836818 - DNA, 15 bp, Homo sapiens
aactcaaaatatttg

SEQ ID NO: 2836819 - DNA, 12 bp, Homo sapiens
aactcaatattt

SEQ ID NO: 2836820 - DNA, 21 bp, Homo sapiens
aactcactgctcaagaagaca

SEQ ID NO: 2836821 - DNA, 22 bp, Homo sapiens
aactcactgctcaagaagacat

SEQ ID NO: 2836822 - DNA, 14 bp, Homo sapiens
aactcatcataaaa

SEQ ID NO: 2836823 - DNA, 15 bp, Homo sapiens
aactcatcataaaat

SEQ ID NO: 2836824 - DNA, 18 bp, Homo sapiens
aactcatcataaaataaa

SEQ ID NO: 2836825 - DNA, 23 bp, Homo sapiens
aactcattagactggaacttgaa

SEQ ID NO: 2836826 - DNA, 18 bp, Homo sapiens
aactcctttagcaggtgg

SEQ ID NO: 2836827 - DNA, 21 bp, Homo sapiens
aactcctttagcaggtggtcc

SEQ ID NO: 2836828 - DNA, 17 bp, Homo sapiens
aactcgaagcccttcca

SEQ ID NO: 2836829 - DNA, 19 bp, Homo sapiens
aactcgaagcccttccagt

SEQ ID NO: 2836830 - DNA, 23 bp, Homo sapiens
aactcgaagcccttccagtggta

SEQ ID NO: 2836831 - DNA, 23 bp, Homo sapiens
aactctaccctggtaggaaagca

SEQ ID NO: 2836832 - DNA, 22 bp, Homo sapiens
aactctctccaccctatatgta

SEQ ID NO: 2836833 - DNA, 16 bp, Homo sapiens
aactctggcttccagg

SEQ ID NO: 2836834 - DNA, 20 bp, Homo sapiens
aactctggcttccaggtatc

SEQ ID NO: 2836835 - DNA, 20 bp, Homo sapiens
aactgaaaagactcagtgtt

SEQ ID NO: 2836836 - DNA, 12 bp, Homo sapiens
aactgaaaatta

SEQ ID NO: 2836837 - DNA, 13 bp, Homo sapiens
aactgaaaattat

SEQ ID NO: 2836838 - DNA, 17 bp, Homo sapiens
aagcctgggggcctggc

SEQ ID NO: 2836839 - DNA, 18 bp, Homo sapiens
aagcctgggggcctggct

SEQ ID NO: 2836840 - DNA, 20 bp, Homo sapiens
aagcctgggggcctggctgg

SEQ ID NO: 2836841 - DNA, 17 bp, Homo sapiens
aagcctgtaatcccagc

SEQ ID NO: 2836842 - DNA, 17 bp, Homo sapiens
aagcctgttcatggcag

SEQ ID NO: 2836843 - DNA, 15 bp, Homo sapiens
aagcgattcttctgc

SEQ ID NO: 2836844 - DNA, 16 bp, Homo sapiens
aagcgtgagccactgc

SEQ ID NO: 2836845 - DNA, 20 bp, Homo sapiens
aagcgtgggtggaggaagat

SEQ ID NO: 2836846 - DNA, 21 bp, Homo sapiens
aagctaaatcctttactgtta

SEQ ID NO: 2836847 - DNA, 23 bp, Homo sapiens
aagttggaaccgtgtccagcaca

SEQ ID NO: 2836848 - DNA, 18 bp, Homo sapiens
aagttgggaaaagtgtta

SEQ ID NO: 2836849 - DNA, 22 bp, Homo sapiens
aagttgtgttaacaatgcagta

SEQ ID NO: 2836850 - DNA, 18 bp, Homo sapiens
aagttgttcacatatatg

SEQ ID NO: 2836851 - DNA, 17 bp, Homo sapiens
aagtttattttttctac

SEQ ID NO: 2836852 - DNA, 19 bp, Homo sapiens
aagtttattttttctacac

SEQ ID NO: 2836853 - DNA, 20 bp, Homo sapiens
aagtttattttttctacaca

SEQ ID NO: 2836854 - DNA, 15 bp, Homo sapiens
aagtttgatcaaatc

SEQ ID NO: 2836855 - DNA, 15 bp, Homo sapiens
aagtttgatttcatt

SEQ ID NO: 2836856 - DNA, 16 bp, Homo sapiens
aagtttgatttcatta

SEQ ID NO: 2836857 - DNA, 15 bp, Homo sapiens
aagttttgcatttat

SEQ ID NO: 2836858 - DNA, 13 bp, Homo sapiens
aagtttttacaaa

SEQ ID NO: 2836859 - DNA, 19 bp, Homo sapiens
aagtttttacaaaatacta

SEQ ID NO: 2836860 - DNA, 19 bp, Homo sapiens
aataaaaaaatacagtaaa

SEQ ID NO: 2836861 - DNA, 21 bp, Homo sapiens
aataaaaaaatacagtaaagt

SEQ ID NO: 2836862 - DNA, 16 bp, Homo sapiens
aataaaacctttcaaa

SEQ ID NO: 2836863 - DNA, 21 bp, Homo sapiens
aataaaacctttcaaatttca

SEQ ID NO: 2836864 - DNA, 23 bp, Homo sapiens
aataaaacctttcaaatttcaca

SEQ ID NO: 2836865 - DNA, 21 bp, Homo sapiens
aataaaagcagcatctgctaa

SEQ ID NO: 2836866 - DNA, 18 bp, Homo sapiens
aataaaatagtattgaaa

SEQ ID NO: 2836867 - DNA, 13 bp, Homo sapiens
aataaaatgatgt

SEQ ID NO: 2836868 - DNA, 15 bp, Homo sapiens
aataaaattttcaaa

SEQ ID NO: 2836869 - DNA, 18 bp, Homo sapiens
aataaaattttcaaactt

SEQ ID NO: 2836870 - DNA, 14 bp, Homo sapiens
aataaactctctag

SEQ ID NO: 2836871 - DNA, 14 bp, Homo sapiens
aataaacttcagca

SEQ ID NO: 2836872 - DNA, 14 bp, Homo sapiens
aataaagctgctga

SEQ ID NO: 2836873 - DNA, 21 bp, Homo sapiens
aataaagctggacaagaagct

SEQ ID NO: 2836874 - DNA, 15 bp, Homo sapiens
aataaagtatatata

SEQ ID NO: 2836875 - DNA, 14 bp, Homo sapiens
aataaagtctgagt

SEQ ID NO: 2836876 - DNA, 16 bp, Homo sapiens
aataaagttagtgtgt

SEQ ID NO: 2836877 - DNA, 11 bp, Homo sapiens
aataaatataa

SEQ ID NO: 2836878 - DNA, 12 bp, Homo sapiens
aataaatataat

SEQ ID NO: 2836879 - DNA, 13 bp, Homo sapiens
aataaatataatt

SEQ ID NO: 2836880 - DNA, 14 bp, Homo sapiens
aataaatattctgc

SEQ ID NO: 2836881 - DNA, 19 bp, Homo sapiens
aataaatgcaatatgtatt

SEQ ID NO: 2836882 - DNA, 21 bp, Homo sapiens
aataaatgtatcttattcaca

SEQ ID NO: 2836883 - DNA, 14 bp, Homo sapiens
aataaatgtgtaaa

SEQ ID NO: 2836884 - DNA, 18 bp, Homo sapiens
aataaatgtgtaaatgtg

SEQ ID NO: 2836885 - DNA, 12 bp, Homo sapiens
aataaattcaaa

SEQ ID NO: 2836886 - DNA, 13 bp, Homo sapiens
aataaattcaaac

SEQ ID NO: 2836887 - DNA, 14 bp, Homo sapiens
aataaattcagata

SEQ ID NO: 2836888 - DNA, 20 bp, Homo sapiens
aataaattgctccttgacat

SEQ ID NO: 2836889 - DNA, 20 bp, Homo sapiens
aataacataatttgtacata

SEQ ID NO: 2836890 - DNA, 13 bp, Homo sapiens
aataacatttgtg

SEQ ID NO: 2836891 - DNA, 18 bp, Homo sapiens
aataactagatctcctgt

SEQ ID NO: 2836892 - DNA, 22 bp, Homo sapiens
aataactagatctcctgtaatt

SEQ ID NO: 2836893 - DNA, 17 bp, Homo sapiens
aataacttcagagaagt

SEQ ID NO: 2836894 - DNA, 14 bp, Homo sapiens
aataagagaaagaa

SEQ ID NO: 2836895 - DNA, 23 bp, Homo sapiens
aataagataatgatgagtaactt

SEQ ID NO: 2836896 - DNA, 17 bp, Homo sapiens
aataaggccttaatatg

SEQ ID NO: 2836897 - DNA, 20 bp, Homo sapiens
aataaggctccttcatgtgg

SEQ ID NO: 2836898 - DNA, 12 bp, Homo sapiens
aataagtgctgt

SEQ ID NO: 2836899 - DNA, 15 bp, Homo sapiens
aataatcacattgac

SEQ ID NO: 2836900 - DNA, 14 bp, Homo sapiens
aataatttaactaa

SEQ ID NO: 2836901 - DNA, 20 bp, Homo sapiens
aataatttaactaatttaaa

SEQ ID NO: 2836902 - DNA, 21 bp, Homo sapiens
aataatttagacttcaagcat

SEQ ID NO: 2836903 - DNA, 12 bp, Homo sapiens
aataattttaaa

SEQ ID NO: 2836904 - DNA, 20 bp, Homo sapiens
aataattttaaaagttggga

SEQ ID NO: 2836905 - DNA, 16 bp, Homo sapiens
aataattttaaacaaa

SEQ ID NO: 2836906 - DNA, 12 bp, Homo sapiens
aataattttcct

SEQ ID NO: 2836907 - DNA, 20 bp, Homo sapiens
aatacaaacatatttgttaa

SEQ ID NO: 2836908 - DNA, 21 bp, Homo sapiens
aatacaaacatatttgttaaa

SEQ ID NO: 2836909 - DNA, 15 bp, Homo sapiens
aatacacaagtaaac

SEQ ID NO: 2836910 - DNA, 20 bp, Homo sapiens
aatacaccacctcactcctg

SEQ ID NO: 2836911 - DNA, 16 bp, Homo sapiens
aatacaccacgaattt

SEQ ID NO: 2836912 - DNA, 19 bp, Homo sapiens
aatacagaaattagccggg

SEQ ID NO: 2836913 - DNA, 17 bp, Homo sapiens
aagttagagaatatatt

SEQ ID NO: 2836914 - DNA, 13 bp, Homo sapiens
aagttagctcagg

SEQ ID NO: 2836915 - DNA, 14 bp, Homo sapiens
aagttagctcagga

SEQ ID NO: 2836916 - DNA, 15 bp, Homo sapiens
aagttagctcaggag

SEQ ID NO: 2836917 - DNA, 14 bp, Homo sapiens
aagttagctgagcg

SEQ ID NO: 2836918 - DNA, 16 bp, Homo sapiens
aagttagctttaactt

SEQ ID NO: 2836919 - DNA, 17 bp, Homo sapiens
aagttaggttataagaa

SEQ ID NO: 2836920 - DNA, 20 bp, Homo sapiens
aagttagtgtgttgtctgtg

SEQ ID NO: 2836921 - DNA, 20 bp, Homo sapiens
aagttataaatcaatgtcac

SEQ ID NO: 2836922 - DNA, 16 bp, Homo sapiens
aagttatagtatatct

SEQ ID NO: 2836923 - DNA, 18 bp, Homo sapiens
aagttattgtgttgcctt

SEQ ID NO: 2836924 - DNA, 14 bp, Homo sapiens
aagttccctacttc

SEQ ID NO: 2836925 - DNA, 20 bp, Homo sapiens
aagttccctacttcctgtga

SEQ ID NO: 2836926 - DNA, 17 bp, Homo sapiens
aagttctagagaagagg

SEQ ID NO: 2836927 - DNA, 18 bp, Homo sapiens
aagttctagagaagaggc

SEQ ID NO: 2836928 - DNA, 19 bp, Homo sapiens
aagttctgaaaactgttta

SEQ ID NO: 2836929 - DNA, 14 bp, Homo sapiens
aagttgccaagagt

SEQ ID NO: 2836930 - DNA, 16 bp, Homo sapiens
aagttgccaagagttc

SEQ ID NO: 2836931 - DNA, 20 bp, Homo sapiens
acagctcaagtcttccctga

SEQ ID NO: 2836932 - DNA, 22 bp, Homo sapiens
acagctcccaccccaccccctt

SEQ ID NO: 2836933 - DNA, 18 bp, Homo sapiens
acagctccttctgtccta

SEQ ID NO: 2836934 - DNA, 23 bp, Homo sapiens
acagctccttctgtcctactctg

SEQ ID NO: 2836935 - DNA, 18 bp, Homo sapiens
acagctcggagttgtgag

SEQ ID NO: 2836936 - DNA, 13 bp, Homo sapiens
acagctctagaca

SEQ ID NO: 2836937 - DNA, 17 bp, Homo sapiens
acagctcttctaaggaa

SEQ ID NO: 2836938 - DNA, 16 bp, Homo sapiens
acagctcttctccagg

SEQ ID NO: 2836939 - DNA, 17 bp, Homo sapiens
acagctcttctccaggc

SEQ ID NO: 2836940 - DNA, 16 bp, Homo sapiens
acagctgcctgcagta

SEQ ID NO: 2836941 - DNA, 14 bp, Homo sapiens
acagctgtccctgt

SEQ ID NO: 2836942 - DNA, 18 bp, Homo sapiens
acagctgtccctgtcacc

SEQ ID NO: 2836943 - DNA, 16 bp, Homo sapiens
acagctgtgcctcgct

SEQ ID NO: 2836944 - DNA, 17 bp, Homo sapiens
acagctgtgcctcgctc

SEQ ID NO: 2836945 - DNA, 17 bp, Homo sapiens
acagcttcatttcctgt

SEQ ID NO: 2836946 - DNA, 19 bp, Homo sapiens
acagcttcatttcctgtgt

SEQ ID NO: 2836947 - DNA, 21 bp, Homo sapiens
acagcttcatttcctgtgtct

SEQ ID NO: 2836948 - DNA, 17 bp, Homo sapiens
acaggaaaagctgctga

SEQ ID NO: 2836949 - DNA, 17 bp, Homo sapiens
acaggaaaatcctctgg

SEQ ID NO: 2836950 - DNA, 21 bp, Homo sapiens
acaggaagcccaaggcagtgt

SEQ ID NO: 2836951 - DNA, 20 bp, Homo sapiens
acaggacagtgcttcagcct

SEQ ID NO: 2836952 - DNA, 20 bp, Homo sapiens
acaggactaacactcagaag

SEQ ID NO: 2836953 - DNA, 14 bp, Homo sapiens
acaggactctgcct

SEQ ID NO: 2836954 - DNA, 15 bp, Homo sapiens
acaggactctgcctc

SEQ ID NO: 2836955 - DNA, 16 bp, Homo sapiens
acaggactctgcctcc

SEQ ID NO: 2836956 - DNA, 20 bp, Homo sapiens
acacccttcacataccctcc

SEQ ID NO: 2836957 - DNA, 13 bp, Homo sapiens
acacccttttaac

SEQ ID NO: 2836958 - DNA, 17 bp, Homo sapiens
acacctatgtcatttca

SEQ ID NO: 2836959 - DNA, 15 bp, Homo sapiens
acacctcaaatacat

SEQ ID NO: 2836960 - DNA, 12 bp, Homo sapiens
acacctcccagg

SEQ ID NO: 2836961 - DNA, 13 bp, Homo sapiens
acacctcccagga

SEQ ID NO: 2836962 - DNA, 16 bp, Homo sapiens
acacctgcacctcccc

SEQ ID NO: 2836963 - DNA, 18 bp, Homo sapiens
acacctgcacctcccccc

SEQ ID NO: 2836964 - DNA, 18 bp, Homo sapiens
acacctgccctgccctgc

SEQ ID NO: 2836965 - DNA, 18 bp, Homo sapiens
acaccttagcagctcttc

SEQ ID NO: 2836966 - DNA, 17 bp, Homo sapiens
acacggaggcatctgca

SEQ ID NO: 2836967 - DNA, 18 bp, Homo sapiens
acacggaggcatctgcac

SEQ ID NO: 2836968 - DNA, 23 bp, Homo sapiens
acacgtacttaaatgaaagcatg

SEQ ID NO: 2836969 - DNA, 13 bp, Homo sapiens
acacgtatttata

SEQ ID NO: 2836970 - DNA, 21 bp, Homo sapiens
acacgtatttatatttggaaa

SEQ ID NO: 2836971 - DNA, 14 bp, Homo sapiens
acacgtgtctataa

SEQ ID NO: 2836972 - DNA, 14 bp, Homo sapiens
acactaaaaataaa

SEQ ID NO: 2836973 - DNA, 15 bp, Homo sapiens
acactaaccacgctg

SEQ ID NO: 2836974 - DNA, 16 bp, Homo sapiens
acactaaccacgctgg

SEQ ID NO: 2836975 - DNA, 19 bp, Homo sapiens
acactacaagtttataagc

SEQ ID NO: 2836976 - DNA, 13 bp, Homo sapiens
acactagcctctc

SEQ ID NO: 2836977 - DNA, 17 bp, Homo sapiens
acactatggtatttgag

SEQ ID NO: 2836978 - DNA, 19 bp, Homo sapiens
acactatggtatttgagtg

SEQ ID NO: 2836979 - DNA, 20 bp, Homo sapiens
acactcacatttattctgct

SEQ ID NO: 2836980 - DNA, 20 bp, Homo sapiens
acactcagaagcctgggggc

SEQ ID NO: 2836981 - DNA, 12 bp, Homo sapiens
acactccagcct

SEQ ID NO: 2836982 - DNA, 12 bp, Homo sapiens
acactctttgta

SEQ ID NO: 2836983 - DNA, 15 bp, Homo sapiens
acactgagcaagatc

SEQ ID NO: 2836984 - DNA, 19 bp, Homo sapiens
acactgagcaagatcttgt

SEQ ID NO: 2836985 - DNA, 18 bp, Homo sapiens
acactgcaagagccttgg

SEQ ID NO: 2836986 - DNA, 14 bp, Homo sapiens
acactgtaatctta

SEQ ID NO: 2836987 - DNA, 14 bp, Homo sapiens
acacttctcaggac

SEQ ID NO: 2836988 - DNA, 20 bp, Homo sapiens
acacttgccttcttcaccca

SEQ ID NO: 2836989 - DNA, 12 bp, Homo sapiens
acagaacactgt

SEQ ID NO: 2836990 - DNA, 21 bp, Homo sapiens
acagaactgaacgtcctgcag

SEQ ID NO: 2836991 - DNA, 14 bp, Homo sapiens
acagaagaaacaag

SEQ ID NO: 2836992 - DNA, 16 bp, Homo sapiens
acagaagaaggcagca

SEQ ID NO: 2836993 - DNA, 20 bp, Homo sapiens
acagaagaaggcagcaggtg

SEQ ID NO: 2836994 - DNA, 15 bp, Homo sapiens
acagaagccaggagc

SEQ ID NO: 2836995 - DNA, 18 bp, Homo sapiens
acagaagccaggagcaaa

SEQ ID NO: 2836996 - DNA, 13 bp, Homo sapiens
acagaagcttcca

SEQ ID NO: 2836997 - DNA, 16 bp, Homo sapiens
acagaagtcatgaagc

SEQ ID NO: 2836998 - DNA, 17 bp, Homo sapiens
acagacacaggcccggc

SEQ ID NO: 2836999 - DNA, 22 bp, Homo sapiens
acagacacaggcccggctccag

SEQ ID NO: 2837000 - DNA, 15 bp, Homo sapiens
acagaccacctgctt

SEQ ID NO: 2837001 - DNA, 15 bp, Homo sapiens
acagacgtatgctta

SEQ ID NO: 2837002 - DNA, 20 bp, Homo sapiens
acagacgtatgcttatttta

SEQ ID NO: 2837003 - DNA, 23 bp, Homo sapiens
acagactgcaagaggctcctgtc

SEQ ID NO: 2837004 - DNA, 16 bp, Homo sapiens
acagacttctccagac

SEQ ID NO: 2837005 - DNA, 17 bp, Homo sapiens
acagacttctccagacc

SEQ ID NO: 2837006 - DNA, 12 bp, Homo sapiens
acagagaatctg

SEQ ID NO: 2837007 - DNA, 18 bp, Homo sapiens
acagagaatctgaagcta

SEQ ID NO: 2837008 - DNA, 15 bp, Homo sapiens
acagagacaggccca

SEQ ID NO: 2837009 - DNA, 18 bp, Homo sapiens
acagagctgggatgtttc

SEQ ID NO: 2837010 - DNA, 16 bp, Homo sapiens
acagaggaagagcagg

SEQ ID NO: 2837011 - DNA, 15 bp, Homo sapiens
acagaggcagcccca

SEQ ID NO: 2837012 - DNA, 19 bp, Homo sapiens
acagaggcagccccattct

SEQ ID NO: 2837013 - DNA, 23 bp, Homo sapiens
acagaggcagccccattctgcct

SEQ ID NO: 2837014 - DNA, 17 bp, Homo sapiens
acagataatttattttg

SEQ ID NO: 2837015 - DNA, 22 bp, Homo sapiens
acagatactggaagttttgcat

SEQ ID NO: 2837016 - DNA, 23 bp, Homo sapiens
acagatagtcaaaccataaactt

SEQ ID NO: 2837017 - DNA, 20 bp, Homo sapiens
acagatatttccatttcttc

SEQ ID NO: 2837018 - DNA, 23 bp, Homo sapiens
acagatgggtattaaacttgtca

SEQ ID NO: 2837019 - DNA, 18 bp, Homo sapiens
acagattacttcagggct

SEQ ID NO: 2837020 - DNA, 21 bp, Homo sapiens
acagattctagccaaactatt

SEQ ID NO: 2837021 - DNA, 15 bp, Homo sapiens
acagattgtttgcaa

SEQ ID NO: 2837022 - DNA, 23 bp, Homo sapiens
acagcaacaggaatctcagagac

SEQ ID NO: 2837023 - DNA, 19 bp, Homo sapiens
acagcagactcagctctga

SEQ ID NO: 2837024 - DNA, 15 bp, Homo sapiens
acagcagaggttctt

SEQ ID NO: 2837025 - DNA, 18 bp, Homo sapiens
acagcagcccctgcacaa

SEQ ID NO: 2837026 - DNA, 17 bp, Homo sapiens
acagcagctcaggcaca

SEQ ID NO: 2837027 - DNA, 14 bp, Homo sapiens
acagcagctgaaca

SEQ ID NO: 2837028 - DNA, 19 bp, Homo sapiens
acagcagtatgaatgatgt

SEQ ID NO: 2837029 - DNA, 18 bp, Homo sapiens
acagcattcctccatctt

SEQ ID NO: 2837030 - DNA, 23 bp, Homo sapiens
acagccaaatgcatggtgcagtt

SEQ ID NO: 2837031 - DNA, 18 bp, Homo sapiens
acagccacggccaggcca

SEQ ID NO: 2837032 - DNA, 19 bp, Homo sapiens
acagccacggccaggccag

SEQ ID NO: 2837033 - DNA, 17 bp, Homo sapiens
acagccagagcctgtct

SEQ ID NO: 2837034 - DNA, 13 bp, Homo sapiens
acagccgcagcct

SEQ ID NO: 2837035 - DNA, 23 bp, Homo sapiens
acagccgcagcctccctctgacc

SEQ ID NO: 2837036 - DNA, 19 bp, Homo sapiens
acagccgtcagccaaatgt

SEQ ID NO: 2837037 - DNA, 17 bp, Homo sapiens
acagcctcacagaagaa

SEQ ID NO: 2837038 - DNA, 18 bp, Homo sapiens
acagcctcacttgaatgt

SEQ ID NO: 2837039 - DNA, 12 bp, Homo sapiens
acagcctggact

SEQ ID NO: 2837040 - DNA, 19 bp, Homo sapiens
acagcctgggaccagggca

SEQ ID NO: 2837041 - DNA, 22 bp, Homo sapiens
acagcctgtggcggtgcctggg

SEQ ID NO: 2837042 - DNA, 17 bp, Homo sapiens
acagcgaactagaagaa

SEQ ID NO: 2837043 - DNA, 15 bp, Homo sapiens
acagcgagaggcaga

SEQ ID NO: 2837044 - DNA, 16 bp, Homo sapiens
acagctaatgggacac

SEQ ID NO: 2837045 - DNA, 17 bp, Homo sapiens
acagctaatgggacact

SEQ ID NO: 2837046 - DNA, 13 bp, Homo sapiens
acatatatgtata

SEQ ID NO: 2837047 - DNA, 13 bp, Homo sapiens
acatatcagaaaa

SEQ ID NO: 2837048 - DNA, 16 bp, Homo sapiens
acatatcagaaaagta

SEQ ID NO: 2837049 - DNA, 19 bp, Homo sapiens
acatatcagaaaagtagaa

SEQ ID NO: 2837050 - DNA, 22 bp, Homo sapiens
acatatcagaaaagtagaatta

SEQ ID NO: 2837051 - DNA, 16 bp, Homo sapiens
acatatgcaccttgtg

SEQ ID NO: 2837052 - DNA, 23 bp, Homo sapiens
acatatggactctgcacatgaat

SEQ ID NO: 2837053 - DNA, 13 bp, Homo sapiens
acatatgtaaaat

SEQ ID NO: 2837054 - DNA, 14 bp, Homo sapiens
acatatgtaaaata

SEQ ID NO: 2837055 - DNA, 12 bp, Homo sapiens
acatattataaa

SEQ ID NO: 2837056 - DNA, 15 bp, Homo sapiens
acatattataaataa

SEQ ID NO: 2837057 - DNA, 13 bp, Homo sapiens
acatcacaggaca

SEQ ID NO: 2837058 - DNA, 16 bp, Homo sapiens
acatcccattgccctg

SEQ ID NO: 2837059 - DNA, 23 bp, Homo sapiens
acatccctacaaaaaattagaaa

SEQ ID NO: 2837060 - DNA, 12 bp, Homo sapiens
acatccctgggc

SEQ ID NO: 2837061 - DNA, 19 bp, Homo sapiens
acatccctgggcctgctgc

SEQ ID NO: 2837062 - DNA, 15 bp, Homo sapiens
acatctgtgtctctg

SEQ ID NO: 2837063 - DNA, 16 bp, Homo sapiens
acatcttgctctgctg

SEQ ID NO: 2837064 - DNA, 19 bp, Homo sapiens
acatcttgctctgctgaca

SEQ ID NO: 2837065 - DNA, 21 bp, Homo sapiens
acatgaagtgtgtttccttca

SEQ ID NO: 2837066 - DNA, 16 bp, Homo sapiens
acatgacgtaaaattt

SEQ ID NO: 2837067 - DNA, 14 bp, Homo sapiens
acatgagaaatgtg

SEQ ID NO: 2837068 - DNA, 15 bp, Homo sapiens
acatgagaaatgtga

SEQ ID NO: 2837069 - DNA, 16 bp, Homo sapiens
acatgagaaatgtgaa

SEQ ID NO: 2837070 - DNA, 21 bp, Homo sapiens
acatgaggacatgatggagcg

SEQ ID NO: 2837071 - DNA, 13 bp, Homo sapiens
acatgattcattt

SEQ ID NO: 2837072 - DNA, 14 bp, Homo sapiens
acatgcacatttat

SEQ ID NO: 2837073 - DNA, 18 bp, Homo sapiens
acatgcacatttatatat

SEQ ID NO: 2837074 - DNA, 16 bp, Homo sapiens
acatgcattactgcat

SEQ ID NO: 2837075 - DNA, 24 bp, Homo sapiens
acatgctaagagaagtagaaatca

SEQ ID NO: 2837076 - DNA, 17 bp, Homo sapiens
acatggagactcctgcc

SEQ ID NO: 2837077 - DNA, 22 bp, Homo sapiens
acatggagactcctgccctgtt

SEQ ID NO: 2837078 - DNA, 15 bp, Homo sapiens
acatggccagtgtga

SEQ ID NO: 2837079 - DNA, 18 bp, Homo sapiens
acatggcctatgcacata

SEQ ID NO: 2837080 - DNA, 17 bp, Homo sapiens
acatgtaacatagattt

SEQ ID NO: 2837081 - DNA, 14 bp, Homo sapiens
acatgtataatatt

SEQ ID NO: 2837082 - DNA, 21 bp, Homo sapiens
acatgtatctatgcattttct

SEQ ID NO: 2837083 - DNA, 21 bp, Homo sapiens
acatgtcctatccaaaggaat

SEQ ID NO: 2837084 - DNA, 21 bp, Homo sapiens
acatgtccttgtgtgttttga

SEQ ID NO: 2837085 - DNA, 14 bp, Homo sapiens
acatgtcttgtaca

SEQ ID NO: 2837086 - DNA, 14 bp, Homo sapiens
acatgtgacacata

SEQ ID NO: 2837087 - DNA, 15 bp, Homo sapiens
acatgtgacacatat

SEQ ID NO: 2837088 - DNA, 23 bp, Homo sapiens
acatgtgagcatggtcacaagca

SEQ ID NO: 2837089 - DNA, 18 bp, Homo sapiens
acatgtgcacatgcacgt

SEQ ID NO: 2837090 - DNA, 23 bp, Homo sapiens
acatgtggtgggacagggaccca

SEQ ID NO: 2837091 - DNA, 20 bp, Homo sapiens
acatgtgtagcctgtgcatg

SEQ ID NO: 2837092 - DNA, 18 bp, Homo sapiens
acatgtgtagggaaagtt

SEQ ID NO: 2837093 - DNA, 14 bp, Homo sapiens
acatgttatttgta

SEQ ID NO: 2837094 - DNA, 21 bp, Homo sapiens
acatgtttatttattctgcat

SEQ ID NO: 2837095 - DNA, 12 bp, Homo sapiens
acattaaaagaa

SEQ ID NO: 2837096 - DNA, 19 bp, Homo sapiens
acattaaaagaagactgga

SEQ ID NO: 2837097 - DNA, 19 bp, Homo sapiens
acattaaacactgtaatct

SEQ ID NO: 2837098 - DNA, 20 bp, Homo sapiens
acattaaacactgtaatctt

SEQ ID NO: 2837099 - DNA, 14 bp, Homo sapiens
acattaaattaaat

SEQ ID NO: 2837100 - DNA, 14 bp, Homo sapiens
acattaactcatta

SEQ ID NO: 2837101 - DNA, 15 bp, Homo sapiens
acattaactcattag

SEQ ID NO: 2837102 - DNA, 15 bp, Homo sapiens
acattacttgcacaa

SEQ ID NO: 2837103 - DNA, 19 bp, Homo sapiens
acattaggaacagagtata

SEQ ID NO: 2837104 - DNA, 15 bp, Homo sapiens
acattatagattttc

SEQ ID NO: 2837105 - DNA, 14 bp, Homo sapiens
acattatttgcatg

SEQ ID NO: 2837106 - DNA, 16 bp, Homo sapiens
acattcaggaagatga

SEQ ID NO: 2837107 - DNA, 21 bp, Homo sapiens
acattcatccagttgcaataa

SEQ ID NO: 2837108 - DNA, 16 bp, Homo sapiens
acattccctggcctgg

SEQ ID NO: 2837109 - DNA, 16 bp, Homo sapiens
acattcctgatactgg

SEQ ID NO: 2837110 - DNA, 23 bp, Homo sapiens
acattctgattcgaatgacactg

SEQ ID NO: 2837111 - DNA, 22 bp, Homo sapiens
acattgcggacagccacggcca

SEQ ID NO: 2837112 - DNA, 14 bp, Homo sapiens
acattggcagtgtg

SEQ ID NO: 2837113 - DNA, 17 bp, Homo sapiens
acattggcagtgtgtca

SEQ ID NO: 2837114 - DNA, 16 bp, Homo sapiens
acattggtaagaatga

SEQ ID NO: 2837115 - DNA, 11 bp, Homo sapiens
acattgtgcca

SEQ ID NO: 2837116 - DNA, 16 bp, Homo sapiens
acatttatctaaaaga

SEQ ID NO: 2837117 - DNA, 14 bp, Homo sapiens
acatttattctgct

SEQ ID NO: 2837118 - DNA, 16 bp, Homo sapiens
accagccccagtgccc

SEQ ID NO: 2837119 - DNA, 19 bp, Homo sapiens
accagccccagtgcccaca

SEQ ID NO: 2837120 - DNA, 13 bp, Homo sapiens
accagcccttccc

SEQ ID NO: 2837121 - DNA, 19 bp, Homo sapiens
accagccgaccggccctgc

SEQ ID NO: 2837122 - DNA, 13 bp, Homo sapiens
accagcctggcca

SEQ ID NO: 2837123 - DNA, 20 bp, Homo sapiens
accagcctggtcaacatggt

SEQ ID NO: 2837124 - DNA, 23 bp, Homo sapiens
accagcctgttggacccgctctg

SEQ ID NO: 2837125 - DNA, 18 bp, Homo sapiens
accagctgctactcataa

SEQ ID NO: 2837126 - DNA, 16 bp, Homo sapiens
accagcttctccaggc

SEQ ID NO: 2837127 - DNA, 18 bp, Homo sapiens
accaggatcgctttgtac

SEQ ID NO: 2837128 - DNA, 19 bp, Homo sapiens
accaggcaccaaaagaagt

SEQ ID NO: 2837129 - DNA, 20 bp, Homo sapiens
accaggcaccaaaagaagta

SEQ ID NO: 2837130 - DNA, 23 bp, Homo sapiens
accaggcacgaacccacctgctg

SEQ ID NO: 2837131 - DNA, 12 bp, Homo sapiens
accagtgtactg

SEQ ID NO: 2837132 - DNA, 16 bp, Homo sapiens
accagtgtagccttgc

SEQ ID NO: 2837133 - DNA, 18 bp, Homo sapiens
accccagggcccccacag

SEQ ID NO: 2837134 - DNA, 19 bp, Homo sapiens
accccagggcccccacagg

SEQ ID NO: 2837135 - DNA, 16 bp, Homo sapiens
accccagttctgctcc

SEQ ID NO: 2837136 - DNA, 23 bp, Homo sapiens
accccagttctgctcctctccag

SEQ ID NO: 2837137 - DNA, 17 bp, Homo sapiens
accccatccagttcatg

SEQ ID NO: 2837138 - DNA, 16 bp, Homo sapiens
accccatctctcttcc

SEQ ID NO: 2837139 - DNA, 11 bp, Homo sapiens
acccccagccc

SEQ ID NO: 2837140 - DNA, 13 bp, Homo sapiens
acccccagccccg

SEQ ID NO: 2837141 - DNA, 13 bp, Homo sapiens
acccccagcctgc

SEQ ID NO: 2837142 - DNA, 14 bp, Homo sapiens
acccccagcctgct

SEQ ID NO: 2837143 - DNA, 15 bp, Homo sapiens
acccccagcctgggc

SEQ ID NO: 2837144 - DNA, 17 bp, Homo sapiens
acccccagcctgggcct

SEQ ID NO: 2837145 - DNA, 16 bp, Homo sapiens
acccccagctttgcta

SEQ ID NO: 2837146 - DNA, 22 bp, Homo sapiens
aatctgtagggctggacctatg

SEQ ID NO: 2837147 - DNA, 16 bp, Homo sapiens
aatctgtttttctaac

SEQ ID NO: 2837148 - DNA, 21 bp, Homo sapiens
aatcttgttaaattgcttatt

SEQ ID NO: 2837149 - DNA, 21 bp, Homo sapiens
aatctttcagcactcagaaaa

SEQ ID NO: 2837150 - DNA, 17 bp, Homo sapiens
aatctttctttacctga

SEQ ID NO: 2837151 - DNA, 21 bp, Homo sapiens
aatctttctttacctgagacc

SEQ ID NO: 2837152 - DNA, 17 bp, Homo sapiens
aatctttgattcagaca

SEQ ID NO: 2837153 - DNA, 14 bp, Homo sapiens
aatgaaaaattctc

SEQ ID NO: 2837154 - DNA, 20 bp, Homo sapiens
aatgaaaattgtatgttaag

SEQ ID NO: 2837155 - DNA, 15 bp, Homo sapiens
aatgaaagcatgtgg

SEQ ID NO: 2837156 - DNA, 22 bp, Homo sapiens
aatgaaagcatgtggcatgttc

SEQ ID NO: 2837157 - DNA, 15 bp, Homo sapiens
aatgaaatatttgct

SEQ ID NO: 2837158 - DNA, 18 bp, Homo sapiens
aatgaaatgctctccttt

SEQ ID NO: 2837159 - DNA, 17 bp, Homo sapiens
aatgaaggaaaacctca

SEQ ID NO: 2837160 - DNA, 15 bp, Homo sapiens
aatgaataataatta

SEQ ID NO: 2837161 - DNA, 21 bp, Homo sapiens
aatgaatatctgctttaatat

SEQ ID NO: 2837162 - DNA, 23 bp, Homo sapiens
aatgaatgtttacactctttgta

SEQ ID NO: 2837163 - DNA, 21 bp, Homo sapiens
aatgaattctctctaaaaata

SEQ ID NO: 2837164 - DNA, 22 bp, Homo sapiens
aatgacagtccgtcaaaacaga

SEQ ID NO: 2837165 - DNA, 18 bp, Homo sapiens
aatgacatcttcaaagct

SEQ ID NO: 2837166 - DNA, 17 bp, Homo sapiens
aatgacatttttgataa

SEQ ID NO: 2837167 - DNA, 16 bp, Homo sapiens
aatgacccaaagacca

SEQ ID NO: 2837168 - DNA, 17 bp, Homo sapiens
aatgactaaaaatatta

SEQ ID NO: 2837169 - DNA, 16 bp, Homo sapiens
aatgactataaacatt

SEQ ID NO: 2837170 - DNA, 17 bp, Homo sapiens
aatgactataaacatta

SEQ ID NO: 2837171 - DNA, 15 bp, Homo sapiens
aatgactttttataa

SEQ ID NO: 2837172 - DNA, 14 bp, Homo sapiens
aatgagggactgga

SEQ ID NO: 2837173 - DNA, 20 bp, Homo sapiens
aatgagggactggaaccagg

SEQ ID NO: 2837174 - DNA, 21 bp, Homo sapiens
aatgagggactggaaccaggg

SEQ ID NO: 2837175 - DNA, 18 bp, Homo sapiens
aatgagggccaagaaaga

SEQ ID NO: 2837176 - DNA, 16 bp, Homo sapiens
aatgaggtcccaggca

SEQ ID NO: 2837177 - DNA, 16 bp, Homo sapiens
aatgaggtctgaaatg

SEQ ID NO: 2837178 - DNA, 15 bp, Homo sapiens
aatgatagctactgt

SEQ ID NO: 2837179 - DNA, 22 bp, Homo sapiens
aatgatctctctgaatcctaag

SEQ ID NO: 2837180 - DNA, 17 bp, Homo sapiens
aatgatcttttcaagtt

SEQ ID NO: 2837181 - DNA, 20 bp, Homo sapiens
aatgatgccaaaatattgct

SEQ ID NO: 2837182 - DNA, 17 bp, Homo sapiens
aatgatggcaattttgt

SEQ ID NO: 2837183 - DNA, 16 bp, Homo sapiens
aatgattcataacaat

SEQ ID NO: 2837184 - DNA, 19 bp, Homo sapiens
aatgattcataacaatgta

SEQ ID NO: 2837185 - DNA, 18 bp, Homo sapiens
aatgattccctcttgcta

SEQ ID NO: 2837186 - DNA, 12 bp, Homo sapiens
aatgattgttta

SEQ ID NO: 2837187 - DNA, 22 bp, Homo sapiens
aatgatttcatgctatctctgt

SEQ ID NO: 2837188 - DNA, 20 bp, Homo sapiens
aatgatttccaaagagaaaa

SEQ ID NO: 2837189 - DNA, 16 bp, Homo sapiens
aatgattttcatcaat

SEQ ID NO: 2837190 - DNA, 18 bp, Homo sapiens
aatgtatcatagaaatgt

SEQ ID NO: 2837191 - DNA, 22 bp, Homo sapiens
aatgtatcatagaaatgtaact

SEQ ID NO: 2837192 - DNA, 12 bp, Homo sapiens
aatgtatcttat

SEQ ID NO: 2837193 - DNA, 17 bp, Homo sapiens
aatgtatcttattcaca

SEQ ID NO: 2837194 - DNA, 15 bp, Homo sapiens
aatgtatcttattta

SEQ ID NO: 2837195 - DNA, 21 bp, Homo sapiens
aatgtatcttatttatatatg

SEQ ID NO: 2837196 - DNA, 22 bp, Homo sapiens
aatgtatcttatttatatatga

SEQ ID NO: 2837197 - DNA, 19 bp, Homo sapiens
aatgtcacaggcaggtcca

SEQ ID NO: 2837198 - DNA, 16 bp, Homo sapiens
aatgtcaccaccttcc

SEQ ID NO: 2837199 - DNA, 14 bp, Homo sapiens
aatgtcatcaaata

SEQ ID NO: 2837200 - DNA, 19 bp, Homo sapiens
aatgtcattaaaataaata

SEQ ID NO: 2837201 - DNA, 14 bp, Homo sapiens
aatgtcattttggt

SEQ ID NO: 2837202 - DNA, 18 bp, Homo sapiens
aatgtctttgttggaaaa

SEQ ID NO: 2837203 - DNA, 15 bp, Homo sapiens
aatgtgaccaggggt

SEQ ID NO: 2837204 - DNA, 20 bp, Homo sapiens
aatgtggatttcctatttta

SEQ ID NO: 2837205 - DNA, 22 bp, Homo sapiens
aatgtggatttcctattttaaa

SEQ ID NO: 2837206 - DNA, 21 bp, Homo sapiens
aatgtggcccctgaacaagaa

SEQ ID NO: 2837207 - DNA, 13 bp, Homo sapiens
aatgtgtaaatgt

SEQ ID NO: 2837208 - DNA, 21 bp, Homo sapiens
aatgtgtggtgctaactgtat

SEQ ID NO: 2837209 - DNA, 22 bp, Homo sapiens
aatgttatgttgtgttctaata

SEQ ID NO: 2837210 - DNA, 22 bp, Homo sapiens
aatgttgaaatatgatgttaaa

SEQ ID NO: 2837211 - DNA, 16 bp, Homo sapiens
aatgttggaattttca

SEQ ID NO: 2837212 - DNA, 16 bp, Homo sapiens
aatgttgggatttata

SEQ ID NO: 2837213 - DNA, 19 bp, Homo sapiens
aatgttgggatttatatct

SEQ ID NO: 2837214 - DNA, 15 bp, Homo sapiens
aatgtttaaaccttt

SEQ ID NO: 2837215 - DNA, 21 bp, Homo sapiens
aatgtttatgcaaggaaggaa

SEQ ID NO: 2837216 - DNA, 23 bp, Homo sapiens
aatgtttcttctaggttctaaaa

SEQ ID NO: 2837217 - DNA, 19 bp, Homo sapiens
aattaaaatatatataaat

SEQ ID NO: 2837218 - DNA, 20 bp, Homo sapiens
aattaaaatatatataaata

SEQ ID NO: 2837219 - DNA, 11 bp, Homo sapiens
aattaaatgta

SEQ ID NO: 2837220 - DNA, 12 bp, Homo sapiens
aattaaatgtag

SEQ ID NO: 2837221 - DNA, 18 bp, Homo sapiens
aattaactgggtaatgaa

SEQ ID NO: 2837222 - DNA, 17 bp, Homo sapiens
aattaagagatacattc

SEQ ID NO: 2837223 - DNA, 22 bp, Homo sapiens
aattaagttagggaatggcaca

SEQ ID NO: 2837224 - DNA, 23 bp, Homo sapiens
aattacaattgtcatttataaaa

SEQ ID NO: 2837225 - DNA, 14 bp, Homo sapiens
aattacactacaag

SEQ ID NO: 2837226 - DNA, 15 bp, Homo sapiens
aattacatccagaaa

SEQ ID NO: 2837227 - DNA, 23 bp, Homo sapiens
aattaccttagattagctctgga

SEQ ID NO: 2837228 - DNA, 14 bp, Homo sapiens
aattacttctctct

SEQ ID NO: 2837229 - DNA, 16 bp, Homo sapiens
aattacttctctctat

SEQ ID NO: 2837230 - DNA, 19 bp, Homo sapiens
aattagaacaatagctatt

SEQ ID NO: 2837231 - DNA, 14 bp, Homo sapiens
aattagccgggcgt

SEQ ID NO: 2837232 - DNA, 12 bp, Homo sapiens
aatttgtatttt

SEQ ID NO: 2837233 - DNA, 22 bp, Homo sapiens
aattttaaggtagaacctcacc

SEQ ID NO: 2837234 - DNA, 21 bp, Homo sapiens
aattttactgacagaaatgca

SEQ ID NO: 2837235 - DNA, 20 bp, Homo sapiens
aattttatagctcagtttat

SEQ ID NO: 2837236 - DNA, 16 bp, Homo sapiens
aattttatctcttatt

SEQ ID NO: 2837237 - DNA, 15 bp, Homo sapiens
aattttcaagagaag

SEQ ID NO: 2837238 - DNA, 18 bp, Homo sapiens
aattttcacttgcttaaa

SEQ ID NO: 2837239 - DNA, 17 bp, Homo sapiens
aattttcagaccccagc

SEQ ID NO: 2837240 - DNA, 13 bp, Homo sapiens
aattttcctccta

SEQ ID NO: 2837241 - DNA, 19 bp, Homo sapiens
aattttcctcctaaacaaa

SEQ ID NO: 2837242 - DNA, 22 bp, Homo sapiens
aattttcttcatgcaatgacat

SEQ ID NO: 2837243 - DNA, 18 bp, Homo sapiens
aattttgcagcagaagcc

SEQ ID NO: 2837244 - DNA, 22 bp, Homo sapiens
aattttggccaaagtgttaatc

SEQ ID NO: 2837245 - DNA, 18 bp, Homo sapiens
aattttgtttgtaatcct

SEQ ID NO: 2837246 - DNA, 13 bp, Homo sapiens
aatttttaaacaa

SEQ ID NO: 2837247 - DNA, 13 bp, Homo sapiens
aatttttaatgac

SEQ ID NO: 2837248 - DNA, 13 bp, Homo sapiens
aatttttatacat

SEQ ID NO: 2837249 - DNA, 14 bp, Homo sapiens
aatttttatacata

SEQ ID NO: 2837250 - DNA, 16 bp, Homo sapiens
aatttttatacatatc

SEQ ID NO: 2837251 - DNA, 20 bp, Homo sapiens
aatttttatacatatcagaa

SEQ ID NO: 2837252 - DNA, 21 bp, Homo sapiens
aatttttatacatatcagaaa

SEQ ID NO: 2837253 - DNA, 15 bp, Homo sapiens
aatttttatttttga

SEQ ID NO: 2837254 - DNA, 13 bp, Homo sapiens
aatttttgatact

SEQ ID NO: 2837255 - DNA, 17 bp, Homo sapiens
aatttttttattactga

SEQ ID NO: 2837256 - DNA, 22 bp, Homo sapiens
acaaaaatgaaagcatgtctca

SEQ ID NO: 2837257 - DNA, 14 bp, Homo sapiens
acaaaaccagctgc

SEQ ID NO: 2837258 - DNA, 23 bp, Homo sapiens
acaaaagcaagactgttgctcaa

SEQ ID NO: 2837259 - DNA, 19 bp, Homo sapiens
acaaaatactatgtgggac

SEQ ID NO: 2837260 - DNA, 18 bp, Homo sapiens
acaaaatatataatggtt

SEQ ID NO: 2837261 - DNA, 13 bp, Homo sapiens
acaaaatcacaag

SEQ ID NO: 2837262 - DNA, 11 bp, Homo sapiens
acaaaatgcaa

SEQ ID NO: 2837263 - DNA, 19 bp, Homo sapiens
acaaacatatttgttaaat

SEQ ID NO: 2837264 - DNA, 18 bp, Homo sapiens
acaaagagaataaagact

SEQ ID NO: 2837265 - DNA, 19 bp, Homo sapiens
acaaagagttcaagaaata

SEQ ID NO: 2837266 - DNA, 22 bp, Homo sapiens
acaaagagttcaagaaataagt

SEQ ID NO: 2837267 - DNA, 24 bp, Homo sapiens
acaaagatgtttgtcagatatgat

SEQ ID NO: 2837268 - DNA, 18 bp, Homo sapiens
acaaagcccttccatgtc

SEQ ID NO: 2837269 - DNA, 13 bp, Homo sapiens
acaaagctcaaga

SEQ ID NO: 2837270 - DNA, 18 bp, Homo sapiens
acaaagctcaagatgaca

SEQ ID NO: 2837271 - DNA, 22 bp, Homo sapiens
acaaagcttctatcccaggagg

SEQ ID NO: 2837272 - DNA, 23 bp, Homo sapiens
acaaagcttctatcccaggaggt

SEQ ID NO: 2837273 - DNA, 23 bp, Homo sapiens
acaaaggagcctgtgaacccagg

SEQ ID NO: 2837274 - DNA, 24 bp, Homo sapiens
acaaaggttgagatgtaaaaggta

SEQ ID NO: 2837275 - DNA, 21 bp, Homo sapiens
acaaaggttttcctcttctat

SEQ ID NO: 2837276 - DNA, 18 bp, Homo sapiens
acaaagttacaaattcaa

SEQ ID NO: 2837277 - DNA, 15 bp, Homo sapiens
acaaatactcttagg

SEQ ID NO: 2837278 - DNA, 17 bp, Homo sapiens
acaaatactcttaggaa

SEQ ID NO: 2837279 - DNA, 23 bp, Homo sapiens
acaaatactcttaggaagagaaa

SEQ ID NO: 2837280 - DNA, 20 bp, Homo sapiens
acaaatatatttaattgtgt

SEQ ID NO: 2837281 - DNA, 20 bp, Homo sapiens
acaaatatttatatatttga

SEQ ID NO: 2837282 - DNA, 14 bp, Homo sapiens
acaataattttcta

SEQ ID NO: 2837283 - DNA, 16 bp, Homo sapiens
acaatcacagctcctc

SEQ ID NO: 2837284 - DNA, 20 bp, Homo sapiens
acaatcatgagtcagacatt

SEQ ID NO: 2837285 - DNA, 16 bp, Homo sapiens
acaatgaaggaaaacc

SEQ ID NO: 2837286 - DNA, 21 bp, Homo sapiens
acaatgatgattaaacacctg

SEQ ID NO: 2837287 - DNA, 21 bp, Homo sapiens
acaatggctaattcccagagt

SEQ ID NO: 2837288 - DNA, 20 bp, Homo sapiens
acaatgtatgtgaaagtgta

SEQ ID NO: 2837289 - DNA, 17 bp, Homo sapiens
acaattatggaaatata

SEQ ID NO: 2837290 - DNA, 17 bp, Homo sapiens
acaattccatttccagt

SEQ ID NO: 2837291 - DNA, 17 bp, Homo sapiens
acaattgaacttaaata

SEQ ID NO: 2837292 - DNA, 20 bp, Homo sapiens
acaatttaaagcaaaggagt

SEQ ID NO: 2837293 - DNA, 16 bp, Homo sapiens
acaatttgagcaattc

SEQ ID NO: 2837294 - DNA, 22 bp, Homo sapiens
acaatttgcactgttacttttt

SEQ ID NO: 2837295 - DNA, 16 bp, Homo sapiens
acacaagccacagaag

SEQ ID NO: 2837296 - DNA, 14 bp, Homo sapiens
acacaagctggaag

SEQ ID NO: 2837297 - DNA, 22 bp, Homo sapiens
acacacacgcgtgcacacacca

SEQ ID NO: 2837298 - DNA, 19 bp, Homo sapiens
acacacagactacagccag

SEQ ID NO: 2837299 - DNA, 11 bp, Homo sapiens
acacacagctc

SEQ ID NO: 2837300 - DNA, 17 bp, Homo sapiens
acacacagctctgtcct

SEQ ID NO: 2837301 - DNA, 15 bp, Homo sapiens
acacaccagagccca

SEQ ID NO: 2837302 - DNA, 20 bp, Homo sapiens
acacaccagagcccaccttg

SEQ ID NO: 2837303 - DNA, 16 bp, Homo sapiens
acacacccctcaaaaa

SEQ ID NO: 2837304 - DNA, 16 bp, Homo sapiens
acacacgcaggaactc

SEQ ID NO: 2837305 - DNA, 16 bp, Homo sapiens
acacagagcctgcctc

SEQ ID NO: 2837306 - DNA, 19 bp, Homo sapiens
acacagagcctgcctcagc

SEQ ID NO: 2837307 - DNA, 14 bp, Homo sapiens
acacagcctggact

SEQ ID NO: 2837308 - DNA, 12 bp, Homo sapiens
acacagctctgt

SEQ ID NO: 2837309 - DNA, 20 bp, Homo sapiens
acacagctcttctccaggct

SEQ ID NO: 2837310 - DNA, 21 bp, Homo sapiens
acacagctcttctccaggctg

SEQ ID NO: 2837311 - DNA, 19 bp, Homo sapiens
acacaggcaactgaggcag

SEQ ID NO: 2837312 - DNA, 20 bp, Homo sapiens
acacaggcaactgaggcaga

SEQ ID NO: 2837313 - DNA, 23 bp, Homo sapiens
acacaggcatttcctgggtggct

SEQ ID NO: 2837314 - DNA, 18 bp, Homo sapiens
acacaggcccggctccag

SEQ ID NO: 2837315 - DNA, 23 bp, Homo sapiens
acacaggcccggctccaggctcc

SEQ ID NO: 2837316 - DNA, 24 bp, Homo sapiens
acacaggcccggctccaggctcct

SEQ ID NO: 2837317 - DNA, 22 bp, Homo sapiens
acacagtaaaaacttgtactat

SEQ ID NO: 2837318 - DNA, 18 bp, Homo sapiens
acacagtattacttctgc

SEQ ID NO: 2837319 - DNA, 19 bp, Homo sapiens
acacagtattacttctgct

SEQ ID NO: 2837320 - DNA, 13 bp, Homo sapiens
acacagtgagtcg

SEQ ID NO: 2837321 - DNA, 15 bp, Homo sapiens
acacatactagaaag

SEQ ID NO: 2837322 - DNA, 20 bp, Homo sapiens
acacatccccagccagaagt

SEQ ID NO: 2837323 - DNA, 15 bp, Homo sapiens
acacattacttgcac

SEQ ID NO: 2837324 - DNA, 17 bp, Homo sapiens
acacattacttgcacaa

SEQ ID NO: 2837325 - DNA, 18 bp, Homo sapiens
acaccaacataaaaatga

SEQ ID NO: 2837326 - DNA, 18 bp, Homo sapiens
acaccacctcactcctgt

SEQ ID NO: 2837327 - DNA, 16 bp, Homo sapiens
acaccacgaatttggt

SEQ ID NO: 2837328 - DNA, 16 bp, Homo sapiens
acaccactctggcagc

SEQ ID NO: 2837329 - DNA, 17 bp, Homo sapiens
acaccactctggcagcc

SEQ ID NO: 2837330 - DNA, 22 bp, Homo sapiens
acaccactctggcagccacact

SEQ ID NO: 2837331 - DNA, 13 bp, Homo sapiens
acaccagagccca

SEQ ID NO: 2837332 - DNA, 23 bp, Homo sapiens
acaccagccatcatgtgcctgga

SEQ ID NO: 2837333 - DNA, 18 bp, Homo sapiens
acaccccttatccaggac

SEQ ID NO: 2837334 - DNA, 16 bp, Homo sapiens
gtcaaacatgaagtgt

SEQ ID NO: 2837335 - DNA, 21 bp, Homo sapiens
gtcaaaccgcactcacccatg

SEQ ID NO: 2837336 - DNA, 17 bp, Homo sapiens
gtcaacggccctgttta

SEQ ID NO: 2837337 - DNA, 17 bp, Homo sapiens
gtcaatattaaatacag

SEQ ID NO: 2837338 - DNA, 23 bp, Homo sapiens
gtcaatattaaatacagacacta

SEQ ID NO: 2837339 - DNA, 21 bp, Homo sapiens
gtcaatttgtatatcatgaaa

SEQ ID NO: 2837340 - DNA, 16 bp, Homo sapiens
gtcacactgagctggg

SEQ ID NO: 2837341 - DNA, 19 bp, Homo sapiens
gtcacactgagctgggcac

SEQ ID NO: 2837342 - DNA, 18 bp, Homo sapiens
gtcacagggcctggggag

SEQ ID NO: 2837343 - DNA, 20 bp, Homo sapiens
gtcacataatgaatgctatt

SEQ ID NO: 2837344 - DNA, 15 bp, Homo sapiens
gtcacatcacaggac

SEQ ID NO: 2837345 - DNA, 18 bp, Homo sapiens
gtcacatgctttgtttcc

SEQ ID NO: 2837346 - DNA, 21 bp, Homo sapiens
gtcacatggcctatgcacata

SEQ ID NO: 2837347 - DNA, 23 bp, Homo sapiens
gtcacatggcctatgcacatatg

SEQ ID NO: 2837348 - DNA, 22 bp, Homo sapiens
gtcaccaatgtacccaccgggc

SEQ ID NO: 2837349 - DNA, 16 bp, Homo sapiens
gtcaccaccttcccag

SEQ ID NO: 2837350 - DNA, 15 bp, Homo sapiens
gtgccagagcctggg

SEQ ID NO: 2837351 - DNA, 16 bp, Homo sapiens
gtgccagagcctgggg

SEQ ID NO: 2837352 - DNA, 17 bp, Homo sapiens
gtgccagagcctggggc

SEQ ID NO: 2837353 - DNA, 18 bp, Homo sapiens
gtgccagagcctggggct

SEQ ID NO: 2837354 - DNA, 17 bp, Homo sapiens
gtgccaggactccccag

SEQ ID NO: 2837355 - DNA, 13 bp, Homo sapiens
gtgccaggcccgg

SEQ ID NO: 2837356 - DNA, 20 bp, Homo sapiens
gtgccaggtttttggtctga

SEQ ID NO: 2837357 - DNA, 22 bp, Homo sapiens
gtgccaggtttttggtctgacc

SEQ ID NO: 2837358 - DNA, 14 bp, Homo sapiens
gtgccatgtgccag

SEQ ID NO: 2837359 - DNA, 16 bp, Homo sapiens
gtgccatgtgccaggt

SEQ ID NO: 2837360 - DNA, 20 bp, Homo sapiens
gtgcccacatcccaggcttc

SEQ ID NO: 2837361 - DNA, 23 bp, Homo sapiens
gtgcccaccaacatcccattgcc

SEQ ID NO: 2837362 - DNA, 12 bp, Homo sapiens
gtgcccaggaga

SEQ ID NO: 2837363 - DNA, 20 bp, Homo sapiens
gtgccccccttgccagacat

SEQ ID NO: 2837364 - DNA, 16 bp, Homo sapiens
gtgccccgcctccccg

SEQ ID NO: 2837365 - DNA, 17 bp, Homo sapiens
gtgccccgcctccccga

SEQ ID NO: 2837366 - DNA, 21 bp, Homo sapiens
gtgccctctgctccccagtgc

SEQ ID NO: 2837367 - DNA, 18 bp, Homo sapiens
gtgcccttaaaataatga

SEQ ID NO: 2837368 - DNA, 18 bp, Homo sapiens
gtgccgttactctccaac

SEQ ID NO: 2837369 - DNA, 15 bp, Homo sapiens
gtgcctcgctcccca

SEQ ID NO: 2837370 - DNA, 19 bp, Homo sapiens
gtgcctcgctccccactct

SEQ ID NO: 2837371 - DNA, 15 bp, Homo sapiens
gtgcctggcctggca

SEQ ID NO: 2837372 - DNA, 16 bp, Homo sapiens
gtgcctgtgaggcagg

SEQ ID NO: 2837373 - DNA, 14 bp, Homo sapiens
gtgccttacctcct

SEQ ID NO: 2837374 - DNA, 20 bp, Homo sapiens
gtgccttacctcctgcccag

SEQ ID NO: 2837375 - DNA, 11 bp, Homo sapiens
gtgccttcatt

SEQ ID NO: 2837376 - DNA, 12 bp, Homo sapiens
gtgccttcattt

SEQ ID NO: 2837377 - DNA, 17 bp, Homo sapiens
gtgccttccataattat

SEQ ID NO: 2837378 - DNA, 14 bp, Homo sapiens
gtgccttggagcag

SEQ ID NO: 2837379 - DNA, 21 bp, Homo sapiens
gtgcgatctgggttcactgca

SEQ ID NO: 2837380 - DNA, 13 bp, Homo sapiens
gtgctaaattttc

SEQ ID NO: 2837381 - DNA, 20 bp, Homo sapiens
gtgctaagaaagcaagccaa

SEQ ID NO: 2837382 - DNA, 18 bp, Homo sapiens
gtgctataggctggagaa

SEQ ID NO: 2837383 - DNA, 21 bp, Homo sapiens
gtgctataggctggagaagct

SEQ ID NO: 2837384 - DNA, 14 bp, Homo sapiens
gtgctcctccttgg

SEQ ID NO: 2837385 - DNA, 16 bp, Homo sapiens
gtgctctgatcatcca

SEQ ID NO: 2837386 - DNA, 13 bp, Homo sapiens
gtgctctggacag

SEQ ID NO: 2837387 - DNA, 15 bp, Homo sapiens
gtgctctggacaggc

SEQ ID NO: 2837388 - DNA, 21 bp, Homo sapiens
gtgctgactaactataagcat

SEQ ID NO: 2837389 - DNA, 20 bp, Homo sapiens
gtgctgatcgtgctaaattt

SEQ ID NO: 2837390 - DNA, 16 bp, Homo sapiens
gtgctgcaggcaaagt

SEQ ID NO: 2837391 - DNA, 12 bp, Homo sapiens
gtgctggaggat

SEQ ID NO: 2837392 - DNA, 21 bp, Homo sapiens
gtgctgggattacaagcgtga

SEQ ID NO: 2837393 - DNA, 19 bp, Homo sapiens
gtgctgtggcctgggcaag

SEQ ID NO: 2837394 - DNA, 17 bp, Homo sapiens
gtgctgttctggagctg

SEQ ID NO: 2837395 - DNA, 13 bp, Homo sapiens
gtgctgtttgaga

SEQ ID NO: 2837396 - DNA, 18 bp, Homo sapiens
gtgcttacagtgactgtc

SEQ ID NO: 2837397 - DNA, 13 bp, Homo sapiens
gtgcttcagcctg

SEQ ID NO: 2837398 - DNA, 21 bp, Homo sapiens
gtgcttgccaccaccagatga

SEQ ID NO: 2837399 - DNA, 21 bp, Homo sapiens
gtgcttgggtggtgggtgctg

SEQ ID NO: 2837400 - DNA, 15 bp, Homo sapiens
gtgcttttaaatgca

SEQ ID NO: 2837401 - DNA, 17 bp, Homo sapiens
gtggaaaaaagagaaaa

SEQ ID NO: 2837402 - DNA, 19 bp, Homo sapiens
gtggaaaaaagagaaaaac

SEQ ID NO: 2837403 - DNA, 20 bp, Homo sapiens
gtggaaaagaatccctgcag

SEQ ID NO: 2837404 - DNA, 15 bp, Homo sapiens
gtggaaagcctctgc

SEQ ID NO: 2837405 - DNA, 14 bp, Homo sapiens
gtggaagccctcct

SEQ ID NO: 2837406 - DNA, 13 bp, Homo sapiens
gtggaatataaag

SEQ ID NO: 2837407 - DNA, 18 bp, Homo sapiens
gtggacacagctcttctc

SEQ ID NO: 2837408 - DNA, 22 bp, Homo sapiens
gtggacacagctcttctccagg

SEQ ID NO: 2837409 - DNA, 15 bp, Homo sapiens
gtggacaccaggagt

SEQ ID NO: 2837410 - DNA, 11 bp, Homo sapiens
gtggacacctg

SEQ ID NO: 2837411 - DNA, 19 bp, Homo sapiens
gtggacacctgccctgccc

SEQ ID NO: 2837412 - DNA, 12 bp, Homo sapiens
gtggacaggact

SEQ ID NO: 2837413 - DNA, 15 bp, Homo sapiens
gtggacagtcctggg

SEQ ID NO: 2837414 - DNA, 16 bp, Homo sapiens
gtggacatcatgaagc

SEQ ID NO: 2837415 - DNA, 14 bp, Homo sapiens
gtggacctgaagga

SEQ ID NO: 2837416 - DNA, 14 bp, Homo sapiens
gtggaccttcctgc

SEQ ID NO: 2837417 - DNA, 15 bp, Homo sapiens
gtggaccttcctgcc

SEQ ID NO: 2837418 - DNA, 14 bp, Homo sapiens
gtggactctgcaca

SEQ ID NO: 2837419 - DNA, 14 bp, Homo sapiens
gtggagagtgagaa

SEQ ID NO: 2837420 - DNA, 21 bp, Homo sapiens
gtggaggagctgggcttctgt

SEQ ID NO: 2837421 - DNA, 12 bp, Homo sapiens
gtggaggctgct

SEQ ID NO: 2837422 - DNA, 22 bp, Homo sapiens
gtggaggggaatcggttcatca

SEQ ID NO: 2837423 - DNA, 19 bp, Homo sapiens
gtggaggttgcagtgagct

SEQ ID NO: 2837424 - DNA, 21 bp, Homo sapiens
gtggatcaccagaggtcagga

SEQ ID NO: 2837425 - DNA, 13 bp, Homo sapiens
gtggatcacctga

SEQ ID NO: 2837426 - DNA, 15 bp, Homo sapiens
gtggatcacctgagg

SEQ ID NO: 2837427 - DNA, 17 bp, Homo sapiens
gtggatccactgtgcag

SEQ ID NO: 2837428 - DNA, 17 bp, Homo sapiens
ggtgaccccagggcaca

SEQ ID NO: 2837429 - DNA, 20 bp, Homo sapiens
ggtgacccggcaccccctgc

SEQ ID NO: 2837430 - DNA, 23 bp, Homo sapiens
ggtgactgcgatcttcagagcag

SEQ ID NO: 2837431 - DNA, 15 bp, Homo sapiens
ggtgagaaatttaaa

SEQ ID NO: 2837432 - DNA, 17 bp, Homo sapiens
ggtgagcacatctggga

SEQ ID NO: 2837433 - DNA, 13 bp, Homo sapiens
ggtgagggatgtg

SEQ ID NO: 2837434 - DNA, 12 bp, Homo sapiens
ggtgataagtgg

SEQ ID NO: 2837435 - DNA, 18 bp, Homo sapiens
ggtgataagtggaaaaaa

SEQ ID NO: 2837436 - DNA, 23 bp, Homo sapiens
ggtgatccacccacctcagcctc

SEQ ID NO: 2837437 - DNA, 18 bp, Homo sapiens
ggtgcaaagttccctact

SEQ ID NO: 2837438 - DNA, 15 bp, Homo sapiens
ggtgcacaggagggg

SEQ ID NO: 2837439 - DNA, 12 bp, Homo sapiens
ggtgcccaggag

SEQ ID NO: 2837440 - DNA, 14 bp, Homo sapiens
ggtgcccaggagaa

SEQ ID NO: 2837441 - DNA, 21 bp, Homo sapiens
ggtgcgagagaggtgggcagc

SEQ ID NO: 2837442 - DNA, 20 bp, Homo sapiens
ggtgctaaatggtcgcccag

SEQ ID NO: 2837443 - DNA, 22 bp, Homo sapiens
ggtgctaaatggtcgcccagga

SEQ ID NO: 2837444 - DNA, 12 bp, Homo sapiens
ggtgctgatgag

SEQ ID NO: 2837445 - DNA, 21 bp, Homo sapiens
ggtgctgccatccaggttcag

SEQ ID NO: 2837446 - DNA, 15 bp, Homo sapiens
ggcccgtcatgttcc

SEQ ID NO: 2837447 - DNA, 19 bp, Homo sapiens
ggccctgagctcggtggac

SEQ ID NO: 2837448 - DNA, 10 bp, Homo sapiens
ggccctgcct

SEQ ID NO: 2837449 - DNA, 14 bp, Homo sapiens
ggccctgccttctt

SEQ ID NO: 2837450 - DNA, 17 bp, Homo sapiens
ggccctggcctgctggg

SEQ ID NO: 2837451 - DNA, 15 bp, Homo sapiens
ggccctggggcctgt

SEQ ID NO: 2837452 - DNA, 18 bp, Homo sapiens
ggccctggggcctgtact

SEQ ID NO: 2837453 - DNA, 17 bp, Homo sapiens
ggccctggtccttccag

SEQ ID NO: 2837454 - DNA, 17 bp, Homo sapiens
ggcccttagctctcccg

SEQ ID NO: 2837455 - DNA, 16 bp, Homo sapiens
ggcccttcctggacag

SEQ ID NO: 2837456 - DNA, 19 bp, Homo sapiens
ggcccttcctggacagctg

SEQ ID NO: 2837457 - DNA, 18 bp, Homo sapiens
ggccgaagctaacaggga

SEQ ID NO: 2837458 - DNA, 15 bp, Homo sapiens
ggccgcctccaggag

SEQ ID NO: 2837459 - DNA, 18 bp, Homo sapiens
ggccgctgccccagcccc

SEQ ID NO: 2837460 - DNA, 21 bp, Homo sapiens
ggccggggaactggccaagct

SEQ ID NO: 2837461 - DNA, 17 bp, Homo sapiens
ggcctaaaagtaaacat

SEQ ID NO: 2837462 - DNA, 21 bp, Homo sapiens
ggcctatgcacatatggactc

SEQ ID NO: 2837463 - DNA, 17 bp, Homo sapiens
ggcctatggagagccct

SEQ ID NO: 2837464 - DNA, 21 bp, Homo sapiens
ggcctatggagagccctggga

SEQ ID NO: 2837465 - DNA, 14 bp, Homo sapiens
ggcctcaagtgatt

SEQ ID NO: 2837466 - DNA, 23 bp, Homo sapiens
ggcctcaagtgattctcctgcct

SEQ ID NO: 2837467 - DNA, 18 bp, Homo sapiens
ggcctccccccagcccct

SEQ ID NO: 2837468 - DNA, 18 bp, Homo sapiens
gggagggctctgaggcgc

SEQ ID NO: 2837469 - DNA, 19 bp, Homo sapiens
gggagggctctgaggcgcc

SEQ ID NO: 2837470 - DNA, 20 bp, Homo sapiens
gggagggctctgaggcgccc

SEQ ID NO: 2837471 - DNA, 14 bp, Homo sapiens
gggagggctgcctg

SEQ ID NO: 2837472 - DNA, 14 bp, Homo sapiens
gggaggtcattttg

SEQ ID NO: 2837473 - DNA, 15 bp, Homo sapiens
gggaggtcgaggtag

SEQ ID NO: 2837474 - DNA, 18 bp, Homo sapiens
gggagtgacagaggcagc

SEQ ID NO: 2837475 - DNA, 11 bp, Homo sapiens
gggagtgagct

SEQ ID NO: 2837476 - DNA, 20 bp, Homo sapiens
gggagttcgagaccaacctg

SEQ ID NO: 2837477 - DNA, 13 bp, Homo sapiens
gggatcacaaggt

SEQ ID NO: 2837478 - DNA, 18 bp, Homo sapiens
gggatcttgcattcccag

SEQ ID NO: 2837479 - DNA, 19 bp, Homo sapiens
gggatgactaaaatattta

SEQ ID NO: 2837480 - DNA, 15 bp, Homo sapiens
gggatggtcctgggg

SEQ ID NO: 2837481 - DNA, 16 bp, Homo sapiens
gggatggtcctggggc

SEQ ID NO: 2837482 - DNA, 15 bp, Homo sapiens
gggattcccaccaag

SEQ ID NO: 2837483 - DNA, 22 bp, Homo sapiens
gggatttttttgttttctgatg

SEQ ID NO: 2837484 - DNA, 18 bp, Homo sapiens
gggcaacccccagcctgc

SEQ ID NO: 2837485 - DNA, 13 bp, Homo sapiens
gggcaagggccat

SEQ ID NO: 2837486 - DNA, 24 bp, Homo sapiens
gggcaagtccctgactctctgtga

SEQ ID NO: 2837487 - DNA, 23 bp, Homo sapiens
gggcacaccgggcactcagaaga

SEQ ID NO: 2837488 - DNA, 14 bp, Homo sapiens
gggcacccccagcc

SEQ ID NO: 2837489 - DNA, 16 bp, Homo sapiens
gggcacccccagcctg

SEQ ID NO: 2837490 - DNA, 17 bp, Homo sapiens
gggcacccccagcctgg

SEQ ID NO: 2837491 - DNA, 21 bp, Homo sapiens
gggcacccccagcctgggcct

SEQ ID NO: 2837492 - DNA, 19 bp, Homo sapiens
gggcacctatagtcccagc

SEQ ID NO: 2837493 - DNA, 16 bp, Homo sapiens
gggcactcagaagaca

SEQ ID NO: 2837494 - DNA, 17 bp, Homo sapiens
gggcagagccgggaagc

SEQ ID NO: 2837495 - DNA, 14 bp, Homo sapiens
gggcagagggcaga

SEQ ID NO: 2837496 - DNA, 13 bp, Homo sapiens
gggcagcagccag

SEQ ID NO: 2837497 - DNA, 22 bp, Homo sapiens
gggcagcagccagccctgcctg

SEQ ID NO: 2837498 - DNA, 23 bp, Homo sapiens
gggcagcagccagccctgcctgg

SEQ ID NO: 2837499 - DNA, 17 bp, Homo sapiens
gggcagccaaacccatg

SEQ ID NO: 2837500 - DNA, 13 bp, Homo sapiens
gggcagcccagcc

SEQ ID NO: 2837501 - DNA, 14 bp, Homo sapiens
gggcaggagtagct

SEQ ID NO: 2837502 - DNA, 21 bp, Homo sapiens
gggcagtgggacccatagatc

SEQ ID NO: 2837503 - DNA, 20 bp, Homo sapiens
gggcagttcgcagccaccct

SEQ ID NO: 2837504 - DNA, 22 bp, Homo sapiens
gggcagttcgcagccaccctga

SEQ ID NO: 2837505 - DNA, 23 bp, Homo sapiens
gggcagttcgcagccaccctgag

SEQ ID NO: 2837506 - DNA, 13 bp, Homo sapiens
gggccaagaaaga

SEQ ID NO: 2837507 - DNA, 16 bp, Homo sapiens
gggccacagagaaagt

SEQ ID NO: 2837508 - DNA, 23 bp, Homo sapiens
gggccacagagaaagtacttctc

SEQ ID NO: 2837509 - DNA, 17 bp, Homo sapiens
gggccaggacaggcccg

SEQ ID NO: 2837510 - DNA, 13 bp, Homo sapiens
gggccagggccct

SEQ ID NO: 2837511 - DNA, 15 bp, Homo sapiens
gggccatgctgaagg

SEQ ID NO: 2837512 - DNA, 12 bp, Homo sapiens
gggcccccacag

SEQ ID NO: 2837513 - DNA, 12 bp, Homo sapiens
gggccctggggc

SEQ ID NO: 2837514 - DNA, 17 bp, Homo sapiens
gggccctggggcctgta

SEQ ID NO: 2837515 - DNA, 19 bp, Homo sapiens
gggccggggaactggccaa

SEQ ID NO: 2837516 - DNA, 13 bp, Homo sapiens
gggccgtgcccag

SEQ ID NO: 2837517 - DNA, 18 bp, Homo sapiens
gggcctatggagagccct

SEQ ID NO: 2837518 - DNA, 19 bp, Homo sapiens
gggcctatggagagccctg

SEQ ID NO: 2837519 - DNA, 19 bp, Homo sapiens
gggcctccccccagcccct

SEQ ID NO: 2837520 - DNA, 21 bp, Homo sapiens
gggcctcctctgtccagggcc

SEQ ID NO: 2837521 - DNA, 13 bp, Homo sapiens
gggcctcctgtgt

SEQ ID NO: 2837522 - DNA, 20 bp, Homo sapiens
gggcctgctgctgagaacct

SEQ ID NO: 2837523 - DNA, 22 bp, Homo sapiens
gggcctgctgctgagaacctgg

SEQ ID NO: 2837524 - DNA, 15 bp, Homo sapiens
gggcctggctggctg

SEQ ID NO: 2837525 - DNA, 20 bp, Homo sapiens
gggcctggctggctgagggc

SEQ ID NO: 2837526 - DNA, 22 bp, Homo sapiens
gggcctggctggctgagggcag

SEQ ID NO: 2837527 - DNA, 23 bp, Homo sapiens
gggcctggctggctgagggcagt

SEQ ID NO: 2837528 - DNA, 18 bp, Homo sapiens
gggcctgtactgcctgct

SEQ ID NO: 2837529 - DNA, 20 bp, Homo sapiens
gggcctgtactgcctgcttg

SEQ ID NO: 2837530 - DNA, 16 bp, Homo sapiens
gggccttttgtggatt

SEQ ID NO: 2837531 - DNA, 22 bp, Homo sapiens
gggcgcctgtagtcccagccac

SEQ ID NO: 2837532 - DNA, 22 bp, Homo sapiens
gggcgctctgccctccctggcc

SEQ ID NO: 2837533 - DNA, 22 bp, Homo sapiens
gggcggcctatgacttgggcac

SEQ ID NO: 2837534 - DNA, 15 bp, Homo sapiens
gggcgggagtggggg

SEQ ID NO: 2837535 - DNA, 13 bp, Homo sapiens
ggagtgggggctg

SEQ ID NO: 2837536 - DNA, 20 bp, Homo sapiens
ggagttcgagaccagcctgg

SEQ ID NO: 2837537 - DNA, 15 bp, Homo sapiens
ggagttcgaggctgc

SEQ ID NO: 2837538 - DNA, 20 bp, Homo sapiens
ggagttcgaggctgcagtca

SEQ ID NO: 2837539 - DNA, 21 bp, Homo sapiens
ggagttcgaggctgcagtcag

SEQ ID NO: 2837540 - DNA, 14 bp, Homo sapiens
ggataaaatgaggt

SEQ ID NO: 2837541 - DNA, 18 bp, Homo sapiens
ggataacaaaatcacaag

SEQ ID NO: 2837542 - DNA, 21 bp, Homo sapiens
ggataacaaaatcacaagcaa

SEQ ID NO: 2837543 - DNA, 20 bp, Homo sapiens
ggataatgctgttgcctcat

SEQ ID NO: 2837544 - DNA, 19 bp, Homo sapiens
ggatcactggagcccagga

SEQ ID NO: 2837545 - DNA, 13 bp, Homo sapiens
ggatcagcgtggc

SEQ ID NO: 2837546 - DNA, 23 bp, Homo sapiens
ggatcctattctcaccaggaagg

SEQ ID NO: 2837547 - DNA, 19 bp, Homo sapiens
ggatctatgcaatttttaa

SEQ ID NO: 2837548 - DNA, 23 bp, Homo sapiens
ggatctatgcaatttttaaacta

SEQ ID NO: 2837549 - DNA, 20 bp, Homo sapiens
ggatctgtaaggaactggaa

SEQ ID NO: 2837550 - DNA, 15 bp, Homo sapiens
ggatctgtccaagga

SEQ ID NO: 2837551 - DNA, 16 bp, Homo sapiens
ggatctgtccaaggaa

SEQ ID NO: 2837552 - DNA, 17 bp, Homo sapiens
ggatcttgcattcccag

SEQ ID NO: 2837553 - DNA, 22 bp, Homo sapiens
ggatcttgcattcccagtggtc

SEQ ID NO: 2837554 - DNA, 22 bp, Homo sapiens
ggatgaatgaggtcccaggcag

SEQ ID NO: 2837555 - DNA, 16 bp, Homo sapiens
ggatgacatgtcccta

SEQ ID NO: 2837556 - DNA, 14 bp, Homo sapiens
ggatgaccagaaca

SEQ ID NO: 2837557 - DNA, 18 bp, Homo sapiens
ggatgactagaggcaggg

SEQ ID NO: 2837558 - DNA, 22 bp, Homo sapiens
ggatgagaaaggttgaagcacc

SEQ ID NO: 2837559 - DNA, 20 bp, Homo sapiens
ggatgcctggtggcagctgc

SEQ ID NO: 2837560 - DNA, 21 bp, Homo sapiens
ggatgcctggtggcagctgcg

SEQ ID NO: 2837561 - DNA, 22 bp, Homo sapiens
ggatggtcctggggctctgtgc

SEQ ID NO: 2837562 - DNA, 16 bp, Homo sapiens
ggatgtgcccacaggg

SEQ ID NO: 2837563 - DNA, 22 bp, Homo sapiens
ggatgtggggtccccatcatcc

SEQ ID NO: 2837564 - DNA, 23 bp, Homo sapiens
ggatgtttctgtcacatcagctc

SEQ ID NO: 2837565 - DNA, 23 bp, Homo sapiens
ggattacaagcgtgagccactgc

SEQ ID NO: 2837566 - DNA, 21 bp, Homo sapiens
ggattcaggaaaaggcctggg

SEQ ID NO: 2837567 - DNA, 13 bp, Homo sapiens
ggattctgggagg

SEQ ID NO: 2837568 - DNA, 13 bp, Homo sapiens
ggattgaggctta

SEQ ID NO: 2837569 - DNA, 20 bp, Homo sapiens
ggattgatcggagcctcctc

SEQ ID NO: 2837570 - DNA, 17 bp, Homo sapiens
ggattgcttgagcccag

SEQ ID NO: 2837571 - DNA, 12 bp, Homo sapiens
ggattggggaag

SEQ ID NO: 2837572 - DNA, 19 bp, Homo sapiens
ggattggggaagactgtgg

SEQ ID NO: 2837573 - DNA, 14 bp, Homo sapiens
ggatttatttaaaa

SEQ ID NO: 2837574 - DNA, 19 bp, Homo sapiens
ggatttcctattttaaaac

SEQ ID NO: 2837575 - DNA, 23 bp, Homo sapiens
ggatttcctattttaaaaccatg

SEQ ID NO: 2837576 - DNA, 14 bp, Homo sapiens
ggatttgccccttc

SEQ ID NO: 2837577 - DNA, 22 bp, Homo sapiens
ggattttaacaaaagcaagact

SEQ ID NO: 2837578 - DNA, 17 bp, Homo sapiens
ggattttgtgttttttc

SEQ ID NO: 2837579 - DNA, 20 bp, Homo sapiens
ggcaacagagcaagactccg

SEQ ID NO: 2837580 - DNA, 17 bp, Homo sapiens
ggcaaccccagttctgc

SEQ ID NO: 2837581 - DNA, 23 bp, Homo sapiens
ggcaaccccagttctgctcctct

SEQ ID NO: 2837582 - DNA, 16 bp, Homo sapiens
ggcaacccccagcctg

SEQ ID NO: 2837583 - DNA, 17 bp, Homo sapiens
ggcaacccccagcctgc

SEQ ID NO: 2837584 - DNA, 18 bp, Homo sapiens
ggcaacccccagcctgct

SEQ ID NO: 2837585 - DNA, 19 bp, Homo sapiens
ggcaaccttgtctctatgc

SEQ ID NO: 2837586 - DNA, 14 bp, Homo sapiens
ggcaagagtgagac

SEQ ID NO: 2837587 - DNA, 21 bp, Homo sapiens
ggcaagggccatgctgaaggg

SEQ ID NO: 2837588 - DNA, 15 bp, Homo sapiens
ggcaatcaatgttca

SEQ ID NO: 2837589 - DNA, 14 bp, Homo sapiens
ggcaatgctggctg

SEQ ID NO: 2837590 - DNA, 18 bp, Homo sapiens
ggcacaccgggcactcag

SEQ ID NO: 2837591 - DNA, 13 bp, Homo sapiens
ggcacaggagcta

SEQ ID NO: 2837592 - DNA, 16 bp, Homo sapiens
ggcacaggagctacct

SEQ ID NO: 2837593 - DNA, 17 bp, Homo sapiens
ggcacaggagctacctg

SEQ ID NO: 2837594 - DNA, 20 bp, Homo sapiens
ggcacaggagctacctgtgt

SEQ ID NO: 2837595 - DNA, 22 bp, Homo sapiens
ggcaccactgcactccagcctg

SEQ ID NO: 2837596 - DNA, 23 bp, Homo sapiens
ggcacccaccatcatgtctggct

SEQ ID NO: 2837597 - DNA, 18 bp, Homo sapiens
ggcacccccagcctgggc

SEQ ID NO: 2837598 - DNA, 13 bp, Homo sapiens
ggcaccccctgca

SEQ ID NO: 2837599 - DNA, 14 bp, Homo sapiens
ggcaccccctggag

SEQ ID NO: 2837600 - DNA, 15 bp, Homo sapiens
ggcaccccctggaga

SEQ ID NO: 2837601 - DNA, 15 bp, Homo sapiens
ggcacccggcccctg

SEQ ID NO: 2837602 - DNA, 19 bp, Homo sapiens
ggcacccggcccctgctgg

SEQ ID NO: 2837603 - DNA, 17 bp, Homo sapiens
ggcacccttctttcctc

SEQ ID NO: 2837604 - DNA, 18 bp, Homo sapiens
ggcacctatagtcccagc

SEQ ID NO: 2837605 - DNA, 23 bp, Homo sapiens
ggcacctcctacgtcaaacatga

SEQ ID NO: 2837606 - DNA, 19 bp, Homo sapiens
ggcacctgggccctggggc

SEQ ID NO: 2837607 - DNA, 23 bp, Homo sapiens
ggcacctgggccctggggcctgt

SEQ ID NO: 2837608 - DNA, 19 bp, Homo sapiens
ggcacgaacccacctgctg

SEQ ID NO: 2837609 - DNA, 20 bp, Homo sapiens
ggcacgaacccacctgctga

SEQ ID NO: 2837610 - DNA, 14 bp, Homo sapiens
ggcacgcctgccca

SEQ ID NO: 2837611 - DNA, 19 bp, Homo sapiens
ggcacgcctgcccagcctc

SEQ ID NO: 2837612 - DNA, 15 bp, Homo sapiens
ggcacgtcccatgtg

SEQ ID NO: 2837613 - DNA, 21 bp, Homo sapiens
ggcacgtcccatgtgcatgga

SEQ ID NO: 2837614 - DNA, 15 bp, Homo sapiens
ggcactcacatgccg

SEQ ID NO: 2837615 - DNA, 19 bp, Homo sapiens
ggcactcagaagacactga

SEQ ID NO: 2837616 - DNA, 16 bp, Homo sapiens
ggcagaaagtggccat

SEQ ID NO: 2837617 - DNA, 16 bp, Homo sapiens
ggcagacagcagctca

SEQ ID NO: 2837618 - DNA, 17 bp, Homo sapiens
ggcagagaaggcttcct

SEQ ID NO: 2837619 - DNA, 16 bp, Homo sapiens
ggcagagccgggaagc

SEQ ID NO: 2837620 - DNA, 13 bp, Homo sapiens
ggcagaggctgga

SEQ ID NO: 2837621 - DNA, 21 bp, Homo sapiens
ggcagaggctggaggcagggc

SEQ ID NO: 2837622 - DNA, 18 bp, Homo sapiens
ggcagataatcagcctct

SEQ ID NO: 2837623 - DNA, 13 bp, Homo sapiens
ggcagcaaggccc

SEQ ID NO: 2837624 - DNA, 17 bp, Homo sapiens
ggcagcaaggcccgagc

SEQ ID NO: 2837625 - DNA, 14 bp, Homo sapiens
ggcagcactcagtg

SEQ ID NO: 2837626 - DNA, 13 bp, Homo sapiens
ggcagcagccagc

SEQ ID NO: 2837627 - DNA, 15 bp, Homo sapiens
ggcagcagccagccc

SEQ ID NO: 2837628 - DNA, 19 bp, Homo sapiens
ggcagcagccagccctgcc

SEQ ID NO: 2837629 - DNA, 21 bp, Homo sapiens
ggcagcagccagccctgcctg

SEQ ID NO: 2837630 - DNA, 23 bp, Homo sapiens
ggcagcagccagccctgcctgga

SEQ ID NO: 2837631 - DNA, 13 bp, Homo sapiens
ggcagcccagcct

SEQ ID NO: 2837632 - DNA, 15 bp, Homo sapiens
ggcagccctgtaggg

SEQ ID NO: 2837633 - DNA, 16 bp, Homo sapiens
ggcagctcctctgtct

SEQ ID NO: 2837634 - DNA, 21 bp, Homo sapiens
ggcagctgaactattggaggg

SEQ ID NO: 2837635 - DNA, 21 bp, Homo sapiens
ggcagctgcggtccacccagg

SEQ ID NO: 2837636 - DNA, 17 bp, Homo sapiens
ggcagcttgagcctgtc

SEQ ID NO: 2837637 - DNA, 17 bp, Homo sapiens
ggcagcttgagggttgg

SEQ ID NO: 2837638 - DNA, 21 bp, Homo sapiens
ggcagcttgagggttgggctg

SEQ ID NO: 2837639 - DNA, 19 bp, Homo sapiens
ggcaggagaatcaataaaa

SEQ ID NO: 2837640 - DNA, 17 bp, Homo sapiens
ggcaggagtagctgagc

SEQ ID NO: 2837641 - DNA, 18 bp, Homo sapiens
ggcaggagtagctgagct

SEQ ID NO: 2837642 - DNA, 19 bp, Homo sapiens
ggcaggagtagctgagctc

SEQ ID NO: 2837643 - DNA, 14 bp, Homo sapiens
ggcaggcagggctc

SEQ ID NO: 2837644 - DNA, 22 bp, Homo sapiens
ggcaggcagggctctcctggct

SEQ ID NO: 2837645 - DNA, 20 bp, Homo sapiens
ggcagggccttgcccagaga

SEQ ID NO: 2837646 - DNA, 17 bp, Homo sapiens
ggcaggggtgggagagc

SEQ ID NO: 2837647 - DNA, 18 bp, Homo sapiens
ggcagggtctcactctgt

SEQ ID NO: 2837648 - DNA, 23 bp, Homo sapiens
ggcagggtgggatggaggagaag

SEQ ID NO: 2837649 - DNA, 15 bp, Homo sapiens
gctcactgcagcctc

SEQ ID NO: 2837650 - DNA, 16 bp, Homo sapiens
gctcactgcagcctca

SEQ ID NO: 2837651 - DNA, 18 bp, Homo sapiens
gctcagaagtttcttctt

SEQ ID NO: 2837652 - DNA, 16 bp, Homo sapiens
gctcagaggcccagga

SEQ ID NO: 2837653 - DNA, 16 bp, Homo sapiens
gctcagccctgactgg

SEQ ID NO: 2837654 - DNA, 19 bp, Homo sapiens
gctcagccctgactggtgc

SEQ ID NO: 2837655 - DNA, 15 bp, Homo sapiens
gctcagcctcccccc

SEQ ID NO: 2837656 - DNA, 14 bp, Homo sapiens
gctcagcctggtgg

SEQ ID NO: 2837657 - DNA, 15 bp, Homo sapiens
gctcagcctggtggg

SEQ ID NO: 2837658 - DNA, 20 bp, Homo sapiens
gctcagcctggtgggcctcc

SEQ ID NO: 2837659 - DNA, 15 bp, Homo sapiens
gctcagcggggacag

SEQ ID NO: 2837660 - DNA, 21 bp, Homo sapiens
gctcagcggggacagctcctt

SEQ ID NO: 2837661 - DNA, 17 bp, Homo sapiens
gctcaggaattgaagat

SEQ ID NO: 2837662 - DNA, 14 bp, Homo sapiens
gctcaggtgtccct

SEQ ID NO: 2837663 - DNA, 12 bp, Homo sapiens
gctcagtcccat

SEQ ID NO: 2837664 - DNA, 14 bp, Homo sapiens
gctccagctcacca

SEQ ID NO: 2837665 - DNA, 20 bp, Homo sapiens
gctccagctcaccagcccca

SEQ ID NO: 2837666 - DNA, 16 bp, Homo sapiens
gctccaggctccttta

SEQ ID NO: 2837667 - DNA, 21 bp, Homo sapiens
gctcccaccccacccccttca

SEQ ID NO: 2837668 - DNA, 16 bp, Homo sapiens
gctccccactctgctc

SEQ ID NO: 2837669 - DNA, 12 bp, Homo sapiens
gctccccctgct

SEQ ID NO: 2837670 - DNA, 20 bp, Homo sapiens
gctccccgggggcagacacc

SEQ ID NO: 2837671 - DNA, 19 bp, Homo sapiens
gctccctagtggcttcctc

SEQ ID NO: 2837672 - DNA, 13 bp, Homo sapiens
gctcccttcctga

SEQ ID NO: 2837673 - DNA, 21 bp, Homo sapiens
gctccgctttctacccagcga

SEQ ID NO: 2837674 - DNA, 11 bp, Homo sapiens
gctcctccagg

SEQ ID NO: 2837675 - DNA, 15 bp, Homo sapiens
gctcctccagggcca

SEQ ID NO: 2837676 - DNA, 12 bp, Homo sapiens
gctcctcccatt

SEQ ID NO: 2837677 - DNA, 15 bp, Homo sapiens
gctcctcccattccc

SEQ ID NO: 2837678 - DNA, 15 bp, Homo sapiens
gctcctctccaggca

SEQ ID NO: 2837679 - DNA, 17 bp, Homo sapiens
gctcctctgtctcgagc

SEQ ID NO: 2837680 - DNA, 22 bp, Homo sapiens
gctcctctgtctcgagcgccct

SEQ ID NO: 2837681 - DNA, 22 bp, Homo sapiens
gctcctggaaaggctcagtctc

SEQ ID NO: 2837682 - DNA, 22 bp, Homo sapiens
gctcctggaaccaatcccgtga

SEQ ID NO: 2837683 - DNA, 14 bp, Homo sapiens
gctcctgggcagct

SEQ ID NO: 2837684 - DNA, 16 bp, Homo sapiens
gctcctgtctgccagc

SEQ ID NO: 2837685 - DNA, 12 bp, Homo sapiens
gctcctgtgtct

SEQ ID NO: 2837686 - DNA, 15 bp, Homo sapiens
gctccttctgtccta

SEQ ID NO: 2837687 - DNA, 18 bp, Homo sapiens
gctccttgggtcctgcaa

SEQ ID NO: 2837688 - DNA, 16 bp, Homo sapiens
gctcctttctccagcc

SEQ ID NO: 2837689 - DNA, 18 bp, Homo sapiens
gctcctttctccagccag

SEQ ID NO: 2837690 - DNA, 19 bp, Homo sapiens
gctcctttctccagccagc

SEQ ID NO: 2837691 - DNA, 16 bp, Homo sapiens
gctcggggtgcacagg

SEQ ID NO: 2837692 - DNA, 20 bp, Homo sapiens
gctcggggtgcacaggaggg

SEQ ID NO: 2837693 - DNA, 19 bp, Homo sapiens
gctcgtccccaagtgacct

SEQ ID NO: 2837694 - DNA, 15 bp, Homo sapiens
gctctaacgcctgag

SEQ ID NO: 2837695 - DNA, 22 bp, Homo sapiens
gctctaacgcctgagcccaggg

SEQ ID NO: 2837696 - DNA, 21 bp, Homo sapiens
gctctactggtcttgtggaat

SEQ ID NO: 2837697 - DNA, 12 bp, Homo sapiens
gctctcagaagg

SEQ ID NO: 2837698 - DNA, 10 bp, Homo sapiens
gctctcagcc

SEQ ID NO: 2837699 - DNA, 12 bp, Homo sapiens
gctctcagcctc

SEQ ID NO: 2837700 - DNA, 23 bp, Homo sapiens
gctctcagcctcccaaccccagg

SEQ ID NO: 2837701 - DNA, 17 bp, Homo sapiens
gctctccacctcagcct

SEQ ID NO: 2837702 - DNA, 19 bp, Homo sapiens
gctctcccctgccctgctg

SEQ ID NO: 2837703 - DNA, 15 bp, Homo sapiens
gctctccctctggcc

SEQ ID NO: 2837704 - DNA, 18 bp, Homo sapiens
gctctcctaccccacctc

SEQ ID NO: 2837705 - DNA, 19 bp, Homo sapiens
gctctcctcagaagaaaga

SEQ ID NO: 2837706 - DNA, 22 bp, Homo sapiens
gctctcctgagaggtgctgcag

SEQ ID NO: 2837707 - DNA, 12 bp, Homo sapiens
gctctcctggct

SEQ ID NO: 2837708 - DNA, 17 bp, Homo sapiens
gctctcctggcttccca

SEQ ID NO: 2837709 - DNA, 19 bp, Homo sapiens
gctctcgggttgtgtgtct

SEQ ID NO: 2837710 - DNA, 22 bp, Homo sapiens
gctctctctacccggcccagag

SEQ ID NO: 2837711 - DNA, 22 bp, Homo sapiens
gctctctgagggagaggctgtg

SEQ ID NO: 2837712 - DNA, 18 bp, Homo sapiens
gctctctgcagccagccc

SEQ ID NO: 2837713 - DNA, 20 bp, Homo sapiens
gctctctgcagccagcccag

SEQ ID NO: 2837714 - DNA, 22 bp, Homo sapiens
gctctgaagtcacatcacagga

SEQ ID NO: 2837715 - DNA, 23 bp, Homo sapiens
gctctgaagtcacatcacaggac

SEQ ID NO: 2837716 - DNA, 20 bp, Homo sapiens
gctctgagaggccctggatc

SEQ ID NO: 2837717 - DNA, 23 bp, Homo sapiens
gctctgagaggccctggatcagc

SEQ ID NO: 2837718 - DNA, 21 bp, Homo sapiens
gctctgagcaaatgtggctcc

SEQ ID NO: 2837719 - DNA, 9 bp, Homo sapiens
gctctgagg

SEQ ID NO: 2837720 - DNA, 23 bp, Homo sapiens
gctctgaggcgccccaacccgtg

SEQ ID NO: 2837721 - DNA, 20 bp, Homo sapiens
gctctgaggcttccagagag

SEQ ID NO: 2837722 - DNA, 14 bp, Homo sapiens
gctctgcatgtgtg

SEQ ID NO: 2837723 - DNA, 13 bp, Homo sapiens
gctctgccccagc

SEQ ID NO: 2837724 - DNA, 19 bp, Homo sapiens
gctctgccccagctctggc

SEQ ID NO: 2837725 - DNA, 20 bp, Homo sapiens
gctctgccccagctctggct

SEQ ID NO: 2837726 - DNA, 19 bp, Homo sapiens
gctctgctcctctccccag

SEQ ID NO: 2837727 - DNA, 20 bp, Homo sapiens
gctctgctgacagacacagg

SEQ ID NO: 2837728 - DNA, 15 bp, Homo sapiens
gctctgctggcctgg

SEQ ID NO: 2837729 - DNA, 17 bp, Homo sapiens
gctctgctggcctggcc

SEQ ID NO: 2837730 - DNA, 21 bp, Homo sapiens
gctctggaaaatgtgacccag

SEQ ID NO: 2837731 - DNA, 14 bp, Homo sapiens
gctctggaagagag

SEQ ID NO: 2837732 - DNA, 22 bp, Homo sapiens
gctctggaccaaccctgtttcc

SEQ ID NO: 2837733 - DNA, 16 bp, Homo sapiens
gctctggaccagcctg

SEQ ID NO: 2837734 - DNA, 16 bp, Homo sapiens
gctctgtcctgggagt

SEQ ID NO: 2837735 - DNA, 19 bp, Homo sapiens
gctcttcagtgggagaaaa

SEQ ID NO: 2837736 - DNA, 21 bp, Homo sapiens
gctcttcccctttcctggggg

SEQ ID NO: 2837737 - DNA, 13 bp, Homo sapiens
gctcttctaagga

SEQ ID NO: 2837738 - DNA, 16 bp, Homo sapiens
gctcttctccaggctg

SEQ ID NO: 2837739 - DNA, 14 bp, Homo sapiens
gccccgcctccccg

SEQ ID NO: 2837740 - DNA, 17 bp, Homo sapiens
gccccgcgcctccttcc

SEQ ID NO: 2837741 - DNA, 15 bp, Homo sapiens
gccccgcttccccac

SEQ ID NO: 2837742 - DNA, 16 bp, Homo sapiens
gccccgcttgtccagc

SEQ ID NO: 2837743 - DNA, 17 bp, Homo sapiens
gccccgggcctgcctct

SEQ ID NO: 2837744 - DNA, 18 bp, Homo sapiens
gccccgggcctgcctctg

SEQ ID NO: 2837745 - DNA, 19 bp, Homo sapiens
gccccgggcctgcctctga

SEQ ID NO: 2837746 - DNA, 23 bp, Homo sapiens
gccccgggcctgcctctgactca

SEQ ID NO: 2837747 - DNA, 20 bp, Homo sapiens
gccccgggtccccagctccc

SEQ ID NO: 2837748 - DNA, 14 bp, Homo sapiens
gcccctcctcccct

SEQ ID NO: 2837749 - DNA, 16 bp, Homo sapiens
gcccctcctccccttc

SEQ ID NO: 2837750 - DNA, 22 bp, Homo sapiens
gcccctcctccccttcctgcac

SEQ ID NO: 2837751 - DNA, 14 bp, Homo sapiens
gcccctcctctgcc

SEQ ID NO: 2837752 - DNA, 15 bp, Homo sapiens
gcccctcctctgcca

SEQ ID NO: 2837753 - DNA, 23 bp, Homo sapiens
gcccctcctctgccacctcccct

SEQ ID NO: 2837754 - DNA, 22 bp, Homo sapiens
gcccctctccaaacaccggcag

SEQ ID NO: 2837755 - DNA, 15 bp, Homo sapiens
gcccctgccaccctg

SEQ ID NO: 2837756 - DNA, 14 bp, Homo sapiens
gcccctgcccggct

SEQ ID NO: 2837757 - DNA, 16 bp, Homo sapiens
gcccctgctggttcag

SEQ ID NO: 2837758 - DNA, 11 bp, Homo sapiens
gcccctgtaaa

SEQ ID NO: 2837759 - DNA, 24 bp, Homo sapiens
gcccctgtgtgagttgagtctcct

SEQ ID NO: 2837760 - DNA, 18 bp, Homo sapiens
gcccctgttcccccgctg

SEQ ID NO: 2837761 - DNA, 22 bp, Homo sapiens
gccccttactatgatctcagga

SEQ ID NO: 2837762 - DNA, 12 bp, Homo sapiens
gccccttgggcc

SEQ ID NO: 2837763 - DNA, 15 bp, Homo sapiens
gccccttgggcctcc

SEQ ID NO: 2837764 - DNA, 15 bp, Homo sapiens
gcccggattctggga

SEQ ID NO: 2837765 - DNA, 13 bp, Homo sapiens
gcccggccccatc

SEQ ID NO: 2837766 - DNA, 14 bp, Homo sapiens
gcccggcctgctcc

SEQ ID NO: 2837767 - DNA, 21 bp, Homo sapiens
gcccggcgcggtggctcacgc

SEQ ID NO: 2837768 - DNA, 12 bp, Homo sapiens
gcccggctccag

SEQ ID NO: 2837769 - DNA, 14 bp, Homo sapiens
gcccgtcttcagcc

SEQ ID NO: 2837770 - DNA, 16 bp, Homo sapiens
gcccgtcttcagccta

SEQ ID NO: 2837771 - DNA, 17 bp, Homo sapiens
gcccgtcttcagcctag

SEQ ID NO: 2837772 - DNA, 18 bp, Homo sapiens
gcccgtcttcagcctagc

SEQ ID NO: 2837773 - DNA, 23 bp, Homo sapiens
gccctcaatccccaagctggcag

SEQ ID NO: 2837774 - DNA, 20 bp, Homo sapiens
gccctccacagccgcagcct

SEQ ID NO: 2837775 - DNA, 16 bp, Homo sapiens
gccctctatttctctc

SEQ ID NO: 2837776 - DNA, 18 bp, Homo sapiens
gccctctgctccccagtg

SEQ ID NO: 2837777 - DNA, 12 bp, Homo sapiens
gccctgacctcc

SEQ ID NO: 2837778 - DNA, 17 bp, Homo sapiens
gccctgacctcccagcc

SEQ ID NO: 2837779 - DNA, 15 bp, Homo sapiens
gccctgagctcggtg

SEQ ID NO: 2837780 - DNA, 12 bp, Homo sapiens
gccctgcacaga

SEQ ID NO: 2837781 - DNA, 20 bp, Homo sapiens
gccctgcacagatatttcca

SEQ ID NO: 2837782 - DNA, 16 bp, Homo sapiens
gccctgcagaccctgc

SEQ ID NO: 2837783 - DNA, 17 bp, Homo sapiens
gccctgcagaccctgcc

SEQ ID NO: 2837784 - DNA, 13 bp, Homo sapiens
gccctgcagaggg

SEQ ID NO: 2837785 - DNA, 21 bp, Homo sapiens
gccctgcagaggggaaaccag

SEQ ID NO: 2837786 - DNA, 13 bp, Homo sapiens
gccctgccctgcc

SEQ ID NO: 2837787 - DNA, 13 bp, Homo sapiens
gccctgcctggag

SEQ ID NO: 2837788 - DNA, 14 bp, Homo sapiens
gcgagcatttccct

SEQ ID NO: 2837789 - DNA, 17 bp, Homo sapiens
gcgagccctggtggcag

SEQ ID NO: 2837790 - DNA, 17 bp, Homo sapiens
gcgaggtcaacagagaa

SEQ ID NO: 2837791 - DNA, 22 bp, Homo sapiens
gcgaggtcaacagagaaggcag

SEQ ID NO: 2837792 - DNA, 21 bp, Homo sapiens
gcgagtgccaggactccccag

SEQ ID NO: 2837793 - DNA, 22 bp, Homo sapiens
gcgagtgccaggactccccagg

SEQ ID NO: 2837794 - DNA, 22 bp, Homo sapiens
gcgatctgggttcactgcaacc

SEQ ID NO: 2837795 - DNA, 19 bp, Homo sapiens
gcgattccctctcccaggc

SEQ ID NO: 2837796 - DNA, 14 bp, Homo sapiens
gcgattcttctgct

SEQ ID NO: 2837797 - DNA, 21 bp, Homo sapiens
gcgcaagcctgtaatcccagc

SEQ ID NO: 2837798 - DNA, 22 bp, Homo sapiens
gcgcaagcctgtaatcccagct

SEQ ID NO: 2837799 - DNA, 17 bp, Homo sapiens
gcgcacaaggctgacca

SEQ ID NO: 2837800 - DNA, 18 bp, Homo sapiens
gcgcagtgcttctctaca

SEQ ID NO: 2837801 - DNA, 18 bp, Homo sapiens
gcgccccaacccgtggag

SEQ ID NO: 2837802 - DNA, 20 bp, Homo sapiens
gcgcctacaggagtgagcac

SEQ ID NO: 2837803 - DNA, 20 bp, Homo sapiens
gcgcctagtggggtctccct

SEQ ID NO: 2837804 - DNA, 17 bp, Homo sapiens
gcgcctccctccacccc

SEQ ID NO: 2837805 - DNA, 18 bp, Homo sapiens
gcgcctccctccacccca

SEQ ID NO: 2837806 - DNA, 23 bp, Homo sapiens
gcgcctccctccaccccaggacg

SEQ ID NO: 2837807 - DNA, 20 bp, Homo sapiens
gcgctctgccctccctggcc

SEQ ID NO: 2837808 - DNA, 17 bp, Homo sapiens
gcgctgccgcaccccag

SEQ ID NO: 2837809 - DNA, 19 bp, Homo sapiens
gcgctgccgcaccccagag

SEQ ID NO: 2837810 - DNA, 21 bp, Homo sapiens
gcgctgccgcaccccagagtg

SEQ ID NO: 2837811 - DNA, 21 bp, Homo sapiens
gcgctgctcaacctctctcct

SEQ ID NO: 2837812 - DNA, 17 bp, Homo sapiens
gcgctggtggaccacag

SEQ ID NO: 2837813 - DNA, 15 bp, Homo sapiens
gcggagagtacagtg

SEQ ID NO: 2837814 - DNA, 22 bp, Homo sapiens
gcggagagtacagtgagccaag

SEQ ID NO: 2837815 - DNA, 18 bp, Homo sapiens
gcggagccggcacctaca

SEQ ID NO: 2837816 - DNA, 22 bp, Homo sapiens
gcggaggagaccagctcagagg

SEQ ID NO: 2837817 - DNA, 15 bp, Homo sapiens
gcggaggttgcaggg

SEQ ID NO: 2837818 - DNA, 16 bp, Homo sapiens
gcggaggttgcaggga

SEQ ID NO: 2837819 - DNA, 15 bp, Homo sapiens
gcggccgcattccct

SEQ ID NO: 2837820 - DNA, 16 bp, Homo sapiens
gcggccgcattccctg

SEQ ID NO: 2837821 - DNA, 19 bp, Homo sapiens
gcggcctatgacttgggca

SEQ ID NO: 2837822 - DNA, 19 bp, Homo sapiens
gcggctactcagcagccct

SEQ ID NO: 2837823 - DNA, 22 bp, Homo sapiens
gcggctgagtcatgatctccct

SEQ ID NO: 2837824 - DNA, 15 bp, Homo sapiens
gcggctgtgggggag

SEQ ID NO: 2837825 - DNA, 21 bp, Homo sapiens
gcggctgtgggggaggtccct

SEQ ID NO: 2837826 - DNA, 23 bp, Homo sapiens
gcgggacgagaccctacaggaga

SEQ ID NO: 2837827 - DNA, 15 bp, Homo sapiens
gcgggatggtcctgg

SEQ ID NO: 2837828 - DNA, 12 bp, Homo sapiens
gcggggacagct

SEQ ID NO: 2837829 - DNA, 14 bp, Homo sapiens
gcggggacagctcc

SEQ ID NO: 2837830 - DNA, 15 bp, Homo sapiens
gcggggacagctcct

SEQ ID NO: 2837831 - DNA, 17 bp, Homo sapiens
gcggggacagctccttc

SEQ ID NO: 2837832 - DNA, 23 bp, Homo sapiens
gcggggacagctccttctgtcct

SEQ ID NO: 2837833 - DNA, 14 bp, Homo sapiens
gcggtccacccagg

SEQ ID NO: 2837834 - DNA, 23 bp, Homo sapiens
gcggtccacccaggagccccgag

SEQ ID NO: 2837835 - DNA, 19 bp, Homo sapiens
gcggtgagaggggaacaga

SEQ ID NO: 2837836 - DNA, 17 bp, Homo sapiens
gcgtcagaggccctgga

SEQ ID NO: 2837837 - DNA, 19 bp, Homo sapiens
gccaggcaccccctggaga

SEQ ID NO: 2837838 - DNA, 20 bp, Homo sapiens
gccaggcaccccctggagag

SEQ ID NO: 2837839 - DNA, 14 bp, Homo sapiens
gccaggcaggggtg

SEQ ID NO: 2837840 - DNA, 20 bp, Homo sapiens
gccaggcaggggtgggagag

SEQ ID NO: 2837841 - DNA, 15 bp, Homo sapiens
gccaggccaccagga

SEQ ID NO: 2837842 - DNA, 12 bp, Homo sapiens
gccaggccagag

SEQ ID NO: 2837843 - DNA, 15 bp, Homo sapiens
gccaggccagaggga

SEQ ID NO: 2837844 - DNA, 17 bp, Homo sapiens
gccaggcccggggctgg

SEQ ID NO: 2837845 - DNA, 18 bp, Homo sapiens
gccaggcccggggctggc

SEQ ID NO: 2837846 - DNA, 15 bp, Homo sapiens
gccaggctaattttt

SEQ ID NO: 2837847 - DNA, 18 bp, Homo sapiens
gccaggctgagtgagcca

SEQ ID NO: 2837848 - DNA, 16 bp, Homo sapiens
gccagggtgagagctg

SEQ ID NO: 2837849 - DNA, 16 bp, Homo sapiens
gccaggtaatgaggga

SEQ ID NO: 2837850 - DNA, 16 bp, Homo sapiens
gccagtctgggctgcc

SEQ ID NO: 2837851 - DNA, 17 bp, Homo sapiens
gccagtctgggctgccg

SEQ ID NO: 2837852 - DNA, 13 bp, Homo sapiens
gccagtcttgtgt

SEQ ID NO: 2837853 - DNA, 20 bp, Homo sapiens
gccagtgatgctaaaggttg

SEQ ID NO: 2837854 - DNA, 17 bp, Homo sapiens
gccagtgtgatcccaag

SEQ ID NO: 2837855 - DNA, 20 bp, Homo sapiens
gccagtgtttagaagagcct

SEQ ID NO: 2837856 - DNA, 22 bp, Homo sapiens
gccagtgtttagaagagcctga

SEQ ID NO: 2837857 - DNA, 17 bp, Homo sapiens
gccagtttcaccatttc

SEQ ID NO: 2837858 - DNA, 13 bp, Homo sapiens
gccatcagggtgg

SEQ ID NO: 2837859 - DNA, 23 bp, Homo sapiens
gccatcagggtgggccactctcc

SEQ ID NO: 2837860 - DNA, 23 bp, Homo sapiens
gccatcctaggcttaaatgcaat

SEQ ID NO: 2837861 - DNA, 22 bp, Homo sapiens
gccatccttcaccagagcccat

SEQ ID NO: 2837862 - DNA, 23 bp, Homo sapiens
gccatccttcaccagagcccatg

SEQ ID NO: 2837863 - DNA, 20 bp, Homo sapiens
gccatctccaccctgagcct

SEQ ID NO: 2837864 - DNA, 20 bp, Homo sapiens
gccatgaggagttgctgttt

SEQ ID NO: 2837865 - DNA, 12 bp, Homo sapiens
gccatgaggcct

SEQ ID NO: 2837866 - DNA, 15 bp, Homo sapiens
gccatgctgaaggga

SEQ ID NO: 2837867 - DNA, 17 bp, Homo sapiens
gccatgcttcttgcccc

SEQ ID NO: 2837868 - DNA, 19 bp, Homo sapiens
gccatgcttcttgcccctt

SEQ ID NO: 2837869 - DNA, 19 bp, Homo sapiens
gccatggagttgtgatcat

SEQ ID NO: 2837870 - DNA, 17 bp, Homo sapiens
gccatggcgtgtccctc

SEQ ID NO: 2837871 - DNA, 17 bp, Homo sapiens
gccatgtcaaacaaata

SEQ ID NO: 2837872 - DNA, 19 bp, Homo sapiens
gccatgtcgcctgccccca

SEQ ID NO: 2837873 - DNA, 16 bp, Homo sapiens
gccatgttggccaggc

SEQ ID NO: 2837874 - DNA, 17 bp, Homo sapiens
gccatgttggccaggct

SEQ ID NO: 2837875 - DNA, 20 bp, Homo sapiens
gctagaagtgggccaggaca

SEQ ID NO: 2837876 - DNA, 13 bp, Homo sapiens
gctagcagaagta

SEQ ID NO: 2837877 - DNA, 18 bp, Homo sapiens
gctagctgtagaaatgta

SEQ ID NO: 2837878 - DNA, 12 bp, Homo sapiens
gctaggaatgaa

SEQ ID NO: 2837879 - DNA, 13 bp, Homo sapiens
gctaggaatgaaa

SEQ ID NO: 2837880 - DNA, 18 bp, Homo sapiens
gctaggaatgaaatcctg

SEQ ID NO: 2837881 - DNA, 19 bp, Homo sapiens
gctaggagcaaagcctgtt

SEQ ID NO: 2837882 - DNA, 16 bp, Homo sapiens
gctaggcgagtgccag

SEQ ID NO: 2837883 - DNA, 21 bp, Homo sapiens
gctaggcgagtgccaggactc

SEQ ID NO: 2837884 - DNA, 18 bp, Homo sapiens
gctagtcagagagagtgt

SEQ ID NO: 2837885 - DNA, 15 bp, Homo sapiens
gctagtctatggtca

SEQ ID NO: 2837886 - DNA, 20 bp, Homo sapiens
gctatcaaaataaattgaaa

SEQ ID NO: 2837887 - DNA, 22 bp, Homo sapiens
gctatcaaaataaattgaaata

SEQ ID NO: 2837888 - DNA, 23 bp, Homo sapiens
gctatcaaaataaattgaaatat

SEQ ID NO: 2837889 - DNA, 16 bp, Homo sapiens
gctatctctgtgtgca

SEQ ID NO: 2837890 - DNA, 11 bp, Homo sapiens
gctatgccttg

SEQ ID NO: 2837891 - DNA, 13 bp, Homo sapiens
gctatggttttct

SEQ ID NO: 2837892 - DNA, 16 bp, Homo sapiens
gctatgtttttaatgt

SEQ ID NO: 2837893 - DNA, 20 bp, Homo sapiens
gctattgatgtttccagaaa

SEQ ID NO: 2837894 - DNA, 22 bp, Homo sapiens
gctattgatgtttccagaaaat

SEQ ID NO: 2837895 - DNA, 23 bp, Homo sapiens
gctattgatgtttccagaaaata

SEQ ID NO: 2837896 - DNA, 14 bp, Homo sapiens
gctattgcactcca

SEQ ID NO: 2837897 - DNA, 15 bp, Homo sapiens
gctattgcactccag

SEQ ID NO: 2837898 - DNA, 16 bp, Homo sapiens
gctattgcactccagt

SEQ ID NO: 2837899 - DNA, 18 bp, Homo sapiens
gctattgcactccagtct

SEQ ID NO: 2837900 - DNA, 22 bp, Homo sapiens
gctattgcatgtaaaatgcagt

SEQ ID NO: 2837901 - DNA, 14 bp, Homo sapiens
gctatttgaagtgt

SEQ ID NO: 2837902 - DNA, 15 bp, Homo sapiens
gctatttttatggaa

SEQ ID NO: 2837903 - DNA, 14 bp, Homo sapiens
gctcaaatctattc

SEQ ID NO: 2837904 - DNA, 20 bp, Homo sapiens
gctcaaatctattcagacaa

SEQ ID NO: 2837905 - DNA, 15 bp, Homo sapiens
gctcaaccactgtgg

SEQ ID NO: 2837906 - DNA, 17 bp, Homo sapiens
gctcaaccactgtggcg

SEQ ID NO: 2837907 - DNA, 18 bp, Homo sapiens
gctcaagatgacagctct

SEQ ID NO: 2837908 - DNA, 19 bp, Homo sapiens
gctcaagtcctcttttctg

SEQ ID NO: 2837909 - DNA, 22 bp, Homo sapiens
gctcaagtcctcttttctgaga

SEQ ID NO: 2837910 - DNA, 20 bp, Homo sapiens
gctcaagtcttccctgatca

SEQ ID NO: 2837911 - DNA, 19 bp, Homo sapiens
gctcaatattcctgaatga

SEQ ID NO: 2837912 - DNA, 21 bp, Homo sapiens
gctcaatattcctgaatgaaa

SEQ ID NO: 2837913 - DNA, 14 bp, Homo sapiens
gctcacaaggcagc

SEQ ID NO: 2837914 - DNA, 22 bp, Homo sapiens
gctcacaaggcagcaaggcccg

SEQ ID NO: 2837915 - DNA, 13 bp, Homo sapiens
gctcacagttcct

SEQ ID NO: 2837916 - DNA, 15 bp, Homo sapiens
gctcacagttcctcg

SEQ ID NO: 2837917 - DNA, 17 bp, Homo sapiens
gctcacagttcctcgcc

SEQ ID NO: 2837918 - DNA, 23 bp, Homo sapiens
gctcacagttcctcgccctgggt

SEQ ID NO: 2837919 - DNA, 16 bp, Homo sapiens
gctcacatatctgtca

SEQ ID NO: 2837920 - DNA, 12 bp, Homo sapiens
gctcaccagccc

SEQ ID NO: 2837921 - DNA, 15 bp, Homo sapiens
gctcaccagccccag

SEQ ID NO: 2837922 - DNA, 20 bp, Homo sapiens
gctcacccaataaacattaa

SEQ ID NO: 2837923 - DNA, 22 bp, Homo sapiens
gctcacgcctataatcccagca

SEQ ID NO: 2837924 - DNA, 12 bp, Homo sapiens
gctcactccctg

SEQ ID NO: 2837925 - DNA, 19 bp, Homo sapiens
gctcactgacctgcctgta

SEQ ID NO: 2837926 - DNA, 15 bp, Homo sapiens
gctgaggtgcccagg

SEQ ID NO: 2837927 - DNA, 14 bp, Homo sapiens
gctgataattttaa

SEQ ID NO: 2837928 - DNA, 23 bp, Homo sapiens
gctgcaaagggtatcaggtgctg

SEQ ID NO: 2837929 - DNA, 13 bp, Homo sapiens
gctgcaaagtgca

SEQ ID NO: 2837930 - DNA, 20 bp, Homo sapiens
gctgcaagtgacatctcttt

SEQ ID NO: 2837931 - DNA, 17 bp, Homo sapiens
gctgcacctgccagcct

SEQ ID NO: 2837932 - DNA, 19 bp, Homo sapiens
gctgcagaaggccaagaat

SEQ ID NO: 2837933 - DNA, 19 bp, Homo sapiens
gctgcagatttcctgtgtg

SEQ ID NO: 2837934 - DNA, 12 bp, Homo sapiens
gctgcagcttcc

SEQ ID NO: 2837935 - DNA, 17 bp, Homo sapiens
gctgccaaattttggcc

SEQ ID NO: 2837936 - DNA, 15 bp, Homo sapiens
gctgccccagccccg

SEQ ID NO: 2837937 - DNA, 20 bp, Homo sapiens
gctgccccgcttccccacag

SEQ ID NO: 2837938 - DNA, 21 bp, Homo sapiens
gctgccccgggtccccagctc

SEQ ID NO: 2837939 - DNA, 22 bp, Homo sapiens
gctgccccgggtccccagctcc

SEQ ID NO: 2837940 - DNA, 14 bp, Homo sapiens
gctgccgcacccca

SEQ ID NO: 2837941 - DNA, 18 bp, Homo sapiens
gctgccgcaccccagagt

SEQ ID NO: 2837942 - DNA, 22 bp, Homo sapiens
gctgccgcaccccagagtgtgg

SEQ ID NO: 2837943 - DNA, 18 bp, Homo sapiens
gctgccgcctcccagcct

SEQ ID NO: 2837944 - DNA, 19 bp, Homo sapiens
gctgccgcctcccagcctg

SEQ ID NO: 2837945 - DNA, 16 bp, Homo sapiens
gctgcctaagtggctg

SEQ ID NO: 2837946 - DNA, 17 bp, Homo sapiens
gctgcctaagtggctgc

SEQ ID NO: 2837947 - DNA, 23 bp, Homo sapiens
gctgcctcatgaccctcctgtcc

SEQ ID NO: 2837948 - DNA, 24 bp, Homo sapiens
gctgcctcatgaccctcctgtcca

SEQ ID NO: 2837949 - DNA, 12 bp, Homo sapiens
gctgcctgtagt

SEQ ID NO: 2837950 - DNA, 12 bp, Homo sapiens
gctgcctgttca

SEQ ID NO: 2837951 - DNA, 13 bp, Homo sapiens
gctgcctgttcag

SEQ ID NO: 2837952 - DNA, 17 bp, Homo sapiens
gctgcctgttcagctcc

SEQ ID NO: 2837953 - DNA, 20 bp, Homo sapiens
gctgcctgttcagctccagc

SEQ ID NO: 2837954 - DNA, 17 bp, Homo sapiens
gctgcgagcatttccct

SEQ ID NO: 2837955 - DNA, 18 bp, Homo sapiens
gctgcgggacagaggacc

SEQ ID NO: 2837956 - DNA, 18 bp, Homo sapiens
gctgcggtccacccagga

SEQ ID NO: 2837957 - DNA, 19 bp, Homo sapiens
gctgcggtccacccaggag

SEQ ID NO: 2837958 - DNA, 14 bp, Homo sapiens
gctgctacccagaa

SEQ ID NO: 2837959 - DNA, 19 bp, Homo sapiens
gctgctagcacttggagcc

SEQ ID NO: 2837960 - DNA, 11 bp, Homo sapiens
gctgctcctcc

SEQ ID NO: 2837961 - DNA, 12 bp, Homo sapiens
gctgctcctcca

SEQ ID NO: 2837962 - DNA, 15 bp, Homo sapiens
gctgctcctccaggg

SEQ ID NO: 2837963 - DNA, 21 bp, Homo sapiens
gctgctcggggtgcacaggag

SEQ ID NO: 2837964 - DNA, 15 bp, Homo sapiens
gctgctgagaacctg

SEQ ID NO: 2837965 - DNA, 16 bp, Homo sapiens
gctgctgagaacctgg

SEQ ID NO: 2837966 - DNA, 22 bp, Homo sapiens
gctgctgagaacctggccttca

SEQ ID NO: 2837967 - DNA, 14 bp, Homo sapiens
gctgctgtgtagct

SEQ ID NO: 2837968 - DNA, 22 bp, Homo sapiens
gctgcttgactatcacatacaa

SEQ ID NO: 2837969 - DNA, 23 bp, Homo sapiens
gctggaaaagtcacacagacaca

SEQ ID NO: 2837970 - DNA, 18 bp, Homo sapiens
gctggaagcactgctgtg

SEQ ID NO: 2837971 - DNA, 14 bp, Homo sapiens
gctggacaacccag

SEQ ID NO: 2837972 - DNA, 16 bp, Homo sapiens
gctggacaagaagctg

SEQ ID NO: 2837973 - DNA, 18 bp, Homo sapiens
gctggaccttgaactggg

SEQ ID NO: 2837974 - DNA, 15 bp, Homo sapiens
gctggactctggcac

SEQ ID NO: 2837975 - DNA, 19 bp, Homo sapiens
gctggactctggcacccag

SEQ ID NO: 2837976 - DNA, 21 bp, Homo sapiens
gctggagcctcggtggccatg

SEQ ID NO: 2837977 - DNA, 14 bp, Homo sapiens
gctggaggcagggc

SEQ ID NO: 2837978 - DNA, 15 bp, Homo sapiens
gctggaggcagggcc

SEQ ID NO: 2837979 - DNA, 16 bp, Homo sapiens
gctggaggcagggcct

SEQ ID NO: 2837980 - DNA, 14 bp, Homo sapiens
gcccattctctctc

SEQ ID NO: 2837981 - DNA, 19 bp, Homo sapiens
gcccattctctctcctgtc

SEQ ID NO: 2837982 - DNA, 20 bp, Homo sapiens
gccccaaacgggctgccctg

SEQ ID NO: 2837983 - DNA, 17 bp, Homo sapiens
gccccaacccgtggagg

SEQ ID NO: 2837984 - DNA, 21 bp, Homo sapiens
gccccaacccgtggaggctgc

SEQ ID NO: 2837985 - DNA, 22 bp, Homo sapiens
gccccaacccgtggaggctgct

SEQ ID NO: 2837986 - DNA, 23 bp, Homo sapiens
gccccaacccgtggaggctgctc

SEQ ID NO: 2837987 - DNA, 17 bp, Homo sapiens
gccccaactcctggaag

SEQ ID NO: 2837988 - DNA, 18 bp, Homo sapiens
gccccaactcctggaagc

SEQ ID NO: 2837989 - DNA, 14 bp, Homo sapiens
gccccaactccttc

SEQ ID NO: 2837990 - DNA, 18 bp, Homo sapiens
gccccaactccttccagc

SEQ ID NO: 2837991 - DNA, 21 bp, Homo sapiens
gccccaactccttccagctag

SEQ ID NO: 2837992 - DNA, 21 bp, Homo sapiens
gccccaaggggtttctgtttc

SEQ ID NO: 2837993 - DNA, 11 bp, Homo sapiens
gccccaccacc

SEQ ID NO: 2837994 - DNA, 14 bp, Homo sapiens
gccccaccagccac

SEQ ID NO: 2837995 - DNA, 15 bp, Homo sapiens
gccccaccagccacc

SEQ ID NO: 2837996 - DNA, 17 bp, Homo sapiens
gccccaccagccacctc

SEQ ID NO: 2837997 - DNA, 22 bp, Homo sapiens
gccccaccctcgtggacacctg

SEQ ID NO: 2837998 - DNA, 18 bp, Homo sapiens
gccccagaaggcagggaa

SEQ ID NO: 2837999 - DNA, 22 bp, Homo sapiens
gccccagacacaccccccagtc

SEQ ID NO: 2838000 - DNA, 18 bp, Homo sapiens
gccccagatcaccagccc

SEQ ID NO: 2838001 - DNA, 20 bp, Homo sapiens
gccccagatcaccagcccgg

SEQ ID NO: 2838002 - DNA, 12 bp, Homo sapiens
gccccagccccc

SEQ ID NO: 2838003 - DNA, 21 bp, Homo sapiens
gccccagccccgttccttccg

SEQ ID NO: 2838004 - DNA, 21 bp, Homo sapiens
gccccagtgcccacaggatca

SEQ ID NO: 2838005 - DNA, 21 bp, Homo sapiens
gccccataattttttttttcc

SEQ ID NO: 2838006 - DNA, 18 bp, Homo sapiens
gccccatcagaggctggg

SEQ ID NO: 2838007 - DNA, 14 bp, Homo sapiens
gccccatgacctcc

SEQ ID NO: 2838008 - DNA, 16 bp, Homo sapiens
gccccatgtctctcag

SEQ ID NO: 2838009 - DNA, 17 bp, Homo sapiens
gccccattctgcctgcc

SEQ ID NO: 2838010 - DNA, 16 bp, Homo sapiens
gcccccacttctctcc

SEQ ID NO: 2838011 - DNA, 16 bp, Homo sapiens
gcccccagcctctgtc

SEQ ID NO: 2838012 - DNA, 13 bp, Homo sapiens
gccccccgcagca

SEQ ID NO: 2838013 - DNA, 16 bp, Homo sapiens
gccccccgcagcaccc

SEQ ID NO: 2838014 - DNA, 20 bp, Homo sapiens
gccccccgcagcaccctgca

SEQ ID NO: 2838015 - DNA, 15 bp, Homo sapiens
gcccccctccaggca

SEQ ID NO: 2838016 - DNA, 14 bp, Homo sapiens
gccccctgtgccct

SEQ ID NO: 2838017 - DNA, 17 bp, Homo sapiens
gccccgactccagccag

SEQ ID NO: 2838018 - DNA, 21 bp, Homo sapiens
gccccgactccagccagcgcc

SEQ ID NO: 2838019 - DNA, 18 bp, Homo sapiens
gccccgaggccttctctg

SEQ ID NO: 2838020 - DNA, 23 bp, Homo sapiens
gccaaggtgggctgagccctggc

SEQ ID NO: 2838021 - DNA, 15 bp, Homo sapiens
gccaagtccaggtcc

SEQ ID NO: 2838022 - DNA, 15 bp, Homo sapiens
gccaagttcctctag

SEQ ID NO: 2838023 - DNA, 23 bp, Homo sapiens
gccaataaatcaactccagctcc

SEQ ID NO: 2838024 - DNA, 12 bp, Homo sapiens
gccaatgaggtc

SEQ ID NO: 2838025 - DNA, 16 bp, Homo sapiens
gccaattaaaatatat

SEQ ID NO: 2838026 - DNA, 18 bp, Homo sapiens
gccaattaaaatatatat

SEQ ID NO: 2838027 - DNA, 22 bp, Homo sapiens
gccaattaaaatatatataaat

SEQ ID NO: 2838028 - DNA, 19 bp, Homo sapiens
gccacacagagcctgcctc

SEQ ID NO: 2838029 - DNA, 17 bp, Homo sapiens
gccacacttctcaggac

SEQ ID NO: 2838030 - DNA, 14 bp, Homo sapiens
gccacagaccacct

SEQ ID NO: 2838031 - DNA, 22 bp, Homo sapiens
gccacagaccacctgcttctga

SEQ ID NO: 2838032 - DNA, 13 bp, Homo sapiens
gccacagagaaag

SEQ ID NO: 2838033 - DNA, 14 bp, Homo sapiens
gccacagagaaagt

SEQ ID NO: 2838034 - DNA, 15 bp, Homo sapiens
gccacatctgtgtct

SEQ ID NO: 2838035 - DNA, 23 bp, Homo sapiens
gccacatctgtgtctctggaacc

SEQ ID NO: 2838036 - DNA, 17 bp, Homo sapiens
gccaccaggatggccct

SEQ ID NO: 2838037 - DNA, 16 bp, Homo sapiens
gccaccaggtcatctc

SEQ ID NO: 2838038 - DNA, 22 bp, Homo sapiens
gccaccatattcagtgctgtgg

SEQ ID NO: 2838039 - DNA, 22 bp, Homo sapiens
gccacccaggcaggccctgcct

SEQ ID NO: 2838040 - DNA, 14 bp, Homo sapiens
gccaccctgaggag

SEQ ID NO: 2838041 - DNA, 22 bp, Homo sapiens
gccaccctgaggagtctgaggt

SEQ ID NO: 2838042 - DNA, 18 bp, Homo sapiens
gccaccgctctcctgcct

SEQ ID NO: 2838043 - DNA, 15 bp, Homo sapiens
gccacctcccctatc

SEQ ID NO: 2838044 - DNA, 17 bp, Homo sapiens
gccacctcttgggcatg

SEQ ID NO: 2838045 - DNA, 14 bp, Homo sapiens
gccacctgtctgtc

SEQ ID NO: 2838046 - DNA, 15 bp, Homo sapiens
gccacctgtctgtct

SEQ ID NO: 2838047 - DNA, 14 bp, Homo sapiens
gccaccttccagtg

SEQ ID NO: 2838048 - DNA, 17 bp, Homo sapiens
gccacggccaggccaga

SEQ ID NO: 2838049 - DNA, 16 bp, Homo sapiens
gccacgtgccaggccc

SEQ ID NO: 2838050 - DNA, 15 bp, Homo sapiens
gccacgttaagtcca

SEQ ID NO: 2838051 - DNA, 16 bp, Homo sapiens
gccacgttccttactg

SEQ ID NO: 2838052 - DNA, 22 bp, Homo sapiens
gccacgttccttactgcagaat

SEQ ID NO: 2838053 - DNA, 18 bp, Homo sapiens
gccactcatttcatctca

SEQ ID NO: 2838054 - DNA, 14 bp, Homo sapiens
gccactccttcctg

SEQ ID NO: 2838055 - DNA, 14 bp, Homo sapiens
gccactgaagctgg

SEQ ID NO: 2838056 - DNA, 21 bp, Homo sapiens
gcatcatgcctctgaggccag

SEQ ID NO: 2838057 - DNA, 13 bp, Homo sapiens
gcatcatggctat

SEQ ID NO: 2838058 - DNA, 12 bp, Homo sapiens
gcatccattcct

SEQ ID NO: 2838059 - DNA, 15 bp, Homo sapiens
gcatccattcctcag

SEQ ID NO: 2838060 - DNA, 21 bp, Homo sapiens
gcatccattcctcagggacag

SEQ ID NO: 2838061 - DNA, 15 bp, Homo sapiens
gcatcccaggggacc

SEQ ID NO: 2838062 - DNA, 19 bp, Homo sapiens
gcatcccaggggaccacac

SEQ ID NO: 2838063 - DNA, 18 bp, Homo sapiens
gcatccgtagttccctga

SEQ ID NO: 2838064 - DNA, 19 bp, Homo sapiens
gcatccgtagttccctgaa

SEQ ID NO: 2838065 - DNA, 13 bp, Homo sapiens
gcatcctggcacc

SEQ ID NO: 2838066 - DNA, 20 bp, Homo sapiens
gcatccttttctgcagaggg

SEQ ID NO: 2838067 - DNA, 14 bp, Homo sapiens
gcatctacacagcc

SEQ ID NO: 2838068 - DNA, 21 bp, Homo sapiens
gcatctagaggcttccttcat

SEQ ID NO: 2838069 - DNA, 16 bp, Homo sapiens
gcatctcttgaggcca

SEQ ID NO: 2838070 - DNA, 17 bp, Homo sapiens
gcatctcttgaggccag

SEQ ID NO: 2838071 - DNA, 18 bp, Homo sapiens
gcatctcttgaggccagg

SEQ ID NO: 2838072 - DNA, 19 bp, Homo sapiens
gcatctgactcacaagaag

SEQ ID NO: 2838073 - DNA, 14 bp, Homo sapiens
gcatctgctcttct

SEQ ID NO: 2838074 - DNA, 23 bp, Homo sapiens
gcatctgggattcccaccaaggt

SEQ ID NO: 2838075 - DNA, 20 bp, Homo sapiens
gcatctgtgtaacctccaca

SEQ ID NO: 2838076 - DNA, 13 bp, Homo sapiens
gcatcttctccat

SEQ ID NO: 2838077 - DNA, 20 bp, Homo sapiens
gcatcttctggagtctccag

SEQ ID NO: 2838078 - DNA, 13 bp, Homo sapiens
gcatgaaggtttc

SEQ ID NO: 2838079 - DNA, 21 bp, Homo sapiens
gcatgagggatcacagggccc

SEQ ID NO: 2838080 - DNA, 14 bp, Homo sapiens
gcatgatcttgtta

SEQ ID NO: 2838081 - DNA, 16 bp, Homo sapiens
gcatgatcttgttaat

SEQ ID NO: 2838082 - DNA, 17 bp, Homo sapiens
gcatgattttatacata

SEQ ID NO: 2838083 - DNA, 20 bp, Homo sapiens
gcatgcaccagtgccgcctg

SEQ ID NO: 2838084 - DNA, 21 bp, Homo sapiens
gcatgcaccagtgccgcctgt

SEQ ID NO: 2838085 - DNA, 21 bp, Homo sapiens
gcaagacttctctttgcctca

SEQ ID NO: 2838086 - DNA, 13 bp, Homo sapiens
gcaagagaacatt

SEQ ID NO: 2838087 - DNA, 20 bp, Homo sapiens
gcaagagaacatttctagaa

SEQ ID NO: 2838088 - DNA, 19 bp, Homo sapiens
gcaagagaattgcttgaac

SEQ ID NO: 2838089 - DNA, 15 bp, Homo sapiens
gcaagatatttatat

SEQ ID NO: 2838090 - DNA, 17 bp, Homo sapiens
gcaagatcttgtctcca

SEQ ID NO: 2838091 - DNA, 13 bp, Homo sapiens
gcaagattgctta

SEQ ID NO: 2838092 - DNA, 14 bp, Homo sapiens
gcaagattgcttaa

SEQ ID NO: 2838093 - DNA, 22 bp, Homo sapiens
gcaagattttccacaagattcc

SEQ ID NO: 2838094 - DNA, 16 bp, Homo sapiens
gcaagcacctcctgcc

SEQ ID NO: 2838095 - DNA, 18 bp, Homo sapiens
gcaagcattcagaagaaa

SEQ ID NO: 2838096 - DNA, 13 bp, Homo sapiens
gcaaggaaggaaa

SEQ ID NO: 2838097 - DNA, 22 bp, Homo sapiens
gcaaggactacgttaagggaag

SEQ ID NO: 2838098 - DNA, 19 bp, Homo sapiens
gcaaggcccgagcagctga

SEQ ID NO: 2838099 - DNA, 21 bp, Homo sapiens
gcaaggcccgagcagctgagc

SEQ ID NO: 2838100 - DNA, 23 bp, Homo sapiens
gcaaggcccgagcagctgagcag

SEQ ID NO: 2838101 - DNA, 24 bp, Homo sapiens
gcaaggcccgagcagctgagcagg

SEQ ID NO: 2838102 - DNA, 19 bp, Homo sapiens
gcaagggccatgctgaagg

SEQ ID NO: 2838103 - DNA, 22 bp, Homo sapiens
gcaaggtgaacaccactttgtc

SEQ ID NO: 2838104 - DNA, 19 bp, Homo sapiens
gcactgtgaagacccagca

SEQ ID NO: 2838105 - DNA, 16 bp, Homo sapiens
gcactgttacttttta

SEQ ID NO: 2838106 - DNA, 23 bp, Homo sapiens
gcacttattatgaggctattaaa

SEQ ID NO: 2838107 - DNA, 15 bp, Homo sapiens
gcacttgctggaaga

SEQ ID NO: 2838108 - DNA, 16 bp, Homo sapiens
gcacttggagccaagg

SEQ ID NO: 2838109 - DNA, 22 bp, Homo sapiens
gcacttggagccaagggttcag

SEQ ID NO: 2838110 - DNA, 20 bp, Homo sapiens
gcactttaaccctctcttcc

SEQ ID NO: 2838111 - DNA, 23 bp, Homo sapiens
gcactttaaccctctcttcccta

SEQ ID NO: 2838112 - DNA, 20 bp, Homo sapiens
gcactttgggaggctgaagt

SEQ ID NO: 2838113 - DNA, 18 bp, Homo sapiens
gcagaaaagcacctgccg

SEQ ID NO: 2838114 - DNA, 20 bp, Homo sapiens
gcagaaaagcacctgccgac

SEQ ID NO: 2838115 - DNA, 15 bp, Homo sapiens
gcagaaaagtgctta

SEQ ID NO: 2838116 - DNA, 21 bp, Homo sapiens
gcagaaaagtgcttagaaagt

SEQ ID NO: 2838117 - DNA, 18 bp, Homo sapiens
gcagaaagccagggtcct

SEQ ID NO: 2838118 - DNA, 21 bp, Homo sapiens
gcagaacagccgctcctgtct

SEQ ID NO: 2838119 - DNA, 15 bp, Homo sapiens
gcagaagggagaagg

SEQ ID NO: 2838120 - DNA, 18 bp, Homo sapiens
gcagacagcagctcaggc

SEQ ID NO: 2838121 - DNA, 19 bp, Homo sapiens
gcagacagcagctcaggca

SEQ ID NO: 2838122 - DNA, 12 bp, Homo sapiens
gcagacaggcaa

SEQ ID NO: 2838123 - DNA, 13 bp, Homo sapiens
gcagacaggcaag

SEQ ID NO: 2838124 - DNA, 23 bp, Homo sapiens
gcagacaggcaagcacctcctgc

SEQ ID NO: 2838125 - DNA, 14 bp, Homo sapiens
gcagaccctgccct

SEQ ID NO: 2838126 - DNA, 15 bp, Homo sapiens
gcagaccctgccctt

SEQ ID NO: 2838127 - DNA, 20 bp, Homo sapiens
gcagactcaataaaatcatg

SEQ ID NO: 2838128 - DNA, 16 bp, Homo sapiens
gcagactcagctctga

SEQ ID NO: 2838129 - DNA, 12 bp, Homo sapiens
gcagactgtggc

SEQ ID NO: 2838130 - DNA, 16 bp, Homo sapiens
gcagagaaagaagaga

SEQ ID NO: 2838131 - DNA, 23 bp, Homo sapiens
gcagagaaagaagagacaggagg

SEQ ID NO: 2838132 - DNA, 13 bp, Homo sapiens
gcagagaaggctt

SEQ ID NO: 2838133 - DNA, 17 bp, Homo sapiens
gcagagaaggcttcctc

SEQ ID NO: 2838134 - DNA, 21 bp, Homo sapiens
gcagagaatgaaagggcccag

SEQ ID NO: 2838135 - DNA, 19 bp, Homo sapiens
gcagagacaataaaacatt

SEQ ID NO: 2838136 - DNA, 21 bp, Homo sapiens
gcagagacaataaaacattcc

SEQ ID NO: 2838137 - DNA, 14 bp, Homo sapiens
gcagagagaagcct

SEQ ID NO: 2838138 - DNA, 22 bp, Homo sapiens
gcagagagcaggacaggagaca

SEQ ID NO: 2838139 - DNA, 19 bp, Homo sapiens
gcagagaggtggagaactg

SEQ ID NO: 2838140 - DNA, 20 bp, Homo sapiens
gcagagcaggggcagggtga

SEQ ID NO: 2838141 - DNA, 17 bp, Homo sapiens
gcagaggagtccagggc

SEQ ID NO: 2838142 - DNA, 18 bp, Homo sapiens
gcagaggattgaggctta

SEQ ID NO: 2838143 - DNA, 18 bp, Homo sapiens
gcagaggggctttctgga

SEQ ID NO: 2838144 - DNA, 15 bp, Homo sapiens
gcagaggtgagcaga

SEQ ID NO: 2838145 - DNA, 22 bp, Homo sapiens
gcagatgagcagtcacactgtt

SEQ ID NO: 2838146 - DNA, 16 bp, Homo sapiens
gcagatgtaggaggga

SEQ ID NO: 2838147 - DNA, 17 bp, Homo sapiens
gcagatgtaggagggac

SEQ ID NO: 2838148 - DNA, 23 bp, Homo sapiens
gcagatttagtgaaagctagaga

SEQ ID NO: 2838149 - DNA, 16 bp, Homo sapiens
gcagcaaggcccgagc

SEQ ID NO: 2838150 - DNA, 17 bp, Homo sapiens
gcagcaaggcccgagca

SEQ ID NO: 2838151 - DNA, 22 bp, Homo sapiens
gcagcaaggcccgagcagctga

SEQ ID NO: 2838152 - DNA, 11 bp, Homo sapiens
gcagcacttta

SEQ ID NO: 2838153 - DNA, 16 bp, Homo sapiens
gcagcagctcagcctc

SEQ ID NO: 2838154 - DNA, 20 bp, Homo sapiens
gcagcaggtggcagaatggg

SEQ ID NO: 2838155 - DNA, 21 bp, Homo sapiens
gcagcatcttcaaacatgtac

SEQ ID NO: 2838156 - DNA, 19 bp, Homo sapiens
gcagcatgtggggaagcaa

SEQ ID NO: 2838157 - DNA, 18 bp, Homo sapiens
gcagccaaacagagcctt

SEQ ID NO: 2838158 - DNA, 21 bp, Homo sapiens
gcagccaaacccatgaggcaa

SEQ ID NO: 2838159 - DNA, 19 bp, Homo sapiens
gcagccacacttctcagga

SEQ ID NO: 2838160 - DNA, 14 bp, Homo sapiens
gcagccaccctgag

SEQ ID NO: 2838161 - DNA, 17 bp, Homo sapiens
gcagccaccctgaggag

SEQ ID NO: 2838162 - DNA, 20 bp, Homo sapiens
gcagccaccctgaggagtct

SEQ ID NO: 2838163 - DNA, 21 bp, Homo sapiens
gcagccaccctgaggagtctg

SEQ ID NO: 2838164 - DNA, 11 bp, Homo sapiens
gcagccagccc

SEQ ID NO: 2838165 - DNA, 16 bp, Homo sapiens
gcagccagcccagccc

SEQ ID NO: 2838166 - DNA, 21 bp, Homo sapiens
gcagccagcccagcccagctg

SEQ ID NO: 2838167 - DNA, 23 bp, Homo sapiens
gcagccagcccagcccagctggt

SEQ ID NO: 2838168 - DNA, 24 bp, Homo sapiens
gaggcctcttggacctctgctctg

SEQ ID NO: 2838169 - DNA, 14 bp, Homo sapiens
gaggcctggccagg

SEQ ID NO: 2838170 - DNA, 15 bp, Homo sapiens
gaggccttgagaggc

SEQ ID NO: 2838171 - DNA, 17 bp, Homo sapiens
gaggcgacttcctctcc

SEQ ID NO: 2838172 - DNA, 20 bp, Homo sapiens
gaggcgacttcctctccagc

SEQ ID NO: 2838173 - DNA, 22 bp, Homo sapiens
gaggcgccccaacccgtggagg

SEQ ID NO: 2838174 - DNA, 14 bp, Homo sapiens
gaggcggaagaatc

SEQ ID NO: 2838175 - DNA, 12 bp, Homo sapiens
gaggcgggtgga

SEQ ID NO: 2838176 - DNA, 19 bp, Homo sapiens
gaggcgggtggatcacttg

SEQ ID NO: 2838177 - DNA, 20 bp, Homo sapiens
gaggcggtttccaggaagag

SEQ ID NO: 2838178 - DNA, 14 bp, Homo sapiens
gaggcgtcttgtat

SEQ ID NO: 2838179 - DNA, 20 bp, Homo sapiens
gaggctattattttcactgt

SEQ ID NO: 2838180 - DNA, 16 bp, Homo sapiens
gaggctctttctgggc

SEQ ID NO: 2838181 - DNA, 12 bp, Homo sapiens
gaggctgaggca

SEQ ID NO: 2838182 - DNA, 16 bp, Homo sapiens
gaggctgaggcaagag

SEQ ID NO: 2838183 - DNA, 17 bp, Homo sapiens
gaggctgaggcaggagg

SEQ ID NO: 2838184 - DNA, 16 bp, Homo sapiens
gaggctgcagcgagct

SEQ ID NO: 2838185 - DNA, 15 bp, Homo sapiens
gaggctgcaggactt

SEQ ID NO: 2838186 - DNA, 14 bp, Homo sapiens
gaggctgcagtcag

SEQ ID NO: 2838187 - DNA, 13 bp, Homo sapiens
gaggctgctcggg

SEQ ID NO: 2838188 - DNA, 21 bp, Homo sapiens
gaggctgctcggggtgcacag

SEQ ID NO: 2838189 - DNA, 15 bp, Homo sapiens
gaggctggaggcagg

SEQ ID NO: 2838190 - DNA, 12 bp, Homo sapiens
gaggctggggga

SEQ ID NO: 2838191 - DNA, 13 bp, Homo sapiens
gaggctggtctcc

SEQ ID NO: 2838192 - DNA, 19 bp, Homo sapiens
gaggcttaattctgagctg

SEQ ID NO: 2838193 - DNA, 21 bp, Homo sapiens
gaggcttccagagagtcctct

SEQ ID NO: 2838194 - DNA, 14 bp, Homo sapiens
gaggcttccttcat

SEQ ID NO: 2838195 - DNA, 17 bp, Homo sapiens
gagggacaaaggagcct

SEQ ID NO: 2838196 - DNA, 18 bp, Homo sapiens
gagggacaaaggagcctg

SEQ ID NO: 2838197 - DNA, 21 bp, Homo sapiens
gagggacaaaggagcctgtga

SEQ ID NO: 2838198 - DNA, 16 bp, Homo sapiens
gagggacgaagaaagg

SEQ ID NO: 2838199 - DNA, 15 bp, Homo sapiens
gagggactgtcgctg

SEQ ID NO: 2838200 - DNA, 13 bp, Homo sapiens
gagggagtgacag

SEQ ID NO: 2838201 - DNA, 22 bp, Homo sapiens
gagggagtgacagaggcagccc

SEQ ID NO: 2838202 - DNA, 23 bp, Homo sapiens
gagggatcacagggccccagaag

SEQ ID NO: 2838203 - DNA, 15 bp, Homo sapiens
gagggcagaggctgg

SEQ ID NO: 2838204 - DNA, 17 bp, Homo sapiens
gagggcagcagccagcc

SEQ ID NO: 2838205 - DNA, 21 bp, Homo sapiens
gagggcagcagccagccctgc

SEQ ID NO: 2838206 - DNA, 22 bp, Homo sapiens
gagggcagcagccagccctgcc

SEQ ID NO: 2838207 - DNA, 21 bp, Homo sapiens
gagggcaggtgccctctgctc

SEQ ID NO: 2838208 - DNA, 20 bp, Homo sapiens
gagggcagttcgcagccacc

SEQ ID NO: 2838209 - DNA, 22 bp, Homo sapiens
gagggcatgcgcacaaggctga

SEQ ID NO: 2838210 - DNA, 19 bp, Homo sapiens
gagggcctgtgggagcctg

SEQ ID NO: 2838211 - DNA, 20 bp, Homo sapiens
gagggcgtgactcacccaag

SEQ ID NO: 2838212 - DNA, 15 bp, Homo sapiens
gagggctctgaggcg

SEQ ID NO: 2838213 - DNA, 12 bp, Homo sapiens
gaggggaacaga

SEQ ID NO: 2838214 - DNA, 19 bp, Homo sapiens
gaggggaataatagaagaa

SEQ ID NO: 2838215 - DNA, 22 bp, Homo sapiens
gaggggactatttatgaaggca

SEQ ID NO: 2838216 - DNA, 18 bp, Homo sapiens
gaggggtaggcagagcct

SEQ ID NO: 2838217 - DNA, 15 bp, Homo sapiens
gagggtctggagaag

SEQ ID NO: 2838218 - DNA, 24 bp, Homo sapiens
gagggtctggagaagcagtgagcc

SEQ ID NO: 2838219 - DNA, 15 bp, Homo sapiens
gagggtgagaggaag

SEQ ID NO: 2838220 - DNA, 20 bp, Homo sapiens
gagggtgagaggaagggtgg

SEQ ID NO: 2838221 - DNA, 21 bp, Homo sapiens
gagggtggtgacctctgcctg

SEQ ID NO: 2838222 - DNA, 18 bp, Homo sapiens
gagggtgtatctagctct

SEQ ID NO: 2838223 - DNA, 15 bp, Homo sapiens
gagggttgggctggt

SEQ ID NO: 2838224 - DNA, 19 bp, Homo sapiens
gaggtagagtttgaaggag

SEQ ID NO: 2838225 - DNA, 15 bp, Homo sapiens
gaggtagctcccagc

SEQ ID NO: 2838226 - DNA, 16 bp, Homo sapiens
gaggtcaacagagaag

SEQ ID NO: 2838227 - DNA, 16 bp, Homo sapiens
gaggtcacattcagga

SEQ ID NO: 2838228 - DNA, 12 bp, Homo sapiens
gaggtcagagcc

SEQ ID NO: 2838229 - DNA, 20 bp, Homo sapiens
gaggtcagagcctgcagtta

SEQ ID NO: 2838230 - DNA, 21 bp, Homo sapiens
gaggtcctgagcactgccagg

SEQ ID NO: 2838231 - DNA, 22 bp, Homo sapiens
gaggtcgaccccaaagcccctt

SEQ ID NO: 2838232 - DNA, 20 bp, Homo sapiens
gaggtcgggagttcgagacc

SEQ ID NO: 2838233 - DNA, 14 bp, Homo sapiens
gaggtctgaaatgg

SEQ ID NO: 2838234 - DNA, 16 bp, Homo sapiens
gaggtcttggccgact

SEQ ID NO: 2838235 - DNA, 18 bp, Homo sapiens
gaggtgaccccagggcac

SEQ ID NO: 2838236 - DNA, 16 bp, Homo sapiens
gaggtgagaccacctc

SEQ ID NO: 2838237 - DNA, 15 bp, Homo sapiens
gaggtgcccaggaga

SEQ ID NO: 2838238 - DNA, 18 bp, Homo sapiens
gaggtgggcagcagctca

SEQ ID NO: 2838239 - DNA, 22 bp, Homo sapiens
gaggttaggagttcgagaccag

SEQ ID NO: 2838240 - DNA, 19 bp, Homo sapiens
gaggttgcagtgagctgag

SEQ ID NO: 2838241 - DNA, 16 bp, Homo sapiens
gagtaatatgcctgct

SEQ ID NO: 2838242 - DNA, 20 bp, Homo sapiens
gagtactagaatttgtattt

SEQ ID NO: 2838243 - DNA, 20 bp, Homo sapiens
gagtagaaagacagagctgg

SEQ ID NO: 2838244 - DNA, 19 bp, Homo sapiens
gagtctcactgttgcccag

SEQ ID NO: 2838245 - DNA, 21 bp, Homo sapiens
gagtctcactgttgcccaggc

SEQ ID NO: 2838246 - DNA, 15 bp, Homo sapiens
gagtctcctctctga

SEQ ID NO: 2838247 - DNA, 20 bp, Homo sapiens
gagtctcctctctgagactg

SEQ ID NO: 2838248 - DNA, 13 bp, Homo sapiens
gagtctgaggtcc

SEQ ID NO: 2838249 - DNA, 17 bp, Homo sapiens
gagtctgaggtcctgag

SEQ ID NO: 2838250 - DNA, 18 bp, Homo sapiens
gagtctgaggtcctgagc

SEQ ID NO: 2838251 - DNA, 19 bp, Homo sapiens
gagtctgaggtcctgagca

SEQ ID NO: 2838252 - DNA, 12 bp, Homo sapiens
gagtctgtctca

SEQ ID NO: 2838253 - DNA, 22 bp, Homo sapiens
gagtgacacccaagagggctgc

SEQ ID NO: 2838254 - DNA, 16 bp, Homo sapiens
gagtgacagaggcagc

SEQ ID NO: 2838255 - DNA, 17 bp, Homo sapiens
gagtgacagaggcagcc

SEQ ID NO: 2838256 - DNA, 18 bp, Homo sapiens
gagtgacagaggcagccc

SEQ ID NO: 2838257 - DNA, 23 bp, Homo sapiens
gagtgagaataattgtgtacaaa

SEQ ID NO: 2838258 - DNA, 18 bp, Homo sapiens
gagtgagactctgtctca

SEQ ID NO: 2838259 - DNA, 22 bp, Homo sapiens
gagtgatacaacttcaagtgca

SEQ ID NO: 2838260 - DNA, 18 bp, Homo sapiens
gagtgcagtgagccgaga

SEQ ID NO: 2838261 - DNA, 12 bp, Homo sapiens
gagtgccaggac

SEQ ID NO: 2838262 - DNA, 14 bp, Homo sapiens
gagtgccaggactc

SEQ ID NO: 2838263 - DNA, 22 bp, Homo sapiens
gagtgccaggactccccaggcc

SEQ ID NO: 2838264 - DNA, 16 bp, Homo sapiens
gagtggatctccaagg

SEQ ID NO: 2838265 - DNA, 21 bp, Homo sapiens
gagtggccggggaagctggca

SEQ ID NO: 2838266 - DNA, 17 bp, Homo sapiens
gagtgtgtttgtcaccg

SEQ ID NO: 2838267 - DNA, 18 bp, Homo sapiens
gagttacagcgagaggca

SEQ ID NO: 2838268 - DNA, 19 bp, Homo sapiens
gagttacagcgagaggcag

SEQ ID NO: 2838269 - DNA, 13 bp, Homo sapiens
gagttataaaaat

SEQ ID NO: 2838270 - DNA, 22 bp, Homo sapiens
gagttcaataaatgtctgttga

SEQ ID NO: 2838271 - DNA, 21 bp, Homo sapiens
gagttcgagaccagcctggcc

SEQ ID NO: 2838272 - DNA, 19 bp, Homo sapiens
gagttcgaggctgcagtca

SEQ ID NO: 2838273 - DNA, 22 bp, Homo sapiens
gagttgagtctcctctctgaga

SEQ ID NO: 2838274 - DNA, 14 bp, Homo sapiens
gagttgcttttcta

SEQ ID NO: 2838275 - DNA, 16 bp, Homo sapiens
gagttgttttcagact

SEQ ID NO: 2838276 - DNA, 16 bp, Homo sapiens
gagtttaagtctctga

SEQ ID NO: 2838277 - DNA, 14 bp, Homo sapiens
gataaagtgaccag

SEQ ID NO: 2838278 - DNA, 12 bp, Homo sapiens
gataaattataa

SEQ ID NO: 2838279 - DNA, 13 bp, Homo sapiens
gataaattataag

SEQ ID NO: 2838280 - DNA, 16 bp, Homo sapiens
gataaattccactgga

SEQ ID NO: 2838281 - DNA, 18 bp, Homo sapiens
gataacaaaatcacaagc

SEQ ID NO: 2838282 - DNA, 15 bp, Homo sapiens
gataacaagatcttt

SEQ ID NO: 2838283 - DNA, 22 bp, Homo sapiens
gataacctgtacttcaagttaa

SEQ ID NO: 2838284 - DNA, 20 bp, Homo sapiens
gataactgaaaattatttaa

SEQ ID NO: 2838285 - DNA, 13 bp, Homo sapiens
gataatcagcctc

SEQ ID NO: 2838286 - DNA, 15 bp, Homo sapiens
gataatcagcctctt

SEQ ID NO: 2838287 - DNA, 13 bp, Homo sapiens
gataatgaacaga

SEQ ID NO: 2838288 - DNA, 16 bp, Homo sapiens
gataatgtcaaaatca

SEQ ID NO: 2838289 - DNA, 16 bp, Homo sapiens
gataatttattttgta

SEQ ID NO: 2838290 - DNA, 20 bp, Homo sapiens
gatacaacttcaagtgcatg

SEQ ID NO: 2838291 - DNA, 15 bp, Homo sapiens
gatacagaatgaatc

SEQ ID NO: 2838292 - DNA, 19 bp, Homo sapiens
gatacaggaaaagctgctg

SEQ ID NO: 2838293 - DNA, 20 bp, Homo sapiens
gatacccatagcttccatga

SEQ ID NO: 2838294 - DNA, 13 bp, Homo sapiens
gataccttgaaaa

SEQ ID NO: 2838295 - DNA, 16 bp, Homo sapiens
gataccttgaaaaagt

SEQ ID NO: 2838296 - DNA, 19 bp, Homo sapiens
gatactggaagttttgcat

SEQ ID NO: 2838297 - DNA, 20 bp, Homo sapiens
gatactgggtacaagagcca

SEQ ID NO: 2838298 - DNA, 20 bp, Homo sapiens
gatacttaagtgctgcaatt

SEQ ID NO: 2838299 - DNA, 22 bp, Homo sapiens
gatagattttctgctactttgc

SEQ ID NO: 2838300 - DNA, 16 bp, Homo sapiens
gatatatctgaaaact

SEQ ID NO: 2838301 - DNA, 22 bp, Homo sapiens
gatatatgtatttattgtcatt

SEQ ID NO: 2838302 - DNA, 15 bp, Homo sapiens
gatatatttttcaca

SEQ ID NO: 2838303 - DNA, 16 bp, Homo sapiens
gatatgtaaaacattt

SEQ ID NO: 2838304 - DNA, 17 bp, Homo sapiens
gatatgttgttaaacac

SEQ ID NO: 2838305 - DNA, 22 bp, Homo sapiens
gatattcctattgtgcaatgta

SEQ ID NO: 2838306 - DNA, 19 bp, Homo sapiens
gatatttatggggggagaa

SEQ ID NO: 2838307 - DNA, 20 bp, Homo sapiens
gatattttcttccaagcaaa

SEQ ID NO: 2838308 - DNA, 16 bp, Homo sapiens
gatcaaagttcctgtt

SEQ ID NO: 2838309 - DNA, 23 bp, Homo sapiens
gatcaaccccttcgctcctgtgt

SEQ ID NO: 2838310 - DNA, 13 bp, Homo sapiens
gatcacgccactg

SEQ ID NO: 2838311 - DNA, 15 bp, Homo sapiens
gatcacgccactgca

SEQ ID NO: 2838312 - DNA, 23 bp, Homo sapiens
gatcacgccactgcactccagcc

SEQ ID NO: 2838313 - DNA, 12 bp, Homo sapiens
gatcacggctca

SEQ ID NO: 2838314 - DNA, 18 bp, Homo sapiens
gatcacggctcactgcag

SEQ ID NO: 2838315 - DNA, 15 bp, Homo sapiens
gatcagaacagcaga

SEQ ID NO: 2838316 - DNA, 22 bp, Homo sapiens
gatcagtctgattcccaagctc

SEQ ID NO: 2838317 - DNA, 22 bp, Homo sapiens
gatcagtttcacaaagtttgtt

SEQ ID NO: 2838318 - DNA, 14 bp, Homo sapiens
gatccttttatgtt

SEQ ID NO: 2838319 - DNA, 23 bp, Homo sapiens
gatcgcgccactacactccagcc

SEQ ID NO: 2838320 - DNA, 16 bp, Homo sapiens
gatcgctggcagagaa

SEQ ID NO: 2838321 - DNA, 19 bp, Homo sapiens
gatcgctttgtactttgtg

SEQ ID NO: 2838322 - DNA, 19 bp, Homo sapiens
gatctaaatagcccttgga

SEQ ID NO: 2838323 - DNA, 17 bp, Homo sapiens
gatctaagcctttccat

SEQ ID NO: 2838324 - DNA, 16 bp, Homo sapiens
gatctatcaatagtca

SEQ ID NO: 2838325 - DNA, 20 bp, Homo sapiens
gatctccaaggaccaggtta

SEQ ID NO: 2838326 - DNA, 20 bp, Homo sapiens
gatctccctgccgcctcaat

SEQ ID NO: 2838327 - DNA, 13 bp, Homo sapiens
gatctcctgtaat

SEQ ID NO: 2838328 - DNA, 15 bp, Homo sapiens
gatctgtactgtaat

SEQ ID NO: 2838329 - DNA, 17 bp, Homo sapiens
gatctgtactgtaattt

SEQ ID NO: 2838330 - DNA, 20 bp, Homo sapiens
gatctgtatatacaataaca

SEQ ID NO: 2838331 - DNA, 19 bp, Homo sapiens
gatctgtttttaaaaatca

SEQ ID NO: 2838332 - DNA, 14 bp, Homo sapiens
gatcttcagagcag

SEQ ID NO: 2838333 - DNA, 16 bp, Homo sapiens
gatcttgtctccacta

SEQ ID NO: 2838334 - DNA, 16 bp, Homo sapiens
gatcttgttaatgcat

SEQ ID NO: 2838335 - DNA, 21 bp, Homo sapiens
gatgaagagtgagagggcatg

SEQ ID NO: 2838336 - DNA, 23 bp, Homo sapiens
gatgaatgaggtcccaggcagag

SEQ ID NO: 2838337 - DNA, 13 bp, Homo sapiens
gatgacagctctt

SEQ ID NO: 2838338 - DNA, 21 bp, Homo sapiens
gatgacagctcttctaaggaa

SEQ ID NO: 2838339 - DNA, 12 bp, Homo sapiens
gatgacagtgct

SEQ ID NO: 2838340 - DNA, 18 bp, Homo sapiens
gatgaccaatctctgtga

SEQ ID NO: 2838341 - DNA, 12 bp, Homo sapiens
gatgactaaaat

SEQ ID NO: 2838342 - DNA, 15 bp, Homo sapiens
gatgactagaggcag

SEQ ID NO: 2838343 - DNA, 12 bp, Homo sapiens
gatgactgagtc

SEQ ID NO: 2838344 - DNA, 18 bp, Homo sapiens
gatgagaagttaagcagc

SEQ ID NO: 2838345 - DNA, 17 bp, Homo sapiens
gatgagagagtgctgag

SEQ ID NO: 2838346 - DNA, 20 bp, Homo sapiens
gatgagcagtcacactgtta

SEQ ID NO: 2838347 - DNA, 23 bp, Homo sapiens
gatgaggcctcttggacctctgc

SEQ ID NO: 2838348 - DNA, 12 bp, Homo sapiens
gatgagggcagc

SEQ ID NO: 2838349 - DNA, 13 bp, Homo sapiens
gatgagggcagca

SEQ ID NO: 2838350 - DNA, 16 bp, Homo sapiens
gatgagggcagcagcc

SEQ ID NO: 2838351 - DNA, 18 bp, Homo sapiens
gatgagggcagcagccag

SEQ ID NO: 2838352 - DNA, 21 bp, Homo sapiens
gatgagggcagcagccagccc

SEQ ID NO: 2838353 - DNA, 19 bp, Homo sapiens
gatgatcagctgtttgtca

SEQ ID NO: 2838354 - DNA, 17 bp, Homo sapiens
gatgattaaacacctga

SEQ ID NO: 2838355 - DNA, 19 bp, Homo sapiens
gatgattaaacacctgaca

SEQ ID NO: 2838356 - DNA, 17 bp, Homo sapiens
gatgcaagatatttata

SEQ ID NO: 2838357 - DNA, 16 bp, Homo sapiens
gatgcagcattatgat

SEQ ID NO: 2838358 - DNA, 20 bp, Homo sapiens
gatgcatcagaaagggaggg

SEQ ID NO: 2838359 - DNA, 22 bp, Homo sapiens
gatgcccagagggcccaggcag

SEQ ID NO: 2838360 - DNA, 17 bp, Homo sapiens
gatgccgctcttctgtc

SEQ ID NO: 2838361 - DNA, 20 bp, Homo sapiens
gatgccgctcttctgtcatc

SEQ ID NO: 2838362 - DNA, 16 bp, Homo sapiens
gatgcctccaccgctg

SEQ ID NO: 2838363 - DNA, 20 bp, Homo sapiens
gatgcctccaccgctgccta

SEQ ID NO: 2838364 - DNA, 14 bp, Homo sapiens
gatgcctggtggca

SEQ ID NO: 2838365 - DNA, 21 bp, Homo sapiens
gatgctcaggcttgaaatgca

SEQ ID NO: 2838366 - DNA, 12 bp, Homo sapiens
gatgctgcctga

SEQ ID NO: 2838367 - DNA, 16 bp, Homo sapiens
gatggagagaggggaa

SEQ ID NO: 2838368 - DNA, 20 bp, Homo sapiens
gatggagccagctctgcatt

SEQ ID NO: 2838369 - DNA, 22 bp, Homo sapiens
gatggagcgcacctgccccctg

SEQ ID NO: 2838370 - DNA, 13 bp, Homo sapiens
gatggaggagaag

SEQ ID NO: 2838371 - DNA, 14 bp, Homo sapiens
gatggcaccagagg

SEQ ID NO: 2838372 - DNA, 22 bp, Homo sapiens
gatggcttagttaagtcatcca

SEQ ID NO: 2838373 - DNA, 15 bp, Homo sapiens
gatgggagtgagaca

SEQ ID NO: 2838374 - DNA, 16 bp, Homo sapiens
gatgggcccaattctt

SEQ ID NO: 2838375 - DNA, 18 bp, Homo sapiens
gatgggcttgttttcttg

SEQ ID NO: 2838376 - DNA, 18 bp, Homo sapiens
gatggggtgggcagggct

SEQ ID NO: 2838377 - DNA, 19 bp, Homo sapiens
gatggggtgggcagggctg

SEQ ID NO: 2838378 - DNA, 15 bp, Homo sapiens
gatggtctcacagag

SEQ ID NO: 2838379 - DNA, 21 bp, Homo sapiens
gatggtggtgagcacatctgg

SEQ ID NO: 2838380 - DNA, 20 bp, Homo sapiens
gatgtaaacagtgcctgctg

SEQ ID NO: 2838381 - DNA, 23 bp, Homo sapiens
gatgtaaggtaatttctgtgtat

SEQ ID NO: 2838382 - DNA, 19 bp, Homo sapiens
gatgtaccatgttaaagag

SEQ ID NO: 2838383 - DNA, 22 bp, Homo sapiens
gatgtcccatctgctcctccca

SEQ ID NO: 2838384 - DNA, 17 bp, Homo sapiens
gatgtgagtgtgtgtga

SEQ ID NO: 2838385 - DNA, 20 bp, Homo sapiens
gatgtgcacggcagcttgag

SEQ ID NO: 2838386 - DNA, 11 bp, Homo sapiens
gatgtgcattc

SEQ ID NO: 2838387 - DNA, 19 bp, Homo sapiens
gatgtgcccacagggacca

SEQ ID NO: 2838388 - DNA, 14 bp, Homo sapiens
gatgtggccctggc

SEQ ID NO: 2838389 - DNA, 14 bp, Homo sapiens
gatgttctgggaca

SEQ ID NO: 2838390 - DNA, 17 bp, Homo sapiens
gatgtttccagaaaata

SEQ ID NO: 2838391 - DNA, 20 bp, Homo sapiens
gatgtttccagaaaatataa

SEQ ID NO: 2838392 - DNA, 22 bp, Homo sapiens
gatgtttccagaaaatataaat

SEQ ID NO: 2838393 - DNA, 20 bp, Homo sapiens
gatgttttgtcccatttcct

SEQ ID NO: 2838394 - DNA, 15 bp, Homo sapiens
gattaattaaatgca

SEQ ID NO: 2838395 - DNA, 20 bp, Homo sapiens
gattagactggacagcttgt

SEQ ID NO: 2838396 - DNA, 15 bp, Homo sapiens
gattatgggtcctgc

SEQ ID NO: 2838397 - DNA, 16 bp, Homo sapiens
gattcaaactgctcca

SEQ ID NO: 2838398 - DNA, 15 bp, Homo sapiens
gattcacatctcatt

SEQ ID NO: 2838399 - DNA, 21 bp, Homo sapiens
gattcaggaaaaggcctgggg

SEQ ID NO: 2838400 - DNA, 21 bp, Homo sapiens
gattcatgccaattagcaatt

SEQ ID NO: 2838401 - DNA, 16 bp, Homo sapiens
gattcccaccaaggtc

SEQ ID NO: 2838402 - DNA, 20 bp, Homo sapiens
gattccctctcccaggcccc

SEQ ID NO: 2838403 - DNA, 14 bp, Homo sapiens
gattccctcttcct

SEQ ID NO: 2838404 - DNA, 15 bp, Homo sapiens
gattctcctgcctca

SEQ ID NO: 2838405 - DNA, 17 bp, Homo sapiens
gattctcctgcctcagc

SEQ ID NO: 2838406 - DNA, 15 bp, Homo sapiens
gattctgggaggaag

SEQ ID NO: 2838407 - DNA, 14 bp, Homo sapiens
gattcttccatctg

SEQ ID NO: 2838408 - DNA, 15 bp, Homo sapiens
gcacgaacccacctg

SEQ ID NO: 2838409 - DNA, 19 bp, Homo sapiens
gcacgaacccacctgctga

SEQ ID NO: 2838410 - DNA, 18 bp, Homo sapiens
gcacgcctgcccagcctc

SEQ ID NO: 2838411 - DNA, 20 bp, Homo sapiens
gcacgcggagtgagtttttt

SEQ ID NO: 2838412 - DNA, 14 bp, Homo sapiens
gcacggcagcttga

SEQ ID NO: 2838413 - DNA, 14 bp, Homo sapiens
gcacgtcccatgtg

SEQ ID NO: 2838414 - DNA, 20 bp, Homo sapiens
gcacgtttggcatttctctt

SEQ ID NO: 2838415 - DNA, 19 bp, Homo sapiens
gcactaatttgatgtttac

SEQ ID NO: 2838416 - DNA, 22 bp, Homo sapiens
gcactatagcctaggtgacaga

SEQ ID NO: 2838417 - DNA, 20 bp, Homo sapiens
gcactcacccatgtgccaag

SEQ ID NO: 2838418 - DNA, 16 bp, Homo sapiens
gcactcagaagacact

SEQ ID NO: 2838419 - DNA, 15 bp, Homo sapiens
gcactccagcctggg

SEQ ID NO: 2838420 - DNA, 14 bp, Homo sapiens
gcactccagtctgg

SEQ ID NO: 2838421 - DNA, 18 bp, Homo sapiens
gcactcctctgtctctgc

SEQ ID NO: 2838422 - DNA, 24 bp, Homo sapiens
gcactctctaaatcttccttgtga

SEQ ID NO: 2838423 - DNA, 13 bp, Homo sapiens
gcactgccaggag

SEQ ID NO: 2838424 - DNA, 14 bp, Homo sapiens
gcactgccaggagg

SEQ ID NO: 2838425 - DNA, 18 bp, Homo sapiens
gcactgccaggagggaca

SEQ ID NO: 2838426 - DNA, 14 bp, Homo sapiens
gcactggagtgcag

SEQ ID NO: 2838427 - DNA, 15 bp, Homo sapiens
gcactggagtgcagg

SEQ ID NO: 2838428 - DNA, 14 bp, Homo sapiens
gcactggccccacc

SEQ ID NO: 2838429 - DNA, 19 bp, Homo sapiens
ctgtaattaagtaaaccaa

SEQ ID NO: 2838430 - DNA, 19 bp, Homo sapiens
ctgtaattggtgacaatgt

SEQ ID NO: 2838431 - DNA, 18 bp, Homo sapiens
ctgtaattttgtttgtaa

SEQ ID NO: 2838432 - DNA, 21 bp, Homo sapiens
ctgtaattttgtttgtaatcc

SEQ ID NO: 2838433 - DNA, 22 bp, Homo sapiens
ctgtaattttgtttgtaatcct

SEQ ID NO: 2838434 - DNA, 16 bp, Homo sapiens
ctgtacacgtgtcctg

SEQ ID NO: 2838435 - DNA, 17 bp, Homo sapiens
ctgtacacgtgtcctgt

SEQ ID NO: 2838436 - DNA, 19 bp, Homo sapiens
ctgtacgtctgacaggcaa

SEQ ID NO: 2838437 - DNA, 20 bp, Homo sapiens
ctgtacgtctgacaggcaat

SEQ ID NO: 2838438 - DNA, 12 bp, Homo sapiens
ctgtactgcctg

SEQ ID NO: 2838439 - DNA, 15 bp, Homo sapiens
ctgtactgcctgctt

SEQ ID NO: 2838440 - DNA, 17 bp, Homo sapiens
ctgtacttgatgacaga

SEQ ID NO: 2838441 - DNA, 15 bp, Homo sapiens
ctgtagcatcttctg

SEQ ID NO: 2838442 - DNA, 20 bp, Homo sapiens
ctgtagcatcttctggagtc

SEQ ID NO: 2838443 - DNA, 15 bp, Homo sapiens
ctgtagggctggacc

SEQ ID NO: 2838444 - DNA, 21 bp, Homo sapiens
ctgtagggctggacctatgtc

SEQ ID NO: 2838445 - DNA, 17 bp, Homo sapiens
ctgtagtgagaaactga

SEQ ID NO: 2838446 - DNA, 18 bp, Homo sapiens
ctgtagtgagaaactgat

SEQ ID NO: 2838447 - DNA, 13 bp, Homo sapiens
ctgtagttaggaa

SEQ ID NO: 2838448 - DNA, 14 bp, Homo sapiens
ctgtagttaggaaa

SEQ ID NO: 2838449 - DNA, 22 bp, Homo sapiens
ctgtagttaggaaataaaacct

SEQ ID NO: 2838450 - DNA, 15 bp, Homo sapiens
ctgtatagtactggc

SEQ ID NO: 2838451 - DNA, 15 bp, Homo sapiens
ctgtatatacaataa

SEQ ID NO: 2838452 - DNA, 16 bp, Homo sapiens
ctgtatattatggtgt

SEQ ID NO: 2838453 - DNA, 18 bp, Homo sapiens
ctgtatcccatgagcctc

SEQ ID NO: 2838454 - DNA, 19 bp, Homo sapiens
ctgtatcccatgagcctca

SEQ ID NO: 2838455 - DNA, 21 bp, Homo sapiens
ctgtatcccatgagcctcagc

SEQ ID NO: 2838456 - DNA, 12 bp, Homo sapiens
ctgtattcagat

SEQ ID NO: 2838457 - DNA, 16 bp, Homo sapiens
ctgtatttgttcccaa

SEQ ID NO: 2838458 - DNA, 19 bp, Homo sapiens
ctgtattttcatttaacta

SEQ ID NO: 2838459 - DNA, 16 bp, Homo sapiens
ctgtattttgccagac

SEQ ID NO: 2838460 - DNA, 19 bp, Homo sapiens
ctgtcacgcagccaccagg

SEQ ID NO: 2838461 - DNA, 16 bp, Homo sapiens
ctgtcacgtgaaatat

SEQ ID NO: 2838462 - DNA, 22 bp, Homo sapiens
ctgtcagatgggaagacatgaa

SEQ ID NO: 2838463 - DNA, 16 bp, Homo sapiens
ctgtcatagaaattac

SEQ ID NO: 2838464 - DNA, 14 bp, Homo sapiens
ctgtcatccagaaa

SEQ ID NO: 2838465 - DNA, 18 bp, Homo sapiens
ctgtcatcccgctcctgc

SEQ ID NO: 2838466 - DNA, 21 bp, Homo sapiens
ctgtcatcccgctcctgctga

SEQ ID NO: 2838467 - DNA, 22 bp, Homo sapiens
ctgtcatttgagcagggctcag

SEQ ID NO: 2838468 - DNA, 23 bp, Homo sapiens
ctgtcatttgagcagggctcagc

SEQ ID NO: 2838469 - DNA, 16 bp, Homo sapiens
ctgtccaacctaaccc

SEQ ID NO: 2838470 - DNA, 11 bp, Homo sapiens
ctgtccaagga

SEQ ID NO: 2838471 - DNA, 18 bp, Homo sapiens
ctgtccaggcactgctgc

SEQ ID NO: 2838472 - DNA, 20 bp, Homo sapiens
ctgtccaggcactgctgccc

SEQ ID NO: 2838473 - DNA, 21 bp, Homo sapiens
ctgtccaggcactgctgccca

SEQ ID NO: 2838474 - DNA, 22 bp, Homo sapiens
ctgtccagggccctgagctcgg

SEQ ID NO: 2838475 - DNA, 16 bp, Homo sapiens
ctgtccagtttccaaa

SEQ ID NO: 2838476 - DNA, 14 bp, Homo sapiens
ctgtccataaagta

SEQ ID NO: 2838477 - DNA, 15 bp, Homo sapiens
ctgtcccacctcttc

SEQ ID NO: 2838478 - DNA, 22 bp, Homo sapiens
ctgtcccccttggaggagggct

SEQ ID NO: 2838479 - DNA, 22 bp, Homo sapiens
ctgtccctctttgcctgtgtga

SEQ ID NO: 2838480 - DNA, 18 bp, Homo sapiens
ctgtccgtttactccaag

SEQ ID NO: 2838481 - DNA, 14 bp, Homo sapiens
ctgtcctacccacc

SEQ ID NO: 2838482 - DNA, 13 bp, Homo sapiens
ctgtcctccagct

SEQ ID NO: 2838483 - DNA, 14 bp, Homo sapiens
ctgtcctccagctt

SEQ ID NO: 2838484 - DNA, 19 bp, Homo sapiens
ctgtcctccagcttcccct

SEQ ID NO: 2838485 - DNA, 13 bp, Homo sapiens
ctgtcctgggagt

SEQ ID NO: 2838486 - DNA, 14 bp, Homo sapiens
ctgtcctgggagtg

SEQ ID NO: 2838487 - DNA, 20 bp, Homo sapiens
ctgtcctgggagtgagctgg

SEQ ID NO: 2838488 - DNA, 13 bp, Homo sapiens
ctgtcgagacact

SEQ ID NO: 2838489 - DNA, 16 bp, Homo sapiens
ctgtcgcccagtctgg

SEQ ID NO: 2838490 - DNA, 14 bp, Homo sapiens
ctgtcgctgcttcg

SEQ ID NO: 2838491 - DNA, 19 bp, Homo sapiens
ctgtcgtgtttacaaaagg

SEQ ID NO: 2838492 - DNA, 13 bp, Homo sapiens
ctgtctaaaaaac

SEQ ID NO: 2838493 - DNA, 16 bp, Homo sapiens
ctgtctcgagcgccct

SEQ ID NO: 2838494 - DNA, 17 bp, Homo sapiens
ctgtctcgagcgccctg

SEQ ID NO: 2838495 - DNA, 22 bp, Homo sapiens
ctgtctcgagcgccctgcagac

SEQ ID NO: 2838496 - DNA, 17 bp, Homo sapiens
ctgtctctcatgaacct

SEQ ID NO: 2838497 - DNA, 16 bp, Homo sapiens
ctgtctctgctcttgc

SEQ ID NO: 2838498 - DNA, 18 bp, Homo sapiens
ctgtctctgctcttgcct

SEQ ID NO: 2838499 - DNA, 12 bp, Homo sapiens
ctgtctctgtcc

SEQ ID NO: 2838500 - DNA, 19 bp, Homo sapiens
ctgtctctgtccctcactg

SEQ ID NO: 2838501 - DNA, 15 bp, Homo sapiens
ctgtctgccagccag

SEQ ID NO: 2838502 - DNA, 15 bp, Homo sapiens
ctgtctgtctgtccc

SEQ ID NO: 2838503 - DNA, 16 bp, Homo sapiens
ctgtctgtctgtccca

SEQ ID NO: 2838504 - DNA, 19 bp, Homo sapiens
ctgtcttatggcgttgcag

SEQ ID NO: 2838505 - DNA, 22 bp, Homo sapiens
gagaattgtgcgacttcacaaa

SEQ ID NO: 2838506 - DNA, 22 bp, Homo sapiens
gagacaaacacctcccaggaga

SEQ ID NO: 2838507 - DNA, 16 bp, Homo sapiens
gagacaataaaacatt

SEQ ID NO: 2838508 - DNA, 13 bp, Homo sapiens
gagacacctgcac

SEQ ID NO: 2838509 - DNA, 20 bp, Homo sapiens
gagacacctgcacctccccc

SEQ ID NO: 2838510 - DNA, 19 bp, Homo sapiens
gagacacgtgtggcgggca

SEQ ID NO: 2838511 - DNA, 17 bp, Homo sapiens
gagacacttgccttctt

SEQ ID NO: 2838512 - DNA, 19 bp, Homo sapiens
gagacaggaaaatcctctg

SEQ ID NO: 2838513 - DNA, 20 bp, Homo sapiens
gagacaggaaaatcctctgg

SEQ ID NO: 2838514 - DNA, 15 bp, Homo sapiens
gagacaggagggcaa

SEQ ID NO: 2838515 - DNA, 22 bp, Homo sapiens
gagacagggttttgccatgttg

SEQ ID NO: 2838516 - DNA, 17 bp, Homo sapiens
gagacagtgatctccat

SEQ ID NO: 2838517 - DNA, 16 bp, Homo sapiens
gagacagttcaagaaa

SEQ ID NO: 2838518 - DNA, 17 bp, Homo sapiens
gagaccaacctgaccaa

SEQ ID NO: 2838519 - DNA, 18 bp, Homo sapiens
gagaccaaggcgggagca

SEQ ID NO: 2838520 - DNA, 12 bp, Homo sapiens
gagaccacctct

SEQ ID NO: 2838521 - DNA, 13 bp, Homo sapiens
gagaccagcctgg

SEQ ID NO: 2838522 - DNA, 14 bp, Homo sapiens
gagaccagcctggc

SEQ ID NO: 2838523 - DNA, 16 bp, Homo sapiens
gagaccagcctggcca

SEQ ID NO: 2838524 - DNA, 12 bp, Homo sapiens
gagaccagctca

SEQ ID NO: 2838525 - DNA, 15 bp, Homo sapiens
gagaccagctcagag

SEQ ID NO: 2838526 - DNA, 21 bp, Homo sapiens
gagaccagctcagaggcccag

SEQ ID NO: 2838527 - DNA, 23 bp, Homo sapiens
gagaccagttgggagcactggag

SEQ ID NO: 2838528 - DNA, 22 bp, Homo sapiens
gagacccagatctcatggaaac

SEQ ID NO: 2838529 - DNA, 13 bp, Homo sapiens
gagacctcagcca

SEQ ID NO: 2838530 - DNA, 15 bp, Homo sapiens
gagacctcagccatg

SEQ ID NO: 2838531 - DNA, 19 bp, Homo sapiens
gagacctgacaagcactgc

SEQ ID NO: 2838532 - DNA, 16 bp, Homo sapiens
gagacggagtcccacc

SEQ ID NO: 2838533 - DNA, 22 bp, Homo sapiens
gagactaagccctgtcgagaca

SEQ ID NO: 2838534 - DNA, 14 bp, Homo sapiens
gagactatgtgtca

SEQ ID NO: 2838535 - DNA, 15 bp, Homo sapiens
gagactatgtgtcat

SEQ ID NO: 2838536 - DNA, 16 bp, Homo sapiens
gagactcacctctgcc

SEQ ID NO: 2838537 - DNA, 19 bp, Homo sapiens
gagactcacctctgcctca

SEQ ID NO: 2838538 - DNA, 13 bp, Homo sapiens
gagactctgtctc

SEQ ID NO: 2838539 - DNA, 16 bp, Homo sapiens
gagactggagcatctg

SEQ ID NO: 2838540 - DNA, 20 bp, Homo sapiens
gagacttccaaacctgacag

SEQ ID NO: 2838541 - DNA, 11 bp, Homo sapiens
gagagaaagaa

SEQ ID NO: 2838542 - DNA, 15 bp, Homo sapiens
gagagacccaaggag

SEQ ID NO: 2838543 - DNA, 12 bp, Homo sapiens
gagagaggggaa

SEQ ID NO: 2838544 - DNA, 16 bp, Homo sapiens
gagagaggtgggcagc

SEQ ID NO: 2838545 - DNA, 17 bp, Homo sapiens
gagagaggtgggcagca

SEQ ID NO: 2838546 - DNA, 16 bp, Homo sapiens
gagagagttgaaccta

SEQ ID NO: 2838547 - DNA, 14 bp, Homo sapiens
gagagagtttatca

SEQ ID NO: 2838548 - DNA, 12 bp, Homo sapiens
gagagccagccc

SEQ ID NO: 2838549 - DNA, 14 bp, Homo sapiens
gagagccagctctc

SEQ ID NO: 2838550 - DNA, 11 bp, Homo sapiens
gagagcccagc

SEQ ID NO: 2838551 - DNA, 16 bp, Homo sapiens
gagagcccttcatttg

SEQ ID NO: 2838552 - DNA, 14 bp, Homo sapiens
gagagcctgctccc

SEQ ID NO: 2838553 - DNA, 23 bp, Homo sapiens
gagagctttctgtccttttggca

SEQ ID NO: 2838554 - DNA, 14 bp, Homo sapiens
gagaggaagggtgg

SEQ ID NO: 2838555 - DNA, 19 bp, Homo sapiens
gagaggaatgcctgtgtga

SEQ ID NO: 2838556 - DNA, 22 bp, Homo sapiens
gagaggcagacttccctgaatg

SEQ ID NO: 2838557 - DNA, 14 bp, Homo sapiens
gagaggcatggctg

SEQ ID NO: 2838558 - DNA, 24 bp, Homo sapiens
gagaggccctggatcagcgtggcc

SEQ ID NO: 2838559 - DNA, 21 bp, Homo sapiens
gagagggcatgcgcacaaggc

SEQ ID NO: 2838560 - DNA, 12 bp, Homo sapiens
gacacaggcctg

SEQ ID NO: 2838561 - DNA, 13 bp, Homo sapiens
gacacaggcctgt

SEQ ID NO: 2838562 - DNA, 14 bp, Homo sapiens
gacacaggcctgtg

SEQ ID NO: 2838563 - DNA, 20 bp, Homo sapiens
gacaccaaattccaaacttc

SEQ ID NO: 2838564 - DNA, 21 bp, Homo sapiens
gacacccaccccctctttgtg

SEQ ID NO: 2838565 - DNA, 17 bp, Homo sapiens
gacaccccttatccagg

SEQ ID NO: 2838566 - DNA, 13 bp, Homo sapiens
gacacctcactga

SEQ ID NO: 2838567 - DNA, 9 bp, Homo sapiens
gacacctgc

SEQ ID NO: 2838568 - DNA, 13 bp, Homo sapiens
gacacctgcacct

SEQ ID NO: 2838569 - DNA, 16 bp, Homo sapiens
gacacctgcacctccc

SEQ ID NO: 2838570 - DNA, 19 bp, Homo sapiens
gacacctgcacctcccccc

SEQ ID NO: 2838571 - DNA, 13 bp, Homo sapiens
gacacctgccctg

SEQ ID NO: 2838572 - DNA, 14 bp, Homo sapiens
gacacctgccctgc

SEQ ID NO: 2838573 - DNA, 16 bp, Homo sapiens
gacacctgccctgccc

SEQ ID NO: 2838574 - DNA, 21 bp, Homo sapiens
gacacctggccgcctccagga

SEQ ID NO: 2838575 - DNA, 12 bp, Homo sapiens
gacacctgtgca

SEQ ID NO: 2838576 - DNA, 15 bp, Homo sapiens
gacaccttgacaggg

SEQ ID NO: 2838577 - DNA, 18 bp, Homo sapiens
gacaccttgacagggcac

SEQ ID NO: 2838578 - DNA, 17 bp, Homo sapiens
gacactaagttatagta

SEQ ID NO: 2838579 - DNA, 15 bp, Homo sapiens
gacacttgccttctt

SEQ ID NO: 2838580 - DNA, 15 bp, Homo sapiens
gacagaacactgtct

SEQ ID NO: 2838581 - DNA, 20 bp, Homo sapiens
gacagaactgaacgtcctgc

SEQ ID NO: 2838582 - DNA, 14 bp, Homo sapiens
gacagacacaggcc

SEQ ID NO: 2838583 - DNA, 15 bp, Homo sapiens
gacagacacaggccc

SEQ ID NO: 2838584 - DNA, 17 bp, Homo sapiens
gacagacacaggcccgg

SEQ ID NO: 2838585 - DNA, 22 bp, Homo sapiens
gacagacacaggcccggctcca

SEQ ID NO: 2838586 - DNA, 15 bp, Homo sapiens
gacagacctggacac

SEQ ID NO: 2838587 - DNA, 16 bp, Homo sapiens
gacagaggcagcccca

SEQ ID NO: 2838588 - DNA, 16 bp, Homo sapiens
gacagagtgagactct

SEQ ID NO: 2838589 - DNA, 21 bp, Homo sapiens
gacagagttcactataaatgg

SEQ ID NO: 2838590 - DNA, 18 bp, Homo sapiens
gacagcaacctgtagagt

SEQ ID NO: 2838591 - DNA, 18 bp, Homo sapiens
gacagcagctcaggcaca

SEQ ID NO: 2838592 - DNA, 21 bp, Homo sapiens
gacagccacggccaggccaga

SEQ ID NO: 2838593 - DNA, 20 bp, Homo sapiens
gacagcctgtggcggtgcct

SEQ ID NO: 2838594 - DNA, 22 bp, Homo sapiens
gacagcctgtggcggtgcctgg

SEQ ID NO: 2838595 - DNA, 14 bp, Homo sapiens
gacagcggggaagg

SEQ ID NO: 2838596 - DNA, 11 bp, Homo sapiens
gacagctcctt

SEQ ID NO: 2838597 - DNA, 17 bp, Homo sapiens
gacagctccttctgtcc

SEQ ID NO: 2838598 - DNA, 19 bp, Homo sapiens
gacagctccttctgtccta

SEQ ID NO: 2838599 - DNA, 18 bp, Homo sapiens
gacaggaaaatcctctgg

SEQ ID NO: 2838600 - DNA, 19 bp, Homo sapiens
gacaggaaaatcctctggc

SEQ ID NO: 2838601 - DNA, 14 bp, Homo sapiens
gacaggacagtgct

SEQ ID NO: 2838602 - DNA, 13 bp, Homo sapiens
gacaggacctgac

SEQ ID NO: 2838603 - DNA, 22 bp, Homo sapiens
gacaggactaacactcagaagc

SEQ ID NO: 2838604 - DNA, 16 bp, Homo sapiens
gacaggcaatgctggc

SEQ ID NO: 2838605 - DNA, 18 bp, Homo sapiens
gacaggcaatgctggctg

SEQ ID NO: 2838606 - DNA, 19 bp, Homo sapiens
gacaggcaatgctggctgt

SEQ ID NO: 2838607 - DNA, 15 bp, Homo sapiens
gacaggcccaagaga

SEQ ID NO: 2838608 - DNA, 16 bp, Homo sapiens
gacagggaggtgaccc

SEQ ID NO: 2838609 - DNA, 15 bp, Homo sapiens
gacaggtctagactt

SEQ ID NO: 2838610 - DNA, 14 bp, Homo sapiens
gacagtcctgggag

SEQ ID NO: 2838611 - DNA, 17 bp, Homo sapiens
gacagtgcttcagcctg

SEQ ID NO: 2838612 - DNA, 18 bp, Homo sapiens
gacagtgcttcagcctga

SEQ ID NO: 2838613 - DNA, 19 bp, Homo sapiens
gacagtgcttcagcctgag

SEQ ID NO: 2838614 - DNA, 21 bp, Homo sapiens
gacagttactcttcagtttta

SEQ ID NO: 2838615 - DNA, 21 bp, Homo sapiens
gacagttatactgtcggtttt

SEQ ID NO: 2838616 - DNA, 14 bp, Homo sapiens
gacagttcaagaaa

SEQ ID NO: 2838617 - DNA, 19 bp, Homo sapiens
gacataaagttgataaaga

SEQ ID NO: 2838618 - DNA, 20 bp, Homo sapiens
gacataaagttgataaagat

SEQ ID NO: 2838619 - DNA, 22 bp, Homo sapiens
gacataaagttgataaagattt

SEQ ID NO: 2838620 - DNA, 15 bp, Homo sapiens
gacatcacttgtaca

SEQ ID NO: 2838621 - DNA, 16 bp, Homo sapiens
gacatccgttgtgctt

SEQ ID NO: 2838622 - DNA, 16 bp, Homo sapiens
gacatgaatgcacact

SEQ ID NO: 2838623 - DNA, 16 bp, Homo sapiens
gacatgcagctctgat

SEQ ID NO: 2838624 - DNA, 14 bp, Homo sapiens
gacatgtggtggga

SEQ ID NO: 2838625 - DNA, 22 bp, Homo sapiens
gacatgtggtgggacagggacc

SEQ ID NO: 2838626 - DNA, 21 bp, Homo sapiens
gacattaactcattagactgg

SEQ ID NO: 2838627 - DNA, 23 bp, Homo sapiens
gacattgcggacagccacggcca

SEQ ID NO: 2838628 - DNA, 11 bp, Homo sapiens
gacatttccct

SEQ ID NO: 2838629 - DNA, 14 bp, Homo sapiens
gacatttccctcct

SEQ ID NO: 2838630 - DNA, 18 bp, Homo sapiens
gacattttctctttaaaa

SEQ ID NO: 2838631 - DNA, 19 bp, Homo sapiens
gaccaaaagttacatgttt

SEQ ID NO: 2838632 - DNA, 16 bp, Homo sapiens
gaccaaccctgtttcc

SEQ ID NO: 2838633 - DNA, 17 bp, Homo sapiens
gaccaaccctgtttcct

SEQ ID NO: 2838634 - DNA, 13 bp, Homo sapiens
gaccaacctgacc

SEQ ID NO: 2838635 - DNA, 10 bp, Homo sapiens
gaccaagaat

SEQ ID NO: 2838636 - DNA, 14 bp, Homo sapiens
gaccaagagagaaa

SEQ ID NO: 2838637 - DNA, 15 bp, Homo sapiens
gaccaagagagaaag

SEQ ID NO: 2838638 - DNA, 13 bp, Homo sapiens
gaccaatctctgt

SEQ ID NO: 2838639 - DNA, 14 bp, Homo sapiens
gaccaatctctgtg

SEQ ID NO: 2838640 - DNA, 12 bp, Homo sapiens
gaccacacctcc

SEQ ID NO: 2838641 - DNA, 16 bp, Homo sapiens
gaccacctgcttctga

SEQ ID NO: 2838642 - DNA, 17 bp, Homo sapiens
gaccacctgcttctgaa

SEQ ID NO: 2838643 - DNA, 20 bp, Homo sapiens
gaccacggacgtttccatca

SEQ ID NO: 2838644 - DNA, 22 bp, Homo sapiens
gaccacggacgtttccatcagg

SEQ ID NO: 2838645 - DNA, 23 bp, Homo sapiens
gaccagacaccttgacagggcac

SEQ ID NO: 2838646 - DNA, 21 bp, Homo sapiens
gaccagagccccacacggagg

SEQ ID NO: 2838647 - DNA, 21 bp, Homo sapiens
gaccagcctccatgctgcctc

SEQ ID NO: 2838648 - DNA, 11 bp, Homo sapiens
gaccagcctgg

SEQ ID NO: 2838649 - DNA, 17 bp, Homo sapiens
gaccagcctgggcagca

SEQ ID NO: 2838650 - DNA, 21 bp, Homo sapiens
gaccaggttattttaaaaaga

SEQ ID NO: 2838651 - DNA, 20 bp, Homo sapiens
gaaaagtgcttagaaagtta

SEQ ID NO: 2838652 - DNA, 21 bp, Homo sapiens
gaaaagtgcttagaaagttat

SEQ ID NO: 2838653 - DNA, 12 bp, Homo sapiens
gaaaagttcata

SEQ ID NO: 2838654 - DNA, 19 bp, Homo sapiens
gaaaatagctctttcaggg

SEQ ID NO: 2838655 - DNA, 13 bp, Homo sapiens
gaaaatataaatg

SEQ ID NO: 2838656 - DNA, 18 bp, Homo sapiens
gaaaatataaatgcatga

SEQ ID NO: 2838657 - DNA, 14 bp, Homo sapiens
gaaaatcctctggc

SEQ ID NO: 2838658 - DNA, 15 bp, Homo sapiens
gaaaatcctctggct

SEQ ID NO: 2838659 - DNA, 22 bp, Homo sapiens
gaaaatgtcagaaaccagttat

SEQ ID NO: 2838660 - DNA, 22 bp, Homo sapiens
gaaaattaggatttcatgattt

SEQ ID NO: 2838661 - DNA, 14 bp, Homo sapiens
gaaacacaatattt

SEQ ID NO: 2838662 - DNA, 14 bp, Homo sapiens
gaaacagaaacaaa

SEQ ID NO: 2838663 - DNA, 17 bp, Homo sapiens
gaaacaggggatcaaag

SEQ ID NO: 2838664 - DNA, 15 bp, Homo sapiens
gaaacatggttttga

SEQ ID NO: 2838665 - DNA, 19 bp, Homo sapiens
gaaacatttacaataaata

SEQ ID NO: 2838666 - DNA, 15 bp, Homo sapiens
gaaacatttatggaa

SEQ ID NO: 2838667 - DNA, 15 bp, Homo sapiens
gaaacccaccagcct

SEQ ID NO: 2838668 - DNA, 23 bp, Homo sapiens
gaaacgaacccactgtgcttaca

SEQ ID NO: 2838669 - DNA, 20 bp, Homo sapiens
gaaactcaccatgtaaaaga

SEQ ID NO: 2838670 - DNA, 22 bp, Homo sapiens
gaaactccgtcttagaagtgga

SEQ ID NO: 2838671 - DNA, 18 bp, Homo sapiens
gaaactgaaaactgtaaa

SEQ ID NO: 2838672 - DNA, 18 bp, Homo sapiens
gaaactgaggaattttct

SEQ ID NO: 2838673 - DNA, 18 bp, Homo sapiens
gaaacttttttatttaaa

SEQ ID NO: 2838674 - DNA, 20 bp, Homo sapiens
gaaagaaacgtacttaactg

SEQ ID NO: 2838675 - DNA, 15 bp, Homo sapiens
gaaagaaagaaggaa

SEQ ID NO: 2838676 - DNA, 13 bp, Homo sapiens
gaaagaattattt

SEQ ID NO: 2838677 - DNA, 16 bp, Homo sapiens
gaaagacagagctggg

SEQ ID NO: 2838678 - DNA, 21 bp, Homo sapiens
gaaagaggtgaccccagggca

SEQ ID NO: 2838679 - DNA, 20 bp, Homo sapiens
gaaagcaccgcagcatgtgg

SEQ ID NO: 2838680 - DNA, 17 bp, Homo sapiens
gaaagcatcacctcagg

SEQ ID NO: 2838681 - DNA, 21 bp, Homo sapiens
gaaagcatgtggcatgttcat

SEQ ID NO: 2838682 - DNA, 18 bp, Homo sapiens
gaaagccccagcactaac

SEQ ID NO: 2838683 - DNA, 15 bp, Homo sapiens
gaaagcctctgctgc

SEQ ID NO: 2838684 - DNA, 19 bp, Homo sapiens
gaaaggctcagtctcagga

SEQ ID NO: 2838685 - DNA, 19 bp, Homo sapiens
gaaagggacttggaagctc

SEQ ID NO: 2838686 - DNA, 15 bp, Homo sapiens
gaaagggagggctct

SEQ ID NO: 2838687 - DNA, 17 bp, Homo sapiens
gaaagggagggctctga

SEQ ID NO: 2838688 - DNA, 21 bp, Homo sapiens
gaaagggagggctctgaggcg

SEQ ID NO: 2838689 - DNA, 17 bp, Homo sapiens
gaaagggcaagaaggaa

SEQ ID NO: 2838690 - DNA, 16 bp, Homo sapiens
gaaagggcccagagag

SEQ ID NO: 2838691 - DNA, 21 bp, Homo sapiens
gaaagtacttctccaccctgc

SEQ ID NO: 2838692 - DNA, 22 bp, Homo sapiens
gaaagtacttctccaccctgct

SEQ ID NO: 2838693 - DNA, 20 bp, Homo sapiens
gaaagtgaataaacttcagc

SEQ ID NO: 2838694 - DNA, 22 bp, Homo sapiens
gaaagtgaataaacttcagcac

SEQ ID NO: 2838695 - DNA, 14 bp, Homo sapiens
gaaagtgacagaga

SEQ ID NO: 2838696 - DNA, 16 bp, Homo sapiens
gaaagtgacagagacc

SEQ ID NO: 2838697 - DNA, 21 bp, Homo sapiens
gaaagtggccatgccaccctg

SEQ ID NO: 2838698 - DNA, 14 bp, Homo sapiens
gaaagttattgtgt

SEQ ID NO: 2838699 - DNA, 14 bp, Homo sapiens
gaaataaaaccttt

SEQ ID NO: 2838700 - DNA, 15 bp, Homo sapiens
gaaataaaacctttc

SEQ ID NO: 2838701 - DNA, 14 bp, Homo sapiens
gaaataaattggtg

SEQ ID NO: 2838702 - DNA, 19 bp, Homo sapiens
gaaatacacaagtaaacat

SEQ ID NO: 2838703 - DNA, 19 bp, Homo sapiens
gaaatagacagtatattta

SEQ ID NO: 2838704 - DNA, 15 bp, Homo sapiens
gaaatataatgcaaa

SEQ ID NO: 2838705 - DNA, 22 bp, Homo sapiens
gaaatatcagttactcagccct

SEQ ID NO: 2838706 - DNA, 17 bp, Homo sapiens
gaaatatgcacaatagc

SEQ ID NO: 2838707 - DNA, 19 bp, Homo sapiens
gaaatatttaagtatatag

SEQ ID NO: 2838708 - DNA, 15 bp, Homo sapiens
gaaatatttgcttat

SEQ ID NO: 2838709 - DNA, 16 bp, Homo sapiens
gaaatcagttgtgttt

SEQ ID NO: 2838710 - DNA, 19 bp, Homo sapiens
gaaatccagtttcccacca

SEQ ID NO: 2838711 - DNA, 13 bp, Homo sapiens
gaaatcctgttac

SEQ ID NO: 2838712 - DNA, 14 bp, Homo sapiens
gaaatcctgttact

SEQ ID NO: 2838713 - DNA, 17 bp, Homo sapiens
gaaatgaatttatctga

SEQ ID NO: 2838714 - DNA, 23 bp, Homo sapiens
gaaatgcatccattcctcaggga

SEQ ID NO: 2838715 - DNA, 20 bp, Homo sapiens
gaaatggaatcagcttttaa

SEQ ID NO: 2838716 - DNA, 15 bp, Homo sapiens
gaaatggagaagctc

SEQ ID NO: 2838717 - DNA, 17 bp, Homo sapiens
gaaatgggctttaacaa

SEQ ID NO: 2838718 - DNA, 22 bp, Homo sapiens
gaaatgttattttttaattatt

SEQ ID NO: 2838719 - DNA, 13 bp, Homo sapiens
gaaattatatctg

SEQ ID NO: 2838720 - DNA, 15 bp, Homo sapiens
gaaattcctgtagca

SEQ ID NO: 2838721 - DNA, 14 bp, Homo sapiens
gaaatttaaactat

SEQ ID NO: 2838722 - DNA, 22 bp, Homo sapiens
gaaattttactgacagaaatgc

SEQ ID NO: 2838723 - DNA, 15 bp, Homo sapiens
gaacaaatggccttt

SEQ ID NO: 2838724 - DNA, 20 bp, Homo sapiens
gaacaatagctattgcatgt

SEQ ID NO: 2838725 - DNA, 15 bp, Homo sapiens
gaacaatgtcagaaa

SEQ ID NO: 2838726 - DNA, 15 bp, Homo sapiens
gaacacccggaaaga

SEQ ID NO: 2838727 - DNA, 16 bp, Homo sapiens
gaacacccggaaagac

SEQ ID NO: 2838728 - DNA, 17 bp, Homo sapiens
gaacacccggaaagact

SEQ ID NO: 2838729 - DNA, 16 bp, Homo sapiens
gaacacggcctactga

SEQ ID NO: 2838730 - DNA, 18 bp, Homo sapiens
gaacactgggggagggga

SEQ ID NO: 2838731 - DNA, 19 bp, Homo sapiens
gaacagacaacagaagtca

SEQ ID NO: 2838732 - DNA, 15 bp, Homo sapiens
gaacagacaggagaa

SEQ ID NO: 2838733 - DNA, 18 bp, Homo sapiens
gaacagacaggagaaatg

SEQ ID NO: 2838734 - DNA, 15 bp, Homo sapiens
gaacagactggaagc

SEQ ID NO: 2838735 - DNA, 19 bp, Homo sapiens
gaacagactggaagcacag

SEQ ID NO: 2838736 - DNA, 14 bp, Homo sapiens
gaacagagtatata

SEQ ID NO: 2838737 - DNA, 23 bp, Homo sapiens
gaacagccaaatgcatggtgcag

SEQ ID NO: 2838738 - DNA, 12 bp, Homo sapiens
gaacagtaaaca

SEQ ID NO: 2838739 - DNA, 18 bp, Homo sapiens
gaacagtgtttcccataa

SEQ ID NO: 2838740 - DNA, 23 bp, Homo sapiens
gaacatccaaggagaaacagaga

SEQ ID NO: 2838741 - DNA, 21 bp, Homo sapiens
gaacatctcactttgccccag

SEQ ID NO: 2838742 - DNA, 22 bp, Homo sapiens
gaagcctgttttgttggaaggt

SEQ ID NO: 2838743 - DNA, 14 bp, Homo sapiens
gaagctaacaggga

SEQ ID NO: 2838744 - DNA, 16 bp, Homo sapiens
gaagctaacagggaag

SEQ ID NO: 2838745 - DNA, 19 bp, Homo sapiens
gaagctattgatgtttcca

SEQ ID NO: 2838746 - DNA, 19 bp, Homo sapiens
gaagctccgctttctaccc

SEQ ID NO: 2838747 - DNA, 13 bp, Homo sapiens
gaagctctgaagt

SEQ ID NO: 2838748 - DNA, 16 bp, Homo sapiens
gaagctctgaagtcac

SEQ ID NO: 2838749 - DNA, 20 bp, Homo sapiens
gaagctctgaagtcacatca

SEQ ID NO: 2838750 - DNA, 22 bp, Homo sapiens
gaagctctgtttataaaaacaa

SEQ ID NO: 2838751 - DNA, 17 bp, Homo sapiens
gaagctgatgctttgct

SEQ ID NO: 2838752 - DNA, 16 bp, Homo sapiens
gaagctgccctgccca

SEQ ID NO: 2838753 - DNA, 21 bp, Homo sapiens
gaagctggcagcactcagtga

SEQ ID NO: 2838754 - DNA, 20 bp, Homo sapiens
gaagctgtgtccttgcacct

SEQ ID NO: 2838755 - DNA, 20 bp, Homo sapiens
gaaggaactctggcttccag

SEQ ID NO: 2838756 - DNA, 22 bp, Homo sapiens
gaaggaactctggcttccaggt

SEQ ID NO: 2838757 - DNA, 22 bp, Homo sapiens
gaaggaataaattgctccttga

SEQ ID NO: 2838758 - DNA, 20 bp, Homo sapiens
gaaggacattgcggacagcc

SEQ ID NO: 2838759 - DNA, 21 bp, Homo sapiens
gaaggacattgcggacagcca

SEQ ID NO: 2838760 - DNA, 18 bp, Homo sapiens
gaaggaccctggctcttc

SEQ ID NO: 2838761 - DNA, 17 bp, Homo sapiens
gaaggagaaggaaggag

SEQ ID NO: 2838762 - DNA, 17 bp, Homo sapiens
gaaggagactcacctct

SEQ ID NO: 2838763 - DNA, 20 bp, Homo sapiens
gaaggagactcacctctgcc

SEQ ID NO: 2838764 - DNA, 13 bp, Homo sapiens
gaaggagatcagg

SEQ ID NO: 2838765 - DNA, 22 bp, Homo sapiens
gaaggatctgtttttaaaaatc

SEQ ID NO: 2838766 - DNA, 18 bp, Homo sapiens
gaaggcacaggtgtaaat

SEQ ID NO: 2838767 - DNA, 19 bp, Homo sapiens
gaaggcacaggtgtaaata

SEQ ID NO: 2838768 - DNA, 13 bp, Homo sapiens
gaaggcaggcagg

SEQ ID NO: 2838769 - DNA, 14 bp, Homo sapiens
gaaggcaggcaggg

SEQ ID NO: 2838770 - DNA, 15 bp, Homo sapiens
gaaggcaggcagggc

SEQ ID NO: 2838771 - DNA, 19 bp, Homo sapiens
gaaggcaggcagggctctc

SEQ ID NO: 2838772 - DNA, 13 bp, Homo sapiens
gaaggcagggaaa

SEQ ID NO: 2838773 - DNA, 20 bp, Homo sapiens
gaaggccgctgccccagccc

SEQ ID NO: 2838774 - DNA, 19 bp, Homo sapiens
gaaggctacttcggggctg

SEQ ID NO: 2838775 - DNA, 14 bp, Homo sapiens
gaaggcttcctcca

SEQ ID NO: 2838776 - DNA, 16 bp, Homo sapiens
gaaggcttcctccagc

SEQ ID NO: 2838777 - DNA, 17 bp, Homo sapiens
gaagggaataaggtaca

SEQ ID NO: 2838778 - DNA, 20 bp, Homo sapiens
gaagggaccttgaagggtaa

SEQ ID NO: 2838779 - DNA, 10 bp, Homo sapiens
gaagggccag

SEQ ID NO: 2838780 - DNA, 11 bp, Homo sapiens
gaagggccagt

SEQ ID NO: 2838781 - DNA, 14 bp, Homo sapiens
gaagggccagtctg

SEQ ID NO: 2838782 - DNA, 18 bp, Homo sapiens
cccttgagacctcagcca

SEQ ID NO: 2838783 - DNA, 19 bp, Homo sapiens
cccttgagacctcagccat

SEQ ID NO: 2838784 - DNA, 20 bp, Homo sapiens
cccttgagacctcagccatg

SEQ ID NO: 2838785 - DNA, 15 bp, Homo sapiens
cccttgccagacatg

SEQ ID NO: 2838786 - DNA, 19 bp, Homo sapiens
cccttgcccagggctcagc

SEQ ID NO: 2838787 - DNA, 13 bp, Homo sapiens
cccttgccctgac

SEQ ID NO: 2838788 - DNA, 15 bp, Homo sapiens
cccttgccctgacct

SEQ ID NO: 2838789 - DNA, 19 bp, Homo sapiens
cccttgccctgacctccca

SEQ ID NO: 2838790 - DNA, 16 bp, Homo sapiens
cccttgcccttgccct

SEQ ID NO: 2838791 - DNA, 18 bp, Homo sapiens
cccttgcccttgccctga

SEQ ID NO: 2838792 - DNA, 15 bp, Homo sapiens
cccttggaggagggc

SEQ ID NO: 2838793 - DNA, 20 bp, Homo sapiens
cccttggcgggcagcccagc

SEQ ID NO: 2838794 - DNA, 21 bp, Homo sapiens
cccttggcgggcagcccagcc

SEQ ID NO: 2838795 - DNA, 15 bp, Homo sapiens
cccttggctcaatcc

SEQ ID NO: 2838796 - DNA, 23 bp, Homo sapiens
cccttgtacctatggctgcctgc

SEQ ID NO: 2838797 - DNA, 20 bp, Homo sapiens
cccttgtttggggcaggagt

SEQ ID NO: 2838798 - DNA, 13 bp, Homo sapiens
ccctttcctcccc

SEQ ID NO: 2838799 - DNA, 19 bp, Homo sapiens
ccgaaagggacttggaagc

SEQ ID NO: 2838800 - DNA, 16 bp, Homo sapiens
ccgaatagctgggact

SEQ ID NO: 2838801 - DNA, 13 bp, Homo sapiens
ccgaccagacacc

SEQ ID NO: 2838802 - DNA, 13 bp, Homo sapiens
ccgaccagagccc

SEQ ID NO: 2838803 - DNA, 22 bp, Homo sapiens
ccgacctcgtcctccccctgcc

SEQ ID NO: 2838804 - DNA, 15 bp, Homo sapiens
ccgactcagggacct

SEQ ID NO: 2838805 - DNA, 14 bp, Homo sapiens
ccgactccagccag

SEQ ID NO: 2838806 - DNA, 13 bp, Homo sapiens
ccgacttttctaa

SEQ ID NO: 2838807 - DNA, 20 bp, Homo sapiens
ccgagagtagccgagagcct

SEQ ID NO: 2838808 - DNA, 21 bp, Homo sapiens
ccgagagtagccgagagcctg

SEQ ID NO: 2838809 - DNA, 21 bp, Homo sapiens
ccgagatcacgccactgcact

SEQ ID NO: 2838810 - DNA, 18 bp, Homo sapiens
ccgagcaaccgtggccct

SEQ ID NO: 2838811 - DNA, 12 bp, Homo sapiens
ccgagcagctga

SEQ ID NO: 2838812 - DNA, 14 bp, Homo sapiens
ccgagcagctgagc

SEQ ID NO: 2838813 - DNA, 17 bp, Homo sapiens
ccgaggccttctctgaa

SEQ ID NO: 2838814 - DNA, 17 bp, Homo sapiens
ccgagtagctgggacta

SEQ ID NO: 2838815 - DNA, 20 bp, Homo sapiens
ccgagtagctgggactacag

SEQ ID NO: 2838816 - DNA, 12 bp, Homo sapiens
ccgatgccagcc

SEQ ID NO: 2838817 - DNA, 17 bp, Homo sapiens
ccgcaccaggccgggct

SEQ ID NO: 2838818 - DNA, 13 bp, Homo sapiens
ccgcaccccagag

SEQ ID NO: 2838819 - DNA, 17 bp, Homo sapiens
ccgcaccccagagtgtg

SEQ ID NO: 2838820 - DNA, 13 bp, Homo sapiens
ccgcagcatgtgg

SEQ ID NO: 2838821 - DNA, 20 bp, Homo sapiens
ccgcagccagccggtgcctg

SEQ ID NO: 2838822 - DNA, 14 bp, Homo sapiens
ccgcagcctccctc

SEQ ID NO: 2838823 - DNA, 22 bp, Homo sapiens
ccgcatcttctccatctggcag

SEQ ID NO: 2838824 - DNA, 15 bp, Homo sapiens
ccgcattccctgagt

SEQ ID NO: 2838825 - DNA, 23 bp, Homo sapiens
ccgcattccctgagtcaccagga

SEQ ID NO: 2838826 - DNA, 21 bp, Homo sapiens
ccgccacgaggagcttccagt

SEQ ID NO: 2838827 - DNA, 17 bp, Homo sapiens
ccgcccttcccacagca

SEQ ID NO: 2838828 - DNA, 14 bp, Homo sapiens
ccgcctcccagcct

SEQ ID NO: 2838829 - DNA, 15 bp, Homo sapiens
ccgcctcccagcctg

SEQ ID NO: 2838830 - DNA, 12 bp, Homo sapiens
ccgcctgtgccc

SEQ ID NO: 2838831 - DNA, 14 bp, Homo sapiens
ccgctaaaagaaac

SEQ ID NO: 2838832 - DNA, 13 bp, Homo sapiens
ccgctcctgctga

SEQ ID NO: 2838833 - DNA, 13 bp, Homo sapiens
ccgctgccccagc

SEQ ID NO: 2838834 - DNA, 14 bp, Homo sapiens
ccgctggctcctcc

SEQ ID NO: 2838835 - DNA, 19 bp, Homo sapiens
ccgctggctcctccaggca

SEQ ID NO: 2838836 - DNA, 15 bp, Homo sapiens
ccgcttccccacaga

SEQ ID NO: 2838837 - DNA, 17 bp, Homo sapiens
ccgcttccccacagaac

SEQ ID NO: 2838838 - DNA, 19 bp, Homo sapiens
ccgcttgtccagcgcctag

SEQ ID NO: 2838839 - DNA, 15 bp, Homo sapiens
ccggagctttcaaag

SEQ ID NO: 2838840 - DNA, 17 bp, Homo sapiens
ccggcaaccccagttct

SEQ ID NO: 2838841 - DNA, 22 bp, Homo sapiens
ccggcaaccccagttctgctcc

SEQ ID NO: 2838842 - DNA, 16 bp, Homo sapiens
ccggcaccccctgcag

SEQ ID NO: 2838843 - DNA, 13 bp, Homo sapiens
ccggcccctgctg

SEQ ID NO: 2838844 - DNA, 21 bp, Homo sapiens
ccggcctgatgacagagcgag

SEQ ID NO: 2838845 - DNA, 16 bp, Homo sapiens
ccggcctgctcccagc

SEQ ID NO: 2838846 - DNA, 13 bp, Homo sapiens
ccggctccaggct

SEQ ID NO: 2838847 - DNA, 14 bp, Homo sapiens
ccggctccaggctc

SEQ ID NO: 2838848 - DNA, 21 bp, Homo sapiens
ccggctccaggctcctttagc

SEQ ID NO: 2838849 - DNA, 15 bp, Homo sapiens
ccggctccagtttcc

SEQ ID NO: 2838850 - DNA, 18 bp, Homo sapiens
ccgggacagacctggaca

SEQ ID NO: 2838851 - DNA, 20 bp, Homo sapiens
ccgggcactcagaagacact

SEQ ID NO: 2838852 - DNA, 22 bp, Homo sapiens
ccgggcactcagaagacactga

SEQ ID NO: 2838853 - DNA, 18 bp, Homo sapiens
ccgggccactccttcctg

SEQ ID NO: 2838854 - DNA, 21 bp, Homo sapiens
ccgggccactccttcctgccc

SEQ ID NO: 2838855 - DNA, 18 bp, Homo sapiens
ccgggcctgcctctgact

SEQ ID NO: 2838856 - DNA, 13 bp, Homo sapiens
ccgggcctggggc

SEQ ID NO: 2838857 - DNA, 19 bp, Homo sapiens
ccgggctgggagctctgca

SEQ ID NO: 2838858 - DNA, 20 bp, Homo sapiens
ccggggaactggccaagctg

SEQ ID NO: 2838859 - DNA, 19 bp, Homo sapiens
ccggggctggcggctactc

SEQ ID NO: 2838860 - DNA, 17 bp, Homo sapiens
ccgggtacctcagtttc

SEQ ID NO: 2838861 - DNA, 17 bp, Homo sapiens
ccggtgtgcctgcagcc

SEQ ID NO: 2838862 - DNA, 17 bp, Homo sapiens
ctcttaaaaaataaaaa

SEQ ID NO: 2838863 - DNA, 19 bp, Homo sapiens
ctcttaggaagagaaacca

SEQ ID NO: 2838864 - DNA, 20 bp, Homo sapiens
ctcttatagaatatttatta

SEQ ID NO: 2838865 - DNA, 21 bp, Homo sapiens
ctcttatagaatatttattac

SEQ ID NO: 2838866 - DNA, 12 bp, Homo sapiens
ctcttatgaaat

SEQ ID NO: 2838867 - DNA, 14 bp, Homo sapiens
ctcttatgaaatgg

SEQ ID NO: 2838868 - DNA, 14 bp, Homo sapiens
ctcttattgcccac

SEQ ID NO: 2838869 - DNA, 15 bp, Homo sapiens
ctcttattgcccacg

SEQ ID NO: 2838870 - DNA, 20 bp, Homo sapiens
ctcttcaactgaccagcctc

SEQ ID NO: 2838871 - DNA, 14 bp, Homo sapiens
ctcttcaggttctt

SEQ ID NO: 2838872 - DNA, 10 bp, Homo sapiens
ctcttcctgt

SEQ ID NO: 2838873 - DNA, 12 bp, Homo sapiens
ctcttccttccc

SEQ ID NO: 2838874 - DNA, 20 bp, Homo sapiens
ctcttccttcccccatcccc

SEQ ID NO: 2838875 - DNA, 19 bp, Homo sapiens
ctcttctattttgtaaact

SEQ ID NO: 2838876 - DNA, 16 bp, Homo sapiens
ctcttctccaggctgt

SEQ ID NO: 2838877 - DNA, 15 bp, Homo sapiens
ctcttctgttctcaa

SEQ ID NO: 2838878 - DNA, 17 bp, Homo sapiens
ctcttcttcttcagaag

SEQ ID NO: 2838879 - DNA, 16 bp, Homo sapiens
ctcttgacctcaggtg

SEQ ID NO: 2838880 - DNA, 14 bp, Homo sapiens
ctcttgaggccagg

SEQ ID NO: 2838881 - DNA, 16 bp, Homo sapiens
ctcttgccactgcctc

SEQ ID NO: 2838882 - DNA, 22 bp, Homo sapiens
ctcttgccactgcctcttcctc

SEQ ID NO: 2838883 - DNA, 14 bp, Homo sapiens
ctcttgcctgcacc

SEQ ID NO: 2838884 - DNA, 10 bp, Homo sapiens
ctcttgcctt

SEQ ID NO: 2838885 - DNA, 20 bp, Homo sapiens
ctcttgggcatgctcagccc

SEQ ID NO: 2838886 - DNA, 19 bp, Homo sapiens
ctcttgggttcaagcgatt

SEQ ID NO: 2838887 - DNA, 21 bp, Homo sapiens
ctcttgggttcaagcgattct

SEQ ID NO: 2838888 - DNA, 20 bp, Homo sapiens
ctctttaaaagaaagttagg

SEQ ID NO: 2838889 - DNA, 23 bp, Homo sapiens
ctctttaatgtcacaggcaggtc

SEQ ID NO: 2838890 - DNA, 22 bp, Homo sapiens
ctgagcaagatcttgtctccac

SEQ ID NO: 2838891 - DNA, 23 bp, Homo sapiens
ctgagcacctgcttcatgctcag

SEQ ID NO: 2838892 - DNA, 12 bp, Homo sapiens
ctgagcagggcc

SEQ ID NO: 2838893 - DNA, 17 bp, Homo sapiens
ctgagcccagggaggcc

SEQ ID NO: 2838894 - DNA, 12 bp, Homo sapiens
ctgagccctggc

SEQ ID NO: 2838895 - DNA, 15 bp, Homo sapiens
ctgagccctggcagg

SEQ ID NO: 2838896 - DNA, 16 bp, Homo sapiens
ctgagcctgacctttc

SEQ ID NO: 2838897 - DNA, 19 bp, Homo sapiens
ctgagcctgacctttctga

SEQ ID NO: 2838898 - DNA, 12 bp, Homo sapiens
ctgagcctgccg

SEQ ID NO: 2838899 - DNA, 19 bp, Homo sapiens
ctgagcctgccgagcaacc

SEQ ID NO: 2838900 - DNA, 12 bp, Homo sapiens
ctgagccttcag

SEQ ID NO: 2838901 - DNA, 17 bp, Homo sapiens
ctgagccttcagtcttg

SEQ ID NO: 2838902 - DNA, 17 bp, Homo sapiens
ctgagctcacaaggcag

SEQ ID NO: 2838903 - DNA, 18 bp, Homo sapiens
ctgagctcacaaggcagc

SEQ ID NO: 2838904 - DNA, 19 bp, Homo sapiens
ctgagctcacaaggcagca

SEQ ID NO: 2838905 - DNA, 22 bp, Homo sapiens
ctgagctcggtggacccaggga

SEQ ID NO: 2838906 - DNA, 20 bp, Homo sapiens
ctgagctctgagaggccctg

SEQ ID NO: 2838907 - DNA, 16 bp, Homo sapiens
ctgagctgggcaccac

SEQ ID NO: 2838908 - DNA, 20 bp, Homo sapiens
ctgagctgggcaccacaggc

SEQ ID NO: 2838909 - DNA, 15 bp, Homo sapiens
ctgagcttctctgtg

SEQ ID NO: 2838910 - DNA, 14 bp, Homo sapiens
ctgaggaatccaga

SEQ ID NO: 2838911 - DNA, 14 bp, Homo sapiens
ctgaggaccagcca

SEQ ID NO: 2838912 - DNA, 11 bp, Homo sapiens
ctgaggagaaa

SEQ ID NO: 2838913 - DNA, 16 bp, Homo sapiens
ctgaggagtctgaggt

SEQ ID NO: 2838914 - DNA, 15 bp, Homo sapiens
ctgaggcagaagaat

SEQ ID NO: 2838915 - DNA, 14 bp, Homo sapiens
ctgaggcagacagc

SEQ ID NO: 2838916 - DNA, 16 bp, Homo sapiens
ctgaggcagacagcag

SEQ ID NO: 2838917 - DNA, 17 bp, Homo sapiens
ctgaggcagacagcagc

SEQ ID NO: 2838918 - DNA, 22 bp, Homo sapiens
ctgaggcagacagcagctcagg

SEQ ID NO: 2838919 - DNA, 12 bp, Homo sapiens
ctgaggccagcc

SEQ ID NO: 2838920 - DNA, 14 bp, Homo sapiens
ctgaggccagcctg

SEQ ID NO: 2838921 - DNA, 22 bp, Homo sapiens
ctgaggccagcctggcctcctg

SEQ ID NO: 2838922 - DNA, 23 bp, Homo sapiens
ctgaggccccttaactcatctgt

SEQ ID NO: 2838923 - DNA, 23 bp, Homo sapiens
ctgaggcctaaaagtaaacatta

SEQ ID NO: 2838924 - DNA, 23 bp, Homo sapiens
ctgaggcgccccaacccgtggag

SEQ ID NO: 2838925 - DNA, 11 bp, Homo sapiens
ctgagggagag

SEQ ID NO: 2838926 - DNA, 13 bp, Homo sapiens
ctgagggccacac

SEQ ID NO: 2838927 - DNA, 14 bp, Homo sapiens
ctgagggccacact

SEQ ID NO: 2838928 - DNA, 20 bp, Homo sapiens
ctgaggggggccgtgcccag

SEQ ID NO: 2838929 - DNA, 21 bp, Homo sapiens
ctgaggggggccgtgcccagg

SEQ ID NO: 2838930 - DNA, 23 bp, Homo sapiens
ctgaggggggccgtgcccagggg

SEQ ID NO: 2838931 - DNA, 15 bp, Homo sapiens
ctgaggtcacctgga

SEQ ID NO: 2838932 - DNA, 15 bp, Homo sapiens
ctgaggtcctgagca

SEQ ID NO: 2838933 - DNA, 19 bp, Homo sapiens
ctgagtacttgatttcagg

SEQ ID NO: 2838934 - DNA, 20 bp, Homo sapiens
ctgagtagctgggattacag

SEQ ID NO: 2838935 - DNA, 20 bp, Homo sapiens
ctgagtatgttaagctcttt

SEQ ID NO: 2838936 - DNA, 16 bp, Homo sapiens
ctgagtcaagttgttc

SEQ ID NO: 2838937 - DNA, 15 bp, Homo sapiens
ctgagtcaccaggaa

SEQ ID NO: 2838938 - DNA, 17 bp, Homo sapiens
ctgagtcaccaggaatg

SEQ ID NO: 2838939 - DNA, 20 bp, Homo sapiens
ctgagtcacccatgaagaca

SEQ ID NO: 2838940 - DNA, 20 bp, Homo sapiens
ctgagtcatgatctccctgc

SEQ ID NO: 2838941 - DNA, 16 bp, Homo sapiens
ctgagtctcctgtgcc

SEQ ID NO: 2838942 - DNA, 16 bp, Homo sapiens
ctgagtgacatgggtg

SEQ ID NO: 2838943 - DNA, 22 bp, Homo sapiens
ctgagtgacatgggtgtgccag

SEQ ID NO: 2838944 - DNA, 23 bp, Homo sapiens
ctgagtgagccacagaccacctg

SEQ ID NO: 2838945 - DNA, 18 bp, Homo sapiens
ctgagtggatctccaagg

SEQ ID NO: 2838946 - DNA, 18 bp, Homo sapiens
ctgagtgtgggcttctga

SEQ ID NO: 2838947 - DNA, 16 bp, Homo sapiens
ctgagttcctgcatgc

SEQ ID NO: 2838948 - DNA, 22 bp, Homo sapiens
ctgataaacattaaacactgta

SEQ ID NO: 2838949 - DNA, 15 bp, Homo sapiens
ctgatacccagagca

SEQ ID NO: 2838950 - DNA, 22 bp, Homo sapiens
ctgatcaagtcaccggagcttt

SEQ ID NO: 2838951 - DNA, 15 bp, Homo sapiens
ctgatcagaatttta

SEQ ID NO: 2838952 - DNA, 17 bp, Homo sapiens
ctgatcgggataacaaa

SEQ ID NO: 2838953 - DNA, 24 bp, Homo sapiens
ctgatcgggataacaaaatcacaa

SEQ ID NO: 2838954 - DNA, 15 bp, Homo sapiens
cctgctcccagcagc

SEQ ID NO: 2838955 - DNA, 23 bp, Homo sapiens
cctgctcccagcagccctaagga

SEQ ID NO: 2838956 - DNA, 16 bp, Homo sapiens
cctgctctcctcttgc

SEQ ID NO: 2838957 - DNA, 18 bp, Homo sapiens
cctgctctcctcttgcca

SEQ ID NO: 2838958 - DNA, 20 bp, Homo sapiens
cctgctgaaacacctcccag

SEQ ID NO: 2838959 - DNA, 23 bp, Homo sapiens
cctgctgaatgatttccaaagag

SEQ ID NO: 2838960 - DNA, 20 bp, Homo sapiens
cctgctgagagacccaagga

SEQ ID NO: 2838961 - DNA, 12 bp, Homo sapiens
cctgctgagctc

SEQ ID NO: 2838962 - DNA, 18 bp, Homo sapiens
cctgctgagctctgagag

SEQ ID NO: 2838963 - DNA, 19 bp, Homo sapiens
cctgctgagctctgagagg

SEQ ID NO: 2838964 - DNA, 20 bp, Homo sapiens
cctgctgagctctgagaggc

SEQ ID NO: 2838965 - DNA, 22 bp, Homo sapiens
cctgctgagctctgagaggccc

SEQ ID NO: 2838966 - DNA, 17 bp, Homo sapiens
cctgctgctgagaacct

SEQ ID NO: 2838967 - DNA, 22 bp, Homo sapiens
cctgctgctgagaacctggcct

SEQ ID NO: 2838968 - DNA, 18 bp, Homo sapiens
cctgctgggctctccacc

SEQ ID NO: 2838969 - DNA, 20 bp, Homo sapiens
cctgctgggctctccacctc

SEQ ID NO: 2838970 - DNA, 13 bp, Homo sapiens
cctgctggttcag

SEQ ID NO: 2838971 - DNA, 22 bp, Homo sapiens
cctgctgtgtgaattcccaggt

SEQ ID NO: 2838972 - DNA, 15 bp, Homo sapiens
cctgcttctcagccc

SEQ ID NO: 2838973 - DNA, 15 bp, Homo sapiens
cctgcttctctgggg

SEQ ID NO: 2838974 - DNA, 22 bp, Homo sapiens
cctgcttgaaggaacagtgctg

SEQ ID NO: 2838975 - DNA, 15 bp, Homo sapiens
cctgctttctcctgg

SEQ ID NO: 2838976 - DNA, 18 bp, Homo sapiens
cctgctttgaggacaaag

SEQ ID NO: 2838977 - DNA, 22 bp, Homo sapiens
cctggaaaggctcagtctcagg

SEQ ID NO: 2838978 - DNA, 22 bp, Homo sapiens
cctggaaatatcagttactcag

SEQ ID NO: 2838979 - DNA, 20 bp, Homo sapiens
cctggaactgtctctcatga

SEQ ID NO: 2838980 - DNA, 21 bp, Homo sapiens
cctggaagctgtgtccttgca

SEQ ID NO: 2838981 - DNA, 12 bp, Homo sapiens
cctggaatgaag

SEQ ID NO: 2838982 - DNA, 16 bp, Homo sapiens
cctggaatgaagcatg

SEQ ID NO: 2838983 - DNA, 13 bp, Homo sapiens
cctggacagctgt

SEQ ID NO: 2838984 - DNA, 23 bp, Homo sapiens
cctggaccaccagccccagcaag

SEQ ID NO: 2838985 - DNA, 14 bp, Homo sapiens
cctggaggacctga

SEQ ID NO: 2838986 - DNA, 19 bp, Homo sapiens
cctggaggacctgagcctg

SEQ ID NO: 2838987 - DNA, 21 bp, Homo sapiens
cctggaggacctgagcctgcc

SEQ ID NO: 2838988 - DNA, 14 bp, Homo sapiens
cctggatcagcgtg

SEQ ID NO: 2838989 - DNA, 16 bp, Homo sapiens
cctggatcagcgtggc

SEQ ID NO: 2838990 - DNA, 17 bp, Homo sapiens
cctggatcagcgtggcc

SEQ ID NO: 2838991 - DNA, 21 bp, Homo sapiens
cctggatccatcaggccactt

SEQ ID NO: 2838992 - DNA, 21 bp, Homo sapiens
cctggatgtcatattggcagt

SEQ ID NO: 2838993 - DNA, 20 bp, Homo sapiens
cctggcatgaccatcctgtc

SEQ ID NO: 2838994 - DNA, 12 bp, Homo sapiens
cctggccaggca

SEQ ID NO: 2838995 - DNA, 11 bp, Homo sapiens
cctggccccag

SEQ ID NO: 2838996 - DNA, 14 bp, Homo sapiens
cctggccccatgtc

SEQ ID NO: 2838997 - DNA, 17 bp, Homo sapiens
cctggccccatgtctct

SEQ ID NO: 2838998 - DNA, 18 bp, Homo sapiens
cctggcccccctccaggc

SEQ ID NO: 2838999 - DNA, 22 bp, Homo sapiens
cctggccccttctcctctgggg

SEQ ID NO: 2839000 - DNA, 15 bp, Homo sapiens
cctggccgcctccag

SEQ ID NO: 2839001 - DNA, 16 bp, Homo sapiens
cctggccgcctccagg

SEQ ID NO: 2839002 - DNA, 22 bp, Homo sapiens
cctggccggcaaccccagttct

SEQ ID NO: 2839003 - DNA, 16 bp, Homo sapiens
cctggccggctccagt

SEQ ID NO: 2839004 - DNA, 16 bp, Homo sapiens
cctggcctcaagcaat

SEQ ID NO: 2839005 - DNA, 17 bp, Homo sapiens
cctggcctcaagcaatc

SEQ ID NO: 2839006 - DNA, 13 bp, Homo sapiens
cctggcctcctgc

SEQ ID NO: 2839007 - DNA, 16 bp, Homo sapiens
cctggcctggcacaca

SEQ ID NO: 2839008 - DNA, 11 bp, Homo sapiens
cctggccttca

SEQ ID NO: 2839009 - DNA, 19 bp, Homo sapiens
cctggcgcccctgcccccc

SEQ ID NO: 2839010 - DNA, 16 bp, Homo sapiens
cctggctctcagaagg

SEQ ID NO: 2839011 - DNA, 23 bp, Homo sapiens
cctggctgaccccaaagagcctg

SEQ ID NO: 2839012 - DNA, 13 bp, Homo sapiens
cctggctggctga

SEQ ID NO: 2839013 - DNA, 18 bp, Homo sapiens
cctggctggctgagggca

SEQ ID NO: 2839014 - DNA, 20 bp, Homo sapiens
cctggctggctgagggcagt

SEQ ID NO: 2839015 - DNA, 13 bp, Homo sapiens
cctggcttctgga

SEQ ID NO: 2839016 - DNA, 20 bp, Homo sapiens
cctggcttctggagcccttg

SEQ ID NO: 2839017 - DNA, 18 bp, Homo sapiens
cctgggagaacctcaggc

SEQ ID NO: 2839018 - DNA, 15 bp, Homo sapiens
cctgggccccaccac

SEQ ID NO: 2839019 - DNA, 21 bp, Homo sapiens
cctgggccccaccacctaggc

SEQ ID NO: 2839020 - DNA, 21 bp, Homo sapiens
cctgggcccgctttgcctgct

SEQ ID NO: 2839021 - DNA, 15 bp, Homo sapiens
cctgggccctggggc

SEQ ID NO: 2839022 - DNA, 17 bp, Homo sapiens
cctgggccctggggcct

SEQ ID NO: 2839023 - DNA, 20 bp, Homo sapiens
cctgggccctggggcctgta

SEQ ID NO: 2839024 - DNA, 21 bp, Homo sapiens
cctgggcctatggagagccct

SEQ ID NO: 2839025 - DNA, 22 bp, Homo sapiens
cctgggcctatggagagccctg

SEQ ID NO: 2839026 - DNA, 13 bp, Homo sapiens
cctgggcctgctg

SEQ ID NO: 2839027 - DNA, 14 bp, Homo sapiens
cctgggcctgctgc

SEQ ID NO: 2839028 - DNA, 17 bp, Homo sapiens
cctgggcctgctgctga

SEQ ID NO: 2839029 - DNA, 22 bp, Homo sapiens
cctgggctctgccccagctctg

SEQ ID NO: 2839030 - DNA, 22 bp, Homo sapiens
cctggggcctcggagcctcatc

SEQ ID NO: 2839031 - DNA, 14 bp, Homo sapiens
cctggggcctgtac

SEQ ID NO: 2839032 - DNA, 18 bp, Homo sapiens
cctggggcctgtactgcc

SEQ ID NO: 2839033 - DNA, 22 bp, Homo sapiens
cctggggctcctttctccagcc

SEQ ID NO: 2839034 - DNA, 13 bp, Homo sapiens
ctctgagaacaga

SEQ ID NO: 2839035 - DNA, 19 bp, Homo sapiens
ctctgagaattccaaggag

SEQ ID NO: 2839036 - DNA, 12 bp, Homo sapiens
ctctgaggacac

SEQ ID NO: 2839037 - DNA, 20 bp, Homo sapiens
ctctgaggccagcctggcct

SEQ ID NO: 2839038 - DNA, 21 bp, Homo sapiens
ctctgaggccagcctggcctc

SEQ ID NO: 2839039 - DNA, 10 bp, Homo sapiens
ctctgaggcg

SEQ ID NO: 2839040 - DNA, 22 bp, Homo sapiens
ctctgaggcgccccaacccgtg

SEQ ID NO: 2839041 - DNA, 19 bp, Homo sapiens
ctctgaggctctttctggg

SEQ ID NO: 2839042 - DNA, 19 bp, Homo sapiens
ctctgaggcttccagagag

SEQ ID NO: 2839043 - DNA, 12 bp, Homo sapiens
ctctgagtgtga

SEQ ID NO: 2839044 - DNA, 20 bp, Homo sapiens
ctctgatgcatcagaaaggg

SEQ ID NO: 2839045 - DNA, 14 bp, Homo sapiens
ctctgcacatgtct

SEQ ID NO: 2839046 - DNA, 18 bp, Homo sapiens
ctctgcacatgtcttgta

SEQ ID NO: 2839047 - DNA, 13 bp, Homo sapiens
ctctgcagccagc

SEQ ID NO: 2839048 - DNA, 15 bp, Homo sapiens
ctctgcattctagta

SEQ ID NO: 2839049 - DNA, 13 bp, Homo sapiens
ctctgccacctcc

SEQ ID NO: 2839050 - DNA, 14 bp, Homo sapiens
ctctgccacctccc

SEQ ID NO: 2839051 - DNA, 13 bp, Homo sapiens
ctctgccccagct

SEQ ID NO: 2839052 - DNA, 16 bp, Homo sapiens
ctctgccccagctctg

SEQ ID NO: 2839053 - DNA, 21 bp, Homo sapiens
ctctgccccagctctggcttc

SEQ ID NO: 2839054 - DNA, 15 bp, Homo sapiens
ctctgcctccctagc

SEQ ID NO: 2839055 - DNA, 16 bp, Homo sapiens
ctctgcctcctcttca

SEQ ID NO: 2839056 - DNA, 10 bp, Homo sapiens
ctctgcctga

SEQ ID NO: 2839057 - DNA, 18 bp, Homo sapiens
ctctgctcctctccccag

SEQ ID NO: 2839058 - DNA, 12 bp, Homo sapiens
ctctgctctgat

SEQ ID NO: 2839059 - DNA, 16 bp, Homo sapiens
ctctgctcttgcctgc

SEQ ID NO: 2839060 - DNA, 17 bp, Homo sapiens
ctctgctcttgcctgca

SEQ ID NO: 2839061 - DNA, 22 bp, Homo sapiens
ctctgctgacagacacaggccc

SEQ ID NO: 2839062 - DNA, 19 bp, Homo sapiens
ctctggaaaatgtgaccca

SEQ ID NO: 2839063 - DNA, 21 bp, Homo sapiens
ctctggaaaatgtgacccaga

SEQ ID NO: 2839064 - DNA, 15 bp, Homo sapiens
ctctggacaggcatg

SEQ ID NO: 2839065 - DNA, 16 bp, Homo sapiens
ctctggacaggcatgt

SEQ ID NO: 2839066 - DNA, 13 bp, Homo sapiens
ctctggcacccag

SEQ ID NO: 2839067 - DNA, 11 bp, Homo sapiens
ctctggcagcc

SEQ ID NO: 2839068 - DNA, 13 bp, Homo sapiens
ctctggccccagg

SEQ ID NO: 2839069 - DNA, 16 bp, Homo sapiens
ctctggccccaggctt

SEQ ID NO: 2839070 - DNA, 15 bp, Homo sapiens
ctctggccctgcctt

SEQ ID NO: 2839071 - DNA, 13 bp, Homo sapiens
ctctggctggcta

SEQ ID NO: 2839072 - DNA, 23 bp, Homo sapiens
ctctggctggctaactggaagca

SEQ ID NO: 2839073 - DNA, 14 bp, Homo sapiens
ctctgggagacttt

SEQ ID NO: 2839074 - DNA, 18 bp, Homo sapiens
ctctgggagactttccct

SEQ ID NO: 2839075 - DNA, 13 bp, Homo sapiens
ctctgtcagatgg

SEQ ID NO: 2839076 - DNA, 23 bp, Homo sapiens
ctctgtcagatgggaagacatga

SEQ ID NO: 2839077 - DNA, 14 bp, Homo sapiens
ctctgtccagggcc

SEQ ID NO: 2839078 - DNA, 15 bp, Homo sapiens
ctctgtccctctttg

SEQ ID NO: 2839079 - DNA, 13 bp, Homo sapiens
ctctgtcctggga

SEQ ID NO: 2839080 - DNA, 13 bp, Homo sapiens
ctctgtctcgagc

SEQ ID NO: 2839081 - DNA, 21 bp, Homo sapiens
ctctgtctcgagcgccctgca

SEQ ID NO: 2839082 - DNA, 22 bp, Homo sapiens
ctctgtctcgagcgccctgcag

SEQ ID NO: 2839083 - DNA, 18 bp, Homo sapiens
ctctgtgaacgatttaga

SEQ ID NO: 2839084 - DNA, 23 bp, Homo sapiens
ctctgtgacctgccccgcccagc

SEQ ID NO: 2839085 - DNA, 19 bp, Homo sapiens
ctctgtgactcgcttagct

SEQ ID NO: 2839086 - DNA, 14 bp, Homo sapiens
ctctgtgccagagc

SEQ ID NO: 2839087 - DNA, 21 bp, Homo sapiens
ctctgtgccagagcctggggc

SEQ ID NO: 2839088 - DNA, 19 bp, Homo sapiens
ctctgtgtcaggtggggca

SEQ ID NO: 2839089 - DNA, 21 bp, Homo sapiens
ctctgtgtcaggtggggcagc

SEQ ID NO: 2839090 - DNA, 23 bp, Homo sapiens
ctctgtgtcaggtggggcagctt

SEQ ID NO: 2839091 - DNA, 14 bp, Homo sapiens
ctgcaagagccttg

SEQ ID NO: 2839092 - DNA, 19 bp, Homo sapiens
ctgcaagagccttggtgtc

SEQ ID NO: 2839093 - DNA, 13 bp, Homo sapiens
ctgcaatctccag

SEQ ID NO: 2839094 - DNA, 14 bp, Homo sapiens
ctgcaatctccagg

SEQ ID NO: 2839095 - DNA, 19 bp, Homo sapiens
ctgcaattctacagtttct

SEQ ID NO: 2839096 - DNA, 18 bp, Homo sapiens
ctgcacaaagcccttcca

SEQ ID NO: 2839097 - DNA, 17 bp, Homo sapiens
ctgcacaagatatttat

SEQ ID NO: 2839098 - DNA, 23 bp, Homo sapiens
ctgcacatgaatcccacccacat

SEQ ID NO: 2839099 - DNA, 18 bp, Homo sapiens
ctgcaccagcccttccct

SEQ ID NO: 2839100 - DNA, 20 bp, Homo sapiens
ctgcaccagcccttccctgc

SEQ ID NO: 2839101 - DNA, 23 bp, Homo sapiens
ctgcaccagcccttccctgcttt

SEQ ID NO: 2839102 - DNA, 13 bp, Homo sapiens
ctgcacccagggg

SEQ ID NO: 2839103 - DNA, 20 bp, Homo sapiens
ctgcacctccccccactgca

SEQ ID NO: 2839104 - DNA, 16 bp, Homo sapiens
ctgcacctgccagcct

SEQ ID NO: 2839105 - DNA, 17 bp, Homo sapiens
ctgcacctgccagcctg

SEQ ID NO: 2839106 - DNA, 22 bp, Homo sapiens
ctgcacgaatggaagaggcacc

SEQ ID NO: 2839107 - DNA, 23 bp, Homo sapiens
ctgcactatagcctaggtgacag

SEQ ID NO: 2839108 - DNA, 17 bp, Homo sapiens
ctgcactccagcctggg

SEQ ID NO: 2839109 - DNA, 18 bp, Homo sapiens
ctgcactctagcctggca

SEQ ID NO: 2839110 - DNA, 20 bp, Homo sapiens
ctgcactgacccacagcctc

SEQ ID NO: 2839111 - DNA, 14 bp, Homo sapiens
ctgcacttgcagac

SEQ ID NO: 2839112 - DNA, 20 bp, Homo sapiens
ctgcagaacgtattggtcca

SEQ ID NO: 2839113 - DNA, 15 bp, Homo sapiens
ctgcagaccctgccc

SEQ ID NO: 2839114 - DNA, 16 bp, Homo sapiens
ctgcagaccctgccct

SEQ ID NO: 2839115 - DNA, 15 bp, Homo sapiens
ctgcagactcactgt

SEQ ID NO: 2839116 - DNA, 14 bp, Homo sapiens
ctgcagagaccttg

SEQ ID NO: 2839117 - DNA, 16 bp, Homo sapiens
ctgcagagcacacagg

SEQ ID NO: 2839118 - DNA, 23 bp, Homo sapiens
ctgcagaggggctttctggagag

SEQ ID NO: 2839119 - DNA, 12 bp, Homo sapiens
ctgcagcacttt

SEQ ID NO: 2839120 - DNA, 18 bp, Homo sapiens
ctgcagccagcccagccc

SEQ ID NO: 2839121 - DNA, 11 bp, Homo sapiens
ctgcagcctca

SEQ ID NO: 2839122 - DNA, 20 bp, Homo sapiens
ctgcagcctcaacctcctgg

SEQ ID NO: 2839123 - DNA, 13 bp, Homo sapiens
ctgcagcctcctc

SEQ ID NO: 2839124 - DNA, 20 bp, Homo sapiens
ctgcagcctggtagaattgg

SEQ ID NO: 2839125 - DNA, 13 bp, Homo sapiens
ctgcagctgcttg

SEQ ID NO: 2839126 - DNA, 13 bp, Homo sapiens
ctgcagcttcctg

SEQ ID NO: 2839127 - DNA, 17 bp, Homo sapiens
ctgcagcttgtagccag

SEQ ID NO: 2839128 - DNA, 20 bp, Homo sapiens
ctgcaggaatcaaaaattga

SEQ ID NO: 2839129 - DNA, 22 bp, Homo sapiens
ctgcaggacttctgcctgaacc

SEQ ID NO: 2839130 - DNA, 21 bp, Homo sapiens
ctgcaggccaagagcagaggc

SEQ ID NO: 2839131 - DNA, 14 bp, Homo sapiens
ctgcaggccccgct

SEQ ID NO: 2839132 - DNA, 17 bp, Homo sapiens
ctgcagggggtgtgtct

SEQ ID NO: 2839133 - DNA, 15 bp, Homo sapiens
ctgcagtagtctctg

SEQ ID NO: 2839134 - DNA, 20 bp, Homo sapiens
ctgcagtagtctctgtgctt

SEQ ID NO: 2839135 - DNA, 23 bp, Homo sapiens
ctgcagtcaacagttcaaagaag

SEQ ID NO: 2839136 - DNA, 18 bp, Homo sapiens
ctgcagttggcagaaagg

SEQ ID NO: 2839137 - DNA, 22 bp, Homo sapiens
ctgcatctattctttgtaccat

SEQ ID NO: 2839138 - DNA, 21 bp, Homo sapiens
ctgcatctgggattcccacca

SEQ ID NO: 2839139 - DNA, 17 bp, Homo sapiens
ctgcatttataaatgtg

SEQ ID NO: 2839140 - DNA, 19 bp, Homo sapiens
ctgcatttataaatgtgtg

SEQ ID NO: 2839141 - DNA, 21 bp, Homo sapiens
ctgcatttataaatgtgtggt

SEQ ID NO: 2839142 - DNA, 20 bp, Homo sapiens
ctgcattttacgtctttgga

SEQ ID NO: 2839143 - DNA, 14 bp, Homo sapiens
ctgccacaccctcc

SEQ ID NO: 2839144 - DNA, 17 bp, Homo sapiens
ctgccacaccctcccca

SEQ ID NO: 2839145 - DNA, 14 bp, Homo sapiens
ctgccaccatcctg

SEQ ID NO: 2839146 - DNA, 17 bp, Homo sapiens
ctgccaccatcctgctg

SEQ ID NO: 2839147 - DNA, 12 bp, Homo sapiens
ctgccaccctgg

SEQ ID NO: 2839148 - DNA, 16 bp, Homo sapiens
ctgccaccctggggag

SEQ ID NO: 2839149 - DNA, 12 bp, Homo sapiens
ctgccacctgtc

SEQ ID NO: 2839150 - DNA, 16 bp, Homo sapiens
ctgccacctgtctgtc

SEQ ID NO: 2839151 - DNA, 19 bp, Homo sapiens
ctgccactttggtacatgg

SEQ ID NO: 2839152 - DNA, 18 bp, Homo sapiens
ctgccagccagcagccag

SEQ ID NO: 2839153 - DNA, 19 bp, Homo sapiens
ctgccagccagcagccagc

SEQ ID NO: 2839154 - DNA, 20 bp, Homo sapiens
ctgccagcctggcttctgga

SEQ ID NO: 2839155 - DNA, 22 bp, Homo sapiens
ctgccaggagggacaaaggagc

SEQ ID NO: 2839156 - DNA, 20 bp, Homo sapiens
ctgccagtgccttacctcct

SEQ ID NO: 2839157 - DNA, 20 bp, Homo sapiens
ctgccatattctgttggcca

SEQ ID NO: 2839158 - DNA, 21 bp, Homo sapiens
ctgccatccaggttcagcttg

SEQ ID NO: 2839159 - DNA, 14 bp, Homo sapiens
ctgccatggcgtgt

SEQ ID NO: 2839160 - DNA, 22 bp, Homo sapiens
ctgccatggcgtgtccctctcg

SEQ ID NO: 2839161 - DNA, 19 bp, Homo sapiens
ctgccatttgcaccctccg

SEQ ID NO: 2839162 - DNA, 20 bp, Homo sapiens
ctgcccagaattcccagctg

SEQ ID NO: 2839163 - DNA, 15 bp, Homo sapiens
ctgcccaggcccctg

SEQ ID NO: 2839164 - DNA, 20 bp, Homo sapiens
ctgcccaggcccctgccacc

SEQ ID NO: 2839165 - DNA, 15 bp, Homo sapiens
ctgccccaactcctt

SEQ ID NO: 2839166 - DNA, 22 bp, Homo sapiens
ctgccccaactccttccagcta

SEQ ID NO: 2839167 - DNA, 14 bp, Homo sapiens
catctctctttaat

SEQ ID NO: 2839168 - DNA, 21 bp, Homo sapiens
catctctgtgtacccactcct

SEQ ID NO: 2839169 - DNA, 15 bp, Homo sapiens
catctcttgaggcca

SEQ ID NO: 2839170 - DNA, 16 bp, Homo sapiens
catctgaaagccacgt

SEQ ID NO: 2839171 - DNA, 18 bp, Homo sapiens
catctgactcacaagaag

SEQ ID NO: 2839172 - DNA, 14 bp, Homo sapiens
catctgagaaaagc

SEQ ID NO: 2839173 - DNA, 23 bp, Homo sapiens
catctgagaaaagctttgaaccc

SEQ ID NO: 2839174 - DNA, 13 bp, Homo sapiens
catctgctgcccc

SEQ ID NO: 2839175 - DNA, 15 bp, Homo sapiens
catctgggaggctgg

SEQ ID NO: 2839176 - DNA, 20 bp, Homo sapiens
catctgggaggctggtctcc

SEQ ID NO: 2839177 - DNA, 15 bp, Homo sapiens
catctgggattccca

SEQ ID NO: 2839178 - DNA, 17 bp, Homo sapiens
catctgtcttgccagcc

SEQ ID NO: 2839179 - DNA, 19 bp, Homo sapiens
catctgtggaaatgacagc

SEQ ID NO: 2839180 - DNA, 21 bp, Homo sapiens
catctgtgtgtgtccccctat

SEQ ID NO: 2839181 - DNA, 17 bp, Homo sapiens
catctgttatcctgcta

SEQ ID NO: 2839182 - DNA, 20 bp, Homo sapiens
catcttatgctaactgtaga

SEQ ID NO: 2839183 - DNA, 14 bp, Homo sapiens
catcttctccatct

SEQ ID NO: 2839184 - DNA, 13 bp, Homo sapiens
catcttctggagt

SEQ ID NO: 2839185 - DNA, 13 bp, Homo sapiens
catcttgctctgc

SEQ ID NO: 2839186 - DNA, 20 bp, Homo sapiens
catcttgctctgctgacaga

SEQ ID NO: 2839187 - DNA, 13 bp, Homo sapiens
catctttaagtat

SEQ ID NO: 2839188 - DNA, 23 bp, Homo sapiens
catctttcttctattttattccc

SEQ ID NO: 2839189 - DNA, 16 bp, Homo sapiens
catcttttgtgagatg

SEQ ID NO: 2839190 - DNA, 22 bp, Homo sapiens
catgaaaaccattacctgactt

SEQ ID NO: 2839191 - DNA, 13 bp, Homo sapiens
catgaaaagtgct

SEQ ID NO: 2839192 - DNA, 13 bp, Homo sapiens
catgaaaatgcaa

SEQ ID NO: 2839193 - DNA, 15 bp, Homo sapiens
catgaaaatgcaaca

SEQ ID NO: 2839194 - DNA, 22 bp, Homo sapiens
catgaaaatgcaacaacatgta

SEQ ID NO: 2839195 - DNA, 19 bp, Homo sapiens
catgaaacagaaacaaaaa

SEQ ID NO: 2839196 - DNA, 19 bp, Homo sapiens
catgaacctcaagctgcat

SEQ ID NO: 2839197 - DNA, 14 bp, Homo sapiens
catgaagacaggac

SEQ ID NO: 2839198 - DNA, 17 bp, Homo sapiens
catgaagaccacatcca

SEQ ID NO: 2839199 - DNA, 12 bp, Homo sapiens
catgaagctgga

SEQ ID NO: 2839200 - DNA, 15 bp, Homo sapiens
catgaaggtttctga

SEQ ID NO: 2839201 - DNA, 18 bp, Homo sapiens
catgaaggtttctgaaaa

SEQ ID NO: 2839202 - DNA, 20 bp, Homo sapiens
catgaatatttcaaaataaa

SEQ ID NO: 2839203 - DNA, 22 bp, Homo sapiens
catgaatatttcaaaataaact

SEQ ID NO: 2839204 - DNA, 16 bp, Homo sapiens
catgaatgcacactag

SEQ ID NO: 2839205 - DNA, 12 bp, Homo sapiens
catgacagccag

SEQ ID NO: 2839206 - DNA, 13 bp, Homo sapiens
catgacagccaga

SEQ ID NO: 2839207 - DNA, 15 bp, Homo sapiens
catgacagccagagc

SEQ ID NO: 2839208 - DNA, 19 bp, Homo sapiens
catgacagccagagcctgt

SEQ ID NO: 2839209 - DNA, 17 bp, Homo sapiens
catgaccctcctgtcca

SEQ ID NO: 2839210 - DNA, 17 bp, Homo sapiens
catgacctccagctttc

SEQ ID NO: 2839211 - DNA, 22 bp, Homo sapiens
catgacctccagctttcctgta

SEQ ID NO: 2839212 - DNA, 10 bp, Homo sapiens
catgagaaat

SEQ ID NO: 2839213 - DNA, 12 bp, Homo sapiens
catgagaaatgt

SEQ ID NO: 2839214 - DNA, 15 bp, Homo sapiens
catgagaagagggcc

SEQ ID NO: 2839215 - DNA, 16 bp, Homo sapiens
catgagaagagggcct

SEQ ID NO: 2839216 - DNA, 20 bp, Homo sapiens
catgagaataagagaaagaa

SEQ ID NO: 2839217 - DNA, 12 bp, Homo sapiens
catgagaatcta

SEQ ID NO: 2839218 - DNA, 19 bp, Homo sapiens
cccctatccacccagccca

SEQ ID NO: 2839219 - DNA, 16 bp, Homo sapiens
cccctccaggcatgct

SEQ ID NO: 2839220 - DNA, 22 bp, Homo sapiens
cccctccaggcatgctggcctc

SEQ ID NO: 2839221 - DNA, 17 bp, Homo sapiens
cccctcccccctgtaaa

SEQ ID NO: 2839222 - DNA, 12 bp, Homo sapiens
cccctcccctcc

SEQ ID NO: 2839223 - DNA, 22 bp, Homo sapiens
cccctcctcacagttgccatgt

SEQ ID NO: 2839224 - DNA, 21 bp, Homo sapiens
cccctgaaagtgacagagacc

SEQ ID NO: 2839225 - DNA, 23 bp, Homo sapiens
cccctgcagcttgtagccagccg

SEQ ID NO: 2839226 - DNA, 21 bp, Homo sapiens
cccctgcagttggcagaaagg

SEQ ID NO: 2839227 - DNA, 14 bp, Homo sapiens
cccctgccagtgcc

SEQ ID NO: 2839228 - DNA, 19 bp, Homo sapiens
cccctgcccggctgcggaa

SEQ ID NO: 2839229 - DNA, 13 bp, Homo sapiens
cccctgccctgct

SEQ ID NO: 2839230 - DNA, 15 bp, Homo sapiens
cccctgccctgctgc

SEQ ID NO: 2839231 - DNA, 13 bp, Homo sapiens
cccctgctggttc

SEQ ID NO: 2839232 - DNA, 20 bp, Homo sapiens
cccctggaccaccagcccca

SEQ ID NO: 2839233 - DNA, 13 bp, Homo sapiens
cccctgggctctg

SEQ ID NO: 2839234 - DNA, 15 bp, Homo sapiens
ctgccccaccagcca

SEQ ID NO: 2839235 - DNA, 19 bp, Homo sapiens
ctgccccaccagccacctc

SEQ ID NO: 2839236 - DNA, 20 bp, Homo sapiens
ctgcccccagcactcctctg

SEQ ID NO: 2839237 - DNA, 13 bp, Homo sapiens
ctgccccgcttcc

SEQ ID NO: 2839238 - DNA, 19 bp, Homo sapiens
ctgccccgcttccccacag

SEQ ID NO: 2839239 - DNA, 20 bp, Homo sapiens
ctgccccgggtccccagctc

SEQ ID NO: 2839240 - DNA, 17 bp, Homo sapiens
ctgcccctgtaggttgc

SEQ ID NO: 2839241 - DNA, 18 bp, Homo sapiens
ctgggcccgctttgcctg

SEQ ID NO: 2839242 - DNA, 20 bp, Homo sapiens
ctgggcccgctttgcctgct

SEQ ID NO: 2839243 - DNA, 20 bp, Homo sapiens
ctgggccctggggcctgtac

SEQ ID NO: 2839244 - DNA, 22 bp, Homo sapiens
ctgggccctggggcctgtactg

SEQ ID NO: 2839245 - DNA, 16 bp, Homo sapiens
ctgggcctatggagag

SEQ ID NO: 2839246 - DNA, 19 bp, Homo sapiens
ctgggcctatggagagccc

SEQ ID NO: 2839247 - DNA, 20 bp, Homo sapiens
ctgggcctatggagagccct

SEQ ID NO: 2839248 - DNA, 15 bp, Homo sapiens
ctgggcctgctgctg

SEQ ID NO: 2839249 - DNA, 18 bp, Homo sapiens
ctgggcctgctgctgaga

SEQ ID NO: 2839250 - DNA, 19 bp, Homo sapiens
ctgggcctgctgctgagaa

SEQ ID NO: 2839251 - DNA, 13 bp, Homo sapiens
ctgggcgacagag

SEQ ID NO: 2839252 - DNA, 14 bp, Homo sapiens
ctgggctcctggaa

SEQ ID NO: 2839253 - DNA, 17 bp, Homo sapiens
ctgggctcctggaacca

SEQ ID NO: 2839254 - DNA, 20 bp, Homo sapiens
ctgggctcctggaaccaatc

SEQ ID NO: 2839255 - DNA, 12 bp, Homo sapiens
ctgggctctcca

SEQ ID NO: 2839256 - DNA, 17 bp, Homo sapiens
ctgggctctccacctca

SEQ ID NO: 2839257 - DNA, 18 bp, Homo sapiens
ctgggctctccacctcag

SEQ ID NO: 2839258 - DNA, 19 bp, Homo sapiens
ctgggctctccacctcagc

SEQ ID NO: 2839259 - DNA, 21 bp, Homo sapiens
ctgggctctccacctcagcct

SEQ ID NO: 2839260 - DNA, 17 bp, Homo sapiens
ctgggctctgccccagc

SEQ ID NO: 2839261 - DNA, 20 bp, Homo sapiens
ctgggcttctgtccaaggca

SEQ ID NO: 2839262 - DNA, 20 bp, Homo sapiens
ctgggcttggggcttcctaa

SEQ ID NO: 2839263 - DNA, 19 bp, Homo sapiens
ctggggacaggtcctcagt

SEQ ID NO: 2839264 - DNA, 12 bp, Homo sapiens
ctggggagtccc

SEQ ID NO: 2839265 - DNA, 14 bp, Homo sapiens
ctggggcctgtact

SEQ ID NO: 2839266 - DNA, 23 bp, Homo sapiens
ctggggctctaacgcctgagccc

SEQ ID NO: 2839267 - DNA, 14 bp, Homo sapiens
ctggggctctggga

SEQ ID NO: 2839268 - DNA, 14 bp, Homo sapiens
ctggggctctgtgc

SEQ ID NO: 2839269 - DNA, 15 bp, Homo sapiens
ctggggcttctcctg

SEQ ID NO: 2839270 - DNA, 19 bp, Homo sapiens
ctggggcttctcctgaccc

SEQ ID NO: 2839271 - DNA, 13 bp, Homo sapiens
ctgggggaagggt

SEQ ID NO: 2839272 - DNA, 16 bp, Homo sapiens
ctgggggaagggtggt

SEQ ID NO: 2839273 - DNA, 13 bp, Homo sapiens
ctgggggcctcag

SEQ ID NO: 2839274 - DNA, 17 bp, Homo sapiens
ctgggggcctcagtgcc

SEQ ID NO: 2839275 - DNA, 12 bp, Homo sapiens
ctgggggcctgg

SEQ ID NO: 2839276 - DNA, 13 bp, Homo sapiens
ctgggggcctggc

SEQ ID NO: 2839277 - DNA, 18 bp, Homo sapiens
ctgggggcctggctggct

SEQ ID NO: 2839278 - DNA, 20 bp, Homo sapiens
ctgggggttctttcttcctc

SEQ ID NO: 2839279 - DNA, 15 bp, Homo sapiens
ctggggtcctggggc

SEQ ID NO: 2839280 - DNA, 13 bp, Homo sapiens
ctggggtgcgaga

SEQ ID NO: 2839281 - DNA, 13 bp, Homo sapiens
ctggggttcagcc

SEQ ID NO: 2839282 - DNA, 16 bp, Homo sapiens
ctgggtacttgtggac

SEQ ID NO: 2839283 - DNA, 19 bp, Homo sapiens
ctgggtacttgtggacaca

SEQ ID NO: 2839284 - DNA, 23 bp, Homo sapiens
ctgggtctatgtaggcccctggt

SEQ ID NO: 2839285 - DNA, 20 bp, Homo sapiens
ctgggtggggctgctcctcc

SEQ ID NO: 2839286 - DNA, 15 bp, Homo sapiens
ctgggttcactgcaa

SEQ ID NO: 2839287 - DNA, 18 bp, Homo sapiens
ctgggttcactgcaacct

SEQ ID NO: 2839288 - DNA, 18 bp, Homo sapiens
ctgggtttctctgtatag

SEQ ID NO: 2839289 - DNA, 15 bp, Homo sapiens
ctggtacaatccttt

SEQ ID NO: 2839290 - DNA, 13 bp, Homo sapiens
ctggtaggaaagc

SEQ ID NO: 2839291 - DNA, 21 bp, Homo sapiens
ctggtatgaacttgaggacac

SEQ ID NO: 2839292 - DNA, 21 bp, Homo sapiens
ctggtcacaggactctgcctc

SEQ ID NO: 2839293 - DNA, 23 bp, Homo sapiens
ctggtcacaggactctgcctcct

SEQ ID NO: 2839294 - DNA, 22 bp, Homo sapiens
ctggtcaggcccactgcagaga

SEQ ID NO: 2839295 - DNA, 15 bp, Homo sapiens
ctggtctccctccag

SEQ ID NO: 2839296 - DNA, 15 bp, Homo sapiens
ctggtcttgagatgt

SEQ ID NO: 2839297 - DNA, 18 bp, Homo sapiens
ctggtcttgtggaattgg

SEQ ID NO: 2839298 - DNA, 23 bp, Homo sapiens
ctggtgcagaggtgagcagagga

SEQ ID NO: 2839299 - DNA, 19 bp, Homo sapiens
ctggtgctataggctggag

SEQ ID NO: 2839300 - DNA, 12 bp, Homo sapiens
ctggtgctgtgg

SEQ ID NO: 2839301 - DNA, 16 bp, Homo sapiens
ctggtgctgtggccag

SEQ ID NO: 2839302 - DNA, 23 bp, Homo sapiens
ctggtgctgtggccagggtgaga

SEQ ID NO: 2839303 - DNA, 18 bp, Homo sapiens
ctggtggacagtcctggg

SEQ ID NO: 2839304 - DNA, 12 bp, Homo sapiens
ctggtggcagct

SEQ ID NO: 2839305 - DNA, 19 bp, Homo sapiens
ctggtggcagtgggagctg

SEQ ID NO: 2839306 - DNA, 17 bp, Homo sapiens
ctggtggggcagctcct

SEQ ID NO: 2839307 - DNA, 23 bp, Homo sapiens
ctggttagaaatgcagaatccta

SEQ ID NO: 2839308 - DNA, 20 bp, Homo sapiens
ctggttcacactgaccaaga

SEQ ID NO: 2839309 - DNA, 14 bp, Homo sapiens
ctggtttaatgttt

SEQ ID NO: 2839310 - DNA, 20 bp, Homo sapiens
ctggtttagcacaatttata

SEQ ID NO: 2839311 - DNA, 21 bp, Homo sapiens
ctggtttagcacaatttatat

SEQ ID NO: 2839312 - DNA, 19 bp, Homo sapiens
ctggtttctcagaatccaa

SEQ ID NO: 2839313 - DNA, 23 bp, Homo sapiens
ctggtttctcagaatccaaagat

SEQ ID NO: 2839314 - DNA, 17 bp, Homo sapiens
ctggtttgaagaatgtt

SEQ ID NO: 2839315 - DNA, 22 bp, Homo sapiens
ctgtaaacatagatagtgcttt

SEQ ID NO: 2839316 - DNA, 12 bp, Homo sapiens
ctgtaaatacaa

SEQ ID NO: 2839317 - DNA, 13 bp, Homo sapiens
ctgtaaatacaaa

SEQ ID NO: 2839318 - DNA, 20 bp, Homo sapiens
ctgtaaatagttttaaatat

SEQ ID NO: 2839319 - DNA, 17 bp, Homo sapiens
ctgtgacctgctgagct

SEQ ID NO: 2839320 - DNA, 14 bp, Homo sapiens
ctgtgactgatgtt

SEQ ID NO: 2839321 - DNA, 17 bp, Homo sapiens
ctgtgacttcagctctg

SEQ ID NO: 2839322 - DNA, 18 bp, Homo sapiens
ctgtgaggcaggggcgga

SEQ ID NO: 2839323 - DNA, 17 bp, Homo sapiens
ctgtgatggggtgggca

SEQ ID NO: 2839324 - DNA, 18 bp, Homo sapiens
ctgtgatggggtgggcag

SEQ ID NO: 2839325 - DNA, 19 bp, Homo sapiens
ctgtgatggggtgggcagg

SEQ ID NO: 2839326 - DNA, 23 bp, Homo sapiens
ctgtgatggggtgggcagggctg

SEQ ID NO: 2839327 - DNA, 18 bp, Homo sapiens
ctgtgcagatgagcagtc

SEQ ID NO: 2839328 - DNA, 22 bp, Homo sapiens
ctgtgcagggaggaggtggcag

SEQ ID NO: 2839329 - DNA, 16 bp, Homo sapiens
ctgtgcatgtatgtct

SEQ ID NO: 2839330 - DNA, 21 bp, Homo sapiens
ctgtgccagagcctggggctc

SEQ ID NO: 2839331 - DNA, 22 bp, Homo sapiens
ctgtgccagagcctggggctct

SEQ ID NO: 2839332 - DNA, 19 bp, Homo sapiens
ctgtgcccacatcccaggc

SEQ ID NO: 2839333 - DNA, 17 bp, Homo sapiens
ctgtgcccacgtgtgca

SEQ ID NO: 2839334 - DNA, 19 bp, Homo sapiens
ctgtgcccctgtaaatagt

SEQ ID NO: 2839335 - DNA, 20 bp, Homo sapiens
ctgtgccctctggattctct

SEQ ID NO: 2839336 - DNA, 22 bp, Homo sapiens
ctgtgcctcgctccccactctg

SEQ ID NO: 2839337 - DNA, 23 bp, Homo sapiens
ctgtgcctcgctccccactctgc

SEQ ID NO: 2839338 - DNA, 11 bp, Homo sapiens
ctgtgcctctg

SEQ ID NO: 2839339 - DNA, 12 bp, Homo sapiens
ctgtgcctctgc

SEQ ID NO: 2839340 - DNA, 17 bp, Homo sapiens
ctgtgcctctgcctgtc

SEQ ID NO: 2839341 - DNA, 17 bp, Homo sapiens
ctgtgctctggacaggc

SEQ ID NO: 2839342 - DNA, 19 bp, Homo sapiens
ctgtgctctggacaggcat

SEQ ID NO: 2839343 - DNA, 17 bp, Homo sapiens
ctgtgcttacagtgact

SEQ ID NO: 2839344 - DNA, 17 bp, Homo sapiens
ctgtgcttcaattaata

SEQ ID NO: 2839345 - DNA, 17 bp, Homo sapiens
ctgtgcttttaaatgca

SEQ ID NO: 2839346 - DNA, 13 bp, Homo sapiens
ctgtggagaaata

SEQ ID NO: 2839347 - DNA, 17 bp, Homo sapiens
ctgtggagagtgagaat

SEQ ID NO: 2839348 - DNA, 13 bp, Homo sapiens
ctgtggcctgggc

SEQ ID NO: 2839349 - DNA, 16 bp, Homo sapiens
ctgtggcctgggcaag

SEQ ID NO: 2839350 - DNA, 18 bp, Homo sapiens
ctgtggcggtgcctgggt

SEQ ID NO: 2839351 - DNA, 18 bp, Homo sapiens
ctgtggcgttctgctgcc

SEQ ID NO: 2839352 - DNA, 19 bp, Homo sapiens
ctgtggcgttctgctgccc

SEQ ID NO: 2839353 - DNA, 23 bp, Homo sapiens
ctgtggcgttctgctgcccctgc

SEQ ID NO: 2839354 - DNA, 18 bp, Homo sapiens
ctgtggctgcagagacct

SEQ ID NO: 2839355 - DNA, 15 bp, Homo sapiens
ctgtgggagcctcgc

SEQ ID NO: 2839356 - DNA, 14 bp, Homo sapiens
ctgtgggagcctgc

SEQ ID NO: 2839357 - DNA, 17 bp, Homo sapiens
ctgtgggggaggtccct

SEQ ID NO: 2839358 - DNA, 21 bp, Homo sapiens
ctgtgggggaggtccctgcca

SEQ ID NO: 2839359 - DNA, 16 bp, Homo sapiens
ctgtggtgatgttgcc

SEQ ID NO: 2839360 - DNA, 20 bp, Homo sapiens
ctgtggtggctgtctctgtc

SEQ ID NO: 2839361 - DNA, 18 bp, Homo sapiens
ctgtgtaacctccacagt

SEQ ID NO: 2839362 - DNA, 21 bp, Homo sapiens
ctgtgtacagaattctgctac

SEQ ID NO: 2839363 - DNA, 19 bp, Homo sapiens
ctgtgtagctctgtccact

SEQ ID NO: 2839364 - DNA, 15 bp, Homo sapiens
ctgtgtagctgtgac

SEQ ID NO: 2839365 - DNA, 16 bp, Homo sapiens
ctgtgtcccttttgca

SEQ ID NO: 2839366 - DNA, 16 bp, Homo sapiens
ctgtgtccttgcacct

SEQ ID NO: 2839367 - DNA, 16 bp, Homo sapiens
ctgtgtcgtagccaag

SEQ ID NO: 2839368 - DNA, 20 bp, Homo sapiens
ctgtgtcttgcaatggcagc

SEQ ID NO: 2839369 - DNA, 18 bp, Homo sapiens
ctgtgtgggctgcagatt

SEQ ID NO: 2839370 - DNA, 18 bp, Homo sapiens
ctgtgtgtgcgcctacag

SEQ ID NO: 2839371 - DNA, 14 bp, Homo sapiens
ctgtgttcagtgcc

SEQ ID NO: 2839372 - DNA, 18 bp, Homo sapiens
ctgtgttgcgtgtcgtgg

SEQ ID NO: 2839373 - DNA, 13 bp, Homo sapiens
ctgtgtttcttgc

SEQ ID NO: 2839374 - DNA, 17 bp, Homo sapiens
ctgtgtttcttgcctca

SEQ ID NO: 2839375 - DNA, 16 bp, Homo sapiens
ctgttaaaatgtacac

SEQ ID NO: 2839376 - DNA, 18 bp, Homo sapiens
ctgttaacgtcatctcag

SEQ ID NO: 2839377 - DNA, 13 bp, Homo sapiens
ctgttactccaca

SEQ ID NO: 2839378 - DNA, 14 bp, Homo sapiens
ctgttactttttag

SEQ ID NO: 2839379 - DNA, 14 bp, Homo sapiens
ctgttagtcatttg

SEQ ID NO: 2839380 - DNA, 15 bp, Homo sapiens
ctgttagtcatttgc

SEQ ID NO: 2839381 - DNA, 19 bp, Homo sapiens
ctgttatcaaaactttctt

SEQ ID NO: 2839382 - DNA, 12 bp, Homo sapiens
ctgttcacccac

SEQ ID NO: 2839383 - DNA, 16 bp, Homo sapiens
ctgttcacttttcctc

SEQ ID NO: 2839384 - DNA, 13 bp, Homo sapiens
ctgttcagctcca

SEQ ID NO: 2839385 - DNA, 14 bp, Homo sapiens
ctgttcagctccag

SEQ ID NO: 2839386 - DNA, 15 bp, Homo sapiens
ctgttcaggagctga

SEQ ID NO: 2839387 - DNA, 14 bp, Homo sapiens
ctgttcatggcaga

SEQ ID NO: 2839388 - DNA, 16 bp, Homo sapiens
ctgttccacttctcta

SEQ ID NO: 2839389 - DNA, 18 bp, Homo sapiens
ctgttcccattcttgcat

SEQ ID NO: 2839390 - DNA, 21 bp, Homo sapiens
ctgttcccccgctggcagcca

SEQ ID NO: 2839391 - DNA, 23 bp, Homo sapiens
ctgttcccccgctggcagccacc

SEQ ID NO: 2839392 - DNA, 15 bp, Homo sapiens
ctgttctcaaatgct

SEQ ID NO: 2839393 - DNA, 14 bp, Homo sapiens
ctgttgagacttag

SEQ ID NO: 2839394 - DNA, 15 bp, Homo sapiens
ctgttgagctgtttt

SEQ ID NO: 2839395 - DNA, 13 bp, Homo sapiens
ctgttgcccaggc

SEQ ID NO: 2839396 - DNA, 15 bp, Homo sapiens
ctgttgcccaggctg

SEQ ID NO: 2839397 - DNA, 11 bp, Homo sapiens
ctgttgctcaa

SEQ ID NO: 2839398 - DNA, 19 bp, Homo sapiens
ctgttggacccgctctgga

SEQ ID NO: 2839399 - DNA, 15 bp, Homo sapiens
ctgttggccagtgtg

SEQ ID NO: 2839400 - DNA, 22 bp, Homo sapiens
ctgttggctgggggcctcagtg

SEQ ID NO: 2839401 - DNA, 22 bp, Homo sapiens
ctgttgttgttaatgaaaatgt

SEQ ID NO: 2839402 - DNA, 22 bp, Homo sapiens
ctgtttaaaaaaagtatatatt

SEQ ID NO: 2839403 - DNA, 20 bp, Homo sapiens
ctgtttagtagcagtgattg

SEQ ID NO: 2839404 - DNA, 18 bp, Homo sapiens
ctgtttatggtattttcg

SEQ ID NO: 2839405 - DNA, 17 bp, Homo sapiens
ctgtttatttattcact

SEQ ID NO: 2839406 - DNA, 13 bp, Homo sapiens
ctgtttcctttta

SEQ ID NO: 2839407 - DNA, 20 bp, Homo sapiens
ctgtttctattctctcctca

SEQ ID NO: 2839408 - DNA, 23 bp, Homo sapiens
ctgtttctttttttatgactgta

SEQ ID NO: 2839409 - DNA, 19 bp, Homo sapiens
cttatttatatatgaagta

SEQ ID NO: 2839410 - DNA, 22 bp, Homo sapiens
cttatttatattcagagatgta

SEQ ID NO: 2839411 - DNA, 13 bp, Homo sapiens
cttatttattatt

SEQ ID NO: 2839412 - DNA, 12 bp, Homo sapiens
cttatttgcaat

SEQ ID NO: 2839413 - DNA, 16 bp, Homo sapiens
cttatttgcaataaaa

SEQ ID NO: 2839414 - DNA, 18 bp, Homo sapiens
cttatttgtttggtcact

SEQ ID NO: 2839415 - DNA, 20 bp, Homo sapiens
cttatttgtttggtcactgc

SEQ ID NO: 2839416 - DNA, 19 bp, Homo sapiens
cttattttcaagaaactga

SEQ ID NO: 2839417 - DNA, 13 bp, Homo sapiens
cttattttgtaat

SEQ ID NO: 2839418 - DNA, 21 bp, Homo sapiens
cttattttgtaataaactctc

SEQ ID NO: 2839419 - DNA, 18 bp, Homo sapiens
cttattttttaaaataat

SEQ ID NO: 2839420 - DNA, 16 bp, Homo sapiens
cttcaaagtttaataa

SEQ ID NO: 2839421 - DNA, 16 bp, Homo sapiens
cttcaaatccatccag

SEQ ID NO: 2839422 - DNA, 17 bp, Homo sapiens
cttcaactgaccagcct

SEQ ID NO: 2839423 - DNA, 18 bp, Homo sapiens
cttcaagcaccctgttcc

SEQ ID NO: 2839424 - DNA, 22 bp, Homo sapiens
cttcaagcatggctattttata

SEQ ID NO: 2839425 - DNA, 17 bp, Homo sapiens
cttcaagtgatatatgt

SEQ ID NO: 2839426 - DNA, 19 bp, Homo sapiens
cttcaagtgatatatgtat

SEQ ID NO: 2839427 - DNA, 20 bp, Homo sapiens
cctcagaccaactctctcct

SEQ ID NO: 2839428 - DNA, 10 bp, Homo sapiens
cctcagactg

SEQ ID NO: 2839429 - DNA, 15 bp, Homo sapiens
cctcagaggcagcag

SEQ ID NO: 2839430 - DNA, 16 bp, Homo sapiens
cctcagcatcctggca

SEQ ID NO: 2839431 - DNA, 14 bp, Homo sapiens
cctcagcctagacc

SEQ ID NO: 2839432 - DNA, 20 bp, Homo sapiens
cctcagcctagaccctcctc

SEQ ID NO: 2839433 - DNA, 22 bp, Homo sapiens
cctcagcctcccgaatagctgg

SEQ ID NO: 2839434 - DNA, 12 bp, Homo sapiens
cctcagcctgtg

SEQ ID NO: 2839435 - DNA, 23 bp, Homo sapiens
cctcagccttgaaaaacaagtct

SEQ ID NO: 2839436 - DNA, 23 bp, Homo sapiens
cctcagccttggataatgctgtt

SEQ ID NO: 2839437 - DNA, 13 bp, Homo sapiens
cctcagctgctcg

SEQ ID NO: 2839438 - DNA, 19 bp, Homo sapiens
cctcagctgctcgcacaga

SEQ ID NO: 2839439 - DNA, 17 bp, Homo sapiens
cctcaggcttccttggc

SEQ ID NO: 2839440 - DNA, 22 bp, Homo sapiens
cctcagggacagagacacctgc

SEQ ID NO: 2839441 - DNA, 24 bp, Homo sapiens
cctcagggacagagacacctgcac

SEQ ID NO: 2839442 - DNA, 22 bp, Homo sapiens
cctcaggtgatccacccacctc

SEQ ID NO: 2839443 - DNA, 11 bp, Homo sapiens
cctcagtgcca

SEQ ID NO: 2839444 - DNA, 11 bp, Homo sapiens
cctcagtgctc

SEQ ID NO: 2839445 - DNA, 22 bp, Homo sapiens
cctcagtgctcggcagtcatac

SEQ ID NO: 2839446 - DNA, 11 bp, Homo sapiens
cctcagtgtca

SEQ ID NO: 2839447 - DNA, 12 bp, Homo sapiens
cctcagtgtcat

SEQ ID NO: 2839448 - DNA, 23 bp, Homo sapiens
cctcagtgtcatttatgaaaaga

SEQ ID NO: 2839449 - DNA, 14 bp, Homo sapiens
cctcataccatctg

SEQ ID NO: 2839450 - DNA, 18 bp, Homo sapiens
cctcataccatctgctgc

SEQ ID NO: 2839451 - DNA, 17 bp, Homo sapiens
cctcatccgaggcaggg

SEQ ID NO: 2839452 - DNA, 20 bp, Homo sapiens
cctcatccgaggcagggtca

SEQ ID NO: 2839453 - DNA, 15 bp, Homo sapiens
cctcatgacagccag

SEQ ID NO: 2839454 - DNA, 17 bp, Homo sapiens
cctcatgaccctcctgt

SEQ ID NO: 2839455 - DNA, 18 bp, Homo sapiens
cctcatgaccctcctgtc

SEQ ID NO: 2839456 - DNA, 20 bp, Homo sapiens
cctcatgaccctcctgtcca

SEQ ID NO: 2839457 - DNA, 23 bp, Homo sapiens
cctcatgaccctcctgtccagca

SEQ ID NO: 2839458 - DNA, 15 bp, Homo sapiens
cctcatgcctggccc

SEQ ID NO: 2839459 - DNA, 13 bp, Homo sapiens
cctcattcaggaa

SEQ ID NO: 2839460 - DNA, 15 bp, Homo sapiens
cctcattcaggaaaa

SEQ ID NO: 2839461 - DNA, 13 bp, Homo sapiens
cctcattcccctc

SEQ ID NO: 2839462 - DNA, 14 bp, Homo sapiens
cctcattcccctcg

SEQ ID NO: 2839463 - DNA, 16 bp, Homo sapiens
cctcatttatccctca

SEQ ID NO: 2839464 - DNA, 18 bp, Homo sapiens
cctcatttttttccttgc

SEQ ID NO: 2839465 - DNA, 15 bp, Homo sapiens
cctccaattccacag

SEQ ID NO: 2839466 - DNA, 16 bp, Homo sapiens
cctccaattccacagt

SEQ ID NO: 2839467 - DNA, 20 bp, Homo sapiens
cctccaattccacagtctct

SEQ ID NO: 2839468 - DNA, 16 bp, Homo sapiens
cctccacagccgcagc

SEQ ID NO: 2839469 - DNA, 15 bp, Homo sapiens
cctccaccccaggac

SEQ ID NO: 2839470 - DNA, 15 bp, Homo sapiens
cctccagctggaatt

SEQ ID NO: 2839471 - DNA, 19 bp, Homo sapiens
cctccaggcatgctggcct

SEQ ID NO: 2839472 - DNA, 19 bp, Homo sapiens
cctccagggccacgtgcca

SEQ ID NO: 2839473 - DNA, 14 bp, Homo sapiens
cctccatgctgcct

SEQ ID NO: 2839474 - DNA, 23 bp, Homo sapiens
cctccatgtgggctagttgggct

SEQ ID NO: 2839475 - DNA, 16 bp, Homo sapiens
cctcccaaccccaggg

SEQ ID NO: 2839476 - DNA, 17 bp, Homo sapiens
cctcccaataaagctgg

SEQ ID NO: 2839477 - DNA, 14 bp, Homo sapiens
cctcccacccccag

SEQ ID NO: 2839478 - DNA, 19 bp, Homo sapiens
cctcccagccctatggatg

SEQ ID NO: 2839479 - DNA, 12 bp, Homo sapiens
cctcccagcctg

SEQ ID NO: 2839480 - DNA, 14 bp, Homo sapiens
cctcccagggccag

SEQ ID NO: 2839481 - DNA, 14 bp, Homo sapiens
cctccccaccttcc

SEQ ID NO: 2839482 - DNA, 15 bp, Homo sapiens
cctccccaccttccc

SEQ ID NO: 2839483 - DNA, 17 bp, Homo sapiens
cctccccattcacagag

SEQ ID NO: 2839484 - DNA, 13 bp, Homo sapiens
cctccccccactg

SEQ ID NO: 2839485 - DNA, 15 bp, Homo sapiens
cctccccccactgca

SEQ ID NO: 2839486 - DNA, 15 bp, Homo sapiens
cctccccgcaccccc

SEQ ID NO: 2839487 - DNA, 21 bp, Homo sapiens
cctccccgcaccccccaagct

SEQ ID NO: 2839488 - DNA, 14 bp, Homo sapiens
cctcccctgcccta

SEQ ID NO: 2839489 - DNA, 17 bp, Homo sapiens
cctccccttcctgcacc

SEQ ID NO: 2839490 - DNA, 18 bp, Homo sapiens
cctccccttcctgcaccc

SEQ ID NO: 2839491 - DNA, 19 bp, Homo sapiens
cctcccgaatagctgggac

SEQ ID NO: 2839492 - DNA, 20 bp, Homo sapiens
cctcccgaatagctgggact

SEQ ID NO: 2839493 - DNA, 21 bp, Homo sapiens
cctcccgaatagctgggacta

SEQ ID NO: 2839494 - DNA, 19 bp, Homo sapiens
cctcccgagtagctgggac

SEQ ID NO: 2839495 - DNA, 20 bp, Homo sapiens
cctcccgagtagctgggact

SEQ ID NO: 2839496 - DNA, 21 bp, Homo sapiens
cctcccgagtagctgggacta

SEQ ID NO: 2839497 - DNA, 16 bp, Homo sapiens
cctccctccaccccag

SEQ ID NO: 2839498 - DNA, 17 bp, Homo sapiens
cctccctccaccccagg

SEQ ID NO: 2839499 - DNA, 13 bp, Homo sapiens
cctccctctaatt

SEQ ID NO: 2839500 - DNA, 18 bp, Homo sapiens
cctccctctgacctgcag

SEQ ID NO: 2839501 - DNA, 20 bp, Homo sapiens
cctccctcttccttccccca

SEQ ID NO: 2839502 - DNA, 12 bp, Homo sapiens
cctccctggcct

SEQ ID NO: 2839503 - DNA, 14 bp, Homo sapiens
cctccctggcctca

SEQ ID NO: 2839504 - DNA, 11 bp, Homo sapiens
cctccctgtcc

SEQ ID NO: 2839505 - DNA, 14 bp, Homo sapiens
cctccctgtcctcc

SEQ ID NO: 2839506 - DNA, 13 bp, Homo sapiens
cctccgccccaga

SEQ ID NO: 2839507 - DNA, 13 bp, Homo sapiens
cctccgcctcttg

SEQ ID NO: 2839508 - DNA, 13 bp, Homo sapiens
cctcctcaccccg

SEQ ID NO: 2839509 - DNA, 14 bp, Homo sapiens
cctcctccccttcc

SEQ ID NO: 2839510 - DNA, 19 bp, Homo sapiens
cctcctccccttcctgcac

SEQ ID NO: 2839511 - DNA, 18 bp, Homo sapiens
cctcctctgccacctccc

SEQ ID NO: 2839512 - DNA, 16 bp, Homo sapiens
cctcctctgtccaggg

SEQ ID NO: 2839513 - DNA, 18 bp, Homo sapiens
cctcctctgtccagggcc

SEQ ID NO: 2839514 - DNA, 12 bp, Homo sapiens
cctcctgccctc

SEQ ID NO: 2839515 - DNA, 12 bp, Homo sapiens
cctcctgcctct

SEQ ID NO: 2839516 - DNA, 13 bp, Homo sapiens
cctcctgggctaa

SEQ ID NO: 2839517 - DNA, 15 bp, Homo sapiens
cctcctgtgtgtgcg

SEQ ID NO: 2839518 - DNA, 19 bp, Homo sapiens
cctccttcctcagtcctgg

SEQ ID NO: 2839519 - DNA, 14 bp, Homo sapiens
ccctcctttcacca

SEQ ID NO: 2839520 - DNA, 19 bp, Homo sapiens
ccctcgctgtcctgctgtg

SEQ ID NO: 2839521 - DNA, 17 bp, Homo sapiens
ccctcgtggacacctgc

SEQ ID NO: 2839522 - DNA, 22 bp, Homo sapiens
ccctcgtggacacctgccctgc

SEQ ID NO: 2839523 - DNA, 14 bp, Homo sapiens
ccctctatttctct

SEQ ID NO: 2839524 - DNA, 11 bp, Homo sapiens
ccctctcctgc

SEQ ID NO: 2839525 - DNA, 17 bp, Homo sapiens
ccctctcttccctatta

SEQ ID NO: 2839526 - DNA, 13 bp, Homo sapiens
ccctctcttgcct

SEQ ID NO: 2839527 - DNA, 21 bp, Homo sapiens
ccctctgagaattccaaggag

SEQ ID NO: 2839528 - DNA, 15 bp, Homo sapiens
ccctctggattctct

SEQ ID NO: 2839529 - DNA, 13 bp, Homo sapiens
ccctctggccctg

SEQ ID NO: 2839530 - DNA, 16 bp, Homo sapiens
ccctctggccctgcct

SEQ ID NO: 2839531 - DNA, 17 bp, Homo sapiens
ccctcttccttccccca

SEQ ID NO: 2839532 - DNA, 19 bp, Homo sapiens
ccctcttgacccatctccc

SEQ ID NO: 2839533 - DNA, 23 bp, Homo sapiens
ccctctttctttcttttgtgttg

SEQ ID NO: 2839534 - DNA, 22 bp, Homo sapiens
ccctctttgtgtacttcagtct

SEQ ID NO: 2839535 - DNA, 14 bp, Homo sapiens
ccctgaaaacccag

SEQ ID NO: 2839536 - DNA, 14 bp, Homo sapiens
ccctgaacaagaat

SEQ ID NO: 2839537 - DNA, 14 bp, Homo sapiens
ccctgaacatctgt

SEQ ID NO: 2839538 - DNA, 17 bp, Homo sapiens
ccctgaagatttcagag

SEQ ID NO: 2839539 - DNA, 11 bp, Homo sapiens
ccctgacctcc

SEQ ID NO: 2839540 - DNA, 19 bp, Homo sapiens
ccctgacctcccagcccta

SEQ ID NO: 2839541 - DNA, 21 bp, Homo sapiens
ccctgacctcccagccctatg

SEQ ID NO: 2839542 - DNA, 15 bp, Homo sapiens
ccctgagaaacccac

SEQ ID NO: 2839543 - DNA, 19 bp, Homo sapiens
ccctgagaaacccaccagc

SEQ ID NO: 2839544 - DNA, 20 bp, Homo sapiens
ccctgagaaacccaccagcc

SEQ ID NO: 2839545 - DNA, 18 bp, Homo sapiens
ccctgagatcagagtcct

SEQ ID NO: 2839546 - DNA, 12 bp, Homo sapiens
ccctgagcctga

SEQ ID NO: 2839547 - DNA, 13 bp, Homo sapiens
ccctgaggagtct

SEQ ID NO: 2839548 - DNA, 15 bp, Homo sapiens
ccctgaggagtctga

SEQ ID NO: 2839549 - DNA, 15 bp, Homo sapiens
ccctgaggtcacctg

SEQ ID NO: 2839550 - DNA, 19 bp, Homo sapiens
ccctgagtggatctccaag

SEQ ID NO: 2839551 - DNA, 21 bp, Homo sapiens
ccctgagtggatctccaagga

SEQ ID NO: 2839552 - DNA, 23 bp, Homo sapiens
ccctgagtggatctccaaggacc

SEQ ID NO: 2839553 - DNA, 23 bp, Homo sapiens
ccctgcaccagcccttccctgct

SEQ ID NO: 2839554 - DNA, 20 bp, Homo sapiens
ccctgcagcttgtagccagc

SEQ ID NO: 2839555 - DNA, 20 bp, Homo sapiens
ccctgcagttggcagaaagg

SEQ ID NO: 2839556 - DNA, 18 bp, Homo sapiens
ccctgccacactcagtcc

SEQ ID NO: 2839557 - DNA, 15 bp, Homo sapiens
ccctgccacctgtct

SEQ ID NO: 2839558 - DNA, 18 bp, Homo sapiens
ccctgccctgccacctgt

SEQ ID NO: 2839559 - DNA, 13 bp, Homo sapiens
ccctgccctgtcc

SEQ ID NO: 2839560 - DNA, 15 bp, Homo sapiens
ccctgccctgtcctc

SEQ ID NO: 2839561 - DNA, 23 bp, Homo sapiens
ccctgcccttgtttggggcagga

SEQ ID NO: 2839562 - DNA, 10 bp, Homo sapiens
ccctgcctgg

SEQ ID NO: 2839563 - DNA, 11 bp, Homo sapiens
ccctgcctgga

SEQ ID NO: 2839564 - DNA, 13 bp, Homo sapiens
ccctgcctggagg

SEQ ID NO: 2839565 - DNA, 17 bp, Homo sapiens
ccctgcctggaggacct

SEQ ID NO: 2839566 - DNA, 20 bp, Homo sapiens
ccctgcgaaggggccctggt

SEQ ID NO: 2839567 - DNA, 12 bp, Homo sapiens
ccctgcggagcc

SEQ ID NO: 2839568 - DNA, 22 bp, Homo sapiens
ccctgctctccgaccagacacc

SEQ ID NO: 2839569 - DNA, 13 bp, Homo sapiens
ccctgctggttca

SEQ ID NO: 2839570 - DNA, 19 bp, Homo sapiens
ccctgctggttcagggttg

SEQ ID NO: 2839571 - DNA, 16 bp, Homo sapiens
ccctgcttctcagccc

SEQ ID NO: 2839572 - DNA, 20 bp, Homo sapiens
ccctggaccaccagccccag

SEQ ID NO: 2839573 - DNA, 13 bp, Homo sapiens
ccctggagagaag

SEQ ID NO: 2839574 - DNA, 20 bp, Homo sapiens
ccctggagcggctctcctga

SEQ ID NO: 2839575 - DNA, 20 bp, Homo sapiens
ccctggatcagcgtggcctt

SEQ ID NO: 2839576 - DNA, 19 bp, Homo sapiens
ccctggatccatcaggcca

SEQ ID NO: 2839577 - DNA, 17 bp, Homo sapiens
ccctggatgtgcccaca

SEQ ID NO: 2839578 - DNA, 22 bp, Homo sapiens
ccctggcaggatgaccctgcga

SEQ ID NO: 2839579 - DNA, 21 bp, Homo sapiens
ccctggcatgaccatcctgtc

SEQ ID NO: 2839580 - DNA, 11 bp, Homo sapiens
ccctggcctca

SEQ ID NO: 2839581 - DNA, 20 bp, Homo sapiens
ccctggcctcacgcccagcc

SEQ ID NO: 2839582 - DNA, 14 bp, Homo sapiens
ccctggcctgctgg

SEQ ID NO: 2839583 - DNA, 20 bp, Homo sapiens
ccctggcctggctctcctgt

SEQ ID NO: 2839584 - DNA, 19 bp, Homo sapiens
ccctggctctcagaaggta

SEQ ID NO: 2839585 - DNA, 23 bp, Homo sapiens
ccctggctgaccccaaagagcct

SEQ ID NO: 2839586 - DNA, 13 bp, Homo sapiens
ccctgggaaaggg

SEQ ID NO: 2839587 - DNA, 16 bp, Homo sapiens
ccctgggccccaccac

SEQ ID NO: 2839588 - DNA, 11 bp, Homo sapiens
ccctgggcctg

SEQ ID NO: 2839589 - DNA, 13 bp, Homo sapiens
ccctgggcctgct

SEQ ID NO: 2839590 - DNA, 15 bp, Homo sapiens
ccctgggcctgctgc

SEQ ID NO: 2839591 - DNA, 20 bp, Homo sapiens
ccctgggcctgctgctgaga

SEQ ID NO: 2839592 - DNA, 18 bp, Homo sapiens
ccctggggcttctcctga

SEQ ID NO: 2839593 - DNA, 18 bp, Homo sapiens
ccctgggggaagccctgg

SEQ ID NO: 2839594 - DNA, 20 bp, Homo sapiens
ccctgggggaagccctggat

SEQ ID NO: 2839595 - DNA, 16 bp, Homo sapiens
ccctggtaggaaagca

SEQ ID NO: 2839596 - DNA, 19 bp, Homo sapiens
ccctggtgcagaggtgagc

SEQ ID NO: 2839597 - DNA, 18 bp, Homo sapiens
ccctggtggacagtcctg

SEQ ID NO: 2839598 - DNA, 20 bp, Homo sapiens
ccctggtggacagtcctggg

SEQ ID NO: 2839599 - DNA, 17 bp, Homo sapiens
ccctgtacaatatttaa

SEQ ID NO: 2839600 - DNA, 14 bp, Homo sapiens
ccctgtaggttgct

SEQ ID NO: 2839601 - DNA, 14 bp, Homo sapiens
ccctgtcaccaagc

SEQ ID NO: 2839602 - DNA, 19 bp, Homo sapiens
ccctgtcctccagcttccc

SEQ ID NO: 2839603 - DNA, 14 bp, Homo sapiens
ccctgtctaaaaaa

SEQ ID NO: 2839604 - DNA, 23 bp, Homo sapiens
ccctgtgtgagttgagtctcctc

SEQ ID NO: 2839605 - DNA, 14 bp, Homo sapiens
cccttagcagggaa

SEQ ID NO: 2839606 - DNA, 13 bp, Homo sapiens
cccttatccagga

SEQ ID NO: 2839607 - DNA, 14 bp, Homo sapiens
cccttatccaggac

SEQ ID NO: 2839608 - DNA, 16 bp, Homo sapiens
cccttatccaggactc

SEQ ID NO: 2839609 - DNA, 13 bp, Homo sapiens
cccttcagtgccc

SEQ ID NO: 2839610 - DNA, 19 bp, Homo sapiens
ccagcttcccctcgctgtc

SEQ ID NO: 2839611 - DNA, 22 bp, Homo sapiens
ccagcttcccctcgctgtcctg

SEQ ID NO: 2839612 - DNA, 16 bp, Homo sapiens
ccagcttctccaggct

SEQ ID NO: 2839613 - DNA, 15 bp, Homo sapiens
ccagcttgttattta

SEQ ID NO: 2839614 - DNA, 16 bp, Homo sapiens
ccagcttgttatttat

SEQ ID NO: 2839615 - DNA, 17 bp, Homo sapiens
ccagcttgttatttata

SEQ ID NO: 2839616 - DNA, 23 bp, Homo sapiens
ccaggaaactctgcattctagta

SEQ ID NO: 2839617 - DNA, 22 bp, Homo sapiens
ccaggaacacccgactcctcaa

SEQ ID NO: 2839618 - DNA, 22 bp, Homo sapiens
ccaggaagggggtccacccagc

SEQ ID NO: 2839619 - DNA, 15 bp, Homo sapiens
ccaggacaggcccgg

SEQ ID NO: 2839620 - DNA, 14 bp, Homo sapiens
ccaggacgccactc

SEQ ID NO: 2839621 - DNA, 15 bp, Homo sapiens
ccaggacgccactca

SEQ ID NO: 2839622 - DNA, 16 bp, Homo sapiens
ccaggacgccactcat

SEQ ID NO: 2839623 - DNA, 20 bp, Homo sapiens
ccaggacgccactcatttca

SEQ ID NO: 2839624 - DNA, 18 bp, Homo sapiens
ccaggactatagcccagg

SEQ ID NO: 2839625 - DNA, 15 bp, Homo sapiens
ccaggactcaccctc

SEQ ID NO: 2839626 - DNA, 19 bp, Homo sapiens
ccaggactccccaggccag

SEQ ID NO: 2839627 - DNA, 22 bp, Homo sapiens
ccaggactccccaggccaggcc

SEQ ID NO: 2839628 - DNA, 15 bp, Homo sapiens
ccaggagaagaaaga

SEQ ID NO: 2839629 - DNA, 20 bp, Homo sapiens
ccaggagaagaaagaggtga

SEQ ID NO: 2839630 - DNA, 16 bp, Homo sapiens
ccaggagagccagccc

SEQ ID NO: 2839631 - DNA, 19 bp, Homo sapiens
ccaggagagccagccctcc

SEQ ID NO: 2839632 - DNA, 20 bp, Homo sapiens
ccaggagagccagccctccc

SEQ ID NO: 2839633 - DNA, 15 bp, Homo sapiens
ccaggagccccgagg

SEQ ID NO: 2839634 - DNA, 20 bp, Homo sapiens
ccaggagccccgaggccttc

SEQ ID NO: 2839635 - DNA, 17 bp, Homo sapiens
ccaggagcctgtgcctc

SEQ ID NO: 2839636 - DNA, 18 bp, Homo sapiens
ccaggaggagaggaaagg

SEQ ID NO: 2839637 - DNA, 16 bp, Homo sapiens
ccaggagggacaaagg

SEQ ID NO: 2839638 - DNA, 17 bp, Homo sapiens
ccaggagggacaaagga

SEQ ID NO: 2839639 - DNA, 17 bp, Homo sapiens
ccaggagtttgagacca

SEQ ID NO: 2839640 - DNA, 21 bp, Homo sapiens
ccaggagtttgaggctgcagc

SEQ ID NO: 2839641 - DNA, 18 bp, Homo sapiens
ccaggagtttgtgtgtct

SEQ ID NO: 2839642 - DNA, 19 bp, Homo sapiens
ccaggatcgctttgtactt

SEQ ID NO: 2839643 - DNA, 23 bp, Homo sapiens
ccaggattttaacaaaagcaaga

SEQ ID NO: 2839644 - DNA, 18 bp, Homo sapiens
ccaggcaccccctggaga

SEQ ID NO: 2839645 - DNA, 21 bp, Homo sapiens
ccaggcacccttctttcctct

SEQ ID NO: 2839646 - DNA, 18 bp, Homo sapiens
ccaggcacgaacccacct

SEQ ID NO: 2839647 - DNA, 22 bp, Homo sapiens
ccaggcacgaacccacctgctg

SEQ ID NO: 2839648 - DNA, 23 bp, Homo sapiens
ccaggcacgaacccacctgctga

SEQ ID NO: 2839649 - DNA, 12 bp, Homo sapiens
cccagatcctca

SEQ ID NO: 2839650 - DNA, 23 bp, Homo sapiens
cccagattgcaacaggctgggct

SEQ ID NO: 2839651 - DNA, 15 bp, Homo sapiens
cccagcaacacaagc

SEQ ID NO: 2839652 - DNA, 20 bp, Homo sapiens
cccagcaagagcacaagagg

SEQ ID NO: 2839653 - DNA, 18 bp, Homo sapiens
cccagcaagtgagagctg

SEQ ID NO: 2839654 - DNA, 16 bp, Homo sapiens
cccagcactcctctgt

SEQ ID NO: 2839655 - DNA, 13 bp, Homo sapiens
cccagcactgtga

SEQ ID NO: 2839656 - DNA, 14 bp, Homo sapiens
cccagcactgtgaa

SEQ ID NO: 2839657 - DNA, 18 bp, Homo sapiens
cccagcacttgtgttgtc

SEQ ID NO: 2839658 - DNA, 17 bp, Homo sapiens
cccagcagccctaagga

SEQ ID NO: 2839659 - DNA, 13 bp, Homo sapiens
cccagcaggaagc

SEQ ID NO: 2839660 - DNA, 15 bp, Homo sapiens
cccagcaggaagcca

SEQ ID NO: 2839661 - DNA, 21 bp, Homo sapiens
cccagcaggaagccaggctga

SEQ ID NO: 2839662 - DNA, 21 bp, Homo sapiens
cccagcatccttttctgcaga

SEQ ID NO: 2839663 - DNA, 13 bp, Homo sapiens
cccagccagaagt

SEQ ID NO: 2839664 - DNA, 19 bp, Homo sapiens
cccagccattaccatggag

SEQ ID NO: 2839665 - DNA, 17 bp, Homo sapiens
cccagcccacttctgcc

SEQ ID NO: 2839666 - DNA, 13 bp, Homo sapiens
cccagcccccacc

SEQ ID NO: 2839667 - DNA, 23 bp, Homo sapiens
cccagcccccacctccgccccag

SEQ ID NO: 2839668 - DNA, 17 bp, Homo sapiens
cccagccccgactccag

SEQ ID NO: 2839669 - DNA, 21 bp, Homo sapiens
cccagccccgactccagccag

SEQ ID NO: 2839670 - DNA, 18 bp, Homo sapiens
cccagcctccaagctcca

SEQ ID NO: 2839671 - DNA, 18 bp, Homo sapiens
cccagcctcgcatgccag

SEQ ID NO: 2839672 - DNA, 13 bp, Homo sapiens
cccagcctctgtc

SEQ ID NO: 2839673 - DNA, 14 bp, Homo sapiens
cccagcctgggcct

SEQ ID NO: 2839674 - DNA, 16 bp, Homo sapiens
cccagcctgggcctat

SEQ ID NO: 2839675 - DNA, 24 bp, Homo sapiens
ccagcactaaagcagtggacacca

SEQ ID NO: 2839676 - DNA, 12 bp, Homo sapiens
ccagcactaacg

SEQ ID NO: 2839677 - DNA, 15 bp, Homo sapiens
ccagcactcctctgt

SEQ ID NO: 2839678 - DNA, 17 bp, Homo sapiens
ccagcactcctctgtct

SEQ ID NO: 2839679 - DNA, 18 bp, Homo sapiens
ccagcactcctctgtctc

SEQ ID NO: 2839680 - DNA, 19 bp, Homo sapiens
ccagcactcctctgtctct

SEQ ID NO: 2839681 - DNA, 14 bp, Homo sapiens
ccagcactgtgaag

SEQ ID NO: 2839682 - DNA, 17 bp, Homo sapiens
ccagcactttgggaggc

SEQ ID NO: 2839683 - DNA, 20 bp, Homo sapiens
ccagcactttgggaggctga

SEQ ID NO: 2839684 - DNA, 16 bp, Homo sapiens
ccagcagaaaagtgct

SEQ ID NO: 2839685 - DNA, 20 bp, Homo sapiens
ccagcagccagctctcagcc

SEQ ID NO: 2839686 - DNA, 14 bp, Homo sapiens
ccagcaggaagcca

SEQ ID NO: 2839687 - DNA, 20 bp, Homo sapiens
ccagcaggaagccaggctga

SEQ ID NO: 2839688 - DNA, 15 bp, Homo sapiens
ccagcagtttgggag

SEQ ID NO: 2839689 - DNA, 21 bp, Homo sapiens
ccagcatccttttctgcagag

SEQ ID NO: 2839690 - DNA, 20 bp, Homo sapiens
ccagccacacagagcctgcc

SEQ ID NO: 2839691 - DNA, 22 bp, Homo sapiens
ccagccacacagagcctgcctc

SEQ ID NO: 2839692 - DNA, 23 bp, Homo sapiens
ccagccacacagagcctgcctca

SEQ ID NO: 2839693 - DNA, 15 bp, Homo sapiens
ccagccacctcttgg

SEQ ID NO: 2839694 - DNA, 20 bp, Homo sapiens
ccagccactcgggaggctga

SEQ ID NO: 2839695 - DNA, 19 bp, Homo sapiens
ccagccagcagccagctct

SEQ ID NO: 2839696 - DNA, 13 bp, Homo sapiens
ccagccagcgcct

SEQ ID NO: 2839697 - DNA, 15 bp, Homo sapiens
ccagccagcgcctcc

SEQ ID NO: 2839698 - DNA, 16 bp, Homo sapiens
ccagccagcgcctccc

SEQ ID NO: 2839699 - DNA, 20 bp, Homo sapiens
ccagccatcaagagactgag

SEQ ID NO: 2839700 - DNA, 21 bp, Homo sapiens
ccagccatcatgtgcctggaa

SEQ ID NO: 2839701 - DNA, 14 bp, Homo sapiens
ccagcccagcccag

SEQ ID NO: 2839702 - DNA, 17 bp, Homo sapiens
ccagcccattctctctc

SEQ ID NO: 2839703 - DNA, 22 bp, Homo sapiens
ccagcccattctctctcctgtc

SEQ ID NO: 2839704 - DNA, 14 bp, Homo sapiens
ccagccccgactcc

SEQ ID NO: 2839705 - DNA, 11 bp, Homo sapiens
ccagcccctcc

SEQ ID NO: 2839706 - DNA, 20 bp, Homo sapiens
ccagcccggcctgctcccag

SEQ ID NO: 2839707 - DNA, 13 bp, Homo sapiens
ccagccctccctg

SEQ ID NO: 2839708 - DNA, 20 bp, Homo sapiens
ccagccctccctgtcctcct

SEQ ID NO: 2839709 - DNA, 22 bp, Homo sapiens
ccagccctccctgtcctcctcg

SEQ ID NO: 2839710 - DNA, 21 bp, Homo sapiens
ccagccctgcctggaggacct

SEQ ID NO: 2839711 - DNA, 22 bp, Homo sapiens
ccagccctgcctggaggacctg

SEQ ID NO: 2839712 - DNA, 15 bp, Homo sapiens
ccagcccttccctgc

SEQ ID NO: 2839713 - DNA, 20 bp, Homo sapiens
ccagccctttgggaggctga

SEQ ID NO: 2839714 - DNA, 18 bp, Homo sapiens
ccagccgtgatgctcagg

SEQ ID NO: 2839715 - DNA, 19 bp, Homo sapiens
ccagccgtgatgctcaggc

SEQ ID NO: 2839716 - DNA, 18 bp, Homo sapiens
cagtgggagctgcctgtt

SEQ ID NO: 2839717 - DNA, 20 bp, Homo sapiens
cagtgggagctgcctgttca

SEQ ID NO: 2839718 - DNA, 20 bp, Homo sapiens
cagtggtaagctctggcttt

SEQ ID NO: 2839719 - DNA, 16 bp, Homo sapiens
cagtggtaccagctca

SEQ ID NO: 2839720 - DNA, 21 bp, Homo sapiens
cagtggtatgatcacggctca

SEQ ID NO: 2839721 - DNA, 14 bp, Homo sapiens
cagtggtgaagaaa

SEQ ID NO: 2839722 - DNA, 17 bp, Homo sapiens
cagtggtgaagaaaact

SEQ ID NO: 2839723 - DNA, 23 bp, Homo sapiens
cagtggtgaagaaaactccttta

SEQ ID NO: 2839724 - DNA, 19 bp, Homo sapiens
cagtggtgcgatctgggtt

SEQ ID NO: 2839725 - DNA, 20 bp, Homo sapiens
cagtggtgcgatctgggttc

SEQ ID NO: 2839726 - DNA, 13 bp, Homo sapiens
cagtggttgctgt

SEQ ID NO: 2839727 - DNA, 14 bp, Homo sapiens
cagtggttgctgtt

SEQ ID NO: 2839728 - DNA, 20 bp, Homo sapiens
cagtgtccttggcaggctga

SEQ ID NO: 2839729 - DNA, 22 bp, Homo sapiens
cagtgtctgtatcggagacagt

SEQ ID NO: 2839730 - DNA, 23 bp, Homo sapiens
cagtgtcttccataatgtataaa

SEQ ID NO: 2839731 - DNA, 22 bp, Homo sapiens
cagtgtgatcccaagtgccagt

SEQ ID NO: 2839732 - DNA, 13 bp, Homo sapiens
cagtgtggcccca

SEQ ID NO: 2839733 - DNA, 14 bp, Homo sapiens
cagtgtggccccag

SEQ ID NO: 2839734 - DNA, 20 bp, Homo sapiens
cagtgtgtcacactgagctg

SEQ ID NO: 2839735 - DNA, 14 bp, Homo sapiens
cagtgtttcccata

SEQ ID NO: 2839736 - DNA, 17 bp, Homo sapiens
cagtgtttcccataatt

SEQ ID NO: 2839737 - DNA, 15 bp, Homo sapiens
cagtgttttctggga

SEQ ID NO: 2839738 - DNA, 22 bp, Homo sapiens
cagtgttttctgggataagtaa

SEQ ID NO: 2839739 - DNA, 12 bp, Homo sapiens
cagttaaaatgt

SEQ ID NO: 2839740 - DNA, 22 bp, Homo sapiens
cagttacaaaaatagtagaaca

SEQ ID NO: 2839741 - DNA, 13 bp, Homo sapiens
cagttaccgagga

SEQ ID NO: 2839742 - DNA, 13 bp, Homo sapiens
cagttactcagcc

SEQ ID NO: 2839743 - DNA, 16 bp, Homo sapiens
cagttactcagccctg

SEQ ID NO: 2839744 - DNA, 17 bp, Homo sapiens
cagttactcagccctgg

SEQ ID NO: 2839745 - DNA, 18 bp, Homo sapiens
cagttactcagccctggg

SEQ ID NO: 2839746 - DNA, 19 bp, Homo sapiens
cagttactggtttcagttg

SEQ ID NO: 2839747 - DNA, 19 bp, Homo sapiens
cagttagggttgagttact

SEQ ID NO: 2839748 - DNA, 13 bp, Homo sapiens
cagttcaaagaag

SEQ ID NO: 2839749 - DNA, 17 bp, Homo sapiens
cagttcaggagtcccaa

SEQ ID NO: 2839750 - DNA, 21 bp, Homo sapiens
cagttcatctatggcagtcca

SEQ ID NO: 2839751 - DNA, 22 bp, Homo sapiens
cagttcatctatggcagtccag

SEQ ID NO: 2839752 - DNA, 14 bp, Homo sapiens
cagttcctcgccct

SEQ ID NO: 2839753 - DNA, 18 bp, Homo sapiens
cagttcgcagccaccctg

SEQ ID NO: 2839754 - DNA, 13 bp, Homo sapiens
cagttctgctcct

SEQ ID NO: 2839755 - DNA, 15 bp, Homo sapiens
cagttctgctcctct

SEQ ID NO: 2839756 - DNA, 20 bp, Homo sapiens
cagttctgctcctctccagg

SEQ ID NO: 2839757 - DNA, 20 bp, Homo sapiens
cagttgacttactgtttctt

SEQ ID NO: 2839758 - DNA, 22 bp, Homo sapiens
cagttgaggaatatgactgttt

SEQ ID NO: 2839759 - DNA, 15 bp, Homo sapiens
cagttgcaataaaat

SEQ ID NO: 2839760 - DNA, 22 bp, Homo sapiens
cagttgcaataaaatagtattg

SEQ ID NO: 2839761 - DNA, 16 bp, Homo sapiens
cagttgggtggatgcc

SEQ ID NO: 2839762 - DNA, 22 bp, Homo sapiens
cagtttcaggtgtttagttgca

SEQ ID NO: 2839763 - DNA, 22 bp, Homo sapiens
cagtttcttactgttttgtatc

SEQ ID NO: 2839764 - DNA, 14 bp, Homo sapiens
cagtttgctttgcc

SEQ ID NO: 2839765 - DNA, 16 bp, Homo sapiens
cagtttgctttgccct

SEQ ID NO: 2839766 - DNA, 16 bp, Homo sapiens
cagttttaactagaat

SEQ ID NO: 2839767 - DNA, 15 bp, Homo sapiens
cataaaaatgatcta

SEQ ID NO: 2839768 - DNA, 20 bp, Homo sapiens
cataaaatatacaaacatgt

SEQ ID NO: 2839769 - DNA, 16 bp, Homo sapiens
cataaacttcatggtc

SEQ ID NO: 2839770 - DNA, 16 bp, Homo sapiens
cataaaggtatttaga

SEQ ID NO: 2839771 - DNA, 20 bp, Homo sapiens
cataaaggtggtatgtgtgt

SEQ ID NO: 2839772 - DNA, 16 bp, Homo sapiens
ccacgctggagtgcag

SEQ ID NO: 2839773 - DNA, 15 bp, Homo sapiens
ccacggcacctgggc

SEQ ID NO: 2839774 - DNA, 20 bp, Homo sapiens
ccacggcacctgggccctgg

SEQ ID NO: 2839775 - DNA, 15 bp, Homo sapiens
ccacgtccccctggg

SEQ ID NO: 2839776 - DNA, 16 bp, Homo sapiens
ccacgtgtgcagactg

SEQ ID NO: 2839777 - DNA, 17 bp, Homo sapiens
ccacgtgtgcagactgt

SEQ ID NO: 2839778 - DNA, 15 bp, Homo sapiens
ccacgttaagtccaa

SEQ ID NO: 2839779 - DNA, 20 bp, Homo sapiens
ccacgttccttactgcagaa

SEQ ID NO: 2839780 - DNA, 18 bp, Homo sapiens
ccactacactccagcctg

SEQ ID NO: 2839781 - DNA, 19 bp, Homo sapiens
ccactacactccagcctga

SEQ ID NO: 2839782 - DNA, 20 bp, Homo sapiens
ccactacactccagcctgag

SEQ ID NO: 2839783 - DNA, 20 bp, Homo sapiens
ccactcaaattaatctttct

SEQ ID NO: 2839784 - DNA, 20 bp, Homo sapiens
ccactcaggccaacaagcca

SEQ ID NO: 2839785 - DNA, 13 bp, Homo sapiens
ccactcatttcat

SEQ ID NO: 2839786 - DNA, 16 bp, Homo sapiens
ccactcctccaaagga

SEQ ID NO: 2839787 - DNA, 18 bp, Homo sapiens
ccactccttcctgcccca

SEQ ID NO: 2839788 - DNA, 21 bp, Homo sapiens
ccactctaggggtcaggctcc

SEQ ID NO: 2839789 - DNA, 13 bp, Homo sapiens
ccactctcccctc

SEQ ID NO: 2839790 - DNA, 14 bp, Homo sapiens
ccactctgctctga

SEQ ID NO: 2839791 - DNA, 13 bp, Homo sapiens
ccactctggcagc

SEQ ID NO: 2839792 - DNA, 15 bp, Homo sapiens
ccactctggcagcca

SEQ ID NO: 2839793 - DNA, 16 bp, Homo sapiens
ccactctggcagccac

SEQ ID NO: 2839794 - DNA, 22 bp, Homo sapiens
ccactctggcagccacacttct

SEQ ID NO: 2839795 - DNA, 13 bp, Homo sapiens
ccactgcaccggg

SEQ ID NO: 2839796 - DNA, 20 bp, Homo sapiens
ccactgcactatagcctagg

SEQ ID NO: 2839797 - DNA, 21 bp, Homo sapiens
ccactgcactccagcctgggc

SEQ ID NO: 2839798 - DNA, 13 bp, Homo sapiens
ccactgcaggccc

SEQ ID NO: 2839799 - DNA, 17 bp, Homo sapiens
ccactgccacaccctcc

SEQ ID NO: 2839800 - DNA, 13 bp, Homo sapiens
ccactgcctcttc

SEQ ID NO: 2839801 - DNA, 15 bp, Homo sapiens
ccactgctctggtta

SEQ ID NO: 2839802 - DNA, 17 bp, Homo sapiens
ccactggtttctcagaa

SEQ ID NO: 2839803 - DNA, 14 bp, Homo sapiens
ccactgtaaaatga

SEQ ID NO: 2839804 - DNA, 17 bp, Homo sapiens
ccactgtcttgcctgcc

SEQ ID NO: 2839805 - DNA, 19 bp, Homo sapiens
ccactgtcttgcctgccag

SEQ ID NO: 2839806 - DNA, 11 bp, Homo sapiens
ccactgtgcag

SEQ ID NO: 2839807 - DNA, 12 bp, Homo sapiens
ccactgtgctta

SEQ ID NO: 2839808 - DNA, 14 bp, Homo sapiens
ccactgttatcaaa

SEQ ID NO: 2839809 - DNA, 16 bp, Homo sapiens
ccacttaaaaaatgtc

SEQ ID NO: 2839810 - DNA, 11 bp, Homo sapiens
ccacttctctc

SEQ ID NO: 2839811 - DNA, 16 bp, Homo sapiens
ccacttcttttataac

SEQ ID NO: 2839812 - DNA, 18 bp, Homo sapiens
ccagaaaatataaatgca

SEQ ID NO: 2839813 - DNA, 19 bp, Homo sapiens
ccagaaagaaggacacttg

SEQ ID NO: 2839814 - DNA, 22 bp, Homo sapiens
ccagaaagaaggacacttgtat

SEQ ID NO: 2839815 - DNA, 18 bp, Homo sapiens
ccagaagaatattcagga

SEQ ID NO: 2839816 - DNA, 20 bp, Homo sapiens
ccagaagaatattcaggact

SEQ ID NO: 2839817 - DNA, 20 bp, Homo sapiens
ccagaaggggcacgcctgcc

SEQ ID NO: 2839818 - DNA, 20 bp, Homo sapiens
ccagacaccttgacagggca

SEQ ID NO: 2839819 - DNA, 23 bp, Homo sapiens
ccagacatgtggtgggacaggga

SEQ ID NO: 2839820 - DNA, 20 bp, Homo sapiens
ccagaccacctccctgccct

SEQ ID NO: 2839821 - DNA, 12 bp, Homo sapiens
ccagaccctgaa

SEQ ID NO: 2839822 - DNA, 13 bp, Homo sapiens
ccagaccctgaag

SEQ ID NO: 2839823 - DNA, 19 bp, Homo sapiens
ccagaccctgaagatttca

SEQ ID NO: 2839824 - DNA, 21 bp, Homo sapiens
ccagaccctgaagatttcaga

SEQ ID NO: 2839825 - DNA, 22 bp, Homo sapiens
ccagactgcttccaattttctg

SEQ ID NO: 2839826 - DNA, 16 bp, Homo sapiens
ccagactgtggagaaa

SEQ ID NO: 2839827 - DNA, 15 bp, Homo sapiens
ccagagacaggaaaa

SEQ ID NO: 2839828 - DNA, 23 bp, Homo sapiens
ccagagacaggaaaatcctctgg

SEQ ID NO: 2839829 - DNA, 16 bp, Homo sapiens
ccagagaccccttcct

SEQ ID NO: 2839830 - DNA, 17 bp, Homo sapiens
ccagagaccccttcctt

SEQ ID NO: 2839831 - DNA, 21 bp, Homo sapiens
ccagagaccccttcctttcct

SEQ ID NO: 2839832 - DNA, 22 bp, Homo sapiens
ccagagaccccttcctttcctc

SEQ ID NO: 2839833 - DNA, 20 bp, Homo sapiens
ccagagaggggacatttccc

SEQ ID NO: 2839834 - DNA, 22 bp, Homo sapiens
ccagagaggggacatttccctc

SEQ ID NO: 2839835 - DNA, 14 bp, Homo sapiens
ccagagagggtggt

SEQ ID NO: 2839836 - DNA, 23 bp, Homo sapiens
ccagagagggtggtgacctctgc

SEQ ID NO: 2839837 - DNA, 15 bp, Homo sapiens
ccagagagtcctctg

SEQ ID NO: 2839838 - DNA, 14 bp, Homo sapiens
ccagagatgcctcc

SEQ ID NO: 2839839 - DNA, 14 bp, Homo sapiens
ccagagccccacac

SEQ ID NO: 2839840 - DNA, 19 bp, Homo sapiens
ccagagccccacacggagg

SEQ ID NO: 2839841 - DNA, 23 bp, Homo sapiens
ccagagccccccacaatgatgat

SEQ ID NO: 2839842 - DNA, 11 bp, Homo sapiens
ccagagcctgg

SEQ ID NO: 2839843 - DNA, 15 bp, Homo sapiens
ccagagcctggggct

SEQ ID NO: 2839844 - DNA, 20 bp, Homo sapiens
ccagagcctggggctctaac

SEQ ID NO: 2839845 - DNA, 19 bp, Homo sapiens
ccagaggctattattttca

SEQ ID NO: 2839846 - DNA, 19 bp, Homo sapiens
ccagagggagtgacagagg

SEQ ID NO: 2839847 - DNA, 13 bp, Homo sapiens
ccagagggcccag

SEQ ID NO: 2839848 - DNA, 17 bp, Homo sapiens
ccagagggcccaggcag

SEQ ID NO: 2839849 - DNA, 18 bp, Homo sapiens
ccagagggcccaggcagg

SEQ ID NO: 2839850 - DNA, 23 bp, Homo sapiens
ccagaggggtgggttcctcttcc

SEQ ID NO: 2839851 - DNA, 12 bp, Homo sapiens
ccagagtgtgaa

SEQ ID NO: 2839852 - DNA, 14 bp, Homo sapiens
ccagattgcaacag

SEQ ID NO: 2839853 - DNA, 19 bp, Homo sapiens
ccagattgcaacaggctgg

SEQ ID NO: 2839854 - DNA, 22 bp, Homo sapiens
ccagattttttaaaatttatat

SEQ ID NO: 2839855 - DNA, 18 bp, Homo sapiens
ccagcaagagcacaagag

SEQ ID NO: 2839856 - DNA, 18 bp, Homo sapiens
ccagcaagtgagagctgg

SEQ ID NO: 2839857 - DNA, 17 bp, Homo sapiens
ccagcaatgatgtccag

SEQ ID NO: 2839858 - DNA, 18 bp, Homo sapiens
ccagcaatgatgtccaga

SEQ ID NO: 2839859 - DNA, 12 bp, Homo sapiens
ccagcacagaag

SEQ ID NO: 2839860 - DNA, 23 bp, Homo sapiens
ccagcacagaaggaatctgtgca

SEQ ID NO: 2839861 - DNA, 12 bp, Homo sapiens
ccagcaccgagc

SEQ ID NO: 2839862 - DNA, 19 bp, Homo sapiens
cattcacatttgatgtaca

SEQ ID NO: 2839863 - DNA, 20 bp, Homo sapiens
cattcacatttgatgtacat

SEQ ID NO: 2839864 - DNA, 18 bp, Homo sapiens
cattcagaagaaaaagaa

SEQ ID NO: 2839865 - DNA, 23 bp, Homo sapiens
cattcaggaccccaacccctctc

SEQ ID NO: 2839866 - DNA, 23 bp, Homo sapiens
cattcagtccgcctggccggctc

SEQ ID NO: 2839867 - DNA, 15 bp, Homo sapiens
cattcataactttca

SEQ ID NO: 2839868 - DNA, 22 bp, Homo sapiens
cattcatccagttgcaataaaa

SEQ ID NO: 2839869 - DNA, 23 bp, Homo sapiens
cattcatccagttgcaataaaat

SEQ ID NO: 2839870 - DNA, 13 bp, Homo sapiens
cattcatctcatt

SEQ ID NO: 2839871 - DNA, 23 bp, Homo sapiens
cattccaacagctcaagtcttcc

SEQ ID NO: 2839872 - DNA, 13 bp, Homo sapiens
cattccatgattt

SEQ ID NO: 2839873 - DNA, 19 bp, Homo sapiens
cattccatgattttacaga

SEQ ID NO: 2839874 - DNA, 11 bp, Homo sapiens
cattcccctcg

SEQ ID NO: 2839875 - DNA, 11 bp, Homo sapiens
cattccctgag

SEQ ID NO: 2839876 - DNA, 17 bp, Homo sapiens
cattccctgagtcacca

SEQ ID NO: 2839877 - DNA, 16 bp, Homo sapiens
cattcctcagggacag

SEQ ID NO: 2839878 - DNA, 13 bp, Homo sapiens
cattcctgaaaga

SEQ ID NO: 2839879 - DNA, 23 bp, Homo sapiens
cattcggtacttacccggagaag

SEQ ID NO: 2839880 - DNA, 16 bp, Homo sapiens
cattctgaatgaataa

SEQ ID NO: 2839881 - DNA, 15 bp, Homo sapiens
cattctgcctgccca

SEQ ID NO: 2839882 - DNA, 15 bp, Homo sapiens
cattctgtcttgaag

SEQ ID NO: 2839883 - DNA, 21 bp, Homo sapiens
cattcttagactagttgaaca

SEQ ID NO: 2839884 - DNA, 17 bp, Homo sapiens
cattcttgaaagctgtg

SEQ ID NO: 2839885 - DNA, 16 bp, Homo sapiens
cattgaaagagaacca

SEQ ID NO: 2839886 - DNA, 18 bp, Homo sapiens
cattgactatcaaactga

SEQ ID NO: 2839887 - DNA, 19 bp, Homo sapiens
cattgactatcaaactgaa

SEQ ID NO: 2839888 - DNA, 18 bp, Homo sapiens
cattgatatgaaaaatat

SEQ ID NO: 2839889 - DNA, 22 bp, Homo sapiens
cattgatatgaaaaatatgata

SEQ ID NO: 2839890 - DNA, 14 bp, Homo sapiens
cattgcggacagcc

SEQ ID NO: 2839891 - DNA, 15 bp, Homo sapiens
cattgcggacagcca

SEQ ID NO: 2839892 - DNA, 21 bp, Homo sapiens
cattgcggacagccacggcca

SEQ ID NO: 2839893 - DNA, 18 bp, Homo sapiens
cattggcagtgtgtcaca

SEQ ID NO: 2839894 - DNA, 22 bp, Homo sapiens
cattggcagtgtgtcacactga

SEQ ID NO: 2839895 - DNA, 14 bp, Homo sapiens
cattgtagaaaagc

SEQ ID NO: 2839896 - DNA, 21 bp, Homo sapiens
cattgtagagcttctggcact

SEQ ID NO: 2839897 - DNA, 20 bp, Homo sapiens
cattgtccatgcctacagat

SEQ ID NO: 2839898 - DNA, 18 bp, Homo sapiens
cattgtgtgagcttctac

SEQ ID NO: 2839899 - DNA, 22 bp, Homo sapiens
cattgtttgtctgtcttcatag

SEQ ID NO: 2839900 - DNA, 15 bp, Homo sapiens
catttaagggaaaaa

SEQ ID NO: 2839901 - DNA, 16 bp, Homo sapiens
catttaattcataatt

SEQ ID NO: 2839902 - DNA, 20 bp, Homo sapiens
catttaattcataattagaa

SEQ ID NO: 2839903 - DNA, 19 bp, Homo sapiens
catttacaataaatattct

SEQ ID NO: 2839904 - DNA, 17 bp, Homo sapiens
catttactttgtgttca

SEQ ID NO: 2839905 - DNA, 20 bp, Homo sapiens
catttatatatatatgtata

SEQ ID NO: 2839906 - DNA, 21 bp, Homo sapiens
catttatatatatatgtatat

SEQ ID NO: 2839907 - DNA, 22 bp, Homo sapiens
catttatatatatatgtatatg

SEQ ID NO: 2839908 - DNA, 20 bp, Homo sapiens
catttatgagctcttcatgt

SEQ ID NO: 2839909 - DNA, 13 bp, Homo sapiens
ccaaaaatagcta

SEQ ID NO: 2839910 - DNA, 22 bp, Homo sapiens
ccaaaattcagaacatcctcca

SEQ ID NO: 2839911 - DNA, 16 bp, Homo sapiens
ccaaacccatgaggca

SEQ ID NO: 2839912 - DNA, 16 bp, Homo sapiens
ccaaagagaaaagatt

SEQ ID NO: 2839913 - DNA, 14 bp, Homo sapiens
ccaaagagcctgga

SEQ ID NO: 2839914 - DNA, 17 bp, Homo sapiens
ccaaagagcctggagaa

SEQ ID NO: 2839915 - DNA, 21 bp, Homo sapiens
ccaaagatatatacacaggat

SEQ ID NO: 2839916 - DNA, 13 bp, Homo sapiens
ccaaataaatgtg

SEQ ID NO: 2839917 - DNA, 16 bp, Homo sapiens
ccaaataaatgtgtaa

SEQ ID NO: 2839918 - DNA, 17 bp, Homo sapiens
ccaaataaatgtgtaaa

SEQ ID NO: 2839919 - DNA, 19 bp, Homo sapiens
ccaaataaatgtgtaaatg

SEQ ID NO: 2839920 - DNA, 22 bp, Homo sapiens
ccaaataaatgtgtaaatgtgg

SEQ ID NO: 2839921 - DNA, 14 bp, Homo sapiens
ccaaatataaactt

SEQ ID NO: 2839922 - DNA, 16 bp, Homo sapiens
ccaaatcatagtggct

SEQ ID NO: 2839923 - DNA, 22 bp, Homo sapiens
ccaaatgcatggtgcagttgac

SEQ ID NO: 2839924 - DNA, 18 bp, Homo sapiens
ccaaatgtaattgaataa

SEQ ID NO: 2839925 - DNA, 16 bp, Homo sapiens
ccaacaataaagagct

SEQ ID NO: 2839926 - DNA, 17 bp, Homo sapiens
ccaacaataaagagctc

SEQ ID NO: 2839927 - DNA, 12 bp, Homo sapiens
ccaacagttcct

SEQ ID NO: 2839928 - DNA, 15 bp, Homo sapiens
ccaacataaaaatga

SEQ ID NO: 2839929 - DNA, 20 bp, Homo sapiens
ccaacatacccttctttaaa

SEQ ID NO: 2839930 - DNA, 23 bp, Homo sapiens
ccaacatggagaaaccctgtctc

SEQ ID NO: 2839931 - DNA, 14 bp, Homo sapiens
ccaacccatcagaa

SEQ ID NO: 2839932 - DNA, 12 bp, Homo sapiens
ccaaccccaggg

SEQ ID NO: 2839933 - DNA, 15 bp, Homo sapiens
ccaacccgtggaggc

SEQ ID NO: 2839934 - DNA, 17 bp, Homo sapiens
ccaacccgtggaggctg

SEQ ID NO: 2839935 - DNA, 18 bp, Homo sapiens
ccaacccgtggaggctgc

SEQ ID NO: 2839936 - DNA, 12 bp, Homo sapiens
ccaacctgacca

SEQ ID NO: 2839937 - DNA, 16 bp, Homo sapiens
ccaacctgaccaacat

SEQ ID NO: 2839938 - DNA, 18 bp, Homo sapiens
ccaacctttccctcaccc

SEQ ID NO: 2839939 - DNA, 23 bp, Homo sapiens
ccaacctttccctcaccccctcc

SEQ ID NO: 2839940 - DNA, 16 bp, Homo sapiens
ccaactctctcctgta

SEQ ID NO: 2839941 - DNA, 17 bp, Homo sapiens
ccaacttgtaaatacac

SEQ ID NO: 2839942 - DNA, 19 bp, Homo sapiens
ccaagaaaaggcatggaga

SEQ ID NO: 2839943 - DNA, 13 bp, Homo sapiens
ccaagagagaaag

SEQ ID NO: 2839944 - DNA, 14 bp, Homo sapiens
ccaagagagaaaga

SEQ ID NO: 2839945 - DNA, 15 bp, Homo sapiens
ccaagagagaaagaa

SEQ ID NO: 2839946 - DNA, 19 bp, Homo sapiens
ccaagagcagaggcagcga

SEQ ID NO: 2839947 - DNA, 17 bp, Homo sapiens
ccaagagcatcatgcct

SEQ ID NO: 2839948 - DNA, 19 bp, Homo sapiens
ccaagagcatcatgcctct

SEQ ID NO: 2839949 - DNA, 21 bp, Homo sapiens
ccaagagcatcatgcctctga

SEQ ID NO: 2839950 - DNA, 17 bp, Homo sapiens
ccaagagtattccattt

SEQ ID NO: 2839951 - DNA, 16 bp, Homo sapiens
ccaagatcgcgccact

SEQ ID NO: 2839952 - DNA, 13 bp, Homo sapiens
ccaagcctgacca

SEQ ID NO: 2839953 - DNA, 20 bp, Homo sapiens
ccaagcgaggtcaacagaga

SEQ ID NO: 2839954 - DNA, 17 bp, Homo sapiens
ccaagctcacagttcct

SEQ ID NO: 2839955 - DNA, 18 bp, Homo sapiens
ccaagctctgctcctctc

SEQ ID NO: 2839956 - DNA, 19 bp, Homo sapiens
ccaagctgaggtgcccagg

SEQ ID NO: 2839957 - DNA, 15 bp, Homo sapiens
ccaagctggcagctg

SEQ ID NO: 2839958 - DNA, 22 bp, Homo sapiens
ccaagctggcagctgtcattca

SEQ ID NO: 2839959 - DNA, 15 bp, Homo sapiens
ccaagcttcaaccct

SEQ ID NO: 2839960 - DNA, 17 bp, Homo sapiens
ccaagcttcaaccctca

SEQ ID NO: 2839961 - DNA, 19 bp, Homo sapiens
ccaagcttcaaccctcagc

SEQ ID NO: 2839962 - DNA, 19 bp, Homo sapiens
ccaagcttcaagtgatata

SEQ ID NO: 2839963 - DNA, 15 bp, Homo sapiens
ccaagctttcttcta

SEQ ID NO: 2839964 - DNA, 21 bp, Homo sapiens
ccaaggaggaaaaacagacaa

SEQ ID NO: 2839965 - DNA, 16 bp, Homo sapiens
ccaaggctctgagcaa

SEQ ID NO: 2839966 - DNA, 22 bp, Homo sapiens
ccaaggctcttctccttggagg

SEQ ID NO: 2839967 - DNA, 13 bp, Homo sapiens
ccaaggctgctca

SEQ ID NO: 2839968 - DNA, 23 bp, Homo sapiens
ccaagggttcagagactcagggc

SEQ ID NO: 2839969 - DNA, 17 bp, Homo sapiens
ccaaggtgggctgagcc

SEQ ID NO: 2839970 - DNA, 23 bp, Homo sapiens
ccaaggtgggctgagccctggca

SEQ ID NO: 2839971 - DNA, 16 bp, Homo sapiens
ccaagtccacctgcct

SEQ ID NO: 2839972 - DNA, 22 bp, Homo sapiens
ccaagtcttcagcgagaccctt

SEQ ID NO: 2839973 - DNA, 22 bp, Homo sapiens
ccaagtgacctatacctgtgtt

SEQ ID NO: 2839974 - DNA, 16 bp, Homo sapiens
ccaagtggctcccaca

SEQ ID NO: 2839975 - DNA, 14 bp, Homo sapiens
ccaataaagctgga

SEQ ID NO: 2839976 - DNA, 19 bp, Homo sapiens
ccaataacttcagagaagt

SEQ ID NO: 2839977 - DNA, 21 bp, Homo sapiens
ccaataacttcagagaagtca

SEQ ID NO: 2839978 - DNA, 18 bp, Homo sapiens
ccaatcccgtgaaagaat

SEQ ID NO: 2839979 - DNA, 23 bp, Homo sapiens
ccaatgaaatacacaagtaaaca

SEQ ID NO: 2839980 - DNA, 20 bp, Homo sapiens
ccaatgattcataacaatgt

SEQ ID NO: 2839981 - DNA, 13 bp, Homo sapiens
ccaattatgtgac

SEQ ID NO: 2839982 - DNA, 13 bp, Homo sapiens
ccaattgtaaaaa

SEQ ID NO: 2839983 - DNA, 17 bp, Homo sapiens
ccacaagattcccagag

SEQ ID NO: 2839984 - DNA, 22 bp, Homo sapiens
ccacacacagaggaagagcagg

SEQ ID NO: 2839985 - DNA, 13 bp, Homo sapiens
ccacacagagcct

SEQ ID NO: 2839986 - DNA, 15 bp, Homo sapiens
ccacacagagcctgc

SEQ ID NO: 2839987 - DNA, 16 bp, Homo sapiens
ccacacagagcctgcc

SEQ ID NO: 2839988 - DNA, 20 bp, Homo sapiens
ccacacagagcctgcctcag

SEQ ID NO: 2839989 - DNA, 22 bp, Homo sapiens
ccacacccagcccacttctgcc

SEQ ID NO: 2839990 - DNA, 21 bp, Homo sapiens
ccacacccggctccccctgct

SEQ ID NO: 2839991 - DNA, 14 bp, Homo sapiens
ccacacctccctga

SEQ ID NO: 2839992 - DNA, 15 bp, Homo sapiens
ccacactgaatctcc

SEQ ID NO: 2839993 - DNA, 13 bp, Homo sapiens
ccacactggtgac

SEQ ID NO: 2839994 - DNA, 17 bp, Homo sapiens
ccacacttctcaggaca

SEQ ID NO: 2839995 - DNA, 21 bp, Homo sapiens
ccacacttctcaggacacagg

SEQ ID NO: 2839996 - DNA, 22 bp, Homo sapiens
ccacacttctcaggacacaggc

SEQ ID NO: 2839997 - DNA, 21 bp, Homo sapiens
ccacagaagccaggagcaaat

SEQ ID NO: 2839998 - DNA, 20 bp, Homo sapiens
ccacagacagatcccatcca

SEQ ID NO: 2839999 - DNA, 14 bp, Homo sapiens
ccacagaccacctg

SEQ ID NO: 2840000 - DNA, 20 bp, Homo sapiens
ccacagaccacctgcttctg

SEQ ID NO: 2840001 - DNA, 22 bp, Homo sapiens
ccacagagaaagtacttctcca

SEQ ID NO: 2840002 - DNA, 14 bp, Homo sapiens
ccacagcagctgaa

SEQ ID NO: 2840003 - DNA, 18 bp, Homo sapiens
ccacagcattcctccatc

SEQ ID NO: 2840004 - DNA, 12 bp, Homo sapiens
ccacagccgcag

SEQ ID NO: 2840005 - DNA, 20 bp, Homo sapiens
ccacagcggaggagaccagc

SEQ ID NO: 2840006 - DNA, 19 bp, Homo sapiens
ccacagctcccaccccacc

SEQ ID NO: 2840007 - DNA, 14 bp, Homo sapiens
ccacaggagggaga

SEQ ID NO: 2840008 - DNA, 16 bp, Homo sapiens
ccacaggatcagtctg

SEQ ID NO: 2840009 - DNA, 20 bp, Homo sapiens
ccacaggccccccgcagcac

SEQ ID NO: 2840010 - DNA, 20 bp, Homo sapiens
ccacagggctaagagctagc

SEQ ID NO: 2840011 - DNA, 23 bp, Homo sapiens
ccacaggtgtttatacagctcag

SEQ ID NO: 2840012 - DNA, 14 bp, Homo sapiens
ccacagtagcattt

SEQ ID NO: 2840013 - DNA, 12 bp, Homo sapiens
ccacatcccagg

SEQ ID NO: 2840014 - DNA, 15 bp, Homo sapiens
ccacatcccaggctt

SEQ ID NO: 2840015 - DNA, 18 bp, Homo sapiens
ccacatcccaggcttcac

SEQ ID NO: 2840016 - DNA, 13 bp, Homo sapiens
ccacatccctggg

SEQ ID NO: 2840017 - DNA, 17 bp, Homo sapiens
ccacatccctgggcctg

SEQ ID NO: 2840018 - DNA, 21 bp, Homo sapiens
ccacatccctgggcctgctgc

SEQ ID NO: 2840019 - DNA, 22 bp, Homo sapiens
ccacatccctgggcctgctgct

SEQ ID NO: 2840020 - DNA, 17 bp, Homo sapiens
ccacatccctttgaaac

SEQ ID NO: 2840021 - DNA, 20 bp, Homo sapiens
ccacatgccatttgtactga

SEQ ID NO: 2840022 - DNA, 14 bp, Homo sapiens
ccacatgtcaccgt

SEQ ID NO: 2840023 - DNA, 19 bp, Homo sapiens
ccacatgtgacacatatgc

SEQ ID NO: 2840024 - DNA, 18 bp, Homo sapiens
ccacattaattagatttt

SEQ ID NO: 2840025 - DNA, 14 bp, Homo sapiens
ccaccacacccagc

SEQ ID NO: 2840026 - DNA, 23 bp, Homo sapiens
ccaccaccctcccaccatgcgct

SEQ ID NO: 2840027 - DNA, 12 bp, Homo sapiens
ccaccacctagg

SEQ ID NO: 2840028 - DNA, 22 bp, Homo sapiens
ccaccacctaggccactcctcc

SEQ ID NO: 2840029 - DNA, 12 bp, Homo sapiens
ccaccaccttgg

SEQ ID NO: 2840030 - DNA, 22 bp, Homo sapiens
ccaccagcatgtcactcccaga

SEQ ID NO: 2840031 - DNA, 16 bp, Homo sapiens
ccaccagccacctctt

SEQ ID NO: 2840032 - DNA, 16 bp, Homo sapiens
ccaccagccccagcaa

SEQ ID NO: 2840033 - DNA, 13 bp, Homo sapiens
ccaccagcctaag

SEQ ID NO: 2840034 - DNA, 15 bp, Homo sapiens
ccaccagcctaagaa

SEQ ID NO: 2840035 - DNA, 14 bp, Homo sapiens
ccaccagtcactgt

SEQ ID NO: 2840036 - DNA, 23 bp, Homo sapiens
ccaccatattcagtgctgtggcc

SEQ ID NO: 2840037 - DNA, 18 bp, Homo sapiens
ccaccatgcgctgctcaa

SEQ ID NO: 2840038 - DNA, 13 bp, Homo sapiens
ccacccacctcag

SEQ ID NO: 2840039 - DNA, 13 bp, Homo sapiens
ccacccagcccat

SEQ ID NO: 2840040 - DNA, 18 bp, Homo sapiens
ccaccccatccagttcat

SEQ ID NO: 2840041 - DNA, 14 bp, Homo sapiens
ccacccccagcccc

SEQ ID NO: 2840042 - DNA, 17 bp, Homo sapiens
ccaccccctccccaggg

SEQ ID NO: 2840043 - DNA, 13 bp, Homo sapiens
ccaccccttcctg

SEQ ID NO: 2840044 - DNA, 15 bp, Homo sapiens
ccaccccttcctgtc

SEQ ID NO: 2840045 - DNA, 14 bp, Homo sapiens
catatcagacctct

SEQ ID NO: 2840046 - DNA, 18 bp, Homo sapiens
catatcagacctctgatc

SEQ ID NO: 2840047 - DNA, 13 bp, Homo sapiens
catatgagtcttt

SEQ ID NO: 2840048 - DNA, 18 bp, Homo sapiens
catatgcaccttgtgtct

SEQ ID NO: 2840049 - DNA, 19 bp, Homo sapiens
catatgcaccttgtgtctg

SEQ ID NO: 2840050 - DNA, 23 bp, Homo sapiens
catatgcaccttgtgtctgtaca

SEQ ID NO: 2840051 - DNA, 17 bp, Homo sapiens
catatggactctgcaca

SEQ ID NO: 2840052 - DNA, 14 bp, Homo sapiens
catatgtaaaataa

SEQ ID NO: 2840053 - DNA, 15 bp, Homo sapiens
catattaaacttctg

SEQ ID NO: 2840054 - DNA, 16 bp, Homo sapiens
catattataaataaat

SEQ ID NO: 2840055 - DNA, 13 bp, Homo sapiens
catattcttggag

SEQ ID NO: 2840056 - DNA, 14 bp, Homo sapiens
catatttgttaaat

SEQ ID NO: 2840057 - DNA, 19 bp, Homo sapiens
catatttgttaaatattta

SEQ ID NO: 2840058 - DNA, 21 bp, Homo sapiens
catatttgttaaatatttaca

SEQ ID NO: 2840059 - DNA, 16 bp, Homo sapiens
catcaattaaaggcaa

SEQ ID NO: 2840060 - DNA, 13 bp, Homo sapiens
catcaatttttat

SEQ ID NO: 2840061 - DNA, 19 bp, Homo sapiens
catcaatttttatacatat

SEQ ID NO: 2840062 - DNA, 19 bp, Homo sapiens
catcacacccttttaacat

SEQ ID NO: 2840063 - DNA, 15 bp, Homo sapiens
catcacagggcagag

SEQ ID NO: 2840064 - DNA, 13 bp, Homo sapiens
catcacctcaggc

SEQ ID NO: 2840065 - DNA, 12 bp, Homo sapiens
catcagaaaggg

SEQ ID NO: 2840066 - DNA, 16 bp, Homo sapiens
catcagaaagggaggg

SEQ ID NO: 2840067 - DNA, 21 bp, Homo sapiens
catcagaaagggagggctctg

SEQ ID NO: 2840068 - DNA, 23 bp, Homo sapiens
catcagaaagggagggctctgag

SEQ ID NO: 2840069 - DNA, 11 bp, Homo sapiens
catcagaagga

SEQ ID NO: 2840070 - DNA, 20 bp, Homo sapiens
catcagcatacctttattgt

SEQ ID NO: 2840071 - DNA, 20 bp, Homo sapiens
catcagcatttaataaatgt

SEQ ID NO: 2840072 - DNA, 12 bp, Homo sapiens
catcagctccct

SEQ ID NO: 2840073 - DNA, 14 bp, Homo sapiens
catcagctcccttt

SEQ ID NO: 2840074 - DNA, 23 bp, Homo sapiens
catcagggtgggccactctcccc

SEQ ID NO: 2840075 - DNA, 21 bp, Homo sapiens
catcagtcattcccacgcttg

SEQ ID NO: 2840076 - DNA, 23 bp, Homo sapiens
catcagttactggtttcagttga

SEQ ID NO: 2840077 - DNA, 23 bp, Homo sapiens
catcataaaataaagtatatata

SEQ ID NO: 2840078 - DNA, 22 bp, Homo sapiens
catcatatcctttgccccaagg

SEQ ID NO: 2840079 - DNA, 16 bp, Homo sapiens
catcatattgtatgta

SEQ ID NO: 2840080 - DNA, 15 bp, Homo sapiens
catcatcccagctgc

SEQ ID NO: 2840081 - DNA, 18 bp, Homo sapiens
catcatgcctctgaggcc

SEQ ID NO: 2840082 - DNA, 14 bp, Homo sapiens
catcatgtctggct

SEQ ID NO: 2840083 - DNA, 15 bp, Homo sapiens
catcatgtctggcta

SEQ ID NO: 2840084 - DNA, 16 bp, Homo sapiens
catcatgtgcctggaa

SEQ ID NO: 2840085 - DNA, 18 bp, Homo sapiens
catccacacacgcaggaa

SEQ ID NO: 2840086 - DNA, 17 bp, Homo sapiens
catccaggttcagcttg

SEQ ID NO: 2840087 - DNA, 16 bp, Homo sapiens
catccagttgcaataa

SEQ ID NO: 2840088 - DNA, 15 bp, Homo sapiens
catccatcagctccc

SEQ ID NO: 2840089 - DNA, 15 bp, Homo sapiens
catccattcctcagg

SEQ ID NO: 2840090 - DNA, 16 bp, Homo sapiens
catccattcctcaggg

SEQ ID NO: 2840091 - DNA, 17 bp, Homo sapiens
catccattcctcaggga

SEQ ID NO: 2840092 - DNA, 18 bp, Homo sapiens
catccattcctcagggac

SEQ ID NO: 2840093 - DNA, 19 bp, Homo sapiens
catccatttcatctatttc

SEQ ID NO: 2840094 - DNA, 19 bp, Homo sapiens
catcccaggcttcaccctg

SEQ ID NO: 2840095 - DNA, 12 bp, Homo sapiens
catcccatcatc

SEQ ID NO: 2840096 - DNA, 21 bp, Homo sapiens
catcccatctaagctgcagct

SEQ ID NO: 2840097 - DNA, 12 bp, Homo sapiens
catcccattgcc

SEQ ID NO: 2840098 - DNA, 16 bp, Homo sapiens
catcccattgccctgg

SEQ ID NO: 2840099 - DNA, 20 bp, Homo sapiens
catcccccactgccacaccc

SEQ ID NO: 2840100 - DNA, 20 bp, Homo sapiens
cagtgacagagttcactata

SEQ ID NO: 2840101 - DNA, 17 bp, Homo sapiens
cagtgacgtgcacctgt

SEQ ID NO: 2840102 - DNA, 22 bp, Homo sapiens
cagtgacgtgcacctgtactca

SEQ ID NO: 2840103 - DNA, 20 bp, Homo sapiens
cagtgactgtcgtgtttaca

SEQ ID NO: 2840104 - DNA, 13 bp, Homo sapiens
cagtgagctgaga

SEQ ID NO: 2840105 - DNA, 17 bp, Homo sapiens
cagtgagtctcttcaga

SEQ ID NO: 2840106 - DNA, 18 bp, Homo sapiens
cagtgagttacagcgaga

SEQ ID NO: 2840107 - DNA, 13 bp, Homo sapiens
cagtgatctccat

SEQ ID NO: 2840108 - DNA, 20 bp, Homo sapiens
cagtgattgtcttaatattg

SEQ ID NO: 2840109 - DNA, 12 bp, Homo sapiens
cagtgccacaga

SEQ ID NO: 2840110 - DNA, 16 bp, Homo sapiens
cagtgccacagagaag

SEQ ID NO: 2840111 - DNA, 12 bp, Homo sapiens
cagtgcccacag

SEQ ID NO: 2840112 - DNA, 21 bp, Homo sapiens
cagtgcccaccaacatcccat

SEQ ID NO: 2840113 - DNA, 19 bp, Homo sapiens
cagtgccctcattttatgt

SEQ ID NO: 2840114 - DNA, 19 bp, Homo sapiens
cagtgccttacctcctgcc

SEQ ID NO: 2840115 - DNA, 22 bp, Homo sapiens
cagtgccttacctcctgcccag

SEQ ID NO: 2840116 - DNA, 13 bp, Homo sapiens
cagtgctcggcag

SEQ ID NO: 2840117 - DNA, 22 bp, Homo sapiens
cagtgctctcctaccccacctc

SEQ ID NO: 2840118 - DNA, 22 bp, Homo sapiens
cagtgctgcgagatcgctggca

SEQ ID NO: 2840119 - DNA, 12 bp, Homo sapiens
cagtgctgtggc

SEQ ID NO: 2840120 - DNA, 18 bp, Homo sapiens
cagtgctgtggcctgggc

SEQ ID NO: 2840121 - DNA, 19 bp, Homo sapiens
cagtgctgtggcctgggca

SEQ ID NO: 2840122 - DNA, 14 bp, Homo sapiens
cagtgctgttctgg

SEQ ID NO: 2840123 - DNA, 20 bp, Homo sapiens
cagtgcttgagtttggggaa

SEQ ID NO: 2840124 - DNA, 12 bp, Homo sapiens
cagtgcttgtaa

SEQ ID NO: 2840125 - DNA, 13 bp, Homo sapiens
cagtggacaccag

SEQ ID NO: 2840126 - DNA, 17 bp, Homo sapiens
cagtggagaaatattta

SEQ ID NO: 2840127 - DNA, 16 bp, Homo sapiens
cagtgggagctgcctg

SEQ ID NO: 2840128 - DNA, 14 bp, Homo sapiens
cagcggggacagct

SEQ ID NO: 2840129 - DNA, 15 bp, Homo sapiens
cagcggggacagctc

SEQ ID NO: 2840130 - DNA, 17 bp, Homo sapiens
cagcggggacagctcct

SEQ ID NO: 2840131 - DNA, 18 bp, Homo sapiens
cagcggggacagctcctt

SEQ ID NO: 2840132 - DNA, 21 bp, Homo sapiens
cagcggggacagctccttctg

SEQ ID NO: 2840133 - DNA, 14 bp, Homo sapiens
cagcgtggccttgt

SEQ ID NO: 2840134 - DNA, 15 bp, Homo sapiens
cagctaagctaggaa

SEQ ID NO: 2840135 - DNA, 12 bp, Homo sapiens
cagctaatctgt

SEQ ID NO: 2840136 - DNA, 19 bp, Homo sapiens
cagctaatctgtagggctg

SEQ ID NO: 2840137 - DNA, 17 bp, Homo sapiens
cagctacacctgaggct

SEQ ID NO: 2840138 - DNA, 16 bp, Homo sapiens
cagctactcagaagcc

SEQ ID NO: 2840139 - DNA, 13 bp, Homo sapiens
cagctactcagga

SEQ ID NO: 2840140 - DNA, 14 bp, Homo sapiens
cagctactcgggag

SEQ ID NO: 2840141 - DNA, 20 bp, Homo sapiens
cagctactcgggaggctgag

SEQ ID NO: 2840142 - DNA, 13 bp, Homo sapiens
cagctagtgaccc

SEQ ID NO: 2840143 - DNA, 19 bp, Homo sapiens
cagctattagcaactgtgc

SEQ ID NO: 2840144 - DNA, 13 bp, Homo sapiens
cagctatttttat

SEQ ID NO: 2840145 - DNA, 13 bp, Homo sapiens
cagctcaagtctt

SEQ ID NO: 2840146 - DNA, 17 bp, Homo sapiens
cagctccagctcaccag

SEQ ID NO: 2840147 - DNA, 15 bp, Homo sapiens
cagctccccaggact

SEQ ID NO: 2840148 - DNA, 17 bp, Homo sapiens
cagctccccaggactca

SEQ ID NO: 2840149 - DNA, 15 bp, Homo sapiens
cagctccctaggaga

SEQ ID NO: 2840150 - DNA, 18 bp, Homo sapiens
cagctccctaggagacca

SEQ ID NO: 2840151 - DNA, 18 bp, Homo sapiens
cagctccctagtggcttc

SEQ ID NO: 2840152 - DNA, 23 bp, Homo sapiens
cagctccctagtggcttcctccg

SEQ ID NO: 2840153 - DNA, 14 bp, Homo sapiens
cagctcctctgtct

SEQ ID NO: 2840154 - DNA, 16 bp, Homo sapiens
cagctccttctgtcct

SEQ ID NO: 2840155 - DNA, 15 bp, Homo sapiens
cagctctccctctgg

SEQ ID NO: 2840156 - DNA, 16 bp, Homo sapiens
cagctctccctctggc

SEQ ID NO: 2840157 - DNA, 12 bp, Homo sapiens
cagctctggctt

SEQ ID NO: 2840158 - DNA, 13 bp, Homo sapiens
cagctctgtcctg

SEQ ID NO: 2840159 - DNA, 17 bp, Homo sapiens
cagctctgtcctgggag

SEQ ID NO: 2840160 - DNA, 17 bp, Homo sapiens
cagctcttcccctttcc

SEQ ID NO: 2840161 - DNA, 20 bp, Homo sapiens
cagctcttcccctttcctgg

SEQ ID NO: 2840162 - DNA, 15 bp, Homo sapiens
cagctcttctaagga

SEQ ID NO: 2840163 - DNA, 18 bp, Homo sapiens
cagctcttctccaggctg

SEQ ID NO: 2840164 - DNA, 19 bp, Homo sapiens
cagctcttctccaggctgt

SEQ ID NO: 2840165 - DNA, 16 bp, Homo sapiens
cagctcttggcccctg

SEQ ID NO: 2840166 - DNA, 14 bp, Homo sapiens
cagctgagcagggc

SEQ ID NO: 2840167 - DNA, 17 bp, Homo sapiens
cagctgcacctgccagc

SEQ ID NO: 2840168 - DNA, 17 bp, Homo sapiens
cagctgcagtcaacagt

SEQ ID NO: 2840169 - DNA, 19 bp, Homo sapiens
cagctgcagtcaacagttc

SEQ ID NO: 2840170 - DNA, 16 bp, Homo sapiens
cagctgcatctactca

SEQ ID NO: 2840171 - DNA, 18 bp, Homo sapiens
cagctgccgaccagagcc

SEQ ID NO: 2840172 - DNA, 21 bp, Homo sapiens
cagctgcggtccacccaggag

SEQ ID NO: 2840173 - DNA, 23 bp, Homo sapiens
cagctgcggtccacccaggagcc

SEQ ID NO: 2840174 - DNA, 24 bp, Homo sapiens
cagctgcggtccacccaggagccc

SEQ ID NO: 2840175 - DNA, 19 bp, Homo sapiens
cagctgcttgttgtcaagt

SEQ ID NO: 2840176 - DNA, 22 bp, Homo sapiens
cagctgcttttgtctatgggac

SEQ ID NO: 2840177 - DNA, 22 bp, Homo sapiens
cagctggaattgctgctctctg

SEQ ID NO: 2840178 - DNA, 21 bp, Homo sapiens
cagctggaatttaaggaggga

SEQ ID NO: 2840179 - DNA, 16 bp, Homo sapiens
cagctggagaagaccc

SEQ ID NO: 2840180 - DNA, 22 bp, Homo sapiens
cagctggtgggaagcgtctgtc

SEQ ID NO: 2840181 - DNA, 17 bp, Homo sapiens
cagctgtccctgtcacc

SEQ ID NO: 2840182 - DNA, 18 bp, Homo sapiens
cagctgtccctgtcacca

SEQ ID NO: 2840183 - DNA, 14 bp, Homo sapiens
cagctgtctgtggc

SEQ ID NO: 2840184 - DNA, 20 bp, Homo sapiens
cagctgtctgtgtcagcctg

SEQ ID NO: 2840185 - DNA, 11 bp, Homo sapiens
cagctgtgcct

SEQ ID NO: 2840186 - DNA, 12 bp, Homo sapiens
cagctgtgcctc

SEQ ID NO: 2840187 - DNA, 17 bp, Homo sapiens
cagctgtgtgggctgca

SEQ ID NO: 2840188 - DNA, 19 bp, Homo sapiens
cagcttcatcaatttttat

SEQ ID NO: 2840189 - DNA, 16 bp, Homo sapiens
cagcttcatttccgtg

SEQ ID NO: 2840190 - DNA, 19 bp, Homo sapiens
cagcttcatttccgtgaag

SEQ ID NO: 2840191 - DNA, 23 bp, Homo sapiens
cagcttcatttccgtgaagggca

SEQ ID NO: 2840192 - DNA, 20 bp, Homo sapiens
cagcttcatttcctgtgtct

SEQ ID NO: 2840193 - DNA, 22 bp, Homo sapiens
cagcttcccctcgctgtcctgc

SEQ ID NO: 2840194 - DNA, 14 bp, Homo sapiens
cagcttctccaggc

SEQ ID NO: 2840195 - DNA, 15 bp, Homo sapiens
cagcttctccaggct

SEQ ID NO: 2840196 - DNA, 20 bp, Homo sapiens
cagcttgagggttgggctgg

SEQ ID NO: 2840197 - DNA, 15 bp, Homo sapiens
cagcttgctcttcag

SEQ ID NO: 2840198 - DNA, 23 bp, Homo sapiens
cagcttgtccaacaactccagga

SEQ ID NO: 2840199 - DNA, 11 bp, Homo sapiens
cagctttgcta

SEQ ID NO: 2840200 - DNA, 21 bp, Homo sapiens
cagcttttaataaaattgaca

SEQ ID NO: 2840201 - DNA, 21 bp, Homo sapiens
caggaaaaaaaaaaaaaagac

SEQ ID NO: 2840202 - DNA, 23 bp, Homo sapiens
caggaaaactgacagaggagggc

SEQ ID NO: 2840203 - DNA, 15 bp, Homo sapiens
caggaaaagctgctg

SEQ ID NO: 2840204 - DNA, 18 bp, Homo sapiens
caggaaaagctgctgaca

SEQ ID NO: 2840205 - DNA, 16 bp, Homo sapiens
caggaaaaggcctggg

SEQ ID NO: 2840206 - DNA, 18 bp, Homo sapiens
caggaaaaggcctggggt

SEQ ID NO: 2840207 - DNA, 17 bp, Homo sapiens
caggaaaatcctctggc

SEQ ID NO: 2840208 - DNA, 13 bp, Homo sapiens
caggaactgggcc

SEQ ID NO: 2840209 - DNA, 12 bp, Homo sapiens
caggaagccagg

SEQ ID NO: 2840210 - DNA, 15 bp, Homo sapiens
caggaagccaggctg

SEQ ID NO: 2840211 - DNA, 17 bp, Homo sapiens
caggaagccaggctgag

SEQ ID NO: 2840212 - DNA, 16 bp, Homo sapiens
caggaaggactatgaa

SEQ ID NO: 2840213 - DNA, 12 bp, Homo sapiens
caggaataaggc

SEQ ID NO: 2840214 - DNA, 16 bp, Homo sapiens
caggaatcatgatctg

SEQ ID NO: 2840215 - DNA, 14 bp, Homo sapiens
caggaatctcagag

SEQ ID NO: 2840216 - DNA, 19 bp, Homo sapiens
caggaatgttaaagtcagt

SEQ ID NO: 2840217 - DNA, 22 bp, Homo sapiens
caggaattgaagatgtaaggaa

SEQ ID NO: 2840218 - DNA, 14 bp, Homo sapiens
caggacaagcatgg

SEQ ID NO: 2840219 - DNA, 14 bp, Homo sapiens
cagcggctgggtgg

SEQ ID NO: 2840220 - DNA, 16 bp, Homo sapiens
cacaggtacagcaaca

SEQ ID NO: 2840221 - DNA, 18 bp, Homo sapiens
cacaggtacagcaacagg

SEQ ID NO: 2840222 - DNA, 14 bp, Homo sapiens
cacaggtgtaaata

SEQ ID NO: 2840223 - DNA, 16 bp, Homo sapiens
cacagtattacttctg

SEQ ID NO: 2840224 - DNA, 19 bp, Homo sapiens
cacagtattacttctgcta

SEQ ID NO: 2840225 - DNA, 23 bp, Homo sapiens
cacagtgctgcgagatcgctggc

SEQ ID NO: 2840226 - DNA, 10 bp, Homo sapiens
cacagtgttt

SEQ ID NO: 2840227 - DNA, 16 bp, Homo sapiens
cacagttcctcgccct

SEQ ID NO: 2840228 - DNA, 19 bp, Homo sapiens
cacagttcctcgccctggg

SEQ ID NO: 2840229 - DNA, 20 bp, Homo sapiens
cacagttcctcgccctgggt

SEQ ID NO: 2840230 - DNA, 15 bp, Homo sapiens
cacataccctccccc

SEQ ID NO: 2840231 - DNA, 20 bp, Homo sapiens
cacatataaaagttaaacta

SEQ ID NO: 2840232 - DNA, 12 bp, Homo sapiens
cacatatctgtc

SEQ ID NO: 2840233 - DNA, 21 bp, Homo sapiens
cacatatgcaccttgtgtctg

SEQ ID NO: 2840234 - DNA, 22 bp, Homo sapiens
cacatatgcaccttgtgtctgt

SEQ ID NO: 2840235 - DNA, 15 bp, Homo sapiens
cacatatttgatagt

SEQ ID NO: 2840236 - DNA, 23 bp, Homo sapiens
cacatccatttcatctatttctg

SEQ ID NO: 2840237 - DNA, 12 bp, Homo sapiens
cacatccctggg

SEQ ID NO: 2840238 - DNA, 21 bp, Homo sapiens
cacatccctgggcctgctgct

SEQ ID NO: 2840239 - DNA, 22 bp, Homo sapiens
cacatcttgctctgctgacaga

SEQ ID NO: 2840240 - DNA, 18 bp, Homo sapiens
cacatgaaccatccttcc

SEQ ID NO: 2840241 - DNA, 20 bp, Homo sapiens
cacatgccgcccccagcagc

SEQ ID NO: 2840242 - DNA, 17 bp, Homo sapiens
cacatgctttgtttcca

SEQ ID NO: 2840243 - DNA, 22 bp, Homo sapiens
cacatggaaggcggcacagagg

SEQ ID NO: 2840244 - DNA, 23 bp, Homo sapiens
cacatggaaggcggcacagaggc

SEQ ID NO: 2840245 - DNA, 19 bp, Homo sapiens
cacatgtcaccgtggacct

SEQ ID NO: 2840246 - DNA, 23 bp, Homo sapiens
cacatgtcaccgtggaccttcct

SEQ ID NO: 2840247 - DNA, 17 bp, Homo sapiens
cacatgtccttgtgtgt

SEQ ID NO: 2840248 - DNA, 15 bp, Homo sapiens
cacatgtgcacatgc

SEQ ID NO: 2840249 - DNA, 16 bp, Homo sapiens
cacattacttgcacaa

SEQ ID NO: 2840250 - DNA, 22 bp, Homo sapiens
cacattacttgcacaagcttgt

SEQ ID NO: 2840251 - DNA, 20 bp, Homo sapiens
cacattatcgggagcagtgt

SEQ ID NO: 2840252 - DNA, 22 bp, Homo sapiens
cacattatcgggagcagtgtct

SEQ ID NO: 2840253 - DNA, 22 bp, Homo sapiens
cacattgagtttaagtctctga

SEQ ID NO: 2840254 - DNA, 18 bp, Homo sapiens
cacatttatatatatatg

SEQ ID NO: 2840255 - DNA, 20 bp, Homo sapiens
cacatttatatatatatgta

SEQ ID NO: 2840256 - DNA, 13 bp, Homo sapiens
cacatttgatgta

SEQ ID NO: 2840257 - DNA, 14 bp, Homo sapiens
cacatttgatgtac

SEQ ID NO: 2840258 - DNA, 16 bp, Homo sapiens
cacatttgatgtacat

SEQ ID NO: 2840259 - DNA, 20 bp, Homo sapiens
cacattttgtacaaagatat

SEQ ID NO: 2840260 - DNA, 19 bp, Homo sapiens
caccaacccatcagaagga

SEQ ID NO: 2840261 - DNA, 13 bp, Homo sapiens
caccaagcccagt

SEQ ID NO: 2840262 - DNA, 20 bp, Homo sapiens
caccaagctcacagttcctc

SEQ ID NO: 2840263 - DNA, 14 bp, Homo sapiens
caccaagctgttcc

SEQ ID NO: 2840264 - DNA, 18 bp, Homo sapiens
caccaataacttcagaga

SEQ ID NO: 2840265 - DNA, 22 bp, Homo sapiens
caccaataacttcagagaagtc

SEQ ID NO: 2840266 - DNA, 22 bp, Homo sapiens
caccaatgtacccaccgggcca

SEQ ID NO: 2840267 - DNA, 13 bp, Homo sapiens
caccacacccagc

SEQ ID NO: 2840268 - DNA, 15 bp, Homo sapiens
caccacacccagccc

SEQ ID NO: 2840269 - DNA, 19 bp, Homo sapiens
caccacacccagcccactt

SEQ ID NO: 2840270 - DNA, 17 bp, Homo sapiens
caccacactgaatctcc

SEQ ID NO: 2840271 - DNA, 22 bp, Homo sapiens
caccacctaggccactcctcca

SEQ ID NO: 2840272 - DNA, 18 bp, Homo sapiens
caccaccttcccagctct

SEQ ID NO: 2840273 - DNA, 22 bp, Homo sapiens
caccaccttcccagctctccct

SEQ ID NO: 2840274 - DNA, 23 bp, Homo sapiens
caccaccttggactcctcccaca

SEQ ID NO: 2840275 - DNA, 18 bp, Homo sapiens
caccacgatgtggccctg

SEQ ID NO: 2840276 - DNA, 21 bp, Homo sapiens
caccacgatgtggccctggcc

SEQ ID NO: 2840277 - DNA, 20 bp, Homo sapiens
caccactaggactctgaggc

SEQ ID NO: 2840278 - DNA, 14 bp, Homo sapiens
caccactctggcag

SEQ ID NO: 2840279 - DNA, 17 bp, Homo sapiens
caccagagcccaccttg

SEQ ID NO: 2840280 - DNA, 16 bp, Homo sapiens
caccagagcccatgct

SEQ ID NO: 2840281 - DNA, 19 bp, Homo sapiens
caccagagcccatgctcaa

SEQ ID NO: 2840282 - DNA, 23 bp, Homo sapiens
caccagaggctgcagaaggccaa

SEQ ID NO: 2840283 - DNA, 17 bp, Homo sapiens
caccagaggtcaggagt

SEQ ID NO: 2840284 - DNA, 16 bp, Homo sapiens
caccagatgagaagtt

SEQ ID NO: 2840285 - DNA, 16 bp, Homo sapiens
caccagccacctcttg

SEQ ID NO: 2840286 - DNA, 14 bp, Homo sapiens
caccagccccagca

SEQ ID NO: 2840287 - DNA, 15 bp, Homo sapiens
caccagccccagcaa

SEQ ID NO: 2840288 - DNA, 13 bp, Homo sapiens
caccagccccagt

SEQ ID NO: 2840289 - DNA, 16 bp, Homo sapiens
caccagccccagtgcc

SEQ ID NO: 2840290 - DNA, 15 bp, Homo sapiens
caccagcccggcctg

SEQ ID NO: 2840291 - DNA, 19 bp, Homo sapiens
caccagcttctccaggctc

SEQ ID NO: 2840292 - DNA, 12 bp, Homo sapiens
caccaggaatgt

SEQ ID NO: 2840293 - DNA, 17 bp, Homo sapiens
caccaggaatgttaaag

SEQ ID NO: 2840294 - DNA, 23 bp, Homo sapiens
caccaggaatgttaaagtcagtg

SEQ ID NO: 2840295 - DNA, 22 bp, Homo sapiens
caccaggcacgaacccacctgc

SEQ ID NO: 2840296 - DNA, 24 bp, Homo sapiens
caccaggcacgaacccacctgctg

SEQ ID NO: 2840297 - DNA, 13 bp, Homo sapiens
caccaggccgggc

SEQ ID NO: 2840298 - DNA, 13 bp, Homo sapiens
caccagtgccgcc

SEQ ID NO: 2840299 - DNA, 19 bp, Homo sapiens
caccagtgccgcctgtgcc

SEQ ID NO: 2840300 - DNA, 20 bp, Homo sapiens
caccagtgccgcctgtgccc

SEQ ID NO: 2840301 - DNA, 13 bp, Homo sapiens
caccatagcctac

SEQ ID NO: 2840302 - DNA, 17 bp, Homo sapiens
caccatcatgtctggct

SEQ ID NO: 2840303 - DNA, 17 bp, Homo sapiens
caccatgcgctgctcaa

SEQ ID NO: 2840304 - DNA, 16 bp, Homo sapiens
caccattcacatttga

SEQ ID NO: 2840305 - DNA, 21 bp, Homo sapiens
caccattcacatttgatgtac

SEQ ID NO: 2840306 - DNA, 23 bp, Homo sapiens
caccattcacatttgatgtacat

SEQ ID NO: 2840307 - DNA, 14 bp, Homo sapiens
cacccaaaagtcaa

SEQ ID NO: 2840308 - DNA, 22 bp, Homo sapiens
cacccaaagaggtatttatctt

SEQ ID NO: 2840309 - DNA, 16 bp, Homo sapiens
cacccaattcaaaaca

SEQ ID NO: 2840310 - DNA, 13 bp, Homo sapiens
cacccacagggct

SEQ ID NO: 2840311 - DNA, 13 bp, Homo sapiens
cacccacatgtga

SEQ ID NO: 2840312 - DNA, 19 bp, Homo sapiens
cacccacatgtgacacata

SEQ ID NO: 2840313 - DNA, 20 bp, Homo sapiens
cacccaccatcatgtctggc

SEQ ID NO: 2840314 - DNA, 12 bp, Homo sapiens
cacccacctcag

SEQ ID NO: 2840315 - DNA, 16 bp, Homo sapiens
cacccacctcagcctc

SEQ ID NO: 2840316 - DNA, 10 bp, Homo sapiens
cacccagccc

SEQ ID NO: 2840317 - DNA, 12 bp, Homo sapiens
cacccagcccat

SEQ ID NO: 2840318 - DNA, 20 bp, Homo sapiens
cacccaggagccccgaggcc

SEQ ID NO: 2840319 - DNA, 20 bp, Homo sapiens
cacccaggcaggccctgcct

SEQ ID NO: 2840320 - DNA, 17 bp, Homo sapiens
cacccagtctgttcccc

SEQ ID NO: 2840321 - DNA, 14 bp, Homo sapiens
cacccatgccatag

SEQ ID NO: 2840322 - DNA, 13 bp, Homo sapiens
cacccatgtgcca

SEQ ID NO: 2840323 - DNA, 11 bp, Homo sapiens
caccccaggac

SEQ ID NO: 2840324 - DNA, 18 bp, Homo sapiens
caccccatctctcttccc

SEQ ID NO: 2840325 - DNA, 16 bp, Homo sapiens
cacccccagcctgggc

SEQ ID NO: 2840326 - DNA, 17 bp, Homo sapiens
cacccccagcctgggcc

SEQ ID NO: 2840327 - DNA, 23 bp, Homo sapiens
caccccccagtcgagccctgcag

SEQ ID NO: 2840328 - DNA, 12 bp, Homo sapiens
caccccctcatt

SEQ ID NO: 2840329 - DNA, 14 bp, Homo sapiens
caccccctcattcc

SEQ ID NO: 2840330 - DNA, 18 bp, Homo sapiens
caccccctccccagggga

SEQ ID NO: 2840331 - DNA, 14 bp, Homo sapiens
caccccctgcagct

SEQ ID NO: 2840332 - DNA, 16 bp, Homo sapiens
cacccccttcagtgcc

SEQ ID NO: 2840333 - DNA, 22 bp, Homo sapiens
cacctgccagcctggcttctgg

SEQ ID NO: 2840334 - DNA, 18 bp, Homo sapiens
cacctgcccaacctgctc

SEQ ID NO: 2840335 - DNA, 15 bp, Homo sapiens
cacctgccccctggt

SEQ ID NO: 2840336 - DNA, 12 bp, Homo sapiens
cacctgccctgc

SEQ ID NO: 2840337 - DNA, 13 bp, Homo sapiens
cacctgccctgcc

SEQ ID NO: 2840338 - DNA, 14 bp, Homo sapiens
cacctgccctgccc

SEQ ID NO: 2840339 - DNA, 13 bp, Homo sapiens
cacctgccgacct

SEQ ID NO: 2840340 - DNA, 17 bp, Homo sapiens
cacctgcctatccatcc

SEQ ID NO: 2840341 - DNA, 22 bp, Homo sapiens
cacctggaagcatttgtttcta

SEQ ID NO: 2840342 - DNA, 16 bp, Homo sapiens
cacctggccccatgtc

SEQ ID NO: 2840343 - DNA, 20 bp, Homo sapiens
cacctggccccatgtctctc

SEQ ID NO: 2840344 - DNA, 19 bp, Homo sapiens
cacctggccgcctccagga

SEQ ID NO: 2840345 - DNA, 14 bp, Homo sapiens
cacctgggccctgg

SEQ ID NO: 2840346 - DNA, 18 bp, Homo sapiens
cacctgggccctggggcc

SEQ ID NO: 2840347 - DNA, 20 bp, Homo sapiens
cacctgggccctggggcctg

SEQ ID NO: 2840348 - DNA, 23 bp, Homo sapiens
cacctgggccctggggcctgtac

SEQ ID NO: 2840349 - DNA, 15 bp, Homo sapiens
cacctgtcccagaaa

SEQ ID NO: 2840350 - DNA, 16 bp, Homo sapiens
cacctgtctgtctgtc

SEQ ID NO: 2840351 - DNA, 17 bp, Homo sapiens
cacctgtgcaccccatg

SEQ ID NO: 2840352 - DNA, 19 bp, Homo sapiens
cacctgttaaaatgtacac

SEQ ID NO: 2840353 - DNA, 16 bp, Homo sapiens
caccttagcagctctt

SEQ ID NO: 2840354 - DNA, 17 bp, Homo sapiens
cactcctcactgcccca

SEQ ID NO: 2840355 - DNA, 15 bp, Homo sapiens
cactcctccaaagga

SEQ ID NO: 2840356 - DNA, 22 bp, Homo sapiens
cactctaggggtcaggctccat

SEQ ID NO: 2840357 - DNA, 12 bp, Homo sapiens
cactctcccctc

SEQ ID NO: 2840358 - DNA, 22 bp, Homo sapiens
cactctcccctccctcttcctt

SEQ ID NO: 2840359 - DNA, 14 bp, Homo sapiens
cactctctaaatct

SEQ ID NO: 2840360 - DNA, 19 bp, Homo sapiens
cactctctaaatcttcctt

SEQ ID NO: 2840361 - DNA, 19 bp, Homo sapiens
cactctgaataccaagtgt

SEQ ID NO: 2840362 - DNA, 12 bp, Homo sapiens
cactctggcagc

SEQ ID NO: 2840363 - DNA, 14 bp, Homo sapiens
cactctggcagcca

SEQ ID NO: 2840364 - DNA, 15 bp, Homo sapiens
cactctggcagccac

SEQ ID NO: 2840365 - DNA, 19 bp, Homo sapiens
cactctgtcgcccagtctg

SEQ ID NO: 2840366 - DNA, 17 bp, Homo sapiens
cactcttattgcccacg

SEQ ID NO: 2840367 - DNA, 18 bp, Homo sapiens
cactcttattgcccacgc

SEQ ID NO: 2840368 - DNA, 19 bp, Homo sapiens
cactgaagttaacagagac

SEQ ID NO: 2840369 - DNA, 22 bp, Homo sapiens
cactgaagttaacagagacaga

SEQ ID NO: 2840370 - DNA, 14 bp, Homo sapiens
cactgacccacagc

SEQ ID NO: 2840371 - DNA, 13 bp, Homo sapiens
cactgagctgggc

SEQ ID NO: 2840372 - DNA, 12 bp, Homo sapiens
cactgcaagaag

SEQ ID NO: 2840373 - DNA, 18 bp, Homo sapiens
cactgcaagaagtcttga

SEQ ID NO: 2840374 - DNA, 20 bp, Homo sapiens
cactgcaatctccacctccc

SEQ ID NO: 2840375 - DNA, 15 bp, Homo sapiens
cactgcaccgggcca

SEQ ID NO: 2840376 - DNA, 17 bp, Homo sapiens
cactgcactccagcctg

SEQ ID NO: 2840377 - DNA, 18 bp, Homo sapiens
cactgcactccagcctgg

SEQ ID NO: 2840378 - DNA, 20 bp, Homo sapiens
cactgcactccagcctgggc

SEQ ID NO: 2840379 - DNA, 13 bp, Homo sapiens
cactgcactccgg

SEQ ID NO: 2840380 - DNA, 20 bp, Homo sapiens
cactgcactctagcctggca

SEQ ID NO: 2840381 - DNA, 12 bp, Homo sapiens
cactgcagagat

SEQ ID NO: 2840382 - DNA, 19 bp, Homo sapiens
cactgcagagatggtggtg

SEQ ID NO: 2840383 - DNA, 19 bp, Homo sapiens
cactgccacaccctcccca

SEQ ID NO: 2840384 - DNA, 12 bp, Homo sapiens
cactgccaggag

SEQ ID NO: 2840385 - DNA, 14 bp, Homo sapiens
cactgccaggaggg

SEQ ID NO: 2840386 - DNA, 17 bp, Homo sapiens
cactgccaggagggaca

SEQ ID NO: 2840387 - DNA, 22 bp, Homo sapiens
cactgccaggagggacaaagga

SEQ ID NO: 2840388 - DNA, 15 bp, Homo sapiens
cactgccccaccagc

SEQ ID NO: 2840389 - DNA, 16 bp, Homo sapiens
cactgccccaccagcc

SEQ ID NO: 2840390 - DNA, 21 bp, Homo sapiens
cactgccccaccagccacctc

SEQ ID NO: 2840391 - DNA, 16 bp, Homo sapiens
cactgcctcttcctcc

SEQ ID NO: 2840392 - DNA, 13 bp, Homo sapiens
cactgccttccag

SEQ ID NO: 2840393 - DNA, 15 bp, Homo sapiens
cactgccttccagga

SEQ ID NO: 2840394 - DNA, 18 bp, Homo sapiens
cactgccttccaggagca

SEQ ID NO: 2840395 - DNA, 21 bp, Homo sapiens
cactgctacaccttagcagct

SEQ ID NO: 2840396 - DNA, 20 bp, Homo sapiens
cactgctaggcgagtgccag

SEQ ID NO: 2840397 - DNA, 13 bp, Homo sapiens
cactgctctcagc

SEQ ID NO: 2840398 - DNA, 18 bp, Homo sapiens
cactgctggggagtccct

SEQ ID NO: 2840399 - DNA, 20 bp, Homo sapiens
cactggaatcgatctgtact

SEQ ID NO: 2840400 - DNA, 16 bp, Homo sapiens
cactggagcaccaggc

SEQ ID NO: 2840401 - DNA, 21 bp, Homo sapiens
cactggagcaccaggcacgaa

SEQ ID NO: 2840402 - DNA, 16 bp, Homo sapiens
cactggagtgcaggga

SEQ ID NO: 2840403 - DNA, 18 bp, Homo sapiens
cactggagtgcagggagg

SEQ ID NO: 2840404 - DNA, 21 bp, Homo sapiens
cactgggggaggggacattga

SEQ ID NO: 2840405 - DNA, 18 bp, Homo sapiens
cactggggtcctggggcc

SEQ ID NO: 2840406 - DNA, 15 bp, Homo sapiens
cactgggttgacttt

SEQ ID NO: 2840407 - DNA, 17 bp, Homo sapiens
cactggttgtaagtaat

SEQ ID NO: 2840408 - DNA, 15 bp, Homo sapiens
cactggtttctcaga

SEQ ID NO: 2840409 - DNA, 14 bp, Homo sapiens
cactggtttgaaga

SEQ ID NO: 2840410 - DNA, 17 bp, Homo sapiens
cactgtaaaatgaaatt

SEQ ID NO: 2840411 - DNA, 17 bp, Homo sapiens
cactgtaacctcaaact

SEQ ID NO: 2840412 - DNA, 15 bp, Homo sapiens
cactgtaagtttatt

SEQ ID NO: 2840413 - DNA, 16 bp, Homo sapiens
cactgtaatcttaaaa

SEQ ID NO: 2840414 - DNA, 21 bp, Homo sapiens
cactgtagcattacagtgggt

SEQ ID NO: 2840415 - DNA, 16 bp, Homo sapiens
cactgtccctcaaatg

SEQ ID NO: 2840416 - DNA, 23 bp, Homo sapiens
cactgtccctcaaatgacccaaa

SEQ ID NO: 2840417 - DNA, 17 bp, Homo sapiens
cactgtcttgcctgcca

SEQ ID NO: 2840418 - DNA, 18 bp, Homo sapiens
cactgtgccatgtgccag

SEQ ID NO: 2840419 - DNA, 15 bp, Homo sapiens
cactgtgtatttaac

SEQ ID NO: 2840420 - DNA, 17 bp, Homo sapiens
cactgttactccacagc

SEQ ID NO: 2840421 - DNA, 18 bp, Homo sapiens
cactgttactccacagcg

SEQ ID NO: 2840422 - DNA, 15 bp, Homo sapiens
cactgttatcaaaac

SEQ ID NO: 2840423 - DNA, 23 bp, Homo sapiens
cactgttgcccaggctggcgtgc

SEQ ID NO: 2840424 - DNA, 16 bp, Homo sapiens
cacttaaaaaatgtcc

SEQ ID NO: 2840425 - DNA, 13 bp, Homo sapiens
cacttaccttcaa

SEQ ID NO: 2840426 - DNA, 16 bp, Homo sapiens
attggtgacaatgtca

SEQ ID NO: 2840427 - DNA, 19 bp, Homo sapiens
attggtgataagtggaaaa

SEQ ID NO: 2840428 - DNA, 19 bp, Homo sapiens
attgtacatatggaaatcc

SEQ ID NO: 2840429 - DNA, 12 bp, Homo sapiens
attgtacctctc

SEQ ID NO: 2840430 - DNA, 22 bp, Homo sapiens
attgtattttagcagggtacat

SEQ ID NO: 2840431 - DNA, 23 bp, Homo sapiens
attgtcagatattttttcagaaa

SEQ ID NO: 2840432 - DNA, 18 bp, Homo sapiens
attgtcattactgccttt

SEQ ID NO: 2840433 - DNA, 20 bp, Homo sapiens
attgtccatatcagacctct

SEQ ID NO: 2840434 - DNA, 14 bp, Homo sapiens
attgtccatgccta

SEQ ID NO: 2840435 - DNA, 19 bp, Homo sapiens
attgtctagaagcggtttc

SEQ ID NO: 2840436 - DNA, 18 bp, Homo sapiens
attgtcttttgtcatgtg

SEQ ID NO: 2840437 - DNA, 17 bp, Homo sapiens
attgtgaccaagttata

SEQ ID NO: 2840438 - DNA, 23 bp, Homo sapiens
attgtgatcagaccataatgtta

SEQ ID NO: 2840439 - DNA, 20 bp, Homo sapiens
attgtgcaatgtaaatattt

SEQ ID NO: 2840440 - DNA, 21 bp, Homo sapiens
attgtgccatgtcaaacaaat

SEQ ID NO: 2840441 - DNA, 19 bp, Homo sapiens
attgtggtacaatctcaaa

SEQ ID NO: 2840442 - DNA, 14 bp, Homo sapiens
attgtgtacaaagt

SEQ ID NO: 2840443 - DNA, 15 bp, Homo sapiens
attgtgtgagcttct

SEQ ID NO: 2840444 - DNA, 18 bp, Homo sapiens
attgtgttgccttagcac

SEQ ID NO: 2840445 - DNA, 19 bp, Homo sapiens
attgttaaaaccttactta

SEQ ID NO: 2840446 - DNA, 13 bp, Homo sapiens
attgttaaaataa

SEQ ID NO: 2840447 - DNA, 15 bp, Homo sapiens
attgttaaaataact

SEQ ID NO: 2840448 - DNA, 19 bp, Homo sapiens
attgttacaggtgtactat

SEQ ID NO: 2840449 - DNA, 15 bp, Homo sapiens
attgtttaattgtag

SEQ ID NO: 2840450 - DNA, 21 bp, Homo sapiens
attgtttatttatcagtgaca

SEQ ID NO: 2840451 - DNA, 19 bp, Homo sapiens
attgtttctttaagaaagt

SEQ ID NO: 2840452 - DNA, 11 bp, Homo sapiens
atttaaaaaat

SEQ ID NO: 2840453 - DNA, 22 bp, Homo sapiens
atttaaaaaataaaaaaataca

SEQ ID NO: 2840454 - DNA, 19 bp, Homo sapiens
atttaaaaaataaatataa

SEQ ID NO: 2840455 - DNA, 23 bp, Homo sapiens
atttaaaatagcaaaagaagaag

SEQ ID NO: 2840456 - DNA, 21 bp, Homo sapiens
atttaaaatcattcaatatct

SEQ ID NO: 2840457 - DNA, 12 bp, Homo sapiens
atttaaaccagc

SEQ ID NO: 2840458 - DNA, 19 bp, Homo sapiens
atttaaaccagcagaaaag

SEQ ID NO: 2840459 - DNA, 22 bp, Homo sapiens
atttaaaccgctaaaagaaact

SEQ ID NO: 2840460 - DNA, 14 bp, Homo sapiens
atttaaagttgttt

SEQ ID NO: 2840461 - DNA, 20 bp, Homo sapiens
atttaaattctttttcaaaa

SEQ ID NO: 2840462 - DNA, 13 bp, Homo sapiens
atttaacaagatc

SEQ ID NO: 2840463 - DNA, 19 bp, Homo sapiens
atttaactaatttaaacca

SEQ ID NO: 2840464 - DNA, 13 bp, Homo sapiens
atttaactctctt

SEQ ID NO: 2840465 - DNA, 15 bp, Homo sapiens
atttaagataattat

SEQ ID NO: 2840466 - DNA, 18 bp, Homo sapiens
atttaagcttatgtcaga

SEQ ID NO: 2840467 - DNA, 13 bp, Homo sapiens
atttaagggaaaa

SEQ ID NO: 2840468 - DNA, 13 bp, Homo sapiens
atttaagtaattt

SEQ ID NO: 2840469 - DNA, 13 bp, Homo sapiens
atttaagtatata

SEQ ID NO: 2840470 - DNA, 14 bp, Homo sapiens
atttaagtatatag

SEQ ID NO: 2840471 - DNA, 15 bp, Homo sapiens
atttaataaatgtat

SEQ ID NO: 2840472 - DNA, 20 bp, Homo sapiens
atttaatagcaaagaattga

SEQ ID NO: 2840473 - DNA, 14 bp, Homo sapiens
atttaatatagcta

SEQ ID NO: 2840474 - DNA, 17 bp, Homo sapiens
atttaatatagctattt

SEQ ID NO: 2840475 - DNA, 22 bp, Homo sapiens
atttaatatctgagaagtgtat

SEQ ID NO: 2840476 - DNA, 15 bp, Homo sapiens
atttaattcataatt

SEQ ID NO: 2840477 - DNA, 17 bp, Homo sapiens
atttaattcataattag

SEQ ID NO: 2840478 - DNA, 20 bp, Homo sapiens
atttaattcataattagaac

SEQ ID NO: 2840479 - DNA, 17 bp, Homo sapiens
atttaatttttgcaatt

SEQ ID NO: 2840480 - DNA, 15 bp, Homo sapiens
atttacatatgaaat

SEQ ID NO: 2840481 - DNA, 16 bp, Homo sapiens
atttacatatgaaatt

SEQ ID NO: 2840482 - DNA, 18 bp, Homo sapiens
atttaccacagcagctga

SEQ ID NO: 2840483 - DNA, 13 bp, Homo sapiens
atttagaaaacat

SEQ ID NO: 2840484 - DNA, 14 bp, Homo sapiens
atttagaaaacttt

SEQ ID NO: 2840485 - DNA, 13 bp, Homo sapiens
atttagaatatat

SEQ ID NO: 2840486 - DNA, 23 bp, Homo sapiens
atttagagatgaattaaatttaa

SEQ ID NO: 2840487 - DNA, 23 bp, Homo sapiens
atttaggtttttgtttgtttcct

SEQ ID NO: 2840488 - DNA, 16 bp, Homo sapiens
atttagttctttgtta

SEQ ID NO: 2840489 - DNA, 17 bp, Homo sapiens
atttagttctttgttat

SEQ ID NO: 2840490 - DNA, 13 bp, Homo sapiens
atttataactcat

SEQ ID NO: 2840491 - DNA, 15 bp, Homo sapiens
atttataactcatca

SEQ ID NO: 2840492 - DNA, 17 bp, Homo sapiens
caaaacaagaaagaaac

SEQ ID NO: 2840493 - DNA, 18 bp, Homo sapiens
caaaacaatgtttaaacc

SEQ ID NO: 2840494 - DNA, 15 bp, Homo sapiens
caaaacatatcaatt

SEQ ID NO: 2840495 - DNA, 18 bp, Homo sapiens
caaaacatatcaattcaa

SEQ ID NO: 2840496 - DNA, 12 bp, Homo sapiens
caaaaccagctg

SEQ ID NO: 2840497 - DNA, 14 bp, Homo sapiens
caaaaccagctgct

SEQ ID NO: 2840498 - DNA, 14 bp, Homo sapiens
caaaagaagaagtt

SEQ ID NO: 2840499 - DNA, 15 bp, Homo sapiens
caaaagctgcttgac

SEQ ID NO: 2840500 - DNA, 22 bp, Homo sapiens
caaaagctgcttgactatcaca

SEQ ID NO: 2840501 - DNA, 16 bp, Homo sapiens
caaaaggcagcccttt

SEQ ID NO: 2840502 - DNA, 19 bp, Homo sapiens
caaaaggcagccctttggg

SEQ ID NO: 2840503 - DNA, 15 bp, Homo sapiens
caaaaggtgcctgtg

SEQ ID NO: 2840504 - DNA, 19 bp, Homo sapiens
caaaagtcaaaaggtgcct

SEQ ID NO: 2840505 - DNA, 16 bp, Homo sapiens
caaaagttacatgttt

SEQ ID NO: 2840506 - DNA, 19 bp, Homo sapiens
caaaagttacatgtttgca

SEQ ID NO: 2840507 - DNA, 11 bp, Homo sapiens
caaaataaatt

SEQ ID NO: 2840508 - DNA, 18 bp, Homo sapiens
caaaataaattgaaatat

SEQ ID NO: 2840509 - DNA, 17 bp, Homo sapiens
caaaataatttaactaa

SEQ ID NO: 2840510 - DNA, 20 bp, Homo sapiens
caaaataatttaactaattt

SEQ ID NO: 2840511 - DNA, 14 bp, Homo sapiens
caaaatatttaatt

SEQ ID NO: 2840512 - DNA, 15 bp, Homo sapiens
caaaatatttaatta

SEQ ID NO: 2840513 - DNA, 16 bp, Homo sapiens
caaaatcacaagcaat

SEQ ID NO: 2840514 - DNA, 18 bp, Homo sapiens
caaaatttccagtacctt

SEQ ID NO: 2840515 - DNA, 20 bp, Homo sapiens
caaaatttccagtacctttg

SEQ ID NO: 2840516 - DNA, 14 bp, Homo sapiens
caaaattttattcc

SEQ ID NO: 2840517 - DNA, 18 bp, Homo sapiens
caaaattttattcctata

SEQ ID NO: 2840518 - DNA, 21 bp, Homo sapiens
caagaagaccagactgtggag

SEQ ID NO: 2840519 - DNA, 17 bp, Homo sapiens
caagaagcattttgtaa

SEQ ID NO: 2840520 - DNA, 23 bp, Homo sapiens
caagaagcattttgtaagttgaa

SEQ ID NO: 2840521 - DNA, 16 bp, Homo sapiens
caagaaggcaaaaata

SEQ ID NO: 2840522 - DNA, 23 bp, Homo sapiens
caagaagggttttccaccctgga

SEQ ID NO: 2840523 - DNA, 22 bp, Homo sapiens
caagaatacagaaaatgctttt

SEQ ID NO: 2840524 - DNA, 22 bp, Homo sapiens
caagacgtcctggaatgaagca

SEQ ID NO: 2840525 - DNA, 15 bp, Homo sapiens
caagactctgtctca

SEQ ID NO: 2840526 - DNA, 14 bp, Homo sapiens
caagactgttgctc

SEQ ID NO: 2840527 - DNA, 18 bp, Homo sapiens
caagactgttgctcaaat

SEQ ID NO: 2840528 - DNA, 16 bp, Homo sapiens
caagagaacatttcta

SEQ ID NO: 2840529 - DNA, 17 bp, Homo sapiens
caagagaagaaaaaatt

SEQ ID NO: 2840530 - DNA, 19 bp, Homo sapiens
caagagaagaaaaaattaa

SEQ ID NO: 2840531 - DNA, 13 bp, Homo sapiens
caagagagaaaga

SEQ ID NO: 2840532 - DNA, 17 bp, Homo sapiens
caagagagaaagaagta

SEQ ID NO: 2840533 - DNA, 20 bp, Homo sapiens
caagagcatcatgcctctga

SEQ ID NO: 2840534 - DNA, 23 bp, Homo sapiens
caagagcatcatgcctctgaggc

SEQ ID NO: 2840535 - DNA, 19 bp, Homo sapiens
caagagcccagcagggcct

SEQ ID NO: 2840536 - DNA, 18 bp, Homo sapiens
caagagccttggtgtcca

SEQ ID NO: 2840537 - DNA, 21 bp, Homo sapiens
caagagccttggtgtccacct

SEQ ID NO: 2840538 - DNA, 19 bp, Homo sapiens
caagagctacataatttag

SEQ ID NO: 2840539 - DNA, 12 bp, Homo sapiens
caagagctgagg

SEQ ID NO: 2840540 - DNA, 15 bp, Homo sapiens
caagaggctgaggca

SEQ ID NO: 2840541 - DNA, 12 bp, Homo sapiens
caagagggtctg

SEQ ID NO: 2840542 - DNA, 16 bp, Homo sapiens
caagagggtctgagga

SEQ ID NO: 2840543 - DNA, 24 bp, Homo sapiens
caagagttctttaggtgcctcctg

SEQ ID NO: 2840544 - DNA, 16 bp, Homo sapiens
caagataactgagaat

SEQ ID NO: 2840545 - DNA, 18 bp, Homo sapiens
caagatcttgtctccact

SEQ ID NO: 2840546 - DNA, 21 bp, Homo sapiens
caagatcttgtctccactaaa

SEQ ID NO: 2840547 - DNA, 15 bp, Homo sapiens
caagatgacagctct

SEQ ID NO: 2840548 - DNA, 16 bp, Homo sapiens
caagatgacagctctt

SEQ ID NO: 2840549 - DNA, 20 bp, Homo sapiens
atgtgataaggatcagaaca

SEQ ID NO: 2840550 - DNA, 17 bp, Homo sapiens
atgtgcattctccagcc

SEQ ID NO: 2840551 - DNA, 13 bp, Homo sapiens
atgtgccaaggtg

SEQ ID NO: 2840552 - DNA, 21 bp, Homo sapiens
atgtgccaggtttttggtctg

SEQ ID NO: 2840553 - DNA, 13 bp, Homo sapiens
atgtgcctggaaa

SEQ ID NO: 2840554 - DNA, 18 bp, Homo sapiens
atgtggcccctgaacaag

SEQ ID NO: 2840555 - DNA, 16 bp, Homo sapiens
atgtggccctggcctg

SEQ ID NO: 2840556 - DNA, 20 bp, Homo sapiens
atgtggccctggcctgctgg

SEQ ID NO: 2840557 - DNA, 19 bp, Homo sapiens
atgtggcctaaaaatgcaa

SEQ ID NO: 2840558 - DNA, 15 bp, Homo sapiens
atgtggtgggacagg

SEQ ID NO: 2840559 - DNA, 11 bp, Homo sapiens
atgtgtaaatg

SEQ ID NO: 2840560 - DNA, 17 bp, Homo sapiens
atgtgtagcctgtgcat

SEQ ID NO: 2840561 - DNA, 20 bp, Homo sapiens
atgtgtagggaaagttaaaa

SEQ ID NO: 2840562 - DNA, 15 bp, Homo sapiens
atgtgtcagcatgca

SEQ ID NO: 2840563 - DNA, 20 bp, Homo sapiens
atgtgtctttatcagtgatg

SEQ ID NO: 2840564 - DNA, 16 bp, Homo sapiens
atgtgtggtgctaact

SEQ ID NO: 2840565 - DNA, 17 bp, Homo sapiens
atgtgtgtatatgtatg

SEQ ID NO: 2840566 - DNA, 18 bp, Homo sapiens
atgtgtgtatatgtatgt

SEQ ID NO: 2840567 - DNA, 19 bp, Homo sapiens
atgtgtgtgtatgctacta

SEQ ID NO: 2840568 - DNA, 17 bp, Homo sapiens
atgtgtttactttatgt

SEQ ID NO: 2840569 - DNA, 14 bp, Homo sapiens
atgtgttttctgaa

SEQ ID NO: 2840570 - DNA, 22 bp, Homo sapiens
atgttaaaaaaataagaagaat

SEQ ID NO: 2840571 - DNA, 21 bp, Homo sapiens
atgttaaagaggcgtcttgta

SEQ ID NO: 2840572 - DNA, 18 bp, Homo sapiens
atgttaagacttgacagt

SEQ ID NO: 2840573 - DNA, 20 bp, Homo sapiens
atgttaagacttgacagtgg

SEQ ID NO: 2840574 - DNA, 17 bp, Homo sapiens
atgttaagttacttcac

SEQ ID NO: 2840575 - DNA, 14 bp, Homo sapiens
atgttacattgttt

SEQ ID NO: 2840576 - DNA, 17 bp, Homo sapiens
atgttagaagtccaggc

SEQ ID NO: 2840577 - DNA, 20 bp, Homo sapiens
atgttatttatatattggta

SEQ ID NO: 2840578 - DNA, 15 bp, Homo sapiens
atgttatttgtaata

SEQ ID NO: 2840579 - DNA, 17 bp, Homo sapiens
atgttattttttaatta

SEQ ID NO: 2840580 - DNA, 19 bp, Homo sapiens
atgttattttttaattatt

SEQ ID NO: 2840581 - DNA, 14 bp, Homo sapiens
atgttcaactggag

SEQ ID NO: 2840582 - DNA, 17 bp, Homo sapiens
atgttcacgcaacttga

SEQ ID NO: 2840583 - DNA, 17 bp, Homo sapiens
atgttctctgaggacac

SEQ ID NO: 2840584 - DNA, 18 bp, Homo sapiens
atgttctgaataatttct

SEQ ID NO: 2840585 - DNA, 23 bp, Homo sapiens
atgttctggctttacattttatt

SEQ ID NO: 2840586 - DNA, 15 bp, Homo sapiens
atgttctgggacaca

SEQ ID NO: 2840587 - DNA, 17 bp, Homo sapiens
atgttgcccaggcaggt

SEQ ID NO: 2840588 - DNA, 13 bp, Homo sapiens
atgttggccaggc

SEQ ID NO: 2840589 - DNA, 14 bp, Homo sapiens
atgttgggatttat

SEQ ID NO: 2840590 - DNA, 21 bp, Homo sapiens
atgttgggatttatatctata

SEQ ID NO: 2840591 - DNA, 16 bp, Homo sapiens
atgttgtgttctaata

SEQ ID NO: 2840592 - DNA, 13 bp, Homo sapiens
atgttgttaaaca

SEQ ID NO: 2840593 - DNA, 12 bp, Homo sapiens
atgttgttattt

SEQ ID NO: 2840594 - DNA, 17 bp, Homo sapiens
atgttgttatttaaaga

SEQ ID NO: 2840595 - DNA, 21 bp, Homo sapiens
atgtttaaaaacattccccaa

SEQ ID NO: 2840596 - DNA, 18 bp, Homo sapiens
atgtttacactctttgta

SEQ ID NO: 2840597 - DNA, 22 bp, Homo sapiens
atgtttacactctttgtaagag

SEQ ID NO: 2840598 - DNA, 18 bp, Homo sapiens
atgtttatgcaaggaagg

SEQ ID NO: 2840599 - DNA, 19 bp, Homo sapiens
atgtttcacgaagtttgtt

SEQ ID NO: 2840600 - DNA, 18 bp, Homo sapiens
atgtttcactatgatttt

SEQ ID NO: 2840601 - DNA, 19 bp, Homo sapiens
atgtttccagaaaatataa

SEQ ID NO: 2840602 - DNA, 22 bp, Homo sapiens
atgtttcccgctccaagagaat

SEQ ID NO: 2840603 - DNA, 23 bp, Homo sapiens
atgtttctgcagtagtctctgtg

SEQ ID NO: 2840604 - DNA, 22 bp, Homo sapiens
atgtttgcacctttctagttga

SEQ ID NO: 2840605 - DNA, 18 bp, Homo sapiens
atgtttgcctctgcctct

SEQ ID NO: 2840606 - DNA, 19 bp, Homo sapiens
atgtttgcctctgcctctg

SEQ ID NO: 2840607 - DNA, 23 bp, Homo sapiens
atgtttgggcagaagggagaagg

SEQ ID NO: 2840608 - DNA, 16 bp, Homo sapiens
atgttttaagaggcag

SEQ ID NO: 2840609 - DNA, 18 bp, Homo sapiens
atgttttaagaggcaggg

SEQ ID NO: 2840610 - DNA, 23 bp, Homo sapiens
atgttttggccaatgcacctaaa

SEQ ID NO: 2840611 - DNA, 13 bp, Homo sapiens
atgtttttaatgt

SEQ ID NO: 2840612 - DNA, 17 bp, Homo sapiens
attaaaaaatttccagt

SEQ ID NO: 2840613 - DNA, 13 bp, Homo sapiens
attaaaaaccact

SEQ ID NO: 2840614 - DNA, 15 bp, Homo sapiens
attaaaaagttaatc

SEQ ID NO: 2840615 - DNA, 23 bp, Homo sapiens
attaaaatctggcaaagttatat

SEQ ID NO: 2840616 - DNA, 13 bp, Homo sapiens
attaaaatgaata

SEQ ID NO: 2840617 - DNA, 22 bp, Homo sapiens
attaaaatgtaggaagaaaaat

SEQ ID NO: 2840618 - DNA, 13 bp, Homo sapiens
attaaacacctga

SEQ ID NO: 2840619 - DNA, 15 bp, Homo sapiens
attaaagcatttact

SEQ ID NO: 2840620 - DNA, 17 bp, Homo sapiens
attaaatacagacacta

SEQ ID NO: 2840621 - DNA, 20 bp, Homo sapiens
attaaatacagacactaagt

SEQ ID NO: 2840622 - DNA, 17 bp, Homo sapiens
attaaattggaattttc

SEQ ID NO: 2840623 - DNA, 15 bp, Homo sapiens
attaaatttctggat

SEQ ID NO: 2840624 - DNA, 17 bp, Homo sapiens
attaaatttctggattt

SEQ ID NO: 2840625 - DNA, 20 bp, Homo sapiens
attaaattttctatgcttat

SEQ ID NO: 2840626 - DNA, 20 bp, Homo sapiens
attaacaaattatgttacat

SEQ ID NO: 2840627 - DNA, 22 bp, Homo sapiens
attaacatcatcaggcttggaa

SEQ ID NO: 2840628 - DNA, 12 bp, Homo sapiens
attaactcatta

SEQ ID NO: 2840629 - DNA, 19 bp, Homo sapiens
attaactgggtaatgaaac

SEQ ID NO: 2840630 - DNA, 15 bp, Homo sapiens
attaacttagcatgt

SEQ ID NO: 2840631 - DNA, 16 bp, Homo sapiens
attaataaaaaatgga

SEQ ID NO: 2840632 - DNA, 15 bp, Homo sapiens
attaatatgttcatt

SEQ ID NO: 2840633 - DNA, 18 bp, Homo sapiens
attaatatgttcattaaa

SEQ ID NO: 2840634 - DNA, 16 bp, Homo sapiens
attaatattcattgta

SEQ ID NO: 2840635 - DNA, 22 bp, Homo sapiens
attaatgaactgtgacaggaag

SEQ ID NO: 2840636 - DNA, 13 bp, Homo sapiens
attaatgcctctc

SEQ ID NO: 2840637 - DNA, 19 bp, Homo sapiens
attaatgcctctcccgcac

SEQ ID NO: 2840638 - DNA, 13 bp, Homo sapiens
attaattatctga

SEQ ID NO: 2840639 - DNA, 17 bp, Homo sapiens
attacataatcaaagct

SEQ ID NO: 2840640 - DNA, 22 bp, Homo sapiens
attacatttccaaatgaatgac

SEQ ID NO: 2840641 - DNA, 13 bp, Homo sapiens
attaccatggaga

SEQ ID NO: 2840642 - DNA, 15 bp, Homo sapiens
attaccatggagaca

SEQ ID NO: 2840643 - DNA, 13 bp, Homo sapiens
attacctctgata

SEQ ID NO: 2840644 - DNA, 18 bp, Homo sapiens
attactaaagacagaaaa

SEQ ID NO: 2840645 - DNA, 23 bp, Homo sapiens
attactgcctttggaagaaacag

SEQ ID NO: 2840646 - DNA, 16 bp, Homo sapiens
attacttatttttgac

SEQ ID NO: 2840647 - DNA, 14 bp, Homo sapiens
attacttctgctac

SEQ ID NO: 2840648 - DNA, 18 bp, Homo sapiens
attacttgcacaagcttg

SEQ ID NO: 2840649 - DNA, 15 bp, Homo sapiens
attagaaattagctg

SEQ ID NO: 2840650 - DNA, 18 bp, Homo sapiens
attagaacaatagctatt

SEQ ID NO: 2840651 - DNA, 19 bp, Homo sapiens
attagaacaggcaagtgaa

SEQ ID NO: 2840652 - DNA, 20 bp, Homo sapiens
attagaagtgttaacttagc

SEQ ID NO: 2840653 - DNA, 13 bp, Homo sapiens
attagaagtgttt

SEQ ID NO: 2840654 - DNA, 19 bp, Homo sapiens
attagagggaggagaatga

SEQ ID NO: 2840655 - DNA, 15 bp, Homo sapiens
attagagtcagcctt

SEQ ID NO: 2840656 - DNA, 14 bp, Homo sapiens
attagcatttagtc

SEQ ID NO: 2840657 - DNA, 21 bp, Homo sapiens
attagctgtaaatacatgtgt

SEQ ID NO: 2840658 - DNA, 16 bp, Homo sapiens
attagctgtgtgaaat

SEQ ID NO: 2840659 - DNA, 18 bp, Homo sapiens
attaggaacagagtatat

SEQ ID NO: 2840660 - DNA, 22 bp, Homo sapiens
attaggaacagagtatatatgt

SEQ ID NO: 2840661 - DNA, 19 bp, Homo sapiens
attaggatctatgcaattt

SEQ ID NO: 2840662 - DNA, 22 bp, Homo sapiens
attaggggttgctaagaagcga

SEQ ID NO: 2840663 - DNA, 15 bp, Homo sapiens
attaggttttgtaca

SEQ ID NO: 2840664 - DNA, 19 bp, Homo sapiens
attagtacacagcaccaga

SEQ ID NO: 2840665 - DNA, 17 bp, Homo sapiens
attagtgagatttgtat

SEQ ID NO: 2840666 - DNA, 20 bp, Homo sapiens
attagttaggtgtgccaaac

SEQ ID NO: 2840667 - DNA, 20 bp, Homo sapiens
attagtttgatttaatatct

SEQ ID NO: 2840668 - DNA, 16 bp, Homo sapiens
attataacttaaaata

SEQ ID NO: 2840669 - DNA, 22 bp, Homo sapiens
attataatatactatatttatg

SEQ ID NO: 2840670 - DNA, 13 bp, Homo sapiens
attataatgaatt

SEQ ID NO: 2840671 - DNA, 15 bp, Homo sapiens
attataatttaatgc

SEQ ID NO: 2840672 - DNA, 17 bp, Homo sapiens
attataatttaatgcat

SEQ ID NO: 2840673 - DNA, 15 bp, Homo sapiens
attatatctaattta

SEQ ID NO: 2840674 - DNA, 19 bp, Homo sapiens
attatatctaatttataca

SEQ ID NO: 2840675 - DNA, 22 bp, Homo sapiens
attatatctaatttatacaaaa

SEQ ID NO: 2840676 - DNA, 13 bp, Homo sapiens
attatattataat

SEQ ID NO: 2840677 - DNA, 17 bp, Homo sapiens
attatcggaagcagtgc

SEQ ID NO: 2840678 - DNA, 22 bp, Homo sapiens
attatcgggaacagtgtttccc

SEQ ID NO: 2840679 - DNA, 17 bp, Homo sapiens
attatcgggagcagtgt

SEQ ID NO: 2840680 - DNA, 20 bp, Homo sapiens
attatgagtctctatgatct

SEQ ID NO: 2840681 - DNA, 16 bp, Homo sapiens
attatggtgtaatgca

SEQ ID NO: 2840682 - DNA, 17 bp, Homo sapiens
attatggtgtaatgcac

SEQ ID NO: 2840683 - DNA, 21 bp, Homo sapiens
attatgtgccattttaataaa

SEQ ID NO: 2840684 - DNA, 20 bp, Homo sapiens
attattacttatttttgaca

SEQ ID NO: 2840685 - DNA, 13 bp, Homo sapiens
attattagattct

SEQ ID NO: 2840686 - DNA, 15 bp, Homo sapiens
attattattcttcat

SEQ ID NO: 2840687 - DNA, 12 bp, Homo sapiens
attattccctct

SEQ ID NO: 2840688 - DNA, 21 bp, Homo sapiens
attattccctgtacaatattt

SEQ ID NO: 2840689 - DNA, 22 bp, Homo sapiens
attattccctgtacaatattta

SEQ ID NO: 2840690 - DNA, 12 bp, Homo sapiens
attattctaatt

SEQ ID NO: 2840691 - DNA, 20 bp, Homo sapiens
attattggaatataattgtt

SEQ ID NO: 2840692 - DNA, 21 bp, Homo sapiens
attatttacaatgcagaattt

SEQ ID NO: 2840693 - DNA, 22 bp, Homo sapiens
attatttcaaccgcttgccata

SEQ ID NO: 2840694 - DNA, 17 bp, Homo sapiens
attattttctatagctc

SEQ ID NO: 2840695 - DNA, 11 bp, Homo sapiens
attatttttgt

SEQ ID NO: 2840696 - DNA, 17 bp, Homo sapiens
attatttttgtgtttct

SEQ ID NO: 2840697 - DNA, 18 bp, Homo sapiens
attatttttgtgtttcta

SEQ ID NO: 2840698 - DNA, 18 bp, Homo sapiens
attcaaaccatttaattc

SEQ ID NO: 2840699 - DNA, 15 bp, Homo sapiens
attcaaactgctcca

SEQ ID NO: 2840700 - DNA, 22 bp, Homo sapiens
attcaacacattacttgcacaa

SEQ ID NO: 2840701 - DNA, 19 bp, Homo sapiens
attcaaccactgtaaaatg

SEQ ID NO: 2840702 - DNA, 22 bp, Homo sapiens
attcaagcctgtgaataaaaac

SEQ ID NO: 2840703 - DNA, 19 bp, Homo sapiens
attcaaggagatataaaat

SEQ ID NO: 2840704 - DNA, 21 bp, Homo sapiens
attcaaggcatttctatcaca

SEQ ID NO: 2840705 - DNA, 13 bp, Homo sapiens
attcaataaagct

SEQ ID NO: 2840706 - DNA, 23 bp, Homo sapiens
attcaatgtttatgcaaggaagg

SEQ ID NO: 2840707 - DNA, 18 bp, Homo sapiens
attcaattcctctgggaa

SEQ ID NO: 2840708 - DNA, 16 bp, Homo sapiens
attcacacacccctca

SEQ ID NO: 2840709 - DNA, 22 bp, Homo sapiens
attcacacacccctcaaaaaaa

SEQ ID NO: 2840710 - DNA, 23 bp, Homo sapiens
attcacactgtgcgttttagagt

SEQ ID NO: 2840711 - DNA, 13 bp, Homo sapiens
attcacagagcct

SEQ ID NO: 2840712 - DNA, 13 bp, Homo sapiens
attcacatttgat

SEQ ID NO: 2840713 - DNA, 16 bp, Homo sapiens
attcacatttgatgta

SEQ ID NO: 2840714 - DNA, 17 bp, Homo sapiens
attcacatttgatgtac

SEQ ID NO: 2840715 - DNA, 23 bp, Homo sapiens
attcacatttgatgtacatgtgt

SEQ ID NO: 2840716 - DNA, 14 bp, Homo sapiens
attcactgtaagtt

SEQ ID NO: 2840717 - DNA, 17 bp, Homo sapiens
attcagaacatcctcca

SEQ ID NO: 2840718 - DNA, 14 bp, Homo sapiens
attcagaagaaaaa

SEQ ID NO: 2840719 - DNA, 17 bp, Homo sapiens
attcagaagaaaaagaa

SEQ ID NO: 2840720 - DNA, 22 bp, Homo sapiens
attcagatcgtattaattatct

SEQ ID NO: 2840721 - DNA, 18 bp, Homo sapiens
attcaggaaaaggcctgg

SEQ ID NO: 2840722 - DNA, 21 bp, Homo sapiens
attcaggaaaaggcctggggt

SEQ ID NO: 2840723 - DNA, 22 bp, Homo sapiens
attcaggacttaacggctccag

SEQ ID NO: 2840724 - DNA, 20 bp, Homo sapiens
attcagtgctgtggcctggg

SEQ ID NO: 2840725 - DNA, 22 bp, Homo sapiens
attcagtgctgtggcctgggca

SEQ ID NO: 2840726 - DNA, 14 bp, Homo sapiens
attcagtgcttctt

SEQ ID NO: 2840727 - DNA, 19 bp, Homo sapiens
attcatccagttgcaataa

SEQ ID NO: 2840728 - DNA, 22 bp, Homo sapiens
attcatccagttgcaataaaat

SEQ ID NO: 2840729 - DNA, 19 bp, Homo sapiens
atgtcttggacactgtaca

SEQ ID NO: 2840730 - DNA, 17 bp, Homo sapiens
atgtcttgtacatgtgt

SEQ ID NO: 2840731 - DNA, 22 bp, Homo sapiens
atgtctttctccaaagttatcc

SEQ ID NO: 2840732 - DNA, 16 bp, Homo sapiens
atgtctttttaagctt

SEQ ID NO: 2840733 - DNA, 18 bp, Homo sapiens
atgtctttttaagcttat

SEQ ID NO: 2840734 - DNA, 20 bp, Homo sapiens
atgtgaatgatctctctgaa

SEQ ID NO: 2840735 - DNA, 16 bp, Homo sapiens
atgtgaattctgtgaa

SEQ ID NO: 2840736 - DNA, 17 bp, Homo sapiens
atgtgaattctgtgaag

SEQ ID NO: 2840737 - DNA, 20 bp, Homo sapiens
atgtgaattctgtgaagaat

SEQ ID NO: 2840738 - DNA, 18 bp, Homo sapiens
atgtgaattgcctgcaga

SEQ ID NO: 2840739 - DNA, 19 bp, Homo sapiens
accgtggcccttcctggac

SEQ ID NO: 2840740 - DNA, 15 bp, Homo sapiens
accgtgtccagcaca

SEQ ID NO: 2840741 - DNA, 17 bp, Homo sapiens
accgtgtccagcacaga

SEQ ID NO: 2840742 - DNA, 18 bp, Homo sapiens
accgttggggattgggga

SEQ ID NO: 2840743 - DNA, 15 bp, Homo sapiens
acctaacccctttcc

SEQ ID NO: 2840744 - DNA, 16 bp, Homo sapiens
acctaatcaggctgag

SEQ ID NO: 2840745 - DNA, 16 bp, Homo sapiens
acctactcacacaggc

SEQ ID NO: 2840746 - DNA, 15 bp, Homo sapiens
acctatacctgtgtt

SEQ ID NO: 2840747 - DNA, 22 bp, Homo sapiens
acctatgtcatttcatttccta

SEQ ID NO: 2840748 - DNA, 12 bp, Homo sapiens
acctcaaactgg

SEQ ID NO: 2840749 - DNA, 16 bp, Homo sapiens
acctcaagctgcatct

SEQ ID NO: 2840750 - DNA, 19 bp, Homo sapiens
acctcaagtttttgttttg

SEQ ID NO: 2840751 - DNA, 19 bp, Homo sapiens
acctcaatcagtctcagaa

SEQ ID NO: 2840752 - DNA, 19 bp, Homo sapiens
acctcacctttgcaaagtt

SEQ ID NO: 2840753 - DNA, 14 bp, Homo sapiens
acctcagccatgag

SEQ ID NO: 2840754 - DNA, 22 bp, Homo sapiens
acctcagccatgaggagttgct

SEQ ID NO: 2840755 - DNA, 10 bp, Homo sapiens
acctcagcct

SEQ ID NO: 2840756 - DNA, 11 bp, Homo sapiens
acctcagcctc

SEQ ID NO: 2840757 - DNA, 12 bp, Homo sapiens
acctcagcctcc

SEQ ID NO: 2840758 - DNA, 16 bp, Homo sapiens
acctcagcctgtgctg

SEQ ID NO: 2840759 - DNA, 20 bp, Homo sapiens
acctcagccttccccttgcc

SEQ ID NO: 2840760 - DNA, 17 bp, Homo sapiens
acctcagttttatcatt

SEQ ID NO: 2840761 - DNA, 18 bp, Homo sapiens
acctcagttttatcattt

SEQ ID NO: 2840762 - DNA, 15 bp, Homo sapiens
acctcatgacagcca

SEQ ID NO: 2840763 - DNA, 20 bp, Homo sapiens
acctcatgacagccagagcc

SEQ ID NO: 2840764 - DNA, 17 bp, Homo sapiens
acctccagctttcctgt

SEQ ID NO: 2840765 - DNA, 14 bp, Homo sapiens
acctcccagcccta

SEQ ID NO: 2840766 - DNA, 21 bp, Homo sapiens
acctcccagccctatggatgt

SEQ ID NO: 2840767 - DNA, 21 bp, Homo sapiens
acctcccaggggctccacctg

SEQ ID NO: 2840768 - DNA, 15 bp, Homo sapiens
acctccccccactgc

SEQ ID NO: 2840769 - DNA, 19 bp, Homo sapiens
acctcccctatccacccag

SEQ ID NO: 2840770 - DNA, 15 bp, Homo sapiens
acctccctgaaccat

SEQ ID NO: 2840771 - DNA, 13 bp, Homo sapiens
acctccctgccct

SEQ ID NO: 2840772 - DNA, 22 bp, Homo sapiens
acctccctgccctgtcctccag

SEQ ID NO: 2840773 - DNA, 17 bp, Homo sapiens
acctccgccccagacac

SEQ ID NO: 2840774 - DNA, 21 bp, Homo sapiens
acctccgccccagacacaccc

SEQ ID NO: 2840775 - DNA, 22 bp, Homo sapiens
acctcctattttaattggaatt

SEQ ID NO: 2840776 - DNA, 15 bp, Homo sapiens
acctcctcctgccct

SEQ ID NO: 2840777 - DNA, 12 bp, Homo sapiens
acctcctgccca

SEQ ID NO: 2840778 - DNA, 16 bp, Homo sapiens
acctcctgcccaggag

SEQ ID NO: 2840779 - DNA, 20 bp, Homo sapiens
acctcctgcccaggagagcc

SEQ ID NO: 2840780 - DNA, 13 bp, Homo sapiens
acctcctgcctcg

SEQ ID NO: 2840781 - DNA, 23 bp, Homo sapiens
acctccttcctcagtcctggaag

SEQ ID NO: 2840782 - DNA, 14 bp, Homo sapiens
acctcgtcctcccc

SEQ ID NO: 2840783 - DNA, 21 bp, Homo sapiens
acctcgtcctccccctgccag

SEQ ID NO: 2840784 - DNA, 20 bp, Homo sapiens
acctctcaatattcaataaa

SEQ ID NO: 2840785 - DNA, 23 bp, Homo sapiens
acctctcttatagaatatttatt

SEQ ID NO: 2840786 - DNA, 15 bp, Homo sapiens
acctctgatacctca

SEQ ID NO: 2840787 - DNA, 12 bp, Homo sapiens
acctctgatccc

SEQ ID NO: 2840788 - DNA, 22 bp, Homo sapiens
acctctgctctgaggcttccag

SEQ ID NO: 2840789 - DNA, 23 bp, Homo sapiens
acctctgctctgaggcttccaga

SEQ ID NO: 2840790 - DNA, 21 bp, Homo sapiens
acctcttctcttcctgtaaca

SEQ ID NO: 2840791 - DNA, 13 bp, Homo sapiens
acctgaacctggg

SEQ ID NO: 2840792 - DNA, 16 bp, Homo sapiens
acctgaagaatcacaa

SEQ ID NO: 2840793 - DNA, 18 bp, Homo sapiens
acctgaagactcattctt

SEQ ID NO: 2840794 - DNA, 12 bp, Homo sapiens
acctgacagatg

SEQ ID NO: 2840795 - DNA, 17 bp, Homo sapiens
acctgagcctgccgagc

SEQ ID NO: 2840796 - DNA, 23 bp, Homo sapiens
acctgaggatgcaacaaatattt

SEQ ID NO: 2840797 - DNA, 15 bp, Homo sapiens
acctgcaaaaaatag

SEQ ID NO: 2840798 - DNA, 16 bp, Homo sapiens
acctgcacctcccccc

SEQ ID NO: 2840799 - DNA, 20 bp, Homo sapiens
acctgcacctccccccactg

SEQ ID NO: 2840800 - DNA, 21 bp, Homo sapiens
acctgcacctccccccactgc

SEQ ID NO: 2840801 - DNA, 19 bp, Homo sapiens
acctgcatccgtagttccc

SEQ ID NO: 2840802 - DNA, 14 bp, Homo sapiens
acctgccagcctgg

SEQ ID NO: 2840803 - DNA, 18 bp, Homo sapiens
acctgccagcctggcttc

SEQ ID NO: 2840804 - DNA, 12 bp, Homo sapiens
acctgccctgcc

SEQ ID NO: 2840805 - DNA, 22 bp, Homo sapiens
acctgccctgccctgccacctg

SEQ ID NO: 2840806 - DNA, 12 bp, Homo sapiens
acctgccgacct

SEQ ID NO: 2840807 - DNA, 13 bp, Homo sapiens
acctgccgacctc

SEQ ID NO: 2840808 - DNA, 18 bp, Homo sapiens
acctgccgacctcgtcct

SEQ ID NO: 2840809 - DNA, 19 bp, Homo sapiens
acctgcctatccatcctgc

SEQ ID NO: 2840810 - DNA, 13 bp, Homo sapiens
acctgcctgccct

SEQ ID NO: 2840811 - DNA, 19 bp, Homo sapiens
acctgctctcctcttgcca

SEQ ID NO: 2840812 - DNA, 13 bp, Homo sapiens
acctgctgagctc

SEQ ID NO: 2840813 - DNA, 15 bp, Homo sapiens
acctgctgagctctg

SEQ ID NO: 2840814 - DNA, 21 bp, Homo sapiens
acctgcttcatgctcagccct

SEQ ID NO: 2840815 - DNA, 16 bp, Homo sapiens
acctgcttctgaactc

SEQ ID NO: 2840816 - DNA, 18 bp, Homo sapiens
acctgcttctgaactcaa

SEQ ID NO: 2840817 - DNA, 23 bp, Homo sapiens
acctggaagcatttgtttctact

SEQ ID NO: 2840818 - DNA, 20 bp, Homo sapiens
acctggccgcctccaggagc

SEQ ID NO: 2840819 - DNA, 18 bp, Homo sapiens
acctgggccctggggcct

SEQ ID NO: 2840820 - DNA, 23 bp, Homo sapiens
acctgggccctggggcctgtact

SEQ ID NO: 2840821 - DNA, 21 bp, Homo sapiens
acctggggtcatcgattcaaa

SEQ ID NO: 2840822 - DNA, 16 bp, Homo sapiens
acctggttggccgtgg

SEQ ID NO: 2840823 - DNA, 15 bp, Homo sapiens
acctgtaatcccagc

SEQ ID NO: 2840824 - DNA, 19 bp, Homo sapiens
acctgtaatcccagctact

SEQ ID NO: 2840825 - DNA, 20 bp, Homo sapiens
acctgtaatcccagctactt

SEQ ID NO: 2840826 - DNA, 12 bp, Homo sapiens
acctgtactcag

SEQ ID NO: 2840827 - DNA, 14 bp, Homo sapiens
acctgtctccctgg

SEQ ID NO: 2840828 - DNA, 11 bp, Homo sapiens
acctgtctgtc

SEQ ID NO: 2840829 - DNA, 12 bp, Homo sapiens
atgcctccaccg

SEQ ID NO: 2840830 - DNA, 18 bp, Homo sapiens
atgcctctgaggccagcc

SEQ ID NO: 2840831 - DNA, 15 bp, Homo sapiens
tttacttttaaacag

SEQ ID NO: 2840832 - DNA, 13 bp, Homo sapiens
tttagaaatcatt

SEQ ID NO: 2840833 - DNA, 14 bp, Homo sapiens
tttagaatatatta

SEQ ID NO: 2840834 - DNA, 18 bp, Homo sapiens
tttagagtagcatgagag

SEQ ID NO: 2840835 - DNA, 22 bp, Homo sapiens
tttagcagttaaaagtgtattt

SEQ ID NO: 2840836 - DNA, 16 bp, Homo sapiens
tttagccttctctgtt

SEQ ID NO: 2840837 - DNA, 16 bp, Homo sapiens
tttagctctgttcttt

SEQ ID NO: 2840838 - DNA, 14 bp, Homo sapiens
tttaggagacagtc

SEQ ID NO: 2840839 - DNA, 14 bp, Homo sapiens
tttaggtgcctcct

SEQ ID NO: 2840840 - DNA, 20 bp, Homo sapiens
tttaggtgcctcctgtctta

SEQ ID NO: 2840841 - DNA, 22 bp, Homo sapiens
tttaggtttttgtttgtttcct

SEQ ID NO: 2840842 - DNA, 13 bp, Homo sapiens
tttagtctgtcat

SEQ ID NO: 2840843 - DNA, 15 bp, Homo sapiens
tttagtcttttactc

SEQ ID NO: 2840844 - DNA, 17 bp, Homo sapiens
tttagtcttttactcct

SEQ ID NO: 2840845 - DNA, 19 bp, Homo sapiens
tttagttgcagactcagtt

SEQ ID NO: 2840846 - DNA, 14 bp, Homo sapiens
tttataaactagat

SEQ ID NO: 2840847 - DNA, 19 bp, Homo sapiens
tttataactcatcataaaa

SEQ ID NO: 2840848 - DNA, 20 bp, Homo sapiens
tttataactcatcataaaat

SEQ ID NO: 2840849 - DNA, 21 bp, Homo sapiens
tttataactcatcataaaata

SEQ ID NO: 2840850 - DNA, 22 bp, Homo sapiens
tttataactcatcataaaataa

SEQ ID NO: 2840851 - DNA, 20 bp, Homo sapiens
tttataagcagatttaacaa

SEQ ID NO: 2840852 - DNA, 22 bp, Homo sapiens
tttataagcccaaatggctctg

SEQ ID NO: 2840853 - DNA, 12 bp, Homo sapiens
tttatacaaaat

SEQ ID NO: 2840854 - DNA, 18 bp, Homo sapiens
tttatacaaaataattta

SEQ ID NO: 2840855 - DNA, 20 bp, Homo sapiens
tttatacatagtcacaaaaa

SEQ ID NO: 2840856 - DNA, 13 bp, Homo sapiens
tttatacatatca

SEQ ID NO: 2840857 - DNA, 20 bp, Homo sapiens
tttatacatatcagaaaagt

SEQ ID NO: 2840858 - DNA, 21 bp, Homo sapiens
tttatacatatcagaaaagta

SEQ ID NO: 2840859 - DNA, 21 bp, Homo sapiens
tttatactctagaacatgcac

SEQ ID NO: 2840860 - DNA, 12 bp, Homo sapiens
tttatatatttg

SEQ ID NO: 2840861 - DNA, 17 bp, Homo sapiens
tttatatcagcctgagt

SEQ ID NO: 2840862 - DNA, 22 bp, Homo sapiens
tttatatgaaatgtttcactat

SEQ ID NO: 2840863 - DNA, 16 bp, Homo sapiens
tttatattagaagtgt

SEQ ID NO: 2840864 - DNA, 15 bp, Homo sapiens
tttatatttctcgta

SEQ ID NO: 2840865 - DNA, 14 bp, Homo sapiens
tttatatttggaaa

SEQ ID NO: 2840866 - DNA, 18 bp, Homo sapiens
tttatatttggaaagaga

SEQ ID NO: 2840867 - DNA, 21 bp, Homo sapiens
tttatgaaatggttaagaatt

SEQ ID NO: 2840868 - DNA, 18 bp, Homo sapiens
tttatgaagaaaaaatac

SEQ ID NO: 2840869 - DNA, 17 bp, Homo sapiens
tttatgaaggcaaaaaa

SEQ ID NO: 2840870 - DNA, 20 bp, Homo sapiens
tttatgactgtaaacataga

SEQ ID NO: 2840871 - DNA, 21 bp, Homo sapiens
tttatgactgtaaacatagat

SEQ ID NO: 2840872 - DNA, 15 bp, Homo sapiens
tttatgcaaggaagg

SEQ ID NO: 2840873 - DNA, 18 bp, Homo sapiens
tttgcacccatgccatag

SEQ ID NO: 2840874 - DNA, 16 bp, Homo sapiens
tttgcacctttctagt

SEQ ID NO: 2840875 - DNA, 22 bp, Homo sapiens
tttgcactgagggccacactat

SEQ ID NO: 2840876 - DNA, 21 bp, Homo sapiens
tttgcactgttactttttagt

SEQ ID NO: 2840877 - DNA, 19 bp, Homo sapiens
tttgcagaaaagcacctgc

SEQ ID NO: 2840878 - DNA, 20 bp, Homo sapiens
tttgcagaaaagcacctgcc

SEQ ID NO: 2840879 - DNA, 16 bp, Homo sapiens
tttgccagacttaaat

SEQ ID NO: 2840880 - DNA, 20 bp, Homo sapiens
tttgcctaggaggccttctc

SEQ ID NO: 2840881 - DNA, 22 bp, Homo sapiens
tttgcctgtgtgagcatctctg

SEQ ID NO: 2840882 - DNA, 17 bp, Homo sapiens
tttgcgctggtggacca

SEQ ID NO: 2840883 - DNA, 23 bp, Homo sapiens
tttgctattgacaagtcatttta

SEQ ID NO: 2840884 - DNA, 19 bp, Homo sapiens
tttgctgagcatgtactga

SEQ ID NO: 2840885 - DNA, 17 bp, Homo sapiens
tttgcttatttatattc

SEQ ID NO: 2840886 - DNA, 14 bp, Homo sapiens
tttggaaagagacc

SEQ ID NO: 2840887 - DNA, 15 bp, Homo sapiens
tttggaaagagacca

SEQ ID NO: 2840888 - DNA, 14 bp, Homo sapiens
tttggaagttttca

SEQ ID NO: 2840889 - DNA, 11 bp, Homo sapiens
tttggaatgtg

SEQ ID NO: 2840890 - DNA, 15 bp, Homo sapiens
tttggatatgtaaaa

SEQ ID NO: 2840891 - DNA, 23 bp, Homo sapiens
tttggcagcaaagtgtcagtgtt

SEQ ID NO: 2840892 - DNA, 19 bp, Homo sapiens
tttggggagggggaagaga

SEQ ID NO: 2840893 - DNA, 20 bp, Homo sapiens
tttggggcaggagtagctga

SEQ ID NO: 2840894 - DNA, 20 bp, Homo sapiens
tttggtaaaatacttcttga

SEQ ID NO: 2840895 - DNA, 19 bp, Homo sapiens
tttggtgtgtggagatgca

SEQ ID NO: 2840896 - DNA, 21 bp, Homo sapiens
tttgtaaaagaacagtaaaca

SEQ ID NO: 2840897 - DNA, 16 bp, Homo sapiens
tttgtaaactcaaaat

SEQ ID NO: 2840898 - DNA, 14 bp, Homo sapiens
tttgtaatcctgta

SEQ ID NO: 2840899 - DNA, 18 bp, Homo sapiens
tttgtaatcgttatgtgt

SEQ ID NO: 2840900 - DNA, 21 bp, Homo sapiens
tttgtacaattgaacttaaat

SEQ ID NO: 2840901 - DNA, 13 bp, Homo sapiens
tttgtacagaatt

SEQ ID NO: 2840902 - DNA, 21 bp, Homo sapiens
tttgtacagaatttttaatga

SEQ ID NO: 2840903 - DNA, 18 bp, Homo sapiens
tttgtacagtggagaaat

SEQ ID NO: 2840904 - DNA, 17 bp, Homo sapiens
tttgtaccatggtgtga

SEQ ID NO: 2840905 - DNA, 17 bp, Homo sapiens
tttgtagtagttgatga

SEQ ID NO: 2840906 - DNA, 17 bp, Homo sapiens
tttgtatagtaaagtga

SEQ ID NO: 2840907 - DNA, 14 bp, Homo sapiens
tttgtatatcatga

SEQ ID NO: 2840908 - DNA, 10 bp, Homo sapiens
tttgtattta

SEQ ID NO: 2840909 - DNA, 13 bp, Homo sapiens
tttgtattttgct

SEQ ID NO: 2840910 - DNA, 14 bp, Homo sapiens
tttgtcagacttta

SEQ ID NO: 2840911 - DNA, 19 bp, Homo sapiens
tttgtcatatattcatgta

SEQ ID NO: 2840912 - DNA, 20 bp, Homo sapiens
tttgtcatatattcatgtaa

SEQ ID NO: 2840913 - DNA, 23 bp, Homo sapiens
tttgtcattcaagcctgtgaata

SEQ ID NO: 2840914 - DNA, 12 bp, Homo sapiens
tttgtcccaggt

SEQ ID NO: 2840915 - DNA, 15 bp, Homo sapiens
tttgtcccatttcct

SEQ ID NO: 2840916 - DNA, 18 bp, Homo sapiens
tttgtctctgagaacaga

SEQ ID NO: 2840917 - DNA, 12 bp, Homo sapiens
tttgtgtaataa

SEQ ID NO: 2840918 - DNA, 17 bp, Homo sapiens
tttgtgtaataaaaatt

SEQ ID NO: 2840919 - DNA, 12 bp, Homo sapiens
tttgtgtgagag

SEQ ID NO: 2840920 - DNA, 14 bp, Homo sapiens
tttgtgtgagagac

SEQ ID NO: 2840921 - DNA, 17 bp, Homo sapiens
tttgttaaatatttaca

SEQ ID NO: 2840922 - DNA, 18 bp, Homo sapiens
tttgttaaatatttacat

SEQ ID NO: 2840923 - DNA, 22 bp, Homo sapiens
tttgttaaatatttacatatga

SEQ ID NO: 2840924 - DNA, 12 bp, Homo sapiens
tttgttaattta

SEQ ID NO: 2840925 - DNA, 23 bp, Homo sapiens
tttgttaatttagaaaactttaa

SEQ ID NO: 2840926 - DNA, 13 bp, Homo sapiens
tttgttaccttta

SEQ ID NO: 2840927 - DNA, 14 bp, Homo sapiens
tttgttctgtattt

SEQ ID NO: 2840928 - DNA, 14 bp, Homo sapiens
tttgttgctgtttt

SEQ ID NO: 2840929 - DNA, 23 bp, Homo sapiens
tttgttggaaggtttggtgtgtg

SEQ ID NO: 2840930 - DNA, 22 bp, Homo sapiens
tttgttgtgattttgtacagaa

SEQ ID NO: 2840931 - DNA, 13 bp, Homo sapiens
tttgtttaaagtt

SEQ ID NO: 2840932 - DNA, 16 bp, Homo sapiens
tttgtttcttccaaag

SEQ ID NO: 2840933 - DNA, 13 bp, Homo sapiens
tttgtttgtaatc

SEQ ID NO: 2840934 - DNA, 13 bp, Homo sapiens
tttgtttgtgcat

SEQ ID NO: 2840935 - DNA, 14 bp, Homo sapiens
tttgtttttatgaa

SEQ ID NO: 2840936 - DNA, 14 bp, Homo sapiens
tttgtttttgtaaa

SEQ ID NO: 2840937 - DNA, 15 bp, Homo sapiens
ttttaaaaatcataa

SEQ ID NO: 2840938 - DNA, 22 bp, Homo sapiens
ttttaaaaatcataaactgtgt

SEQ ID NO: 2840939 - DNA, 23 bp, Homo sapiens
ttttaaaaatcataaactgtgtg

SEQ ID NO: 2840940 - DNA, 22 bp, Homo sapiens
ttttaaaacacttccataatct

SEQ ID NO: 2840941 - DNA, 19 bp, Homo sapiens
ttttaaacatgagaataaa

SEQ ID NO: 2840942 - DNA, 14 bp, Homo sapiens
ttttaaactagtaa

SEQ ID NO: 2840943 - DNA, 15 bp, Homo sapiens
ttttaaataaaagca

SEQ ID NO: 2840944 - DNA, 17 bp, Homo sapiens
ttttaaatatgaacaaa

SEQ ID NO: 2840945 - DNA, 19 bp, Homo sapiens
ttttaaatatgaacaaaga

SEQ ID NO: 2840946 - DNA, 16 bp, Homo sapiens
ttttaactagaattta

SEQ ID NO: 2840947 - DNA, 22 bp, Homo sapiens
ttttaagataaattataagtta

SEQ ID NO: 2840948 - DNA, 17 bp, Homo sapiens
ttttaagcattcttaga

SEQ ID NO: 2840949 - DNA, 20 bp, Homo sapiens
ttttaagggtttgtggaaaa

SEQ ID NO: 2840950 - DNA, 19 bp, Homo sapiens
ttttaagtatttatatatt

SEQ ID NO: 2840951 - DNA, 19 bp, Homo sapiens
ttttaagtgctttgtaatg

SEQ ID NO: 2840952 - DNA, 16 bp, Homo sapiens
ttttaattattattct

SEQ ID NO: 2840953 - DNA, 20 bp, Homo sapiens
ttttaattattatttatata

SEQ ID NO: 2840954 - DNA, 13 bp, Homo sapiens
ttttaatttgata

SEQ ID NO: 2840955 - DNA, 12 bp, Homo sapiens
ttttacagagaa

SEQ ID NO: 2840956 - DNA, 16 bp, Homo sapiens
ttttacagctgcctgc

SEQ ID NO: 2840957 - DNA, 18 bp, Homo sapiens
ttttacctaccacagtgt

SEQ ID NO: 2840958 - DNA, 15 bp, Homo sapiens
ttttactaaagcagt

SEQ ID NO: 2840959 - DNA, 20 bp, Homo sapiens
ttttactaaagcagtgtttt

SEQ ID NO: 2840960 - DNA, 18 bp, Homo sapiens
ttttactacttgttacct

SEQ ID NO: 2840961 - DNA, 15 bp, Homo sapiens
ttttactccagtggt

SEQ ID NO: 2840962 - DNA, 15 bp, Homo sapiens
ttttactgacagaaa

SEQ ID NO: 2840963 - DNA, 15 bp, Homo sapiens
ttttactgtctgtaa

SEQ ID NO: 2840964 - DNA, 22 bp, Homo sapiens
ttttacttgcattgaatatatt

SEQ ID NO: 2840965 - DNA, 14 bp, Homo sapiens
ttttagaaaacagc

SEQ ID NO: 2840966 - DNA, 21 bp, Homo sapiens
ttttagagattaatttgtgta

SEQ ID NO: 2840967 - DNA, 23 bp, Homo sapiens
ttttagcaaagatatctcatctc

SEQ ID NO: 2840968 - DNA, 21 bp, Homo sapiens
ttttagtcttttactcctttg

SEQ ID NO: 2840969 - DNA, 17 bp, Homo sapiens
ttttagttcctttattt

SEQ ID NO: 2840970 - DNA, 13 bp, Homo sapiens
ttttagttttagt

SEQ ID NO: 2840971 - DNA, 20 bp, Homo sapiens
ttttataactagtcctttac

SEQ ID NO: 2840972 - DNA, 12 bp, Homo sapiens
ttttatacatag

SEQ ID NO: 2840973 - DNA, 13 bp, Homo sapiens
ttttatacatatc

SEQ ID NO: 2840974 - DNA, 18 bp, Homo sapiens
ttttatacatatcagaaa

SEQ ID NO: 2840975 - DNA, 21 bp, Homo sapiens
ttttatacatatcagaaaagt

SEQ ID NO: 2840976 - DNA, 22 bp, Homo sapiens
ttttatatgaaatgtttcacta

SEQ ID NO: 2840977 - DNA, 19 bp, Homo sapiens
ttttatcattttcaaaatg

SEQ ID NO: 2840978 - DNA, 19 bp, Homo sapiens
ttttatgccttttatttct

SEQ ID NO: 2840979 - DNA, 13 bp, Homo sapiens
ttttatttaaaaa

SEQ ID NO: 2840980 - DNA, 17 bp, Homo sapiens
ttttatttccacataaa

SEQ ID NO: 2840981 - DNA, 17 bp, Homo sapiens
ttttcaaccagcatttt

SEQ ID NO: 2840982 - DNA, 20 bp, Homo sapiens
ttttcaagagaagaaaaaat

SEQ ID NO: 2840983 - DNA, 23 bp, Homo sapiens
ttttcacctgtttttaagctgtt

SEQ ID NO: 2840984 - DNA, 18 bp, Homo sapiens
ttttcacttgcttaaaaa

SEQ ID NO: 2840985 - DNA, 15 bp, Homo sapiens
ttttcagaaatatgt

SEQ ID NO: 2840986 - DNA, 11 bp, Homo sapiens
ttttcagaccc

SEQ ID NO: 2840987 - DNA, 14 bp, Homo sapiens
ttttcagactcaga

SEQ ID NO: 2840988 - DNA, 20 bp, Homo sapiens
ttttcagtttcaattcagtg

SEQ ID NO: 2840989 - DNA, 17 bp, Homo sapiens
ttttcattgatatgaaa

SEQ ID NO: 2840990 - DNA, 20 bp, Homo sapiens
ttttcccagatacttcccat

SEQ ID NO: 2840991 - DNA, 23 bp, Homo sapiens
ttttccccggtcccttgagacct

SEQ ID NO: 2840992 - DNA, 19 bp, Homo sapiens
ttttccctctcttgccttt

SEQ ID NO: 2840993 - DNA, 14 bp, Homo sapiens
ttttcctaaatgca

SEQ ID NO: 2840994 - DNA, 13 bp, Homo sapiens
ttttcctccctca

SEQ ID NO: 2840995 - DNA, 17 bp, Homo sapiens
ttttcctttgaatcctc

SEQ ID NO: 2840996 - DNA, 14 bp, Homo sapiens
ttttcgtgcatttg

SEQ ID NO: 2840997 - DNA, 16 bp, Homo sapiens
ttttcgtgcatttgtg

SEQ ID NO: 2840998 - DNA, 12 bp, Homo sapiens
ttttctaactgg

SEQ ID NO: 2840999 - DNA, 19 bp, Homo sapiens
ttttctatttttcttctaa

SEQ ID NO: 2841000 - DNA, 17 bp, Homo sapiens
ttttctccactttgttg

SEQ ID NO: 2841001 - DNA, 19 bp, Homo sapiens
ttttctcctcccaggaact

SEQ ID NO: 2841002 - DNA, 17 bp, Homo sapiens
ttttctggaatacatga

SEQ ID NO: 2841003 - DNA, 21 bp, Homo sapiens
ttttctggaatacatgaaata

SEQ ID NO: 2841004 - DNA, 20 bp, Homo sapiens
ttttcttcccatttgtaatg

SEQ ID NO: 2841005 - DNA, 19 bp, Homo sapiens
ttttctttgtgtagctttg

SEQ ID NO: 2841006 - DNA, 16 bp, Homo sapiens
ttttgaagaagggaaa

SEQ ID NO: 2841007 - DNA, 20 bp, Homo sapiens
ttttgaagaagggaaattca

SEQ ID NO: 2841008 - DNA, 16 bp, Homo sapiens
ttttgaatccatgctt

SEQ ID NO: 2841009 - DNA, 23 bp, Homo sapiens
ttttgacagtgttgaaaatgttc

SEQ ID NO: 2841010 - DNA, 15 bp, Homo sapiens
ttttgacataaagtt

SEQ ID NO: 2841011 - DNA, 13 bp, Homo sapiens
ttttgactgcttg

SEQ ID NO: 2841012 - DNA, 17 bp, Homo sapiens
ttttgacttaaagcaga

SEQ ID NO: 2841013 - DNA, 18 bp, Homo sapiens
ttttgatactaagcattg

SEQ ID NO: 2841014 - DNA, 17 bp, Homo sapiens
ttttgatccaagctggt

SEQ ID NO: 2841015 - DNA, 20 bp, Homo sapiens
ttttgatttgtactgaaaaa

SEQ ID NO: 2841016 - DNA, 21 bp, Homo sapiens
ttttgatttgtactgaaaaat

SEQ ID NO: 2841017 - DNA, 14 bp, Homo sapiens
ttttgcagcagtga

SEQ ID NO: 2841018 - DNA, 17 bp, Homo sapiens
ttttgcataagattaaa

SEQ ID NO: 2841019 - DNA, 22 bp, Homo sapiens
ttttgcattgtgtgagcttcta

SEQ ID NO: 2841020 - DNA, 21 bp, Homo sapiens
ttttgcggttcaggaaaattg

SEQ ID NO: 2841021 - DNA, 19 bp, Homo sapiens
ttttgctggtgtctgagct

SEQ ID NO: 2841022 - DNA, 15 bp, Homo sapiens
ttttgtaaagatgcc

SEQ ID NO: 2841023 - DNA, 13 bp, Homo sapiens
ttttgtaataaac

SEQ ID NO: 2841024 - DNA, 14 bp, Homo sapiens
ttttgtacagaatt

SEQ ID NO: 2841025 - DNA, 22 bp, Homo sapiens
ttttgtacagaatttttaatga

SEQ ID NO: 2841026 - DNA, 13 bp, Homo sapiens
ttttgtgtttcta

SEQ ID NO: 2841027 - DNA, 15 bp, Homo sapiens
ttttgtgtttctaaa

SEQ ID NO: 2841028 - DNA, 17 bp, Homo sapiens
ttttgttaataataaga

SEQ ID NO: 2841029 - DNA, 15 bp, Homo sapiens
ttttgttgattaaaa

SEQ ID NO: 2841030 - DNA, 19 bp, Homo sapiens
ttttgttgattaaaacatt

SEQ ID NO: 2841031 - DNA, 21 bp, Homo sapiens
ttttgttgtttcttaaataag

SEQ ID NO: 2841032 - DNA, 15 bp, Homo sapiens
tttttaaaaaagctt

SEQ ID NO: 2841033 - DNA, 18 bp, Homo sapiens
tttttaaaaagtactctt

SEQ ID NO: 2841034 - DNA, 16 bp, Homo sapiens
tttttaaacaagtatt

SEQ ID NO: 2841035 - DNA, 13 bp, Homo sapiens
tttttaaactagt

SEQ ID NO: 2841036 - DNA, 16 bp, Homo sapiens
tttttaaactagtaat

SEQ ID NO: 2841037 - DNA, 15 bp, Homo sapiens
tttttaatgactttt

SEQ ID NO: 2841038 - DNA, 18 bp, Homo sapiens
tttttaatgtatagtaaa

SEQ ID NO: 2841039 - DNA, 15 bp, Homo sapiens
tttttacaaagccct

SEQ ID NO: 2841040 - DNA, 12 bp, Homo sapiens
tttttactaaag

SEQ ID NO: 2841041 - DNA, 15 bp, Homo sapiens
tttttactaaagcag

SEQ ID NO: 2841042 - DNA, 17 bp, Homo sapiens
tttttactaaagcagtg

SEQ ID NO: 2841043 - DNA, 16 bp, Homo sapiens
tttttactacagttgt

SEQ ID NO: 2841044 - DNA, 20 bp, Homo sapiens
tttttaggaagcaagcttaa

SEQ ID NO: 2841045 - DNA, 17 bp, Homo sapiens
tttttagtcttttactc

SEQ ID NO: 2841046 - DNA, 22 bp, Homo sapiens
tttttataatgtggatttccta

SEQ ID NO: 2841047 - DNA, 13 bp, Homo sapiens
tttttatacatat

SEQ ID NO: 2841048 - DNA, 18 bp, Homo sapiens
tttttatacatatcagaa

SEQ ID NO: 2841049 - DNA, 12 bp, Homo sapiens
tttttatactcc

SEQ ID NO: 2841050 - DNA, 13 bp, Homo sapiens
tttttcaaaaatt

SEQ ID NO: 2841051 - DNA, 21 bp, Homo sapiens
tttttcaaccagcattttact

SEQ ID NO: 2841052 - DNA, 16 bp, Homo sapiens
tttttcaatatttatt

SEQ ID NO: 2841053 - DNA, 22 bp, Homo sapiens
tttttcttctaaaatgctttta

SEQ ID NO: 2841054 - DNA, 23 bp, Homo sapiens
tttttgaaaaagcgaaaaaatca

SEQ ID NO: 2841055 - DNA, 11 bp, Homo sapiens
tttttgaagaa

SEQ ID NO: 2841056 - DNA, 23 bp, Homo sapiens
tttttgaataaaaaacatttgta

SEQ ID NO: 2841057 - DNA, 18 bp, Homo sapiens
tttttggttgtcaatatt

SEQ ID NO: 2841058 - DNA, 14 bp, Homo sapiens
tttttgtgaaattc

SEQ ID NO: 2841059 - DNA, 13 bp, Homo sapiens
tttttgtgtttct

SEQ ID NO: 2841060 - DNA, 15 bp, Homo sapiens
tttttgttttctgat

SEQ ID NO: 2841061 - DNA, 16 bp, Homo sapiens
ttttttatgctaatca

SEQ ID NO: 2841062 - DNA, 13 bp, Homo sapiens
ttttttatttcca

SEQ ID NO: 2841063 - DNA, 20 bp, Homo sapiens
ttggagagtaaaaactgaat

SEQ ID NO: 2841064 - DNA, 11 bp, Homo sapiens
ttggaggacag

SEQ ID NO: 2841065 - DNA, 13 bp, Homo sapiens
ttggaggacagtg

SEQ ID NO: 2841066 - DNA, 16 bp, Homo sapiens
ttggagggtgtcccaa

SEQ ID NO: 2841067 - DNA, 22 bp, Homo sapiens
ttggataatgctgttgcctcat

SEQ ID NO: 2841068 - DNA, 20 bp, Homo sapiens
ttggatatgtaaaacattta

SEQ ID NO: 2841069 - DNA, 20 bp, Homo sapiens
ttggatttacgactgaagaa

SEQ ID NO: 2841070 - DNA, 22 bp, Homo sapiens
ttggcactgagatatttattgt

SEQ ID NO: 2841071 - DNA, 16 bp, Homo sapiens
ttggcccctgtgtgag

SEQ ID NO: 2841072 - DNA, 22 bp, Homo sapiens
ttggctaggacccctccatgtg

SEQ ID NO: 2841073 - DNA, 13 bp, Homo sapiens
ttggctcaatcct

SEQ ID NO: 2841074 - DNA, 14 bp, Homo sapiens
ttggctcaatcctc

SEQ ID NO: 2841075 - DNA, 18 bp, Homo sapiens
ttggctgggggcctcagt

SEQ ID NO: 2841076 - DNA, 21 bp, Homo sapiens
ttggctgggggcctcagtgcc

SEQ ID NO: 2841077 - DNA, 22 bp, Homo sapiens
ttggctttaaccgtttttcaag

SEQ ID NO: 2841078 - DNA, 11 bp, Homo sapiens
ttgggagcact

SEQ ID NO: 2841079 - DNA, 17 bp, Homo sapiens
ttgggagcttgggaatg

SEQ ID NO: 2841080 - DNA, 17 bp, Homo sapiens
ttgggcacccccagcct

SEQ ID NO: 2841081 - DNA, 22 bp, Homo sapiens
ttgggcacccccagcctgggcc

SEQ ID NO: 2841082 - DNA, 20 bp, Homo sapiens
ttgggcctccccccagcccc

SEQ ID NO: 2841083 - DNA, 22 bp, Homo sapiens
ttgggcctccccccagcccctc

SEQ ID NO: 2841084 - DNA, 16 bp, Homo sapiens
ttggggtcagccaggg

SEQ ID NO: 2841085 - DNA, 19 bp, Homo sapiens
ttggtaacatcctttctat

SEQ ID NO: 2841086 - DNA, 22 bp, Homo sapiens
ttggtactactagatgtcttta

SEQ ID NO: 2841087 - DNA, 20 bp, Homo sapiens
ttggtctgacccactgcttt

SEQ ID NO: 2841088 - DNA, 14 bp, Homo sapiens
ttggtgataagtgg

SEQ ID NO: 2841089 - DNA, 20 bp, Homo sapiens
ttggtgataagtggaaaaaa

SEQ ID NO: 2841090 - DNA, 23 bp, Homo sapiens
ttggtgataagtggaaaaaagag

SEQ ID NO: 2841091 - DNA, 13 bp, Homo sapiens
ttggtgcctggcc

SEQ ID NO: 2841092 - DNA, 21 bp, Homo sapiens
ttggtgtggctgtattcagat

SEQ ID NO: 2841093 - DNA, 18 bp, Homo sapiens
ttggttgtcaatattaaa

SEQ ID NO: 2841094 - DNA, 16 bp, Homo sapiens
ttggttttgctacata

SEQ ID NO: 2841095 - DNA, 22 bp, Homo sapiens
ttgtaaaaattaaaagttatgg

SEQ ID NO: 2841096 - DNA, 20 bp, Homo sapiens
ttgtaaatttggatttacga

SEQ ID NO: 2841097 - DNA, 14 bp, Homo sapiens
ttgtaactccacca

SEQ ID NO: 2841098 - DNA, 22 bp, Homo sapiens
ttgtaagacaaaggttttcctc

SEQ ID NO: 2841099 - DNA, 14 bp, Homo sapiens
ttgtaataaactct

SEQ ID NO: 2841100 - DNA, 15 bp, Homo sapiens
ttgtaataaactctc

SEQ ID NO: 2841101 - DNA, 17 bp, Homo sapiens
ttgtaataaactctcta

SEQ ID NO: 2841102 - DNA, 16 bp, Homo sapiens
ttgtaatcctgtatat

SEQ ID NO: 2841103 - DNA, 14 bp, Homo sapiens
ttgtaatgtcacca

SEQ ID NO: 2841104 - DNA, 12 bp, Homo sapiens
ttgtacaaaata

SEQ ID NO: 2841105 - DNA, 14 bp, Homo sapiens
ttgtacaaaataaa

SEQ ID NO: 2841106 - DNA, 18 bp, Homo sapiens
ttgtacaaagatatgcta

SEQ ID NO: 2841107 - DNA, 17 bp, Homo sapiens
ttgtacagtggagaaat

SEQ ID NO: 2841108 - DNA, 16 bp, Homo sapiens
ttgtacatagttattt

SEQ ID NO: 2841109 - DNA, 18 bp, Homo sapiens
ttgtacatatgtaaaata

SEQ ID NO: 2841110 - DNA, 21 bp, Homo sapiens
ttgtagagtggcccagaattg

SEQ ID NO: 2841111 - DNA, 16 bp, Homo sapiens
ttgtagcatttcttga

SEQ ID NO: 2841112 - DNA, 15 bp, Homo sapiens
ttgtatagtaaagtg

SEQ ID NO: 2841113 - DNA, 23 bp, Homo sapiens
ttgtatagttttataaaactcag

SEQ ID NO: 2841114 - DNA, 15 bp, Homo sapiens
ttgtatatacatatt

SEQ ID NO: 2841115 - DNA, 21 bp, Homo sapiens
ttgtatattatggaagatttt

SEQ ID NO: 2841116 - DNA, 14 bp, Homo sapiens
ttgtatctcttttg

SEQ ID NO: 2841117 - DNA, 17 bp, Homo sapiens
ttgtatttttgaataaa

SEQ ID NO: 2841118 - DNA, 14 bp, Homo sapiens
ttgtcaatattaaa

SEQ ID NO: 2841119 - DNA, 19 bp, Homo sapiens
ttgtcaatattaaatacag

SEQ ID NO: 2841120 - DNA, 17 bp, Homo sapiens
ttgtcacacactttggc

SEQ ID NO: 2841121 - DNA, 17 bp, Homo sapiens
ttgtcactagcagctgc

SEQ ID NO: 2841122 - DNA, 20 bp, Homo sapiens
ttgtcactagcagctgcagt

SEQ ID NO: 2841123 - DNA, 23 bp, Homo sapiens
ttgtcatatattcatgtaataaa

SEQ ID NO: 2841124 - DNA, 13 bp, Homo sapiens
ttgtccatgccta

SEQ ID NO: 2841125 - DNA, 17 bp, Homo sapiens
ttgtcccatttccttgg

SEQ ID NO: 2841126 - DNA, 23 bp, Homo sapiens
ttgtcccatttccttggaggcca

SEQ ID NO: 2841127 - DNA, 20 bp, Homo sapiens
ttgtcctttgagaaagaaat

SEQ ID NO: 2841128 - DNA, 13 bp, Homo sapiens
ttgtctcaagatt

SEQ ID NO: 2841129 - DNA, 11 bp, Homo sapiens
ttgtctctgag

SEQ ID NO: 2841130 - DNA, 14 bp, Homo sapiens
ttgtgaaatgatgg

SEQ ID NO: 2841131 - DNA, 19 bp, Homo sapiens
ttgtgaaattcaacctgtg

SEQ ID NO: 2841132 - DNA, 16 bp, Homo sapiens
ttgtgagcactctact

SEQ ID NO: 2841133 - DNA, 23 bp, Homo sapiens
ttgtgaggattatgggtcctgca

SEQ ID NO: 2841134 - DNA, 22 bp, Homo sapiens
ttgtgatgtcccaacttgtaaa

SEQ ID NO: 2841135 - DNA, 15 bp, Homo sapiens
ttgtgattttgtaca

SEQ ID NO: 2841136 - DNA, 18 bp, Homo sapiens
ttgtgcaatgtaaatatt

SEQ ID NO: 2841137 - DNA, 22 bp, Homo sapiens
ttgtgccatagtcacatggcct

SEQ ID NO: 2841138 - DNA, 21 bp, Homo sapiens
ttgtgccatgtcaaacaaata

SEQ ID NO: 2841139 - DNA, 21 bp, Homo sapiens
ttgtggaaaatgaaaattagg

SEQ ID NO: 2841140 - DNA, 15 bp, Homo sapiens
ttgtggaacaaaagt

SEQ ID NO: 2841141 - DNA, 16 bp, Homo sapiens
ttgtggacacagctct

SEQ ID NO: 2841142 - DNA, 17 bp, Homo sapiens
ttgtggacacagctctt

SEQ ID NO: 2841143 - DNA, 13 bp, Homo sapiens
ttgtgggtgggag

SEQ ID NO: 2841144 - DNA, 23 bp, Homo sapiens
ttgtgtaataaaaatttgtttaa

SEQ ID NO: 2841145 - DNA, 21 bp, Homo sapiens
ttgtgtacaaagtagagaagt

SEQ ID NO: 2841146 - DNA, 15 bp, Homo sapiens
ttgtgtacagttatt

SEQ ID NO: 2841147 - DNA, 14 bp, Homo sapiens
ttgtgtagattgtg

SEQ ID NO: 2841148 - DNA, 19 bp, Homo sapiens
ttgtgtctggcagtttata

SEQ ID NO: 2841149 - DNA, 15 bp, Homo sapiens
ttgtgtgttatttaa

SEQ ID NO: 2841150 - DNA, 21 bp, Homo sapiens
ttgtgtgttatttaaatgagt

SEQ ID NO: 2841151 - DNA, 19 bp, Homo sapiens
ttgttaatgaaaatgtcag

SEQ ID NO: 2841152 - DNA, 11 bp, Homo sapiens
ttgttaatgtt

SEQ ID NO: 2841153 - DNA, 21 bp, Homo sapiens
ttgttaatgttgggatttata

SEQ ID NO: 2841154 - DNA, 20 bp, Homo sapiens
ttgttaatttagaaaacttt

SEQ ID NO: 2841155 - DNA, 23 bp, Homo sapiens
ttgttattgggcaagtgattgaa

SEQ ID NO: 2841156 - DNA, 14 bp, Homo sapiens
ttgttatttataac

SEQ ID NO: 2841157 - DNA, 15 bp, Homo sapiens
ttgttctgtattttc

SEQ ID NO: 2841158 - DNA, 19 bp, Homo sapiens
ttgttgcaagtactgctgt

SEQ ID NO: 2841159 - DNA, 21 bp, Homo sapiens
ttgttggaaaagaatacagaa

SEQ ID NO: 2841160 - DNA, 15 bp, Homo sapiens
ttgttgtcaagtata

SEQ ID NO: 2841161 - DNA, 17 bp, Homo sapiens
ttgttgtcaagtataaa

SEQ ID NO: 2841162 - DNA, 21 bp, Homo sapiens
ttgttgttaatgaaaatgtca

SEQ ID NO: 2841163 - DNA, 14 bp, Homo sapiens
ttgtttaattgtag

SEQ ID NO: 2841164 - DNA, 17 bp, Homo sapiens
ttgtttctccccctggg

SEQ ID NO: 2841165 - DNA, 20 bp, Homo sapiens
ttgtttgagcgcagagtaaa

SEQ ID NO: 2841166 - DNA, 20 bp, Homo sapiens
ttgtttggggatgagaaagg

SEQ ID NO: 2841167 - DNA, 17 bp, Homo sapiens
ttgtttggggcaggagt

SEQ ID NO: 2841168 - DNA, 12 bp, Homo sapiens
ttgtttgtaatc

SEQ ID NO: 2841169 - DNA, 18 bp, Homo sapiens
ttgttttcttctgtatgt

SEQ ID NO: 2841170 - DNA, 20 bp, Homo sapiens
ttgttttcttctgtatgtta

SEQ ID NO: 2841171 - DNA, 22 bp, Homo sapiens
tttaaaaaaagtatatattcta

SEQ ID NO: 2841172 - DNA, 14 bp, Homo sapiens
tttaaaaaactaaa

SEQ ID NO: 2841173 - DNA, 21 bp, Homo sapiens
tttaaaaaactaaaaactaga

SEQ ID NO: 2841174 - DNA, 17 bp, Homo sapiens
tttaaaaaagcttaaaa

SEQ ID NO: 2841175 - DNA, 22 bp, Homo sapiens
tttaaaaaataaaaaaatacag

SEQ ID NO: 2841176 - DNA, 21 bp, Homo sapiens
tttaaaaggttgactcaagtt

SEQ ID NO: 2841177 - DNA, 16 bp, Homo sapiens
tttaaaatcattcaat

SEQ ID NO: 2841178 - DNA, 17 bp, Homo sapiens
tttaaaatttatattgt

SEQ ID NO: 2841179 - DNA, 20 bp, Homo sapiens
tttaaaatttatattgtaaa

SEQ ID NO: 2841180 - DNA, 16 bp, Homo sapiens
tttaaaccagcagaaa

SEQ ID NO: 2841181 - DNA, 19 bp, Homo sapiens
tttaaaccagcagaaaagt

SEQ ID NO: 2841182 - DNA, 20 bp, Homo sapiens
tttaaaccgctaaaagaaac

SEQ ID NO: 2841183 - DNA, 15 bp, Homo sapiens
tttaaactagtaatg

SEQ ID NO: 2841184 - DNA, 15 bp, Homo sapiens
tttaaactataagca

SEQ ID NO: 2841185 - DNA, 12 bp, Homo sapiens
tttaaagaattg

SEQ ID NO: 2841186 - DNA, 16 bp, Homo sapiens
tttaaaggggcagaaa

SEQ ID NO: 2841187 - DNA, 22 bp, Homo sapiens
tttaaaggggcagaaaaactct

SEQ ID NO: 2841188 - DNA, 16 bp, Homo sapiens
tttaaatatgaacaaa

SEQ ID NO: 2841189 - DNA, 18 bp, Homo sapiens
tttaaatcaaaagctgct

SEQ ID NO: 2841190 - DNA, 23 bp, Homo sapiens
tttaaatctatctatataatgta

SEQ ID NO: 2841191 - DNA, 20 bp, Homo sapiens
tttaaatctgtttttctaac

SEQ ID NO: 2841192 - DNA, 22 bp, Homo sapiens
tttaaatgacatttttgataaa

SEQ ID NO: 2841193 - DNA, 18 bp, Homo sapiens
gtgtgaaagtcagatgcc

SEQ ID NO: 2841194 - DNA, 13 bp, Homo sapiens
gtgtgaaggtctt

SEQ ID NO: 2841195 - DNA, 14 bp, Homo sapiens
gtgtgaattcccag

SEQ ID NO: 2841196 - DNA, 22 bp, Homo sapiens
gtgtgacaaggattgctactgt

SEQ ID NO: 2841197 - DNA, 17 bp, Homo sapiens
gtgtgatcccaagtgcc

SEQ ID NO: 2841198 - DNA, 18 bp, Homo sapiens
gtgtgcagactgtggctg

SEQ ID NO: 2841199 - DNA, 16 bp, Homo sapiens
gtgtgcctgcagcccc

SEQ ID NO: 2841200 - DNA, 14 bp, Homo sapiens
gtgtggacaggact

SEQ ID NO: 2841201 - DNA, 14 bp, Homo sapiens
gtgtggctgtattc

SEQ ID NO: 2841202 - DNA, 22 bp, Homo sapiens
gctggttcagggttggcccctg

SEQ ID NO: 2841203 - DNA, 14 bp, Homo sapiens
gctggttttcctaa

SEQ ID NO: 2841204 - DNA, 23 bp, Homo sapiens
gctgtatcccatgagcctcagca

SEQ ID NO: 2841205 - DNA, 13 bp, Homo sapiens
gctgtcctaggcc

SEQ ID NO: 2841206 - DNA, 16 bp, Homo sapiens
gctgtcctaggccaca

SEQ ID NO: 2841207 - DNA, 17 bp, Homo sapiens
gctgtcctgctgtgtga

SEQ ID NO: 2841208 - DNA, 16 bp, Homo sapiens
gctgtctctgtccctc

SEQ ID NO: 2841209 - DNA, 14 bp, Homo sapiens
gctgtgacctgctg

SEQ ID NO: 2841210 - DNA, 15 bp, Homo sapiens
gctgtgacctgctga

SEQ ID NO: 2841211 - DNA, 18 bp, Homo sapiens
gctgtgacctgctgagct

SEQ ID NO: 2841212 - DNA, 22 bp, Homo sapiens
gctgtgacctgctgagctctga

SEQ ID NO: 2841213 - DNA, 23 bp, Homo sapiens
gctgtgcctcgctccccactctg

SEQ ID NO: 2841214 - DNA, 15 bp, Homo sapiens
gctgtgctctggaca

SEQ ID NO: 2841215 - DNA, 16 bp, Homo sapiens
gctgtgctctggacag

SEQ ID NO: 2841216 - DNA, 18 bp, Homo sapiens
gctgtgctctggacaggc

SEQ ID NO: 2841217 - DNA, 21 bp, Homo sapiens
gctgtgctctggacaggcatg

SEQ ID NO: 2841218 - DNA, 14 bp, Homo sapiens
gctgtggccagggt

SEQ ID NO: 2841219 - DNA, 16 bp, Homo sapiens
gctgtggccagggtga

SEQ ID NO: 2841220 - DNA, 17 bp, Homo sapiens
gctgtggccagggtgag

SEQ ID NO: 2841221 - DNA, 19 bp, Homo sapiens
gctgtggccagggtgagag

SEQ ID NO: 2841222 - DNA, 21 bp, Homo sapiens
gctgtggccagggtgagagct

SEQ ID NO: 2841223 - DNA, 22 bp, Homo sapiens
gctgtggccagggtgagagctg

SEQ ID NO: 2841224 - DNA, 12 bp, Homo sapiens
gctgtgtagctc

SEQ ID NO: 2841225 - DNA, 21 bp, Homo sapiens
gctgtgtccttgcacctgcat

SEQ ID NO: 2841226 - DNA, 18 bp, Homo sapiens
gctgttatttctattttt

SEQ ID NO: 2841227 - DNA, 20 bp, Homo sapiens
gctgttcacccacagggcta

SEQ ID NO: 2841228 - DNA, 22 bp, Homo sapiens
gctgttccaacagacagggcct

SEQ ID NO: 2841229 - DNA, 15 bp, Homo sapiens
gctgttctggagctg

SEQ ID NO: 2841230 - DNA, 16 bp, Homo sapiens
gctgttgagctgtttt

SEQ ID NO: 2841231 - DNA, 21 bp, Homo sapiens
gctgttgatgaggcctcttgg

SEQ ID NO: 2841232 - DNA, 20 bp, Homo sapiens
gctgttggctgggggcctca

SEQ ID NO: 2841233 - DNA, 22 bp, Homo sapiens
gctgttggctgggggcctcagt

SEQ ID NO: 2841234 - DNA, 13 bp, Homo sapiens
gctgtttccatag

SEQ ID NO: 2841235 - DNA, 21 bp, Homo sapiens
gctgtttgtttgacaaagaaa

SEQ ID NO: 2841236 - DNA, 18 bp, Homo sapiens
gcttaaaactttgaagtt

SEQ ID NO: 2841237 - DNA, 16 bp, Homo sapiens
gcttagacctcagcct

SEQ ID NO: 2841238 - DNA, 17 bp, Homo sapiens
gcttagctgaaacctaa

SEQ ID NO: 2841239 - DNA, 22 bp, Homo sapiens
gcttagtaatagatcacggcat

SEQ ID NO: 2841240 - DNA, 13 bp, Homo sapiens
gcttatcaaaatc

SEQ ID NO: 2841241 - DNA, 17 bp, Homo sapiens
gcttatcaataaacctg

SEQ ID NO: 2841242 - DNA, 18 bp, Homo sapiens
gcttatgacatcacttgt

SEQ ID NO: 2841243 - DNA, 14 bp, Homo sapiens
gcttatggccaggg

SEQ ID NO: 2841244 - DNA, 14 bp, Homo sapiens
gcttatttatattc

SEQ ID NO: 2841245 - DNA, 18 bp, Homo sapiens
gcttattttttaaaataa

SEQ ID NO: 2841246 - DNA, 12 bp, Homo sapiens
gcttcaagtgat

SEQ ID NO: 2841247 - DNA, 15 bp, Homo sapiens
gcttcaattaataaa

SEQ ID NO: 2841248 - DNA, 20 bp, Homo sapiens
gcttcagcctgaggctgaga

SEQ ID NO: 2841249 - DNA, 21 bp, Homo sapiens
gcttcagcctgaggctgagac

SEQ ID NO: 2841250 - DNA, 14 bp, Homo sapiens
gcttcagtggcagc

SEQ ID NO: 2841251 - DNA, 16 bp, Homo sapiens
gcttcagtggcagctg

SEQ ID NO: 2841252 - DNA, 18 bp, Homo sapiens
gcttcagtggcagctgct

SEQ ID NO: 2841253 - DNA, 19 bp, Homo sapiens
gcttcatcaatttttatac

SEQ ID NO: 2841254 - DNA, 12 bp, Homo sapiens
gcttccaatttt

SEQ ID NO: 2841255 - DNA, 21 bp, Homo sapiens
gcttccagagagtcctctgga

SEQ ID NO: 2841256 - DNA, 22 bp, Homo sapiens
gcttccagagagtcctctggat

SEQ ID NO: 2841257 - DNA, 20 bp, Homo sapiens
gcttccaggtatctccagga

SEQ ID NO: 2841258 - DNA, 22 bp, Homo sapiens
gcttccaggtatctccaggatt

SEQ ID NO: 2841259 - DNA, 12 bp, Homo sapiens
gcttccattcca

SEQ ID NO: 2841260 - DNA, 15 bp, Homo sapiens
ttgatatagaaagct

SEQ ID NO: 2841261 - DNA, 21 bp, Homo sapiens
ttgatatatttcattctctta

SEQ ID NO: 2841262 - DNA, 15 bp, Homo sapiens
ttgatgaaggagttt

SEQ ID NO: 2841263 - DNA, 16 bp, Homo sapiens
ttgatgatctttgcag

SEQ ID NO: 2841264 - DNA, 14 bp, Homo sapiens
ttgatggagatatt

SEQ ID NO: 2841265 - DNA, 11 bp, Homo sapiens
ttgatgtacat

SEQ ID NO: 2841266 - DNA, 16 bp, Homo sapiens
ttgatgtacatgtgta

SEQ ID NO: 2841267 - DNA, 16 bp, Homo sapiens
ttgatgtttccagaaa

SEQ ID NO: 2841268 - DNA, 17 bp, Homo sapiens
ttgatgtttccagaaaa

SEQ ID NO: 2841269 - DNA, 23 bp, Homo sapiens
ttgatttattttttaatcattta

SEQ ID NO: 2841270 - DNA, 16 bp, Homo sapiens
ttgcaaaatttccagt

SEQ ID NO: 2841271 - DNA, 21 bp, Homo sapiens
ttgcaaaatttccagtacctt

SEQ ID NO: 2841272 - DNA, 18 bp, Homo sapiens
ttgcaaagttacagatgc

SEQ ID NO: 2841273 - DNA, 12 bp, Homo sapiens
ttgcaaggaagc

SEQ ID NO: 2841274 - DNA, 13 bp, Homo sapiens
ttgcaataaaata

SEQ ID NO: 2841275 - DNA, 15 bp, Homo sapiens
ttgcaataaaatagt

SEQ ID NO: 2841276 - DNA, 17 bp, Homo sapiens
ttgcaatggcagccttg

SEQ ID NO: 2841277 - DNA, 19 bp, Homo sapiens
ttgcaatggcagccttggc

SEQ ID NO: 2841278 - DNA, 14 bp, Homo sapiens
ttgcaattattcta

SEQ ID NO: 2841279 - DNA, 16 bp, Homo sapiens
ttgcaattattctaat

SEQ ID NO: 2841280 - DNA, 21 bp, Homo sapiens
ttgcaattattctaattttat

SEQ ID NO: 2841281 - DNA, 13 bp, Homo sapiens
ttgcacaatttga

SEQ ID NO: 2841282 - DNA, 16 bp, Homo sapiens
ttgcacagctatgaag

SEQ ID NO: 2841283 - DNA, 22 bp, Homo sapiens
ttgcacatgtaacatagattta

SEQ ID NO: 2841284 - DNA, 18 bp, Homo sapiens
ttgcactcagcttttttc

SEQ ID NO: 2841285 - DNA, 14 bp, Homo sapiens
ttgcactccagtct

SEQ ID NO: 2841286 - DNA, 21 bp, Homo sapiens
ttgcactgagggccacactat

SEQ ID NO: 2841287 - DNA, 15 bp, Homo sapiens
ttgcagcagaagcca

SEQ ID NO: 2841288 - DNA, 19 bp, Homo sapiens
ttgcagcagaagccaaatt

SEQ ID NO: 2841289 - DNA, 14 bp, Homo sapiens
ttgcagcagtgagt

SEQ ID NO: 2841290 - DNA, 12 bp, Homo sapiens
ttgcatgtaaaa

SEQ ID NO: 2841291 - DNA, 15 bp, Homo sapiens
ttgcatgtaaaatgc

SEQ ID NO: 2841292 - DNA, 17 bp, Homo sapiens
ttgcatgtaaaatgcag

SEQ ID NO: 2841293 - DNA, 18 bp, Homo sapiens
ttgcatgtaaaatgcagt

SEQ ID NO: 2841294 - DNA, 16 bp, Homo sapiens
ttgcattgtgtgagct

SEQ ID NO: 2841295 - DNA, 15 bp, Homo sapiens
ttgcatttatggtca

SEQ ID NO: 2841296 - DNA, 17 bp, Homo sapiens
ttgccaagctttcttct

SEQ ID NO: 2841297 - DNA, 21 bp, Homo sapiens
ttgccaatgaggtctgaaatg

SEQ ID NO: 2841298 - DNA, 15 bp, Homo sapiens
ttgccactgcctctt

SEQ ID NO: 2841299 - DNA, 15 bp, Homo sapiens
ttaaaggctgtggta

SEQ ID NO: 2841300 - DNA, 12 bp, Homo sapiens
ttaaataaatgt

SEQ ID NO: 2841301 - DNA, 20 bp, Homo sapiens
ttaaataaatgtcattaaaa

SEQ ID NO: 2841302 - DNA, 14 bp, Homo sapiens
ttaaataaattcaa

SEQ ID NO: 2841303 - DNA, 17 bp, Homo sapiens
ttaaataagaaactttt

SEQ ID NO: 2841304 - DNA, 20 bp, Homo sapiens
ttaaatacagacactaagtt

SEQ ID NO: 2841305 - DNA, 20 bp, Homo sapiens
ttaaatagcatctgctcttc

SEQ ID NO: 2841306 - DNA, 15 bp, Homo sapiens
ttaaatatgaacaaa

SEQ ID NO: 2841307 - DNA, 21 bp, Homo sapiens
ttaaatatgttagcaaagagt

SEQ ID NO: 2841308 - DNA, 14 bp, Homo sapiens
ttaaatcaaaagct

SEQ ID NO: 2841309 - DNA, 17 bp, Homo sapiens
ttaaatcaaaagctgct

SEQ ID NO: 2841310 - DNA, 18 bp, Homo sapiens
ttaaatcaaaagctgctt

SEQ ID NO: 2841311 - DNA, 18 bp, Homo sapiens
ttaaatctgtttttctaa

SEQ ID NO: 2841312 - DNA, 15 bp, Homo sapiens
ttaaatgaaagcatg

SEQ ID NO: 2841313 - DNA, 21 bp, Homo sapiens
ttaaattataacttaaaatat

SEQ ID NO: 2841314 - DNA, 17 bp, Homo sapiens
ttaaattttaaggtaga

SEQ ID NO: 2841315 - DNA, 19 bp, Homo sapiens
ttaacaaaacaagaaagaa

SEQ ID NO: 2841316 - DNA, 15 bp, Homo sapiens
ttaacaaaagcaaga

SEQ ID NO: 2841317 - DNA, 16 bp, Homo sapiens
ttaacaattccaaagg

SEQ ID NO: 2841318 - DNA, 17 bp, Homo sapiens
ttaacattaacatctat

SEQ ID NO: 2841319 - DNA, 13 bp, Homo sapiens
ttaaccagaataa

SEQ ID NO: 2841320 - DNA, 17 bp, Homo sapiens
ttaaccgtttttcaaga

SEQ ID NO: 2841321 - DNA, 18 bp, Homo sapiens
ttaaccgtttttcaagaa

SEQ ID NO: 2841322 - DNA, 13 bp, Homo sapiens
ttaactaatttaa

SEQ ID NO: 2841323 - DNA, 16 bp, Homo sapiens
ttaactaatttaaacc

SEQ ID NO: 2841324 - DNA, 17 bp, Homo sapiens
ttaactaatttaaacca

SEQ ID NO: 2841325 - DNA, 14 bp, Homo sapiens
ttaactagaattta

SEQ ID NO: 2841326 - DNA, 16 bp, Homo sapiens
ttaactagaatttatt

SEQ ID NO: 2841327 - DNA, 21 bp, Homo sapiens
ttaactagaatttattcaatt

SEQ ID NO: 2841328 - DNA, 23 bp, Homo sapiens
ttaactcatctgttatcctgcta

SEQ ID NO: 2841329 - DNA, 17 bp, Homo sapiens
ttaactgtgtgaagaaa

SEQ ID NO: 2841330 - DNA, 22 bp, Homo sapiens
ttaacttcagagggaaagtaaa

SEQ ID NO: 2841331 - DNA, 16 bp, Homo sapiens
ttaactttaagactga

SEQ ID NO: 2841332 - DNA, 13 bp, Homo sapiens
ttaagagatacat

SEQ ID NO: 2841333 - DNA, 13 bp, Homo sapiens
ttaagaggcaggg

SEQ ID NO: 2841334 - DNA, 16 bp, Homo sapiens
ttaagagtgaaataat

SEQ ID NO: 2841335 - DNA, 18 bp, Homo sapiens
ttaagcattttactgtct

SEQ ID NO: 2841336 - DNA, 20 bp, Homo sapiens
ttaaggattgtgatattttt

SEQ ID NO: 2841337 - DNA, 15 bp, Homo sapiens
ttaagtatatagtat

SEQ ID NO: 2841338 - DNA, 16 bp, Homo sapiens
ttaagtatttatatat

SEQ ID NO: 2841339 - DNA, 17 bp, Homo sapiens
ttaagtatttatatatt

SEQ ID NO: 2841340 - DNA, 12 bp, Homo sapiens
ttaagtctctga

SEQ ID NO: 2841341 - DNA, 21 bp, Homo sapiens
ttaagtgttgtaaatatttat

SEQ ID NO: 2841342 - DNA, 19 bp, Homo sapiens
ttaagttagagaatatatt

SEQ ID NO: 2841343 - DNA, 18 bp, Homo sapiens
ttaagttgctgatgaact

SEQ ID NO: 2841344 - DNA, 13 bp, Homo sapiens
ttaataaaatgaa

SEQ ID NO: 2841345 - DNA, 21 bp, Homo sapiens
ttaataattatgtgccatttt

SEQ ID NO: 2841346 - DNA, 15 bp, Homo sapiens
ttaatacttaacatt

SEQ ID NO: 2841347 - DNA, 20 bp, Homo sapiens
ttaatagcaaagaattgact

SEQ ID NO: 2841348 - DNA, 22 bp, Homo sapiens
ttaatatctgagaagtgtatat

SEQ ID NO: 2841349 - DNA, 23 bp, Homo sapiens
ttaatatgttaacctcagtgtca

SEQ ID NO: 2841350 - DNA, 17 bp, Homo sapiens
ttaatcaactttcctta

SEQ ID NO: 2841351 - DNA, 22 bp, Homo sapiens
ttaatcttcagttttatcttta

SEQ ID NO: 2841352 - DNA, 17 bp, Homo sapiens
ttaatctttctttacct

SEQ ID NO: 2841353 - DNA, 21 bp, Homo sapiens
ttaatctttctttacctgaga

SEQ ID NO: 2841354 - DNA, 14 bp, Homo sapiens
ttaatgaaaatgtc

SEQ ID NO: 2841355 - DNA, 14 bp, Homo sapiens
ttctgtccaaggca

SEQ ID NO: 2841356 - DNA, 19 bp, Homo sapiens
ttctgtcctactctgtgtc

SEQ ID NO: 2841357 - DNA, 15 bp, Homo sapiens
ttctgttaaaatcag

SEQ ID NO: 2841358 - DNA, 17 bp, Homo sapiens
ttctgttaaaatcagga

SEQ ID NO: 2841359 - DNA, 21 bp, Homo sapiens
ttcttaaaatatatttcagat

SEQ ID NO: 2841360 - DNA, 11 bp, Homo sapiens
ttcttaaataa

SEQ ID NO: 2841361 - DNA, 22 bp, Homo sapiens
ttcttaaggattgtgatatttt

SEQ ID NO: 2841362 - DNA, 19 bp, Homo sapiens
ttcttattctcactccacc

SEQ ID NO: 2841363 - DNA, 18 bp, Homo sapiens
ttcttatttgcaataaaa

SEQ ID NO: 2841364 - DNA, 20 bp, Homo sapiens
ttcttatttgtttggtcact

SEQ ID NO: 2841365 - DNA, 16 bp, Homo sapiens
ttcttattttgtaata

SEQ ID NO: 2841366 - DNA, 20 bp, Homo sapiens
ttcttattttgtaataaact

SEQ ID NO: 2841367 - DNA, 21 bp, Homo sapiens
ttcttcacccagctaatctgt

SEQ ID NO: 2841368 - DNA, 14 bp, Homo sapiens
ttcttcatgcaatg

SEQ ID NO: 2841369 - DNA, 15 bp, Homo sapiens
ttcttcatgcaatga

SEQ ID NO: 2841370 - DNA, 17 bp, Homo sapiens
ttcttcatgcaatgaca

SEQ ID NO: 2841371 - DNA, 20 bp, Homo sapiens
ttcttcattcaatacaagtg

SEQ ID NO: 2841372 - DNA, 14 bp, Homo sapiens
ttcttccatctgat

SEQ ID NO: 2841373 - DNA, 12 bp, Homo sapiens
ttcttcctctgc

SEQ ID NO: 2841374 - DNA, 13 bp, Homo sapiens
ttcttcctctgct

SEQ ID NO: 2841375 - DNA, 18 bp, Homo sapiens
ttcttctaggttctaaaa

SEQ ID NO: 2841376 - DNA, 15 bp, Homo sapiens
ttcttcttcagaaga

SEQ ID NO: 2841377 - DNA, 15 bp, Homo sapiens
ttcttgaaagctgtg

SEQ ID NO: 2841378 - DNA, 19 bp, Homo sapiens
ttcttgcagtcatcagaag

SEQ ID NO: 2841379 - DNA, 14 bp, Homo sapiens
ttcttgccccttgg

SEQ ID NO: 2841380 - DNA, 15 bp, Homo sapiens
ttcttgccccttggg

SEQ ID NO: 2841381 - DNA, 16 bp, Homo sapiens
ttcttggtctcagctt

SEQ ID NO: 2841382 - DNA, 19 bp, Homo sapiens
ttcttgtctgattggctca

SEQ ID NO: 2841383 - DNA, 23 bp, Homo sapiens
ttctttaggtgcctcctgtctta

SEQ ID NO: 2841384 - DNA, 22 bp, Homo sapiens
ttctttcaagtgaatctaaaag

SEQ ID NO: 2841385 - DNA, 22 bp, Homo sapiens
ttctttcctctccaattgtaaa

SEQ ID NO: 2841386 - DNA, 15 bp, Homo sapiens
ttctttcttcctctg

SEQ ID NO: 2841387 - DNA, 17 bp, Homo sapiens
ttctttgtaccatctgt

SEQ ID NO: 2841388 - DNA, 21 bp, Homo sapiens
ttcttttaaaggggcagaaaa

SEQ ID NO: 2841389 - DNA, 22 bp, Homo sapiens
ttcttttgcccttcacagtgtt

SEQ ID NO: 2841390 - DNA, 23 bp, Homo sapiens
ttcttttgcccttcacagtgttt

SEQ ID NO: 2841391 - DNA, 15 bp, Homo sapiens
ttctttttattttct

SEQ ID NO: 2841392 - DNA, 20 bp, Homo sapiens
gcctcaaataaaaagtgctt

SEQ ID NO: 2841393 - DNA, 20 bp, Homo sapiens
gcctcaagtgattctcctgc

SEQ ID NO: 2841394 - DNA, 24 bp, Homo sapiens
gcctcaagtgattctcctgcctca

SEQ ID NO: 2841395 - DNA, 15 bp, Homo sapiens
gcctcacgcccagcc

SEQ ID NO: 2841396 - DNA, 16 bp, Homo sapiens
gcctcacttgaatgtg

SEQ ID NO: 2841397 - DNA, 18 bp, Homo sapiens
gcctcacttgaatgtgtc

SEQ ID NO: 2841398 - DNA, 22 bp, Homo sapiens
gcctcacttttaatgaacaaat

SEQ ID NO: 2841399 - DNA, 16 bp, Homo sapiens
gcctcagaccaactct

SEQ ID NO: 2841400 - DNA, 18 bp, Homo sapiens
gcctcagcatcctggcac

SEQ ID NO: 2841401 - DNA, 14 bp, Homo sapiens
gcctcagctgctcg

SEQ ID NO: 2841402 - DNA, 17 bp, Homo sapiens
gcctcagctgctcgcac

SEQ ID NO: 2841403 - DNA, 12 bp, Homo sapiens
gcctcaggggag

SEQ ID NO: 2841404 - DNA, 17 bp, Homo sapiens
gcctcatccgaggcagg

SEQ ID NO: 2841405 - DNA, 22 bp, Homo sapiens
gcctcatccgaggcagggtcag

SEQ ID NO: 2841406 - DNA, 17 bp, Homo sapiens
gcctccaagctccatct

SEQ ID NO: 2841407 - DNA, 12 bp, Homo sapiens
gcctccaccgct

SEQ ID NO: 2841408 - DNA, 12 bp, Homo sapiens
gcctccaggagc

SEQ ID NO: 2841409 - DNA, 13 bp, Homo sapiens
gcctccaggagcc

SEQ ID NO: 2841410 - DNA, 16 bp, Homo sapiens
gcctcccaaagtgctg

SEQ ID NO: 2841411 - DNA, 17 bp, Homo sapiens
gcctcccaaagtgctgg

SEQ ID NO: 2841412 - DNA, 18 bp, Homo sapiens
gcctcccaaagtgctggg

SEQ ID NO: 2841413 - DNA, 19 bp, Homo sapiens
gcctcccaaagtgctggga

SEQ ID NO: 2841414 - DNA, 17 bp, Homo sapiens
gcctcccaaccccaggg

SEQ ID NO: 2841415 - DNA, 18 bp, Homo sapiens
gcctcccaaccccagggc

SEQ ID NO: 2841416 - DNA, 10 bp, Homo sapiens
gcctcccagc

SEQ ID NO: 2841417 - DNA, 13 bp, Homo sapiens
gcctcccagcctg

SEQ ID NO: 2841418 - DNA, 14 bp, Homo sapiens
gcctcccagcctgg

SEQ ID NO: 2841419 - DNA, 17 bp, Homo sapiens
gcctccccccagcccct

SEQ ID NO: 2841420 - DNA, 20 bp, Homo sapiens
gcctccccccgctggggagc

SEQ ID NO: 2841421 - DNA, 17 bp, Homo sapiens
gcctcccgagtagctgg

SEQ ID NO: 2841422 - DNA, 18 bp, Homo sapiens
gcctcccgagtagctggg

SEQ ID NO: 2841423 - DNA, 21 bp, Homo sapiens
gcctcccgagtagctgggact

SEQ ID NO: 2841424 - DNA, 23 bp, Homo sapiens
gcctcccgagtagctgggactac

SEQ ID NO: 2841425 - DNA, 16 bp, Homo sapiens
gcctccctccacccca

SEQ ID NO: 2841426 - DNA, 18 bp, Homo sapiens
gcctccctccaccccagg

SEQ ID NO: 2841427 - DNA, 20 bp, Homo sapiens
gcctccctccaccccaggac

SEQ ID NO: 2841428 - DNA, 12 bp, Homo sapiens
gcctccctctga

SEQ ID NO: 2841429 - DNA, 20 bp, Homo sapiens
gcctccctctgacctgcagg

SEQ ID NO: 2841430 - DNA, 16 bp, Homo sapiens
gcctccctggtccctt

SEQ ID NO: 2841431 - DNA, 19 bp, Homo sapiens
gcctcctcccaccaccctc

SEQ ID NO: 2841432 - DNA, 13 bp, Homo sapiens
gcctcctgtgtgt

SEQ ID NO: 2841433 - DNA, 13 bp, Homo sapiens
gcctcgcatgcca

SEQ ID NO: 2841434 - DNA, 14 bp, Homo sapiens
gcctcgcatgccag

SEQ ID NO: 2841435 - DNA, 18 bp, Homo sapiens
gcctcgctccccactctg

SEQ ID NO: 2841436 - DNA, 19 bp, Homo sapiens
gcctcgctccccactctgc

SEQ ID NO: 2841437 - DNA, 20 bp, Homo sapiens
gcctcgctccccactctgct

SEQ ID NO: 2841438 - DNA, 23 bp, Homo sapiens
gcctcgctccccactctgctctg

SEQ ID NO: 2841439 - DNA, 15 bp, Homo sapiens
gcctcggtggccatg

SEQ ID NO: 2841440 - DNA, 15 bp, Homo sapiens
gcctctactgggaag

SEQ ID NO: 2841441 - DNA, 13 bp, Homo sapiens
gcctctcccgcac

SEQ ID NO: 2841442 - DNA, 20 bp, Homo sapiens
gcctctcccgcaccaggccg

SEQ ID NO: 2841443 - DNA, 16 bp, Homo sapiens
gcctctccttgcctgg

SEQ ID NO: 2841444 - DNA, 15 bp, Homo sapiens
gcctctgacacacag

SEQ ID NO: 2841445 - DNA, 17 bp, Homo sapiens
gcctctgacacacagct

SEQ ID NO: 2841446 - DNA, 18 bp, Homo sapiens
gcctctgacacacagctc

SEQ ID NO: 2841447 - DNA, 20 bp, Homo sapiens
gcctctgacacacagctctg

SEQ ID NO: 2841448 - DNA, 14 bp, Homo sapiens
gcctctgaggccag

SEQ ID NO: 2841449 - DNA, 20 bp, Homo sapiens
gcctctgaggccagcctggc

SEQ ID NO: 2841450 - DNA, 21 bp, Homo sapiens
gcctctgaggccagcctggcc

SEQ ID NO: 2841451 - DNA, 11 bp, Homo sapiens
gcctctgctgc

SEQ ID NO: 2841452 - DNA, 15 bp, Homo sapiens
gcctctgctgccatg

SEQ ID NO: 2841453 - DNA, 22 bp, Homo sapiens
gcctctgtccctctttgcctgt

SEQ ID NO: 2841454 - DNA, 22 bp, Homo sapiens
gcctcttaaagctgcctgtagt

SEQ ID NO: 2841455 - DNA, 23 bp, Homo sapiens
gcctcttaaagctgcctgtagtt

SEQ ID NO: 2841456 - DNA, 10 bp, Homo sapiens
aaaaaaagag

SEQ ID NO: 2841457 - DNA, 12 bp, Homo sapiens
aaaaaaataata

SEQ ID NO: 2841458 - DNA, 14 bp, Homo sapiens
aaaaaagcaacagt

SEQ ID NO: 2841459 - DNA, 12 bp, Homo sapiens
aaaaaagccttt

SEQ ID NO: 2841460 - DNA, 17 bp, Homo sapiens
aaaaaatacaccacgaa

SEQ ID NO: 2841461 - DNA, 12 bp, Homo sapiens
aaaaaatacagt

SEQ ID NO: 2841462 - DNA, 16 bp, Homo sapiens
aaaaaatttccagtga

SEQ ID NO: 2841463 - DNA, 12 bp, Homo sapiens
aaaaacactagt

SEQ ID NO: 2841464 - DNA, 17 bp, Homo sapiens
aaaaactaaaaactaga

SEQ ID NO: 2841465 - DNA, 12 bp, Homo sapiens
aaaaactgaatg

SEQ ID NO: 2841466 - DNA, 15 bp, Homo sapiens
aaaaacttgtactat

SEQ ID NO: 2841467 - DNA, 16 bp, Homo sapiens
aaaaactttgttatat

SEQ ID NO: 2841468 - DNA, 14 bp, Homo sapiens
aaaaagaagaatct

SEQ ID NO: 2841469 - DNA, 18 bp, Homo sapiens
aaaaagaagcaacctcag

SEQ ID NO: 2841470 - DNA, 13 bp, Homo sapiens
aaaaagattatat

SEQ ID NO: 2841471 - DNA, 14 bp, Homo sapiens
aaaaagcagtcctc

SEQ ID NO: 2841472 - DNA, 16 bp, Homo sapiens
aaaaagcagtcctctt

SEQ ID NO: 2841473 - DNA, 19 bp, Homo sapiens
aaaaagcttaaaactttga

SEQ ID NO: 2841474 - DNA, 14 bp, Homo sapiens
aaaacaaaaataaa

SEQ ID NO: 2841475 - DNA, 13 bp, Homo sapiens
aaaacaagaaaga

SEQ ID NO: 2841476 - DNA, 14 bp, Homo sapiens
aaaacaagaaagaa

SEQ ID NO: 2841477 - DNA, 17 bp, Homo sapiens
aaaacaatgaaggaaaa

SEQ ID NO: 2841478 - DNA, 18 bp, Homo sapiens
aaaacacattgagtttaa

SEQ ID NO: 2841479 - DNA, 18 bp, Homo sapiens
aaaacagcctcacagaag

SEQ ID NO: 2841480 - DNA, 19 bp, Homo sapiens
aaaacatatcaattcaaca

SEQ ID NO: 2841481 - DNA, 23 bp, Homo sapiens
aaaacatatcaattcaacacatt

SEQ ID NO: 2841482 - DNA, 13 bp, Homo sapiens
aaaacatgagaaa

SEQ ID NO: 2841483 - DNA, 14 bp, Homo sapiens
aaaacatggtagaa

SEQ ID NO: 2841484 - DNA, 13 bp, Homo sapiens
aaaacattcatcc

SEQ ID NO: 2841485 - DNA, 14 bp, Homo sapiens
aaaacattcatcca

SEQ ID NO: 2841486 - DNA, 21 bp, Homo sapiens
aaaacattccccaattatctt

SEQ ID NO: 2841487 - DNA, 13 bp, Homo sapiens
aaaacatttattt

SEQ ID NO: 2841488 - DNA, 13 bp, Homo sapiens
aaaacatttgtac

SEQ ID NO: 2841489 - DNA, 21 bp, Homo sapiens
aaaacatttgtacattcctga

SEQ ID NO: 2841490 - DNA, 19 bp, Homo sapiens
aaaaccagaatcataattt

SEQ ID NO: 2841491 - DNA, 13 bp, Homo sapiens
aaaaccagctgct

SEQ ID NO: 2841492 - DNA, 16 bp, Homo sapiens
aaaaccatgcagcttc

SEQ ID NO: 2841493 - DNA, 20 bp, Homo sapiens
aaaaccatgcagcttcatca

SEQ ID NO: 2841494 - DNA, 13 bp, Homo sapiens
aaaacccagagag

SEQ ID NO: 2841495 - DNA, 15 bp, Homo sapiens
aaaacccagagagga

SEQ ID NO: 2841496 - DNA, 20 bp, Homo sapiens
aaaacctcatgacagccaga

SEQ ID NO: 2841497 - DNA, 20 bp, Homo sapiens
aaaacctccagtagtggaca

SEQ ID NO: 2841498 - DNA, 17 bp, Homo sapiens
aaaacgcaaagggctga

SEQ ID NO: 2841499 - DNA, 23 bp, Homo sapiens
aaaactatacttgtactccttaa

SEQ ID NO: 2841500 - DNA, 15 bp, Homo sapiens
aaaactgacagagga

SEQ ID NO: 2841501 - DNA, 12 bp, Homo sapiens
aaaactggaaat

SEQ ID NO: 2841502 - DNA, 17 bp, Homo sapiens
aaaacttgtaaatgctg

SEQ ID NO: 2841503 - DNA, 18 bp, Homo sapiens
aaaagaaaccgtaatttt

SEQ ID NO: 2841504 - DNA, 10 bp, Homo sapiens
aaaagaaagc

SEQ ID NO: 2841505 - DNA, 16 bp, Homo sapiens
aaaagaacagtaaaca

SEQ ID NO: 2841506 - DNA, 12 bp, Homo sapiens
aaaagaagaagt

SEQ ID NO: 2841507 - DNA, 16 bp, Homo sapiens
aaaagaatacagaaag

SEQ ID NO: 2841508 - DNA, 17 bp, Homo sapiens
aaaagaatttaaattct

SEQ ID NO: 2841509 - DNA, 21 bp, Homo sapiens
aaaagacagtggatcatgaaa

SEQ ID NO: 2841510 - DNA, 20 bp, Homo sapiens
aaaagataggtttgagttca

SEQ ID NO: 2841511 - DNA, 15 bp, Homo sapiens
aaaagattatatatc

SEQ ID NO: 2841512 - DNA, 20 bp, Homo sapiens
aaaagattatatatcataaa

SEQ ID NO: 2841513 - DNA, 16 bp, Homo sapiens
aaaagcaaaaaagaaa

SEQ ID NO: 2841514 - DNA, 12 bp, Homo sapiens
aaaagcagtcct

SEQ ID NO: 2841515 - DNA, 11 bp, Homo sapiens
aaaaggcctgg

SEQ ID NO: 2841516 - DNA, 12 bp, Homo sapiens
aaaaggcctggg

SEQ ID NO: 2841517 - DNA, 14 bp, Homo sapiens
aaaaggcctggggt

SEQ ID NO: 2841518 - DNA, 20 bp, Homo sapiens
aaaaggtgcctgtgaggcag

SEQ ID NO: 2841519 - DNA, 20 bp, Homo sapiens
aaaaggtttatgaaaaagaa

SEQ ID NO: 2841520 - DNA, 14 bp, Homo sapiens
aaaagtaattgtag

SEQ ID NO: 2841521 - DNA, 18 bp, Homo sapiens
aaaagtagaattatatct

SEQ ID NO: 2841522 - DNA, 23 bp, Homo sapiens
aaaagtagaattatatctaattt

SEQ ID NO: 2841523 - DNA, 19 bp, Homo sapiens
aaaagtatttttttaagtt

SEQ ID NO: 2841524 - DNA, 15 bp, Homo sapiens
aaaagtcacacagac

SEQ ID NO: 2841525 - DNA, 19 bp, Homo sapiens
aaaagtcacacagacacac

SEQ ID NO: 2841526 - DNA, 19 bp, Homo sapiens
aaaagtcagactgctggga

SEQ ID NO: 2841527 - DNA, 14 bp, Homo sapiens
aaaagtgactctca

SEQ ID NO: 2841528 - DNA, 16 bp, Homo sapiens
aaaagttcgaaagaaa

SEQ ID NO: 2841529 - DNA, 14 bp, Homo sapiens
aaaagttgcacatt

SEQ ID NO: 2841530 - DNA, 17 bp, Homo sapiens
aaaataaaaacataaaa

SEQ ID NO: 2841531 - DNA, 16 bp, Homo sapiens
aaaataaaattatggt

SEQ ID NO: 2841532 - DNA, 12 bp, Homo sapiens
aaaataaataaa

SEQ ID NO: 2841533 - DNA, 22 bp, Homo sapiens
aaaataaatataattgggattt

SEQ ID NO: 2841534 - DNA, 14 bp, Homo sapiens
aaaataagtatttc

SEQ ID NO: 2841535 - DNA, 16 bp, Homo sapiens
aaaataattgatttca

SEQ ID NO: 2841536 - DNA, 22 bp, Homo sapiens
aaaataattgatttcaagacct

SEQ ID NO: 2841537 - DNA, 12 bp, Homo sapiens
aaaataatttaa

SEQ ID NO: 2841538 - DNA, 13 bp, Homo sapiens
aaaataatttaac

SEQ ID NO: 2841539 - DNA, 15 bp, Homo sapiens
aaaataatttaacta

SEQ ID NO: 2841540 - DNA, 20 bp, Homo sapiens
aaaataatttaactaattta

SEQ ID NO: 2841541 - DNA, 22 bp, Homo sapiens
aaaataatttaactaatttaaa

SEQ ID NO: 2841542 - DNA, 20 bp, Homo sapiens
aaaataattttaaacaaagg

SEQ ID NO: 2841543 - DNA, 14 bp, Homo sapiens
aaaatacagtaaag

SEQ ID NO: 2841544 - DNA, 14 bp, Homo sapiens
aaaatagaagaata

SEQ ID NO: 2841545 - DNA, 20 bp, Homo sapiens
aaaatagctaaatacctcaa

SEQ ID NO: 2841546 - DNA, 18 bp, Homo sapiens
aaaataggtatacagtgg

SEQ ID NO: 2841547 - DNA, 19 bp, Homo sapiens
aaaatagtaaatgctttgt

SEQ ID NO: 2841548 - DNA, 14 bp, Homo sapiens
aaagggaaactatt

SEQ ID NO: 2841549 - DNA, 23 bp, Homo sapiens
aaaggtattgagccattttttaa

SEQ ID NO: 2841550 - DNA, 13 bp, Homo sapiens
aaaggtatttaga

SEQ ID NO: 2841551 - DNA, 19 bp, Homo sapiens
aaaggtcattgtggctatc

SEQ ID NO: 2841552 - DNA, 21 bp, Homo sapiens
aaaggtgcctgtgaggcaggg

SEQ ID NO: 2841553 - DNA, 12 bp, Homo sapiens
aaaggttaacag

SEQ ID NO: 2841554 - DNA, 19 bp, Homo sapiens
aaaggtttatgaaaaagaa

SEQ ID NO: 2841555 - DNA, 14 bp, Homo sapiens
aaagtagaattata

SEQ ID NO: 2841556 - DNA, 17 bp, Homo sapiens
aaagtagaattatatct

SEQ ID NO: 2841557 - DNA, 13 bp, Homo sapiens
aaagtagagaagt

SEQ ID NO: 2841558 - DNA, 15 bp, Homo sapiens
aaagtatatatttat

SEQ ID NO: 2841559 - DNA, 15 bp, Homo sapiens
aaagtcacacagaca

SEQ ID NO: 2841560 - DNA, 18 bp, Homo sapiens
aaagtcacacagacacac

SEQ ID NO: 2841561 - DNA, 13 bp, Homo sapiens
aaagtctgagtgg

SEQ ID NO: 2841562 - DNA, 16 bp, Homo sapiens
aaagtgaataaacttc

SEQ ID NO: 2841563 - DNA, 18 bp, Homo sapiens
aaagtgaataaacttcag

SEQ ID NO: 2841564 - DNA, 19 bp, Homo sapiens
aaagtgaataaacttcagc

SEQ ID NO: 2841565 - DNA, 22 bp, Homo sapiens
aaagtgatcagtatgctgtttt

SEQ ID NO: 2841566 - DNA, 16 bp, Homo sapiens
aaagtgcttagaaagt

SEQ ID NO: 2841567 - DNA, 16 bp, Homo sapiens
aaagtgtaaaatagaa

SEQ ID NO: 2841568 - DNA, 17 bp, Homo sapiens
aaagtgtaaaatagaat

SEQ ID NO: 2841569 - DNA, 22 bp, Homo sapiens
aaagtgtgagcagtgagttaca

SEQ ID NO: 2841570 - DNA, 19 bp, Homo sapiens
aaagtgttggctaatgaag

SEQ ID NO: 2841571 - DNA, 14 bp, Homo sapiens
aaagttagctgagc

SEQ ID NO: 2841572 - DNA, 18 bp, Homo sapiens
aaagttaggttataagaa

SEQ ID NO: 2841573 - DNA, 14 bp, Homo sapiens
aaagttcctgttca

SEQ ID NO: 2841574 - DNA, 20 bp, Homo sapiens
aaagttgataaagatttttt

SEQ ID NO: 2841575 - DNA, 23 bp, Homo sapiens
aaagttgataaagattttttaat

SEQ ID NO: 2841576 - DNA, 19 bp, Homo sapiens
aaagttgggaaaagtgtta

SEQ ID NO: 2841577 - DNA, 15 bp, Homo sapiens
aaagtttaaaaaata

SEQ ID NO: 2841578 - DNA, 18 bp, Homo sapiens
aaagtttaaaaaatacac

SEQ ID NO: 2841579 - DNA, 10 bp, Homo sapiens
aaagtttctt

SEQ ID NO: 2841580 - DNA, 23 bp, Homo sapiens
aaataaaaaaatacagtaaagtt

SEQ ID NO: 2841581 - DNA, 14 bp, Homo sapiens
aaataaaaataaat

SEQ ID NO: 2841582 - DNA, 14 bp, Homo sapiens
aaataaaaatattc

SEQ ID NO: 2841583 - DNA, 16 bp, Homo sapiens
aaataaaaatattctc

SEQ ID NO: 2841584 - DNA, 18 bp, Homo sapiens
aaataaaaatattctcca

SEQ ID NO: 2841585 - DNA, 20 bp, Homo sapiens
aaataaaaatattctccatg

SEQ ID NO: 2841586 - DNA, 11 bp, Homo sapiens
aaataaaagca

SEQ ID NO: 2841587 - DNA, 14 bp, Homo sapiens
aaataaaagcctct

SEQ ID NO: 2841588 - DNA, 14 bp, Homo sapiens
aaataaaatgatgt

SEQ ID NO: 2841589 - DNA, 20 bp, Homo sapiens
aaataaagcttgcaacaaaa

SEQ ID NO: 2841590 - DNA, 15 bp, Homo sapiens
aaataaagtatatat

SEQ ID NO: 2841591 - DNA, 20 bp, Homo sapiens
aaataaagtatatatagaat

SEQ ID NO: 2841592 - DNA, 12 bp, Homo sapiens
aaataaatataa

SEQ ID NO: 2841593 - DNA, 15 bp, Homo sapiens
aaataaatataattg

SEQ ID NO: 2841594 - DNA, 18 bp, Homo sapiens
aaataaatataattggga

SEQ ID NO: 2841595 - DNA, 22 bp, Homo sapiens
aaataaattggtgataagtgga

SEQ ID NO: 2841596 - DNA, 17 bp, Homo sapiens
aaataactagtgttgct

SEQ ID NO: 2841597 - DNA, 14 bp, Homo sapiens
aaataagaaacttt

SEQ ID NO: 2841598 - DNA, 21 bp, Homo sapiens
aaataagaaacttttttattt

SEQ ID NO: 2841599 - DNA, 12 bp, Homo sapiens
aaataatgattt

SEQ ID NO: 2841600 - DNA, 22 bp, Homo sapiens
aaataatgatttaagcatttta

SEQ ID NO: 2841601 - DNA, 23 bp, Homo sapiens
aaataatgttctgtcacgtgaaa

SEQ ID NO: 2841602 - DNA, 17 bp, Homo sapiens
aaataattgatttcaag

SEQ ID NO: 2841603 - DNA, 12 bp, Homo sapiens
aaataattttaa

SEQ ID NO: 2841604 - DNA, 13 bp, Homo sapiens
aaatacaaaataa

SEQ ID NO: 2841605 - DNA, 21 bp, Homo sapiens
aaatacaaaataaaattatgg

SEQ ID NO: 2841606 - DNA, 22 bp, Homo sapiens
aaatacaccacctcactcctgt

SEQ ID NO: 2841607 - DNA, 21 bp, Homo sapiens
aaatacaccacgaatttggtg

SEQ ID NO: 2841608 - DNA, 12 bp, Homo sapiens
aaatacatgtgt

SEQ ID NO: 2841609 - DNA, 22 bp, Homo sapiens
aaatacatgtgtggatgtgtaa

SEQ ID NO: 2841610 - DNA, 18 bp, Homo sapiens
aaatactgcctagaaaat

SEQ ID NO: 2841611 - DNA, 16 bp, Homo sapiens
aaatagacagtatatt

SEQ ID NO: 2841612 - DNA, 19 bp, Homo sapiens
aaatagacagtatatttat

SEQ ID NO: 2841613 - DNA, 17 bp, Homo sapiens
aaatagcaaaagaagaa

SEQ ID NO: 2841614 - DNA, 24 bp, Homo sapiens
aaatagctcaggtgtccctgcact

SEQ ID NO: 2841615 - DNA, 20 bp, Homo sapiens
aaatagtttggatatgtaaa

SEQ ID NO: 2841616 - DNA, 21 bp, Homo sapiens
aaatagtttggatatgtaaaa

SEQ ID NO: 2841617 - DNA, 21 bp, Homo sapiens
aaatagttttaaatatgaaca

SEQ ID NO: 2841618 - DNA, 22 bp, Homo sapiens
aaatagttttaaatatgaacaa

SEQ ID NO: 2841619 - DNA, 22 bp, Homo sapiens
aaatataaatgcatgattttat

SEQ ID NO: 2841620 - DNA, 21 bp, Homo sapiens
aaatataattgggattttaaa

SEQ ID NO: 2841621 - DNA, 16 bp, Homo sapiens
aaatatacaaacatgt

SEQ ID NO: 2841622 - DNA, 16 bp, Homo sapiens
aaatatataatggttt

SEQ ID NO: 2841623 - DNA, 18 bp, Homo sapiens
aaatatatataaatatat

SEQ ID NO: 2841624 - DNA, 19 bp, Homo sapiens
aaatatatataaatatata

SEQ ID NO: 2841625 - DNA, 22 bp, Homo sapiens
aaatatatatctatctatttga

SEQ ID NO: 2841626 - DNA, 16 bp, Homo sapiens
aaatatatatttttca

SEQ ID NO: 2841627 - DNA, 20 bp, Homo sapiens
aaatatatttaagataatta

SEQ ID NO: 2841628 - DNA, 15 bp, Homo sapiens
aaatatattttatga

SEQ ID NO: 2841629 - DNA, 15 bp, Homo sapiens
aaatatgaacaaaga

SEQ ID NO: 2841630 - DNA, 21 bp, Homo sapiens
aaatatgatgttaaaaaaata

SEQ ID NO: 2841631 - DNA, 20 bp, Homo sapiens
aaatattcctgcatttgtga

SEQ ID NO: 2841632 - DNA, 12 bp, Homo sapiens
aaatatttaagt

SEQ ID NO: 2841633 - DNA, 16 bp, Homo sapiens
aaatatttgcttattt

SEQ ID NO: 2841634 - DNA, 16 bp, Homo sapiens
aaatattttaaagaat

SEQ ID NO: 2841635 - DNA, 23 bp, Homo sapiens
aaatattttaaagaattgtgtca

SEQ ID NO: 2841636 - DNA, 13 bp, Homo sapiens
aaatcaaaagctg

SEQ ID NO: 2841637 - DNA, 18 bp, Homo sapiens
aaatcaaaagctgcttga

SEQ ID NO: 2841638 - DNA, 15 bp, Homo sapiens
aaaatataaatgcat

SEQ ID NO: 2841639 - DNA, 16 bp, Homo sapiens
aaaatatatataaata

SEQ ID NO: 2841640 - DNA, 22 bp, Homo sapiens
aaaatatatataaatatatatt

SEQ ID NO: 2841641 - DNA, 20 bp, Homo sapiens
aaaatatattttatgattta

SEQ ID NO: 2841642 - DNA, 13 bp, Homo sapiens
aaaatattttata

SEQ ID NO: 2841643 - DNA, 17 bp, Homo sapiens
aaaatcacaagcaataa

SEQ ID NO: 2841644 - DNA, 19 bp, Homo sapiens
aaaatcacaagcaataatt

SEQ ID NO: 2841645 - DNA, 23 bp, Homo sapiens
aaaatcacaagcaataattagga

SEQ ID NO: 2841646 - DNA, 15 bp, Homo sapiens
aaaatcactatcttt

SEQ ID NO: 2841647 - DNA, 19 bp, Homo sapiens
aaaatcactatctttctga

SEQ ID NO: 2841648 - DNA, 11 bp, Homo sapiens
aaaatcaggat

SEQ ID NO: 2841649 - DNA, 13 bp, Homo sapiens
aaaatcataaact

SEQ ID NO: 2841650 - DNA, 18 bp, Homo sapiens
aaaatcatgaatatttca

SEQ ID NO: 2841651 - DNA, 12 bp, Homo sapiens
aaaatcatgaga

SEQ ID NO: 2841652 - DNA, 17 bp, Homo sapiens
aaaatcatgtacatttc

SEQ ID NO: 2841653 - DNA, 18 bp, Homo sapiens
aaaatcatgtacatttct

SEQ ID NO: 2841654 - DNA, 19 bp, Homo sapiens
aatggtttactgctgtcat

SEQ ID NO: 2841655 - DNA, 19 bp, Homo sapiens
aatggtttgcaaggaagcc

SEQ ID NO: 2841656 - DNA, 16 bp, Homo sapiens
aatgtaaatattttaa

SEQ ID NO: 2841657 - DNA, 19 bp, Homo sapiens
aatgtaaatattttaaaga

SEQ ID NO: 2841658 - DNA, 21 bp, Homo sapiens
aatgtaaatattttaaagaat

SEQ ID NO: 2841659 - DNA, 15 bp, Homo sapiens
aatgtaagaaaattt

SEQ ID NO: 2841660 - DNA, 19 bp, Homo sapiens
aatgtaatcaatgtttctt

SEQ ID NO: 2841661 - DNA, 18 bp, Homo sapiens
aatgtacccaccgggcca

SEQ ID NO: 2841662 - DNA, 16 bp, Homo sapiens
aatgtatcttatttat

SEQ ID NO: 2841663 - DNA, 15 bp, Homo sapiens
aatgtatgtgaaagt

SEQ ID NO: 2841664 - DNA, 14 bp, Homo sapiens
aatgtcacaggcag

SEQ ID NO: 2841665 - DNA, 15 bp, Homo sapiens
aatgtcaccaccttc

SEQ ID NO: 2841666 - DNA, 18 bp, Homo sapiens
aatgtcaccaccttccca

SEQ ID NO: 2841667 - DNA, 19 bp, Homo sapiens
aatgtcaccaccttcccag

SEQ ID NO: 2841668 - DNA, 23 bp, Homo sapiens
aatgtcaccaccttcccagctct

SEQ ID NO: 2841669 - DNA, 17 bp, Homo sapiens
aatgtcacttaaaggct

SEQ ID NO: 2841670 - DNA, 18 bp, Homo sapiens
aatgtcaggaacagaagg

SEQ ID NO: 2841671 - DNA, 19 bp, Homo sapiens
aatgtcattttggtacttt

SEQ ID NO: 2841672 - DNA, 22 bp, Homo sapiens
aatgtctttgttggaaaagaat

SEQ ID NO: 2841673 - DNA, 20 bp, Homo sapiens
aatgtgatttacgctcattg

SEQ ID NO: 2841674 - DNA, 20 bp, Homo sapiens
aatgtggcctaaaaatgcaa

SEQ ID NO: 2841675 - DNA, 14 bp, Homo sapiens
aatgtggctcctgg

SEQ ID NO: 2841676 - DNA, 16 bp, Homo sapiens
aatgtggtagcctcac

SEQ ID NO: 2841677 - DNA, 12 bp, Homo sapiens
aatgtgtaaatg

SEQ ID NO: 2841678 - DNA, 22 bp, Homo sapiens
aatgtgttgatttgagaaattt

SEQ ID NO: 2841679 - DNA, 19 bp, Homo sapiens
aatgttaaaatattgattt

SEQ ID NO: 2841680 - DNA, 14 bp, Homo sapiens
aatgttaaagtcag

SEQ ID NO: 2841681 - DNA, 19 bp, Homo sapiens
aatgttaagacttgacagt

SEQ ID NO: 2841682 - DNA, 15 bp, Homo sapiens
aatgttacattatta

SEQ ID NO: 2841683 - DNA, 19 bp, Homo sapiens
aatgttattttttaattat

SEQ ID NO: 2841684 - DNA, 21 bp, Homo sapiens
aatgttattttttaattatta

SEQ ID NO: 2841685 - DNA, 12 bp, Homo sapiens
aatgttctctgg

SEQ ID NO: 2841686 - DNA, 21 bp, Homo sapiens
aatgttctgaataatttctta

SEQ ID NO: 2841687 - DNA, 15 bp, Homo sapiens
aatgttgaaatatga

SEQ ID NO: 2841688 - DNA, 13 bp, Homo sapiens
aatgttggaattt

SEQ ID NO: 2841689 - DNA, 17 bp, Homo sapiens
aatgttgggatttatat

SEQ ID NO: 2841690 - DNA, 20 bp, Homo sapiens
aatgttgggatttatatcta

SEQ ID NO: 2841691 - DNA, 21 bp, Homo sapiens
aatgttgggatttatatctat

SEQ ID NO: 2841692 - DNA, 22 bp, Homo sapiens
aatgtttatgcaaggaaggaaa

SEQ ID NO: 2841693 - DNA, 20 bp, Homo sapiens
aatgtttcactatgattttc

SEQ ID NO: 2841694 - DNA, 16 bp, Homo sapiens
aatgtttgcctctgcc

SEQ ID NO: 2841695 - DNA, 19 bp, Homo sapiens
aatgtttgcctctgcctct

SEQ ID NO: 2841696 - DNA, 17 bp, Homo sapiens
aattaaaaaatttccag

SEQ ID NO: 2841697 - DNA, 14 bp, Homo sapiens
aattaaaaaccact

SEQ ID NO: 2841698 - DNA, 13 bp, Homo sapiens
aattaaaatatat

SEQ ID NO: 2841699 - DNA, 15 bp, Homo sapiens
aattaaaatatatat

SEQ ID NO: 2841700 - DNA, 16 bp, Homo sapiens
aattaaaatatatata

SEQ ID NO: 2841701 - DNA, 22 bp, Homo sapiens
aattaaaatatatataaatata

SEQ ID NO: 2841702 - DNA, 12 bp, Homo sapiens
aattaacactgc

SEQ ID NO: 2841703 - DNA, 21 bp, Homo sapiens
aattaactgggtaatgaaaca

SEQ ID NO: 2841704 - DNA, 16 bp, Homo sapiens
aattaaggcataagaa

SEQ ID NO: 2841705 - DNA, 23 bp, Homo sapiens
aattaataaaaaatggaaagaat

SEQ ID NO: 2841706 - DNA, 20 bp, Homo sapiens
aattaataaacgaagataaa

SEQ ID NO: 2841707 - DNA, 20 bp, Homo sapiens
aattaatatgttcattaaat

SEQ ID NO: 2841708 - DNA, 21 bp, Homo sapiens
aattaccttgagccagtaatt

SEQ ID NO: 2841709 - DNA, 15 bp, Homo sapiens
aattactacaaaatt

SEQ ID NO: 2841710 - DNA, 11 bp, Homo sapiens
aattacttctc

SEQ ID NO: 2841711 - DNA, 18 bp, Homo sapiens
aattagaaattggctgga

SEQ ID NO: 2841712 - DNA, 14 bp, Homo sapiens
aattagaacaatag

SEQ ID NO: 2841713 - DNA, 16 bp, Homo sapiens
aattaggatctatgca

SEQ ID NO: 2841714 - DNA, 20 bp, Homo sapiens
aattaggatctatgcaattt

SEQ ID NO: 2841715 - DNA, 15 bp, Homo sapiens
aattagtgaagttct

SEQ ID NO: 2841716 - DNA, 17 bp, Homo sapiens
aattataacttaaaata

SEQ ID NO: 2841717 - DNA, 13 bp, Homo sapiens
aattatatctaat

SEQ ID NO: 2841718 - DNA, 15 bp, Homo sapiens
aattatatctaattt

SEQ ID NO: 2841719 - DNA, 16 bp, Homo sapiens
aattatatctaattta

SEQ ID NO: 2841720 - DNA, 17 bp, Homo sapiens
aattatatctaatttat

SEQ ID NO: 2841721 - DNA, 19 bp, Homo sapiens
aattatatctaatttatac

SEQ ID NO: 2841722 - DNA, 22 bp, Homo sapiens
aattatatctaatttatacaaa

SEQ ID NO: 2841723 - DNA, 15 bp, Homo sapiens
aattatccagagttt

SEQ ID NO: 2841724 - DNA, 12 bp, Homo sapiens
aattatgacagt

SEQ ID NO: 2841725 - DNA, 15 bp, Homo sapiens
aattatgacagttat

SEQ ID NO: 2841726 - DNA, 12 bp, Homo sapiens
aattatgtgaca

SEQ ID NO: 2841727 - DNA, 20 bp, Homo sapiens
aattatgtgacaacctttgt

SEQ ID NO: 2841728 - DNA, 21 bp, Homo sapiens
aattatgtgacaacctttgtg

SEQ ID NO: 2841729 - DNA, 22 bp, Homo sapiens
aattatgtgacaacctttgtgt

SEQ ID NO: 2841730 - DNA, 23 bp, Homo sapiens
aattatgtgacaacctttgtgta

SEQ ID NO: 2841731 - DNA, 13 bp, Homo sapiens
aattattatttat

SEQ ID NO: 2841732 - DNA, 21 bp, Homo sapiens
aattattatttatatatgtat

SEQ ID NO: 2841733 - DNA, 18 bp, Homo sapiens
aattattctaattttata

SEQ ID NO: 2841734 - DNA, 15 bp, Homo sapiens
aattcaaaccattta

SEQ ID NO: 2841735 - DNA, 22 bp, Homo sapiens
aattcaaagctgtgtgtttgga

SEQ ID NO: 2841736 - DNA, 19 bp, Homo sapiens
aattcacttcattgaccaa

SEQ ID NO: 2841737 - DNA, 14 bp, Homo sapiens
aattcataattaga

SEQ ID NO: 2841738 - DNA, 15 bp, Homo sapiens
aattcataattagaa

SEQ ID NO: 2841739 - DNA, 18 bp, Homo sapiens
aattcataattagaacaa

SEQ ID NO: 2841740 - DNA, 15 bp, Homo sapiens
aattcatttcacttt

SEQ ID NO: 2841741 - DNA, 19 bp, Homo sapiens
aattcatttcactttaaag

SEQ ID NO: 2841742 - DNA, 23 bp, Homo sapiens
aattccaaggagttccatgaaga

SEQ ID NO: 2841743 - DNA, 14 bp, Homo sapiens
aattccactggact

SEQ ID NO: 2841744 - DNA, 13 bp, Homo sapiens
aatacttcatgat

SEQ ID NO: 2841745 - DNA, 13 bp, Homo sapiens
aatagaaactcac

SEQ ID NO: 2841746 - DNA, 21 bp, Homo sapiens
aatagaaactcaccatgtaaa

SEQ ID NO: 2841747 - DNA, 17 bp, Homo sapiens
aatagaatataattatc

SEQ ID NO: 2841748 - DNA, 16 bp, Homo sapiens
aatctgcattattgga

SEQ ID NO: 2841749 - DNA, 17 bp, Homo sapiens
aatctgcattattggaa

SEQ ID NO: 2841750 - DNA, 16 bp, Homo sapiens
aatctggactcctctg

SEQ ID NO: 2841751 - DNA, 18 bp, Homo sapiens
aatctggactcctctgtc

SEQ ID NO: 2841752 - DNA, 17 bp, Homo sapiens
aatctgtttgatccctg

SEQ ID NO: 2841753 - DNA, 15 bp, Homo sapiens
aatctgtttttctaa

SEQ ID NO: 2841754 - DNA, 15 bp, Homo sapiens
aatcttatattccat

SEQ ID NO: 2841755 - DNA, 15 bp, Homo sapiens
aatcttccttgtgag

SEQ ID NO: 2841756 - DNA, 13 bp, Homo sapiens
aatcttgaaaatg

SEQ ID NO: 2841757 - DNA, 19 bp, Homo sapiens
aatcttggggggtttttac

SEQ ID NO: 2841758 - DNA, 15 bp, Homo sapiens
aatcttgttaaattg

SEQ ID NO: 2841759 - DNA, 15 bp, Homo sapiens
aatctttctttacct

SEQ ID NO: 2841760 - DNA, 19 bp, Homo sapiens
aatctttctttacctgaga

SEQ ID NO: 2841761 - DNA, 16 bp, Homo sapiens
aatcttttataggatt

SEQ ID NO: 2841762 - DNA, 14 bp, Homo sapiens
aatgaaaatgtcag

SEQ ID NO: 2841763 - DNA, 20 bp, Homo sapiens
aatgaaaatgtcagaaacca

SEQ ID NO: 2841764 - DNA, 19 bp, Homo sapiens
aatgaaacaaataatcaca

SEQ ID NO: 2841765 - DNA, 15 bp, Homo sapiens
aatgaaagtttgcac

SEQ ID NO: 2841766 - DNA, 21 bp, Homo sapiens
aatgaaatatttgcttattta

SEQ ID NO: 2841767 - DNA, 23 bp, Homo sapiens
aatgaaattactacaaaatttga

SEQ ID NO: 2841768 - DNA, 12 bp, Homo sapiens
aatgaacaaatg

SEQ ID NO: 2841769 - DNA, 16 bp, Homo sapiens
aatgaaccacatcttg

SEQ ID NO: 2841770 - DNA, 16 bp, Homo sapiens
aatgaactgtgacagg

SEQ ID NO: 2841771 - DNA, 21 bp, Homo sapiens
aatgaagacccagtgtaaaga

SEQ ID NO: 2841772 - DNA, 15 bp, Homo sapiens
aatgaagcatgtagc

SEQ ID NO: 2841773 - DNA, 14 bp, Homo sapiens
aatgaatatctgct

SEQ ID NO: 2841774 - DNA, 14 bp, Homo sapiens
aatgaatttatctg

SEQ ID NO: 2841775 - DNA, 19 bp, Homo sapiens
aatgaatttatctgaatat

SEQ ID NO: 2841776 - DNA, 20 bp, Homo sapiens
aatgaatttatctgaatata

SEQ ID NO: 2841777 - DNA, 14 bp, Homo sapiens
aatgagcattagct

SEQ ID NO: 2841778 - DNA, 14 bp, Homo sapiens
aatgagcctgtaat

SEQ ID NO: 2841779 - DNA, 21 bp, Homo sapiens
aatgagctggtttgtcaaaca

SEQ ID NO: 2841780 - DNA, 15 bp, Homo sapiens
aatgaggtcccaggc

SEQ ID NO: 2841781 - DNA, 20 bp, Homo sapiens
aatgatgattaaacacctga

SEQ ID NO: 2841782 - DNA, 15 bp, Homo sapiens
aatgatgtatgattt

SEQ ID NO: 2841783 - DNA, 13 bp, Homo sapiens
aatgattcataac

SEQ ID NO: 2841784 - DNA, 18 bp, Homo sapiens
aatgattgtttaattgta

SEQ ID NO: 2841785 - DNA, 13 bp, Homo sapiens
aatgatttcatgc

SEQ ID NO: 2841786 - DNA, 18 bp, Homo sapiens
aatgatttccaaagagaa

SEQ ID NO: 2841787 - DNA, 12 bp, Homo sapiens
aatgcaaaatga

SEQ ID NO: 2841788 - DNA, 15 bp, Homo sapiens
aatgcaacaacatgt

SEQ ID NO: 2841789 - DNA, 21 bp, Homo sapiens
aatgcaagattttccacaaga

SEQ ID NO: 2841790 - DNA, 10 bp, Homo sapiens
aatgcacaat

SEQ ID NO: 2841791 - DNA, 15 bp, Homo sapiens
aatgcacaatttaga

SEQ ID NO: 2841792 - DNA, 19 bp, Homo sapiens
aatgcacaatttagaaaac

SEQ ID NO: 2841793 - DNA, 22 bp, Homo sapiens
aatgcagaattttttgagtaat

SEQ ID NO: 2841794 - DNA, 16 bp, Homo sapiens
aatgcagtccagaata

SEQ ID NO: 2841795 - DNA, 21 bp, Homo sapiens
aatgcatcatcatagaaaaac

SEQ ID NO: 2841796 - DNA, 14 bp, Homo sapiens
aatgcatgatttta

SEQ ID NO: 2841797 - DNA, 16 bp, Homo sapiens
aatgcatgattttata

SEQ ID NO: 2841798 - DNA, 20 bp, Homo sapiens
aatgcatgattttatacata

SEQ ID NO: 2841799 - DNA, 22 bp, Homo sapiens
aatgcatgattttatacatagt

SEQ ID NO: 2841800 - DNA, 18 bp, Homo sapiens
aatgcatgttaggaaaat

SEQ ID NO: 2841801 - DNA, 23 bp, Homo sapiens
aatgccaacttgtccttttgtac

SEQ ID NO: 2841802 - DNA, 16 bp, Homo sapiens
aatgcctaataaacaa

SEQ ID NO: 2841803 - DNA, 12 bp, Homo sapiens
aatgcctcctcc

SEQ ID NO: 2841804 - DNA, 14 bp, Homo sapiens
aatgcctcctccct

SEQ ID NO: 2841805 - DNA, 12 bp, Homo sapiens
aatgctaaatgc

SEQ ID NO: 2841806 - DNA, 14 bp, Homo sapiens
aatgctaaatgcaa

SEQ ID NO: 2841807 - DNA, 13 bp, Homo sapiens
aatgctctccttt

SEQ ID NO: 2841808 - DNA, 14 bp, Homo sapiens
aatgctctcctttc

SEQ ID NO: 2841809 - DNA, 22 bp, Homo sapiens
aatgctggctgttggctggggg

SEQ ID NO: 2841810 - DNA, 15 bp, Homo sapiens
aatgctggttttcct

SEQ ID NO: 2841811 - DNA, 19 bp, Homo sapiens
aatgctggttttcctaaat

SEQ ID NO: 2841812 - DNA, 16 bp, Homo sapiens
aatgctgttgcctcat

SEQ ID NO: 2841813 - DNA, 22 bp, Homo sapiens
aatgcttaatcagatagatatt

SEQ ID NO: 2841814 - DNA, 12 bp, Homo sapiens
aatgctttgata

SEQ ID NO: 2841815 - DNA, 18 bp, Homo sapiens
aatgctttgatatttcaa

SEQ ID NO: 2841816 - DNA, 23 bp, Homo sapiens
aatgcttttctagcaactgttgg

SEQ ID NO: 2841817 - DNA, 18 bp, Homo sapiens
aatggaaggtttgtatat

SEQ ID NO: 2841818 - DNA, 19 bp, Homo sapiens
aatggaatcagcttttaat

SEQ ID NO: 2841819 - DNA, 16 bp, Homo sapiens
aatggagcttgtacat

SEQ ID NO: 2841820 - DNA, 19 bp, Homo sapiens
aatggcacagcccaaagaa

SEQ ID NO: 2841821 - DNA, 20 bp, Homo sapiens
aatggcacagcccaaagaag

SEQ ID NO: 2841822 - DNA, 12 bp, Homo sapiens
aatggcagcctt

SEQ ID NO: 2841823 - DNA, 17 bp, Homo sapiens
aatggccatttgctttt

SEQ ID NO: 2841824 - DNA, 14 bp, Homo sapiens
aatggcctgccttg

SEQ ID NO: 2841825 - DNA, 19 bp, Homo sapiens
aatggctctgtgaaatcag

SEQ ID NO: 2841826 - DNA, 21 bp, Homo sapiens
aatggctctgtgaaatcagaa

SEQ ID NO: 2841827 - DNA, 15 bp, Homo sapiens
aatggctgataattt

SEQ ID NO: 2841828 - DNA, 18 bp, Homo sapiens
aatgggccaattaaaata

SEQ ID NO: 2841829 - DNA, 12 bp, Homo sapiens
aatgggtaatat

SEQ ID NO: 2841830 - DNA, 16 bp, Homo sapiens
aatggtcgcccaggag

SEQ ID NO: 2841831 - DNA, 15 bp, Homo sapiens
aatggtggtttgtca

SEQ ID NO: 2841832 - DNA, 21 bp, Homo sapiens
aatggtggtttgtcatatatt

SEQ ID NO: 2841833 - DNA, 19 bp, Homo sapiens
aatggttccatgcctgagg

SEQ ID NO: 2841834 - DNA, 21 bp, Homo sapiens
aatggttccatgcctgagggt

SEQ ID NO: 2841835 - DNA, 15 bp, Homo sapiens
aatggtttactgctg

SEQ ID NO: 2841836 - DNA, 17 bp, Homo sapiens
aatggtttactgctgtc

SEQ ID NO: 2841837 - DNA, 22 bp, Homo sapiens
aagttaaaagtgttgattacat

SEQ ID NO: 2841838 - DNA, 12 bp, Homo sapiens
aagttaatttaa

SEQ ID NO: 2841839 - DNA, 16 bp, Homo sapiens
aagttacatgtttgca

SEQ ID NO: 2841840 - DNA, 15 bp, Homo sapiens
aagttacttattcta

SEQ ID NO: 2841841 - DNA, 16 bp, Homo sapiens
aaggctggctgggcat

SEQ ID NO: 2841842 - DNA, 14 bp, Homo sapiens
aagggccagtctgg

SEQ ID NO: 2841843 - DNA, 16 bp, Homo sapiens
aagggccatgctgaag

SEQ ID NO: 2841844 - DNA, 17 bp, Homo sapiens
aagggccatgctgaagg

SEQ ID NO: 2841845 - DNA, 17 bp, Homo sapiens
aagggctgccgggccag

SEQ ID NO: 2841846 - DNA, 20 bp, Homo sapiens
aaatcaaaagctgcttgact

SEQ ID NO: 2841847 - DNA, 16 bp, Homo sapiens
aaatcacaagcaataa

SEQ ID NO: 2841848 - DNA, 18 bp, Homo sapiens
aaatcactatctttctga

SEQ ID NO: 2841849 - DNA, 21 bp, Homo sapiens
aaatcactgaggcatttttac

SEQ ID NO: 2841850 - DNA, 15 bp, Homo sapiens
aaatcagaagtgcaa

SEQ ID NO: 2841851 - DNA, 17 bp, Homo sapiens
aaatcagaagtgcaaag

SEQ ID NO: 2841852 - DNA, 17 bp, Homo sapiens
aaatcaggattttagtg

SEQ ID NO: 2841853 - DNA, 11 bp, Homo sapiens
aaatcagttgt

SEQ ID NO: 2841854 - DNA, 23 bp, Homo sapiens
aaatcataaactgtgtgcagact

SEQ ID NO: 2841855 - DNA, 14 bp, Homo sapiens
aaatcattttgcaa

SEQ ID NO: 2841856 - DNA, 12 bp, Homo sapiens
aaatccaaagaa

SEQ ID NO: 2841857 - DNA, 15 bp, Homo sapiens
aaatccagaaagaaa

SEQ ID NO: 2841858 - DNA, 23 bp, Homo sapiens
aagcatatgcctacttgtaattt

SEQ ID NO: 2841859 - DNA, 15 bp, Homo sapiens
aagcatggctatttt

SEQ ID NO: 2841860 - DNA, 22 bp, Homo sapiens
aagcatggtcccacatccctgg

SEQ ID NO: 2841861 - DNA, 23 bp, Homo sapiens
aagcatggtcccacatccctggg

SEQ ID NO: 2841862 - DNA, 16 bp, Homo sapiens
aagcatttactttgaa

SEQ ID NO: 2841863 - DNA, 16 bp, Homo sapiens
aagcatttactttgtg

SEQ ID NO: 2841864 - DNA, 13 bp, Homo sapiens
aagcattttgtaa

SEQ ID NO: 2841865 - DNA, 12 bp, Homo sapiens
aagccaaaacaa

SEQ ID NO: 2841866 - DNA, 14 bp, Homo sapiens
aagccaaactctgc

SEQ ID NO: 2841867 - DNA, 17 bp, Homo sapiens
aagccaaagctaggcct

SEQ ID NO: 2841868 - DNA, 15 bp, Homo sapiens
aagccaaatttatat

SEQ ID NO: 2841869 - DNA, 23 bp, Homo sapiens
aagccaccttccagtgagctctg

SEQ ID NO: 2841870 - DNA, 18 bp, Homo sapiens
aagccaggctgagtgagc

SEQ ID NO: 2841871 - DNA, 23 bp, Homo sapiens
aagccaggctgagtgagccacag

SEQ ID NO: 2841872 - DNA, 14 bp, Homo sapiens
aagcccaaatggct

SEQ ID NO: 2841873 - DNA, 22 bp, Homo sapiens
aagcccaacctcctgacctgtc

SEQ ID NO: 2841874 - DNA, 18 bp, Homo sapiens
aagcccaatattataatt

SEQ ID NO: 2841875 - DNA, 12 bp, Homo sapiens
aagccctccttc

SEQ ID NO: 2841876 - DNA, 13 bp, Homo sapiens
aagccctccttcc

SEQ ID NO: 2841877 - DNA, 15 bp, Homo sapiens
aagccctccttccac

SEQ ID NO: 2841878 - DNA, 23 bp, Homo sapiens
aagcccttccatgtcgcctctgc

SEQ ID NO: 2841879 - DNA, 21 bp, Homo sapiens
aagcctgcctaggaattccca

SEQ ID NO: 2841880 - DNA, 15 bp, Homo sapiens
aagcctgggggcctg

SEQ ID NO: 2841881 - DNA, 19 bp, Homo sapiens
aagcctgggggcctggctg

SEQ ID NO: 2841882 - DNA, 19 bp, Homo sapiens
aagcctgttttgttggaag

SEQ ID NO: 2841883 - DNA, 17 bp, Homo sapiens
aagcctttagttcctac

SEQ ID NO: 2841884 - DNA, 14 bp, Homo sapiens
aagcctttccataa

SEQ ID NO: 2841885 - DNA, 20 bp, Homo sapiens
aagcgatgaatttggagact

SEQ ID NO: 2841886 - DNA, 20 bp, Homo sapiens
aagcggtttccaggccaccg

SEQ ID NO: 2841887 - DNA, 21 bp, Homo sapiens
aagcgtgagccactgcaccgg

SEQ ID NO: 2841888 - DNA, 20 bp, Homo sapiens
aagctaacagggaaggcagg

SEQ ID NO: 2841889 - DNA, 23 bp, Homo sapiens
aagctaacagggaaggcaggcag

SEQ ID NO: 2841890 - DNA, 19 bp, Homo sapiens
aagctagaaggccacatgt

SEQ ID NO: 2841891 - DNA, 19 bp, Homo sapiens
aagctagaattgagtgttt

SEQ ID NO: 2841892 - DNA, 22 bp, Homo sapiens
aagctaggcctggccagatgca

SEQ ID NO: 2841893 - DNA, 20 bp, Homo sapiens
aagctcaagatgacagctct

SEQ ID NO: 2841894 - DNA, 12 bp, Homo sapiens
aagctctgaagt

SEQ ID NO: 2841895 - DNA, 22 bp, Homo sapiens
aagctctgaagtcacatcacag

SEQ ID NO: 2841896 - DNA, 17 bp, Homo sapiens
aagctctgcatgtgtgt

SEQ ID NO: 2841897 - DNA, 17 bp, Homo sapiens
aagctctgctcctctcc

SEQ ID NO: 2841898 - DNA, 23 bp, Homo sapiens
aagctctggccccaggcttgtca

SEQ ID NO: 2841899 - DNA, 11 bp, Homo sapiens
aagctctggct

SEQ ID NO: 2841900 - DNA, 12 bp, Homo sapiens
aagctgcagctt

SEQ ID NO: 2841901 - DNA, 17 bp, Homo sapiens
aagctgcagcttcctgt

SEQ ID NO: 2841902 - DNA, 18 bp, Homo sapiens
aagctgcagcttcctgtc

SEQ ID NO: 2841903 - DNA, 16 bp, Homo sapiens
aagctgcctgtagtta

SEQ ID NO: 2841904 - DNA, 18 bp, Homo sapiens
aagctggacaagaagctg

SEQ ID NO: 2841905 - DNA, 11 bp, Homo sapiens
aagctgtaccc

SEQ ID NO: 2841906 - DNA, 20 bp, Homo sapiens
aagctgtgtccttgcacctg

SEQ ID NO: 2841907 - DNA, 22 bp, Homo sapiens
aagctgtgtccttgcacctgca

SEQ ID NO: 2841908 - DNA, 12 bp, Homo sapiens
aagctgttccac

SEQ ID NO: 2841909 - DNA, 15 bp, Homo sapiens
aagctgtttccatag

SEQ ID NO: 2841910 - DNA, 23 bp, Homo sapiens
aagctgtttccatagggtgacac

SEQ ID NO: 2841911 - DNA, 19 bp, Homo sapiens
aagcttcaaccctcagcct

SEQ ID NO: 2841912 - DNA, 14 bp, Homo sapiens
aagcttcaagtgat

SEQ ID NO: 2841913 - DNA, 18 bp, Homo sapiens
aagcttgtatatacatat

SEQ ID NO: 2841914 - DNA, 23 bp, Homo sapiens
aagctttgcttatggtaataaaa

SEQ ID NO: 2841915 - DNA, 18 bp, Homo sapiens
aaggaacacccggaaaga

SEQ ID NO: 2841916 - DNA, 21 bp, Homo sapiens
aaggaataaattgctccttga

SEQ ID NO: 2841917 - DNA, 18 bp, Homo sapiens
aaggacattgcggacagc

SEQ ID NO: 2841918 - DNA, 16 bp, Homo sapiens
aaggagatataaaatc

SEQ ID NO: 2841919 - DNA, 17 bp, Homo sapiens
aaggagggacaagaatc

SEQ ID NO: 2841920 - DNA, 19 bp, Homo sapiens
aaggagtgagatcattttc

SEQ ID NO: 2841921 - DNA, 19 bp, Homo sapiens
aaggagtgtagcaactaca

SEQ ID NO: 2841922 - DNA, 21 bp, Homo sapiens
aaggatctctcaggagcacag

SEQ ID NO: 2841923 - DNA, 23 bp, Homo sapiens
aaggatctgtttttaaaaatcat

SEQ ID NO: 2841924 - DNA, 23 bp, Homo sapiens
aaggatgaatgaggtcccaggca

SEQ ID NO: 2841925 - DNA, 18 bp, Homo sapiens
aaggatgttctggcttta

SEQ ID NO: 2841926 - DNA, 15 bp, Homo sapiens
aaggattgctactgt

SEQ ID NO: 2841927 - DNA, 14 bp, Homo sapiens
aaggattgtgatat

SEQ ID NO: 2841928 - DNA, 17 bp, Homo sapiens
aaggattgtgatatttt

SEQ ID NO: 2841929 - DNA, 19 bp, Homo sapiens
aaggcaggaatgtgtggca

SEQ ID NO: 2841930 - DNA, 14 bp, Homo sapiens
aaggcaggcagggc

SEQ ID NO: 2841931 - DNA, 22 bp, Homo sapiens
aaggcaggcagggctctcctgg

SEQ ID NO: 2841932 - DNA, 18 bp, Homo sapiens
aaggcagggaaaggctct

SEQ ID NO: 2841933 - DNA, 20 bp, Homo sapiens
aaggcagggagcgagggaga

SEQ ID NO: 2841934 - DNA, 21 bp, Homo sapiens
aaggcatgatgttaaccagaa

SEQ ID NO: 2841935 - DNA, 17 bp, Homo sapiens
aaggcctggggtgaccc

SEQ ID NO: 2841936 - DNA, 20 bp, Homo sapiens
aaggctacttcggggctggg

SEQ ID NO: 2841937 - DNA, 17 bp, Homo sapiens
aaggctcagtctcagga

SEQ ID NO: 2841938 - DNA, 19 bp, Homo sapiens
aaggctgaccaagagagaa

SEQ ID NO: 2841939 - DNA, 20 bp, Homo sapiens
aaggctggctgaaaatcact

SEQ ID NO: 2841940 - DNA, 19 bp, Homo sapiens
acaattaaagctgttattt

SEQ ID NO: 2841941 - DNA, 18 bp, Homo sapiens
acaattccaaaggaatct

SEQ ID NO: 2841942 - DNA, 14 bp, Homo sapiens
acaattctaaaatg

SEQ ID NO: 2841943 - DNA, 23 bp, Homo sapiens
acaattctaaaatgattgtagta

SEQ ID NO: 2841944 - DNA, 13 bp, Homo sapiens
acaatttaaagca

SEQ ID NO: 2841945 - DNA, 13 bp, Homo sapiens
acaatttagaaaa

SEQ ID NO: 2841946 - DNA, 18 bp, Homo sapiens
acaggctactctcctcgg

SEQ ID NO: 2841947 - DNA, 14 bp, Homo sapiens
acaggctgggcttc

SEQ ID NO: 2841948 - DNA, 22 bp, Homo sapiens
acagggaaccctgcttgcactt

SEQ ID NO: 2841949 - DNA, 14 bp, Homo sapiens
acagggaaggcagg

SEQ ID NO: 2841950 - DNA, 19 bp, Homo sapiens
acagggaaggcaggcaggg

SEQ ID NO: 2841951 - DNA, 12 bp, Homo sapiens
acagggcacacc

SEQ ID NO: 2841952 - DNA, 18 bp, Homo sapiens
acaggtaaactatcttgg

SEQ ID NO: 2841953 - DNA, 14 bp, Homo sapiens
acaggtctcctctt

SEQ ID NO: 2841954 - DNA, 19 bp, Homo sapiens
acaggtggcaggaccagga

SEQ ID NO: 2841955 - DNA, 20 bp, Homo sapiens
acaggtggcaggaccaggac

SEQ ID NO: 2841956 - DNA, 24 bp, Homo sapiens
acaggtgtactatggctgtatttt

SEQ ID NO: 2841957 - DNA, 19 bp, Homo sapiens
acaggtgtgaaccaccaca

SEQ ID NO: 2841958 - DNA, 22 bp, Homo sapiens
acaggtgtgagtcaccaagccc

SEQ ID NO: 2841959 - DNA, 23 bp, Homo sapiens
acaggtgtgagtcaccaagccca

SEQ ID NO: 2841960 - DNA, 22 bp, Homo sapiens
acaggtttggggagggggaaga

SEQ ID NO: 2841961 - DNA, 22 bp, Homo sapiens
acagtaaaaacttgtactatgt

SEQ ID NO: 2841962 - DNA, 16 bp, Homo sapiens
acagtaaagtttaaaa

SEQ ID NO: 2841963 - DNA, 22 bp, Homo sapiens
acagtaaagtttaaaaaataca

SEQ ID NO: 2841964 - DNA, 23 bp, Homo sapiens
acagtaaagtttaaaaaatacac

SEQ ID NO: 2841965 - DNA, 14 bp, Homo sapiens
acagtaagctgctc

SEQ ID NO: 2841966 - DNA, 18 bp, Homo sapiens
acagtagcttaaataaat

SEQ ID NO: 2841967 - DNA, 12 bp, Homo sapiens
acagtcctggga

SEQ ID NO: 2841968 - DNA, 22 bp, Homo sapiens
acagtctagattagaagtgttt

SEQ ID NO: 2841969 - DNA, 12 bp, Homo sapiens
acagtgagccaa

SEQ ID NO: 2841970 - DNA, 14 bp, Homo sapiens
acagtgagcctgaa

SEQ ID NO: 2841971 - DNA, 18 bp, Homo sapiens
acagtgagcctgaatttt

SEQ ID NO: 2841972 - DNA, 21 bp, Homo sapiens
acagtgagcctgaattttgtt

SEQ ID NO: 2841973 - DNA, 14 bp, Homo sapiens
acagtgatctccat

SEQ ID NO: 2841974 - DNA, 13 bp, Homo sapiens
acagtgcctgctg

SEQ ID NO: 2841975 - DNA, 14 bp, Homo sapiens
acagtgcctgctga

SEQ ID NO: 2841976 - DNA, 14 bp, Homo sapiens
acagtgctgcgaga

SEQ ID NO: 2841977 - DNA, 14 bp, Homo sapiens
acagtgcttcagcc

SEQ ID NO: 2841978 - DNA, 17 bp, Homo sapiens
acagtgcttcagcctga

SEQ ID NO: 2841979 - DNA, 18 bp, Homo sapiens
acagtgcttcagcctgag

SEQ ID NO: 2841980 - DNA, 13 bp, Homo sapiens
acagtggagaaat

SEQ ID NO: 2841981 - DNA, 16 bp, Homo sapiens
acagtggagaaatatt

SEQ ID NO: 2841982 - DNA, 21 bp, Homo sapiens
acagtgggtgccccccttgcc

SEQ ID NO: 2841983 - DNA, 9 bp, Homo sapiens
acagtgttt

SEQ ID NO: 2841984 - DNA, 16 bp, Homo sapiens
acagtgtttcccataa

SEQ ID NO: 2841985 - DNA, 19 bp, Homo sapiens
acagtgtttcgacagctga

SEQ ID NO: 2841986 - DNA, 16 bp, Homo sapiens
acagttatctaagtta

SEQ ID NO: 2841987 - DNA, 17 bp, Homo sapiens
acagttatctaagttaa

SEQ ID NO: 2841988 - DNA, 12 bp, Homo sapiens
acagttcaagaa

SEQ ID NO: 2841989 - DNA, 16 bp, Homo sapiens
acagttcaagaaagct

SEQ ID NO: 2841990 - DNA, 15 bp, Homo sapiens
acagttcctcgccct

SEQ ID NO: 2841991 - DNA, 18 bp, Homo sapiens
acagttcctcgccctggg

SEQ ID NO: 2841992 - DNA, 13 bp, Homo sapiens
acagttccttcag

SEQ ID NO: 2841993 - DNA, 12 bp, Homo sapiens
acataaagttga

SEQ ID NO: 2841994 - DNA, 21 bp, Homo sapiens
acataatatcttgaagaatat

SEQ ID NO: 2841995 - DNA, 22 bp, Homo sapiens
acataatatcttgaagaatatt

SEQ ID NO: 2841996 - DNA, 17 bp, Homo sapiens
acataattatccaggaa

SEQ ID NO: 2841997 - DNA, 21 bp, Homo sapiens
acataatttagtttcatataa

SEQ ID NO: 2841998 - DNA, 12 bp, Homo sapiens
acatacaatttg

SEQ ID NO: 2841999 - DNA, 21 bp, Homo sapiens
acatacacctatgtcatttca

SEQ ID NO: 2842000 - DNA, 17 bp, Homo sapiens
acatacccttctttaaa

SEQ ID NO: 2842001 - DNA, 20 bp, Homo sapiens
acatacccttctttaaatca

SEQ ID NO: 2842002 - DNA, 12 bp, Homo sapiens
acatactcattt

SEQ ID NO: 2842003 - DNA, 13 bp, Homo sapiens
acatactcatttt

SEQ ID NO: 2842004 - DNA, 16 bp, Homo sapiens
acatagaaattgcctg

SEQ ID NO: 2842005 - DNA, 17 bp, Homo sapiens
acatagacagaagaaac

SEQ ID NO: 2842006 - DNA, 13 bp, Homo sapiens
acatagtcacaaa

SEQ ID NO: 2842007 - DNA, 22 bp, Homo sapiens
acatataaaagttaaactactt

SEQ ID NO: 2842008 - DNA, 14 bp, Homo sapiens
acatatatgtatat

SEQ ID NO: 2842009 - DNA, 16 bp, Homo sapiens
acatatcaattcaaca

SEQ ID NO: 2842010 - DNA, 20 bp, Homo sapiens
acatatcaattcaacacatt

SEQ ID NO: 2842011 - DNA, 21 bp, Homo sapiens
acatatcagaaaagtagaatt

SEQ ID NO: 2842012 - DNA, 13 bp, Homo sapiens
acatatcattttt

SEQ ID NO: 2842013 - DNA, 15 bp, Homo sapiens
acatatgaaatttaa

SEQ ID NO: 2842014 - DNA, 17 bp, Homo sapiens
acatatgcaccttgtgt

SEQ ID NO: 2842015 - DNA, 19 bp, Homo sapiens
acatatgcaccttgtgtct

SEQ ID NO: 2842016 - DNA, 16 bp, Homo sapiens
acatattataaataaa

SEQ ID NO: 2842017 - DNA, 19 bp, Homo sapiens
acatattataaataaatgc

SEQ ID NO: 2842018 - DNA, 20 bp, Homo sapiens
acatattataaataaatgcc

SEQ ID NO: 2842019 - DNA, 14 bp, Homo sapiens
acatatttgttaaa

SEQ ID NO: 2842020 - DNA, 15 bp, Homo sapiens
acatcacttgtacaa

SEQ ID NO: 2842021 - DNA, 19 bp, Homo sapiens
acatcacttgtacaaaata

SEQ ID NO: 2842022 - DNA, 14 bp, Homo sapiens
acatcaggagttca

SEQ ID NO: 2842023 - DNA, 13 bp, Homo sapiens
acatccaaggaga

SEQ ID NO: 2842024 - DNA, 14 bp, Homo sapiens
acatccaaggagaa

SEQ ID NO: 2842025 - DNA, 17 bp, Homo sapiens
accacatcttgctctgc

SEQ ID NO: 2842026 - DNA, 21 bp, Homo sapiens
accacatcttgctctgctgac

SEQ ID NO: 2842027 - DNA, 24 bp, Homo sapiens
accacatcttgctctgctgacaga

SEQ ID NO: 2842028 - DNA, 16 bp, Homo sapiens
accaccagccccagca

SEQ ID NO: 2842029 - DNA, 14 bp, Homo sapiens
accaccccttcctg

SEQ ID NO: 2842030 - DNA, 14 bp, Homo sapiens
accaccctcccacc

SEQ ID NO: 2842031 - DNA, 15 bp, Homo sapiens
accaccctcccacca

SEQ ID NO: 2842032 - DNA, 18 bp, Homo sapiens
accacctaggccactcct

SEQ ID NO: 2842033 - DNA, 21 bp, Homo sapiens
accacctaggccactcctcca

SEQ ID NO: 2842034 - DNA, 14 bp, Homo sapiens
accaccttcccagc

SEQ ID NO: 2842035 - DNA, 19 bp, Homo sapiens
accaccttggactcctccc

SEQ ID NO: 2842036 - DNA, 22 bp, Homo sapiens
accaccttggactcctcccaca

SEQ ID NO: 2842037 - DNA, 16 bp, Homo sapiens
accacgatgtggccct

SEQ ID NO: 2842038 - DNA, 21 bp, Homo sapiens
acccgtgccaagtccaggtcc

SEQ ID NO: 2842039 - DNA, 21 bp, Homo sapiens
acccgttcaacttttcctttg

SEQ ID NO: 2842040 - DNA, 21 bp, Homo sapiens
accctacttcattttcagagt

SEQ ID NO: 2842041 - DNA, 17 bp, Homo sapiens
accctcactgctgggga

SEQ ID NO: 2842042 - DNA, 11 bp, Homo sapiens
accctcagcct

SEQ ID NO: 2842043 - DNA, 22 bp, Homo sapiens
accctccgccttcactccggtg

SEQ ID NO: 2842044 - DNA, 18 bp, Homo sapiens
accctcgtggacacctgc

SEQ ID NO: 2842045 - DNA, 17 bp, Homo sapiens
accctgaagatttcaga

SEQ ID NO: 2842046 - DNA, 21 bp, Homo sapiens
accctgaagatttcagaggct

SEQ ID NO: 2842047 - DNA, 23 bp, Homo sapiens
accctgcagagcacacaggtaca

SEQ ID NO: 2842048 - DNA, 18 bp, Homo sapiens
accctgcgaaggggccct

SEQ ID NO: 2842049 - DNA, 20 bp, Homo sapiens
accctgcgaaggggccctgg

SEQ ID NO: 2842050 - DNA, 16 bp, Homo sapiens
accctggggagaaagt

SEQ ID NO: 2842051 - DNA, 21 bp, Homo sapiens
accctgtctcttaaagaaaaa

SEQ ID NO: 2842052 - DNA, 14 bp, Homo sapiens
accatgcgctgctc

SEQ ID NO: 2842053 - DNA, 19 bp, Homo sapiens
accatgcgctgctcaacct

SEQ ID NO: 2842054 - DNA, 11 bp, Homo sapiens
accatgtacat

SEQ ID NO: 2842055 - DNA, 17 bp, Homo sapiens
accatgtacatgaagaa

SEQ ID NO: 2842056 - DNA, 13 bp, Homo sapiens
accattcacattt

SEQ ID NO: 2842057 - DNA, 14 bp, Homo sapiens
accattcacatttg

SEQ ID NO: 2842058 - DNA, 19 bp, Homo sapiens
accattcacatttgatgta

SEQ ID NO: 2842059 - DNA, 22 bp, Homo sapiens
accattttggggtacccactgc

SEQ ID NO: 2842060 - DNA, 23 bp, Homo sapiens
accattttggggtacccactgct

SEQ ID NO: 2842061 - DNA, 23 bp, Homo sapiens
acccaaaagtcaaaaggtgcctg

SEQ ID NO: 2842062 - DNA, 18 bp, Homo sapiens
acccaaagaggtatttat

SEQ ID NO: 2842063 - DNA, 16 bp, Homo sapiens
acccaaataaatgtgt

SEQ ID NO: 2842064 - DNA, 21 bp, Homo sapiens
acccaaataaatgtgtaaatg

SEQ ID NO: 2842065 - DNA, 16 bp, Homo sapiens
acccaagtgggggcag

SEQ ID NO: 2842066 - DNA, 22 bp, Homo sapiens
atggtaagactgtaattaagta

SEQ ID NO: 2842067 - DNA, 14 bp, Homo sapiens
atggtaattgttgc

SEQ ID NO: 2842068 - DNA, 12 bp, Homo sapiens
atggtattttcg

SEQ ID NO: 2842069 - DNA, 19 bp, Homo sapiens
atggtattttcgtgcattt

SEQ ID NO: 2842070 - DNA, 20 bp, Homo sapiens
atggtattttcgtgcatttg

SEQ ID NO: 2842071 - DNA, 22 bp, Homo sapiens
atggtattttcgtgcatttgtg

SEQ ID NO: 2842072 - DNA, 17 bp, Homo sapiens
atggtcccacatccctg

SEQ ID NO: 2842073 - DNA, 20 bp, Homo sapiens
atggtcccacatccctgggc

SEQ ID NO: 2842074 - DNA, 12 bp, Homo sapiens
atggtcctgggg

SEQ ID NO: 2842075 - DNA, 14 bp, Homo sapiens
atggtcctggggct

SEQ ID NO: 2842076 - DNA, 24 bp, Homo sapiens
atggtgaaaccccgtctctactaa

SEQ ID NO: 2842077 - DNA, 18 bp, Homo sapiens
atggtgcagttgacagca

SEQ ID NO: 2842078 - DNA, 20 bp, Homo sapiens
atggtgcagttgacagcagg

SEQ ID NO: 2842079 - DNA, 14 bp, Homo sapiens
atggtgccttcatt

SEQ ID NO: 2842080 - DNA, 13 bp, Homo sapiens
atggtgctcccct

SEQ ID NO: 2842081 - DNA, 16 bp, Homo sapiens
atggtggcgcgcacct

SEQ ID NO: 2842082 - DNA, 23 bp, Homo sapiens
atggtggtttgtcatatattcat

SEQ ID NO: 2842083 - DNA, 20 bp, Homo sapiens
atggtgtaatgcacaattta

SEQ ID NO: 2842084 - DNA, 22 bp, Homo sapiens
atggtgtaatgcacaatttaga

SEQ ID NO: 2842085 - DNA, 19 bp, Homo sapiens
atggttcccaataaaagtg

SEQ ID NO: 2842086 - DNA, 13 bp, Homo sapiens
atggtttactgct

SEQ ID NO: 2842087 - DNA, 19 bp, Homo sapiens
atggtttactgctgtcatt

SEQ ID NO: 2842088 - DNA, 23 bp, Homo sapiens
atggtttttgcaagatttaacac

SEQ ID NO: 2842089 - DNA, 13 bp, Homo sapiens
atgtaaaacattt

SEQ ID NO: 2842090 - DNA, 14 bp, Homo sapiens
atgtaaaacattta

SEQ ID NO: 2842091 - DNA, 14 bp, Homo sapiens
atgtaaaatgcagt

SEQ ID NO: 2842092 - DNA, 22 bp, Homo sapiens
atgtaaaatgcagtccagaata

SEQ ID NO: 2842093 - DNA, 23 bp, Homo sapiens
atgtaaatattttaaagaattgt

SEQ ID NO: 2842094 - DNA, 17 bp, Homo sapiens
atgtaacccaaatgtcc

SEQ ID NO: 2842095 - DNA, 14 bp, Homo sapiens
atgtaacttttgta

SEQ ID NO: 2842096 - DNA, 15 bp, Homo sapiens
atgtaaggaattgaa

SEQ ID NO: 2842097 - DNA, 18 bp, Homo sapiens
atgtaaggtaatttctgt

SEQ ID NO: 2842098 - DNA, 12 bp, Homo sapiens
atgtaataaatc

SEQ ID NO: 2842099 - DNA, 13 bp, Homo sapiens
atgtaataaatct

SEQ ID NO: 2842100 - DNA, 21 bp, Homo sapiens
atgtacaaaatcgattggctt

SEQ ID NO: 2842101 - DNA, 13 bp, Homo sapiens
atgtacagcatgc

SEQ ID NO: 2842102 - DNA, 14 bp, Homo sapiens
atgtacatgtgtag

SEQ ID NO: 2842103 - DNA, 15 bp, Homo sapiens
atgtaccagtgtact

SEQ ID NO: 2842104 - DNA, 16 bp, Homo sapiens
atgtaccagtgtactg

SEQ ID NO: 2842105 - DNA, 22 bp, Homo sapiens
atgtaccagtgtactgctttca

SEQ ID NO: 2842106 - DNA, 15 bp, Homo sapiens
atgtaccatgtacat

SEQ ID NO: 2842107 - DNA, 12 bp, Homo sapiens
atgtagaaagct

SEQ ID NO: 2842108 - DNA, 13 bp, Homo sapiens
atgtaggagggac

SEQ ID NO: 2842109 - DNA, 21 bp, Homo sapiens
atgtaggtgtctgcacccagg

SEQ ID NO: 2842110 - DNA, 19 bp, Homo sapiens
atgtatagtgagtgtggct

SEQ ID NO: 2842111 - DNA, 13 bp, Homo sapiens
atgtatatctata

SEQ ID NO: 2842112 - DNA, 15 bp, Homo sapiens
atgtatatctatatc

SEQ ID NO: 2842113 - DNA, 19 bp, Homo sapiens
atgtatatctatatctcta

SEQ ID NO: 2842114 - DNA, 14 bp, Homo sapiens
atgtatatgtatat

SEQ ID NO: 2842115 - DNA, 19 bp, Homo sapiens
atgtatatgtatatctata

SEQ ID NO: 2842116 - DNA, 16 bp, Homo sapiens
atgtatatgtgttcat

SEQ ID NO: 2842117 - DNA, 17 bp, Homo sapiens
atgtatcatagaaatgt

SEQ ID NO: 2842118 - DNA, 14 bp, Homo sapiens
atgtatgattacat

SEQ ID NO: 2842119 - DNA, 23 bp, Homo sapiens
atgtatgtgaaagtgtaaaatag

SEQ ID NO: 2842120 - DNA, 23 bp, Homo sapiens
atgtattattttctatagctctt

SEQ ID NO: 2842121 - DNA, 17 bp, Homo sapiens
atgtatttataaatata

SEQ ID NO: 2842122 - DNA, 23 bp, Homo sapiens
atgtatttattgtcattactgcc

SEQ ID NO: 2842123 - DNA, 17 bp, Homo sapiens
atgtatttttgtaccct

SEQ ID NO: 2842124 - DNA, 14 bp, Homo sapiens
atgtcacaggcagg

SEQ ID NO: 2842125 - DNA, 17 bp, Homo sapiens
atgtcacaggcaggtcc

SEQ ID NO: 2842126 - DNA, 20 bp, Homo sapiens
atgtcacataatgaatgcta

SEQ ID NO: 2842127 - DNA, 18 bp, Homo sapiens
atgtcaccaccttcccag

SEQ ID NO: 2842128 - DNA, 23 bp, Homo sapiens
atgtcaccgtggaccttcctgcc

SEQ ID NO: 2842129 - DNA, 17 bp, Homo sapiens
atgtcattaaaataaat

SEQ ID NO: 2842130 - DNA, 13 bp, Homo sapiens
atgtcattaaatg

SEQ ID NO: 2842131 - DNA, 22 bp, Homo sapiens
atgtccagaagaatattcagga

SEQ ID NO: 2842132 - DNA, 20 bp, Homo sapiens
atgtcccaacttgtaaaaat

SEQ ID NO: 2842133 - DNA, 17 bp, Homo sapiens
atgtcccatctgctcct

SEQ ID NO: 2842134 - DNA, 21 bp, Homo sapiens
atgtcccatctgctcctccca

SEQ ID NO: 2842135 - DNA, 14 bp, Homo sapiens
atgtcccttgctgt

SEQ ID NO: 2842136 - DNA, 23 bp, Homo sapiens
atgtcctaggggccgagggaaat

SEQ ID NO: 2842137 - DNA, 17 bp, Homo sapiens
atgtctcaggtccctgc

SEQ ID NO: 2842138 - DNA, 16 bp, Homo sapiens
atgtctctcagaattc

SEQ ID NO: 2842139 - DNA, 14 bp, Homo sapiens
atgtctgtggattt

SEQ ID NO: 2842140 - DNA, 16 bp, Homo sapiens
atgtcttggacactgt

SEQ ID NO: 2842141 - DNA, 17 bp, Homo sapiens
atgtgaaagtgtaaaat

SEQ ID NO: 2842142 - DNA, 15 bp, Homo sapiens
atgtgaatcagaccc

SEQ ID NO: 2842143 - DNA, 18 bp, Homo sapiens
atgtgaattctgtgaaga

SEQ ID NO: 2842144 - DNA, 19 bp, Homo sapiens
atgtgaattctgtgaagaa

SEQ ID NO: 2842145 - DNA, 18 bp, Homo sapiens
atgtgacaacctttgtgt

SEQ ID NO: 2842146 - DNA, 19 bp, Homo sapiens
atgtgacaacctttgtgta

SEQ ID NO: 2842147 - DNA, 17 bp, Homo sapiens
atgtgagtgtgtgtgat

SEQ ID NO: 2842148 - DNA, 21 bp, Homo sapiens
atgtgatacccatagcttcca

SEQ ID NO: 2842149 - DNA, 17 bp, Homo sapiens
atgtgatccttttatgt

SEQ ID NO: 2842150 - DNA, 18 bp, Homo sapiens
atgtgatccttttatgtt

SEQ ID NO: 2842151 - DNA, 22 bp, Homo sapiens
atgtgcatggaaatgtcctcca

SEQ ID NO: 2842152 - DNA, 15 bp, Homo sapiens
atgtgccaaggtggg

SEQ ID NO: 2842153 - DNA, 21 bp, Homo sapiens
atgtgccattttaataaaatg

SEQ ID NO: 2842154 - DNA, 18 bp, Homo sapiens
atgtggaatggattatag

SEQ ID NO: 2842155 - DNA, 22 bp, Homo sapiens
atgtggcccctgaacaagaatt

SEQ ID NO: 2842156 - DNA, 13 bp, Homo sapiens
atgtggccctggc

SEQ ID NO: 2842157 - DNA, 20 bp, Homo sapiens
atgtgggctagttgggcttc

SEQ ID NO: 2842158 - DNA, 19 bp, Homo sapiens
atgtgtaaatgtggacaca

SEQ ID NO: 2842159 - DNA, 17 bp, Homo sapiens
atgtgtagattgcgtgg

SEQ ID NO: 2842160 - DNA, 14 bp, Homo sapiens
atgtgtagcctgtg

SEQ ID NO: 2842161 - DNA, 16 bp, Homo sapiens
atgtgtagggaaagtt

SEQ ID NO: 2842162 - DNA, 18 bp, Homo sapiens
atgtgtcatgatttcaat

SEQ ID NO: 2842163 - DNA, 23 bp, Homo sapiens
atgtgtcatgatttcaatgattg

SEQ ID NO: 2842164 - DNA, 18 bp, Homo sapiens
atgtgtgaaggtcttgcc

SEQ ID NO: 2842165 - DNA, 15 bp, Homo sapiens
atgtgtggatgtgta

SEQ ID NO: 2842166 - DNA, 10 bp, Homo sapiens
atgtgtgtat

SEQ ID NO: 2842167 - DNA, 20 bp, Homo sapiens
atgtgtgtatgggtgtgtgt

SEQ ID NO: 2842168 - DNA, 12 bp, Homo sapiens
atgtgtgtgtat

SEQ ID NO: 2842169 - DNA, 15 bp, Homo sapiens
atgtgttttctgaat

SEQ ID NO: 2842170 - DNA, 12 bp, Homo sapiens
atgttaaagagg

SEQ ID NO: 2842171 - DNA, 13 bp, Homo sapiens
atgttaagctctt

SEQ ID NO: 2842172 - DNA, 17 bp, Homo sapiens
atgttacatcacagtgt

SEQ ID NO: 2842173 - DNA, 21 bp, Homo sapiens
atgttacctcctataaactta

SEQ ID NO: 2842174 - DNA, 17 bp, Homo sapiens
atgttactacatgcact

SEQ ID NO: 2842175 - DNA, 15 bp, Homo sapiens
atgttagcaaagagt

SEQ ID NO: 2842176 - DNA, 18 bp, Homo sapiens
atgttaggaaaatttcac

SEQ ID NO: 2842177 - DNA, 16 bp, Homo sapiens
atgttagggtgctctg

SEQ ID NO: 2842178 - DNA, 19 bp, Homo sapiens
atgttcacgcaacttgaaa

SEQ ID NO: 2842179 - DNA, 16 bp, Homo sapiens
atgttctgaataattt

SEQ ID NO: 2842180 - DNA, 12 bp, Homo sapiens
atgttctgggac

SEQ ID NO: 2842181 - DNA, 14 bp, Homo sapiens
atgttctgggacac

SEQ ID NO: 2842182 - DNA, 22 bp, Homo sapiens
atgttgaatgcccacaggcaaa

SEQ ID NO: 2842183 - DNA, 18 bp, Homo sapiens
atgttgccatgaggcctt

SEQ ID NO: 2842184 - DNA, 13 bp, Homo sapiens
atgttgcccaggc

SEQ ID NO: 2842185 - DNA, 14 bp, Homo sapiens
atgttgcccaggca

SEQ ID NO: 2842186 - DNA, 13 bp, Homo sapiens
atgttgctgaaac

SEQ ID NO: 2842187 - DNA, 15 bp, Homo sapiens
atgttgctggactgt

SEQ ID NO: 2842188 - DNA, 19 bp, Homo sapiens
atgttgctggactgtcata

SEQ ID NO: 2842189 - DNA, 14 bp, Homo sapiens
atgttggccaggct

SEQ ID NO: 2842190 - DNA, 18 bp, Homo sapiens
atgttgggatttatatct

SEQ ID NO: 2842191 - DNA, 14 bp, Homo sapiens
atgttgttatttaa

SEQ ID NO: 2842192 - DNA, 14 bp, Homo sapiens
atgtttaaaccttt

SEQ ID NO: 2842193 - DNA, 16 bp, Homo sapiens
atgtttacactctttg

SEQ ID NO: 2842194 - DNA, 19 bp, Homo sapiens
atgtttacactctttgtaa

SEQ ID NO: 2842195 - DNA, 21 bp, Homo sapiens
atgtttacactctttgtaaga

SEQ ID NO: 2842196 - DNA, 22 bp, Homo sapiens
atgtttacaggtggacacacaa

SEQ ID NO: 2842197 - DNA, 21 bp, Homo sapiens
atgtttatttattctgcattt

SEQ ID NO: 2842198 - DNA, 14 bp, Homo sapiens
atgtttccagaaaa

SEQ ID NO: 2842199 - DNA, 21 bp, Homo sapiens
atgtttccagaaaatataaat

SEQ ID NO: 2842200 - DNA, 20 bp, Homo sapiens
atgtttgaactgccaagaaa

SEQ ID NO: 2842201 - DNA, 22 bp, Homo sapiens
atgtttgcctctgcctctgaca

SEQ ID NO: 2842202 - DNA, 21 bp, Homo sapiens
atgttttgtcccatttccttg

SEQ ID NO: 2842203 - DNA, 23 bp, Homo sapiens
atgttttgtcccatttccttgga

SEQ ID NO: 2842204 - DNA, 19 bp, Homo sapiens
atgtttttaatgtatagta

SEQ ID NO: 2842205 - DNA, 12 bp, Homo sapiens
attaaaaaattt

SEQ ID NO: 2842206 - DNA, 14 bp, Homo sapiens
attaaaaactgagt

SEQ ID NO: 2842207 - DNA, 17 bp, Homo sapiens
attaaaaagttaatctt

SEQ ID NO: 2842208 - DNA, 15 bp, Homo sapiens
attaaaacacagctt

SEQ ID NO: 2842209 - DNA, 14 bp, Homo sapiens
attaaaagaatttt

SEQ ID NO: 2842210 - DNA, 19 bp, Homo sapiens
attaaaataaataaatgca

SEQ ID NO: 2842211 - DNA, 12 bp, Homo sapiens
attaaaatatat

SEQ ID NO: 2842212 - DNA, 16 bp, Homo sapiens
attaaaatatatataa

SEQ ID NO: 2842213 - DNA, 21 bp, Homo sapiens
attaaaatatatataaatata

SEQ ID NO: 2842214 - DNA, 23 bp, Homo sapiens
attaaaatatatataaatatata

SEQ ID NO: 2842215 - DNA, 21 bp, Homo sapiens
attaaaatctggcaaagttat

SEQ ID NO: 2842216 - DNA, 13 bp, Homo sapiens
attaaaattagtg

SEQ ID NO: 2842217 - DNA, 14 bp, Homo sapiens
attaaacacctgac

SEQ ID NO: 2842218 - DNA, 15 bp, Homo sapiens
attaaacacctgaca

SEQ ID NO: 2842219 - DNA, 17 bp, Homo sapiens
attaaacacctgacaca

SEQ ID NO: 2842220 - DNA, 15 bp, Homo sapiens
attaaacactgtaat

SEQ ID NO: 2842221 - DNA, 19 bp, Homo sapiens
attaaagcaccaaattcat

SEQ ID NO: 2842222 - DNA, 12 bp, Homo sapiens
attaaaggaagg

SEQ ID NO: 2842223 - DNA, 13 bp, Homo sapiens
attaaaggaagga

SEQ ID NO: 2842224 - DNA, 12 bp, Homo sapiens
attaaatacaga

SEQ ID NO: 2842225 - DNA, 15 bp, Homo sapiens
attaaattttctatg

SEQ ID NO: 2842226 - DNA, 19 bp, Homo sapiens
attaacattgggaaatctt

SEQ ID NO: 2842227 - DNA, 17 bp, Homo sapiens
attaactcattagactg

SEQ ID NO: 2842228 - DNA, 22 bp, Homo sapiens
attaactgggtaatgaaacaaa

SEQ ID NO: 2842229 - DNA, 17 bp, Homo sapiens
attaacttaaaagattc

SEQ ID NO: 2842230 - DNA, 22 bp, Homo sapiens
attaataaaaaatggaaagaat

SEQ ID NO: 2842231 - DNA, 17 bp, Homo sapiens
attaataaacgaagata

SEQ ID NO: 2842232 - DNA, 14 bp, Homo sapiens
attaatatgttcat

SEQ ID NO: 2842233 - DNA, 17 bp, Homo sapiens
attaatattcattgtat

SEQ ID NO: 2842234 - DNA, 19 bp, Homo sapiens
attaatcaactttccttaa

SEQ ID NO: 2842235 - DNA, 18 bp, Homo sapiens
attaatctttctttacct

SEQ ID NO: 2842236 - DNA, 23 bp, Homo sapiens
attaatctttctttacctgagac

SEQ ID NO: 2842237 - DNA, 14 bp, Homo sapiens
attaattaaatgca

SEQ ID NO: 2842238 - DNA, 19 bp, Homo sapiens
attaattcaccttccagtg

SEQ ID NO: 2842239 - DNA, 12 bp, Homo sapiens
attaatttgtgt

SEQ ID NO: 2842240 - DNA, 22 bp, Homo sapiens
attacaagcgtgagccactgca

SEQ ID NO: 2842241 - DNA, 16 bp, Homo sapiens
attacaggtgtgaacc

SEQ ID NO: 2842242 - DNA, 18 bp, Homo sapiens
attaccaaaaaagtattt

SEQ ID NO: 2842243 - DNA, 19 bp, Homo sapiens
attaccaaaaaagtatttt

SEQ ID NO: 2842244 - DNA, 22 bp, Homo sapiens
attaccccctcattgtttatta

SEQ ID NO: 2842245 - DNA, 21 bp, Homo sapiens
attaccttagattagctctgg

SEQ ID NO: 2842246 - DNA, 15 bp, Homo sapiens
attactacaaaattt

SEQ ID NO: 2842247 - DNA, 17 bp, Homo sapiens
atctctgtgtacccact

SEQ ID NO: 2842248 - DNA, 14 bp, Homo sapiens
atctgaaaactgga

SEQ ID NO: 2842249 - DNA, 15 bp, Homo sapiens
atctgaaaactggaa

SEQ ID NO: 2842250 - DNA, 21 bp, Homo sapiens
atctgacactaccttatcagg

SEQ ID NO: 2842251 - DNA, 22 bp, Homo sapiens
atctgacagttactcttcagtt

SEQ ID NO: 2842252 - DNA, 18 bp, Homo sapiens
atctgactcacaagaaga

SEQ ID NO: 2842253 - DNA, 18 bp, Homo sapiens
atctgactttaattgtgt

SEQ ID NO: 2842254 - DNA, 17 bp, Homo sapiens
atctgagcaagagctgg

SEQ ID NO: 2842255 - DNA, 22 bp, Homo sapiens
atctgagcaagagctggcaaag

SEQ ID NO: 2842256 - DNA, 17 bp, Homo sapiens
atctgagcctaaatcta

SEQ ID NO: 2842257 - DNA, 19 bp, Homo sapiens
atctgagcctaaatctaat

SEQ ID NO: 2842258 - DNA, 19 bp, Homo sapiens
atctgatcgggataacaaa

SEQ ID NO: 2842259 - DNA, 21 bp, Homo sapiens
atctgatcgggataacaaaat

SEQ ID NO: 2842260 - DNA, 22 bp, Homo sapiens
atctgatcgggataacaaaatc

SEQ ID NO: 2842261 - DNA, 14 bp, Homo sapiens
atctgcatttataa

SEQ ID NO: 2842262 - DNA, 21 bp, Homo sapiens
atctgcatttataaatgtgtg

SEQ ID NO: 2842263 - DNA, 15 bp, Homo sapiens
atctgctcctcccat

SEQ ID NO: 2842264 - DNA, 12 bp, Homo sapiens
atctgctgcccc

SEQ ID NO: 2842265 - DNA, 16 bp, Homo sapiens
atctgcttgtattttc

SEQ ID NO: 2842266 - DNA, 16 bp, Homo sapiens
atctggactcctctgt

SEQ ID NO: 2842267 - DNA, 24 bp, Homo sapiens
atctgggaggctggtctccctcca

SEQ ID NO: 2842268 - DNA, 19 bp, Homo sapiens
atctgggttcactgcaacc

SEQ ID NO: 2842269 - DNA, 17 bp, Homo sapiens
atctggtagatttttaa

SEQ ID NO: 2842270 - DNA, 12 bp, Homo sapiens
atctgtactgta

SEQ ID NO: 2842271 - DNA, 17 bp, Homo sapiens
atctgtagggctggacc

SEQ ID NO: 2842272 - DNA, 14 bp, Homo sapiens
atctgtatatacaa

SEQ ID NO: 2842273 - DNA, 20 bp, Homo sapiens
atctgtatatacaataacat

SEQ ID NO: 2842274 - DNA, 13 bp, Homo sapiens
atctgtccaagga

SEQ ID NO: 2842275 - DNA, 14 bp, Homo sapiens
atctgtccaaggaa

SEQ ID NO: 2842276 - DNA, 16 bp, Homo sapiens
atctgtcttgccagcc

SEQ ID NO: 2842277 - DNA, 19 bp, Homo sapiens
atctgtgaggtgctgatga

SEQ ID NO: 2842278 - DNA, 22 bp, Homo sapiens
atctgtgcaaatccttgatact

SEQ ID NO: 2842279 - DNA, 16 bp, Homo sapiens
atctgtggtcttcaaa

SEQ ID NO: 2842280 - DNA, 21 bp, Homo sapiens
atctgtgtaacctccacagta

SEQ ID NO: 2842281 - DNA, 13 bp, Homo sapiens
atctgtgtctctg

SEQ ID NO: 2842282 - DNA, 16 bp, Homo sapiens
atctgtgtctctggaa

SEQ ID NO: 2842283 - DNA, 16 bp, Homo sapiens
atctgtgttgtctctc

SEQ ID NO: 2842284 - DNA, 21 bp, Homo sapiens
atctgtttgagaatatgatca

SEQ ID NO: 2842285 - DNA, 18 bp, Homo sapiens
atctgtttttaaaaatca

SEQ ID NO: 2842286 - DNA, 16 bp, Homo sapiens
atcttactatttcaca

SEQ ID NO: 2842287 - DNA, 15 bp, Homo sapiens
atcttagctttccac

SEQ ID NO: 2842288 - DNA, 14 bp, Homo sapiens
atcttatttatata

SEQ ID NO: 2842289 - DNA, 23 bp, Homo sapiens
atcttattttcatgtatatgtgt

SEQ ID NO: 2842290 - DNA, 16 bp, Homo sapiens
atcttccttgtgagga

SEQ ID NO: 2842291 - DNA, 15 bp, Homo sapiens
atcttctccatctgg

SEQ ID NO: 2842292 - DNA, 19 bp, Homo sapiens
atcttctccatctggcagg

SEQ ID NO: 2842293 - DNA, 19 bp, Homo sapiens
atcttctgaaatgaaacaa

SEQ ID NO: 2842294 - DNA, 20 bp, Homo sapiens
atcttcttatgcaatttcct

SEQ ID NO: 2842295 - DNA, 17 bp, Homo sapiens
atcttgacattcaaggc

SEQ ID NO: 2842296 - DNA, 16 bp, Homo sapiens
atcttgactcactgca

SEQ ID NO: 2842297 - DNA, 13 bp, Homo sapiens
atcttgctctgct

SEQ ID NO: 2842298 - DNA, 14 bp, Homo sapiens
atcttggactgaca

SEQ ID NO: 2842299 - DNA, 16 bp, Homo sapiens
atcttggactgacatt

SEQ ID NO: 2842300 - DNA, 21 bp, Homo sapiens
atcttggttgatgccaaaaaa

SEQ ID NO: 2842301 - DNA, 14 bp, Homo sapiens
atcttgtctctggg

SEQ ID NO: 2842302 - DNA, 18 bp, Homo sapiens
atctttaaaaagcagtcc

SEQ ID NO: 2842303 - DNA, 19 bp, Homo sapiens
atctttcagcactcagaaa

SEQ ID NO: 2842304 - DNA, 22 bp, Homo sapiens
atctttcttctattttattccc

SEQ ID NO: 2842305 - DNA, 20 bp, Homo sapiens
atctttctttacctgagacc

SEQ ID NO: 2842306 - DNA, 16 bp, Homo sapiens
atctttgattcagaca

SEQ ID NO: 2842307 - DNA, 17 bp, Homo sapiens
atctttgcagacaggca

SEQ ID NO: 2842308 - DNA, 23 bp, Homo sapiens
atcttttgtgagatgtaattgtt

SEQ ID NO: 2842309 - DNA, 14 bp, Homo sapiens
atctttttctctaa

SEQ ID NO: 2842310 - DNA, 18 bp, Homo sapiens
atgaaaagaataaaaatt

SEQ ID NO: 2842311 - DNA, 16 bp, Homo sapiens
atgaaacacttctcat

SEQ ID NO: 2842312 - DNA, 20 bp, Homo sapiens
atgaaagatggctgtgcctc

SEQ ID NO: 2842313 - DNA, 15 bp, Homo sapiens
atgaaagggcccaga

SEQ ID NO: 2842314 - DNA, 18 bp, Homo sapiens
atgaaagggcccagagag

SEQ ID NO: 2842315 - DNA, 20 bp, Homo sapiens
atgaaataaattggtgataa

SEQ ID NO: 2842316 - DNA, 19 bp, Homo sapiens
atgaaatacacaagtaaac

SEQ ID NO: 2842317 - DNA, 13 bp, Homo sapiens
atgaaatatcaga

SEQ ID NO: 2842318 - DNA, 18 bp, Homo sapiens
atgaaatgggctttaaca

SEQ ID NO: 2842319 - DNA, 20 bp, Homo sapiens
atgaaattgtctagcagagc

SEQ ID NO: 2842320 - DNA, 10 bp, Homo sapiens
atgaacaaag

SEQ ID NO: 2842321 - DNA, 22 bp, Homo sapiens
atgaacaaagggattctccagg

SEQ ID NO: 2842322 - DNA, 12 bp, Homo sapiens
atgaacaaatgg

SEQ ID NO: 2842323 - DNA, 20 bp, Homo sapiens
atgaaccacatcttgctctg

SEQ ID NO: 2842324 - DNA, 19 bp, Homo sapiens
atcccaggcttcaccctga

SEQ ID NO: 2842325 - DNA, 12 bp, Homo sapiens
atcccaggggac

SEQ ID NO: 2842326 - DNA, 15 bp, Homo sapiens
atcccatcatggctg

SEQ ID NO: 2842327 - DNA, 19 bp, Homo sapiens
atcccatccatcagctccc

SEQ ID NO: 2842328 - DNA, 18 bp, Homo sapiens
atcccatctaagctgcag

SEQ ID NO: 2842329 - DNA, 19 bp, Homo sapiens
agtgggccaggacaggccc

SEQ ID NO: 2842330 - DNA, 20 bp, Homo sapiens
agtggggtctccctctcctg

SEQ ID NO: 2842331 - DNA, 19 bp, Homo sapiens
agtggggttgcaaccactg

SEQ ID NO: 2842332 - DNA, 22 bp, Homo sapiens
agtggggttgcaaccactgcaa

SEQ ID NO: 2842333 - DNA, 17 bp, Homo sapiens
agtgggtgaatgtgtga

SEQ ID NO: 2842334 - DNA, 21 bp, Homo sapiens
agtggtaccagctcactccct

SEQ ID NO: 2842335 - DNA, 23 bp, Homo sapiens
agtggtcaaaccgcactcaccca

SEQ ID NO: 2842336 - DNA, 22 bp, Homo sapiens
agtggtcgcttactttgagtga

SEQ ID NO: 2842337 - DNA, 17 bp, Homo sapiens
agtggtgcgatctgggt

SEQ ID NO: 2842338 - DNA, 13 bp, Homo sapiens
agtgtaaaataga

SEQ ID NO: 2842339 - DNA, 18 bp, Homo sapiens
agtgtaaagaataaatga

SEQ ID NO: 2842340 - DNA, 19 bp, Homo sapiens
agtgtaaagaataaatgaa

SEQ ID NO: 2842341 - DNA, 21 bp, Homo sapiens
agtgtaaatcctttttcttta

SEQ ID NO: 2842342 - DNA, 13 bp, Homo sapiens
agtgtactgcttt

SEQ ID NO: 2842343 - DNA, 14 bp, Homo sapiens
agtgtactgctttc

SEQ ID NO: 2842344 - DNA, 20 bp, Homo sapiens
agtgtatggaaataaatgta

SEQ ID NO: 2842345 - DNA, 19 bp, Homo sapiens
agtgtcacttacctagatt

SEQ ID NO: 2842346 - DNA, 12 bp, Homo sapiens
agtgtcagtgtt

SEQ ID NO: 2842347 - DNA, 13 bp, Homo sapiens
agtgtcagtgttg

SEQ ID NO: 2842348 - DNA, 20 bp, Homo sapiens
agtgtcatatgtaggtgtct

SEQ ID NO: 2842349 - DNA, 19 bp, Homo sapiens
agtgtcatttatgaaaaga

SEQ ID NO: 2842350 - DNA, 19 bp, Homo sapiens
agtgtcttcctagtatatt

SEQ ID NO: 2842351 - DNA, 22 bp, Homo sapiens
agtgtgaccaaaagttacatgt

SEQ ID NO: 2842352 - DNA, 22 bp, Homo sapiens
agtgtgcttctgttatcaaaca

SEQ ID NO: 2842353 - DNA, 19 bp, Homo sapiens
agtgtgcttgtcatctgcc

SEQ ID NO: 2842354 - DNA, 22 bp, Homo sapiens
agtgttattttctttgaaattg

SEQ ID NO: 2842355 - DNA, 17 bp, Homo sapiens
agtgttgaaaatgttca

SEQ ID NO: 2842356 - DNA, 21 bp, Homo sapiens
agtgttgaagaagagtttgca

SEQ ID NO: 2842357 - DNA, 15 bp, Homo sapiens
agtgtttcccataat

SEQ ID NO: 2842358 - DNA, 17 bp, Homo sapiens
agtgttttcacctcata

SEQ ID NO: 2842359 - DNA, 16 bp, Homo sapiens
agttaaagtgaataac

SEQ ID NO: 2842360 - DNA, 12 bp, Homo sapiens
agttaacagaga

SEQ ID NO: 2842361 - DNA, 21 bp, Homo sapiens
agttaacattaacatctatta

SEQ ID NO: 2842362 - DNA, 19 bp, Homo sapiens
agttaagcagcctttctgt

SEQ ID NO: 2842363 - DNA, 21 bp, Homo sapiens
agttaagcagcctttctgtgg

SEQ ID NO: 2842364 - DNA, 23 bp, Homo sapiens
agttacagcgagaggcagagaaa

SEQ ID NO: 2842365 - DNA, 15 bp, Homo sapiens
agttactcagccctg

SEQ ID NO: 2842366 - DNA, 17 bp, Homo sapiens
agttactcagccctggg

SEQ ID NO: 2842367 - DNA, 14 bp, Homo sapiens
agttactggtttca

SEQ ID NO: 2842368 - DNA, 14 bp, Homo sapiens
agttacttcctatc

SEQ ID NO: 2842369 - DNA, 16 bp, Homo sapiens
agttagagaatatatt

SEQ ID NO: 2842370 - DNA, 17 bp, Homo sapiens
agttagagaatatattt

SEQ ID NO: 2842371 - DNA, 15 bp, Homo sapiens
agttagctttaactt

SEQ ID NO: 2842372 - DNA, 12 bp, Homo sapiens
agttaggaaata

SEQ ID NO: 2842373 - DNA, 14 bp, Homo sapiens
agttaggaaataaa

SEQ ID NO: 2842374 - DNA, 18 bp, Homo sapiens
agttaggaaataaaacct

SEQ ID NO: 2842375 - DNA, 17 bp, Homo sapiens
agttagggaatggcaca

SEQ ID NO: 2842376 - DNA, 16 bp, Homo sapiens
agttaggttataagaa

SEQ ID NO: 2842377 - DNA, 16 bp, Homo sapiens
agttagtttctttggg

SEQ ID NO: 2842378 - DNA, 17 bp, Homo sapiens
agttagtttctttggga

SEQ ID NO: 2842379 - DNA, 15 bp, Homo sapiens
agttataaaaataca

SEQ ID NO: 2842380 - DNA, 16 bp, Homo sapiens
agttataaaaatacaa

SEQ ID NO: 2842381 - DNA, 12 bp, Homo sapiens
agttataaatca

SEQ ID NO: 2842382 - DNA, 16 bp, Homo sapiens
agttatagtttgcttt

SEQ ID NO: 2842383 - DNA, 19 bp, Homo sapiens
agttatatttactttaaaa

SEQ ID NO: 2842384 - DNA, 21 bp, Homo sapiens
agttatccagagggttgtgat

SEQ ID NO: 2842385 - DNA, 13 bp, Homo sapiens
agttatgtgaatg

SEQ ID NO: 2842386 - DNA, 22 bp, Homo sapiens
agttattgtgttgccttagcac

SEQ ID NO: 2842387 - DNA, 22 bp, Homo sapiens
agttatttatgcctctgtattt

SEQ ID NO: 2842388 - DNA, 13 bp, Homo sapiens
agttattttagga

SEQ ID NO: 2842389 - DNA, 15 bp, Homo sapiens
agttcaaagaagtca

SEQ ID NO: 2842390 - DNA, 13 bp, Homo sapiens
agttcaagaaata

SEQ ID NO: 2842391 - DNA, 21 bp, Homo sapiens
agttcaataaatgtctgttga

SEQ ID NO: 2842392 - DNA, 16 bp, Homo sapiens
agttcaggagtcccaa

SEQ ID NO: 2842393 - DNA, 20 bp, Homo sapiens
agttcaggagtcccaaggaa

SEQ ID NO: 2842394 - DNA, 19 bp, Homo sapiens
agttcaggtaacaggcaga

SEQ ID NO: 2842395 - DNA, 18 bp, Homo sapiens
agttcatctatggcagtc

SEQ ID NO: 2842396 - DNA, 17 bp, Homo sapiens
agttccctacttcctgt

SEQ ID NO: 2842397 - DNA, 19 bp, Homo sapiens
agttccctgaaaacccaga

SEQ ID NO: 2842398 - DNA, 22 bp, Homo sapiens
agttccctgaacatctgtgtgt

SEQ ID NO: 2842399 - DNA, 14 bp, Homo sapiens
agttcctcgccctg

SEQ ID NO: 2842400 - DNA, 13 bp, Homo sapiens
agttcgcagccac

SEQ ID NO: 2842401 - DNA, 14 bp, Homo sapiens
agttcgcagccacc

SEQ ID NO: 2842402 - DNA, 13 bp, Homo sapiens
agttctagagaag

SEQ ID NO: 2842403 - DNA, 20 bp, Homo sapiens
agttctagagaagaggctgg

SEQ ID NO: 2842404 - DNA, 12 bp, Homo sapiens
agttctgaaaac

SEQ ID NO: 2842405 - DNA, 17 bp, Homo sapiens
agttctgaaaactgttt

SEQ ID NO: 2842406 - DNA, 14 bp, Homo sapiens
agttctgagtgttt

SEQ ID NO: 2842407 - DNA, 14 bp, Homo sapiens
agttctgctcctct

SEQ ID NO: 2842408 - DNA, 16 bp, Homo sapiens
agttctgctcctctcc

SEQ ID NO: 2842409 - DNA, 18 bp, Homo sapiens
agttctgctcctctccag

SEQ ID NO: 2842410 - DNA, 19 bp, Homo sapiens
agttctgctcctctccagg

SEQ ID NO: 2842411 - DNA, 16 bp, Homo sapiens
agttctttaggtgcct

SEQ ID NO: 2842412 - DNA, 21 bp, Homo sapiens
agttctttaggtgcctcctgt

SEQ ID NO: 2842413 - DNA, 16 bp, Homo sapiens
agttgaaaataaagtg

SEQ ID NO: 2842414 - DNA, 19 bp, Homo sapiens
agttgaaaataaagtgtat

SEQ ID NO: 2842415 - DNA, 16 bp, Homo sapiens
agttgaagctaagatt

SEQ ID NO: 2842416 - DNA, 16 bp, Homo sapiens
agttgacttactgttt

SEQ ID NO: 2842417 - DNA, 20 bp, Homo sapiens
agttgacttactgtttctta

SEQ ID NO: 2842418 - DNA, 15 bp, Homo sapiens
atacaaatatattta

SEQ ID NO: 2842419 - DNA, 16 bp, Homo sapiens
atacaactagagatat

SEQ ID NO: 2842420 - DNA, 14 bp, Homo sapiens
atacaataacataa

SEQ ID NO: 2842421 - DNA, 16 bp, Homo sapiens
atacaatgacaagtat

SEQ ID NO: 2842422 - DNA, 13 bp, Homo sapiens
atacaatttgcac

SEQ ID NO: 2842423 - DNA, 20 bp, Homo sapiens
atacactcaaacaatcatga

SEQ ID NO: 2842424 - DNA, 21 bp, Homo sapiens
atacactgaagttaacagaga

SEQ ID NO: 2842425 - DNA, 18 bp, Homo sapiens
atacagacactaagttat

SEQ ID NO: 2842426 - DNA, 23 bp, Homo sapiens
atacagacactaagttatagtat

SEQ ID NO: 2842427 - DNA, 14 bp, Homo sapiens
atacaggaaaagct

SEQ ID NO: 2842428 - DNA, 20 bp, Homo sapiens
atacaggaaaagctgctgac

SEQ ID NO: 2842429 - DNA, 17 bp, Homo sapiens
atacagtaaagtttaaa

SEQ ID NO: 2842430 - DNA, 19 bp, Homo sapiens
atacagtaagctgctctat

SEQ ID NO: 2842431 - DNA, 13 bp, Homo sapiens
atacatagtcaca

SEQ ID NO: 2842432 - DNA, 15 bp, Homo sapiens
atacatatcagaaaa

SEQ ID NO: 2842433 - DNA, 16 bp, Homo sapiens
atacatgactcagcat

SEQ ID NO: 2842434 - DNA, 18 bp, Homo sapiens
atacatgctaagagaagt

SEQ ID NO: 2842435 - DNA, 21 bp, Homo sapiens
atacattttatatctggattt

SEQ ID NO: 2842436 - DNA, 11 bp, Homo sapiens
ataccaagtgt

SEQ ID NO: 2842437 - DNA, 14 bp, Homo sapiens
ataccaggttgaaa

SEQ ID NO: 2842438 - DNA, 16 bp, Homo sapiens
ataccaggttgaaaga

SEQ ID NO: 2842439 - DNA, 15 bp, Homo sapiens
ataccatctgctgcc

SEQ ID NO: 2842440 - DNA, 22 bp, Homo sapiens
ataccatctgctgccccgcttc

SEQ ID NO: 2842441 - DNA, 18 bp, Homo sapiens
atacccatagcttccatg

SEQ ID NO: 2842442 - DNA, 17 bp, Homo sapiens
ataccccaagtccacct

SEQ ID NO: 2842443 - DNA, 12 bp, Homo sapiens
ataccctccccc

SEQ ID NO: 2842444 - DNA, 19 bp, Homo sapiens
atacctactgactgatgac

SEQ ID NO: 2842445 - DNA, 18 bp, Homo sapiens
atacctcaacctatggta

SEQ ID NO: 2842446 - DNA, 21 bp, Homo sapiens
atacctctctctatatataca

SEQ ID NO: 2842447 - DNA, 16 bp, Homo sapiens
ataccttgaaaaagta

SEQ ID NO: 2842448 - DNA, 18 bp, Homo sapiens
atactaaaaatcatgaga

SEQ ID NO: 2842449 - DNA, 18 bp, Homo sapiens
atactctagaacatgcac

SEQ ID NO: 2842450 - DNA, 19 bp, Homo sapiens
atactctagaacatgcaca

SEQ ID NO: 2842451 - DNA, 13 bp, Homo sapiens
atactctgtcaga

SEQ ID NO: 2842452 - DNA, 14 bp, Homo sapiens
atactctgtcagat

SEQ ID NO: 2842453 - DNA, 15 bp, Homo sapiens
atactctgtcagatg

SEQ ID NO: 2842454 - DNA, 16 bp, Homo sapiens
atactctgtcagatgg

SEQ ID NO: 2842455 - DNA, 22 bp, Homo sapiens
atactcttaggaagagaaacca

SEQ ID NO: 2842456 - DNA, 21 bp, Homo sapiens
atactgcctagaaaatgcaaa

SEQ ID NO: 2842457 - DNA, 16 bp, Homo sapiens
atactggaagttttgc

SEQ ID NO: 2842458 - DNA, 17 bp, Homo sapiens
atactggaagttttgca

SEQ ID NO: 2842459 - DNA, 20 bp, Homo sapiens
atactggaagttttgcattt

SEQ ID NO: 2842460 - DNA, 21 bp, Homo sapiens
atactgtcggttttttttaaa

SEQ ID NO: 2842461 - DNA, 22 bp, Homo sapiens
atacttagcaaagttttacctg

SEQ ID NO: 2842462 - DNA, 16 bp, Homo sapiens
atacttctcatttttt

SEQ ID NO: 2842463 - DNA, 19 bp, Homo sapiens
atacttttttcttatttaa

SEQ ID NO: 2842464 - DNA, 13 bp, Homo sapiens
atagaatatttat

SEQ ID NO: 2842465 - DNA, 14 bp, Homo sapiens
atagacagaagaaa

SEQ ID NO: 2842466 - DNA, 19 bp, Homo sapiens
atagacagaagaaacaagg

SEQ ID NO: 2842467 - DNA, 20 bp, Homo sapiens
atagacagtatatttatagt

SEQ ID NO: 2842468 - DNA, 19 bp, Homo sapiens
atagagaaaaactttcatt

SEQ ID NO: 2842469 - DNA, 16 bp, Homo sapiens
atagagtatactaaaa

SEQ ID NO: 2842470 - DNA, 17 bp, Homo sapiens
atagagtatactaaaaa

SEQ ID NO: 2842471 - DNA, 17 bp, Homo sapiens
atagatcacggcatgtt

SEQ ID NO: 2842472 - DNA, 18 bp, Homo sapiens
atagatcacggcatgttt

SEQ ID NO: 2842473 - DNA, 15 bp, Homo sapiens
atagcaaaagaagaa

SEQ ID NO: 2842474 - DNA, 13 bp, Homo sapiens
atagcaaagaatt

SEQ ID NO: 2842475 - DNA, 15 bp, Homo sapiens
atagcaaagaattga

SEQ ID NO: 2842476 - DNA, 16 bp, Homo sapiens
atagcaacactctata

SEQ ID NO: 2842477 - DNA, 19 bp, Homo sapiens
atagcaagacacatcccta

SEQ ID NO: 2842478 - DNA, 14 bp, Homo sapiens
atagcacaggctaa

SEQ ID NO: 2842479 - DNA, 21 bp, Homo sapiens
atagcactgggaactctggct

SEQ ID NO: 2842480 - DNA, 19 bp, Homo sapiens
atagcatctgctcttctct

SEQ ID NO: 2842481 - DNA, 18 bp, Homo sapiens
atagccaaaaatagctaa

SEQ ID NO: 2842482 - DNA, 19 bp, Homo sapiens
atagccacttaccttcaat

SEQ ID NO: 2842483 - DNA, 15 bp, Homo sapiens
atagcctaggtgaca

SEQ ID NO: 2842484 - DNA, 20 bp, Homo sapiens
atagctattgcatgtaaaat

SEQ ID NO: 2842485 - DNA, 21 bp, Homo sapiens
atagctcaggtgtccctgcac

SEQ ID NO: 2842486 - DNA, 19 bp, Homo sapiens
atagctcttctatttaaaa

SEQ ID NO: 2842487 - DNA, 15 bp, Homo sapiens
atagctctttcaggg

SEQ ID NO: 2842488 - DNA, 14 bp, Homo sapiens
atagctgatcagtt

SEQ ID NO: 2842489 - DNA, 24 bp, Homo sapiens
atagctgggaacccgactgtgaaa

SEQ ID NO: 2842490 - DNA, 22 bp, Homo sapiens
atagctttattttttaagtatt

SEQ ID NO: 2842491 - DNA, 11 bp, Homo sapiens
ataggaagcat

SEQ ID NO: 2842492 - DNA, 23 bp, Homo sapiens
ataggatttatttaaaatagcaa

SEQ ID NO: 2842493 - DNA, 21 bp, Homo sapiens
ataggccctggatgtgcccac

SEQ ID NO: 2842494 - DNA, 22 bp, Homo sapiens
ataggccctggatgtgcccaca

SEQ ID NO: 2842495 - DNA, 13 bp, Homo sapiens
ataggctggagaa

SEQ ID NO: 2842496 - DNA, 14 bp, Homo sapiens
ataggctggagaag

SEQ ID NO: 2842497 - DNA, 21 bp, Homo sapiens
ataggctggagaagctcaccc

SEQ ID NO: 2842498 - DNA, 23 bp, Homo sapiens
atagggaagagagaaacatttat

SEQ ID NO: 2842499 - DNA, 21 bp, Homo sapiens
atagggtctcttcaggttctt

SEQ ID NO: 2842500 - DNA, 18 bp, Homo sapiens
ataggtagaatgtaaagc

SEQ ID NO: 2842501 - DNA, 12 bp, Homo sapiens
ataggtttccac

SEQ ID NO: 2842502 - DNA, 19 bp, Homo sapiens
atagtaaatcacgcttttt

SEQ ID NO: 2842503 - DNA, 22 bp, Homo sapiens
atagtaactactttttatactc

SEQ ID NO: 2842504 - DNA, 20 bp, Homo sapiens
atagtagcagagtcattgtt

SEQ ID NO: 2842505 - DNA, 17 bp, Homo sapiens
atagtatggtggctggg

SEQ ID NO: 2842506 - DNA, 16 bp, Homo sapiens
atatgtaaaacattta

SEQ ID NO: 2842507 - DNA, 14 bp, Homo sapiens
atatgtaaaataaa

SEQ ID NO: 2842508 - DNA, 16 bp, Homo sapiens
atatgtaaaataaaat

SEQ ID NO: 2842509 - DNA, 23 bp, Homo sapiens
agtacttgggagacctgtaatca

SEQ ID NO: 2842510 - DNA, 14 bp, Homo sapiens
agtagaaattgttc

SEQ ID NO: 2842511 - DNA, 13 bp, Homo sapiens
agtagaattatat

SEQ ID NO: 2842512 - DNA, 14 bp, Homo sapiens
agtctcctctctga

SEQ ID NO: 2842513 - DNA, 18 bp, Homo sapiens
agtctcctttgcactgag

SEQ ID NO: 2842514 - DNA, 18 bp, Homo sapiens
agtctctgactcttgcct

SEQ ID NO: 2842515 - DNA, 12 bp, Homo sapiens
agtctcttcaga

SEQ ID NO: 2842516 - DNA, 22 bp, Homo sapiens
agtctctttaatcttcagtttt

SEQ ID NO: 2842517 - DNA, 14 bp, Homo sapiens
agtctgaggtcctg

SEQ ID NO: 2842518 - DNA, 20 bp, Homo sapiens
agtctgattcccaagctctg

SEQ ID NO: 2842519 - DNA, 22 bp, Homo sapiens
agtctgattcccaagctctgct

SEQ ID NO: 2842520 - DNA, 20 bp, Homo sapiens
agtctggtttctagacttgt

SEQ ID NO: 2842521 - DNA, 17 bp, Homo sapiens
agtctgtctcaaaagaa

SEQ ID NO: 2842522 - DNA, 23 bp, Homo sapiens
agtctttccgtctccctaaaata

SEQ ID NO: 2842523 - DNA, 13 bp, Homo sapiens
agtcttttactcc

SEQ ID NO: 2842524 - DNA, 14 bp, Homo sapiens
agtgaaaataggta

SEQ ID NO: 2842525 - DNA, 14 bp, Homo sapiens
agtgaaagcatcac

SEQ ID NO: 2842526 - DNA, 19 bp, Homo sapiens
agtgaacaactatttataa

SEQ ID NO: 2842527 - DNA, 15 bp, Homo sapiens
agtgaaccaaagaga

SEQ ID NO: 2842528 - DNA, 22 bp, Homo sapiens
agtgaaccaaagagactggagc

SEQ ID NO: 2842529 - DNA, 16 bp, Homo sapiens
agtgaagaaaagtgaa

SEQ ID NO: 2842530 - DNA, 19 bp, Homo sapiens
agtgaagaaaagtgaatgc

SEQ ID NO: 2842531 - DNA, 22 bp, Homo sapiens
agtgaagaatacttctcatttt

SEQ ID NO: 2842532 - DNA, 22 bp, Homo sapiens
agtgaagttcttttactgtaat

SEQ ID NO: 2842533 - DNA, 13 bp, Homo sapiens
agtgaataaactt

SEQ ID NO: 2842534 - DNA, 14 bp, Homo sapiens
agtgaataaacttc

SEQ ID NO: 2842535 - DNA, 16 bp, Homo sapiens
agtgaataaacttcag

SEQ ID NO: 2842536 - DNA, 23 bp, Homo sapiens
agtgacaaaattggccagagagt

SEQ ID NO: 2842537 - DNA, 19 bp, Homo sapiens
agtgacagaggcagcccca

SEQ ID NO: 2842538 - DNA, 22 bp, Homo sapiens
agtgacatgggtgtgccaggct

SEQ ID NO: 2842539 - DNA, 21 bp, Homo sapiens
agtgaccaggctcacaactgt

SEQ ID NO: 2842540 - DNA, 18 bp, Homo sapiens
agtgactctatatagctg

SEQ ID NO: 2842541 - DNA, 19 bp, Homo sapiens
agtgactgtcgtgtttaca

SEQ ID NO: 2842542 - DNA, 23 bp, Homo sapiens
agtgactgtcgtgtttacaaaag

SEQ ID NO: 2842543 - DNA, 13 bp, Homo sapiens
agtgagactctgt

SEQ ID NO: 2842544 - DNA, 22 bp, Homo sapiens
agtgagactctgtctcaaaaaa

SEQ ID NO: 2842545 - DNA, 18 bp, Homo sapiens
agtgagactgacacctca

SEQ ID NO: 2842546 - DNA, 17 bp, Homo sapiens
agtgagatttgtattta

SEQ ID NO: 2842547 - DNA, 19 bp, Homo sapiens
agtgagatttgtatttata

SEQ ID NO: 2842548 - DNA, 22 bp, Homo sapiens
agtgagcactaaggtgtgctct

SEQ ID NO: 2842549 - DNA, 19 bp, Homo sapiens
agtgagccgcatcttctcc

SEQ ID NO: 2842550 - DNA, 23 bp, Homo sapiens
agtgagctgagatcgtgccgtta

SEQ ID NO: 2842551 - DNA, 19 bp, Homo sapiens
agtgataatttctggaatt

SEQ ID NO: 2842552 - DNA, 17 bp, Homo sapiens
agtgatacaacttcaag

SEQ ID NO: 2842553 - DNA, 23 bp, Homo sapiens
agtgatacaacttcaagtgcatg

SEQ ID NO: 2842554 - DNA, 20 bp, Homo sapiens
agtgatcagtatgctgtttt

SEQ ID NO: 2842555 - DNA, 14 bp, Homo sapiens
agtgatcctcccac

SEQ ID NO: 2842556 - DNA, 22 bp, Homo sapiens
agtgatcctcccacctcagcct

SEQ ID NO: 2842557 - DNA, 14 bp, Homo sapiens
agtgatctccatat

SEQ ID NO: 2842558 - DNA, 19 bp, Homo sapiens
agtgatggtctcacagagc

SEQ ID NO: 2842559 - DNA, 14 bp, Homo sapiens
agtgattctcctgc

SEQ ID NO: 2842560 - DNA, 19 bp, Homo sapiens
agtgattctcctgcctcag

SEQ ID NO: 2842561 - DNA, 15 bp, Homo sapiens
agtgattgtcttaat

SEQ ID NO: 2842562 - DNA, 18 bp, Homo sapiens
agtgcacttgctggaaga

SEQ ID NO: 2842563 - DNA, 17 bp, Homo sapiens
agtgcatgctctctgca

SEQ ID NO: 2842564 - DNA, 17 bp, Homo sapiens
agtgcattttcccagat

SEQ ID NO: 2842565 - DNA, 10 bp, Homo sapiens
agtgccacag

SEQ ID NO: 2842566 - DNA, 13 bp, Homo sapiens
agtgccacagaga

SEQ ID NO: 2842567 - DNA, 15 bp, Homo sapiens
agtgccacagagaag

SEQ ID NO: 2842568 - DNA, 13 bp, Homo sapiens
agtgccaggactc

SEQ ID NO: 2842569 - DNA, 16 bp, Homo sapiens
agtgcccaccaacatc

SEQ ID NO: 2842570 - DNA, 16 bp, Homo sapiens
agtgccctccacagcc

SEQ ID NO: 2842571 - DNA, 17 bp, Homo sapiens
agtgccttacctcctgc

SEQ ID NO: 2842572 - DNA, 18 bp, Homo sapiens
agtgccttacctcctgcc

SEQ ID NO: 2842573 - DNA, 21 bp, Homo sapiens
agtgccttacctcctgcccag

SEQ ID NO: 2842574 - DNA, 22 bp, Homo sapiens
agtgccttacctcctgcccagg

SEQ ID NO: 2842575 - DNA, 18 bp, Homo sapiens
agtgctgagaaggacacc

SEQ ID NO: 2842576 - DNA, 20 bp, Homo sapiens
agtgctgggattacaagcgt

SEQ ID NO: 2842577 - DNA, 20 bp, Homo sapiens
agtgctgggattacaggtgt

SEQ ID NO: 2842578 - DNA, 16 bp, Homo sapiens
agtgctgtggcctggg

SEQ ID NO: 2842579 - DNA, 17 bp, Homo sapiens
agtgctgtggcctgggc

SEQ ID NO: 2842580 - DNA, 18 bp, Homo sapiens
agtgctgtggcctgggca

SEQ ID NO: 2842581 - DNA, 15 bp, Homo sapiens
agtgctgttctggag

SEQ ID NO: 2842582 - DNA, 22 bp, Homo sapiens
agtgctgttttgtcctttgaga

SEQ ID NO: 2842583 - DNA, 13 bp, Homo sapiens
agtgcttagaaag

SEQ ID NO: 2842584 - DNA, 14 bp, Homo sapiens
agtgcttagaaagt

SEQ ID NO: 2842585 - DNA, 16 bp, Homo sapiens
agtgcttagaaagtta

SEQ ID NO: 2842586 - DNA, 20 bp, Homo sapiens
agtgcttagaaagttattgt

SEQ ID NO: 2842587 - DNA, 23 bp, Homo sapiens
agtgctttacctttattaatgaa

SEQ ID NO: 2842588 - DNA, 15 bp, Homo sapiens
agtgctttattttgt

SEQ ID NO: 2842589 - DNA, 14 bp, Homo sapiens
agtggacaacaggt

SEQ ID NO: 2842590 - DNA, 12 bp, Homo sapiens
agtggagaaata

SEQ ID NO: 2842591 - DNA, 11 bp, Homo sapiens
agtggctgctg

SEQ ID NO: 2842592 - DNA, 12 bp, Homo sapiens
agtggcttcctc

SEQ ID NO: 2842593 - DNA, 14 bp, Homo sapiens
agtggcttcctccg

SEQ ID NO: 2842594 - DNA, 21 bp, Homo sapiens
agtgggacaaaccagagcaga

SEQ ID NO: 2842595 - DNA, 18 bp, Homo sapiens
agtgggacccatagatct

SEQ ID NO: 2842596 - DNA, 21 bp, Homo sapiens
agtgggacccatagatcttct

SEQ ID NO: 2842597 - DNA, 13 bp, Homo sapiens
agtgggagaaaac

SEQ ID NO: 2842598 - DNA, 14 bp, Homo sapiens
agtgggagaaaaca

SEQ ID NO: 2842599 - DNA, 14 bp, Homo sapiens
agtgggagctgcct

SEQ ID NO: 2842600 - DNA, 20 bp, Homo sapiens
aggtcctggtggggcagctc

SEQ ID NO: 2842601 - DNA, 22 bp, Homo sapiens
aggtcctggtggggcagctcct

SEQ ID NO: 2842602 - DNA, 13 bp, Homo sapiens
aggtctagacttt

SEQ ID NO: 2842603 - DNA, 15 bp, Homo sapiens
aggtctagactttct

SEQ ID NO: 2842604 - DNA, 20 bp, Homo sapiens
aggtctagactttctcagtg

SEQ ID NO: 2842605 - DNA, 23 bp, Homo sapiens
aggtctcctcttaaaaaataaaa

SEQ ID NO: 2842606 - DNA, 20 bp, Homo sapiens
aggtctctccactgctctca

SEQ ID NO: 2842607 - DNA, 15 bp, Homo sapiens
aggtctgaaatggag

SEQ ID NO: 2842608 - DNA, 16 bp, Homo sapiens
aggtcttgaactcctg

SEQ ID NO: 2842609 - DNA, 20 bp, Homo sapiens
aggtcttgaactcctggcct

SEQ ID NO: 2842610 - DNA, 19 bp, Homo sapiens
aggtcttggccgactcagg

SEQ ID NO: 2842611 - DNA, 13 bp, Homo sapiens
aggtgacagagtg

SEQ ID NO: 2842612 - DNA, 15 bp, Homo sapiens
aggtgacagagtgag

SEQ ID NO: 2842613 - DNA, 22 bp, Homo sapiens
aggtgacagagtgagactctgt

SEQ ID NO: 2842614 - DNA, 13 bp, Homo sapiens
aggtgaccccagg

SEQ ID NO: 2842615 - DNA, 15 bp, Homo sapiens
aggtgaccccagggc

SEQ ID NO: 2842616 - DNA, 16 bp, Homo sapiens
aggtgaccccagggca

SEQ ID NO: 2842617 - DNA, 18 bp, Homo sapiens
aggtgaccccagggcaca

SEQ ID NO: 2842618 - DNA, 16 bp, Homo sapiens
aggtgagaccacctct

SEQ ID NO: 2842619 - DNA, 23 bp, Homo sapiens
aggtgatccacccacctcagcct

SEQ ID NO: 2842620 - DNA, 16 bp, Homo sapiens
aggtgcagtggctcac

SEQ ID NO: 2842621 - DNA, 12 bp, Homo sapiens
aggtgcccagga

SEQ ID NO: 2842622 - DNA, 15 bp, Homo sapiens
aggtgcccaggagaa

SEQ ID NO: 2842623 - DNA, 17 bp, Homo sapiens
aggtgccccaaaatgca

SEQ ID NO: 2842624 - DNA, 15 bp, Homo sapiens
aggtgcctcctgtct

SEQ ID NO: 2842625 - DNA, 20 bp, Homo sapiens
aggtgcctgtgaggcagggg

SEQ ID NO: 2842626 - DNA, 22 bp, Homo sapiens
aggtgcctgtgaggcaggggcg

SEQ ID NO: 2842627 - DNA, 16 bp, Homo sapiens
aggtgcggccaccacc

SEQ ID NO: 2842628 - DNA, 21 bp, Homo sapiens
aggtgcttcaggataccatat

SEQ ID NO: 2842629 - DNA, 13 bp, Homo sapiens
aggtggaaaaaca

SEQ ID NO: 2842630 - DNA, 19 bp, Homo sapiens
aggtggaagccctccttcc

SEQ ID NO: 2842631 - DNA, 20 bp, Homo sapiens
aggtggaggttgcagtgagc

SEQ ID NO: 2842632 - DNA, 13 bp, Homo sapiens
aggtggcagccct

SEQ ID NO: 2842633 - DNA, 14 bp, Homo sapiens
aggtggcaggacca

SEQ ID NO: 2842634 - DNA, 17 bp, Homo sapiens
aggtggctatggccacc

SEQ ID NO: 2842635 - DNA, 23 bp, Homo sapiens
aggtgggaaatggtatgagctga

SEQ ID NO: 2842636 - DNA, 12 bp, Homo sapiens
aggtgggcagca

SEQ ID NO: 2842637 - DNA, 17 bp, Homo sapiens
aggtgggcagcagctca

SEQ ID NO: 2842638 - DNA, 18 bp, Homo sapiens
aggtgggcagcagctcag

SEQ ID NO: 2842639 - DNA, 16 bp, Homo sapiens
aggtgggctgagccct

SEQ ID NO: 2842640 - DNA, 18 bp, Homo sapiens
aggtgggctgagccctgg

SEQ ID NO: 2842641 - DNA, 23 bp, Homo sapiens
aggtggggcagcttgagggttgg

SEQ ID NO: 2842642 - DNA, 21 bp, Homo sapiens
aggtggggtctttgtgagagt

SEQ ID NO: 2842643 - DNA, 22 bp, Homo sapiens
aggtggggtctttgtgagagtg

SEQ ID NO: 2842644 - DNA, 14 bp, Homo sapiens
aggtgtaaatatag

SEQ ID NO: 2842645 - DNA, 14 bp, Homo sapiens
aggtgtctatccac

SEQ ID NO: 2842646 - DNA, 21 bp, Homo sapiens
aggtgtctatccacctggggt

SEQ ID NO: 2842647 - DNA, 16 bp, Homo sapiens
aggtgtctgcacccag

SEQ ID NO: 2842648 - DNA, 17 bp, Homo sapiens
aggtgtctgcacccagg

SEQ ID NO: 2842649 - DNA, 17 bp, Homo sapiens
aggtgtgaaccaccaca

SEQ ID NO: 2842650 - DNA, 22 bp, Homo sapiens
aggtgtgaaccaccacacccag

SEQ ID NO: 2842651 - DNA, 14 bp, Homo sapiens
aggtgtttatacag

SEQ ID NO: 2842652 - DNA, 21 bp, Homo sapiens
aggttaccctgtaacatgcaa

SEQ ID NO: 2842653 - DNA, 14 bp, Homo sapiens
aggttagtgacaaa

SEQ ID NO: 2842654 - DNA, 11 bp, Homo sapiens
aggttctaaaa

SEQ ID NO: 2842655 - DNA, 21 bp, Homo sapiens
aggttgacaataaatgtgctt

SEQ ID NO: 2842656 - DNA, 16 bp, Homo sapiens
aggttgactcaagttt

SEQ ID NO: 2842657 - DNA, 17 bp, Homo sapiens
aggttgaggggctcctg

SEQ ID NO: 2842658 - DNA, 20 bp, Homo sapiens
aggttgcagtgagctgagat

SEQ ID NO: 2842659 - DNA, 14 bp, Homo sapiens
aggtttatgaaaaa

SEQ ID NO: 2842660 - DNA, 22 bp, Homo sapiens
aggtttggggagggggaagaga

SEQ ID NO: 2842661 - DNA, 13 bp, Homo sapiens
aggtttgtatatt

SEQ ID NO: 2842662 - DNA, 14 bp, Homo sapiens
aggttttctccact

SEQ ID NO: 2842663 - DNA, 19 bp, Homo sapiens
aggtttttgtttgtttcct

SEQ ID NO: 2842664 - DNA, 16 bp, Homo sapiens
agtaaaagcaaaaaag

SEQ ID NO: 2842665 - DNA, 15 bp, Homo sapiens
agtaaaagctaatta

SEQ ID NO: 2842666 - DNA, 19 bp, Homo sapiens
agtaaagtgataatttctg

SEQ ID NO: 2842667 - DNA, 14 bp, Homo sapiens
agtaaatatttcag

SEQ ID NO: 2842668 - DNA, 20 bp, Homo sapiens
agtaaatcacgctttttgaa

SEQ ID NO: 2842669 - DNA, 14 bp, Homo sapiens
agtaacttttacaa

SEQ ID NO: 2842670 - DNA, 20 bp, Homo sapiens
agtaagctgctctattgtag

SEQ ID NO: 2842671 - DNA, 17 bp, Homo sapiens
agtaagtaccactcagg

SEQ ID NO: 2842672 - DNA, 20 bp, Homo sapiens
agtaagttctgaaaactgtt

SEQ ID NO: 2842673 - DNA, 21 bp, Homo sapiens
agtaagttctgaaaactgttt

SEQ ID NO: 2842674 - DNA, 22 bp, Homo sapiens
agtaattatcgggaacagtgtt

SEQ ID NO: 2842675 - DNA, 14 bp, Homo sapiens
agtaatttagaaat

SEQ ID NO: 2842676 - DNA, 19 bp, Homo sapiens
agtacagtagcttaaataa

SEQ ID NO: 2842677 - DNA, 20 bp, Homo sapiens
agtacagtagcttaaataaa

SEQ ID NO: 2842678 - DNA, 16 bp, Homo sapiens
agtaccaatcatttta

SEQ ID NO: 2842679 - DNA, 15 bp, Homo sapiens
agtaccactcaggcc

SEQ ID NO: 2842680 - DNA, 18 bp, Homo sapiens
agtacctgtagtgagaaa

SEQ ID NO: 2842681 - DNA, 13 bp, Homo sapiens
agtacctttgtca

SEQ ID NO: 2842682 - DNA, 21 bp, Homo sapiens
agtactcctgcaaaattttat

SEQ ID NO: 2842683 - DNA, 19 bp, Homo sapiens
agtacttctccaccctgct

SEQ ID NO: 2842684 - DNA, 14 bp, Homo sapiens
agtacttgatttca

SEQ ID NO: 2842685 - DNA, 19 bp, Homo sapiens
agcccaggagtttgaggct

SEQ ID NO: 2842686 - DNA, 16 bp, Homo sapiens
agcccagggaggccga

SEQ ID NO: 2842687 - DNA, 19 bp, Homo sapiens
agcccattctctctcctgt

SEQ ID NO: 2842688 - DNA, 20 bp, Homo sapiens
agcccattctctctcctgtc

SEQ ID NO: 2842689 - DNA, 21 bp, Homo sapiens
agcccattctctctcctgtcc

SEQ ID NO: 2842690 - DNA, 15 bp, Homo sapiens
agccccagcactaac

SEQ ID NO: 2842691 - DNA, 16 bp, Homo sapiens
agccccattctgcctg

SEQ ID NO: 2842692 - DNA, 17 bp, Homo sapiens
agccccattctgcctgc

SEQ ID NO: 2842693 - DNA, 19 bp, Homo sapiens
agccccattctgcctgccc

SEQ ID NO: 2842694 - DNA, 21 bp, Homo sapiens
agccccattctgcctgcccag

SEQ ID NO: 2842695 - DNA, 23 bp, Homo sapiens
agcccccacctccgccccagaca

SEQ ID NO: 2842696 - DNA, 16 bp, Homo sapiens
agcccccacttctctc

SEQ ID NO: 2842697 - DNA, 15 bp, Homo sapiens
agccccgactccagc

SEQ ID NO: 2842698 - DNA, 18 bp, Homo sapiens
agccccgactccagccag

SEQ ID NO: 2842699 - DNA, 20 bp, Homo sapiens
agccccgactccagccagcg

SEQ ID NO: 2842700 - DNA, 22 bp, Homo sapiens
agccccgactccagccagcgcc

SEQ ID NO: 2842701 - DNA, 16 bp, Homo sapiens
agccccgaggccttct

SEQ ID NO: 2842702 - DNA, 15 bp, Homo sapiens
agccccgcgcctcct

SEQ ID NO: 2842703 - DNA, 18 bp, Homo sapiens
agccccgcgcctccttcc

SEQ ID NO: 2842704 - DNA, 17 bp, Homo sapiens
agccccgggcctgcctc

SEQ ID NO: 2842705 - DNA, 19 bp, Homo sapiens
agccccgggcctgcctctg

SEQ ID NO: 2842706 - DNA, 17 bp, Homo sapiens
agcccctcctccccttc

SEQ ID NO: 2842707 - DNA, 22 bp, Homo sapiens
agcccctcctccccttcctgca

SEQ ID NO: 2842708 - DNA, 15 bp, Homo sapiens
agcccctcctctgcc

SEQ ID NO: 2842709 - DNA, 20 bp, Homo sapiens
agcccctcctctgccacctc

SEQ ID NO: 2842710 - DNA, 21 bp, Homo sapiens
agcccctcttttcccacattc

SEQ ID NO: 2842711 - DNA, 21 bp, Homo sapiens
agccccttactatgatctcag

SEQ ID NO: 2842712 - DNA, 23 bp, Homo sapiens
agccccttactatgatctcagga

SEQ ID NO: 2842713 - DNA, 11 bp, Homo sapiens
agcccggcctg

SEQ ID NO: 2842714 - DNA, 20 bp, Homo sapiens
agcccggcgccaccatcctg

SEQ ID NO: 2842715 - DNA, 15 bp, Homo sapiens
agccctaaacatcat

SEQ ID NO: 2842716 - DNA, 21 bp, Homo sapiens
agccctaaacatcattcttga

SEQ ID NO: 2842717 - DNA, 15 bp, Homo sapiens
agccctatggatgtg

SEQ ID NO: 2842718 - DNA, 21 bp, Homo sapiens
agccctccctgtcctcctcgg

SEQ ID NO: 2842719 - DNA, 12 bp, Homo sapiens
agccctccttcc

SEQ ID NO: 2842720 - DNA, 17 bp, Homo sapiens
agccctccttccacgga

SEQ ID NO: 2842721 - DNA, 23 bp, Homo sapiens
agccctgcagccaaacagagcct

SEQ ID NO: 2842722 - DNA, 20 bp, Homo sapiens
agccctgcctggaggacctg

SEQ ID NO: 2842723 - DNA, 21 bp, Homo sapiens
agccctgcctggaggacctga

SEQ ID NO: 2842724 - DNA, 19 bp, Homo sapiens
agccctgcggagccggcac

SEQ ID NO: 2842725 - DNA, 11 bp, Homo sapiens
agccctgggac

SEQ ID NO: 2842726 - DNA, 17 bp, Homo sapiens
agccctgggccccacca

SEQ ID NO: 2842727 - DNA, 19 bp, Homo sapiens
agccctgggccccaccacc

SEQ ID NO: 2842728 - DNA, 15 bp, Homo sapiens
agccctggtggcagt

SEQ ID NO: 2842729 - DNA, 21 bp, Homo sapiens
agccctggtggcagtgggagc

SEQ ID NO: 2842730 - DNA, 23 bp, Homo sapiens
agccctggtggcagtgggagctg

SEQ ID NO: 2842731 - DNA, 21 bp, Homo sapiens
agccctgtcgagacacttgcc

SEQ ID NO: 2842732 - DNA, 23 bp, Homo sapiens
agccctgtcgagacacttgcctt

SEQ ID NO: 2842733 - DNA, 16 bp, Homo sapiens
agcccttagcagggaa

SEQ ID NO: 2842734 - DNA, 13 bp, Homo sapiens
agcccttcatttg

SEQ ID NO: 2842735 - DNA, 14 bp, Homo sapiens
agcccttccagtgg

SEQ ID NO: 2842736 - DNA, 14 bp, Homo sapiens
agcccttccctgct

SEQ ID NO: 2842737 - DNA, 17 bp, Homo sapiens
agcccttccctgctttg

SEQ ID NO: 2842738 - DNA, 21 bp, Homo sapiens
agccctttgggaggctgaggc

SEQ ID NO: 2842739 - DNA, 15 bp, Homo sapiens
agccgacctcagcct

SEQ ID NO: 2842740 - DNA, 14 bp, Homo sapiens
agccgagagcctgc

SEQ ID NO: 2842741 - DNA, 15 bp, Homo sapiens
agccgagagcctgct

SEQ ID NO: 2842742 - DNA, 16 bp, Homo sapiens
agccgagagcctgctc

SEQ ID NO: 2842743 - DNA, 14 bp, Homo sapiens
agccgcagcctccc

SEQ ID NO: 2842744 - DNA, 17 bp, Homo sapiens
agccgcatcttctccat

SEQ ID NO: 2842745 - DNA, 22 bp, Homo sapiens
agccgctcctgtctgccagcca

SEQ ID NO: 2842746 - DNA, 22 bp, Homo sapiens
agccggcacctacatccccagg

SEQ ID NO: 2842747 - DNA, 19 bp, Homo sapiens
agccgtcagccaaatgtaa

SEQ ID NO: 2842748 - DNA, 19 bp, Homo sapiens
agcctaaatctaatcaggt

SEQ ID NO: 2842749 - DNA, 15 bp, Homo sapiens
agcctcaacctcctg

SEQ ID NO: 2842750 - DNA, 17 bp, Homo sapiens
agcctcaacctcctggg

SEQ ID NO: 2842751 - DNA, 21 bp, Homo sapiens
agcctcaagtcttatttcctc

SEQ ID NO: 2842752 - DNA, 23 bp, Homo sapiens
agcagggccggggaactggccaa

SEQ ID NO: 2842753 - DNA, 22 bp, Homo sapiens
agcaggggtccttggtgtgacc

SEQ ID NO: 2842754 - DNA, 18 bp, Homo sapiens
agcagggtagtctggttt

SEQ ID NO: 2842755 - DNA, 21 bp, Homo sapiens
agcagggtagtctggtttcta

SEQ ID NO: 2842756 - DNA, 14 bp, Homo sapiens
agcaggtaagagct

SEQ ID NO: 2842757 - DNA, 17 bp, Homo sapiens
agcaggtggtcctgaga

SEQ ID NO: 2842758 - DNA, 15 bp, Homo sapiens
agcagtatgaatgat

SEQ ID NO: 2842759 - DNA, 13 bp, Homo sapiens
agcagtcacactg

SEQ ID NO: 2842760 - DNA, 23 bp, Homo sapiens
agcagtgagttacagcgagaggc

SEQ ID NO: 2842761 - DNA, 16 bp, Homo sapiens
agcagtgcttgtaaac

SEQ ID NO: 2842762 - DNA, 19 bp, Homo sapiens
agcagtggacaccaggagt

SEQ ID NO: 2842763 - DNA, 20 bp, Homo sapiens
agcagtgtcttccataatgt

SEQ ID NO: 2842764 - DNA, 12 bp, Homo sapiens
agcagtgttttc

SEQ ID NO: 2842765 - DNA, 15 bp, Homo sapiens
agcagttaactttaa

SEQ ID NO: 2842766 - DNA, 14 bp, Homo sapiens
agcataaatgcaaa

SEQ ID NO: 2842767 - DNA, 16 bp, Homo sapiens
agcatacctttattgt

SEQ ID NO: 2842768 - DNA, 16 bp, Homo sapiens
agcatcacctcaggcc

SEQ ID NO: 2842769 - DNA, 21 bp, Homo sapiens
agcatcatgcctctgaggcca

SEQ ID NO: 2842770 - DNA, 22 bp, Homo sapiens
agcatcatgcctctgaggccag

SEQ ID NO: 2842771 - DNA, 23 bp, Homo sapiens
agcatcatgcctctgaggccagc

SEQ ID NO: 2842772 - DNA, 21 bp, Homo sapiens
agcatcattatttgcagagac

SEQ ID NO: 2842773 - DNA, 21 bp, Homo sapiens
agcatccttttctgcagaggg

SEQ ID NO: 2842774 - DNA, 20 bp, Homo sapiens
agcatctctgtgtacccact

SEQ ID NO: 2842775 - DNA, 13 bp, Homo sapiens
agcatctgctaat

SEQ ID NO: 2842776 - DNA, 13 bp, Homo sapiens
agcatctgctctt

SEQ ID NO: 2842777 - DNA, 18 bp, Homo sapiens
agcatgatcttgttaatg

SEQ ID NO: 2842778 - DNA, 13 bp, Homo sapiens
agcctcactgata

SEQ ID NO: 2842779 - DNA, 17 bp, Homo sapiens
agcctcactgatatatt

SEQ ID NO: 2842780 - DNA, 16 bp, Homo sapiens
agcctcacttgaatgt

SEQ ID NO: 2842781 - DNA, 17 bp, Homo sapiens
agcctcacttgaatgtg

SEQ ID NO: 2842782 - DNA, 23 bp, Homo sapiens
agcctcacttttaatgaacaaat

SEQ ID NO: 2842783 - DNA, 13 bp, Homo sapiens
agcctcagcatcc

SEQ ID NO: 2842784 - DNA, 22 bp, Homo sapiens
agcctcagcatcctggcacccg

SEQ ID NO: 2842785 - DNA, 17 bp, Homo sapiens
agcctcatccgaggcag

SEQ ID NO: 2842786 - DNA, 17 bp, Homo sapiens
agcctccatgctgcctc

SEQ ID NO: 2842787 - DNA, 18 bp, Homo sapiens
agcctccatttctggctt

SEQ ID NO: 2842788 - DNA, 21 bp, Homo sapiens
agcctccccccgctggggagc

SEQ ID NO: 2842789 - DNA, 18 bp, Homo sapiens
agcctcccgagtagctgg

SEQ ID NO: 2842790 - DNA, 19 bp, Homo sapiens
agcctcccgagtagctggg

SEQ ID NO: 2842791 - DNA, 15 bp, Homo sapiens
agcctccctctgacc

SEQ ID NO: 2842792 - DNA, 16 bp, Homo sapiens
agcctcctcccaccac

SEQ ID NO: 2842793 - DNA, 20 bp, Homo sapiens
agcctcctcccaccaccctc

SEQ ID NO: 2842794 - DNA, 16 bp, Homo sapiens
agcctcctcctgacca

SEQ ID NO: 2842795 - DNA, 13 bp, Homo sapiens
agcctcctctctc

SEQ ID NO: 2842796 - DNA, 19 bp, Homo sapiens
agcctcgcaacccgtgcca

SEQ ID NO: 2842797 - DNA, 14 bp, Homo sapiens
agcctcgcatgcca

SEQ ID NO: 2842798 - DNA, 17 bp, Homo sapiens
agcctcggtggccatgc

SEQ ID NO: 2842799 - DNA, 18 bp, Homo sapiens
agcctcggtggccatgct

SEQ ID NO: 2842800 - DNA, 21 bp, Homo sapiens
agcctcggtggccatgcttct

SEQ ID NO: 2842801 - DNA, 14 bp, Homo sapiens
agcctctccaggaa

SEQ ID NO: 2842802 - DNA, 23 bp, Homo sapiens
agcctctccaggaatgcctcctc

SEQ ID NO: 2842803 - DNA, 22 bp, Homo sapiens
agcctctgcagcggaatctgtt

SEQ ID NO: 2842804 - DNA, 16 bp, Homo sapiens
agcctctgtccctctt

SEQ ID NO: 2842805 - DNA, 17 bp, Homo sapiens
agcctgacaacatttct

SEQ ID NO: 2842806 - DNA, 16 bp, Homo sapiens
agcctgacctttctga

SEQ ID NO: 2842807 - DNA, 11 bp, Homo sapiens
agcctgactgt

SEQ ID NO: 2842808 - DNA, 17 bp, Homo sapiens
agcctgaggctgagact

SEQ ID NO: 2842809 - DNA, 17 bp, Homo sapiens
agcctgagtctcctgtg

SEQ ID NO: 2842810 - DNA, 18 bp, Homo sapiens
agcctgagtctcctgtgc

SEQ ID NO: 2842811 - DNA, 11 bp, Homo sapiens
agcctgctccc

SEQ ID NO: 2842812 - DNA, 14 bp, Homo sapiens
agcctgctccccca

SEQ ID NO: 2842813 - DNA, 14 bp, Homo sapiens
agcctggagaagct

SEQ ID NO: 2842814 - DNA, 11 bp, Homo sapiens
agcctggcctc

SEQ ID NO: 2842815 - DNA, 18 bp, Homo sapiens
agcctggcctcctgcctc

SEQ ID NO: 2842816 - DNA, 19 bp, Homo sapiens
agcctggcctcctgcctct

SEQ ID NO: 2842817 - DNA, 14 bp, Homo sapiens
agcctggcttctgg

SEQ ID NO: 2842818 - DNA, 15 bp, Homo sapiens
agcctggcttctgga

SEQ ID NO: 2842819 - DNA, 16 bp, Homo sapiens
agcctgggaccagggc

SEQ ID NO: 2842820 - DNA, 18 bp, Homo sapiens
agcctgggaccagggcat

SEQ ID NO: 2842821 - DNA, 12 bp, Homo sapiens
agcctgggccta

SEQ ID NO: 2842822 - DNA, 19 bp, Homo sapiens
agcctgggcctatggagag

SEQ ID NO: 2842823 - DNA, 20 bp, Homo sapiens
agcctgggcctatggagagc

SEQ ID NO: 2842824 - DNA, 24 bp, Homo sapiens
agcctgggcctatggagagccctg

SEQ ID NO: 2842825 - DNA, 15 bp, Homo sapiens
agcctgggcgacaga

SEQ ID NO: 2842826 - DNA, 16 bp, Homo sapiens
agcctggggcatccca

SEQ ID NO: 2842827 - DNA, 14 bp, Homo sapiens
agcctggggctcta

SEQ ID NO: 2842828 - DNA, 16 bp, Homo sapiens
agcctggggctctaac

SEQ ID NO: 2842829 - DNA, 23 bp, Homo sapiens
agcctggggctctaacgcctgag

SEQ ID NO: 2842830 - DNA, 15 bp, Homo sapiens
agcctgggggcctgg

SEQ ID NO: 2842831 - DNA, 22 bp, Homo sapiens
agcctggtagaattgggaagct

SEQ ID NO: 2842832 - DNA, 18 bp, Homo sapiens
agcctggtgggcctcctc

SEQ ID NO: 2842833 - DNA, 22 bp, Homo sapiens
agcctggtgggcctcctctgtc

SEQ ID NO: 2842834 - DNA, 17 bp, Homo sapiens
agcctgtgaacccagga

SEQ ID NO: 2842835 - DNA, 18 bp, Homo sapiens
agcctgtgaacccaggac

SEQ ID NO: 2842836 - DNA, 20 bp, Homo sapiens
agcctgtgaacccaggacaa

SEQ ID NO: 2842837 - DNA, 22 bp, Homo sapiens
agcctgtgaacccaggacaagc

SEQ ID NO: 2842838 - DNA, 21 bp, Homo sapiens
agcctgtgcatgtatgtcttg

SEQ ID NO: 2842839 - DNA, 12 bp, Homo sapiens
agcctgtgcctc

SEQ ID NO: 2842840 - DNA, 17 bp, Homo sapiens
agcctgtggcggtgcct

SEQ ID NO: 2842841 - DNA, 18 bp, Homo sapiens
agcctgtggcggtgcctg

SEQ ID NO: 2842842 - DNA, 22 bp, Homo sapiens
agcctgtggcggtgcctgggtg

SEQ ID NO: 2842843 - DNA, 14 bp, Homo sapiens
agcctgttcatggc

SEQ ID NO: 2842844 - DNA, 20 bp, Homo sapiens
agccttagaagtcacacagt

SEQ ID NO: 2842845 - DNA, 20 bp, Homo sapiens
agccttccccttgcccaggg

SEQ ID NO: 2842846 - DNA, 11 bp, Homo sapiens
agccttctctc

SEQ ID NO: 2842847 - DNA, 14 bp, Homo sapiens
agccttctctgttc

SEQ ID NO: 2842848 - DNA, 15 bp, Homo sapiens
agccttctctgttca

SEQ ID NO: 2842849 - DNA, 19 bp, Homo sapiens
agccttggataatgctgtt

SEQ ID NO: 2842850 - DNA, 20 bp, Homo sapiens
agccttggataatgctgttg

SEQ ID NO: 2842851 - DNA, 23 bp, Homo sapiens
agccttggataatgctgttgcct

SEQ ID NO: 2842852 - DNA, 18 bp, Homo sapiens
agccttggtgtccacctg

SEQ ID NO: 2842853 - DNA, 19 bp, Homo sapiens
agccttggtgtccacctgg

SEQ ID NO: 2842854 - DNA, 22 bp, Homo sapiens
agccttggtgtccacctggccc

SEQ ID NO: 2842855 - DNA, 18 bp, Homo sapiens
agccttgtaattctaaat

SEQ ID NO: 2842856 - DNA, 12 bp, Homo sapiens
agcgaaactccg

SEQ ID NO: 2842857 - DNA, 16 bp, Homo sapiens
agcgaactagaagaaa

SEQ ID NO: 2842858 - DNA, 14 bp, Homo sapiens
agcgaagcagagag

SEQ ID NO: 2842859 - DNA, 22 bp, Homo sapiens
agcgaggtcaacagagaaggca

SEQ ID NO: 2842860 - DNA, 23 bp, Homo sapiens
agcgattccctctcccaggcccc

SEQ ID NO: 2842861 - DNA, 17 bp, Homo sapiens
agcgattcttctgcttc

SEQ ID NO: 2842862 - DNA, 13 bp, Homo sapiens
agcgccctgcaga

SEQ ID NO: 2842863 - DNA, 14 bp, Homo sapiens
agcgccctgcagac

SEQ ID NO: 2842864 - DNA, 22 bp, Homo sapiens
agcgcctagtggggtctccctc

SEQ ID NO: 2842865 - DNA, 18 bp, Homo sapiens
agcgcctccctccacccc

SEQ ID NO: 2842866 - DNA, 23 bp, Homo sapiens
agcgcctccctccaccccaggac

SEQ ID NO: 2842867 - DNA, 19 bp, Homo sapiens
agcgctgccgcaccccaga

SEQ ID NO: 2842868 - DNA, 21 bp, Homo sapiens
agcggctgagtcatgatctcc

SEQ ID NO: 2842869 - DNA, 17 bp, Homo sapiens
agcgtcagaggccctgg

SEQ ID NO: 2842870 - DNA, 18 bp, Homo sapiens
agcgtggccttgttctgt

SEQ ID NO: 2842871 - DNA, 16 bp, Homo sapiens
agctaaagcccaacct

SEQ ID NO: 2842872 - DNA, 13 bp, Homo sapiens
agctaaatccttt

SEQ ID NO: 2842873 - DNA, 21 bp, Homo sapiens
agctaacagggaaggcaggca

SEQ ID NO: 2842874 - DNA, 23 bp, Homo sapiens
agctaacccccttctactgagcc

SEQ ID NO: 2842875 - DNA, 13 bp, Homo sapiens
agctaatgggaca

SEQ ID NO: 2842876 - DNA, 21 bp, Homo sapiens
agctactcaagaggctgaggc

SEQ ID NO: 2842877 - DNA, 22 bp, Homo sapiens
agctactcaagaggctgaggca

SEQ ID NO: 2842878 - DNA, 15 bp, Homo sapiens
agctactcagaagcc

SEQ ID NO: 2842879 - DNA, 20 bp, Homo sapiens
agctactcagaagcctgagg

SEQ ID NO: 2842880 - DNA, 14 bp, Homo sapiens
agctagaaggccac

SEQ ID NO: 2842881 - DNA, 16 bp, Homo sapiens
agctagaaggccacat

SEQ ID NO: 2842882 - DNA, 20 bp, Homo sapiens
agatctaagcctttccataa

SEQ ID NO: 2842883 - DNA, 19 bp, Homo sapiens
agatctcctatttttcaga

SEQ ID NO: 2842884 - DNA, 16 bp, Homo sapiens
agatctcctgtaattt

SEQ ID NO: 2842885 - DNA, 16 bp, Homo sapiens
agatcttgtctccact

SEQ ID NO: 2842886 - DNA, 22 bp, Homo sapiens
agatcttgtctccactaaatga

SEQ ID NO: 2842887 - DNA, 13 bp, Homo sapiens
agatctttcagga

SEQ ID NO: 2842888 - DNA, 13 bp, Homo sapiens
agatgaaagagga

SEQ ID NO: 2842889 - DNA, 19 bp, Homo sapiens
agatgaagagtgagagggc

SEQ ID NO: 2842890 - DNA, 23 bp, Homo sapiens
agatgagaagttaagcagccttt

SEQ ID NO: 2842891 - DNA, 16 bp, Homo sapiens
agatgatcacatggaa

SEQ ID NO: 2842892 - DNA, 15 bp, Homo sapiens
agatgcaccagccct

SEQ ID NO: 2842893 - DNA, 19 bp, Homo sapiens
agatgcaccccaacattga

SEQ ID NO: 2842894 - DNA, 22 bp, Homo sapiens
agatgcccagagggcccaggca

SEQ ID NO: 2842895 - DNA, 17 bp, Homo sapiens
agatggaaagaaagcac

SEQ ID NO: 2842896 - DNA, 22 bp, Homo sapiens
agatggaagttgcagtgagctg

SEQ ID NO: 2842897 - DNA, 20 bp, Homo sapiens
agatggcgagcatcctggcc

SEQ ID NO: 2842898 - DNA, 21 bp, Homo sapiens
agatggctgtgcctctgcctg

SEQ ID NO: 2842899 - DNA, 22 bp, Homo sapiens
agatggctgtgcctctgcctgt

SEQ ID NO: 2842900 - DNA, 22 bp, Homo sapiens
agatgggctgaactgagcctag

SEQ ID NO: 2842901 - DNA, 16 bp, Homo sapiens
agatgggcttgttttc

SEQ ID NO: 2842902 - DNA, 14 bp, Homo sapiens
agatggggtcttgc

SEQ ID NO: 2842903 - DNA, 17 bp, Homo sapiens
agatgggtattaaactt

SEQ ID NO: 2842904 - DNA, 21 bp, Homo sapiens
agatgggtctggctgagctga

SEQ ID NO: 2842905 - DNA, 15 bp, Homo sapiens
agatgtctttaggca

SEQ ID NO: 2842906 - DNA, 16 bp, Homo sapiens
agatgtgtttttaatg

SEQ ID NO: 2842907 - DNA, 19 bp, Homo sapiens
agatgttttacaaatttaa

SEQ ID NO: 2842908 - DNA, 11 bp, Homo sapiens
agattaaagga

SEQ ID NO: 2842909 - DNA, 14 bp, Homo sapiens
agattaaaggaagg

SEQ ID NO: 2842910 - DNA, 15 bp, Homo sapiens
agattaaaggaagga

SEQ ID NO: 2842911 - DNA, 21 bp, Homo sapiens
agattagaatgaaaattgtat

SEQ ID NO: 2842912 - DNA, 15 bp, Homo sapiens
agattagctctggac

SEQ ID NO: 2842913 - DNA, 17 bp, Homo sapiens
agattagctctggacca

SEQ ID NO: 2842914 - DNA, 16 bp, Homo sapiens
agattatatatcataa

SEQ ID NO: 2842915 - DNA, 22 bp, Homo sapiens
agattatatatcataaagtatg

SEQ ID NO: 2842916 - DNA, 21 bp, Homo sapiens
agattattgtagtgttcaaaa

SEQ ID NO: 2842917 - DNA, 17 bp, Homo sapiens
agattcatttttctttc

SEQ ID NO: 2842918 - DNA, 13 bp, Homo sapiens
agattcccagaga

SEQ ID NO: 2842919 - DNA, 16 bp, Homo sapiens
agattcccagagcaaa

SEQ ID NO: 2842920 - DNA, 17 bp, Homo sapiens
agattctccaaatgatt

SEQ ID NO: 2842921 - DNA, 13 bp, Homo sapiens
agattgtgtaaat

SEQ ID NO: 2842922 - DNA, 14 bp, Homo sapiens
agattgttaaaata

SEQ ID NO: 2842923 - DNA, 20 bp, Homo sapiens
agatttatgtaatgctttat

SEQ ID NO: 2842924 - DNA, 15 bp, Homo sapiens
agatttcaacatatc

SEQ ID NO: 2842925 - DNA, 15 bp, Homo sapiens
agatttgtatttata

SEQ ID NO: 2842926 - DNA, 16 bp, Homo sapiens
agatttgtatttatat

SEQ ID NO: 2842927 - DNA, 17 bp, Homo sapiens
agatttgtatttatatt

SEQ ID NO: 2842928 - DNA, 19 bp, Homo sapiens
agattttaaattcacaata

SEQ ID NO: 2842929 - DNA, 23 bp, Homo sapiens
agattttccacaagattcccaga

SEQ ID NO: 2842930 - DNA, 20 bp, Homo sapiens
agattttgtgcagttaatac

SEQ ID NO: 2842931 - DNA, 14 bp, Homo sapiens
agcaaaagaagaag

SEQ ID NO: 2842932 - DNA, 12 bp, Homo sapiens
agcaaagagtgg

SEQ ID NO: 2842933 - DNA, 20 bp, Homo sapiens
agcaaagatatctcatctct

SEQ ID NO: 2842934 - DNA, 22 bp, Homo sapiens
agcaaagcctgttcatggcaga

SEQ ID NO: 2842935 - DNA, 23 bp, Homo sapiens
agcaaaggagtagaaagacagag

SEQ ID NO: 2842936 - DNA, 17 bp, Homo sapiens
agcaaagtgtcagtgtt

SEQ ID NO: 2842937 - DNA, 18 bp, Homo sapiens
agcaaagtgtcagtgttg

SEQ ID NO: 2842938 - DNA, 14 bp, Homo sapiens
agcaaatgtttctg

SEQ ID NO: 2842939 - DNA, 16 bp, Homo sapiens
agcaaatgtttctgca

SEQ ID NO: 2842940 - DNA, 22 bp, Homo sapiens
agcaacagagtgagaccctgtc

SEQ ID NO: 2842941 - DNA, 18 bp, Homo sapiens
agcaacaggaatctcaga

SEQ ID NO: 2842942 - DNA, 21 bp, Homo sapiens
agcaaccgtggcccttcctgg

SEQ ID NO: 2842943 - DNA, 22 bp, Homo sapiens
agcaaccgtggcccttcctgga

SEQ ID NO: 2842944 - DNA, 15 bp, Homo sapiens
agcaacctgtagagt

SEQ ID NO: 2842945 - DNA, 16 bp, Homo sapiens
agcaagacgtcctgga

SEQ ID NO: 2842946 - DNA, 17 bp, Homo sapiens
agcaagacgtcctggaa

SEQ ID NO: 2842947 - DNA, 22 bp, Homo sapiens
agcaagactccgtctcaaaaaa

SEQ ID NO: 2842948 - DNA, 12 bp, Homo sapiens
agcaagactctg

SEQ ID NO: 2842949 - DNA, 22 bp, Homo sapiens
agcaagacttctctttgcctca

SEQ ID NO: 2842950 - DNA, 23 bp, Homo sapiens
agcaagagctggcaaaggtggct

SEQ ID NO: 2842951 - DNA, 20 bp, Homo sapiens
agcaagcatttatgtttatt

SEQ ID NO: 2842952 - DNA, 17 bp, Homo sapiens
agcaagcttaatggctg

SEQ ID NO: 2842953 - DNA, 12 bp, Homo sapiens
agcaaggcccga

SEQ ID NO: 2842954 - DNA, 20 bp, Homo sapiens
agcaaggcccgagcagctga

SEQ ID NO: 2842955 - DNA, 22 bp, Homo sapiens
agcaaggcccgagcagctgagc

SEQ ID NO: 2842956 - DNA, 13 bp, Homo sapiens
agcaagtgagagc

SEQ ID NO: 2842957 - DNA, 14 bp, Homo sapiens
agcaagtgagagct

SEQ ID NO: 2842958 - DNA, 14 bp, Homo sapiens
agcaataattagga

SEQ ID NO: 2842959 - DNA, 17 bp, Homo sapiens
agcaatccatgttagtt

SEQ ID NO: 2842960 - DNA, 23 bp, Homo sapiens
agcaatccatgttagtttttact

SEQ ID NO: 2842961 - DNA, 23 bp, Homo sapiens
agcaatgatgtccagaagaatat

SEQ ID NO: 2842962 - DNA, 16 bp, Homo sapiens
agcaattcatttcact

SEQ ID NO: 2842963 - DNA, 21 bp, Homo sapiens
agcaattcatttcactttaaa

SEQ ID NO: 2842964 - DNA, 20 bp, Homo sapiens
agcacacaggtacagcaaca

SEQ ID NO: 2842965 - DNA, 13 bp, Homo sapiens
agcacacgaaccc

SEQ ID NO: 2842966 - DNA, 17 bp, Homo sapiens
agcacaggctaattttt

SEQ ID NO: 2842967 - DNA, 22 bp, Homo sapiens
agcaccaaaagcttaccaaggg

SEQ ID NO: 2842968 - DNA, 18 bp, Homo sapiens
agcaccagcttctccagg

SEQ ID NO: 2842969 - DNA, 14 bp, Homo sapiens
agcaccaggcacga

SEQ ID NO: 2842970 - DNA, 14 bp, Homo sapiens
agcaccccctcatt

SEQ ID NO: 2842971 - DNA, 12 bp, Homo sapiens
agaggagatcag

SEQ ID NO: 2842972 - DNA, 13 bp, Homo sapiens
agaggagatcagg

SEQ ID NO: 2842973 - DNA, 19 bp, Homo sapiens
agaggagggcgtgactcac

SEQ ID NO: 2842974 - DNA, 19 bp, Homo sapiens
agaggagtccagggcggga

SEQ ID NO: 2842975 - DNA, 17 bp, Homo sapiens
agaggcaaacatttctt

SEQ ID NO: 2842976 - DNA, 14 bp, Homo sapiens
agaggcagagaaag

SEQ ID NO: 2842977 - DNA, 22 bp, Homo sapiens
agaggcagagaaagaagagaca

SEQ ID NO: 2842978 - DNA, 21 bp, Homo sapiens
agaggcagccccattctgcct

SEQ ID NO: 2842979 - DNA, 23 bp, Homo sapiens
agaggcagccccattctgcctgc

SEQ ID NO: 2842980 - DNA, 13 bp, Homo sapiens
agaggcagggagg

SEQ ID NO: 2842981 - DNA, 13 bp, Homo sapiens
agaggcagggtct

SEQ ID NO: 2842982 - DNA, 14 bp, Homo sapiens
agaggccatggcag

SEQ ID NO: 2842983 - DNA, 19 bp, Homo sapiens
agaggccttttggaatgtg

SEQ ID NO: 2842984 - DNA, 14 bp, Homo sapiens
agaggcgacttcct

SEQ ID NO: 2842985 - DNA, 22 bp, Homo sapiens
agaggcgtctcacatttttact

SEQ ID NO: 2842986 - DNA, 17 bp, Homo sapiens
agaggcgtcttgtattt

SEQ ID NO: 2842987 - DNA, 13 bp, Homo sapiens
agaggctgaggac

SEQ ID NO: 2842988 - DNA, 13 bp, Homo sapiens
agaggctgcagaa

SEQ ID NO: 2842989 - DNA, 21 bp, Homo sapiens
agaggctgcagaaggccaaga

SEQ ID NO: 2842990 - DNA, 19 bp, Homo sapiens
agaggctggaggcagggcc

SEQ ID NO: 2842991 - DNA, 14 bp, Homo sapiens
agaggctgggggag

SEQ ID NO: 2842992 - DNA, 21 bp, Homo sapiens
agaggctggtgctgtggccag

SEQ ID NO: 2842993 - DNA, 22 bp, Homo sapiens
agaggctggtgctgtggccagg

SEQ ID NO: 2842994 - DNA, 20 bp, Homo sapiens
agaggcttccttcatttcct

SEQ ID NO: 2842995 - DNA, 19 bp, Homo sapiens
agagggagaagggatggag

SEQ ID NO: 2842996 - DNA, 15 bp, Homo sapiens
agagggagtgacaga

SEQ ID NO: 2842997 - DNA, 14 bp, Homo sapiens
agagggcagaggct

SEQ ID NO: 2842998 - DNA, 23 bp, Homo sapiens
agagggcatgcgcacaaggctga

SEQ ID NO: 2842999 - DNA, 21 bp, Homo sapiens
agagggctgcgagcatttccc

SEQ ID NO: 2843000 - DNA, 22 bp, Homo sapiens
agagggctgcgagcatttccct

SEQ ID NO: 2843001 - DNA, 16 bp, Homo sapiens
agaggggaagggccag

SEQ ID NO: 2843002 - DNA, 19 bp, Homo sapiens
agaggggaataatagaaga

SEQ ID NO: 2843003 - DNA, 20 bp, Homo sapiens
agaggggaataatagaagaa

SEQ ID NO: 2843004 - DNA, 17 bp, Homo sapiens
agaggggacatttccct

SEQ ID NO: 2843005 - DNA, 18 bp, Homo sapiens
agaggggctttctggaga

SEQ ID NO: 2843006 - DNA, 17 bp, Homo sapiens
agaggtatttatcttta

SEQ ID NO: 2843007 - DNA, 16 bp, Homo sapiens
agaggtgaccccaggg

SEQ ID NO: 2843008 - DNA, 17 bp, Homo sapiens
agaggtgagaaatttaa

SEQ ID NO: 2843009 - DNA, 16 bp, Homo sapiens
agaggtgggcagcagc

SEQ ID NO: 2843010 - DNA, 19 bp, Homo sapiens
agaggtgggcagcagctca

SEQ ID NO: 2843011 - DNA, 19 bp, Homo sapiens
agagtacagtgagccaaga

SEQ ID NO: 2843012 - DNA, 17 bp, Homo sapiens
agagtagccgagagcct

SEQ ID NO: 2843013 - DNA, 13 bp, Homo sapiens
agagtatatatgt

SEQ ID NO: 2843014 - DNA, 14 bp, Homo sapiens
agagtatatatgta

SEQ ID NO: 2843015 - DNA, 18 bp, Homo sapiens
agagtatattatgtattt

SEQ ID NO: 2843016 - DNA, 21 bp, Homo sapiens
agagtatgcaagaagaatata

SEQ ID NO: 2843017 - DNA, 21 bp, Homo sapiens
agagtgagaataattgtgtac

SEQ ID NO: 2843018 - DNA, 15 bp, Homo sapiens
agagtgagactctgt

SEQ ID NO: 2843019 - DNA, 19 bp, Homo sapiens
agagtgagactctgtctca

SEQ ID NO: 2843020 - DNA, 21 bp, Homo sapiens
agagtgattcaggggctcccc

SEQ ID NO: 2843021 - DNA, 19 bp, Homo sapiens
agagtgcccttaaaataat

SEQ ID NO: 2843022 - DNA, 12 bp, Homo sapiens
agagtgctgaga

SEQ ID NO: 2843023 - DNA, 18 bp, Homo sapiens
agagtgggctgcatctgg

SEQ ID NO: 2843024 - DNA, 19 bp, Homo sapiens
agagttagtttctttggga

SEQ ID NO: 2843025 - DNA, 14 bp, Homo sapiens
agacacctgcacct

SEQ ID NO: 2843026 - DNA, 18 bp, Homo sapiens
agacaccttgacagggca

SEQ ID NO: 2843027 - DNA, 22 bp, Homo sapiens
agacaccttgacagggcacacc

SEQ ID NO: 2843028 - DNA, 20 bp, Homo sapiens
agacactgccacacagggtc

SEQ ID NO: 2843029 - DNA, 12 bp, Homo sapiens
agacactggttt

SEQ ID NO: 2843030 - DNA, 20 bp, Homo sapiens
agacacttctaaatgaagtg

SEQ ID NO: 2843031 - DNA, 16 bp, Homo sapiens
agacagaagaaacaag

SEQ ID NO: 2843032 - DNA, 12 bp, Homo sapiens
agacagagctgg

SEQ ID NO: 2843033 - DNA, 11 bp, Homo sapiens
agacagagtct

SEQ ID NO: 2843034 - DNA, 16 bp, Homo sapiens
agacagatcccatcca

SEQ ID NO: 2843035 - DNA, 14 bp, Homo sapiens
agacagcagctcag

SEQ ID NO: 2843036 - DNA, 21 bp, Homo sapiens
agacagcgaactagaagaaag

SEQ ID NO: 2843037 - DNA, 18 bp, Homo sapiens
agacaggaaaatcctctg

SEQ ID NO: 2843038 - DNA, 21 bp, Homo sapiens
agacaggacagtgcttcagcc

SEQ ID NO: 2843039 - DNA, 18 bp, Homo sapiens
agacaggacctgactatt

SEQ ID NO: 2843040 - DNA, 23 bp, Homo sapiens
agacaggcccaagagatgaagag

SEQ ID NO: 2843041 - DNA, 15 bp, Homo sapiens
agacagtatatttat

SEQ ID NO: 2843042 - DNA, 18 bp, Homo sapiens
agacagtgatctccatat

SEQ ID NO: 2843043 - DNA, 20 bp, Homo sapiens
agacagtgatctccatatgt

SEQ ID NO: 2843044 - DNA, 21 bp, Homo sapiens
agacagtgatctccatatgtt

SEQ ID NO: 2843045 - DNA, 16 bp, Homo sapiens
agacatattcttggag

SEQ ID NO: 2843046 - DNA, 18 bp, Homo sapiens
agacatggagactcctgc

SEQ ID NO: 2843047 - DNA, 17 bp, Homo sapiens
agacatgtggtgggaca

SEQ ID NO: 2843048 - DNA, 14 bp, Homo sapiens
agaccacctccctg

SEQ ID NO: 2843049 - DNA, 18 bp, Homo sapiens
agaccacctccctgccct

SEQ ID NO: 2843050 - DNA, 17 bp, Homo sapiens
agaccacctctcaatat

SEQ ID NO: 2843051 - DNA, 15 bp, Homo sapiens
agaccacctgcttct

SEQ ID NO: 2843052 - DNA, 16 bp, Homo sapiens
agaccagactgtggag

SEQ ID NO: 2843053 - DNA, 18 bp, Homo sapiens
agaccagcccagccaaca

SEQ ID NO: 2843054 - DNA, 20 bp, Homo sapiens
agaccagcccagccaacatg

SEQ ID NO: 2843055 - DNA, 13 bp, Homo sapiens
agaccataatgtt

SEQ ID NO: 2843056 - DNA, 14 bp, Homo sapiens
agacccaaggagga

SEQ ID NO: 2843057 - DNA, 13 bp, Homo sapiens
agacccagatctc

SEQ ID NO: 2843058 - DNA, 16 bp, Homo sapiens
agacccagcaggaagc

SEQ ID NO: 2843059 - DNA, 15 bp, Homo sapiens
agaccccttcctttc

SEQ ID NO: 2843060 - DNA, 18 bp, Homo sapiens
agaccccttcctttcctc

SEQ ID NO: 2843061 - DNA, 19 bp, Homo sapiens
agaccctaagcctcctttt

SEQ ID NO: 2843062 - DNA, 18 bp, Homo sapiens
agaccctaccccaccacg

SEQ ID NO: 2843063 - DNA, 21 bp, Homo sapiens
agaccctcactgctggggagt

SEQ ID NO: 2843064 - DNA, 21 bp, Homo sapiens
agaccgagcgctttctggaaa

SEQ ID NO: 2843065 - DNA, 12 bp, Homo sapiens
agacctcagcca

SEQ ID NO: 2843066 - DNA, 14 bp, Homo sapiens
agacctcagccatg

SEQ ID NO: 2843067 - DNA, 18 bp, Homo sapiens
agacctcagccatgagga

SEQ ID NO: 2843068 - DNA, 12 bp, Homo sapiens
agacctcagcct

SEQ ID NO: 2843069 - DNA, 15 bp, Homo sapiens
agacctcagcctgtg

SEQ ID NO: 2843070 - DNA, 20 bp, Homo sapiens
agacctcagcctgtgctgcc

SEQ ID NO: 2843071 - DNA, 11 bp, Homo sapiens
agacctctgat

SEQ ID NO: 2843072 - DNA, 19 bp, Homo sapiens
agaccttctgaagatctca

SEQ ID NO: 2843073 - DNA, 17 bp, Homo sapiens
agaccttgcgaccatgt

SEQ ID NO: 2843074 - DNA, 16 bp, Homo sapiens
ccccattcacagagcc

SEQ ID NO: 2843075 - DNA, 13 bp, Homo sapiens
ccccattctgcct

SEQ ID NO: 2843076 - DNA, 21 bp, Homo sapiens
ccccattctgcctgcccaggc

SEQ ID NO: 2843077 - DNA, 23 bp, Homo sapiens
ccccattcttcctagttttctcc

SEQ ID NO: 2843078 - DNA, 19 bp, Homo sapiens
cccccaagctgttttcttc

SEQ ID NO: 2843079 - DNA, 22 bp, Homo sapiens
cccccacaggccccccgcagca

SEQ ID NO: 2843080 - DNA, 15 bp, Homo sapiens
cccccaccacactga

SEQ ID NO: 2843081 - DNA, 15 bp, Homo sapiens
cccccacctggctca

SEQ ID NO: 2843082 - DNA, 21 bp, Homo sapiens
cccccactctcattccccagg

SEQ ID NO: 2843083 - DNA, 14 bp, Homo sapiens
cccccactgccaca

SEQ ID NO: 2843084 - DNA, 23 bp, Homo sapiens
cccccagccccgactccagccag

SEQ ID NO: 2843085 - DNA, 12 bp, Homo sapiens
cccccagcctct

SEQ ID NO: 2843086 - DNA, 14 bp, Homo sapiens
cccccagcctgggc

SEQ ID NO: 2843087 - DNA, 15 bp, Homo sapiens
cccccagcctgggcc

SEQ ID NO: 2843088 - DNA, 13 bp, Homo sapiens
ccccccagcccct

SEQ ID NO: 2843089 - DNA, 17 bp, Homo sapiens
cccccgccatccttcac

SEQ ID NO: 2843090 - DNA, 11 bp, Homo sapiens
ccccctcattc

SEQ ID NO: 2843091 - DNA, 13 bp, Homo sapiens
ccccctccccagg

SEQ ID NO: 2843092 - DNA, 14 bp, Homo sapiens
ccccctgcagcttg

SEQ ID NO: 2843093 - DNA, 21 bp, Homo sapiens
ccccctggtggacagtcctgg

SEQ ID NO: 2843094 - DNA, 14 bp, Homo sapiens
cccccttcagtgcc

SEQ ID NO: 2843095 - DNA, 17 bp, Homo sapiens
ccccgactccagccagc

SEQ ID NO: 2843096 - DNA, 23 bp, Homo sapiens
ccccgaggccttctctgaaggac

SEQ ID NO: 2843097 - DNA, 13 bp, Homo sapiens
ccccgcagcaccc

SEQ ID NO: 2843098 - DNA, 13 bp, Homo sapiens
ccccgccatcctt

SEQ ID NO: 2843099 - DNA, 19 bp, Homo sapiens
ccccgcttccccacagaac

SEQ ID NO: 2843100 - DNA, 19 bp, Homo sapiens
ccccgcttgtccagcgcct

SEQ ID NO: 2843101 - DNA, 14 bp, Homo sapiens
ccccgggcctgcct

SEQ ID NO: 2843102 - DNA, 17 bp, Homo sapiens
ccccgggggaggaaggg

SEQ ID NO: 2843103 - DNA, 21 bp, Homo sapiens
ccccgtggtctttgaataaag

SEQ ID NO: 2843104 - DNA, 14 bp, Homo sapiens
cccctatccaccca

SEQ ID NO: 2843105 - DNA, 16 bp, Homo sapiens
cccctatccacccagc

SEQ ID NO: 2843106 - DNA, 17 bp, Homo sapiens
cccctatccacccagcc

SEQ ID NO: 2843107 - DNA, 11 bp, Homo sapiens
cccctcagtgc

SEQ ID NO: 2843108 - DNA, 11 bp, Homo sapiens
cccctccaggc

SEQ ID NO: 2843109 - DNA, 12 bp, Homo sapiens
cccctcccaccc

SEQ ID NO: 2843110 - DNA, 17 bp, Homo sapiens
cccctcccacccccagc

SEQ ID NO: 2843111 - DNA, 14 bp, Homo sapiens
cccctcccagggcc

SEQ ID NO: 2843112 - DNA, 15 bp, Homo sapiens
cccctccccagggga

SEQ ID NO: 2843113 - DNA, 20 bp, Homo sapiens
cccctccctcttccttcccc

SEQ ID NO: 2843114 - DNA, 13 bp, Homo sapiens
cccctcctctgcc

SEQ ID NO: 2843115 - DNA, 14 bp, Homo sapiens
cccctgacctcacc

SEQ ID NO: 2843116 - DNA, 16 bp, Homo sapiens
cccctgccaccctggg

SEQ ID NO: 2843117 - DNA, 15 bp, Homo sapiens
cccctgccagtgcct

SEQ ID NO: 2843118 - DNA, 16 bp, Homo sapiens
cccctgccagtgcctt

SEQ ID NO: 2843119 - DNA, 17 bp, Homo sapiens
cccctgccagtgcctta

SEQ ID NO: 2843120 - DNA, 17 bp, Homo sapiens
cccctgcccggctgcgg

SEQ ID NO: 2843121 - DNA, 11 bp, Homo sapiens
cccctgctggt

SEQ ID NO: 2843122 - DNA, 15 bp, Homo sapiens
cccctgctggttcag

SEQ ID NO: 2843123 - DNA, 18 bp, Homo sapiens
cccctgcttctcagcccc

SEQ ID NO: 2843124 - DNA, 15 bp, Homo sapiens
cccctggagagaagt

SEQ ID NO: 2843125 - DNA, 23 bp, Homo sapiens
cccctggtgcactggccccaccc

SEQ ID NO: 2843126 - DNA, 15 bp, Homo sapiens
cccctggtggacagt

SEQ ID NO: 2843127 - DNA, 19 bp, Homo sapiens
cccctggtggacagtcctg

SEQ ID NO: 2843128 - DNA, 20 bp, Homo sapiens
cccctggtggacagtcctgg

SEQ ID NO: 2843129 - DNA, 22 bp, Homo sapiens
cccctggtggacagtcctggga

SEQ ID NO: 2843130 - DNA, 19 bp, Homo sapiens
cccctgtaaacacagtgct

SEQ ID NO: 2843131 - DNA, 15 bp, Homo sapiens
cccctgtaaatagtt

SEQ ID NO: 2843132 - DNA, 23 bp, Homo sapiens
cccctgtaaatagttttaaatat

SEQ ID NO: 2843133 - DNA, 19 bp, Homo sapiens
cccctgttcccccgctggc

SEQ ID NO: 2843134 - DNA, 20 bp, Homo sapiens
ccccttcactccctccctgg

SEQ ID NO: 2843135 - DNA, 13 bp, Homo sapiens
ccccttcagtgcc

SEQ ID NO: 2843136 - DNA, 19 bp, Homo sapiens
ccccttcgctcctgtgtct

SEQ ID NO: 2843137 - DNA, 22 bp, Homo sapiens
ccccttgaagaggggaggggcc

SEQ ID NO: 2843138 - DNA, 20 bp, Homo sapiens
ccccttgcccagggctcagc

SEQ ID NO: 2843139 - DNA, 19 bp, Homo sapiens
ccccttgcccttgccctga

SEQ ID NO: 2843140 - DNA, 21 bp, Homo sapiens
ccccttgcccttgccctgacc

SEQ ID NO: 2843141 - DNA, 23 bp, Homo sapiens
ccccttgcccttgccctgacctc

SEQ ID NO: 2843142 - DNA, 24 bp, Homo sapiens
ccccttgcccttgccctgacctcc

SEQ ID NO: 2843143 - DNA, 22 bp, Homo sapiens
ccccttgctctcccctgccctg

SEQ ID NO: 2843144 - DNA, 16 bp, Homo sapiens
cccgaatagctgggac

SEQ ID NO: 2843145 - DNA, 15 bp, Homo sapiens
cccgactccagccag

SEQ ID NO: 2843146 - DNA, 17 bp, Homo sapiens
cccgactccagccagcg

SEQ ID NO: 2843147 - DNA, 12 bp, Homo sapiens
cccgactcctca

SEQ ID NO: 2843148 - DNA, 12 bp, Homo sapiens
cccgagcagctg

SEQ ID NO: 2843149 - DNA, 15 bp, Homo sapiens
cccgaggccttctct

SEQ ID NO: 2843150 - DNA, 21 bp, Homo sapiens
cccgaggccttctctgaagga

SEQ ID NO: 2843151 - DNA, 14 bp, Homo sapiens
cccgaggctgccca

SEQ ID NO: 2843152 - DNA, 13 bp, Homo sapiens
cccgagtagctgg

SEQ ID NO: 2843153 - DNA, 18 bp, Homo sapiens
cccgagtagctgggacta

SEQ ID NO: 2843154 - DNA, 12 bp, Homo sapiens
cccgcagcaccc

SEQ ID NO: 2843155 - DNA, 15 bp, Homo sapiens
cccgcgcctccttcc

SEQ ID NO: 2843156 - DNA, 16 bp, Homo sapiens
cccgctcctgctgaaa

SEQ ID NO: 2843157 - DNA, 12 bp, Homo sapiens
cccgctctggac

SEQ ID NO: 2843158 - DNA, 19 bp, Homo sapiens
ccgagcgctttctggaaaa

SEQ ID NO: 2843159 - DNA, 14 bp, Homo sapiens
ccgaggcagggtca

SEQ ID NO: 2843160 - DNA, 20 bp, Homo sapiens
ccgaggcagggtcaggagag

SEQ ID NO: 2843161 - DNA, 14 bp, Homo sapiens
ccgaggccttctct

SEQ ID NO: 2843162 - DNA, 21 bp, Homo sapiens
ccgagtttgggccactgcact

SEQ ID NO: 2843163 - DNA, 18 bp, Homo sapiens
ccgcagagctcccttcct

SEQ ID NO: 2843164 - DNA, 22 bp, Homo sapiens
ccgcagccagccggtgcctggc

SEQ ID NO: 2843165 - DNA, 12 bp, Homo sapiens
ccgcatcttctc

SEQ ID NO: 2843166 - DNA, 18 bp, Homo sapiens
ccgccatccttcaccaga

SEQ ID NO: 2843167 - DNA, 22 bp, Homo sapiens
ccgccatccttcaccagagccc

SEQ ID NO: 2843168 - DNA, 17 bp, Homo sapiens
ccgcccagctgcacctg

SEQ ID NO: 2843169 - DNA, 13 bp, Homo sapiens
ccgcctggccggc

SEQ ID NO: 2843170 - DNA, 14 bp, Homo sapiens
ccgcctggccggct

SEQ ID NO: 2843171 - DNA, 15 bp, Homo sapiens
ccgcgtctaccctgg

SEQ ID NO: 2843172 - DNA, 16 bp, Homo sapiens
ccgcgtctaccctggg

SEQ ID NO: 2843173 - DNA, 16 bp, Homo sapiens
ccgctacaccactctg

SEQ ID NO: 2843174 - DNA, 19 bp, Homo sapiens
ccgctacaccactctggca

SEQ ID NO: 2843175 - DNA, 19 bp, Homo sapiens
ccgctgcctaagtggctgc

SEQ ID NO: 2843176 - DNA, 15 bp, Homo sapiens
ccgctggcagccacc

SEQ ID NO: 2843177 - DNA, 16 bp, Homo sapiens
ccgctggctcctccag

SEQ ID NO: 2843178 - DNA, 17 bp, Homo sapiens
ccgctggctcctccagg

SEQ ID NO: 2843179 - DNA, 16 bp, Homo sapiens
ccgctgttcacccaca

SEQ ID NO: 2843180 - DNA, 14 bp, Homo sapiens
ccgcttccccacag

SEQ ID NO: 2843181 - DNA, 19 bp, Homo sapiens
ccgcttccccacagaactg

SEQ ID NO: 2843182 - DNA, 16 bp, Homo sapiens
ccgcttgtccagcgcc

SEQ ID NO: 2843183 - DNA, 17 bp, Homo sapiens
ccgcttgtccagcgcct

SEQ ID NO: 2843184 - DNA, 21 bp, Homo sapiens
ccgctttcatgaacacagcct

SEQ ID NO: 2843185 - DNA, 19 bp, Homo sapiens
ccgctttctacccagcgag

SEQ ID NO: 2843186 - DNA, 14 bp, Homo sapiens
ccgctttgcctgct

SEQ ID NO: 2843187 - DNA, 22 bp, Homo sapiens
ccggacctgtggggccccagag

SEQ ID NO: 2843188 - DNA, 15 bp, Homo sapiens
ccggcaccccctgca

SEQ ID NO: 2843189 - DNA, 18 bp, Homo sapiens
ccggcaccccctgcagct

SEQ ID NO: 2843190 - DNA, 19 bp, Homo sapiens
ccggcaccccctgcagctt

SEQ ID NO: 2843191 - DNA, 20 bp, Homo sapiens
ccggcaccccctgcagcttg

SEQ ID NO: 2843192 - DNA, 21 bp, Homo sapiens
ccggcaccccctgcagcttgt

SEQ ID NO: 2843193 - DNA, 18 bp, Homo sapiens
ccggccccatcagaggct

SEQ ID NO: 2843194 - DNA, 15 bp, Homo sapiens
ccggcccctgctggt

SEQ ID NO: 2843195 - DNA, 16 bp, Homo sapiens
ccgggacagacctgga

SEQ ID NO: 2843196 - DNA, 22 bp, Homo sapiens
ccgggacagacctggacactag

SEQ ID NO: 2843197 - DNA, 15 bp, Homo sapiens
ccgggcctgcctctg

SEQ ID NO: 2843198 - DNA, 13 bp, Homo sapiens
ccgggctgggagc

SEQ ID NO: 2843199 - DNA, 18 bp, Homo sapiens
ccgggctgggagctctgc

SEQ ID NO: 2843200 - DNA, 12 bp, Homo sapiens
ccgggcttgggc

SEQ ID NO: 2843201 - DNA, 16 bp, Homo sapiens
ccggggaactggccaa

SEQ ID NO: 2843202 - DNA, 19 bp, Homo sapiens
ccggggaactggccaagct

SEQ ID NO: 2843203 - DNA, 16 bp, Homo sapiens
ccgggtccccagctcc

SEQ ID NO: 2843204 - DNA, 20 bp, Homo sapiens
ccgggtccccagctccccag

SEQ ID NO: 2843205 - DNA, 20 bp, Homo sapiens
ccggtcccttgagacctcag

SEQ ID NO: 2843206 - DNA, 22 bp, Homo sapiens
ccggtcccttgagacctcagcc

SEQ ID NO: 2843207 - DNA, 14 bp, Homo sapiens
ccggtcctggcccc

SEQ ID NO: 2843208 - DNA, 19 bp, Homo sapiens
ccgtacccccgtggtcttt

SEQ ID NO: 2843209 - DNA, 17 bp, Homo sapiens
ccgtcagccaaatgtaa

SEQ ID NO: 2843210 - DNA, 17 bp, Homo sapiens
ccgtcagccacacctgt

SEQ ID NO: 2843211 - DNA, 23 bp, Homo sapiens
ccgtctggggttcagcccctcct

SEQ ID NO: 2843212 - DNA, 14 bp, Homo sapiens
ccgtcttcagccta

SEQ ID NO: 2843213 - DNA, 21 bp, Homo sapiens
ccgtgccaagtccaggtcctg

SEQ ID NO: 2843214 - DNA, 15 bp, Homo sapiens
ccgtggaccttcctg

SEQ ID NO: 2843215 - DNA, 12 bp, Homo sapiens
ccgtggaggctg

SEQ ID NO: 2843216 - DNA, 14 bp, Homo sapiens
ccgtggaggctgct

SEQ ID NO: 2843217 - DNA, 18 bp, Homo sapiens
ccgtggtccagctcttgg

SEQ ID NO: 2843218 - DNA, 20 bp, Homo sapiens
ccgtggtccagctcttggcc

SEQ ID NO: 2843219 - DNA, 15 bp, Homo sapiens
ccgtgtccagcacag

SEQ ID NO: 2843220 - DNA, 16 bp, Homo sapiens
ccgtgtccagcacaga

SEQ ID NO: 2843221 - DNA, 13 bp, Homo sapiens
ccgttactctcca

SEQ ID NO: 2843222 - DNA, 14 bp, Homo sapiens
ccgttactctccaa

SEQ ID NO: 2843223 - DNA, 17 bp, Homo sapiens
ccgttactctccaacct

SEQ ID NO: 2843224 - DNA, 22 bp, Homo sapiens
ccgttactctccaacctggaca

SEQ ID NO: 2843225 - DNA, 23 bp, Homo sapiens
ccgttctgctggcctggatctcc

SEQ ID NO: 2843226 - DNA, 20 bp, Homo sapiens
ccgttggggattggggaaga

SEQ ID NO: 2843227 - DNA, 12 bp, Homo sapiens
ccgtttttcaag

SEQ ID NO: 2843228 - DNA, 23 bp, Homo sapiens
ccgtttttcaagaaaactggaaa

SEQ ID NO: 2843229 - DNA, 15 bp, Homo sapiens
cctaaaagtaaacat

SEQ ID NO: 2843230 - DNA, 17 bp, Homo sapiens
cctaaaataaaaaccag

SEQ ID NO: 2843231 - DNA, 15 bp, Homo sapiens
cctaaaattcagtgg

SEQ ID NO: 2843232 - DNA, 16 bp, Homo sapiens
cctaaaattcagtgga

SEQ ID NO: 2843233 - DNA, 16 bp, Homo sapiens
cctaaagaaaaacaaa

SEQ ID NO: 2843234 - DNA, 13 bp, Homo sapiens
cctaaatccaaag

SEQ ID NO: 2843235 - DNA, 13 bp, Homo sapiens
cctaagaagctct

SEQ ID NO: 2843236 - DNA, 17 bp, Homo sapiens
cctaagacttcagtcct

SEQ ID NO: 2843237 - DNA, 19 bp, Homo sapiens
cctaagaggcgacttcctc

SEQ ID NO: 2843238 - DNA, 22 bp, Homo sapiens
cctaagcagtgcttgtaaacca

SEQ ID NO: 2843239 - DNA, 19 bp, Homo sapiens
cctctgacacacagctctg

SEQ ID NO: 2843240 - DNA, 15 bp, Homo sapiens
cctctgacctgcagg

SEQ ID NO: 2843241 - DNA, 16 bp, Homo sapiens
cctctgacctgcaggc

SEQ ID NO: 2843242 - DNA, 17 bp, Homo sapiens
cctctgacctgcaggcc

SEQ ID NO: 2843243 - DNA, 20 bp, Homo sapiens
cctctgacctgcaggccaag

SEQ ID NO: 2843244 - DNA, 14 bp, Homo sapiens
cctctgaggccagc

SEQ ID NO: 2843245 - DNA, 16 bp, Homo sapiens
cctctgaggccagcct

SEQ ID NO: 2843246 - DNA, 18 bp, Homo sapiens
cctctgatacccagagca

SEQ ID NO: 2843247 - DNA, 20 bp, Homo sapiens
cctctgatacccagagcatt

SEQ ID NO: 2843248 - DNA, 13 bp, Homo sapiens
cctctgccacctc

SEQ ID NO: 2843249 - DNA, 15 bp, Homo sapiens
cctctgccacctccc

SEQ ID NO: 2843250 - DNA, 12 bp, Homo sapiens
cctctgcctcaa

SEQ ID NO: 2843251 - DNA, 12 bp, Homo sapiens
cctctgcctgtc

SEQ ID NO: 2843252 - DNA, 21 bp, Homo sapiens
cctctggatggcaccagaggc

SEQ ID NO: 2843253 - DNA, 23 bp, Homo sapiens
cctctggctggctaactggaagc

SEQ ID NO: 2843254 - DNA, 17 bp, Homo sapiens
cctctgtccaggcactg

SEQ ID NO: 2843255 - DNA, 14 bp, Homo sapiens
cctctgtccagggc

SEQ ID NO: 2843256 - DNA, 15 bp, Homo sapiens
cctctgtccagggcc

SEQ ID NO: 2843257 - DNA, 20 bp, Homo sapiens
cctctgtctcgagcgccctg

SEQ ID NO: 2843258 - DNA, 22 bp, Homo sapiens
cctctgtctctgctcttgcctg

SEQ ID NO: 2843259 - DNA, 23 bp, Homo sapiens
cctctgtctctgctcttgcctgc

SEQ ID NO: 2843260 - DNA, 17 bp, Homo sapiens
cctcttaaaaaataaaa

SEQ ID NO: 2843261 - DNA, 18 bp, Homo sapiens
cctcttaaaaaataaaaa

SEQ ID NO: 2843262 - DNA, 17 bp, Homo sapiens
cctcttaaagctgcctg

SEQ ID NO: 2843263 - DNA, 13 bp, Homo sapiens
cctcttattccta

SEQ ID NO: 2843264 - DNA, 16 bp, Homo sapiens
cctcttattcctaagg

SEQ ID NO: 2843265 - DNA, 18 bp, Homo sapiens
cctcttccgtgacgtcac

SEQ ID NO: 2843266 - DNA, 15 bp, Homo sapiens
cctcttcctccctca

SEQ ID NO: 2843267 - DNA, 16 bp, Homo sapiens
cctcttcctccctcat

SEQ ID NO: 2843268 - DNA, 19 bp, Homo sapiens
cctcttcctccctcattcc

SEQ ID NO: 2843269 - DNA, 22 bp, Homo sapiens
cctcttgccactgcctcttcct

SEQ ID NO: 2843270 - DNA, 12 bp, Homo sapiens
cctcttgctcaa

SEQ ID NO: 2843271 - DNA, 15 bp, Homo sapiens
cctcttggacctctg

SEQ ID NO: 2843272 - DNA, 19 bp, Homo sapiens
cctcttggacctctgctct

SEQ ID NO: 2843273 - DNA, 22 bp, Homo sapiens
cctcttgggcatgctcagccct

SEQ ID NO: 2843274 - DNA, 24 bp, Homo sapiens
cctcttgggcatgctcagcccttc

SEQ ID NO: 2843275 - DNA, 21 bp, Homo sapiens
cctctttgcctgtgtgagcat

SEQ ID NO: 2843276 - DNA, 13 bp, Homo sapiens
cctgaaagtgaca

SEQ ID NO: 2843277 - DNA, 17 bp, Homo sapiens
cctgaacaagaattgga

SEQ ID NO: 2843278 - DNA, 23 bp, Homo sapiens
cctgaagatttcagaggctgcag

SEQ ID NO: 2843279 - DNA, 16 bp, Homo sapiens
cctgaagtcacacagt

SEQ ID NO: 2843280 - DNA, 17 bp, Homo sapiens
cctgaagtcacacagtg

SEQ ID NO: 2843281 - DNA, 19 bp, Homo sapiens
cctgaagtcacacagtgag

SEQ ID NO: 2843282 - DNA, 16 bp, Homo sapiens
cctgaatattaatccc

SEQ ID NO: 2843283 - DNA, 18 bp, Homo sapiens
cctgaatccatcaggact

SEQ ID NO: 2843284 - DNA, 22 bp, Homo sapiens
cctgaatggttccatgcctgag

SEQ ID NO: 2843285 - DNA, 15 bp, Homo sapiens
cctgaattattccaa

SEQ ID NO: 2843286 - DNA, 20 bp, Homo sapiens
cctgacagatgtcagccgag

SEQ ID NO: 2843287 - DNA, 21 bp, Homo sapiens
cctgacagatgtcagccgagc

SEQ ID NO: 2843288 - DNA, 12 bp, Homo sapiens
cctgacctccca

SEQ ID NO: 2843289 - DNA, 17 bp, Homo sapiens
cctgacctcccagccct

SEQ ID NO: 2843290 - DNA, 18 bp, Homo sapiens
cctgacctcccagcccta

SEQ ID NO: 2843291 - DNA, 23 bp, Homo sapiens
cctgactggtgctataggctgga

SEQ ID NO: 2843292 - DNA, 22 bp, Homo sapiens
cctgagaaacccaccagcctaa

SEQ ID NO: 2843293 - DNA, 12 bp, Homo sapiens
cctgagaccaca

SEQ ID NO: 2843294 - DNA, 17 bp, Homo sapiens
cctgagatcagagtcct

SEQ ID NO: 2843295 - DNA, 14 bp, Homo sapiens
cctgagcactgcca

SEQ ID NO: 2843296 - DNA, 15 bp, Homo sapiens
cctgagcactgccag

SEQ ID NO: 2843297 - DNA, 16 bp, Homo sapiens
cctgagcactgccagg

SEQ ID NO: 2843298 - DNA, 17 bp, Homo sapiens
cctgagcactgccagga

SEQ ID NO: 2843299 - DNA, 18 bp, Homo sapiens
cctgagcctgacctttct

SEQ ID NO: 2843300 - DNA, 12 bp, Homo sapiens
cctgagcctgcc

SEQ ID NO: 2843301 - DNA, 14 bp, Homo sapiens
cctgagcctgccga

SEQ ID NO: 2843302 - DNA, 16 bp, Homo sapiens
cctgagctcggtggac

SEQ ID NO: 2843303 - DNA, 19 bp, Homo sapiens
cctgagctcggtggaccca

SEQ ID NO: 2843304 - DNA, 14 bp, Homo sapiens
cctgaggctgagac

SEQ ID NO: 2843305 - DNA, 13 bp, Homo sapiens
cctgagtcaccag

SEQ ID NO: 2843306 - DNA, 14 bp, Homo sapiens
cctgagtctcctgt

SEQ ID NO: 2843307 - DNA, 18 bp, Homo sapiens
cctgagtctcctgtgccc

SEQ ID NO: 2843308 - DNA, 22 bp, Homo sapiens
cctgatactgggtacaagagcc

SEQ ID NO: 2843309 - DNA, 16 bp, Homo sapiens
cctgatgacagagcga

SEQ ID NO: 2843310 - DNA, 17 bp, Homo sapiens
cctgatggccaggccag

SEQ ID NO: 2843311 - DNA, 16 bp, Homo sapiens
cctgcaaactcactgc

SEQ ID NO: 2843312 - DNA, 12 bp, Homo sapiens
cctgcaaggact

SEQ ID NO: 2843313 - DNA, 16 bp, Homo sapiens
cctgcaatctccaggg

SEQ ID NO: 2843314 - DNA, 17 bp, Homo sapiens
cctgcaatctccagggc

SEQ ID NO: 2843315 - DNA, 20 bp, Homo sapiens
cctgcaatctccagggctgc

SEQ ID NO: 2843316 - DNA, 21 bp, Homo sapiens
cctgcaccagcccttccctgc

SEQ ID NO: 2843317 - DNA, 22 bp, Homo sapiens
cctgcaccagcccttccctgct

SEQ ID NO: 2843318 - DNA, 13 bp, Homo sapiens
cctgcacccgtac

SEQ ID NO: 2843319 - DNA, 15 bp, Homo sapiens
cctgcacccgtaccc

SEQ ID NO: 2843320 - DNA, 19 bp, Homo sapiens
cctgcacccttcctcctcc

SEQ ID NO: 2843321 - DNA, 18 bp, Homo sapiens
cctgcacctccccccact

SEQ ID NO: 2843322 - DNA, 20 bp, Homo sapiens
cctgcacctccccccactgc

SEQ ID NO: 2843323 - DNA, 22 bp, Homo sapiens
cctgcacttgcagactctacag

SEQ ID NO: 2843324 - DNA, 15 bp, Homo sapiens
cctgcagaccctgcc

SEQ ID NO: 2843325 - DNA, 17 bp, Homo sapiens
cctgcagaccctgccct

SEQ ID NO: 2843326 - DNA, 18 bp, Homo sapiens
cctgcagaccctgccctt

SEQ ID NO: 2843327 - DNA, 15 bp, Homo sapiens
cctgcagcctcctcc

SEQ ID NO: 2843328 - DNA, 15 bp, Homo sapiens
cctgcagcctggtag

SEQ ID NO: 2843329 - DNA, 15 bp, Homo sapiens
cctcatgaccctcct

SEQ ID NO: 2843330 - DNA, 14 bp, Homo sapiens
cctcatgcctggcc

SEQ ID NO: 2843331 - DNA, 23 bp, Homo sapiens
cctcatgcctggcccccctccag

SEQ ID NO: 2843332 - DNA, 21 bp, Homo sapiens
cctcattccaccttcccatgc

SEQ ID NO: 2843333 - DNA, 15 bp, Homo sapiens
cctcattcccctcgt

SEQ ID NO: 2843334 - DNA, 22 bp, Homo sapiens
cctccaaggggctttgtcctgg

SEQ ID NO: 2843335 - DNA, 22 bp, Homo sapiens
cctccaattccacagtctctgg

SEQ ID NO: 2843336 - DNA, 13 bp, Homo sapiens
cctccaccccagg

SEQ ID NO: 2843337 - DNA, 21 bp, Homo sapiens
cctccagctggaattgctgct

SEQ ID NO: 2843338 - DNA, 23 bp, Homo sapiens
cctccagctggaattgctgctct

SEQ ID NO: 2843339 - DNA, 13 bp, Homo sapiens
cctccagctttcc

SEQ ID NO: 2843340 - DNA, 13 bp, Homo sapiens
cctccaggagcct

SEQ ID NO: 2843341 - DNA, 10 bp, Homo sapiens
cctccaggca

SEQ ID NO: 2843342 - DNA, 20 bp, Homo sapiens
cctccaggcatgctggcctc

SEQ ID NO: 2843343 - DNA, 22 bp, Homo sapiens
cctccaggcatgctggcctccc

SEQ ID NO: 2843344 - DNA, 12 bp, Homo sapiens
cctccagggcca

SEQ ID NO: 2843345 - DNA, 18 bp, Homo sapiens
cctccagggccacgtgcc

SEQ ID NO: 2843346 - DNA, 22 bp, Homo sapiens
cctccagggccacgtgccaggc

SEQ ID NO: 2843347 - DNA, 18 bp, Homo sapiens
cctccatcccgcccttcc

SEQ ID NO: 2843348 - DNA, 12 bp, Homo sapiens
cctccatgtggg

SEQ ID NO: 2843349 - DNA, 15 bp, Homo sapiens
cctccatgtgggcta

SEQ ID NO: 2843350 - DNA, 15 bp, Homo sapiens
cctccattctgacca

SEQ ID NO: 2843351 - DNA, 24 bp, Homo sapiens
cctccatttctggcttctagtctg

SEQ ID NO: 2843352 - DNA, 18 bp, Homo sapiens
cctcccaataaagctgga

SEQ ID NO: 2843353 - DNA, 21 bp, Homo sapiens
cctcccaccaccctcccacca

SEQ ID NO: 2843354 - DNA, 15 bp, Homo sapiens
cctcccacccccagc

SEQ ID NO: 2843355 - DNA, 16 bp, Homo sapiens
cctcccacccccagcc

SEQ ID NO: 2843356 - DNA, 15 bp, Homo sapiens
cctcccacctcagcc

SEQ ID NO: 2843357 - DNA, 19 bp, Homo sapiens
cctcccaggggctccacct

SEQ ID NO: 2843358 - DNA, 14 bp, Homo sapiens
cctccccccactgc

SEQ ID NO: 2843359 - DNA, 16 bp, Homo sapiens
cctccccccagcccct

SEQ ID NO: 2843360 - DNA, 13 bp, Homo sapiens
cctccccctgcca

SEQ ID NO: 2843361 - DNA, 15 bp, Homo sapiens
cctccccctgccagt

SEQ ID NO: 2843362 - DNA, 18 bp, Homo sapiens
cctccccctgccagtgcc

SEQ ID NO: 2843363 - DNA, 19 bp, Homo sapiens
cctccccctgccagtgcct

SEQ ID NO: 2843364 - DNA, 18 bp, Homo sapiens
cctcccctatccacccag

SEQ ID NO: 2843365 - DNA, 22 bp, Homo sapiens
cctcccctatccacccagccca

SEQ ID NO: 2843366 - DNA, 17 bp, Homo sapiens
cctcccgaatagctggg

SEQ ID NO: 2843367 - DNA, 12 bp, Homo sapiens
cctccctccacc

SEQ ID NO: 2843368 - DNA, 14 bp, Homo sapiens
cctccctctgacct

SEQ ID NO: 2843369 - DNA, 19 bp, Homo sapiens
cctccctctgacctgcagg

SEQ ID NO: 2843370 - DNA, 12 bp, Homo sapiens
cctccctcttcc

SEQ ID NO: 2843371 - DNA, 17 bp, Homo sapiens
cctccctcttccttccc

SEQ ID NO: 2843372 - DNA, 20 bp, Homo sapiens
cctccctgaaccatccctga

SEQ ID NO: 2843373 - DNA, 12 bp, Homo sapiens
cctccctgtcct

SEQ ID NO: 2843374 - DNA, 16 bp, Homo sapiens
cctccctgtcctcctc

SEQ ID NO: 2843375 - DNA, 12 bp, Homo sapiens
cctccgccccag

SEQ ID NO: 2843376 - DNA, 16 bp, Homo sapiens
cctccgccccagacac

SEQ ID NO: 2843377 - DNA, 19 bp, Homo sapiens
cctccgctgggaggaacct

SEQ ID NO: 2843378 - DNA, 16 bp, Homo sapiens
cctccgtctgcaatgt

SEQ ID NO: 2843379 - DNA, 13 bp, Homo sapiens
cctcctcaccccc

SEQ ID NO: 2843380 - DNA, 14 bp, Homo sapiens
cctcctcaccccca

SEQ ID NO: 2843381 - DNA, 16 bp, Homo sapiens
cctcctcacccccagc

SEQ ID NO: 2843382 - DNA, 13 bp, Homo sapiens
cctcctcccacca

SEQ ID NO: 2843383 - DNA, 17 bp, Homo sapiens
cctcctccccttcctgc

SEQ ID NO: 2843384 - DNA, 14 bp, Homo sapiens
cctcctcctgccct

SEQ ID NO: 2843385 - DNA, 12 bp, Homo sapiens
cctcctctgcca

SEQ ID NO: 2843386 - DNA, 21 bp, Homo sapiens
cctcctgcccaggagagccag

SEQ ID NO: 2843387 - DNA, 23 bp, Homo sapiens
cctcctgcccaggagagccagcc

SEQ ID NO: 2843388 - DNA, 23 bp, Homo sapiens
cctcctgcctcgaactggctgca

SEQ ID NO: 2843389 - DNA, 13 bp, Homo sapiens
cctcctgcctcta

SEQ ID NO: 2843390 - DNA, 18 bp, Homo sapiens
cctcctgcctctactggg

SEQ ID NO: 2843391 - DNA, 22 bp, Homo sapiens
cctcctgtgtgtgcgcctacag

SEQ ID NO: 2843392 - DNA, 23 bp, Homo sapiens
cctcctgtgtgtgcgcctacagg

SEQ ID NO: 2843393 - DNA, 23 bp, Homo sapiens
cctcgcaacccgtgccaagtcca

SEQ ID NO: 2843394 - DNA, 18 bp, Homo sapiens
cctcgcatgccagagcct

SEQ ID NO: 2843395 - DNA, 12 bp, Homo sapiens
cctcgccctggg

SEQ ID NO: 2843396 - DNA, 17 bp, Homo sapiens
cctcgctccccactctg

SEQ ID NO: 2843397 - DNA, 18 bp, Homo sapiens
cctcgctccccactctgc

SEQ ID NO: 2843398 - DNA, 23 bp, Homo sapiens
cctcgctccccactctgctctga

SEQ ID NO: 2843399 - DNA, 14 bp, Homo sapiens
cctcggagcctcat

SEQ ID NO: 2843400 - DNA, 17 bp, Homo sapiens
cctcgtcctccccctgc

SEQ ID NO: 2843401 - DNA, 15 bp, Homo sapiens
cctacatccccaggt

SEQ ID NO: 2843402 - DNA, 17 bp, Homo sapiens
cctacattccctggcct

SEQ ID NO: 2843403 - DNA, 18 bp, Homo sapiens
cctacattccctggcctg

SEQ ID NO: 2843404 - DNA, 15 bp, Homo sapiens
cctaccacagtgtct

SEQ ID NO: 2843405 - DNA, 13 bp, Homo sapiens
cctaccacccctt

SEQ ID NO: 2843406 - DNA, 18 bp, Homo sapiens
cctaccaccccttcctgt

SEQ ID NO: 2843407 - DNA, 13 bp, Homo sapiens
cctaccccacctc

SEQ ID NO: 2843408 - DNA, 19 bp, Homo sapiens
cctaccccacctcatgcct

SEQ ID NO: 2843409 - DNA, 21 bp, Homo sapiens
cctaccccctgaaagtgacag

SEQ ID NO: 2843410 - DNA, 12 bp, Homo sapiens
cctacctcagcc

SEQ ID NO: 2843411 - DNA, 13 bp, Homo sapiens
cctacctcagcct

SEQ ID NO: 2843412 - DNA, 16 bp, Homo sapiens
cctacctcagcctaga

SEQ ID NO: 2843413 - DNA, 14 bp, Homo sapiens
cctacctgtgcctg

SEQ ID NO: 2843414 - DNA, 23 bp, Homo sapiens
cctactcacacaggcatttcctg

SEQ ID NO: 2843415 - DNA, 13 bp, Homo sapiens
cctactgactgat

SEQ ID NO: 2843416 - DNA, 18 bp, Homo sapiens
cctacttcattttcagag

SEQ ID NO: 2843417 - DNA, 17 bp, Homo sapiens
cctagatccacacacag

SEQ ID NO: 2843418 - DNA, 20 bp, Homo sapiens
cctagatccacacacagagg

SEQ ID NO: 2843419 - DNA, 17 bp, Homo sapiens
cctagccgacctcagcc

SEQ ID NO: 2843420 - DNA, 19 bp, Homo sapiens
cctagccttagaagtcaca

SEQ ID NO: 2843421 - DNA, 22 bp, Homo sapiens
cctagccttagaagtcacacag

SEQ ID NO: 2843422 - DNA, 23 bp, Homo sapiens
cctaggccacaccatctcctttc

SEQ ID NO: 2843423 - DNA, 16 bp, Homo sapiens
cctaggccactcctcc

SEQ ID NO: 2843424 - DNA, 17 bp, Homo sapiens
cctaggccactcctcca

SEQ ID NO: 2843425 - DNA, 22 bp, Homo sapiens
cctagggccttttgtggattga

SEQ ID NO: 2843426 - DNA, 13 bp, Homo sapiens
cctaggtgacaga

SEQ ID NO: 2843427 - DNA, 15 bp, Homo sapiens
cctagttttctcctc

SEQ ID NO: 2843428 - DNA, 18 bp, Homo sapiens
cctagttttctcctccca

SEQ ID NO: 2843429 - DNA, 19 bp, Homo sapiens
cctagttttctcctcccag

SEQ ID NO: 2843430 - DNA, 20 bp, Homo sapiens
cctagttttctcctcccagg

SEQ ID NO: 2843431 - DNA, 18 bp, Homo sapiens
cctatagtcccagctact

SEQ ID NO: 2843432 - DNA, 13 bp, Homo sapiens
cctatcaaaacat

SEQ ID NO: 2843433 - DNA, 20 bp, Homo sapiens
cctatcaaaacatatcaatt

SEQ ID NO: 2843434 - DNA, 13 bp, Homo sapiens
cctatccacccag

SEQ ID NO: 2843435 - DNA, 14 bp, Homo sapiens
cctatccacccagc

SEQ ID NO: 2843436 - DNA, 18 bp, Homo sapiens
cctatccacccagcccat

SEQ ID NO: 2843437 - DNA, 12 bp, Homo sapiens
cctatccatcct

SEQ ID NO: 2843438 - DNA, 18 bp, Homo sapiens
cctatcttttagttttag

SEQ ID NO: 2843439 - DNA, 15 bp, Homo sapiens
cctatgatcccagca

SEQ ID NO: 2843440 - DNA, 16 bp, Homo sapiens
cctatggagagccctg

SEQ ID NO: 2843441 - DNA, 17 bp, Homo sapiens
cctatggagagccctgg

SEQ ID NO: 2843442 - DNA, 22 bp, Homo sapiens
cctatggagagccctgggaccg

SEQ ID NO: 2843443 - DNA, 22 bp, Homo sapiens
cctatggtataatggttgactg

SEQ ID NO: 2843444 - DNA, 14 bp, Homo sapiens
cctatgtcctaagg

SEQ ID NO: 2843445 - DNA, 15 bp, Homo sapiens
cctatgtcctaagga

SEQ ID NO: 2843446 - DNA, 17 bp, Homo sapiens
cctattaaaacacagct

SEQ ID NO: 2843447 - DNA, 19 bp, Homo sapiens
cctattatttccgggtgga

SEQ ID NO: 2843448 - DNA, 13 bp, Homo sapiens
cctattctcacca

SEQ ID NO: 2843449 - DNA, 16 bp, Homo sapiens
cctattctcaccagga

SEQ ID NO: 2843450 - DNA, 19 bp, Homo sapiens
cctattctcaccaggaagg

SEQ ID NO: 2843451 - DNA, 21 bp, Homo sapiens
cctattttaaaaccatgcagc

SEQ ID NO: 2843452 - DNA, 20 bp, Homo sapiens
cctcaaaaagatttccccat

SEQ ID NO: 2843453 - DNA, 21 bp, Homo sapiens
cctcaaagcaagcattcagaa

SEQ ID NO: 2843454 - DNA, 22 bp, Homo sapiens
cctcaaataaaaagtgcttttg

SEQ ID NO: 2843455 - DNA, 21 bp, Homo sapiens
cctcaaatacatacctactga

SEQ ID NO: 2843456 - DNA, 16 bp, Homo sapiens
cctcaacctcctgggc

SEQ ID NO: 2843457 - DNA, 19 bp, Homo sapiens
cctcaacgttgctccccat

SEQ ID NO: 2843458 - DNA, 21 bp, Homo sapiens
cctcaatccccaagctggcag

SEQ ID NO: 2843459 - DNA, 21 bp, Homo sapiens
cctcaatgtgaatcagaccct

SEQ ID NO: 2843460 - DNA, 12 bp, Homo sapiens
cctcaccaataa

SEQ ID NO: 2843461 - DNA, 17 bp, Homo sapiens
cctcaccccctcccacc

SEQ ID NO: 2843462 - DNA, 21 bp, Homo sapiens
cctcacccgaggctgcccact

SEQ ID NO: 2843463 - DNA, 13 bp, Homo sapiens
cctcacctgcctg

SEQ ID NO: 2843464 - DNA, 15 bp, Homo sapiens
cctcacgcccagcct

SEQ ID NO: 2843465 - DNA, 13 bp, Homo sapiens
cctcactccacac

SEQ ID NO: 2843466 - DNA, 12 bp, Homo sapiens
cctcactcctgt

SEQ ID NO: 2843467 - DNA, 14 bp, Homo sapiens
cctcactgccccac

SEQ ID NO: 2843468 - DNA, 19 bp, Homo sapiens
cctcactgccccaccagcc

SEQ ID NO: 2843469 - DNA, 15 bp, Homo sapiens
cctcactgccttcca

SEQ ID NO: 2843470 - DNA, 17 bp, Homo sapiens
cctcactgctggggagt

SEQ ID NO: 2843471 - DNA, 19 bp, Homo sapiens
cctcactggggtcctgggg

SEQ ID NO: 2843472 - DNA, 23 bp, Homo sapiens
cctcactggggtcctggggcctc

SEQ ID NO: 2843473 - DNA, 18 bp, Homo sapiens
cctcacttttaatgaaca

SEQ ID NO: 2843474 - DNA, 14 bp, Homo sapiens
cctcagaccaactc

SEQ ID NO: 2843475 - DNA, 15 bp, Homo sapiens
cctcagactgctcaa

SEQ ID NO: 2843476 - DNA, 15 bp, Homo sapiens
cccagtgtggcccca

SEQ ID NO: 2843477 - DNA, 20 bp, Homo sapiens
cccagtgtggccccagcccg

SEQ ID NO: 2843478 - DNA, 22 bp, Homo sapiens
cccagttcaggagtcccaagga

SEQ ID NO: 2843479 - DNA, 13 bp, Homo sapiens
cccagttctgctc

SEQ ID NO: 2843480 - DNA, 15 bp, Homo sapiens
cccagttctgctcct

SEQ ID NO: 2843481 - DNA, 16 bp, Homo sapiens
cccagttctgctcctc

SEQ ID NO: 2843482 - DNA, 14 bp, Homo sapiens
cccagttgggtgga

SEQ ID NO: 2843483 - DNA, 16 bp, Homo sapiens
cccagtttgcagaaaa

SEQ ID NO: 2843484 - DNA, 23 bp, Homo sapiens
cccagtttgcagaaaagcacctg

SEQ ID NO: 2843485 - DNA, 17 bp, Homo sapiens
cccatagatcttctgaa

SEQ ID NO: 2843486 - DNA, 13 bp, Homo sapiens
cccatagcttcca

SEQ ID NO: 2843487 - DNA, 20 bp, Homo sapiens
cccatcacctactcacacag

SEQ ID NO: 2843488 - DNA, 22 bp, Homo sapiens
cccatcacctactcacacaggc

SEQ ID NO: 2843489 - DNA, 20 bp, Homo sapiens
cccatcactggagcaccagg

SEQ ID NO: 2843490 - DNA, 16 bp, Homo sapiens
cccatcagaggctggg

SEQ ID NO: 2843491 - DNA, 18 bp, Homo sapiens
cccatcagaggctggggg

SEQ ID NO: 2843492 - DNA, 22 bp, Homo sapiens
cccatcatatcctttgccccaa

SEQ ID NO: 2843493 - DNA, 12 bp, Homo sapiens
cccatcatccca

SEQ ID NO: 2843494 - DNA, 14 bp, Homo sapiens
cccatccatcagct

SEQ ID NO: 2843495 - DNA, 15 bp, Homo sapiens
cccatccatcagctc

SEQ ID NO: 2843496 - DNA, 17 bp, Homo sapiens
cccatccatcagctccc

SEQ ID NO: 2843497 - DNA, 21 bp, Homo sapiens
cccatctaagctgcagcttcc

SEQ ID NO: 2843498 - DNA, 21 bp, Homo sapiens
cccatctatgtcccttgctgt

SEQ ID NO: 2843499 - DNA, 12 bp, Homo sapiens
cccatctccccc

SEQ ID NO: 2843500 - DNA, 19 bp, Homo sapiens
cccatgaagacaggacagt

SEQ ID NO: 2843501 - DNA, 22 bp, Homo sapiens
cccatgaagacaggacagtgct

SEQ ID NO: 2843502 - DNA, 16 bp, Homo sapiens
cccatgacctccagct

SEQ ID NO: 2843503 - DNA, 15 bp, Homo sapiens
cccatgagcctcagc

SEQ ID NO: 2843504 - DNA, 16 bp, Homo sapiens
cccatgagcctcagca

SEQ ID NO: 2843505 - DNA, 20 bp, Homo sapiens
cccatgagcctcagcatcct

SEQ ID NO: 2843506 - DNA, 19 bp, Homo sapiens
cccatgatgccgctcttct

SEQ ID NO: 2843507 - DNA, 14 bp, Homo sapiens
cccattcacagagc

SEQ ID NO: 2843508 - DNA, 20 bp, Homo sapiens
cccattctctctcctgtcca

SEQ ID NO: 2843509 - DNA, 13 bp, Homo sapiens
cccattctgcctg

SEQ ID NO: 2843510 - DNA, 21 bp, Homo sapiens
cccattctgcctgcccaggcc

SEQ ID NO: 2843511 - DNA, 22 bp, Homo sapiens
cccattctgcctgcccaggccc

SEQ ID NO: 2843512 - DNA, 23 bp, Homo sapiens
cccattctgcctgcccaggcccc

SEQ ID NO: 2843513 - DNA, 16 bp, Homo sapiens
cccatttctatttatt

SEQ ID NO: 2843514 - DNA, 12 bp, Homo sapiens
cccatttgtaat

SEQ ID NO: 2843515 - DNA, 17 bp, Homo sapiens
cccattttgagtgactc

SEQ ID NO: 2843516 - DNA, 22 bp, Homo sapiens
cccattttgcaaaatttccagt

SEQ ID NO: 2843517 - DNA, 16 bp, Homo sapiens
cccatttttgagccaa

SEQ ID NO: 2843518 - DNA, 17 bp, Homo sapiens
cccatttttgagccaag

SEQ ID NO: 2843519 - DNA, 19 bp, Homo sapiens
ccccaaacgggctgccctg

SEQ ID NO: 2843520 - DNA, 22 bp, Homo sapiens
ccccaaagagcctggagaagct

SEQ ID NO: 2843521 - DNA, 14 bp, Homo sapiens
ccccaaatcccaca

SEQ ID NO: 2843522 - DNA, 23 bp, Homo sapiens
ccccaacccgtggaggctgctcg

SEQ ID NO: 2843523 - DNA, 16 bp, Homo sapiens
ccccaactccttccag

SEQ ID NO: 2843524 - DNA, 20 bp, Homo sapiens
ccccaattatcttatttaat

SEQ ID NO: 2843525 - DNA, 22 bp, Homo sapiens
ccccacaggccccccgcagcac

SEQ ID NO: 2843526 - DNA, 15 bp, Homo sapiens
ccccaccacactgaa

SEQ ID NO: 2843527 - DNA, 22 bp, Homo sapiens
ccccaccctcgtggacacctgc

SEQ ID NO: 2843528 - DNA, 17 bp, Homo sapiens
ccccaccttccccagac

SEQ ID NO: 2843529 - DNA, 14 bp, Homo sapiens
ccccaccttgccaa

SEQ ID NO: 2843530 - DNA, 14 bp, Homo sapiens
ccccactccccacc

SEQ ID NO: 2843531 - DNA, 12 bp, Homo sapiens
ccccactctgct

SEQ ID NO: 2843532 - DNA, 19 bp, Homo sapiens
ccccacttctctactctgg

SEQ ID NO: 2843533 - DNA, 13 bp, Homo sapiens
ccccagacactgg

SEQ ID NO: 2843534 - DNA, 17 bp, Homo sapiens
ccccagactcagctcca

SEQ ID NO: 2843535 - DNA, 19 bp, Homo sapiens
ccccagacttctctttctt

SEQ ID NO: 2843536 - DNA, 12 bp, Homo sapiens
ccccagcaagag

SEQ ID NO: 2843537 - DNA, 19 bp, Homo sapiens
ccccagcaagtgagagctg

SEQ ID NO: 2843538 - DNA, 20 bp, Homo sapiens
ccccagcaagtgagagctgg

SEQ ID NO: 2843539 - DNA, 11 bp, Homo sapiens
ccccagcacta

SEQ ID NO: 2843540 - DNA, 19 bp, Homo sapiens
ccccagcactcctctgtct

SEQ ID NO: 2843541 - DNA, 12 bp, Homo sapiens
ccccagcagctc

SEQ ID NO: 2843542 - DNA, 10 bp, Homo sapiens
ccccagctcc

SEQ ID NO: 2843543 - DNA, 19 bp, Homo sapiens
ccccagctccccaggactc

SEQ ID NO: 2843544 - DNA, 23 bp, Homo sapiens
ccccagctgtcatcaattaaagg

SEQ ID NO: 2843545 - DNA, 22 bp, Homo sapiens
ccccaggcttgtcactagcagc

SEQ ID NO: 2843546 - DNA, 11 bp, Homo sapiens
ccccagggcac

SEQ ID NO: 2843547 - DNA, 15 bp, Homo sapiens
ccccagggcacagga

SEQ ID NO: 2843548 - DNA, 18 bp, Homo sapiens
ccccagggcacaggagct

SEQ ID NO: 2843549 - DNA, 22 bp, Homo sapiens
ccccagggcacaggagctacct

SEQ ID NO: 2843550 - DNA, 17 bp, Homo sapiens
ccccagggcccccacag

SEQ ID NO: 2843551 - DNA, 19 bp, Homo sapiens
ccccagggcccccacaggc

SEQ ID NO: 2843552 - DNA, 18 bp, Homo sapiens
ccccaggtctctccactg

SEQ ID NO: 2843553 - DNA, 21 bp, Homo sapiens
ccccaggtggctgacccagtc

SEQ ID NO: 2843554 - DNA, 17 bp, Homo sapiens
ccccagtcgagccctgc

SEQ ID NO: 2843555 - DNA, 19 bp, Homo sapiens
ccccagtcgagccctgcag

SEQ ID NO: 2843556 - DNA, 16 bp, Homo sapiens
ccccagtgctacctct

SEQ ID NO: 2843557 - DNA, 21 bp, Homo sapiens
ccagttcaggagtcccaagga

SEQ ID NO: 2843558 - DNA, 13 bp, Homo sapiens
ccagttctgctcc

SEQ ID NO: 2843559 - DNA, 21 bp, Homo sapiens
ccagtttcaggtgtttagttg

SEQ ID NO: 2843560 - DNA, 20 bp, Homo sapiens
ccagtttccccatggggctg

SEQ ID NO: 2843561 - DNA, 13 bp, Homo sapiens
ccagtttgcagaa

SEQ ID NO: 2843562 - DNA, 13 bp, Homo sapiens
ccagtttgctttg

SEQ ID NO: 2843563 - DNA, 14 bp, Homo sapiens
ccataaacttcatg

SEQ ID NO: 2843564 - DNA, 15 bp, Homo sapiens
ccataacagccaaca

SEQ ID NO: 2843565 - DNA, 17 bp, Homo sapiens
ccataagcctccattta

SEQ ID NO: 2843566 - DNA, 21 bp, Homo sapiens
ccataatctggactcctctgt

SEQ ID NO: 2843567 - DNA, 17 bp, Homo sapiens
ccataattttcttcatg

SEQ ID NO: 2843568 - DNA, 14 bp, Homo sapiens
ccatagatcttctg

SEQ ID NO: 2843569 - DNA, 21 bp, Homo sapiens
ccatagatcttctgaaatgaa

SEQ ID NO: 2843570 - DNA, 21 bp, Homo sapiens
ccatagatgggtctggctgag

SEQ ID NO: 2843571 - DNA, 15 bp, Homo sapiens
ccataggtagaatgt

SEQ ID NO: 2843572 - DNA, 13 bp, Homo sapiens
ccatcagctccct

SEQ ID NO: 2843573 - DNA, 24 bp, Homo sapiens
ccatcagggtgggccactctcccc

SEQ ID NO: 2843574 - DNA, 13 bp, Homo sapiens
ccatcagttactg

SEQ ID NO: 2843575 - DNA, 12 bp, Homo sapiens
ccatcatgtctg

SEQ ID NO: 2843576 - DNA, 17 bp, Homo sapiens
ccatcatgtgcctggaa

SEQ ID NO: 2843577 - DNA, 18 bp, Homo sapiens
ccatcatgtgcctggaaa

SEQ ID NO: 2843578 - DNA, 17 bp, Homo sapiens
ccatcattataaacgtg

SEQ ID NO: 2843579 - DNA, 17 bp, Homo sapiens
ccatccatcagctccct

SEQ ID NO: 2843580 - DNA, 13 bp, Homo sapiens
ccatccccagcga

SEQ ID NO: 2843581 - DNA, 13 bp, Homo sapiens
ccatcccctttcc

SEQ ID NO: 2843582 - DNA, 14 bp, Homo sapiens
ccatcccctttcct

SEQ ID NO: 2843583 - DNA, 18 bp, Homo sapiens
ccatcccctttcctcccc

SEQ ID NO: 2843584 - DNA, 21 bp, Homo sapiens
ccatcccctttcctccccacc

SEQ ID NO: 2843585 - DNA, 16 bp, Homo sapiens
ccatcccgaaaatctc

SEQ ID NO: 2843586 - DNA, 16 bp, Homo sapiens
ccatcctgcagcctcc

SEQ ID NO: 2843587 - DNA, 22 bp, Homo sapiens
ccatcctgcagcctcctcctga

SEQ ID NO: 2843588 - DNA, 15 bp, Homo sapiens
ccatcctgtcctttg

SEQ ID NO: 2843589 - DNA, 17 bp, Homo sapiens
ccatctaagctgcagct

SEQ ID NO: 2843590 - DNA, 20 bp, Homo sapiens
ccatctaagctgcagcttcc

SEQ ID NO: 2843591 - DNA, 17 bp, Homo sapiens
ccatctcctttcaggga

SEQ ID NO: 2843592 - DNA, 18 bp, Homo sapiens
ccatctcctttcagggaa

SEQ ID NO: 2843593 - DNA, 14 bp, Homo sapiens
ccatctctcttccc

SEQ ID NO: 2843594 - DNA, 23 bp, Homo sapiens
ccatctctgattttcaaagcttt

SEQ ID NO: 2843595 - DNA, 22 bp, Homo sapiens
ccatctgctgccccgcttcccc

SEQ ID NO: 2843596 - DNA, 20 bp, Homo sapiens
ccatctgtcttgccagccag

SEQ ID NO: 2843597 - DNA, 17 bp, Homo sapiens
ccatgaatcaaagacat

SEQ ID NO: 2843598 - DNA, 17 bp, Homo sapiens
ccatgagaagagggcct

SEQ ID NO: 2843599 - DNA, 21 bp, Homo sapiens
ccatgagcctcagcatcctgg

SEQ ID NO: 2843600 - DNA, 22 bp, Homo sapiens
ccatgatgccgctcttctgtca

SEQ ID NO: 2843601 - DNA, 14 bp, Homo sapiens
ccatgcagcttcat

SEQ ID NO: 2843602 - DNA, 14 bp, Homo sapiens
ccatgcctgagggt

SEQ ID NO: 2843603 - DNA, 15 bp, Homo sapiens
ccatgcctgagggtg

SEQ ID NO: 2843604 - DNA, 18 bp, Homo sapiens
ccatgcctgagggtggag

SEQ ID NO: 2843605 - DNA, 16 bp, Homo sapiens
ccatgctcaaccactg

SEQ ID NO: 2843606 - DNA, 18 bp, Homo sapiens
ccatgctcaaccactgtg

SEQ ID NO: 2843607 - DNA, 16 bp, Homo sapiens
ccatgctgaattattt

SEQ ID NO: 2843608 - DNA, 18 bp, Homo sapiens
ccatgctgaattattttg

SEQ ID NO: 2843609 - DNA, 14 bp, Homo sapiens
ccatgctgcctcca

SEQ ID NO: 2843610 - DNA, 20 bp, Homo sapiens
ccatgcttcttgccccttgg

SEQ ID NO: 2843611 - DNA, 19 bp, Homo sapiens
ccatggcgtgtccctctcg

SEQ ID NO: 2843612 - DNA, 13 bp, Homo sapiens
ccatgggcctcct

SEQ ID NO: 2843613 - DNA, 13 bp, Homo sapiens
ccatggggctgcg

SEQ ID NO: 2843614 - DNA, 16 bp, Homo sapiens
ccatgtcaaacaaata

SEQ ID NO: 2843615 - DNA, 18 bp, Homo sapiens
ccatgtcgcctgccccca

SEQ ID NO: 2843616 - DNA, 16 bp, Homo sapiens
ccatgtctctcagaat

SEQ ID NO: 2843617 - DNA, 18 bp, Homo sapiens
ccatgttagtttttactt

SEQ ID NO: 2843618 - DNA, 20 bp, Homo sapiens
ccatgttggccaggatggtc

SEQ ID NO: 2843619 - DNA, 19 bp, Homo sapiens
ccatgttggccaggctggt

SEQ ID NO: 2843620 - DNA, 17 bp, Homo sapiens
ccatgtttgagctcaga

SEQ ID NO: 2843621 - DNA, 19 bp, Homo sapiens
ccattacaactagatcaag

SEQ ID NO: 2843622 - DNA, 16 bp, Homo sapiens
ccattagagtcagcct

SEQ ID NO: 2843623 - DNA, 18 bp, Homo sapiens
ccattcacatttgatgta

SEQ ID NO: 2843624 - DNA, 12 bp, Homo sapiens
ccattcctcagg

SEQ ID NO: 2843625 - DNA, 16 bp, Homo sapiens
ccattcctcagggaca

SEQ ID NO: 2843626 - DNA, 16 bp, Homo sapiens
ccattctctctcctgt

SEQ ID NO: 2843627 - DNA, 20 bp, Homo sapiens
ccattctgcctgcccaggcc

SEQ ID NO: 2843628 - DNA, 23 bp, Homo sapiens
ccatttaattcataattagaaca

SEQ ID NO: 2843629 - DNA, 16 bp, Homo sapiens
ccatttaggtttctga

SEQ ID NO: 2843630 - DNA, 21 bp, Homo sapiens
ccatttaggtttctgagttcc

SEQ ID NO: 2843631 - DNA, 16 bp, Homo sapiens
ccatttcatctatttc

SEQ ID NO: 2843632 - DNA, 17 bp, Homo sapiens
ccatttcatctatttct

SEQ ID NO: 2843633 - DNA, 21 bp, Homo sapiens
ccatttcatctatttctgaga

SEQ ID NO: 2843634 - DNA, 13 bp, Homo sapiens
ccatttctattta

SEQ ID NO: 2843635 - DNA, 15 bp, Homo sapiens
ccatttcttcctcac

SEQ ID NO: 2843636 - DNA, 12 bp, Homo sapiens
ccatttgtaatg

SEQ ID NO: 2843637 - DNA, 17 bp, Homo sapiens
ccatttgtaatgtatct

SEQ ID NO: 2843638 - DNA, 12 bp, Homo sapiens
ccattttcgctt

SEQ ID NO: 2843639 - DNA, 14 bp, Homo sapiens
ccattttgcaaaat

SEQ ID NO: 2843640 - DNA, 16 bp, Homo sapiens
ccatttttactaaagc

SEQ ID NO: 2843641 - DNA, 22 bp, Homo sapiens
cccaaaagtcaaaaggtgcctg

SEQ ID NO: 2843642 - DNA, 23 bp, Homo sapiens
cccaaaagtcaaaaggtgcctgt

SEQ ID NO: 2843643 - DNA, 19 bp, Homo sapiens
cccaaagagcctggagaag

SEQ ID NO: 2843644 - DNA, 15 bp, Homo sapiens
cccaaagtgctggga

SEQ ID NO: 2843645 - DNA, 14 bp, Homo sapiens
cccaaataaatgtg

SEQ ID NO: 2843646 - DNA, 17 bp, Homo sapiens
cccaaattggtgtttct

SEQ ID NO: 2843647 - DNA, 15 bp, Homo sapiens
cccaaccccagggcc

SEQ ID NO: 2843648 - DNA, 14 bp, Homo sapiens
cccagagggcccag

SEQ ID NO: 2843649 - DNA, 15 bp, Homo sapiens
cccagagtgtgaaac

SEQ ID NO: 2843650 - DNA, 17 bp, Homo sapiens
cccagagtgtgaaactt

SEQ ID NO: 2843651 - DNA, 16 bp, Homo sapiens
cccagagtgtgggaag

SEQ ID NO: 2843652 - DNA, 12 bp, Homo sapiens
cccagatctcat

SEQ ID NO: 2843653 - DNA, 22 bp, Homo sapiens
cccagattgcaacaggctgggc

SEQ ID NO: 2843654 - DNA, 22 bp, Homo sapiens
cccagcaacacaagctggaagc

SEQ ID NO: 2843655 - DNA, 21 bp, Homo sapiens
cccagcaagtgagagctgggt

SEQ ID NO: 2843656 - DNA, 23 bp, Homo sapiens
cccagcactcctctgtctctgct

SEQ ID NO: 2843657 - DNA, 22 bp, Homo sapiens
cccagcactgtgaagacccagc

SEQ ID NO: 2843658 - DNA, 22 bp, Homo sapiens
cccagcactttgggaggccaag

SEQ ID NO: 2843659 - DNA, 16 bp, Homo sapiens
cccagcagtttgggag

SEQ ID NO: 2843660 - DNA, 18 bp, Homo sapiens
cccagccattaccatgga

SEQ ID NO: 2843661 - DNA, 20 bp, Homo sapiens
cccagccattaccatggaga

SEQ ID NO: 2843662 - DNA, 22 bp, Homo sapiens
cccagccattaccatggagaca

SEQ ID NO: 2843663 - DNA, 19 bp, Homo sapiens
cccagcccacttctgccat

SEQ ID NO: 2843664 - DNA, 16 bp, Homo sapiens
cccagcccagctggtg

SEQ ID NO: 2843665 - DNA, 18 bp, Homo sapiens
cccagcccagctggtggg

SEQ ID NO: 2843666 - DNA, 18 bp, Homo sapiens
cccagcccccacctccgc

SEQ ID NO: 2843667 - DNA, 18 bp, Homo sapiens
cccagccccgactccagc

SEQ ID NO: 2843668 - DNA, 20 bp, Homo sapiens
cccagccccgactccagcca

SEQ ID NO: 2843669 - DNA, 23 bp, Homo sapiens
cccagccccgactccagccagcg

SEQ ID NO: 2843670 - DNA, 16 bp, Homo sapiens
cccagcccctcctccc

SEQ ID NO: 2843671 - DNA, 21 bp, Homo sapiens
cccagcccctcctccccttcc

SEQ ID NO: 2843672 - DNA, 22 bp, Homo sapiens
cccagcccctcctccccttcct

SEQ ID NO: 2843673 - DNA, 23 bp, Homo sapiens
cccagcccctcctccccttcctg

SEQ ID NO: 2843674 - DNA, 18 bp, Homo sapiens
cccagccctatggatgtg

SEQ ID NO: 2843675 - DNA, 21 bp, Homo sapiens
cccagccctttgggaggctga

SEQ ID NO: 2843676 - DNA, 17 bp, Homo sapiens
cccagcctcctcccacc

SEQ ID NO: 2843677 - DNA, 18 bp, Homo sapiens
cccagcctcctcccacca

SEQ ID NO: 2843678 - DNA, 12 bp, Homo sapiens
cccagcctgcta

SEQ ID NO: 2843679 - DNA, 10 bp, Homo sapiens
cccagcctgg

SEQ ID NO: 2843680 - DNA, 15 bp, Homo sapiens
cccagcgagccctgg

SEQ ID NO: 2843681 - DNA, 17 bp, Homo sapiens
cccagcgagccctggtg

SEQ ID NO: 2843682 - DNA, 18 bp, Homo sapiens
cccagcgagccctggtgg

SEQ ID NO: 2843683 - DNA, 23 bp, Homo sapiens
cccagcgagccctggtggcagtg

SEQ ID NO: 2843684 - DNA, 23 bp, Homo sapiens
cccagctaatctgtagggctgga

SEQ ID NO: 2843685 - DNA, 17 bp, Homo sapiens
cccagctactcagaagc

SEQ ID NO: 2843686 - DNA, 15 bp, Homo sapiens
cccagctagggctgg

SEQ ID NO: 2843687 - DNA, 9 bp, Homo sapiens
cccagctcc

SEQ ID NO: 2843688 - DNA, 13 bp, Homo sapiens
cccagctctccct

SEQ ID NO: 2843689 - DNA, 15 bp, Homo sapiens
cccagctctccctct

SEQ ID NO: 2843690 - DNA, 18 bp, Homo sapiens
cccagctctccctctggc

SEQ ID NO: 2843691 - DNA, 19 bp, Homo sapiens
cccagctctccctctggcc

SEQ ID NO: 2843692 - DNA, 13 bp, Homo sapiens
cccagctctggct

SEQ ID NO: 2843693 - DNA, 22 bp, Homo sapiens
cccagctctttgttcagttgac

SEQ ID NO: 2843694 - DNA, 23 bp, Homo sapiens
cccagctctttgttcagttgact

SEQ ID NO: 2843695 - DNA, 12 bp, Homo sapiens
cccagctgcacc

SEQ ID NO: 2843696 - DNA, 19 bp, Homo sapiens
cccagctggtgggaagcgt

SEQ ID NO: 2843697 - DNA, 15 bp, Homo sapiens
cccagctgtctgtgt

SEQ ID NO: 2843698 - DNA, 16 bp, Homo sapiens
cccaggacaagcatgg

SEQ ID NO: 2843699 - DNA, 17 bp, Homo sapiens
cccaggactcaccctca

SEQ ID NO: 2843700 - DNA, 15 bp, Homo sapiens
cccaggagacagttc

SEQ ID NO: 2843701 - DNA, 21 bp, Homo sapiens
cccaggagagccagccctccc

SEQ ID NO: 2843702 - DNA, 18 bp, Homo sapiens
cccaggagccccgaggcc

SEQ ID NO: 2843703 - DNA, 13 bp, Homo sapiens
cccaggccaggcc

SEQ ID NO: 2843704 - DNA, 16 bp, Homo sapiens
cccaggccccatgacc

SEQ ID NO: 2843705 - DNA, 17 bp, Homo sapiens
cccaggccccatgacct

SEQ ID NO: 2843706 - DNA, 21 bp, Homo sapiens
cccaggccccatgacctccag

SEQ ID NO: 2843707 - DNA, 22 bp, Homo sapiens
cccaggccccatgacctccagc

SEQ ID NO: 2843708 - DNA, 19 bp, Homo sapiens
cccaggctggagtgcagtg

SEQ ID NO: 2843709 - DNA, 13 bp, Homo sapiens
cccaggctggcgt

SEQ ID NO: 2843710 - DNA, 17 bp, Homo sapiens
cccaggctggcgtgcag

SEQ ID NO: 2843711 - DNA, 19 bp, Homo sapiens
cccaggcttgtcactagca

SEQ ID NO: 2843712 - DNA, 22 bp, Homo sapiens
cccaggcttgtcactagcagct

SEQ ID NO: 2843713 - DNA, 15 bp, Homo sapiens
cccagggaagttttg

SEQ ID NO: 2843714 - DNA, 11 bp, Homo sapiens
cccagggcaca

SEQ ID NO: 2843715 - DNA, 16 bp, Homo sapiens
cccagggcacaggagc

SEQ ID NO: 2843716 - DNA, 19 bp, Homo sapiens
cccagggcacttcagagta

SEQ ID NO: 2843717 - DNA, 14 bp, Homo sapiens
cccagggcatccca

SEQ ID NO: 2843718 - DNA, 18 bp, Homo sapiens
cccagggccagggccctg

SEQ ID NO: 2843719 - DNA, 21 bp, Homo sapiens
cccagggccagggccctgcag

SEQ ID NO: 2843720 - DNA, 22 bp, Homo sapiens
cccagggccagggccctgcaga

SEQ ID NO: 2843721 - DNA, 18 bp, Homo sapiens
cccagggcccccacaggc

SEQ ID NO: 2843722 - DNA, 21 bp, Homo sapiens
cccagggctaccctcccccag

SEQ ID NO: 2843723 - DNA, 15 bp, Homo sapiens
cccagggctcagcct

SEQ ID NO: 2843724 - DNA, 16 bp, Homo sapiens
cccagggctcagcctg

SEQ ID NO: 2843725 - DNA, 17 bp, Homo sapiens
cccagggctcagcctgg

SEQ ID NO: 2843726 - DNA, 17 bp, Homo sapiens
cccaggggcccacaggg

SEQ ID NO: 2843727 - DNA, 13 bp, Homo sapiens
cccaggtcctcac

SEQ ID NO: 2843728 - DNA, 15 bp, Homo sapiens
cccaggtcctctgat

SEQ ID NO: 2843729 - DNA, 14 bp, Homo sapiens
cccaggtctctcca

SEQ ID NO: 2843730 - DNA, 20 bp, Homo sapiens
cccaggtctctccactgctc

SEQ ID NO: 2843731 - DNA, 16 bp, Homo sapiens
cccaggtggctgaccc

SEQ ID NO: 2843732 - DNA, 23 bp, Homo sapiens
cccaggtggctgacccagtccct

SEQ ID NO: 2843733 - DNA, 13 bp, Homo sapiens
cccaggtttctat

SEQ ID NO: 2843734 - DNA, 13 bp, Homo sapiens
cccagtccccgtg

SEQ ID NO: 2843735 - DNA, 13 bp, Homo sapiens
cccagtccctggg

SEQ ID NO: 2843736 - DNA, 19 bp, Homo sapiens
cccagtcgagccctgcagc

SEQ ID NO: 2843737 - DNA, 10 bp, Homo sapiens
cccagtctgg

SEQ ID NO: 2843738 - DNA, 18 bp, Homo sapiens
ccagagccccacacggag

SEQ ID NO: 2843739 - DNA, 21 bp, Homo sapiens
ccagagccccccacaatgatg

SEQ ID NO: 2843740 - DNA, 12 bp, Homo sapiens
ccagagcctggg

SEQ ID NO: 2843741 - DNA, 13 bp, Homo sapiens
ccagagcctgggg

SEQ ID NO: 2843742 - DNA, 16 bp, Homo sapiens
ccagagcctggggctc

SEQ ID NO: 2843743 - DNA, 18 bp, Homo sapiens
ccagagcctggggctcta

SEQ ID NO: 2843744 - DNA, 13 bp, Homo sapiens
ccagagccttctc

SEQ ID NO: 2843745 - DNA, 17 bp, Homo sapiens
ccagagccttctcctgc

SEQ ID NO: 2843746 - DNA, 18 bp, Homo sapiens
ccagagccttctcctgcc

SEQ ID NO: 2843747 - DNA, 16 bp, Homo sapiens
ccagagggagtgacag

SEQ ID NO: 2843748 - DNA, 17 bp, Homo sapiens
ccagagggagtgacaga

SEQ ID NO: 2843749 - DNA, 22 bp, Homo sapiens
ccagagggagtgacagaggcag

SEQ ID NO: 2843750 - DNA, 23 bp, Homo sapiens
ccagagggagtgacagaggcagc

SEQ ID NO: 2843751 - DNA, 17 bp, Homo sapiens
ccagatgcaccagccct

SEQ ID NO: 2843752 - DNA, 16 bp, Homo sapiens
ccagattgcaacaggc

SEQ ID NO: 2843753 - DNA, 18 bp, Homo sapiens
ccagattgcaacaggctg

SEQ ID NO: 2843754 - DNA, 21 bp, Homo sapiens
ccagattgcaacaggctgggc

SEQ ID NO: 2843755 - DNA, 20 bp, Homo sapiens
ccagcaagtgagagctgggt

SEQ ID NO: 2843756 - DNA, 21 bp, Homo sapiens
ccagcaagtgagagctgggtg

SEQ ID NO: 2843757 - DNA, 22 bp, Homo sapiens
ccacccaattcaaaacattgtg

SEQ ID NO: 2843758 - DNA, 14 bp, Homo sapiens
ccacccacctcagc

SEQ ID NO: 2843759 - DNA, 16 bp, Homo sapiens
ccacccacctcagcct

SEQ ID NO: 2843760 - DNA, 21 bp, Homo sapiens
ccacccaggagccccgaggcc

SEQ ID NO: 2843761 - DNA, 23 bp, Homo sapiens
ccacccaggggaatgatctctga

SEQ ID NO: 2843762 - DNA, 17 bp, Homo sapiens
ccaccccacccccttca

SEQ ID NO: 2843763 - DNA, 12 bp, Homo sapiens
ccaccccaggac

SEQ ID NO: 2843764 - DNA, 13 bp, Homo sapiens
ccaccccaggacg

SEQ ID NO: 2843765 - DNA, 16 bp, Homo sapiens
ccacccccagccccga

SEQ ID NO: 2843766 - DNA, 19 bp, Homo sapiens
ccaccccctccccagggga

SEQ ID NO: 2843767 - DNA, 12 bp, Homo sapiens
ccacccccttca

SEQ ID NO: 2843768 - DNA, 17 bp, Homo sapiens
ccacccccttcagtgcc

SEQ ID NO: 2843769 - DNA, 18 bp, Homo sapiens
ccacccccttcagtgccc

SEQ ID NO: 2843770 - DNA, 20 bp, Homo sapiens
ccacccccttcagtgcccac

SEQ ID NO: 2843771 - DNA, 14 bp, Homo sapiens
ccaccccttcctgt

SEQ ID NO: 2843772 - DNA, 23 bp, Homo sapiens
ccaccctacttcattttcagagt

SEQ ID NO: 2843773 - DNA, 14 bp, Homo sapiens
ccaccctcctttca

SEQ ID NO: 2843774 - DNA, 17 bp, Homo sapiens
ccaccctcgtggacacc

SEQ ID NO: 2843775 - DNA, 22 bp, Homo sapiens
ccaccctcgtggacacctgccc

SEQ ID NO: 2843776 - DNA, 13 bp, Homo sapiens
ccaccctgagcct

SEQ ID NO: 2843777 - DNA, 17 bp, Homo sapiens
ccaccctgagcctgacc

SEQ ID NO: 2843778 - DNA, 21 bp, Homo sapiens
ccaccctgaggagtctgaggt

SEQ ID NO: 2843779 - DNA, 23 bp, Homo sapiens
ccaccctgaggagtctgaggtcc

SEQ ID NO: 2843780 - DNA, 12 bp, Homo sapiens
ccaccctgctct

SEQ ID NO: 2843781 - DNA, 13 bp, Homo sapiens
ccaccgctgccta

SEQ ID NO: 2843782 - DNA, 14 bp, Homo sapiens
ccaccgctgcctaa

SEQ ID NO: 2843783 - DNA, 19 bp, Homo sapiens
ccaccgggacagacctgga

SEQ ID NO: 2843784 - DNA, 21 bp, Homo sapiens
ccaccgggacagacctggaca

SEQ ID NO: 2843785 - DNA, 22 bp, Homo sapiens
ccaccgggccactccttcctgc

SEQ ID NO: 2843786 - DNA, 22 bp, Homo sapiens
ccaccgggctgggagctctgca

SEQ ID NO: 2843787 - DNA, 23 bp, Homo sapiens
ccaccgggctgggagctctgcag

SEQ ID NO: 2843788 - DNA, 18 bp, Homo sapiens
ccaccgtctacagatggc

SEQ ID NO: 2843789 - DNA, 16 bp, Homo sapiens
ccacctaggccactcc

SEQ ID NO: 2843790 - DNA, 22 bp, Homo sapiens
ccacctaggccactcctccaaa

SEQ ID NO: 2843791 - DNA, 15 bp, Homo sapiens
ccacctcactcctgt

SEQ ID NO: 2843792 - DNA, 10 bp, Homo sapiens
ccacctcagc

SEQ ID NO: 2843793 - DNA, 14 bp, Homo sapiens
ccacctcagccttg

SEQ ID NO: 2843794 - DNA, 19 bp, Homo sapiens
ccacctcccctatccaccc

SEQ ID NO: 2843795 - DNA, 13 bp, Homo sapiens
ccacctctcaata

SEQ ID NO: 2843796 - DNA, 23 bp, Homo sapiens
ccacctcttctcttcctgtaaca

SEQ ID NO: 2843797 - DNA, 17 bp, Homo sapiens
ccacctcttgtcagtgc

SEQ ID NO: 2843798 - DNA, 14 bp, Homo sapiens
ccacctgcctatcc

SEQ ID NO: 2843799 - DNA, 15 bp, Homo sapiens
ccacctgcctatcca

SEQ ID NO: 2843800 - DNA, 16 bp, Homo sapiens
ccacctgcctatccat

SEQ ID NO: 2843801 - DNA, 22 bp, Homo sapiens
ccacctgctgagagacccaagg

SEQ ID NO: 2843802 - DNA, 23 bp, Homo sapiens
ccacctgctgagagacccaagga

SEQ ID NO: 2843803 - DNA, 19 bp, Homo sapiens
ccacctgctttctcctggg

SEQ ID NO: 2843804 - DNA, 21 bp, Homo sapiens
ccacctggccccatgtctctc

SEQ ID NO: 2843805 - DNA, 11 bp, Homo sapiens
ccacctgtctg

SEQ ID NO: 2843806 - DNA, 22 bp, Homo sapiens
ccacctgttaaaatgtacactg

SEQ ID NO: 2843807 - DNA, 17 bp, Homo sapiens
ccacctgttcaggagct

SEQ ID NO: 2843808 - DNA, 18 bp, Homo sapiens
ccacctgttcaggagctg

SEQ ID NO: 2843809 - DNA, 18 bp, Homo sapiens
ccaccttcaagcaccctg

SEQ ID NO: 2843810 - DNA, 19 bp, Homo sapiens
ccaccttcaagcaccctgt

SEQ ID NO: 2843811 - DNA, 19 bp, Homo sapiens
ccaccttcaattcctgggc

SEQ ID NO: 2843812 - DNA, 20 bp, Homo sapiens
ccaccttcaattcctgggcc

SEQ ID NO: 2843813 - DNA, 17 bp, Homo sapiens
ccaccttccagtgagct

SEQ ID NO: 2843814 - DNA, 11 bp, Homo sapiens
ccaccttccca

SEQ ID NO: 2843815 - DNA, 14 bp, Homo sapiens
ccaccttcccatgc

SEQ ID NO: 2843816 - DNA, 11 bp, Homo sapiens
ccaccttcccc

SEQ ID NO: 2843817 - DNA, 15 bp, Homo sapiens
ccaccttccccagac

SEQ ID NO: 2843818 - DNA, 18 bp, Homo sapiens
ccaccttccccagactca

SEQ ID NO: 2843819 - DNA, 20 bp, Homo sapiens
ccaccttccccagactcagc

SEQ ID NO: 2843820 - DNA, 22 bp, Homo sapiens
ccaccttggactcctcccacaa

SEQ ID NO: 2843821 - DNA, 23 bp, Homo sapiens
ccaccttggactcctcccacaat

SEQ ID NO: 2843822 - DNA, 14 bp, Homo sapiens
ccaccttggctcaa

SEQ ID NO: 2843823 - DNA, 12 bp, Homo sapiens
ccaccttggctg

SEQ ID NO: 2843824 - DNA, 14 bp, Homo sapiens
ccaccttggctgca

SEQ ID NO: 2843825 - DNA, 17 bp, Homo sapiens
ccacgatgtggccctgg

SEQ ID NO: 2843826 - DNA, 19 bp, Homo sapiens
ccacgctggagtgcagtga

SEQ ID NO: 2843827 - DNA, 14 bp, Homo sapiens
ccacggccaggcca

SEQ ID NO: 2843828 - DNA, 15 bp, Homo sapiens
ccacggccaggccag

SEQ ID NO: 2843829 - DNA, 22 bp, Homo sapiens
ccacgtccccctggggcttctc

SEQ ID NO: 2843830 - DNA, 16 bp, Homo sapiens
ccacgtgccaggcccg

SEQ ID NO: 2843831 - DNA, 14 bp, Homo sapiens
ccacgtgtgcagac

SEQ ID NO: 2843832 - DNA, 14 bp, Homo sapiens
ccactacactccag

SEQ ID NO: 2843833 - DNA, 22 bp, Homo sapiens
ccactacggaatagttggctag

SEQ ID NO: 2843834 - DNA, 23 bp, Homo sapiens
ccactacggaatagttggctagg

SEQ ID NO: 2843835 - DNA, 18 bp, Homo sapiens
ccactaggactctgaggc

SEQ ID NO: 2843836 - DNA, 21 bp, Homo sapiens
ccactatggtcatctttttct

SEQ ID NO: 2843837 - DNA, 20 bp, Homo sapiens
ccactcaggaggctgaggca

SEQ ID NO: 2843838 - DNA, 14 bp, Homo sapiens
ccactcatttcatc

SEQ ID NO: 2843839 - DNA, 15 bp, Homo sapiens
ccactcatttcatct

SEQ ID NO: 2843840 - DNA, 18 bp, Homo sapiens
ccactcctcactgcccca

SEQ ID NO: 2843841 - DNA, 12 bp, Homo sapiens
ccactcctccaa

SEQ ID NO: 2843842 - DNA, 18 bp, Homo sapiens
ccactctcattccccagg

SEQ ID NO: 2843843 - DNA, 19 bp, Homo sapiens
ccactctcattccccaggt

SEQ ID NO: 2843844 - DNA, 16 bp, Homo sapiens
ccactctcccctccct

SEQ ID NO: 2843845 - DNA, 18 bp, Homo sapiens
ccactctcccctccctct

SEQ ID NO: 2843846 - DNA, 23 bp, Homo sapiens
ccactctgctctgatgcatcaga

SEQ ID NO: 2843847 - DNA, 19 bp, Homo sapiens
ccactctggcagccacact

SEQ ID NO: 2843848 - DNA, 17 bp, Homo sapiens
caggtctagactttctc

SEQ ID NO: 2843849 - DNA, 11 bp, Homo sapiens
caggtctcctc

SEQ ID NO: 2843850 - DNA, 15 bp, Homo sapiens
caggtctctccactg

SEQ ID NO: 2843851 - DNA, 17 bp, Homo sapiens
caggtctctccactgct

SEQ ID NO: 2843852 - DNA, 19 bp, Homo sapiens
caggtcttgaactcctggc

SEQ ID NO: 2843853 - DNA, 20 bp, Homo sapiens
caggtcttgaactcctggcc

SEQ ID NO: 2843854 - DNA, 21 bp, Homo sapiens
caggtcttgaactcctggcct

SEQ ID NO: 2843855 - DNA, 23 bp, Homo sapiens
caggtgatccacccacctcagcc

SEQ ID NO: 2843856 - DNA, 14 bp, Homo sapiens
caggtgctgccatc

SEQ ID NO: 2843857 - DNA, 20 bp, Homo sapiens
caggtggcaggaccaggact

SEQ ID NO: 2843858 - DNA, 15 bp, Homo sapiens
caggtggcctagcag

SEQ ID NO: 2843859 - DNA, 18 bp, Homo sapiens
caggtggcctagcaggca

SEQ ID NO: 2843860 - DNA, 19 bp, Homo sapiens
caggtggcctagcaggcac

SEQ ID NO: 2843861 - DNA, 20 bp, Homo sapiens
caggtggcctagcaggcaca

SEQ ID NO: 2843862 - DNA, 16 bp, Homo sapiens
caggtggctgacccag

SEQ ID NO: 2843863 - DNA, 19 bp, Homo sapiens
caggtggctgacccagtcc

SEQ ID NO: 2843864 - DNA, 23 bp, Homo sapiens
caggtggctgacccagtccctgg

SEQ ID NO: 2843865 - DNA, 13 bp, Homo sapiens
caggtggggcagc

SEQ ID NO: 2843866 - DNA, 14 bp, Homo sapiens
caggtggggcagct

SEQ ID NO: 2843867 - DNA, 16 bp, Homo sapiens
caggtggggcagcttg

SEQ ID NO: 2843868 - DNA, 20 bp, Homo sapiens
caggtggtcctgagacctga

SEQ ID NO: 2843869 - DNA, 19 bp, Homo sapiens
caggtgtccctgcacttgc

SEQ ID NO: 2843870 - DNA, 22 bp, Homo sapiens
caggtgtgaaccaccacaccca

SEQ ID NO: 2843871 - DNA, 20 bp, Homo sapiens
caggtgtgagtcaccaagcc

SEQ ID NO: 2843872 - DNA, 21 bp, Homo sapiens
caggtgtgagtcaccaagccc

SEQ ID NO: 2843873 - DNA, 16 bp, Homo sapiens
caggtgtttagttgca

SEQ ID NO: 2843874 - DNA, 14 bp, Homo sapiens
caggttccatcccg

SEQ ID NO: 2843875 - DNA, 22 bp, Homo sapiens
caggttgaggggctcctggaaa

SEQ ID NO: 2843876 - DNA, 21 bp, Homo sapiens
caggttttcaccatagcctac

SEQ ID NO: 2843877 - DNA, 20 bp, Homo sapiens
cagtaaaaacttgtactatg

SEQ ID NO: 2843878 - DNA, 14 bp, Homo sapiens
cagtaaagtttaaa

SEQ ID NO: 2843879 - DNA, 14 bp, Homo sapiens
cagtgtgcacccct

SEQ ID NO: 2843880 - DNA, 19 bp, Homo sapiens
cagtgtgtcacactgagct

SEQ ID NO: 2843881 - DNA, 23 bp, Homo sapiens
cagtgtttagaagagcctgactg

SEQ ID NO: 2843882 - DNA, 18 bp, Homo sapiens
cagtgtttcccataattt

SEQ ID NO: 2843883 - DNA, 16 bp, Homo sapiens
cagttaactttcagaa

SEQ ID NO: 2843884 - DNA, 22 bp, Homo sapiens
cagttaactttcagaagagatg

SEQ ID NO: 2843885 - DNA, 14 bp, Homo sapiens
cagttacaaaaata

SEQ ID NO: 2843886 - DNA, 15 bp, Homo sapiens
cagttactcagccct

SEQ ID NO: 2843887 - DNA, 13 bp, Homo sapiens
cagttactggttt

SEQ ID NO: 2843888 - DNA, 18 bp, Homo sapiens
cagttatgtgaatgatct

SEQ ID NO: 2843889 - DNA, 20 bp, Homo sapiens
cagttcaggagtcccaagga

SEQ ID NO: 2843890 - DNA, 12 bp, Homo sapiens
cagttcatctat

SEQ ID NO: 2843891 - DNA, 15 bp, Homo sapiens
cagttcctttcaatg

SEQ ID NO: 2843892 - DNA, 13 bp, Homo sapiens
cagttcgcagcca

SEQ ID NO: 2843893 - DNA, 14 bp, Homo sapiens
cagttcgcagccac

SEQ ID NO: 2843894 - DNA, 14 bp, Homo sapiens
cagttctgctcctc

SEQ ID NO: 2843895 - DNA, 22 bp, Homo sapiens
cagttctgctcctctccaggca

SEQ ID NO: 2843896 - DNA, 14 bp, Homo sapiens
cagttgacagcagg

SEQ ID NO: 2843897 - DNA, 18 bp, Homo sapiens
cagttggagaaaatgaag

SEQ ID NO: 2843898 - DNA, 19 bp, Homo sapiens
cagttgggtggatgcctgg

SEQ ID NO: 2843899 - DNA, 15 bp, Homo sapiens
cagttgtgtttggca

SEQ ID NO: 2843900 - DNA, 14 bp, Homo sapiens
cagtttatatttaa

SEQ ID NO: 2843901 - DNA, 14 bp, Homo sapiens
cagtttatttgttg

SEQ ID NO: 2843902 - DNA, 21 bp, Homo sapiens
cagtttgtacagacgtatgct

SEQ ID NO: 2843903 - DNA, 19 bp, Homo sapiens
cagttttttcacctggaag

SEQ ID NO: 2843904 - DNA, 9 bp, Homo sapiens
cataaaata

SEQ ID NO: 2843905 - DNA, 12 bp, Homo sapiens
cataaaatatac

SEQ ID NO: 2843906 - DNA, 17 bp, Homo sapiens
cataaaatatacaaaca

SEQ ID NO: 2843907 - DNA, 15 bp, Homo sapiens
cataaactgtgtgca

SEQ ID NO: 2843908 - DNA, 23 bp, Homo sapiens
cataaaggtatttagaatatatt

SEQ ID NO: 2843909 - DNA, 20 bp, Homo sapiens
cataaagtatgccttcctgt

SEQ ID NO: 2843910 - DNA, 16 bp, Homo sapiens
cataacctagccttag

SEQ ID NO: 2843911 - DNA, 21 bp, Homo sapiens
cataagaatgaataataatta

SEQ ID NO: 2843912 - DNA, 11 bp, Homo sapiens
cataagaccat

SEQ ID NO: 2843913 - DNA, 20 bp, Homo sapiens
cataagaccataacagccaa

SEQ ID NO: 2843914 - DNA, 23 bp, Homo sapiens
cataagaccataacagccaacag

SEQ ID NO: 2843915 - DNA, 16 bp, Homo sapiens
cataagattaaaggaa

SEQ ID NO: 2843916 - DNA, 12 bp, Homo sapiens
cataagtttctg

SEQ ID NO: 2843917 - DNA, 20 bp, Homo sapiens
cataatatcttgaagaatat

SEQ ID NO: 2843918 - DNA, 20 bp, Homo sapiens
cataatctggactcctctgt

SEQ ID NO: 2843919 - DNA, 22 bp, Homo sapiens
cataatctggactcctctgtcc

SEQ ID NO: 2843920 - DNA, 23 bp, Homo sapiens
cataatctggactcctctgtcca

SEQ ID NO: 2843921 - DNA, 20 bp, Homo sapiens
cataatgaatgctattgaaa

SEQ ID NO: 2843922 - DNA, 22 bp, Homo sapiens
cataatgaatgctattgaaaag

SEQ ID NO: 2843923 - DNA, 15 bp, Homo sapiens
cataattagaacaat

SEQ ID NO: 2843924 - DNA, 21 bp, Homo sapiens
cataattatccaggaagggaa

SEQ ID NO: 2843925 - DNA, 18 bp, Homo sapiens
cataattcttgtatatta

SEQ ID NO: 2843926 - DNA, 12 bp, Homo sapiens
catacaatttgc

SEQ ID NO: 2843927 - DNA, 22 bp, Homo sapiens
catacaatttgcactgttactt

SEQ ID NO: 2843928 - DNA, 24 bp, Homo sapiens
catacatttataatgtttgctatt

SEQ ID NO: 2843929 - DNA, 15 bp, Homo sapiens
catacctctctctat

SEQ ID NO: 2843930 - DNA, 23 bp, Homo sapiens
catacctctctctatatatacat

SEQ ID NO: 2843931 - DNA, 22 bp, Homo sapiens
catactcatttttcatgataat

SEQ ID NO: 2843932 - DNA, 19 bp, Homo sapiens
catagacagaagaaacaag

SEQ ID NO: 2843933 - DNA, 13 bp, Homo sapiens
catagatagtgct

SEQ ID NO: 2843934 - DNA, 13 bp, Homo sapiens
catagatcttctg

SEQ ID NO: 2843935 - DNA, 15 bp, Homo sapiens
catagatcttctgaa

SEQ ID NO: 2843936 - DNA, 15 bp, Homo sapiens
catagcaagacacat

SEQ ID NO: 2843937 - DNA, 17 bp, Homo sapiens
caggactatagcccagg

SEQ ID NO: 2843938 - DNA, 18 bp, Homo sapiens
caggactatagcccaggt

SEQ ID NO: 2843939 - DNA, 15 bp, Homo sapiens
caggactcaccctca

SEQ ID NO: 2843940 - DNA, 17 bp, Homo sapiens
caggactccccaggcca

SEQ ID NO: 2843941 - DNA, 13 bp, Homo sapiens
caggactctgcct

SEQ ID NO: 2843942 - DNA, 21 bp, Homo sapiens
caggacttaacggctccagga

SEQ ID NO: 2843943 - DNA, 23 bp, Homo sapiens
caggacttaacggctccaggatt

SEQ ID NO: 2843944 - DNA, 20 bp, Homo sapiens
caggacttggtctgatttca

SEQ ID NO: 2843945 - DNA, 14 bp, Homo sapiens
caggagaagaaaga

SEQ ID NO: 2843946 - DNA, 20 bp, Homo sapiens
caggagaagaaagaggtgac

SEQ ID NO: 2843947 - DNA, 19 bp, Homo sapiens
caggagagagttgaaccta

SEQ ID NO: 2843948 - DNA, 15 bp, Homo sapiens
caggagagccagccc

SEQ ID NO: 2843949 - DNA, 16 bp, Homo sapiens
caggagagccagccct

SEQ ID NO: 2843950 - DNA, 19 bp, Homo sapiens
caggagagccagccctccc

SEQ ID NO: 2843951 - DNA, 15 bp, Homo sapiens
caggagaggggcaga

SEQ ID NO: 2843952 - DNA, 18 bp, Homo sapiens
caggagcaaatgtttctg

SEQ ID NO: 2843953 - DNA, 22 bp, Homo sapiens
caggagcaaatgtttctgcagt

SEQ ID NO: 2843954 - DNA, 17 bp, Homo sapiens
caggagcacaggcagct

SEQ ID NO: 2843955 - DNA, 18 bp, Homo sapiens
caggagccccgaggcctt

SEQ ID NO: 2843956 - DNA, 20 bp, Homo sapiens
caggagccccgaggccttct

SEQ ID NO: 2843957 - DNA, 19 bp, Homo sapiens
caggagcctaccccctgaa

SEQ ID NO: 2843958 - DNA, 12 bp, Homo sapiens
caggagcctggc

SEQ ID NO: 2843959 - DNA, 16 bp, Homo sapiens
caggagcctgtgcctc

SEQ ID NO: 2843960 - DNA, 17 bp, Homo sapiens
caggagctacctgtgtg

SEQ ID NO: 2843961 - DNA, 18 bp, Homo sapiens
caggagctacctgtgtgg

SEQ ID NO: 2843962 - DNA, 23 bp, Homo sapiens
caggaggattgcttgagcccagg

SEQ ID NO: 2843963 - DNA, 18 bp, Homo sapiens
caggaggctgaggcagaa

SEQ ID NO: 2843964 - DNA, 17 bp, Homo sapiens
caggaggctgaggcagg

SEQ ID NO: 2843965 - DNA, 15 bp, Homo sapiens
caggaggctgagggg

SEQ ID NO: 2843966 - DNA, 21 bp, Homo sapiens
caggaggcttggaaagcatca

SEQ ID NO: 2843967 - DNA, 16 bp, Homo sapiens
caggagggacaaagga

SEQ ID NO: 2843968 - DNA, 12 bp, Homo sapiens
caggagggagag

SEQ ID NO: 2843969 - DNA, 16 bp, Homo sapiens
caggagggcaagggcc

SEQ ID NO: 2843970 - DNA, 19 bp, Homo sapiens
caggagggcaagggccatg

SEQ ID NO: 2843971 - DNA, 19 bp, Homo sapiens
caggagggggtcgtggaga

SEQ ID NO: 2843972 - DNA, 20 bp, Homo sapiens
caggagggggtcgtggagag

SEQ ID NO: 2843973 - DNA, 20 bp, Homo sapiens
cagctgtgctctggacaggc

SEQ ID NO: 2843974 - DNA, 18 bp, Homo sapiens
cagctgtgtgggctgcag

SEQ ID NO: 2843975 - DNA, 18 bp, Homo sapiens
cagcttcatcaattttta

SEQ ID NO: 2843976 - DNA, 22 bp, Homo sapiens
cagcttcatcaatttttataca

SEQ ID NO: 2843977 - DNA, 10 bp, Homo sapiens
cagcttcatt

SEQ ID NO: 2843978 - DNA, 15 bp, Homo sapiens
cagcttcatttcctg

SEQ ID NO: 2843979 - DNA, 21 bp, Homo sapiens
cagcttcatttcctgtgtctt

SEQ ID NO: 2843980 - DNA, 23 bp, Homo sapiens
cagcttcccctcgctgtcctgct

SEQ ID NO: 2843981 - DNA, 13 bp, Homo sapiens
cagcttcctgtca

SEQ ID NO: 2843982 - DNA, 12 bp, Homo sapiens
cagcttctccag

SEQ ID NO: 2843983 - DNA, 13 bp, Homo sapiens
cagcttctccagg

SEQ ID NO: 2843984 - DNA, 14 bp, Homo sapiens
cagcttgagcctgt

SEQ ID NO: 2843985 - DNA, 15 bp, Homo sapiens
cagcttgagcctgtc

SEQ ID NO: 2843986 - DNA, 19 bp, Homo sapiens
cagcttgtaaatagctcag

SEQ ID NO: 2843987 - DNA, 17 bp, Homo sapiens
cagcttgtagccagccg

SEQ ID NO: 2843988 - DNA, 13 bp, Homo sapiens
cagcttgtccaac

SEQ ID NO: 2843989 - DNA, 20 bp, Homo sapiens
cagcttgtggcaagtgaatt

SEQ ID NO: 2843990 - DNA, 13 bp, Homo sapiens
cagcttttaataa

SEQ ID NO: 2843991 - DNA, 14 bp, Homo sapiens
cagcttttaataaa

SEQ ID NO: 2843992 - DNA, 17 bp, Homo sapiens
cagcttttaataaaatt

SEQ ID NO: 2843993 - DNA, 13 bp, Homo sapiens
cagctttttgtct

SEQ ID NO: 2843994 - DNA, 16 bp, Homo sapiens
cagctttttgtctttt

SEQ ID NO: 2843995 - DNA, 16 bp, Homo sapiens
caggaaaagctgctga

SEQ ID NO: 2843996 - DNA, 17 bp, Homo sapiens
caggaaaaggcctgggg

SEQ ID NO: 2843997 - DNA, 21 bp, Homo sapiens
caggaaatagtgttcttttta

SEQ ID NO: 2843998 - DNA, 13 bp, Homo sapiens
caggaacagaagg

SEQ ID NO: 2843999 - DNA, 18 bp, Homo sapiens
caggaagggggtccaccc

SEQ ID NO: 2844000 - DNA, 21 bp, Homo sapiens
caggaagggggtccacccagc

SEQ ID NO: 2844001 - DNA, 17 bp, Homo sapiens
caggaaggtagcccagc

SEQ ID NO: 2844002 - DNA, 20 bp, Homo sapiens
caggaaggtagcccagcact

SEQ ID NO: 2844003 - DNA, 16 bp, Homo sapiens
caggaatctcagagac

SEQ ID NO: 2844004 - DNA, 17 bp, Homo sapiens
caggaatctcagagaca

SEQ ID NO: 2844005 - DNA, 18 bp, Homo sapiens
caggaatctcagagacag

SEQ ID NO: 2844006 - DNA, 24 bp, Homo sapiens
caggaatctcagagacaggtggcc

SEQ ID NO: 2844007 - DNA, 15 bp, Homo sapiens
caggaattgaagatg

SEQ ID NO: 2844008 - DNA, 19 bp, Homo sapiens
caggacacaggcctgtgta

SEQ ID NO: 2844009 - DNA, 22 bp, Homo sapiens
caggacacctggccgcctccag

SEQ ID NO: 2844010 - DNA, 13 bp, Homo sapiens
caggacaggacca

SEQ ID NO: 2844011 - DNA, 12 bp, Homo sapiens
caggacaggccc

SEQ ID NO: 2844012 - DNA, 16 bp, Homo sapiens
caggacagtgcttcag

SEQ ID NO: 2844013 - DNA, 22 bp, Homo sapiens
caggacagtgcttcagcctgag

SEQ ID NO: 2844014 - DNA, 12 bp, Homo sapiens
caggaccacaaa

SEQ ID NO: 2844015 - DNA, 16 bp, Homo sapiens
caggaccacaaaaatg

SEQ ID NO: 2844016 - DNA, 14 bp, Homo sapiens
caggaccaggacta

SEQ ID NO: 2844017 - DNA, 15 bp, Homo sapiens
caggaccccaacccc

SEQ ID NO: 2844018 - DNA, 12 bp, Homo sapiens
caggacgccact

SEQ ID NO: 2844019 - DNA, 14 bp, Homo sapiens
caggacgccactca

SEQ ID NO: 2844020 - DNA, 17 bp, Homo sapiens
caggacgccactcattt

SEQ ID NO: 2844021 - DNA, 18 bp, Homo sapiens
caggacgccactcatttc

SEQ ID NO: 2844022 - DNA, 19 bp, Homo sapiens
caggacgccactcatttca

SEQ ID NO: 2844023 - DNA, 21 bp, Homo sapiens
caggacgccactcatttcatc

SEQ ID NO: 2844024 - DNA, 20 bp, Homo sapiens
caggactaacactcagaagc

SEQ ID NO: 2844025 - DNA, 22 bp, Homo sapiens
caggactaacactcagaagcct

SEQ ID NO: 2844026 - DNA, 13 bp, Homo sapiens
cagcaggaagcca

SEQ ID NO: 2844027 - DNA, 22 bp, Homo sapiens
cagcaggtagtgggtgaatgtg

SEQ ID NO: 2844028 - DNA, 17 bp, Homo sapiens
cagcagtatgaatgatg

SEQ ID NO: 2844029 - DNA, 17 bp, Homo sapiens
cagcagtttgggaggtc

SEQ ID NO: 2844030 - DNA, 12 bp, Homo sapiens
cagcatatttat

SEQ ID NO: 2844031 - DNA, 18 bp, Homo sapiens
cagcatatttatagcaat

SEQ ID NO: 2844032 - DNA, 14 bp, Homo sapiens
cagcatcctggcac

SEQ ID NO: 2844033 - DNA, 20 bp, Homo sapiens
cagcatcctggcacccggcc

SEQ ID NO: 2844034 - DNA, 21 bp, Homo sapiens
cagcatcctggcacccggccc

SEQ ID NO: 2844035 - DNA, 23 bp, Homo sapiens
cagcatccttttctgcagagggg

SEQ ID NO: 2844036 - DNA, 18 bp, Homo sapiens
cagcatgtcactcccaga

SEQ ID NO: 2844037 - DNA, 16 bp, Homo sapiens
cagccaaacagagcct

SEQ ID NO: 2844038 - DNA, 16 bp, Homo sapiens
cagccaaacccatgag

SEQ ID NO: 2844039 - DNA, 22 bp, Homo sapiens
cagccaaatgtaattgaataaa

SEQ ID NO: 2844040 - DNA, 18 bp, Homo sapiens
cagccaacaggtggcagg

SEQ ID NO: 2844041 - DNA, 23 bp, Homo sapiens
cagccaataaatcaactccagct

SEQ ID NO: 2844042 - DNA, 14 bp, Homo sapiens
cagccacacagagc

SEQ ID NO: 2844043 - DNA, 16 bp, Homo sapiens
cagccacacagagcct

SEQ ID NO: 2844044 - DNA, 22 bp, Homo sapiens
cagccacacagagcctgcctca

SEQ ID NO: 2844045 - DNA, 19 bp, Homo sapiens
cagccacacttctcaggac

SEQ ID NO: 2844046 - DNA, 21 bp, Homo sapiens
cagccaccccctcccccatca

SEQ ID NO: 2844047 - DNA, 12 bp, Homo sapiens
cagccaccctga

SEQ ID NO: 2844048 - DNA, 14 bp, Homo sapiens
cagccaccctgagg

SEQ ID NO: 2844049 - DNA, 16 bp, Homo sapiens
cagccaccctgaggag

SEQ ID NO: 2844050 - DNA, 14 bp, Homo sapiens
cagccacggccagg

SEQ ID NO: 2844051 - DNA, 21 bp, Homo sapiens
cagccacggccaggccagagg

SEQ ID NO: 2844052 - DNA, 22 bp, Homo sapiens
cagccacggccaggccagaggg

SEQ ID NO: 2844053 - DNA, 17 bp, Homo sapiens
cagccagaagcctctgc

SEQ ID NO: 2844054 - DNA, 20 bp, Homo sapiens
cagccagaggaggccggtga

SEQ ID NO: 2844055 - DNA, 23 bp, Homo sapiens
cagccagcaatgatgtccagaag

SEQ ID NO: 2844056 - DNA, 12 bp, Homo sapiens
cagccagcagcc

SEQ ID NO: 2844057 - DNA, 15 bp, Homo sapiens
cagccagcagccagc

SEQ ID NO: 2844058 - DNA, 17 bp, Homo sapiens
cagccagcagccagctc

SEQ ID NO: 2844059 - DNA, 18 bp, Homo sapiens
cagccagcagccagctct

SEQ ID NO: 2844060 - DNA, 21 bp, Homo sapiens
cagccagcagccagctctcag

SEQ ID NO: 2844061 - DNA, 11 bp, Homo sapiens
cagccagccca

SEQ ID NO: 2844062 - DNA, 19 bp, Homo sapiens
cagccagcccagcccagct

SEQ ID NO: 2844063 - DNA, 20 bp, Homo sapiens
cagccagcccagcccagctg

SEQ ID NO: 2844064 - DNA, 13 bp, Homo sapiens
cagccagccctgc

SEQ ID NO: 2844065 - DNA, 15 bp, Homo sapiens
cagccagccctgcct

SEQ ID NO: 2844066 - DNA, 20 bp, Homo sapiens
cagccagccctgcctggagg

SEQ ID NO: 2844067 - DNA, 22 bp, Homo sapiens
cagccagccctgcctggaggac

SEQ ID NO: 2844068 - DNA, 12 bp, Homo sapiens
cagccagctcct

SEQ ID NO: 2844069 - DNA, 17 bp, Homo sapiens
cagccagctcctgggca

SEQ ID NO: 2844070 - DNA, 18 bp, Homo sapiens
cagccatcaagagactga

SEQ ID NO: 2844071 - DNA, 18 bp, Homo sapiens
cagccatcatgtgcctgg

SEQ ID NO: 2844072 - DNA, 18 bp, Homo sapiens
cagccatgaggagttgct

SEQ ID NO: 2844073 - DNA, 16 bp, Homo sapiens
cagccattaccatgga

SEQ ID NO: 2844074 - DNA, 20 bp, Homo sapiens
cagccattaccatggagaca

SEQ ID NO: 2844075 - DNA, 15 bp, Homo sapiens
cagcccagcccagct

SEQ ID NO: 2844076 - DNA, 17 bp, Homo sapiens
cagcccagcccagctgg

SEQ ID NO: 2844077 - DNA, 21 bp, Homo sapiens
cagcccattctctctcctgtc

SEQ ID NO: 2844078 - DNA, 23 bp, Homo sapiens
cagcccattctctctcctgtcca

SEQ ID NO: 2844079 - DNA, 20 bp, Homo sapiens
cagcccattggctcccatct

SEQ ID NO: 2844080 - DNA, 12 bp, Homo sapiens
cagccccagcaa

SEQ ID NO: 2844081 - DNA, 13 bp, Homo sapiens
cagccccagtgcc

SEQ ID NO: 2844082 - DNA, 13 bp, Homo sapiens
cagccccattctg

SEQ ID NO: 2844083 - DNA, 14 bp, Homo sapiens
cagccccattctgc

SEQ ID NO: 2844084 - DNA, 18 bp, Homo sapiens
cagccccattctgcctgc

SEQ ID NO: 2844085 - DNA, 19 bp, Homo sapiens
cagccccattctgcctgcc

SEQ ID NO: 2844086 - DNA, 22 bp, Homo sapiens
cagccccattctgcctgcccag

SEQ ID NO: 2844087 - DNA, 23 bp, Homo sapiens
cagccccattctgcctgcccagg

SEQ ID NO: 2844088 - DNA, 24 bp, Homo sapiens
cagccccattctgcctgcccaggc

SEQ ID NO: 2844089 - DNA, 19 bp, Homo sapiens
cagccccgggcctgcctct

SEQ ID NO: 2844090 - DNA, 13 bp, Homo sapiens
cagcccctcctcc

SEQ ID NO: 2844091 - DNA, 14 bp, Homo sapiens
cagcccctcctccc

SEQ ID NO: 2844092 - DNA, 21 bp, Homo sapiens
cagcccctcctccccttcctg

SEQ ID NO: 2844093 - DNA, 13 bp, Homo sapiens
cagcccctcctct

SEQ ID NO: 2844094 - DNA, 15 bp, Homo sapiens
cagcccctcctctgc

SEQ ID NO: 2844095 - DNA, 17 bp, Homo sapiens
cagcccctcctctgcca

SEQ ID NO: 2844096 - DNA, 19 bp, Homo sapiens
cagcccctcctctgccacc

SEQ ID NO: 2844097 - DNA, 20 bp, Homo sapiens
cagcccctcctctgccacct

SEQ ID NO: 2844098 - DNA, 21 bp, Homo sapiens
cagcccctcctctgccacctc

SEQ ID NO: 2844099 - DNA, 18 bp, Homo sapiens
cagccccttgagaaacct

SEQ ID NO: 2844100 - DNA, 23 bp, Homo sapiens
cagcccggcctgctcccagcagc

SEQ ID NO: 2844101 - DNA, 21 bp, Homo sapiens
cagcccggcgccaccatcctg

SEQ ID NO: 2844102 - DNA, 17 bp, Homo sapiens
cagccctaaggatctct

SEQ ID NO: 2844103 - DNA, 22 bp, Homo sapiens
cagccctaaggatctctcagga

SEQ ID NO: 2844104 - DNA, 13 bp, Homo sapiens
cagccctccctgt

SEQ ID NO: 2844105 - DNA, 18 bp, Homo sapiens
cagccctccctgtcctcc

SEQ ID NO: 2844106 - DNA, 21 bp, Homo sapiens
cagccctccctgtcctcctcg

SEQ ID NO: 2844107 - DNA, 22 bp, Homo sapiens
cagccctccctgtcctcctcgg

SEQ ID NO: 2844108 - DNA, 16 bp, Homo sapiens
cagccctgcctggagg

SEQ ID NO: 2844109 - DNA, 20 bp, Homo sapiens
cagccctgcctggaggacct

SEQ ID NO: 2844110 - DNA, 12 bp, Homo sapiens
cagcccttccct

SEQ ID NO: 2844111 - DNA, 17 bp, Homo sapiens
cagcccttccctgcttt

SEQ ID NO: 2844112 - DNA, 23 bp, Homo sapiens
cagccctttgggaggctgaggcg

SEQ ID NO: 2844113 - DNA, 19 bp, Homo sapiens
cagccgagccgggcctggg

SEQ ID NO: 2844114 - DNA, 16 bp, Homo sapiens
cagccgcagcctccct

SEQ ID NO: 2844115 - DNA, 19 bp, Homo sapiens
cagccgctcctgtctgcca

SEQ ID NO: 2844116 - DNA, 17 bp, Homo sapiens
attcaattcctctggga

SEQ ID NO: 2844117 - DNA, 14 bp, Homo sapiens
attcacaatagaaa

SEQ ID NO: 2844118 - DNA, 22 bp, Homo sapiens
attcacaatgaaatgctctcct

SEQ ID NO: 2844119 - DNA, 18 bp, Homo sapiens
attcacactgtgcgtttt

SEQ ID NO: 2844120 - DNA, 15 bp, Homo sapiens
attcacatctcattt

SEQ ID NO: 2844121 - DNA, 20 bp, Homo sapiens
attcacatttgatgtacatg

SEQ ID NO: 2844122 - DNA, 23 bp, Homo sapiens
attcaccttccagtgtctcggag

SEQ ID NO: 2844123 - DNA, 16 bp, Homo sapiens
attcactgcacaagat

SEQ ID NO: 2844124 - DNA, 22 bp, Homo sapiens
attcactttaccttcagcagtt

SEQ ID NO: 2844125 - DNA, 18 bp, Homo sapiens
attcagaacatcctccaa

SEQ ID NO: 2844126 - DNA, 18 bp, Homo sapiens
attcagaagaaaaagaag

SEQ ID NO: 2844127 - DNA, 14 bp, Homo sapiens
attcagagatgtac

SEQ ID NO: 2844128 - DNA, 17 bp, Homo sapiens
attcagagatgtaccat

SEQ ID NO: 2844129 - DNA, 21 bp, Homo sapiens
attcagagatgtaccatgtta

SEQ ID NO: 2844130 - DNA, 21 bp, Homo sapiens
attcagatatatttttcacag

SEQ ID NO: 2844131 - DNA, 18 bp, Homo sapiens
attcagatcgtattaatt

SEQ ID NO: 2844132 - DNA, 17 bp, Homo sapiens
attcaggaaaaggcctg

SEQ ID NO: 2844133 - DNA, 19 bp, Homo sapiens
attcaggaaaaggcctggg

SEQ ID NO: 2844134 - DNA, 23 bp, Homo sapiens
attcataacaatgtatgtgaaag

SEQ ID NO: 2844135 - DNA, 13 bp, Homo sapiens
attcataattaga

SEQ ID NO: 2844136 - DNA, 17 bp, Homo sapiens
atgaaggtttctgaaaa

SEQ ID NO: 2844137 - DNA, 23 bp, Homo sapiens
atgaagtgtgtttccttcagtgc

SEQ ID NO: 2844138 - DNA, 21 bp, Homo sapiens
atgaatacagggcatgcattt

SEQ ID NO: 2844139 - DNA, 11 bp, Homo sapiens
atgaatgttta

SEQ ID NO: 2844140 - DNA, 22 bp, Homo sapiens
atgacaaacccaggagtttgtg

SEQ ID NO: 2844141 - DNA, 16 bp, Homo sapiens
atgacaaagttacaaa

SEQ ID NO: 2844142 - DNA, 16 bp, Homo sapiens
atgacactgttcagga

SEQ ID NO: 2844143 - DNA, 17 bp, Homo sapiens
atgacagccagagcctg

SEQ ID NO: 2844144 - DNA, 20 bp, Homo sapiens
atgacagtccgtcaaaacag

SEQ ID NO: 2844145 - DNA, 13 bp, Homo sapiens
atgacatttttga

SEQ ID NO: 2844146 - DNA, 17 bp, Homo sapiens
atgaccttctaggaagc

SEQ ID NO: 2844147 - DNA, 16 bp, Homo sapiens
atgactaaaaatatta

SEQ ID NO: 2844148 - DNA, 18 bp, Homo sapiens
atgactgtaaacatagat

SEQ ID NO: 2844149 - DNA, 22 bp, Homo sapiens
atgacttgggcacccccagcct

SEQ ID NO: 2844150 - DNA, 11 bp, Homo sapiens
atgagaaatgt

SEQ ID NO: 2844151 - DNA, 21 bp, Homo sapiens
atgagaagagggcctgtggga

SEQ ID NO: 2844152 - DNA, 21 bp, Homo sapiens
atgagaagttaagcagccttt

SEQ ID NO: 2844153 - DNA, 23 bp, Homo sapiens
atgagacttccaaacctgacaga

SEQ ID NO: 2844154 - DNA, 16 bp, Homo sapiens
atgagcagtcacactg

SEQ ID NO: 2844155 - DNA, 17 bp, Homo sapiens
atgagcctcagcatcct

SEQ ID NO: 2844156 - DNA, 23 bp, Homo sapiens
atgagcctgtaatcctcagctga

SEQ ID NO: 2844157 - DNA, 12 bp, Homo sapiens
atgagctcctgc

SEQ ID NO: 2844158 - DNA, 19 bp, Homo sapiens
atgaggaacctcaaactgg

SEQ ID NO: 2844159 - DNA, 21 bp, Homo sapiens
atgaggcaatgtcaggaacag

SEQ ID NO: 2844160 - DNA, 17 bp, Homo sapiens
atgaggctattaaaaga

SEQ ID NO: 2844161 - DNA, 20 bp, Homo sapiens
atgagggactggaaccaggg

SEQ ID NO: 2844162 - DNA, 16 bp, Homo sapiens
atgagggcagcagcca

SEQ ID NO: 2844163 - DNA, 19 bp, Homo sapiens
atgagggcagcagccagcc

SEQ ID NO: 2844164 - DNA, 20 bp, Homo sapiens
atgagggcagcagccagccc

SEQ ID NO: 2844165 - DNA, 15 bp, Homo sapiens
atgaggtcagagcct

SEQ ID NO: 2844166 - DNA, 14 bp, Homo sapiens
atgaggtcccaggc

SEQ ID NO: 2844167 - DNA, 15 bp, Homo sapiens
atgaggtcccaggca

SEQ ID NO: 2844168 - DNA, 19 bp, Homo sapiens
atgaggtcccaggcagaga

SEQ ID NO: 2844169 - DNA, 20 bp, Homo sapiens
atgaggtcccaggcagagaa

SEQ ID NO: 2844170 - DNA, 22 bp, Homo sapiens
atgaggttcaactgttgattgc

SEQ ID NO: 2844171 - DNA, 19 bp, Homo sapiens
atgagtgattgacacacag

SEQ ID NO: 2844172 - DNA, 19 bp, Homo sapiens
atgagtttttgatagcttt

SEQ ID NO: 2844173 - DNA, 20 bp, Homo sapiens
atgagtttttgatagcttta

SEQ ID NO: 2844174 - DNA, 20 bp, Homo sapiens
atgataaagatgtcaaatat

SEQ ID NO: 2844175 - DNA, 12 bp, Homo sapiens
atgataatgaac

SEQ ID NO: 2844176 - DNA, 22 bp, Homo sapiens
atgatatgtaaacataattctt

SEQ ID NO: 2844177 - DNA, 18 bp, Homo sapiens
atgatcagctgtttgtca

SEQ ID NO: 2844178 - DNA, 22 bp, Homo sapiens
atgatcatgtaaatgattatct

SEQ ID NO: 2844179 - DNA, 14 bp, Homo sapiens
atgatcgtgcctat

SEQ ID NO: 2844180 - DNA, 15 bp, Homo sapiens
atgatctcaggagct

SEQ ID NO: 2844181 - DNA, 14 bp, Homo sapiens
atgatctctctgaa

SEQ ID NO: 2844182 - DNA, 20 bp, Homo sapiens
atgatctgactttaattgtg

SEQ ID NO: 2844183 - DNA, 17 bp, Homo sapiens
atgatctttgcagacag

SEQ ID NO: 2844184 - DNA, 21 bp, Homo sapiens
atgatctttgcagacaggcaa

SEQ ID NO: 2844185 - DNA, 15 bp, Homo sapiens
atgatcttttcaagt

SEQ ID NO: 2844186 - DNA, 23 bp, Homo sapiens
atgatgaaatgaggtcagagcct

SEQ ID NO: 2844187 - DNA, 23 bp, Homo sapiens
atgatgattaaacacctgacaca

SEQ ID NO: 2844188 - DNA, 23 bp, Homo sapiens
atgatgattccttgagcatttta

SEQ ID NO: 2844189 - DNA, 23 bp, Homo sapiens
atgatgccgctcttctgtcatcc

SEQ ID NO: 2844190 - DNA, 15 bp, Homo sapiens
atgatgtatttttgt

SEQ ID NO: 2844191 - DNA, 15 bp, Homo sapiens
atgatgtccagaaga

SEQ ID NO: 2844192 - DNA, 18 bp, Homo sapiens
atgatgtccagaagaata

SEQ ID NO: 2844193 - DNA, 19 bp, Homo sapiens
atgatgtgggtcaaggaat

SEQ ID NO: 2844194 - DNA, 22 bp, Homo sapiens
atgatgttaaaaaaataagaag

SEQ ID NO: 2844195 - DNA, 18 bp, Homo sapiens
atgattccttgagcattt

SEQ ID NO: 2844196 - DNA, 19 bp, Homo sapiens
atgattcggatttgacaaa

SEQ ID NO: 2844197 - DNA, 20 bp, Homo sapiens
atgattgtttaattgtaggt

SEQ ID NO: 2844198 - DNA, 17 bp, Homo sapiens
atgatttaaaaaataaa

SEQ ID NO: 2844199 - DNA, 21 bp, Homo sapiens
atgatttaaaaaataaatata

SEQ ID NO: 2844200 - DNA, 20 bp, Homo sapiens
atgattttacagagaatctg

SEQ ID NO: 2844201 - DNA, 12 bp, Homo sapiens
atgattttatac

SEQ ID NO: 2844202 - DNA, 13 bp, Homo sapiens
atgattttataca

SEQ ID NO: 2844203 - DNA, 21 bp, Homo sapiens
atgcaacaacatgtataatat

SEQ ID NO: 2844204 - DNA, 16 bp, Homo sapiens
atgcaaggaaggaaag

SEQ ID NO: 2844205 - DNA, 19 bp, Homo sapiens
atgcaatgacatcttcaaa

SEQ ID NO: 2844206 - DNA, 17 bp, Homo sapiens
atgcaatttcctttttt

SEQ ID NO: 2844207 - DNA, 19 bp, Homo sapiens
atgcaatttttaaactagt

SEQ ID NO: 2844208 - DNA, 20 bp, Homo sapiens
atgcaatttttaaactagta

SEQ ID NO: 2844209 - DNA, 11 bp, Homo sapiens
atgcacaattt

SEQ ID NO: 2844210 - DNA, 19 bp, Homo sapiens
atgcacaatttagaaaaca

SEQ ID NO: 2844211 - DNA, 14 bp, Homo sapiens
atgcacatttatat

SEQ ID NO: 2844212 - DNA, 15 bp, Homo sapiens
atgcacctaaagaaa

SEQ ID NO: 2844213 - DNA, 20 bp, Homo sapiens
atgcagcgaaccaatatttg

SEQ ID NO: 2844214 - DNA, 16 bp, Homo sapiens
atgcagtccagaataa

SEQ ID NO: 2844215 - DNA, 16 bp, Homo sapiens
atgcagtgaattgtga

SEQ ID NO: 2844216 - DNA, 14 bp, Homo sapiens
atgcatcagaaagg

SEQ ID NO: 2844217 - DNA, 15 bp, Homo sapiens
atgcatcagaaaggg

SEQ ID NO: 2844218 - DNA, 13 bp, Homo sapiens
atgcatgatttta

SEQ ID NO: 2844219 - DNA, 23 bp, Homo sapiens
atgcatggagggctgccctgtac

SEQ ID NO: 2844220 - DNA, 21 bp, Homo sapiens
atgcattataggatcatttgt

SEQ ID NO: 2844221 - DNA, 22 bp, Homo sapiens
atgcattataggatcatttgtt

SEQ ID NO: 2844222 - DNA, 23 bp, Homo sapiens
atgcattttattttagacacaaa

SEQ ID NO: 2844223 - DNA, 13 bp, Homo sapiens
atgcattttgcag

SEQ ID NO: 2844224 - DNA, 18 bp, Homo sapiens
atgcattttgcagcagtg

SEQ ID NO: 2844225 - DNA, 16 bp, Homo sapiens
cactgtaaaatgaaat

SEQ ID NO: 2844226 - DNA, 18 bp, Homo sapiens
cactgtaaaatgaaatta

SEQ ID NO: 2844227 - DNA, 20 bp, Homo sapiens
cactgtacaaggtacccctt

SEQ ID NO: 2844228 - DNA, 18 bp, Homo sapiens
cactgtagaatgatttca

SEQ ID NO: 2844229 - DNA, 18 bp, Homo sapiens
cactgtatgctggacggc

SEQ ID NO: 2844230 - DNA, 14 bp, Homo sapiens
cactgtcttgaaga

SEQ ID NO: 2844231 - DNA, 20 bp, Homo sapiens
cactgtgaagacccagcagg

SEQ ID NO: 2844232 - DNA, 23 bp, Homo sapiens
cactgtgaagacccagcaggaag

SEQ ID NO: 2844233 - DNA, 14 bp, Homo sapiens
cactgtgccatgtg

SEQ ID NO: 2844234 - DNA, 18 bp, Homo sapiens
cactgtgcgttttagagt

SEQ ID NO: 2844235 - DNA, 20 bp, Homo sapiens
cactgtgcgttttagagtat

SEQ ID NO: 2844236 - DNA, 17 bp, Homo sapiens
cactgtgcttacagtga

SEQ ID NO: 2844237 - DNA, 19 bp, Homo sapiens
cactgtggcgttctgctgc

SEQ ID NO: 2844238 - DNA, 14 bp, Homo sapiens
cactgttgcccagg

SEQ ID NO: 2844239 - DNA, 17 bp, Homo sapiens
cactgttgcccaggctg

SEQ ID NO: 2844240 - DNA, 14 bp, Homo sapiens
cacttaaaaaatgt

SEQ ID NO: 2844241 - DNA, 12 bp, Homo sapiens
cacttaatgaac

SEQ ID NO: 2844242 - DNA, 22 bp, Homo sapiens
cacttaccttcaataaagtatc

SEQ ID NO: 2844243 - DNA, 22 bp, Homo sapiens
cacttattatgaggctattaaa

SEQ ID NO: 2844244 - DNA, 20 bp, Homo sapiens
cacttattccccattcttcc

SEQ ID NO: 2844245 - DNA, 14 bp, Homo sapiens
cacttatttcataa

SEQ ID NO: 2844246 - DNA, 18 bp, Homo sapiens
cacttcacacacaggcaa

SEQ ID NO: 2844247 - DNA, 18 bp, Homo sapiens
cacttcatggaccaagaa

SEQ ID NO: 2844248 - DNA, 18 bp, Homo sapiens
cacttctaaatgaagtgc

SEQ ID NO: 2844249 - DNA, 23 bp, Homo sapiens
cacttctcaggacacaggcctgt

SEQ ID NO: 2844250 - DNA, 17 bp, Homo sapiens
cacttctcatcatattg

SEQ ID NO: 2844251 - DNA, 13 bp, Homo sapiens
cacttctctccag

SEQ ID NO: 2844252 - DNA, 18 bp, Homo sapiens
cacttgaggtcaggagtt

SEQ ID NO: 2844253 - DNA, 22 bp, Homo sapiens
cacttgaggtcaggagttccta

SEQ ID NO: 2844254 - DNA, 18 bp, Homo sapiens
cacttgcagactctacag

SEQ ID NO: 2844255 - DNA, 12 bp, Homo sapiens
cacttgtacaaa

SEQ ID NO: 2844256 - DNA, 15 bp, Homo sapiens
cactttaaagtcttt

SEQ ID NO: 2844257 - DNA, 16 bp, Homo sapiens
cactttaaccctctct

SEQ ID NO: 2844258 - DNA, 14 bp, Homo sapiens
cactttgcacagct

SEQ ID NO: 2844259 - DNA, 13 bp, Homo sapiens
cactttgggaggc

SEQ ID NO: 2844260 - DNA, 20 bp, Homo sapiens
cactttggtacatggccagt

SEQ ID NO: 2844261 - DNA, 15 bp, Homo sapiens
cactttgttaaaaat

SEQ ID NO: 2844262 - DNA, 14 bp, Homo sapiens
cagaaaaaaataaa

SEQ ID NO: 2844263 - DNA, 15 bp, Homo sapiens
cagaaaacctccagt

SEQ ID NO: 2844264 - DNA, 15 bp, Homo sapiens
cagaaaagtagaatt

SEQ ID NO: 2844265 - DNA, 17 bp, Homo sapiens
cagaaaagtagaattat

SEQ ID NO: 2844266 - DNA, 20 bp, Homo sapiens
cagaaaagtagaattatatc

SEQ ID NO: 2844267 - DNA, 21 bp, Homo sapiens
cagaaaagtagaattatatct

SEQ ID NO: 2844268 - DNA, 12 bp, Homo sapiens
cagaaaagtgct

SEQ ID NO: 2844269 - DNA, 18 bp, Homo sapiens
cagaaaagtgcttagaaa

SEQ ID NO: 2844270 - DNA, 17 bp, Homo sapiens
cagaaaatataaatgca

SEQ ID NO: 2844271 - DNA, 18 bp, Homo sapiens
cagaaaatataaatgcat

SEQ ID NO: 2844272 - DNA, 21 bp, Homo sapiens
cagaaaatataaatgcatgat

SEQ ID NO: 2844273 - DNA, 18 bp, Homo sapiens
cagaaacaaaaacactaa

SEQ ID NO: 2844274 - DNA, 22 bp, Homo sapiens
cagaaacaggtgcatctgggga

SEQ ID NO: 2844275 - DNA, 13 bp, Homo sapiens
cagaaaccagtta

SEQ ID NO: 2844276 - DNA, 14 bp, Homo sapiens
gccctgccacctgt

SEQ ID NO: 2844277 - DNA, 16 bp, Homo sapiens
gccctgccacctgtct

SEQ ID NO: 2844278 - DNA, 17 bp, Homo sapiens
gccctgccctgccacct

SEQ ID NO: 2844279 - DNA, 14 bp, Homo sapiens
gccctgcctggagg

SEQ ID NO: 2844280 - DNA, 15 bp, Homo sapiens
gccctgcctggagga

SEQ ID NO: 2844281 - DNA, 18 bp, Homo sapiens
gccctgcctggaggacct

SEQ ID NO: 2844282 - DNA, 19 bp, Homo sapiens
gccctgcctggaggacctg

SEQ ID NO: 2844283 - DNA, 21 bp, Homo sapiens
gccctgcctggaggacctgag

SEQ ID NO: 2844284 - DNA, 20 bp, Homo sapiens
gccctgcggagccggcacct

SEQ ID NO: 2844285 - DNA, 22 bp, Homo sapiens
gccctgctgccgcctcccagcc

SEQ ID NO: 2844286 - DNA, 19 bp, Homo sapiens
gccctggatgtgcccacag

SEQ ID NO: 2844287 - DNA, 18 bp, Homo sapiens
gccctggatttcagaaag

SEQ ID NO: 2844288 - DNA, 12 bp, Homo sapiens
gccctggcagga

SEQ ID NO: 2844289 - DNA, 14 bp, Homo sapiens
gccctggcctgctg

SEQ ID NO: 2844290 - DNA, 16 bp, Homo sapiens
gccctggcctgctggg

SEQ ID NO: 2844291 - DNA, 14 bp, Homo sapiens
gccctgggaccgct

SEQ ID NO: 2844292 - DNA, 22 bp, Homo sapiens
gccctgggaccgctacaccact

SEQ ID NO: 2844293 - DNA, 18 bp, Homo sapiens
gccctgggccccaccacc

SEQ ID NO: 2844294 - DNA, 22 bp, Homo sapiens
gccctgggccccaccacctagg

SEQ ID NO: 2844295 - DNA, 13 bp, Homo sapiens
gccctggggcctg

SEQ ID NO: 2844296 - DNA, 18 bp, Homo sapiens
gccctggtccttccaggc

SEQ ID NO: 2844297 - DNA, 20 bp, Homo sapiens
gccctggtggcagtgggagc

SEQ ID NO: 2844298 - DNA, 14 bp, Homo sapiens
gccctgtcctccag

SEQ ID NO: 2844299 - DNA, 15 bp, Homo sapiens
gccctgtcctccagc

SEQ ID NO: 2844300 - DNA, 20 bp, Homo sapiens
gcccttagcagggaaacagc

SEQ ID NO: 2844301 - DNA, 22 bp, Homo sapiens
gcccttagcagggaaacagcta

SEQ ID NO: 2844302 - DNA, 20 bp, Homo sapiens
gcccttattttcaagaaact

SEQ ID NO: 2844303 - DNA, 22 bp, Homo sapiens
gcccttccagtggtaccagctc

SEQ ID NO: 2844304 - DNA, 12 bp, Homo sapiens
gcccttccatgt

SEQ ID NO: 2844305 - DNA, 21 bp, Homo sapiens
gcccttccatgtcgcctctgc

SEQ ID NO: 2844306 - DNA, 12 bp, Homo sapiens
gcccttccctgc

SEQ ID NO: 2844307 - DNA, 13 bp, Homo sapiens
gcccttcctagaa

SEQ ID NO: 2844308 - DNA, 19 bp, Homo sapiens
gcccttcctggacagctgt

SEQ ID NO: 2844309 - DNA, 20 bp, Homo sapiens
gcccttcctggacagctgtg

SEQ ID NO: 2844310 - DNA, 23 bp, Homo sapiens
gcccttcctggacagctgtgcct

SEQ ID NO: 2844311 - DNA, 13 bp, Homo sapiens
gcccttgccctga

SEQ ID NO: 2844312 - DNA, 14 bp, Homo sapiens
gcccttgccctgac

SEQ ID NO: 2844313 - DNA, 16 bp, Homo sapiens
gcccttgccctgacct

SEQ ID NO: 2844314 - DNA, 18 bp, Homo sapiens
gcccttgccctgacctcc

SEQ ID NO: 2844315 - DNA, 19 bp, Homo sapiens
gcccttgtttggggcagga

SEQ ID NO: 2844316 - DNA, 13 bp, Homo sapiens
gccgacctcagcc

SEQ ID NO: 2844317 - DNA, 14 bp, Homo sapiens
gccgacctcagcct

SEQ ID NO: 2844318 - DNA, 17 bp, Homo sapiens
gccgacctcagccttcc

SEQ ID NO: 2844319 - DNA, 16 bp, Homo sapiens
gccgactcagggacct

SEQ ID NO: 2844320 - DNA, 15 bp, Homo sapiens
gccgagagcctgctc

SEQ ID NO: 2844321 - DNA, 16 bp, Homo sapiens
gccgagatcacgccac

SEQ ID NO: 2844322 - DNA, 18 bp, Homo sapiens
gccgagatcacgccactg

SEQ ID NO: 2844323 - DNA, 19 bp, Homo sapiens
gccgagatcacgccactgc

SEQ ID NO: 2844324 - DNA, 22 bp, Homo sapiens
gccgagatcacgccactgcact

SEQ ID NO: 2844325 - DNA, 14 bp, Homo sapiens
gccgagcaaccgtg

SEQ ID NO: 2844326 - DNA, 20 bp, Homo sapiens
gccgagcaaccgtggccctt

SEQ ID NO: 2844327 - DNA, 15 bp, Homo sapiens
gccgagccgggcctg

SEQ ID NO: 2844328 - DNA, 15 bp, Homo sapiens
gccgcaccccagagt

SEQ ID NO: 2844329 - DNA, 23 bp, Homo sapiens
gccgcaccccagagtgtgggaag

SEQ ID NO: 2844330 - DNA, 18 bp, Homo sapiens
gccgcagcctccctctga

SEQ ID NO: 2844331 - DNA, 14 bp, Homo sapiens
gccgcattccctga

SEQ ID NO: 2844332 - DNA, 18 bp, Homo sapiens
gccgcattccctgagtca

SEQ ID NO: 2844333 - DNA, 12 bp, Homo sapiens
gccgcctcccag

SEQ ID NO: 2844334 - DNA, 13 bp, Homo sapiens
gccgcctcccagc

SEQ ID NO: 2844335 - DNA, 19 bp, Homo sapiens
gccgcctcccagcctgggg

SEQ ID NO: 2844336 - DNA, 15 bp, Homo sapiens
gccgctcctgtctgc

SEQ ID NO: 2844337 - DNA, 19 bp, Homo sapiens
gccgctcctgtctgccagc

SEQ ID NO: 2844338 - DNA, 20 bp, Homo sapiens
gccgctcctgtctgccagcc

SEQ ID NO: 2844339 - DNA, 22 bp, Homo sapiens
gccgctcctgtctgccagccag

SEQ ID NO: 2844340 - DNA, 11 bp, Homo sapiens
gccggcaaccc

SEQ ID NO: 2844341 - DNA, 14 bp, Homo sapiens
gcccgagcagctga

SEQ ID NO: 2844342 - DNA, 16 bp, Homo sapiens
gcccgagcagctgagc

SEQ ID NO: 2844343 - DNA, 19 bp, Homo sapiens
gcccgagcagctgagcagg

SEQ ID NO: 2844344 - DNA, 22 bp, Homo sapiens
gcccgagcagctgagcagggcc

SEQ ID NO: 2844345 - DNA, 23 bp, Homo sapiens
gcccgagcagctgagcagggccg

SEQ ID NO: 2844346 - DNA, 16 bp, Homo sapiens
gcccgctttgcctgct

SEQ ID NO: 2844347 - DNA, 12 bp, Homo sapiens
gcccggccccat

SEQ ID NO: 2844348 - DNA, 15 bp, Homo sapiens
gcccggcctgctccc

SEQ ID NO: 2844349 - DNA, 18 bp, Homo sapiens
gcccggcctgctcccagc

SEQ ID NO: 2844350 - DNA, 14 bp, Homo sapiens
gcccggctccaggc

SEQ ID NO: 2844351 - DNA, 16 bp, Homo sapiens
gcccggctccaggctc

SEQ ID NO: 2844352 - DNA, 17 bp, Homo sapiens
gcccggctccaggctcc

SEQ ID NO: 2844353 - DNA, 15 bp, Homo sapiens
gccctaccagaggga

SEQ ID NO: 2844354 - DNA, 21 bp, Homo sapiens
gccctagagcacactgtagca

SEQ ID NO: 2844355 - DNA, 14 bp, Homo sapiens
gccctccctggcct

SEQ ID NO: 2844356 - DNA, 15 bp, Homo sapiens
gccctccctggcctc

SEQ ID NO: 2844357 - DNA, 21 bp, Homo sapiens
gccctccctgtcctcctcgga

SEQ ID NO: 2844358 - DNA, 14 bp, Homo sapiens
gccctcctcacccc

SEQ ID NO: 2844359 - DNA, 19 bp, Homo sapiens
gccctgacctcccagccct

SEQ ID NO: 2844360 - DNA, 22 bp, Homo sapiens
gccctgagctcggtggacccag

SEQ ID NO: 2844361 - DNA, 15 bp, Homo sapiens
gccctgcagaccctg

SEQ ID NO: 2844362 - DNA, 21 bp, Homo sapiens
gccctgcagccaaacagagcc

SEQ ID NO: 2844363 - DNA, 19 bp, Homo sapiens
gcaataaatgccctctctg

SEQ ID NO: 2844364 - DNA, 22 bp, Homo sapiens
gcaataattaggatctatgcaa

SEQ ID NO: 2844365 - DNA, 24 bp, Homo sapiens
gcaataattaggatctatgcaatt

SEQ ID NO: 2844366 - DNA, 22 bp, Homo sapiens
gcaatccatgttagtttttact

SEQ ID NO: 2844367 - DNA, 16 bp, Homo sapiens
gcaatgacatcttcaa

SEQ ID NO: 2844368 - DNA, 13 bp, Homo sapiens
gcaatgctggctg

SEQ ID NO: 2844369 - DNA, 23 bp, Homo sapiens
gcaatgctggctgttggctgggg

SEQ ID NO: 2844370 - DNA, 14 bp, Homo sapiens
gcaatggcagcctt

SEQ ID NO: 2844371 - DNA, 18 bp, Homo sapiens
gcaatgtaaatattttaa

SEQ ID NO: 2844372 - DNA, 20 bp, Homo sapiens
gcaatgtcaggaacagaagg

SEQ ID NO: 2844373 - DNA, 20 bp, Homo sapiens
gcaatgtcccttgcacagcc

SEQ ID NO: 2844374 - DNA, 15 bp, Homo sapiens
gcaattattctaatt

SEQ ID NO: 2844375 - DNA, 20 bp, Homo sapiens
gcaattattctaattttata

SEQ ID NO: 2844376 - DNA, 22 bp, Homo sapiens
gcaattattctaattttatata

SEQ ID NO: 2844377 - DNA, 21 bp, Homo sapiens
gcaattctacccagagccttc

SEQ ID NO: 2844378 - DNA, 14 bp, Homo sapiens
gcaattttgtaacg

SEQ ID NO: 2844379 - DNA, 20 bp, Homo sapiens
gcactttgggaggctgaggc

SEQ ID NO: 2844380 - DNA, 15 bp, Homo sapiens
gcagaaaagcacctg

SEQ ID NO: 2844381 - DNA, 16 bp, Homo sapiens
gcagaaaagcacctgc

SEQ ID NO: 2844382 - DNA, 21 bp, Homo sapiens
gcagaaaagcacctgccgacc

SEQ ID NO: 2844383 - DNA, 14 bp, Homo sapiens
gcagaaaagtgctt

SEQ ID NO: 2844384 - DNA, 16 bp, Homo sapiens
gcagaaaagtgcttag

SEQ ID NO: 2844385 - DNA, 18 bp, Homo sapiens
gcagaaaagtgcttagaa

SEQ ID NO: 2844386 - DNA, 23 bp, Homo sapiens
gcagaagaattgaacccaggagg

SEQ ID NO: 2844387 - DNA, 16 bp, Homo sapiens
gcagacacctgtgcac

SEQ ID NO: 2844388 - DNA, 16 bp, Homo sapiens
gcagacagcagctcag

SEQ ID NO: 2844389 - DNA, 17 bp, Homo sapiens
gcagacagcagctcagg

SEQ ID NO: 2844390 - DNA, 20 bp, Homo sapiens
gcagacagcagctcaggcac

SEQ ID NO: 2844391 - DNA, 21 bp, Homo sapiens
gcagacagcagctcaggcaca

SEQ ID NO: 2844392 - DNA, 17 bp, Homo sapiens
gcagactctacagaggc

SEQ ID NO: 2844393 - DNA, 23 bp, Homo sapiens
gcagactgtggctgcagagacct

SEQ ID NO: 2844394 - DNA, 15 bp, Homo sapiens
gcagagaaagaagag

SEQ ID NO: 2844395 - DNA, 22 bp, Homo sapiens
gcagagaatgaaagggcccaga

SEQ ID NO: 2844396 - DNA, 18 bp, Homo sapiens
gcagagacaataaaacat

SEQ ID NO: 2844397 - DNA, 17 bp, Homo sapiens
gcagagacaggacctga

SEQ ID NO: 2844398 - DNA, 13 bp, Homo sapiens
gcagagagaagcc

SEQ ID NO: 2844399 - DNA, 14 bp, Homo sapiens
gcagagaggtggag

SEQ ID NO: 2844400 - DNA, 16 bp, Homo sapiens
gcagagaggtggagaa

SEQ ID NO: 2844401 - DNA, 18 bp, Homo sapiens
gcagagaggtggagaact

SEQ ID NO: 2844402 - DNA, 19 bp, Homo sapiens
gcagaggctggaggcaggg

SEQ ID NO: 2844403 - DNA, 21 bp, Homo sapiens
gcagaggctggaggcagggcc

SEQ ID NO: 2844404 - DNA, 22 bp, Homo sapiens
gcagaggctggaggcagggcct

SEQ ID NO: 2844405 - DNA, 12 bp, Homo sapiens
gcagaggggctt

SEQ ID NO: 2844406 - DNA, 13 bp, Homo sapiens
gcagaggtaaaag

SEQ ID NO: 2844407 - DNA, 20 bp, Homo sapiens
gcagaggtaaaagtgtgagc

SEQ ID NO: 2844408 - DNA, 21 bp, Homo sapiens
gcagaggtaaaagtgtgagca

SEQ ID NO: 2844409 - DNA, 16 bp, Homo sapiens
gcagataatcagcctc

SEQ ID NO: 2844410 - DNA, 18 bp, Homo sapiens
gcagataatcagcctctt

SEQ ID NO: 2844411 - DNA, 20 bp, Homo sapiens
gcagatttagtgaaagctag

SEQ ID NO: 2844412 - DNA, 14 bp, Homo sapiens
gcagcaaagtgtca

SEQ ID NO: 2844413 - DNA, 21 bp, Homo sapiens
gcagcaaggcccgagcagctg

SEQ ID NO: 2844414 - DNA, 15 bp, Homo sapiens
gcagcaccctgcaga

SEQ ID NO: 2844415 - DNA, 17 bp, Homo sapiens
gcagcaccctgcagagc

SEQ ID NO: 2844416 - DNA, 11 bp, Homo sapiens
gcagcagaagc

SEQ ID NO: 2844417 - DNA, 12 bp, Homo sapiens
gcagcagaagcc

SEQ ID NO: 2844418 - DNA, 13 bp, Homo sapiens
gcagcagaagcca

SEQ ID NO: 2844419 - DNA, 20 bp, Homo sapiens
gcagcagccagccctgcctg

SEQ ID NO: 2844420 - DNA, 12 bp, Homo sapiens
gcagcagctcag

SEQ ID NO: 2844421 - DNA, 17 bp, Homo sapiens
gcagcagctcagcctcc

SEQ ID NO: 2844422 - DNA, 23 bp, Homo sapiens
gcagcagcttttaatacagggta

SEQ ID NO: 2844423 - DNA, 21 bp, Homo sapiens
gcagcagtgagtctcttcaga

SEQ ID NO: 2844424 - DNA, 10 bp, Homo sapiens
gcagcatgtg

SEQ ID NO: 2844425 - DNA, 18 bp, Homo sapiens
gcagccacacttctcagg

SEQ ID NO: 2844426 - DNA, 20 bp, Homo sapiens
gcagccacacttctcaggac

SEQ ID NO: 2844427 - DNA, 15 bp, Homo sapiens
gcagccaccctgagg

SEQ ID NO: 2844428 - DNA, 13 bp, Homo sapiens
gcagccagcccag

SEQ ID NO: 2844429 - DNA, 17 bp, Homo sapiens
gcagccagccctgcctg

SEQ ID NO: 2844430 - DNA, 13 bp, Homo sapiens
gcagccagctctc

SEQ ID NO: 2844431 - DNA, 15 bp, Homo sapiens
gcagccagctctcag

SEQ ID NO: 2844432 - DNA, 16 bp, Homo sapiens
gcagccagctctcagc

SEQ ID NO: 2844433 - DNA, 17 bp, Homo sapiens
gcagccagctctcagcc

SEQ ID NO: 2844434 - DNA, 17 bp, Homo sapiens
gcagccccattctgcct

SEQ ID NO: 2844435 - DNA, 22 bp, Homo sapiens
gcagccctaaggatctctcagg

SEQ ID NO: 2844436 - DNA, 19 bp, Homo sapiens
gcagcctcaacctcctggg

SEQ ID NO: 2844437 - DNA, 16 bp, Homo sapiens
gcagcctccctctgac

SEQ ID NO: 2844438 - DNA, 14 bp, Homo sapiens
gcagcctttctgtg

SEQ ID NO: 2844439 - DNA, 22 bp, Homo sapiens
gcagcgagctatgatcgcgcca

SEQ ID NO: 2844440 - DNA, 20 bp, Homo sapiens
gcagctcctctgtctcgagc

SEQ ID NO: 2844441 - DNA, 19 bp, Homo sapiens
gcagctcttcccctttcct

SEQ ID NO: 2844442 - DNA, 12 bp, Homo sapiens
gcagctgagcag

SEQ ID NO: 2844443 - DNA, 17 bp, Homo sapiens
gcagctgagcagggccg

SEQ ID NO: 2844444 - DNA, 22 bp, Homo sapiens
gcagctgcggtccacccaggag

SEQ ID NO: 2844445 - DNA, 22 bp, Homo sapiens
gcagcttcatcaatttttatac

SEQ ID NO: 2844446 - DNA, 13 bp, Homo sapiens
gcagcttcctgtc

SEQ ID NO: 2844447 - DNA, 15 bp, Homo sapiens
gcagcttgagagggc

SEQ ID NO: 2844448 - DNA, 23 bp, Homo sapiens
gcagcttgagagggcaaacccaa

SEQ ID NO: 2844449 - DNA, 16 bp, Homo sapiens
gcagcttgagggttgg

SEQ ID NO: 2844450 - DNA, 19 bp, Homo sapiens
gcatgtaatcccagctact

SEQ ID NO: 2844451 - DNA, 15 bp, Homo sapiens
gcatgtaggagaatc

SEQ ID NO: 2844452 - DNA, 14 bp, Homo sapiens
gcatgtatgtcttg

SEQ ID NO: 2844453 - DNA, 22 bp, Homo sapiens
gcatgtgaattctgtgaagaat

SEQ ID NO: 2844454 - DNA, 18 bp, Homo sapiens
gcatgttacctcctataa

SEQ ID NO: 2844455 - DNA, 15 bp, Homo sapiens
gcatgttctctgagg

SEQ ID NO: 2844456 - DNA, 19 bp, Homo sapiens
gcatgttgccatgaggcct

SEQ ID NO: 2844457 - DNA, 20 bp, Homo sapiens
gcattaaattttaaggtaga

SEQ ID NO: 2844458 - DNA, 15 bp, Homo sapiens
gcattacgtgagcca

SEQ ID NO: 2844459 - DNA, 17 bp, Homo sapiens
gcattacgtgagccagg

SEQ ID NO: 2844460 - DNA, 22 bp, Homo sapiens
gcattattggaatataattgtt

SEQ ID NO: 2844461 - DNA, 18 bp, Homo sapiens
gcattcagaagaaaaaga

SEQ ID NO: 2844462 - DNA, 16 bp, Homo sapiens
gcattcctacaaagat

SEQ ID NO: 2844463 - DNA, 22 bp, Homo sapiens
gcattcggtacttacccggaga

SEQ ID NO: 2844464 - DNA, 21 bp, Homo sapiens
gcattgaatggctatgttttt

SEQ ID NO: 2844465 - DNA, 17 bp, Homo sapiens
gcatttactttgaattt

SEQ ID NO: 2844466 - DNA, 15 bp, Homo sapiens
gcatttactttgtgt

SEQ ID NO: 2844467 - DNA, 17 bp, Homo sapiens
gcatttataaatgtgtg

SEQ ID NO: 2844468 - DNA, 19 bp, Homo sapiens
gcatttataaatgtgtggt

SEQ ID NO: 2844469 - DNA, 16 bp, Homo sapiens
gcatttcccccaggga

SEQ ID NO: 2844470 - DNA, 21 bp, Homo sapiens
gcatttcctgggtggctactc

SEQ ID NO: 2844471 - DNA, 21 bp, Homo sapiens
gcatttcttatttgtttggtc

SEQ ID NO: 2844472 - DNA, 19 bp, Homo sapiens
gcatttgtgagccaaagag

SEQ ID NO: 2844473 - DNA, 14 bp, Homo sapiens
gcattttctctagc

SEQ ID NO: 2844474 - DNA, 15 bp, Homo sapiens
gcattttctctagct

SEQ ID NO: 2844475 - DNA, 13 bp, Homo sapiens
gccaaaaatagct

SEQ ID NO: 2844476 - DNA, 23 bp, Homo sapiens
gccaaaacaatgtttaaaccttt

SEQ ID NO: 2844477 - DNA, 20 bp, Homo sapiens
gccaaaatattgcttatgtc

SEQ ID NO: 2844478 - DNA, 14 bp, Homo sapiens
gccaaacagagcct

SEQ ID NO: 2844479 - DNA, 15 bp, Homo sapiens
gccaaacagagcctt

SEQ ID NO: 2844480 - DNA, 22 bp, Homo sapiens
gccaaacccatgaggcaatgtc

SEQ ID NO: 2844481 - DNA, 20 bp, Homo sapiens
gccaaagccaaagctaggcc

SEQ ID NO: 2844482 - DNA, 18 bp, Homo sapiens
gccaaatgtaattgaata

SEQ ID NO: 2844483 - DNA, 22 bp, Homo sapiens
gccaacaggtggcaggaccagg

SEQ ID NO: 2844484 - DNA, 22 bp, Homo sapiens
gccaacatacccttctttaaat

SEQ ID NO: 2844485 - DNA, 13 bp, Homo sapiens
gccaacttgtaaa

SEQ ID NO: 2844486 - DNA, 15 bp, Homo sapiens
gccaacttgtaaata

SEQ ID NO: 2844487 - DNA, 17 bp, Homo sapiens
gccaacttgtaaataca

SEQ ID NO: 2844488 - DNA, 18 bp, Homo sapiens
gccaacttgtaaatacac

SEQ ID NO: 2844489 - DNA, 22 bp, Homo sapiens
gccaagcacctagcctcgctct

SEQ ID NO: 2844490 - DNA, 18 bp, Homo sapiens
gccaagctgaggtgccca

SEQ ID NO: 2844491 - DNA, 18 bp, Homo sapiens
gccaaggtgggctgagcc

SEQ ID NO: 2844492 - DNA, 16 bp, Homo sapiens
gccaagtccaggtcct

SEQ ID NO: 2844493 - DNA, 19 bp, Homo sapiens
gccaagtccaggtcctggt

SEQ ID NO: 2844494 - DNA, 19 bp, Homo sapiens
gccaatgaggtctgaaatg

SEQ ID NO: 2844495 - DNA, 22 bp, Homo sapiens
gccaatgaggtctgaaatggag

SEQ ID NO: 2844496 - DNA, 21 bp, Homo sapiens
gccaattaaaatatatataaa

SEQ ID NO: 2844497 - DNA, 12 bp, Homo sapiens
gccacacagagc

SEQ ID NO: 2844498 - DNA, 14 bp, Homo sapiens
gccacacagagcct

SEQ ID NO: 2844499 - DNA, 20 bp, Homo sapiens
gccacacagagcctgcctca

SEQ ID NO: 2844500 - DNA, 21 bp, Homo sapiens
gccacacagagcctgcctcag

SEQ ID NO: 2844501 - DNA, 19 bp, Homo sapiens
gccacaccatctcctttca

SEQ ID NO: 2844502 - DNA, 15 bp, Homo sapiens
gccacacccggctcc

SEQ ID NO: 2844503 - DNA, 22 bp, Homo sapiens
gccacacccggctccccctgct

SEQ ID NO: 2844504 - DNA, 18 bp, Homo sapiens
gccacactattaccatga

SEQ ID NO: 2844505 - DNA, 14 bp, Homo sapiens
gccacactcagtcc

SEQ ID NO: 2844506 - DNA, 15 bp, Homo sapiens
gccacactcagtccc

SEQ ID NO: 2844507 - DNA, 23 bp, Homo sapiens
gccacacttctcaggacacaggc

SEQ ID NO: 2844508 - DNA, 19 bp, Homo sapiens
gccacagaagccaggagca

SEQ ID NO: 2844509 - DNA, 15 bp, Homo sapiens
gccacagaccacctg

SEQ ID NO: 2844510 - DNA, 20 bp, Homo sapiens
gccacagaccacctgcttct

SEQ ID NO: 2844511 - DNA, 13 bp, Homo sapiens
gccacagagaaga

SEQ ID NO: 2844512 - DNA, 12 bp, Homo sapiens
gccaccaggatg

SEQ ID NO: 2844513 - DNA, 12 bp, Homo sapiens
gccaccatcctg

SEQ ID NO: 2844514 - DNA, 15 bp, Homo sapiens
gccaccatcctgctg

SEQ ID NO: 2844515 - DNA, 18 bp, Homo sapiens
gccacccgttctgctggc

SEQ ID NO: 2844516 - DNA, 20 bp, Homo sapiens
gccaccctgaggagtctgag

SEQ ID NO: 2844517 - DNA, 19 bp, Homo sapiens
gccaccctggggagaaagt

SEQ ID NO: 2844518 - DNA, 17 bp, Homo sapiens
gccaccgggacagacct

SEQ ID NO: 2844519 - DNA, 23 bp, Homo sapiens
gccaccgggacagacctggacac

SEQ ID NO: 2844520 - DNA, 11 bp, Homo sapiens
gccacctcccc

SEQ ID NO: 2844521 - DNA, 21 bp, Homo sapiens
gccacctcccctatccaccca

SEQ ID NO: 2844522 - DNA, 15 bp, Homo sapiens
gccacctcttgggca

SEQ ID NO: 2844523 - DNA, 13 bp, Homo sapiens
gccacctgtctgt

SEQ ID NO: 2844524 - DNA, 15 bp, Homo sapiens
gccacggccaggcca

SEQ ID NO: 2844525 - DNA, 19 bp, Homo sapiens
gccacggccaggccagagg

SEQ ID NO: 2844526 - DNA, 13 bp, Homo sapiens
gccacgtgccagg

SEQ ID NO: 2844527 - DNA, 17 bp, Homo sapiens
gccactacactccagcc

SEQ ID NO: 2844528 - DNA, 18 bp, Homo sapiens
gccactacactccagcct

SEQ ID NO: 2844529 - DNA, 20 bp, Homo sapiens
gccactacactccagcctga

SEQ ID NO: 2844530 - DNA, 22 bp, Homo sapiens
gccactacactccagcctgagc

SEQ ID NO: 2844531 - DNA, 23 bp, Homo sapiens
gccactacactccagcctgagca

SEQ ID NO: 2844532 - DNA, 20 bp, Homo sapiens
gccactcaggaggctgaggc

SEQ ID NO: 2844533 - DNA, 13 bp, Homo sapiens
gccactcatttca

SEQ ID NO: 2844534 - DNA, 14 bp, Homo sapiens
gccactcatttcat

SEQ ID NO: 2844535 - DNA, 20 bp, Homo sapiens
gccactcatttcatctcatt

SEQ ID NO: 2844536 - DNA, 15 bp, Homo sapiens
gccactccttcctgc

SEQ ID NO: 2844537 - DNA, 18 bp, Homo sapiens
gccactccttcctgcccc

SEQ ID NO: 2844538 - DNA, 17 bp, Homo sapiens
gccactctcccctccct

SEQ ID NO: 2844539 - DNA, 22 bp, Homo sapiens
gccactctcccctccctcttcc

SEQ ID NO: 2844540 - DNA, 23 bp, Homo sapiens
gccatttgcaccctccgccttca

SEQ ID NO: 2844541 - DNA, 13 bp, Homo sapiens
gccattttaataa

SEQ ID NO: 2844542 - DNA, 16 bp, Homo sapiens
gcccaaatggctctgt

SEQ ID NO: 2844543 - DNA, 24 bp, Homo sapiens
gcccaacctgctctcctcttgcca

SEQ ID NO: 2844544 - DNA, 17 bp, Homo sapiens
gcccacagctcccaccc

SEQ ID NO: 2844545 - DNA, 12 bp, Homo sapiens
gcccacagggaa

SEQ ID NO: 2844546 - DNA, 19 bp, Homo sapiens
gcccacagggaaccctgct

SEQ ID NO: 2844547 - DNA, 17 bp, Homo sapiens
gcccaccaacatcccat

SEQ ID NO: 2844548 - DNA, 21 bp, Homo sapiens
gcccaccaacatcccattgcc

SEQ ID NO: 2844549 - DNA, 13 bp, Homo sapiens
gcccaccttggct

SEQ ID NO: 2844550 - DNA, 15 bp, Homo sapiens
gcccaccttggctca

SEQ ID NO: 2844551 - DNA, 16 bp, Homo sapiens
gcccaccttggctcaa

SEQ ID NO: 2844552 - DNA, 18 bp, Homo sapiens
gcccaccttggctcaagt

SEQ ID NO: 2844553 - DNA, 21 bp, Homo sapiens
gcccacgctggagtgcagtga

SEQ ID NO: 2844554 - DNA, 18 bp, Homo sapiens
gcccacgtgtgcagactg

SEQ ID NO: 2844555 - DNA, 22 bp, Homo sapiens
gcccacttgaggctggcactcc

SEQ ID NO: 2844556 - DNA, 18 bp, Homo sapiens
gcccagaaaacctccagt

SEQ ID NO: 2844557 - DNA, 18 bp, Homo sapiens
gcccagagaccccttcct

SEQ ID NO: 2844558 - DNA, 17 bp, Homo sapiens
gcccagagatgcctcca

SEQ ID NO: 2844559 - DNA, 20 bp, Homo sapiens
gcccagagatgcctccaccg

SEQ ID NO: 2844560 - DNA, 22 bp, Homo sapiens
gcccagagatgcctccaccgct

SEQ ID NO: 2844561 - DNA, 16 bp, Homo sapiens
gcccagagctggaaca

SEQ ID NO: 2844562 - DNA, 16 bp, Homo sapiens
gaggggcctagggagc

SEQ ID NO: 2844563 - DNA, 17 bp, Homo sapiens
gaggggcctagggagcc

SEQ ID NO: 2844564 - DNA, 14 bp, Homo sapiens
gaggggctcctgga

SEQ ID NO: 2844565 - DNA, 17 bp, Homo sapiens
gagggtccccgggagca

SEQ ID NO: 2844566 - DNA, 21 bp, Homo sapiens
gagggtcgccacacccggctc

SEQ ID NO: 2844567 - DNA, 13 bp, Homo sapiens
gagggtctgagga

SEQ ID NO: 2844568 - DNA, 14 bp, Homo sapiens
gagggtctgaggaa

SEQ ID NO: 2844569 - DNA, 22 bp, Homo sapiens
gagggtgtcccaaaaagaaagg

SEQ ID NO: 2844570 - DNA, 15 bp, Homo sapiens
gagggttgctatttg

SEQ ID NO: 2844571 - DNA, 14 bp, Homo sapiens
gagggttgggctgg

SEQ ID NO: 2844572 - DNA, 22 bp, Homo sapiens
gaggtaaaagtgtgagcagtga

SEQ ID NO: 2844573 - DNA, 23 bp, Homo sapiens
gaggtagagtttgaaggaggtga

SEQ ID NO: 2844574 - DNA, 20 bp, Homo sapiens
gaggtagctcccagcactca

SEQ ID NO: 2844575 - DNA, 23 bp, Homo sapiens
gactcaccctcataccatctgct

SEQ ID NO: 2844576 - DNA, 12 bp, Homo sapiens
gactcacctctg

SEQ ID NO: 2844577 - DNA, 14 bp, Homo sapiens
gactcacctctgcc

SEQ ID NO: 2844578 - DNA, 22 bp, Homo sapiens
gactcaggcccccacctggctc

SEQ ID NO: 2844579 - DNA, 13 bp, Homo sapiens
gactcagggacct

SEQ ID NO: 2844580 - DNA, 19 bp, Homo sapiens
gactcagggacctaagcca

SEQ ID NO: 2844581 - DNA, 15 bp, Homo sapiens
gactcagggccccag

SEQ ID NO: 2844582 - DNA, 18 bp, Homo sapiens
gactcagggccccagcac

SEQ ID NO: 2844583 - DNA, 10 bp, Homo sapiens
gactccagcc

SEQ ID NO: 2844584 - DNA, 20 bp, Homo sapiens
gactccagccagcgcctccc

SEQ ID NO: 2844585 - DNA, 15 bp, Homo sapiens
gactccccaggccag

SEQ ID NO: 2844586 - DNA, 11 bp, Homo sapiens
gactcctccca

SEQ ID NO: 2844587 - DNA, 14 bp, Homo sapiens
gactcctgccctgt

SEQ ID NO: 2844588 - DNA, 12 bp, Homo sapiens
gactctctgtga

SEQ ID NO: 2844589 - DNA, 14 bp, Homo sapiens
gactctctgtgacc

SEQ ID NO: 2844590 - DNA, 19 bp, Homo sapiens
gactctctgtgacctgccc

SEQ ID NO: 2844591 - DNA, 19 bp, Homo sapiens
gactctgcacatgtcttgt

SEQ ID NO: 2844592 - DNA, 20 bp, Homo sapiens
gactctgcacatgtcttgta

SEQ ID NO: 2844593 - DNA, 12 bp, Homo sapiens
gactctgcctcc

SEQ ID NO: 2844594 - DNA, 16 bp, Homo sapiens
gactctgcctcctctt

SEQ ID NO: 2844595 - DNA, 22 bp, Homo sapiens
gactctgtcaatttccctgact

SEQ ID NO: 2844596 - DNA, 12 bp, Homo sapiens
gactctgtctca

SEQ ID NO: 2844597 - DNA, 17 bp, Homo sapiens
gactcttctgagcacct

SEQ ID NO: 2844598 - DNA, 12 bp, Homo sapiens
gactcttgcctt

SEQ ID NO: 2844599 - DNA, 19 bp, Homo sapiens
gactcttgttttcagtttc

SEQ ID NO: 2844600 - DNA, 17 bp, Homo sapiens
gactcttttgccattaa

SEQ ID NO: 2844601 - DNA, 18 bp, Homo sapiens
gactgaattgtccccagt

SEQ ID NO: 2844602 - DNA, 17 bp, Homo sapiens
gactgacacctcactga

SEQ ID NO: 2844603 - DNA, 18 bp, Homo sapiens
gactgcaagaggctcctg

SEQ ID NO: 2844604 - DNA, 17 bp, Homo sapiens
gactggaaccagggaga

SEQ ID NO: 2844605 - DNA, 14 bp, Homo sapiens
gactggaagcacag

SEQ ID NO: 2844606 - DNA, 16 bp, Homo sapiens
gactggaagcacagct

SEQ ID NO: 2844607 - DNA, 15 bp, Homo sapiens
gactggacagcttgt

SEQ ID NO: 2844608 - DNA, 21 bp, Homo sapiens
gactggacagcttgtggcaag

SEQ ID NO: 2844609 - DNA, 14 bp, Homo sapiens
gactggagcatctg

SEQ ID NO: 2844610 - DNA, 16 bp, Homo sapiens
gactggctggctgcag

SEQ ID NO: 2844611 - DNA, 22 bp, Homo sapiens
gactggtgctataggctggaga

SEQ ID NO: 2844612 - DNA, 19 bp, Homo sapiens
gactgtcgtgtttacaaaa

SEQ ID NO: 2844613 - DNA, 21 bp, Homo sapiens
gactgtggctgcagagacctt

SEQ ID NO: 2844614 - DNA, 15 bp, Homo sapiens
gactgtggctgctag

SEQ ID NO: 2844615 - DNA, 21 bp, Homo sapiens
gactgtgttcagtgccttgga

SEQ ID NO: 2844616 - DNA, 19 bp, Homo sapiens
gacttaacggctccaggat

SEQ ID NO: 2844617 - DNA, 15 bp, Homo sapiens
gacttactgtttctt

SEQ ID NO: 2844618 - DNA, 17 bp, Homo sapiens
gacttagtatattttct

SEQ ID NO: 2844619 - DNA, 14 bp, Homo sapiens
gacttcagctctgt

SEQ ID NO: 2844620 - DNA, 22 bp, Homo sapiens
gacttcagtcctggtctgctca

SEQ ID NO: 2844621 - DNA, 23 bp, Homo sapiens
gacttctctttcttattttgtaa

SEQ ID NO: 2844622 - DNA, 14 bp, Homo sapiens
gacttctctttgcc

SEQ ID NO: 2844623 - DNA, 18 bp, Homo sapiens
gacttgacagaacactgt

SEQ ID NO: 2844624 - DNA, 14 bp, Homo sapiens
gacttggaagctcc

SEQ ID NO: 2844625 - DNA, 15 bp, Homo sapiens
gacttggaagctccg

SEQ ID NO: 2844626 - DNA, 23 bp, Homo sapiens
gacttgggcacccccagcctggg

SEQ ID NO: 2844627 - DNA, 13 bp, Homo sapiens
gacttgtgtctct

SEQ ID NO: 2844628 - DNA, 22 bp, Homo sapiens
gactttatctaatacctctgtg

SEQ ID NO: 2844629 - DNA, 14 bp, Homo sapiens
gactttcaggtact

SEQ ID NO: 2844630 - DNA, 16 bp, Homo sapiens
gactttcctaaatgtt

SEQ ID NO: 2844631 - DNA, 13 bp, Homo sapiens
gactttttataat

SEQ ID NO: 2844632 - DNA, 16 bp, Homo sapiens
gactttttataatgtg

SEQ ID NO: 2844633 - DNA, 11 bp, Homo sapiens
gagaaaaacaa

SEQ ID NO: 2844634 - DNA, 12 bp, Homo sapiens
gagaaaaaccaa

SEQ ID NO: 2844635 - DNA, 14 bp, Homo sapiens
gagaaaaaccaatg

SEQ ID NO: 2844636 - DNA, 17 bp, Homo sapiens
gagaaaaaccaatgatt

SEQ ID NO: 2844637 - DNA, 17 bp, Homo sapiens
gagaaaaactttcattt

SEQ ID NO: 2844638 - DNA, 14 bp, Homo sapiens
gagaaaagattaaa

SEQ ID NO: 2844639 - DNA, 14 bp, Homo sapiens
gagaaacagagaca

SEQ ID NO: 2844640 - DNA, 12 bp, Homo sapiens
gagaaaccctgt

SEQ ID NO: 2844641 - DNA, 13 bp, Homo sapiens
gagaaatttttat

SEQ ID NO: 2844642 - DNA, 19 bp, Homo sapiens
gagaaatttttatttttga

SEQ ID NO: 2844643 - DNA, 15 bp, Homo sapiens
gagaacctggccttc

SEQ ID NO: 2844644 - DNA, 22 bp, Homo sapiens
gagaagaaagaggtgaccccag

SEQ ID NO: 2844645 - DNA, 19 bp, Homo sapiens
gagaagagagaaatagcct

SEQ ID NO: 2844646 - DNA, 21 bp, Homo sapiens
gagaagaggctggtgctgtgg

SEQ ID NO: 2844647 - DNA, 16 bp, Homo sapiens
gagaagagggcctgtg

SEQ ID NO: 2844648 - DNA, 17 bp, Homo sapiens
gagaaggatctagaatg

SEQ ID NO: 2844649 - DNA, 12 bp, Homo sapiens
gagaaggcagga

SEQ ID NO: 2844650 - DNA, 15 bp, Homo sapiens
gagaaggtccttaat

SEQ ID NO: 2844651 - DNA, 18 bp, Homo sapiens
gagaagtatccaattatg

SEQ ID NO: 2844652 - DNA, 22 bp, Homo sapiens
gagaagtatccaattatgtgac

SEQ ID NO: 2844653 - DNA, 19 bp, Homo sapiens
gagaagtcagttggagaaa

SEQ ID NO: 2844654 - DNA, 21 bp, Homo sapiens
gagaagtcagttggagaaaat

SEQ ID NO: 2844655 - DNA, 15 bp, Homo sapiens
gagaagttaagcagc

SEQ ID NO: 2844656 - DNA, 16 bp, Homo sapiens
gagaataaagacttca

SEQ ID NO: 2844657 - DNA, 12 bp, Homo sapiens
gagaatatatac

SEQ ID NO: 2844658 - DNA, 13 bp, Homo sapiens
gagcttgggaatg

SEQ ID NO: 2844659 - DNA, 12 bp, Homo sapiens
gaggaagagaga

SEQ ID NO: 2844660 - DNA, 13 bp, Homo sapiens
gaggaatatcaat

SEQ ID NO: 2844661 - DNA, 22 bp, Homo sapiens
gaggaattttctttgtgtagct

SEQ ID NO: 2844662 - DNA, 20 bp, Homo sapiens
gaggacaaagagaataaaga

SEQ ID NO: 2844663 - DNA, 13 bp, Homo sapiens
gaggacacatgtc

SEQ ID NO: 2844664 - DNA, 23 bp, Homo sapiens
gaggacagggaggtgaccccagg

SEQ ID NO: 2844665 - DNA, 17 bp, Homo sapiens
gaggacctgagcctgcc

SEQ ID NO: 2844666 - DNA, 21 bp, Homo sapiens
gaggacctgagcctgccgagc

SEQ ID NO: 2844667 - DNA, 17 bp, Homo sapiens
gaggacttgtgtctctg

SEQ ID NO: 2844668 - DNA, 16 bp, Homo sapiens
gaggacttttctttgt

SEQ ID NO: 2844669 - DNA, 22 bp, Homo sapiens
gaggagaagaattttcagaccc

SEQ ID NO: 2844670 - DNA, 12 bp, Homo sapiens
gaccagcctggg

SEQ ID NO: 2844671 - DNA, 23 bp, Homo sapiens
gaccagcctgttggacccgctct

SEQ ID NO: 2844672 - DNA, 17 bp, Homo sapiens
gaccagctcagaggccc

SEQ ID NO: 2844673 - DNA, 21 bp, Homo sapiens
gaccagctcagaggcccagga

SEQ ID NO: 2844674 - DNA, 16 bp, Homo sapiens
gaccaggacaggacca

SEQ ID NO: 2844675 - DNA, 14 bp, Homo sapiens
gaccaggactatag

SEQ ID NO: 2844676 - DNA, 18 bp, Homo sapiens
gaccaggctcacaactgt

SEQ ID NO: 2844677 - DNA, 20 bp, Homo sapiens
gaccaggctcacaactgttt

SEQ ID NO: 2844678 - DNA, 15 bp, Homo sapiens
gaccagttgggagca

SEQ ID NO: 2844679 - DNA, 19 bp, Homo sapiens
gaccataacagccaacagg

SEQ ID NO: 2844680 - DNA, 20 bp, Homo sapiens
gaccataatgttacattatt

SEQ ID NO: 2844681 - DNA, 13 bp, Homo sapiens
gaccatcctgtcc

SEQ ID NO: 2844682 - DNA, 20 bp, Homo sapiens
gacccagatcctcacaacca

SEQ ID NO: 2844683 - DNA, 17 bp, Homo sapiens
gacccagatctcatgga

SEQ ID NO: 2844684 - DNA, 16 bp, Homo sapiens
gacccagcaggaagcc

SEQ ID NO: 2844685 - DNA, 21 bp, Homo sapiens
gacccagcaggaagccaggct

SEQ ID NO: 2844686 - DNA, 22 bp, Homo sapiens
gacccagcaggaagccaggctg

SEQ ID NO: 2844687 - DNA, 14 bp, Homo sapiens
gacccagtccctgg

SEQ ID NO: 2844688 - DNA, 15 bp, Homo sapiens
gacccagtccctggg

SEQ ID NO: 2844689 - DNA, 18 bp, Homo sapiens
gacccatagatcttctga

SEQ ID NO: 2844690 - DNA, 23 bp, Homo sapiens
gaccccaaagagcctggagaagc

SEQ ID NO: 2844691 - DNA, 17 bp, Homo sapiens
gaccccagggcacagga

SEQ ID NO: 2844692 - DNA, 19 bp, Homo sapiens
gacccccactctcattccc

SEQ ID NO: 2844693 - DNA, 13 bp, Homo sapiens
gacccctcagtgc

SEQ ID NO: 2844694 - DNA, 13 bp, Homo sapiens
gacccctccatgt

SEQ ID NO: 2844695 - DNA, 17 bp, Homo sapiens
gacccggcaccccctgc

SEQ ID NO: 2844696 - DNA, 19 bp, Homo sapiens
gacccggcaccccctgcag

SEQ ID NO: 2844697 - DNA, 20 bp, Homo sapiens
gacccggcaccccctgcagc

SEQ ID NO: 2844698 - DNA, 12 bp, Homo sapiens
gacccggctgcg

SEQ ID NO: 2844699 - DNA, 22 bp, Homo sapiens
gacccgttcaacttttcctttg

SEQ ID NO: 2844700 - DNA, 17 bp, Homo sapiens
gaccctacttcctgcac

SEQ ID NO: 2844701 - DNA, 15 bp, Homo sapiens
gaccctccccgcacc

SEQ ID NO: 2844702 - DNA, 17 bp, Homo sapiens
gaccctccccgcacccc

SEQ ID NO: 2844703 - DNA, 15 bp, Homo sapiens
gaccctcctgtccag

SEQ ID NO: 2844704 - DNA, 22 bp, Homo sapiens
gaccctggagcggctctcctga

SEQ ID NO: 2844705 - DNA, 19 bp, Homo sapiens
gaccctgtagagtcactga

SEQ ID NO: 2844706 - DNA, 12 bp, Homo sapiens
gaccctgtctct

SEQ ID NO: 2844707 - DNA, 14 bp, Homo sapiens
gaccctttccttcc

SEQ ID NO: 2844708 - DNA, 20 bp, Homo sapiens
gaccctttccttccttccct

SEQ ID NO: 2844709 - DNA, 21 bp, Homo sapiens
gaccctttccttccttccctg

SEQ ID NO: 2844710 - DNA, 14 bp, Homo sapiens
gaccgaattttatt

SEQ ID NO: 2844711 - DNA, 21 bp, Homo sapiens
gaccgctacaccactctggca

SEQ ID NO: 2844712 - DNA, 22 bp, Homo sapiens
gaccgctacaccactctggcag

SEQ ID NO: 2844713 - DNA, 15 bp, Homo sapiens
gaccggccctgcccc

SEQ ID NO: 2844714 - DNA, 16 bp, Homo sapiens
gacctatacctgtgtt

SEQ ID NO: 2844715 - DNA, 21 bp, Homo sapiens
gacctatgtcctaaggacaca

SEQ ID NO: 2844716 - DNA, 22 bp, Homo sapiens
gacctatgtcctaaggacacac

SEQ ID NO: 2844717 - DNA, 13 bp, Homo sapiens
gacctcacctttg

SEQ ID NO: 2844718 - DNA, 10 bp, Homo sapiens
gacctcagcc

SEQ ID NO: 2844719 - DNA, 11 bp, Homo sapiens
gacctcagcca

SEQ ID NO: 2844720 - DNA, 11 bp, Homo sapiens
gacctcagcct

SEQ ID NO: 2844721 - DNA, 13 bp, Homo sapiens
gacctcagccttc

SEQ ID NO: 2844722 - DNA, 20 bp, Homo sapiens
gacctcagttttatcatttt

SEQ ID NO: 2844723 - DNA, 21 bp, Homo sapiens
gacctcagttttatcattttc

SEQ ID NO: 2844724 - DNA, 15 bp, Homo sapiens
gacctcccagcccta

SEQ ID NO: 2844725 - DNA, 22 bp, Homo sapiens
gacctcccagccctatggatgt

SEQ ID NO: 2844726 - DNA, 17 bp, Homo sapiens
gacctcctcctgccctc

SEQ ID NO: 2844727 - DNA, 17 bp, Homo sapiens
gacctcgtcctccccct

SEQ ID NO: 2844728 - DNA, 13 bp, Homo sapiens
gacctctgatccc

SEQ ID NO: 2844729 - DNA, 14 bp, Homo sapiens
gacctctgatccct

SEQ ID NO: 2844730 - DNA, 13 bp, Homo sapiens
gacctgagcctgc

SEQ ID NO: 2844731 - DNA, 13 bp, Homo sapiens
gacctgcaggcca

SEQ ID NO: 2844732 - DNA, 21 bp, Homo sapiens
gacctgccccgcccagctgca

SEQ ID NO: 2844733 - DNA, 12 bp, Homo sapiens
gacctgcctgta

SEQ ID NO: 2844734 - DNA, 13 bp, Homo sapiens
gacctgctgagct

SEQ ID NO: 2844735 - DNA, 14 bp, Homo sapiens
gacctgctgagctc

SEQ ID NO: 2844736 - DNA, 18 bp, Homo sapiens
gacctgctgagctctgag

SEQ ID NO: 2844737 - DNA, 19 bp, Homo sapiens
gacctgtggggccccagag

SEQ ID NO: 2844738 - DNA, 14 bp, Homo sapiens
gaccttcctgccac

SEQ ID NO: 2844739 - DNA, 16 bp, Homo sapiens
gaccttcctgccacca

SEQ ID NO: 2844740 - DNA, 23 bp, Homo sapiens
gaccttcctgccaccagtcactg

SEQ ID NO: 2844741 - DNA, 13 bp, Homo sapiens
gaccttctgaaga

SEQ ID NO: 2844742 - DNA, 20 bp, Homo sapiens
gaccttgttgcatgatgtat

SEQ ID NO: 2844743 - DNA, 14 bp, Homo sapiens
gacgccactcattt

SEQ ID NO: 2844744 - DNA, 18 bp, Homo sapiens
gacggttaacttgtatat

SEQ ID NO: 2844745 - DNA, 20 bp, Homo sapiens
gacggttaacttgtatattc

SEQ ID NO: 2844746 - DNA, 21 bp, Homo sapiens
gacggtttcaaaccaggattt

SEQ ID NO: 2844747 - DNA, 23 bp, Homo sapiens
gacgtatgcttattttaaaattt

SEQ ID NO: 2844748 - DNA, 14 bp, Homo sapiens
gacgtcaagtctcc

SEQ ID NO: 2844749 - DNA, 18 bp, Homo sapiens
gacgtgcacctgtactca

SEQ ID NO: 2844750 - DNA, 21 bp, Homo sapiens
gacgttcggggcatgctgggg

SEQ ID NO: 2844751 - DNA, 16 bp, Homo sapiens
gactaacactcagaag

SEQ ID NO: 2844752 - DNA, 14 bp, Homo sapiens
gactaagccctgtc

SEQ ID NO: 2844753 - DNA, 22 bp, Homo sapiens
gactaagccctgtcgagacact

SEQ ID NO: 2844754 - DNA, 12 bp, Homo sapiens
gactacaggcac

SEQ ID NO: 2844755 - DNA, 14 bp, Homo sapiens
gaataaagtctgag

SEQ ID NO: 2844756 - DNA, 17 bp, Homo sapiens
gaataaagtctgagtgg

SEQ ID NO: 2844757 - DNA, 13 bp, Homo sapiens
gaataaagttctg

SEQ ID NO: 2844758 - DNA, 20 bp, Homo sapiens
gaataaagttctgagtgttt

SEQ ID NO: 2844759 - DNA, 15 bp, Homo sapiens
gaataaattgctcct

SEQ ID NO: 2844760 - DNA, 19 bp, Homo sapiens
gaataaggtacaagaagca

SEQ ID NO: 2844761 - DNA, 15 bp, Homo sapiens
gaataatagaagaac

SEQ ID NO: 2844762 - DNA, 16 bp, Homo sapiens
gaataattgtgtacaa

SEQ ID NO: 2844763 - DNA, 19 bp, Homo sapiens
gaataattgtgtacaaagt

SEQ ID NO: 2844764 - DNA, 21 bp, Homo sapiens
gaataattgtgtacaaagtag

SEQ ID NO: 2844765 - DNA, 14 bp, Homo sapiens
gaataatttcttac

SEQ ID NO: 2844766 - DNA, 14 bp, Homo sapiens
gaatacagaaagat

SEQ ID NO: 2844767 - DNA, 15 bp, Homo sapiens
gaatagctgggacta

SEQ ID NO: 2844768 - DNA, 13 bp, Homo sapiens
gaatataattatc

SEQ ID NO: 2844769 - DNA, 12 bp, Homo sapiens
gaatatattata

SEQ ID NO: 2844770 - DNA, 10 bp, Homo sapiens
gaatatttat

SEQ ID NO: 2844771 - DNA, 13 bp, Homo sapiens
gaatatttattac

SEQ ID NO: 2844772 - DNA, 21 bp, Homo sapiens
gaatatttattacctctgata

SEQ ID NO: 2844773 - DNA, 17 bp, Homo sapiens
gaatatttcaaaataaa

SEQ ID NO: 2844774 - DNA, 21 bp, Homo sapiens
gaatcaaaaattgaagagaga

SEQ ID NO: 2844775 - DNA, 18 bp, Homo sapiens
gaatcagaccctacccca

SEQ ID NO: 2844776 - DNA, 23 bp, Homo sapiens
gaatcagaccctaccccaccacg

SEQ ID NO: 2844777 - DNA, 15 bp, Homo sapiens
gaatcataattttca

SEQ ID NO: 2844778 - DNA, 16 bp, Homo sapiens
gaatcataattttcaa

SEQ ID NO: 2844779 - DNA, 23 bp, Homo sapiens
gaatcataattttcaagagaaga

SEQ ID NO: 2844780 - DNA, 16 bp, Homo sapiens
gaatccaagcgaggtc

SEQ ID NO: 2844781 - DNA, 22 bp, Homo sapiens
gaatcccacccacatgtgacac

SEQ ID NO: 2844782 - DNA, 18 bp, Homo sapiens
gaatccctgcagcctggt

SEQ ID NO: 2844783 - DNA, 12 bp, Homo sapiens
gaatcctttcag

SEQ ID NO: 2844784 - DNA, 18 bp, Homo sapiens
gaatcgacctcactgtca

SEQ ID NO: 2844785 - DNA, 19 bp, Homo sapiens
gaatcgatctgtactgtaa

SEQ ID NO: 2844786 - DNA, 13 bp, Homo sapiens
gaatctacagaac

SEQ ID NO: 2844787 - DNA, 19 bp, Homo sapiens
gaatctacagaacaaagaa

SEQ ID NO: 2844788 - DNA, 14 bp, Homo sapiens
gaatctcccctcct

SEQ ID NO: 2844789 - DNA, 16 bp, Homo sapiens
gaatctgtgcagatga

SEQ ID NO: 2844790 - DNA, 13 bp, Homo sapiens
gaatcttactcct

SEQ ID NO: 2844791 - DNA, 22 bp, Homo sapiens
gaatgaaccacatcttgctctg

SEQ ID NO: 2844792 - DNA, 14 bp, Homo sapiens
gaatgaattaaata

SEQ ID NO: 2844793 - DNA, 17 bp, Homo sapiens
gaatgactataaacatt

SEQ ID NO: 2844794 - DNA, 11 bp, Homo sapiens
gaatgagcctc

SEQ ID NO: 2844795 - DNA, 13 bp, Homo sapiens
gaatgagcctcgg

SEQ ID NO: 2844796 - DNA, 23 bp, Homo sapiens
gaatgaggaataataagttaaac

SEQ ID NO: 2844797 - DNA, 18 bp, Homo sapiens
gaatgaggtcccaggcag

SEQ ID NO: 2844798 - DNA, 11 bp, Homo sapiens
gaatgcagtgg

SEQ ID NO: 2844799 - DNA, 15 bp, Homo sapiens
gaatgctgtatatgt

SEQ ID NO: 2844800 - DNA, 17 bp, Homo sapiens
gaatggcacagcccaaa

SEQ ID NO: 2844801 - DNA, 14 bp, Homo sapiens
gaatggcagctgga

SEQ ID NO: 2844802 - DNA, 17 bp, Homo sapiens
gaatggcctgccttgaa

SEQ ID NO: 2844803 - DNA, 21 bp, Homo sapiens
gaatggcctgccttgaagcca

SEQ ID NO: 2844804 - DNA, 14 bp, Homo sapiens
gaatggtgcagaaa

SEQ ID NO: 2844805 - DNA, 16 bp, Homo sapiens
gaatggttccatgcct

SEQ ID NO: 2844806 - DNA, 20 bp, Homo sapiens
gaatggttccatgcctgagg

SEQ ID NO: 2844807 - DNA, 15 bp, Homo sapiens
gaatgtaaagcttgt

SEQ ID NO: 2844808 - DNA, 13 bp, Homo sapiens
gaatgtaatcaat

SEQ ID NO: 2844809 - DNA, 19 bp, Homo sapiens
gaatgtaatcaatgtttct

SEQ ID NO: 2844810 - DNA, 20 bp, Homo sapiens
gaatgttaagacttgacagt

SEQ ID NO: 2844811 - DNA, 16 bp, Homo sapiens
gaatgttactttggaa

SEQ ID NO: 2844812 - DNA, 22 bp, Homo sapiens
gaatgttactttggaatgacta

SEQ ID NO: 2844813 - DNA, 19 bp, Homo sapiens
gaatgtttgcctctgcctc

SEQ ID NO: 2844814 - DNA, 20 bp, Homo sapiens
gaattaaataaacccttcct

SEQ ID NO: 2844815 - DNA, 18 bp, Homo sapiens
gaattatatctaatttat

SEQ ID NO: 2844816 - DNA, 14 bp, Homo sapiens
gaattatttttgtg

SEQ ID NO: 2844817 - DNA, 16 bp, Homo sapiens
gaattccaaggagttc

SEQ ID NO: 2844818 - DNA, 16 bp, Homo sapiens
gaattctagaaaattt

SEQ ID NO: 2844819 - DNA, 16 bp, Homo sapiens
gaattgaacccaggag

SEQ ID NO: 2844820 - DNA, 15 bp, Homo sapiens
gaattgaagatgtaa

SEQ ID NO: 2844821 - DNA, 19 bp, Homo sapiens
gaattgagtgtttaaagtt

SEQ ID NO: 2844822 - DNA, 22 bp, Homo sapiens
gaattgcctgcagagagaagcc

SEQ ID NO: 2844823 - DNA, 23 bp, Homo sapiens
gaattgtccccagtttgcagaaa

SEQ ID NO: 2844824 - DNA, 22 bp, Homo sapiens
gaattgtgcgacttcacaaaat

SEQ ID NO: 2844825 - DNA, 18 bp, Homo sapiens
gaatttaaaaataagaaa

SEQ ID NO: 2844826 - DNA, 21 bp, Homo sapiens
gaatttaaattctttttcaaa

SEQ ID NO: 2844827 - DNA, 12 bp, Homo sapiens
gaatttctaaaa

SEQ ID NO: 2844828 - DNA, 19 bp, Homo sapiens
gaatttggagactctgtgg

SEQ ID NO: 2844829 - DNA, 14 bp, Homo sapiens
gaattttcagaccc

SEQ ID NO: 2844830 - DNA, 18 bp, Homo sapiens
gaatttttaaacaagtat

SEQ ID NO: 2844831 - DNA, 16 bp, Homo sapiens
gaatttttcattgata

SEQ ID NO: 2844832 - DNA, 16 bp, Homo sapiens
gacaaaaacagcctca

SEQ ID NO: 2844833 - DNA, 20 bp, Homo sapiens
gacaaaattggccagagagt

SEQ ID NO: 2844834 - DNA, 17 bp, Homo sapiens
gacaaacacctcccagg

SEQ ID NO: 2844835 - DNA, 13 bp, Homo sapiens
gacaaaggagcct

SEQ ID NO: 2844836 - DNA, 15 bp, Homo sapiens
gacaaaggagcctgt

SEQ ID NO: 2844837 - DNA, 16 bp, Homo sapiens
gacaaaggagcctgtg

SEQ ID NO: 2844838 - DNA, 18 bp, Homo sapiens
gacaaaggagcctgtgaa

SEQ ID NO: 2844839 - DNA, 19 bp, Homo sapiens
gacaaagggaaggctgctg

SEQ ID NO: 2844840 - DNA, 12 bp, Homo sapiens
ctttttctttat

SEQ ID NO: 2844841 - DNA, 18 bp, Homo sapiens
cttttttaaatgaagaaa

SEQ ID NO: 2844842 - DNA, 15 bp, Homo sapiens
cttttttcactacat

SEQ ID NO: 2844843 - DNA, 13 bp, Homo sapiens
gaaaaaaatgact

SEQ ID NO: 2844844 - DNA, 15 bp, Homo sapiens
gaaaaaagagaaaaa

SEQ ID NO: 2844845 - DNA, 10 bp, Homo sapiens
gaaaaaatac

SEQ ID NO: 2844846 - DNA, 14 bp, Homo sapiens
gaaaaaatacattt

SEQ ID NO: 2844847 - DNA, 15 bp, Homo sapiens
gaaaaaatacatttt

SEQ ID NO: 2844848 - DNA, 20 bp, Homo sapiens
gaaaaaattaagagatacat

SEQ ID NO: 2844849 - DNA, 21 bp, Homo sapiens
gaaaaaattaagagatacatt

SEQ ID NO: 2844850 - DNA, 23 bp, Homo sapiens
gaaaaacaaactcgttttttaca

SEQ ID NO: 2844851 - DNA, 15 bp, Homo sapiens
gaaaaaccaatgatt

SEQ ID NO: 2844852 - DNA, 15 bp, Homo sapiens
gaaaacattcatcca

SEQ ID NO: 2844853 - DNA, 12 bp, Homo sapiens
gaaaacccagag

SEQ ID NO: 2844854 - DNA, 19 bp, Homo sapiens
gaaaacctcatttaccata

SEQ ID NO: 2844855 - DNA, 19 bp, Homo sapiens
gaaaactggaaatctggat

SEQ ID NO: 2844856 - DNA, 16 bp, Homo sapiens
gaaaactgtaaataca

SEQ ID NO: 2844857 - DNA, 21 bp, Homo sapiens
gaaaactgtaaatacaaaata

SEQ ID NO: 2844858 - DNA, 23 bp, Homo sapiens
gaaaactgtttatggtattttcg

SEQ ID NO: 2844859 - DNA, 16 bp, Homo sapiens
gaaaactttaaagcgt

SEQ ID NO: 2844860 - DNA, 18 bp, Homo sapiens
gaaaagaatacagaaaga

SEQ ID NO: 2844861 - DNA, 22 bp, Homo sapiens
gaaaagaatccctgcagcctgg

SEQ ID NO: 2844862 - DNA, 21 bp, Homo sapiens
gaaaagattaaaattagtgag

SEQ ID NO: 2844863 - DNA, 19 bp, Homo sapiens
gaaaagctgctgacagtgt

SEQ ID NO: 2844864 - DNA, 11 bp, Homo sapiens
gaaaaggcagg

SEQ ID NO: 2844865 - DNA, 12 bp, Homo sapiens
gaaaaggcctgg

SEQ ID NO: 2844866 - DNA, 14 bp, Homo sapiens
gaaaaggtacatgt

SEQ ID NO: 2844867 - DNA, 17 bp, Homo sapiens
gaaaaggtttatgaaaa

SEQ ID NO: 2844868 - DNA, 13 bp, Homo sapiens
gaaaagtagaatt

SEQ ID NO: 2844869 - DNA, 20 bp, Homo sapiens
gaaaagtagaattatatcta

SEQ ID NO: 2844870 - DNA, 15 bp, Homo sapiens
gaaaagtcacacaga

SEQ ID NO: 2844871 - DNA, 14 bp, Homo sapiens
gaaaagtgctgttt

SEQ ID NO: 2844872 - DNA, 18 bp, Homo sapiens
gaaaagtgcttagaaagt

SEQ ID NO: 2844873 - DNA, 13 bp, Homo sapiens
gaaaagtgttatt

SEQ ID NO: 2844874 - DNA, 14 bp, Homo sapiens
gaaaagtgttatta

SEQ ID NO: 2844875 - DNA, 15 bp, Homo sapiens
gaaaagtgttattat

SEQ ID NO: 2844876 - DNA, 20 bp, Homo sapiens
gaaaatagtaaatgctttgt

SEQ ID NO: 2844877 - DNA, 22 bp, Homo sapiens
gaaaatataaatgcatgatttt

SEQ ID NO: 2844878 - DNA, 18 bp, Homo sapiens
gaaaatgcaacaacatgt

SEQ ID NO: 2844879 - DNA, 23 bp, Homo sapiens
gaaaatgtctattcaaaatatca

SEQ ID NO: 2844880 - DNA, 13 bp, Homo sapiens
gaaaattaacact

SEQ ID NO: 2844881 - DNA, 18 bp, Homo sapiens
gaaaattaggatttcatg

SEQ ID NO: 2844882 - DNA, 19 bp, Homo sapiens
gaaacaaaaacactaaaaa

SEQ ID NO: 2844883 - DNA, 23 bp, Homo sapiens
gaaacaaagagttcaagaaataa

SEQ ID NO: 2844884 - DNA, 16 bp, Homo sapiens
gaaacacctcccaggg

SEQ ID NO: 2844885 - DNA, 20 bp, Homo sapiens
gaaacagagaaccctgtggg

SEQ ID NO: 2844886 - DNA, 17 bp, Homo sapiens
gaaacagagacaggccc

SEQ ID NO: 2844887 - DNA, 18 bp, Homo sapiens
gaaacaggggatcaaagt

SEQ ID NO: 2844888 - DNA, 22 bp, Homo sapiens
gaaacaggggatcaaagttcct

SEQ ID NO: 2844889 - DNA, 11 bp, Homo sapiens
gaaacatttac

SEQ ID NO: 2844890 - DNA, 22 bp, Homo sapiens
gaaacatttacaataaatattc

SEQ ID NO: 2844891 - DNA, 20 bp, Homo sapiens
gaaacctgtccataaagtaa

SEQ ID NO: 2844892 - DNA, 20 bp, Homo sapiens
gaaaccttattgtacctctc

SEQ ID NO: 2844893 - DNA, 19 bp, Homo sapiens
gaaacgtacttaactgtgt

SEQ ID NO: 2844894 - DNA, 22 bp, Homo sapiens
gaaactgaggaattttctttgt

SEQ ID NO: 2844895 - DNA, 16 bp, Homo sapiens
gaaactggccaggggt

SEQ ID NO: 2844896 - DNA, 16 bp, Homo sapiens
gaaagaaaaaacaaaa

SEQ ID NO: 2844897 - DNA, 15 bp, Homo sapiens
gaaagaaataattgt

SEQ ID NO: 2844898 - DNA, 19 bp, Homo sapiens
gaaagagagagaattcttt

SEQ ID NO: 2844899 - DNA, 22 bp, Homo sapiens
gaaagatggctgtgcctctgcc

SEQ ID NO: 2844900 - DNA, 18 bp, Homo sapiens
gaaagcaccgcagcatgt

SEQ ID NO: 2844901 - DNA, 22 bp, Homo sapiens
gaaagcaccgcagcatgtgggg

SEQ ID NO: 2844902 - DNA, 18 bp, Homo sapiens
gaaagcatcacctcaggc

SEQ ID NO: 2844903 - DNA, 14 bp, Homo sapiens
gaaagccatttgtt

SEQ ID NO: 2844904 - DNA, 18 bp, Homo sapiens
gaaagcctcactgatata

SEQ ID NO: 2844905 - DNA, 14 bp, Homo sapiens
gaaagcctctggaa

SEQ ID NO: 2844906 - DNA, 14 bp, Homo sapiens
gaaaggctcagtct

SEQ ID NO: 2844907 - DNA, 15 bp, Homo sapiens
gaaaggctctgaaag

SEQ ID NO: 2844908 - DNA, 17 bp, Homo sapiens
gaaaggctctgaaagcc

SEQ ID NO: 2844909 - DNA, 16 bp, Homo sapiens
gaaagggagggctctg

SEQ ID NO: 2844910 - DNA, 18 bp, Homo sapiens
gaaagggagggctctgag

SEQ ID NO: 2844911 - DNA, 19 bp, Homo sapiens
gaaagggagggctctgagg

SEQ ID NO: 2844912 - DNA, 23 bp, Homo sapiens
gaaagggtcaacggccctgttta

SEQ ID NO: 2844913 - DNA, 20 bp, Homo sapiens
gaaagggtctgataaacaca

SEQ ID NO: 2844914 - DNA, 17 bp, Homo sapiens
gaaagtgaataaacttc

SEQ ID NO: 2844915 - DNA, 21 bp, Homo sapiens
gaaagtgatatcccccagcct

SEQ ID NO: 2844916 - DNA, 20 bp, Homo sapiens
gaaagttattgtgttgcctt

SEQ ID NO: 2844917 - DNA, 22 bp, Homo sapiens
gaaagttattgtgttgccttag

SEQ ID NO: 2844918 - DNA, 23 bp, Homo sapiens
gaaagtttcttggtctcagcttc

SEQ ID NO: 2844919 - DNA, 16 bp, Homo sapiens
gaaataaaacctttca

SEQ ID NO: 2844920 - DNA, 15 bp, Homo sapiens
gaaataaaagcctct

SEQ ID NO: 2844921 - DNA, 17 bp, Homo sapiens
gaaataaaagcctctgg

SEQ ID NO: 2844922 - DNA, 18 bp, Homo sapiens
gaaataaagttggtgaca

SEQ ID NO: 2844923 - DNA, 20 bp, Homo sapiens
gaaataaattggtgataagt

SEQ ID NO: 2844924 - DNA, 22 bp, Homo sapiens
gaaataaattggtgataagtgg

SEQ ID NO: 2844925 - DNA, 21 bp, Homo sapiens
gaaatagtgttctttttaaaa

SEQ ID NO: 2844926 - DNA, 17 bp, Homo sapiens
gaagaaagaggtgaccc

SEQ ID NO: 2844927 - DNA, 23 bp, Homo sapiens
gaagaaagggtctgataaacaca

SEQ ID NO: 2844928 - DNA, 15 bp, Homo sapiens
gaagaaattcctgta

SEQ ID NO: 2844929 - DNA, 20 bp, Homo sapiens
gaagaacatccaaggagaaa

SEQ ID NO: 2844930 - DNA, 19 bp, Homo sapiens
gaagaatattcaggactta

SEQ ID NO: 2844931 - DNA, 17 bp, Homo sapiens
gaagaattttcagaccc

SEQ ID NO: 2844932 - DNA, 20 bp, Homo sapiens
gaagaattttcagaccccag

SEQ ID NO: 2844933 - DNA, 21 bp, Homo sapiens
gaagacacagactgcgatttg

SEQ ID NO: 2844934 - DNA, 17 bp, Homo sapiens
gaagaccgaattttatt

SEQ ID NO: 2844935 - DNA, 23 bp, Homo sapiens
gaagactatcttactatttcaca

SEQ ID NO: 2844936 - DNA, 17 bp, Homo sapiens
gaagactcattcttctg

SEQ ID NO: 2844937 - DNA, 19 bp, Homo sapiens
gaagactcattcttctgta

SEQ ID NO: 2844938 - DNA, 12 bp, Homo sapiens
gaagagaaattt

SEQ ID NO: 2844939 - DNA, 18 bp, Homo sapiens
gaagagacaggagggcaa

SEQ ID NO: 2844940 - DNA, 15 bp, Homo sapiens
gaagagagagaccct

SEQ ID NO: 2844941 - DNA, 19 bp, Homo sapiens
gaagagagatatatctgaa

SEQ ID NO: 2844942 - DNA, 23 bp, Homo sapiens
gaagagagatatatctgaaaact

SEQ ID NO: 2844943 - DNA, 18 bp, Homo sapiens
gaagagatgggcttgttt

SEQ ID NO: 2844944 - DNA, 20 bp, Homo sapiens
gaagagggcctgtgggagcc

SEQ ID NO: 2844945 - DNA, 16 bp, Homo sapiens
gaagaggggaggggcc

SEQ ID NO: 2844946 - DNA, 18 bp, Homo sapiens
gaagatcgttagtatcta

SEQ ID NO: 2844947 - DNA, 17 bp, Homo sapiens
gaagatgaaagaggagg

SEQ ID NO: 2844948 - DNA, 16 bp, Homo sapiens
gaagcaaagcaccagc

SEQ ID NO: 2844949 - DNA, 21 bp, Homo sapiens
gaagcaagacgtcctggaatg

SEQ ID NO: 2844950 - DNA, 16 bp, Homo sapiens
gaagcaagcttaatgg

SEQ ID NO: 2844951 - DNA, 14 bp, Homo sapiens
gaagcacatgttta

SEQ ID NO: 2844952 - DNA, 19 bp, Homo sapiens
gaagcaggttgaggggctc

SEQ ID NO: 2844953 - DNA, 15 bp, Homo sapiens
gaagcagtgagccgc

SEQ ID NO: 2844954 - DNA, 16 bp, Homo sapiens
gaagcagtgagccgca

SEQ ID NO: 2844955 - DNA, 16 bp, Homo sapiens
gaagcatgtaggagaa

SEQ ID NO: 2844956 - DNA, 13 bp, Homo sapiens
gaagccaggagca

SEQ ID NO: 2844957 - DNA, 14 bp, Homo sapiens
gaagcccaataaac

SEQ ID NO: 2844958 - DNA, 16 bp, Homo sapiens
gaagcccatggagcag

SEQ ID NO: 2844959 - DNA, 11 bp, Homo sapiens
gaagccctgga

SEQ ID NO: 2844960 - DNA, 12 bp, Homo sapiens
gaagcctgaggc

SEQ ID NO: 2844961 - DNA, 13 bp, Homo sapiens
gaagcctgaggct

SEQ ID NO: 2844962 - DNA, 13 bp, Homo sapiens
gaagcctgggggc

SEQ ID NO: 2844963 - DNA, 17 bp, Homo sapiens
gaagcctgggggcctgg

SEQ ID NO: 2844964 - DNA, 15 bp, Homo sapiens
gaagctaacagggaa

SEQ ID NO: 2844965 - DNA, 17 bp, Homo sapiens
gaagctaacagggaagg

SEQ ID NO: 2844966 - DNA, 18 bp, Homo sapiens
gaagctaacagggaaggc

SEQ ID NO: 2844967 - DNA, 22 bp, Homo sapiens
gaagctaacagggaaggcaggc

SEQ ID NO: 2844968 - DNA, 18 bp, Homo sapiens
gaagctattgatgtttcc

SEQ ID NO: 2844969 - DNA, 15 bp, Homo sapiens
gaagctctgaagtca

SEQ ID NO: 2844970 - DNA, 18 bp, Homo sapiens
gaagctggaagcactgct

SEQ ID NO: 2844971 - DNA, 17 bp, Homo sapiens
gaagctggcagcactca

SEQ ID NO: 2844972 - DNA, 19 bp, Homo sapiens
gaagctgggggaagggtgg

SEQ ID NO: 2844973 - DNA, 22 bp, Homo sapiens
gaagctgtacccaatttaattc

SEQ ID NO: 2844974 - DNA, 17 bp, Homo sapiens
gaagctgtgtccttgca

SEQ ID NO: 2844975 - DNA, 22 bp, Homo sapiens
gaagctgtgtccttgcacctgc

SEQ ID NO: 2844976 - DNA, 20 bp, Homo sapiens
gaaggaaaaggcagggagcg

SEQ ID NO: 2844977 - DNA, 23 bp, Homo sapiens
gaaggaaggagactcacctctgc

SEQ ID NO: 2844978 - DNA, 16 bp, Homo sapiens
gaaggaagtgaagagg

SEQ ID NO: 2844979 - DNA, 16 bp, Homo sapiens
gaaggaatctgtgcag

SEQ ID NO: 2844980 - DNA, 19 bp, Homo sapiens
gaaggacattgcggacagc

SEQ ID NO: 2844981 - DNA, 21 bp, Homo sapiens
gaaggacattttctctttaaa

SEQ ID NO: 2844982 - DNA, 21 bp, Homo sapiens
gaaggactatgaaaagctaga

SEQ ID NO: 2844983 - DNA, 15 bp, Homo sapiens
gaaggagactcacct

SEQ ID NO: 2844984 - DNA, 19 bp, Homo sapiens
gaaggagggttagggaggg

SEQ ID NO: 2844985 - DNA, 15 bp, Homo sapiens
gaaggaggtgaggga

SEQ ID NO: 2844986 - DNA, 17 bp, Homo sapiens
gaaggaggtgagggatg

SEQ ID NO: 2844987 - DNA, 12 bp, Homo sapiens
gaaggcaaaaaa

SEQ ID NO: 2844988 - DNA, 17 bp, Homo sapiens
gaaggcaggcagggctc

SEQ ID NO: 2844989 - DNA, 22 bp, Homo sapiens
gaaggcaggcagggctctcctg

SEQ ID NO: 2844990 - DNA, 13 bp, Homo sapiens
gaaggccacatgt

SEQ ID NO: 2844991 - DNA, 22 bp, Homo sapiens
gaaggctacttcggggctggga

SEQ ID NO: 2844992 - DNA, 13 bp, Homo sapiens
gaaggctgctgtg

SEQ ID NO: 2844993 - DNA, 16 bp, Homo sapiens
gaaggctggctgggca

SEQ ID NO: 2844994 - DNA, 11 bp, Homo sapiens
gaagggaaatt

SEQ ID NO: 2844995 - DNA, 22 bp, Homo sapiens
gaagggaataaggtacaagaag

SEQ ID NO: 2844996 - DNA, 12 bp, Homo sapiens
gaagggagaagg

SEQ ID NO: 2844997 - DNA, 18 bp, Homo sapiens
gaagggccagtctgggct

SEQ ID NO: 2844998 - DNA, 20 bp, Homo sapiens
gaagggccagtctgggctgc

SEQ ID NO: 2844999 - DNA, 14 bp, Homo sapiens
gaagggggcggcct

SEQ ID NO: 2845000 - DNA, 19 bp, Homo sapiens
gaagggtggtctgagcacc

SEQ ID NO: 2845001 - DNA, 20 bp, Homo sapiens
gaagggttttccaccctgga

SEQ ID NO: 2845002 - DNA, 23 bp, Homo sapiens
gaaggtcactcttcctgcaagga

SEQ ID NO: 2845003 - DNA, 19 bp, Homo sapiens
gaagtaaaagcaaaaaaga

SEQ ID NO: 2845004 - DNA, 23 bp, Homo sapiens
gaagtaggaagtgaaaataggta

SEQ ID NO: 2845005 - DNA, 15 bp, Homo sapiens
gaagtccaggcagag

SEQ ID NO: 2845006 - DNA, 16 bp, Homo sapiens
gaagtctaggagctgg

SEQ ID NO: 2845007 - DNA, 20 bp, Homo sapiens
gaagtctaggagctgggagg

SEQ ID NO: 2845008 - DNA, 22 bp, Homo sapiens
gaagtctaggagctgggaggaa

SEQ ID NO: 2845009 - DNA, 16 bp, Homo sapiens
gaagtggaccaggaca

SEQ ID NO: 2845010 - DNA, 19 bp, Homo sapiens
gaagtgggccaggacaggc

SEQ ID NO: 2845011 - DNA, 21 bp, Homo sapiens
gaagttaagcagcctttctgt

SEQ ID NO: 2845012 - DNA, 17 bp, Homo sapiens
gaagttgcagtgagctg

SEQ ID NO: 2845013 - DNA, 23 bp, Homo sapiens
gaagttttcaggacttggtctga

SEQ ID NO: 2845014 - DNA, 12 bp, Homo sapiens
gaagttttgcat

SEQ ID NO: 2845015 - DNA, 16 bp, Homo sapiens
gaataaaaaacatttg

SEQ ID NO: 2845016 - DNA, 14 bp, Homo sapiens
ctggcgtgcagtgg

SEQ ID NO: 2845017 - DNA, 17 bp, Homo sapiens
ctggctaactggaagca

SEQ ID NO: 2845018 - DNA, 18 bp, Homo sapiens
ctggctctcctgtagctc

SEQ ID NO: 2845019 - DNA, 12 bp, Homo sapiens
ctggctgaaaat

SEQ ID NO: 2845020 - DNA, 14 bp, Homo sapiens
ctggctgaaaatca

SEQ ID NO: 2845021 - DNA, 16 bp, Homo sapiens
ctggctgaaaatcact

SEQ ID NO: 2845022 - DNA, 17 bp, Homo sapiens
ctggctgaaaatcacta

SEQ ID NO: 2845023 - DNA, 23 bp, Homo sapiens
ctggctgaccccaaagagcctgg

SEQ ID NO: 2845024 - DNA, 13 bp, Homo sapiens
ctggctgagctga

SEQ ID NO: 2845025 - DNA, 21 bp, Homo sapiens
ctggctgaggatttcaagcct

SEQ ID NO: 2845026 - DNA, 12 bp, Homo sapiens
ctggctgagggc

SEQ ID NO: 2845027 - DNA, 15 bp, Homo sapiens
ctggctgagggcagt

SEQ ID NO: 2845028 - DNA, 14 bp, Homo sapiens
ctggctggctgagg

SEQ ID NO: 2845029 - DNA, 17 bp, Homo sapiens
ctggctggctgcagtga

SEQ ID NO: 2845030 - DNA, 19 bp, Homo sapiens
ctggctgttggctgggggc

SEQ ID NO: 2845031 - DNA, 14 bp, Homo sapiens
ctggcttccaggta

SEQ ID NO: 2845032 - DNA, 22 bp, Homo sapiens
ctggcttccaggtatctccagg

SEQ ID NO: 2845033 - DNA, 15 bp, Homo sapiens
ctggcttctggagcc

SEQ ID NO: 2845034 - DNA, 19 bp, Homo sapiens
ctggcttgtaactccacca

SEQ ID NO: 2845035 - DNA, 15 bp, Homo sapiens
ctggctttctccgac

SEQ ID NO: 2845036 - DNA, 18 bp, Homo sapiens
ctgggaaccatgaagctg

SEQ ID NO: 2845037 - DNA, 23 bp, Homo sapiens
ctgggaagtcgtccttactcctg

SEQ ID NO: 2845038 - DNA, 16 bp, Homo sapiens
ctgggaccagggcata

SEQ ID NO: 2845039 - DNA, 15 bp, Homo sapiens
ctgggaccctttcct

SEQ ID NO: 2845040 - DNA, 23 bp, Homo sapiens
ctgggaccctttccttccttccc

SEQ ID NO: 2845041 - DNA, 23 bp, Homo sapiens
ctgggaccgctacaccactctgg

SEQ ID NO: 2845042 - DNA, 24 bp, Homo sapiens
ctgggaccgctacaccactctggc

SEQ ID NO: 2845043 - DNA, 16 bp, Homo sapiens
ctgggactacaggcac

SEQ ID NO: 2845044 - DNA, 17 bp, Homo sapiens
ctgggactacaggtgtg

SEQ ID NO: 2845045 - DNA, 13 bp, Homo sapiens
ctgggactggcca

SEQ ID NO: 2845046 - DNA, 12 bp, Homo sapiens
ctgggagaacct

SEQ ID NO: 2845047 - DNA, 16 bp, Homo sapiens
ctgggagaacctcagg

SEQ ID NO: 2845048 - DNA, 16 bp, Homo sapiens
ctgggagagaaggaga

SEQ ID NO: 2845049 - DNA, 23 bp, Homo sapiens
ctgggagagaaggagatcagggc

SEQ ID NO: 2845050 - DNA, 15 bp, Homo sapiens
ctgggagctctgcag

SEQ ID NO: 2845051 - DNA, 22 bp, Homo sapiens
ctgggaggcggagagtacagtg

SEQ ID NO: 2845052 - DNA, 16 bp, Homo sapiens
ctgggaggctggtctc

SEQ ID NO: 2845053 - DNA, 19 bp, Homo sapiens
ctgggatgtttctgtcaca

SEQ ID NO: 2845054 - DNA, 22 bp, Homo sapiens
ctgggattcaggaaaaggcctg

SEQ ID NO: 2845055 - DNA, 20 bp, Homo sapiens
ctgggattcccaccaaggtc

SEQ ID NO: 2845056 - DNA, 15 bp, Homo sapiens
ctgggcaacagagca

SEQ ID NO: 2845057 - DNA, 17 bp, Homo sapiens
ctgggcaccacaggctg

SEQ ID NO: 2845058 - DNA, 13 bp, Homo sapiens
ctgggcagacctt

SEQ ID NO: 2845059 - DNA, 22 bp, Homo sapiens
ctgggcagcttgagagggcaaa

SEQ ID NO: 2845060 - DNA, 15 bp, Homo sapiens
ctgggccaagttcct

SEQ ID NO: 2845061 - DNA, 21 bp, Homo sapiens
ctgggccaagttcctctagtg

SEQ ID NO: 2845062 - DNA, 13 bp, Homo sapiens
ctgggccccacca

SEQ ID NO: 2845063 - DNA, 14 bp, Homo sapiens
ctgggccccaccac

SEQ ID NO: 2845064 - DNA, 12 bp, Homo sapiens
ctgggccctggg

SEQ ID NO: 2845065 - DNA, 14 bp, Homo sapiens
ctgggccctggggc

SEQ ID NO: 2845066 - DNA, 12 bp, Homo sapiens
ctgggcctatgg

SEQ ID NO: 2845067 - DNA, 18 bp, Homo sapiens
ctgggcctatggagagcc

SEQ ID NO: 2845068 - DNA, 21 bp, Homo sapiens
ctgggcctatggagagccctg

SEQ ID NO: 2845069 - DNA, 23 bp, Homo sapiens
ctgggcctatggagagccctggg

SEQ ID NO: 2845070 - DNA, 13 bp, Homo sapiens
ctgggcctgctgc

SEQ ID NO: 2845071 - DNA, 14 bp, Homo sapiens
ctgggcctgctgct

SEQ ID NO: 2845072 - DNA, 16 bp, Homo sapiens
ctgggcctgctgctga

SEQ ID NO: 2845073 - DNA, 23 bp, Homo sapiens
ctgggcgaatctacagaacaaag

SEQ ID NO: 2845074 - DNA, 14 bp, Homo sapiens
ctgggctaccccac

SEQ ID NO: 2845075 - DNA, 15 bp, Homo sapiens
ctgggctctccacct

SEQ ID NO: 2845076 - DNA, 20 bp, Homo sapiens
ctgggctctccacctcagcc

SEQ ID NO: 2845077 - DNA, 14 bp, Homo sapiens
ctgggctgcagaga

SEQ ID NO: 2845078 - DNA, 16 bp, Homo sapiens
ctgggcttcagcctct

SEQ ID NO: 2845079 - DNA, 15 bp, Homo sapiens
ctgggcttcagtggc

SEQ ID NO: 2845080 - DNA, 24 bp, Homo sapiens
ctgggcttcagtggcagctgcttt

SEQ ID NO: 2845081 - DNA, 12 bp, Homo sapiens
ctggggacaggt

SEQ ID NO: 2845082 - DNA, 14 bp, Homo sapiens
ctggggcaagtccc

SEQ ID NO: 2845083 - DNA, 13 bp, Homo sapiens
ctggggcatccca

SEQ ID NO: 2845084 - DNA, 14 bp, Homo sapiens
ctggggccccttgg

SEQ ID NO: 2845085 - DNA, 18 bp, Homo sapiens
ctggggcctgtactgcct

SEQ ID NO: 2845086 - DNA, 20 bp, Homo sapiens
ctggggcctgtactgcctgc

SEQ ID NO: 2845087 - DNA, 23 bp, Homo sapiens
ctggggcctgtactgcctgcttg

SEQ ID NO: 2845088 - DNA, 19 bp, Homo sapiens
ctggggctcctttctccag

SEQ ID NO: 2845089 - DNA, 19 bp, Homo sapiens
ctggggctctaacgcctga

SEQ ID NO: 2845090 - DNA, 15 bp, Homo sapiens
ctggggctctgggat

SEQ ID NO: 2845091 - DNA, 20 bp, Homo sapiens
ctggggcttctcctgaccca

SEQ ID NO: 2845092 - DNA, 14 bp, Homo sapiens
ctgggggaagccct

SEQ ID NO: 2845093 - DNA, 16 bp, Homo sapiens
ctgggggaagccctgg

SEQ ID NO: 2845094 - DNA, 23 bp, Homo sapiens
ctgggggatgtgcacggcagctt

SEQ ID NO: 2845095 - DNA, 14 bp, Homo sapiens
ctgggggcctggct

SEQ ID NO: 2845096 - DNA, 18 bp, Homo sapiens
ctgggggcgggggagcca

SEQ ID NO: 2845097 - DNA, 19 bp, Homo sapiens
ctggggtcctggggcctcg

SEQ ID NO: 2845098 - DNA, 15 bp, Homo sapiens
ctggggttcagcccc

SEQ ID NO: 2845099 - DNA, 19 bp, Homo sapiens
ctggggttcagcccctcct

SEQ ID NO: 2845100 - DNA, 21 bp, Homo sapiens
ctggggttcagcccctcctct

SEQ ID NO: 2845101 - DNA, 22 bp, Homo sapiens
ctggggttcagcccctcctctg

SEQ ID NO: 2845102 - DNA, 18 bp, Homo sapiens
ctgggtacttgtggacac

SEQ ID NO: 2845103 - DNA, 15 bp, Homo sapiens
cttcttatgtttgct

SEQ ID NO: 2845104 - DNA, 17 bp, Homo sapiens
cttcttattctcactcc

SEQ ID NO: 2845105 - DNA, 20 bp, Homo sapiens
cttcttattctcactccacc

SEQ ID NO: 2845106 - DNA, 15 bp, Homo sapiens
cttcttcacccagct

SEQ ID NO: 2845107 - DNA, 23 bp, Homo sapiens
cttcttcacccagctaatctgta

SEQ ID NO: 2845108 - DNA, 21 bp, Homo sapiens
cttcttcagccacctctcttt

SEQ ID NO: 2845109 - DNA, 21 bp, Homo sapiens
cttcttcggggaactcctgga

SEQ ID NO: 2845110 - DNA, 12 bp, Homo sapiens
cttcttgcccct

SEQ ID NO: 2845111 - DNA, 19 bp, Homo sapiens
cttcttgccccttgggcct

SEQ ID NO: 2845112 - DNA, 12 bp, Homo sapiens
cttctttaaatc

SEQ ID NO: 2845113 - DNA, 13 bp, Homo sapiens
cttctttaaatca

SEQ ID NO: 2845114 - DNA, 11 bp, Homo sapiens
cttctttcctc

SEQ ID NO: 2845115 - DNA, 13 bp, Homo sapiens
cttcttttgctct

SEQ ID NO: 2845116 - DNA, 14 bp, Homo sapiens
cttcttttgctctt

SEQ ID NO: 2845117 - DNA, 15 bp, Homo sapiens
cttctttttattttc

SEQ ID NO: 2845118 - DNA, 23 bp, Homo sapiens
cttctttttattttcttttgtaa

SEQ ID NO: 2845119 - DNA, 23 bp, Homo sapiens
cttcttttttgtctcaagattat

SEQ ID NO: 2845120 - DNA, 15 bp, Homo sapiens
cttgaacccaggaga

SEQ ID NO: 2845121 - DNA, 17 bp, Homo sapiens
cttgaactcctggcctc

SEQ ID NO: 2845122 - DNA, 16 bp, Homo sapiens
cttgaactgggtactt

SEQ ID NO: 2845123 - DNA, 12 bp, Homo sapiens
cttgaagaatat

SEQ ID NO: 2845124 - DNA, 14 bp, Homo sapiens
cttgaagaatattg

SEQ ID NO: 2845125 - DNA, 15 bp, Homo sapiens
cttgaagaatattgt

SEQ ID NO: 2845126 - DNA, 23 bp, Homo sapiens
cttgaagaggggaggggcctagg

SEQ ID NO: 2845127 - DNA, 13 bp, Homo sapiens
cttgaagccactg

SEQ ID NO: 2845128 - DNA, 17 bp, Homo sapiens
cttgaagccactgaagc

SEQ ID NO: 2845129 - DNA, 19 bp, Homo sapiens
cttgaagccactgaagctg

SEQ ID NO: 2845130 - DNA, 16 bp, Homo sapiens
cttgaaggaacagtgc

SEQ ID NO: 2845131 - DNA, 14 bp, Homo sapiens
cttgacagaacact

SEQ ID NO: 2845132 - DNA, 13 bp, Homo sapiens
cttgacagggcac

SEQ ID NO: 2845133 - DNA, 20 bp, Homo sapiens
cttgacagtggaactacatt

SEQ ID NO: 2845134 - DNA, 13 bp, Homo sapiens
cttgacccatctc

SEQ ID NO: 2845135 - DNA, 16 bp, Homo sapiens
cttgacccatctcccc

SEQ ID NO: 2845136 - DNA, 13 bp, Homo sapiens
cttgacctcaggt

SEQ ID NO: 2845137 - DNA, 12 bp, Homo sapiens
cttgacctccta

SEQ ID NO: 2845138 - DNA, 17 bp, Homo sapiens
cttgactatcacataca

SEQ ID NO: 2845139 - DNA, 20 bp, Homo sapiens
cttgactatcacatacaatt

SEQ ID NO: 2845140 - DNA, 18 bp, Homo sapiens
cttgagacctcagccatg

SEQ ID NO: 2845141 - DNA, 12 bp, Homo sapiens
cttgagcccagg

SEQ ID NO: 2845142 - DNA, 13 bp, Homo sapiens
cttgagcccagga

SEQ ID NO: 2845143 - DNA, 15 bp, Homo sapiens
cttgagcccaggagt

SEQ ID NO: 2845144 - DNA, 21 bp, Homo sapiens
cttgagcctgtcacgtggtca

SEQ ID NO: 2845145 - DNA, 20 bp, Homo sapiens
cttgagcttggcagctgaac

SEQ ID NO: 2845146 - DNA, 21 bp, Homo sapiens
cttgagcttggcagctgaact

SEQ ID NO: 2845147 - DNA, 20 bp, Homo sapiens
cttgagggttgggctggtgt

SEQ ID NO: 2845148 - DNA, 21 bp, Homo sapiens
cttgagggttgggctggtgtc

SEQ ID NO: 2845149 - DNA, 23 bp, Homo sapiens
cttgatgttgcttagtcacttat

SEQ ID NO: 2845150 - DNA, 21 bp, Homo sapiens
cttgattttagccttctctgt

SEQ ID NO: 2845151 - DNA, 13 bp, Homo sapiens
cttgcacctgcat

SEQ ID NO: 2845152 - DNA, 18 bp, Homo sapiens
cttgcagactctacagag

SEQ ID NO: 2845153 - DNA, 23 bp, Homo sapiens
cttgcaggaaggactatgaaaag

SEQ ID NO: 2845154 - DNA, 15 bp, Homo sapiens
cttgcagtcatcaga

SEQ ID NO: 2845155 - DNA, 13 bp, Homo sapiens
cttgcattagaaa

SEQ ID NO: 2845156 - DNA, 12 bp, Homo sapiens
cttgcattccca

SEQ ID NO: 2845157 - DNA, 16 bp, Homo sapiens
cttgcattcccagtgg

SEQ ID NO: 2845158 - DNA, 18 bp, Homo sapiens
cttgcattgaatatatta

SEQ ID NO: 2845159 - DNA, 20 bp, Homo sapiens
cttgccaagctttcttctac

SEQ ID NO: 2845160 - DNA, 22 bp, Homo sapiens
cttgccagccagaagcctctgc

SEQ ID NO: 2845161 - DNA, 13 bp, Homo sapiens
cttgcccagagat

SEQ ID NO: 2845162 - DNA, 21 bp, Homo sapiens
cttgcccagagatgcctccac

SEQ ID NO: 2845163 - DNA, 14 bp, Homo sapiens
cttgcccagggctc

SEQ ID NO: 2845164 - DNA, 15 bp, Homo sapiens
cttgcccagggctca

SEQ ID NO: 2845165 - DNA, 16 bp, Homo sapiens
cttgcccagggctcag

SEQ ID NO: 2845166 - DNA, 20 bp, Homo sapiens
cttgcccagggctcagcctg

SEQ ID NO: 2845167 - DNA, 23 bp, Homo sapiens
cttgcccagggctcagcctggtg

SEQ ID NO: 2845168 - DNA, 18 bp, Homo sapiens
cttgccccttgggcctcc

SEQ ID NO: 2845169 - DNA, 19 bp, Homo sapiens
cttgccccttgggcctccc

SEQ ID NO: 2845170 - DNA, 18 bp, Homo sapiens
cttgcccggattctggga

SEQ ID NO: 2845171 - DNA, 14 bp, Homo sapiens
cttgccctgacctc

SEQ ID NO: 2845172 - DNA, 13 bp, Homo sapiens
cttgcctcatttt

SEQ ID NO: 2845173 - DNA, 20 bp, Homo sapiens
cttgcctgcacccttcctcc

SEQ ID NO: 2845174 - DNA, 21 bp, Homo sapiens
cttgcctgcacccttcctcct

SEQ ID NO: 2845175 - DNA, 23 bp, Homo sapiens
cttgcctgcacccttcctcctcc

SEQ ID NO: 2845176 - DNA, 16 bp, Homo sapiens
cttgcctgccagggcc

SEQ ID NO: 2845177 - DNA, 19 bp, Homo sapiens
cttgccttcttcacccagc

SEQ ID NO: 2845178 - DNA, 14 bp, Homo sapiens
cttgcctttccacc

SEQ ID NO: 2845179 - DNA, 17 bp, Homo sapiens
cttgcctttcttatttg

SEQ ID NO: 2845180 - DNA, 14 bp, Homo sapiens
cttgcgaccatgtg

SEQ ID NO: 2845181 - DNA, 15 bp, Homo sapiens
cttgctattggaatg

SEQ ID NO: 2845182 - DNA, 22 bp, Homo sapiens
cttgctcaccaagctgttccac

SEQ ID NO: 2845183 - DNA, 20 bp, Homo sapiens
cttgctcgctgtaaaatctt

SEQ ID NO: 2845184 - DNA, 19 bp, Homo sapiens
cttgctctcccctgccctg

SEQ ID NO: 2845185 - DNA, 13 bp, Homo sapiens
cttgctctgctga

SEQ ID NO: 2845186 - DNA, 17 bp, Homo sapiens
cttgctctgctgacaga

SEQ ID NO: 2845187 - DNA, 13 bp, Homo sapiens
cttgctggaagac

SEQ ID NO: 2845188 - DNA, 21 bp, Homo sapiens
cttggaaactggatgaggtca

SEQ ID NO: 2845189 - DNA, 20 bp, Homo sapiens
cttggaaagcatcacctcag

SEQ ID NO: 2845190 - DNA, 14 bp, Homo sapiens
cttggaagctccgc

SEQ ID NO: 2845191 - DNA, 20 bp, Homo sapiens
cttggaagctccgctttcta

SEQ ID NO: 2845192 - DNA, 17 bp, Homo sapiens
cttaccttcaataaagt

SEQ ID NO: 2845193 - DNA, 21 bp, Homo sapiens
cttactaaacattttgttatt

SEQ ID NO: 2845194 - DNA, 14 bp, Homo sapiens
cttactagccctgc

SEQ ID NO: 2845195 - DNA, 18 bp, Homo sapiens
cttactatgatctcagga

SEQ ID NO: 2845196 - DNA, 14 bp, Homo sapiens
cttactccaggaga

SEQ ID NO: 2845197 - DNA, 15 bp, Homo sapiens
cttactcctgtggga

SEQ ID NO: 2845198 - DNA, 13 bp, Homo sapiens
cttactgcagaat

SEQ ID NO: 2845199 - DNA, 19 bp, Homo sapiens
cttacttggaactgaaggg

SEQ ID NO: 2845200 - DNA, 17 bp, Homo sapiens
cttagaagtggaccagg

SEQ ID NO: 2845201 - DNA, 18 bp, Homo sapiens
cttagaagtggaccagga

SEQ ID NO: 2845202 - DNA, 22 bp, Homo sapiens
cttagaagtggaccaggacagg

SEQ ID NO: 2845203 - DNA, 13 bp, Homo sapiens
cttagacctcagc

SEQ ID NO: 2845204 - DNA, 15 bp, Homo sapiens
cttagacctcagcct

SEQ ID NO: 2845205 - DNA, 17 bp, Homo sapiens
cttagactagttgaaca

SEQ ID NO: 2845206 - DNA, 19 bp, Homo sapiens
cttagacttcgactcagga

SEQ ID NO: 2845207 - DNA, 20 bp, Homo sapiens
cttagacttcgactcaggat

SEQ ID NO: 2845208 - DNA, 19 bp, Homo sapiens
cttagctgaacaatgaatg

SEQ ID NO: 2845209 - DNA, 20 bp, Homo sapiens
cttagctgaacaatgaatgc

SEQ ID NO: 2845210 - DNA, 19 bp, Homo sapiens
cttagcttagacctcagcc

SEQ ID NO: 2845211 - DNA, 21 bp, Homo sapiens
cttagcttagacctcagcctg

SEQ ID NO: 2845212 - DNA, 23 bp, Homo sapiens
cttagcttctattatagccacat

SEQ ID NO: 2845213 - DNA, 16 bp, Homo sapiens
cttagctttccacagg

SEQ ID NO: 2845214 - DNA, 17 bp, Homo sapiens
cttaggaagagaaacca

SEQ ID NO: 2845215 - DNA, 13 bp, Homo sapiens
cttagtatctcat

SEQ ID NO: 2845216 - DNA, 17 bp, Homo sapiens
cttagtatctcatcaac

SEQ ID NO: 2845217 - DNA, 22 bp, Homo sapiens
cttagtatctcatcaacaaaga

SEQ ID NO: 2845218 - DNA, 17 bp, Homo sapiens
cttagttaagtcatcca

SEQ ID NO: 2845219 - DNA, 16 bp, Homo sapiens
cttatacgagtaatat

SEQ ID NO: 2845220 - DNA, 18 bp, Homo sapiens
cttatatagtattcattt

SEQ ID NO: 2845221 - DNA, 20 bp, Homo sapiens
cttatcatgctgtctttaca

SEQ ID NO: 2845222 - DNA, 15 bp, Homo sapiens
cttatccaggactct

SEQ ID NO: 2845223 - DNA, 19 bp, Homo sapiens
cttatccaggactctgtca

SEQ ID NO: 2845224 - DNA, 12 bp, Homo sapiens
cttatgaaatgg

SEQ ID NO: 2845225 - DNA, 17 bp, Homo sapiens
cttattagaacaggcaa

SEQ ID NO: 2845226 - DNA, 13 bp, Homo sapiens
cttattgcccacg

SEQ ID NO: 2845227 - DNA, 15 bp, Homo sapiens
cttattgtacctctc

SEQ ID NO: 2845228 - DNA, 15 bp, Homo sapiens
cttattgtccccact

SEQ ID NO: 2845229 - DNA, 19 bp, Homo sapiens
cttatttaatttttgcaat

SEQ ID NO: 2845230 - DNA, 14 bp, Homo sapiens
cttatttgtataat

SEQ ID NO: 2845231 - DNA, 14 bp, Homo sapiens
cttattttcaagaa

SEQ ID NO: 2845232 - DNA, 16 bp, Homo sapiens
cttattttcatgtata

SEQ ID NO: 2845233 - DNA, 12 bp, Homo sapiens
cttattttccaa

SEQ ID NO: 2845234 - DNA, 15 bp, Homo sapiens
cttattttgtaataa

SEQ ID NO: 2845235 - DNA, 16 bp, Homo sapiens
cttattttgtaataaa

SEQ ID NO: 2845236 - DNA, 17 bp, Homo sapiens
cttattttgtaataaac

SEQ ID NO: 2845237 - DNA, 20 bp, Homo sapiens
cttattttgtaataaactct

SEQ ID NO: 2845238 - DNA, 14 bp, Homo sapiens
cttcaaatccatcc

SEQ ID NO: 2845239 - DNA, 17 bp, Homo sapiens
cttcaaatccatccaga

SEQ ID NO: 2845240 - DNA, 14 bp, Homo sapiens
cttcaaccctcagc

SEQ ID NO: 2845241 - DNA, 20 bp, Homo sapiens
cttcaactgaccagcctcca

SEQ ID NO: 2845242 - DNA, 19 bp, Homo sapiens
cttcaagcaccctgttccc

SEQ ID NO: 2845243 - DNA, 20 bp, Homo sapiens
cttcaagcaccctgttccct

SEQ ID NO: 2845244 - DNA, 16 bp, Homo sapiens
cttcaagtgatatatg

SEQ ID NO: 2845245 - DNA, 22 bp, Homo sapiens
cttcaagtgatatatgtattta

SEQ ID NO: 2845246 - DNA, 13 bp, Homo sapiens
cttcacaaaatgc

SEQ ID NO: 2845247 - DNA, 16 bp, Homo sapiens
cttcacaaccagccac

SEQ ID NO: 2845248 - DNA, 18 bp, Homo sapiens
cttcacaaccagccacac

SEQ ID NO: 2845249 - DNA, 21 bp, Homo sapiens
cttcacaaccagccacacaga

SEQ ID NO: 2845250 - DNA, 17 bp, Homo sapiens
cttcacacacaggcaac

SEQ ID NO: 2845251 - DNA, 13 bp, Homo sapiens
cttcacagtgttt

SEQ ID NO: 2845252 - DNA, 14 bp, Homo sapiens
cttcacagtgtttc

SEQ ID NO: 2845253 - DNA, 22 bp, Homo sapiens
cttcacccagctaatctgtagg

SEQ ID NO: 2845254 - DNA, 24 bp, Homo sapiens
cttcactccggtgtgcctgcagcc

SEQ ID NO: 2845255 - DNA, 15 bp, Homo sapiens
cttcactttaattct

SEQ ID NO: 2845256 - DNA, 21 bp, Homo sapiens
cttcagaatatggacaaagaa

SEQ ID NO: 2845257 - DNA, 13 bp, Homo sapiens
cttcagagaagtc

SEQ ID NO: 2845258 - DNA, 17 bp, Homo sapiens
cttcagatcagtgcttg

SEQ ID NO: 2845259 - DNA, 23 bp, Homo sapiens
cttcagcataattcggaagggaa

SEQ ID NO: 2845260 - DNA, 15 bp, Homo sapiens
cttcagcctgaggct

SEQ ID NO: 2845261 - DNA, 11 bp, Homo sapiens
cttcagggctg

SEQ ID NO: 2845262 - DNA, 15 bp, Homo sapiens
cttcaggttcttagt

SEQ ID NO: 2845263 - DNA, 16 bp, Homo sapiens
cttcagtcctggtctg

SEQ ID NO: 2845264 - DNA, 13 bp, Homo sapiens
cttcagtgcccac

SEQ ID NO: 2845265 - DNA, 13 bp, Homo sapiens
cttcagtgggaga

SEQ ID NO: 2845266 - DNA, 15 bp, Homo sapiens
cttcagtgggagaaa

SEQ ID NO: 2845267 - DNA, 15 bp, Homo sapiens
cttcataacaatttt

SEQ ID NO: 2845268 - DNA, 18 bp, Homo sapiens
cttcatagcagattttaa

SEQ ID NO: 2845269 - DNA, 13 bp, Homo sapiens
cttcatcaatttt

SEQ ID NO: 2845270 - DNA, 16 bp, Homo sapiens
cttcatcaatttttat

SEQ ID NO: 2845271 - DNA, 12 bp, Homo sapiens
cttcatgcaatg

SEQ ID NO: 2845272 - DNA, 13 bp, Homo sapiens
cttcatggaccaa

SEQ ID NO: 2845273 - DNA, 20 bp, Homo sapiens
cttcattcttgaaagctgtg

SEQ ID NO: 2845274 - DNA, 16 bp, Homo sapiens
cttcattgaccaagat

SEQ ID NO: 2845275 - DNA, 14 bp, Homo sapiens
cttcatttcctccg

SEQ ID NO: 2845276 - DNA, 24 bp, Homo sapiens
cttcatttgggatgctactctagt

SEQ ID NO: 2845277 - DNA, 16 bp, Homo sapiens
cttccaagcaaaggtg

SEQ ID NO: 2845278 - DNA, 18 bp, Homo sapiens
cttccagagagtcctctg

SEQ ID NO: 2845279 - DNA, 21 bp, Homo sapiens
cttccagagagtcctctggat

SEQ ID NO: 2845280 - DNA, 21 bp, Homo sapiens
cttccaggagcaatttgcaca

SEQ ID NO: 2845281 - DNA, 23 bp, Homo sapiens
cttccaggagcaatttgcacatg

SEQ ID NO: 2845282 - DNA, 16 bp, Homo sapiens
cttccaggcccccacc

SEQ ID NO: 2845283 - DNA, 18 bp, Homo sapiens
cttccaggtatctccagg

SEQ ID NO: 2845284 - DNA, 19 bp, Homo sapiens
cttccaggtatctccagga

SEQ ID NO: 2845285 - DNA, 14 bp, Homo sapiens
cttccagtggtacc

SEQ ID NO: 2845286 - DNA, 18 bp, Homo sapiens
cttccagtggtaccagct

SEQ ID NO: 2845287 - DNA, 23 bp, Homo sapiens
cttccagtggtaccagctcactc

SEQ ID NO: 2845288 - DNA, 23 bp, Homo sapiens
cttccataatgtataaagaacaa

SEQ ID NO: 2845289 - DNA, 21 bp, Homo sapiens
cttccatgagaacagcagggt

SEQ ID NO: 2845290 - DNA, 15 bp, Homo sapiens
cttcccactggaggt

SEQ ID NO: 2845291 - DNA, 20 bp, Homo sapiens
cttcccagctctccctctgg

SEQ ID NO: 2845292 - DNA, 22 bp, Homo sapiens
cttcccagctctccctctggcc

SEQ ID NO: 2845293 - DNA, 23 bp, Homo sapiens
cttcccagttcaggagtcccaag

SEQ ID NO: 2845294 - DNA, 17 bp, Homo sapiens
cttcccatcactggagc

SEQ ID NO: 2845295 - DNA, 17 bp, Homo sapiens
cttcccatccccagcga

SEQ ID NO: 2845296 - DNA, 22 bp, Homo sapiens
cttcccatgatgccgctcttct

SEQ ID NO: 2845297 - DNA, 17 bp, Homo sapiens
cttcccatgtctttctc

SEQ ID NO: 2845298 - DNA, 15 bp, Homo sapiens
cttccccacagaact

SEQ ID NO: 2845299 - DNA, 17 bp, Homo sapiens
cttccccagactcagct

SEQ ID NO: 2845300 - DNA, 19 bp, Homo sapiens
cttccccagactcagctcc

SEQ ID NO: 2845301 - DNA, 20 bp, Homo sapiens
cttccccagactcagctcca

SEQ ID NO: 2845302 - DNA, 22 bp, Homo sapiens
cttccccagacttctctttctt

SEQ ID NO: 2845303 - DNA, 20 bp, Homo sapiens
cttcccctcgctgtcctgct

SEQ ID NO: 2845304 - DNA, 12 bp, Homo sapiens
cttccccttgcc

SEQ ID NO: 2845305 - DNA, 23 bp, Homo sapiens
cttccccttgcccagggctcagc

SEQ ID NO: 2845306 - DNA, 23 bp, Homo sapiens
cttccccttgcccttgccctgac

SEQ ID NO: 2845307 - DNA, 14 bp, Homo sapiens
cttcccctttcctg

SEQ ID NO: 2845308 - DNA, 19 bp, Homo sapiens
cttcccctttcctggggga

SEQ ID NO: 2845309 - DNA, 17 bp, Homo sapiens
cttccctgctttgagga

SEQ ID NO: 2845310 - DNA, 19 bp, Homo sapiens
cttccgatgacagtgctct

SEQ ID NO: 2845311 - DNA, 15 bp, Homo sapiens
cttcctagttttctc

SEQ ID NO: 2845312 - DNA, 22 bp, Homo sapiens
cttcctagttttctcctcccag

SEQ ID NO: 2845313 - DNA, 20 bp, Homo sapiens
cttcctcactatgacactga

SEQ ID NO: 2845314 - DNA, 11 bp, Homo sapiens
cttcctctgct

SEQ ID NO: 2845315 - DNA, 19 bp, Homo sapiens
cttcctgaccctccgctgc

SEQ ID NO: 2845316 - DNA, 14 bp, Homo sapiens
cttcctgcacccgt

SEQ ID NO: 2845317 - DNA, 15 bp, Homo sapiens
cttcctgcacccgta

SEQ ID NO: 2845318 - DNA, 15 bp, Homo sapiens
cttcctgccaccagt

SEQ ID NO: 2845319 - DNA, 17 bp, Homo sapiens
cttcctggacagctgtg

SEQ ID NO: 2845320 - DNA, 20 bp, Homo sapiens
cttcctggggcatctggcga

SEQ ID NO: 2845321 - DNA, 17 bp, Homo sapiens
cttcctgtcccacctct

SEQ ID NO: 2845322 - DNA, 16 bp, Homo sapiens
cttcctgtgacttcag

SEQ ID NO: 2845323 - DNA, 13 bp, Homo sapiens
cttccttccctgg

SEQ ID NO: 2845324 - DNA, 15 bp, Homo sapiens
cttccttccctggct

SEQ ID NO: 2845325 - DNA, 19 bp, Homo sapiens
cttccttgctgtcctaggc

SEQ ID NO: 2845326 - DNA, 14 bp, Homo sapiens
cttcctttcctctg

SEQ ID NO: 2845327 - DNA, 20 bp, Homo sapiens
cttcgaaagcatcattattt

SEQ ID NO: 2845328 - DNA, 18 bp, Homo sapiens
cttcgaccctttctctga

SEQ ID NO: 2845329 - DNA, 14 bp, Homo sapiens
cttcgactcaggat

SEQ ID NO: 2845330 - DNA, 18 bp, Homo sapiens
cttcgactcaggatccag

SEQ ID NO: 2845331 - DNA, 13 bp, Homo sapiens
cttcgctcctgtg

SEQ ID NO: 2845332 - DNA, 15 bp, Homo sapiens
cttcgctcctgtgtc

SEQ ID NO: 2845333 - DNA, 19 bp, Homo sapiens
cttcggggaactcctggaa

SEQ ID NO: 2845334 - DNA, 22 bp, Homo sapiens
cttctaaggaaatggagaagct

SEQ ID NO: 2845335 - DNA, 23 bp, Homo sapiens
cttctaaggaaatggagaagctc

SEQ ID NO: 2845336 - DNA, 19 bp, Homo sapiens
cttctacaaccagagcccc

SEQ ID NO: 2845337 - DNA, 18 bp, Homo sapiens
cttctactgagccttcag

SEQ ID NO: 2845338 - DNA, 13 bp, Homo sapiens
cttctacttttaa

SEQ ID NO: 2845339 - DNA, 16 bp, Homo sapiens
cttctaggttctaaaa

SEQ ID NO: 2845340 - DNA, 15 bp, Homo sapiens
cttctatcccaggag

SEQ ID NO: 2845341 - DNA, 15 bp, Homo sapiens
cttctatttaaaaaa

SEQ ID NO: 2845342 - DNA, 16 bp, Homo sapiens
cttctatttaaaaaat

SEQ ID NO: 2845343 - DNA, 19 bp, Homo sapiens
cttctatttaaaaaataaa

SEQ ID NO: 2845344 - DNA, 21 bp, Homo sapiens
cttctatttaaaaaataaaaa

SEQ ID NO: 2845345 - DNA, 21 bp, Homo sapiens
cttctcagccccgggcctgcc

SEQ ID NO: 2845346 - DNA, 14 bp, Homo sapiens
cttctccaccctgc

SEQ ID NO: 2845347 - DNA, 15 bp, Homo sapiens
cttctccaccctgct

SEQ ID NO: 2845348 - DNA, 21 bp, Homo sapiens
cttctccaccctgctctccga

SEQ ID NO: 2845349 - DNA, 12 bp, Homo sapiens
cttctccaggct

SEQ ID NO: 2845350 - DNA, 13 bp, Homo sapiens
cttctccaggctg

SEQ ID NO: 2845351 - DNA, 14 bp, Homo sapiens
cttctccaggctgt

SEQ ID NO: 2845352 - DNA, 14 bp, Homo sapiens
cttctccatctggc

SEQ ID NO: 2845353 - DNA, 14 bp, Homo sapiens
cttctcctgcctac

SEQ ID NO: 2845354 - DNA, 18 bp, Homo sapiens
cttctccttggaggacag

SEQ ID NO: 2845355 - DNA, 12 bp, Homo sapiens
cttctctaccca

SEQ ID NO: 2845356 - DNA, 20 bp, Homo sapiens
cttctctacccatctccccc

SEQ ID NO: 2845357 - DNA, 16 bp, Homo sapiens
cttctctctctggtca

SEQ ID NO: 2845358 - DNA, 17 bp, Homo sapiens
cttctctgttcatttcc

SEQ ID NO: 2845359 - DNA, 16 bp, Homo sapiens
cttctctttgcctcaa

SEQ ID NO: 2845360 - DNA, 23 bp, Homo sapiens
cttctgaaatgaaacaaataatc

SEQ ID NO: 2845361 - DNA, 21 bp, Homo sapiens
cttctgactgctgattctccc

SEQ ID NO: 2845362 - DNA, 17 bp, Homo sapiens
cttctgcttcagcctcc

SEQ ID NO: 2845363 - DNA, 13 bp, Homo sapiens
cttctggagccct

SEQ ID NO: 2845364 - DNA, 14 bp, Homo sapiens
cttctggagccctt

SEQ ID NO: 2845365 - DNA, 16 bp, Homo sapiens
cttctggagtctccag

SEQ ID NO: 2845366 - DNA, 17 bp, Homo sapiens
cttctggcacttggaga

SEQ ID NO: 2845367 - DNA, 21 bp, Homo sapiens
cttctgtacgtctgacaggca

SEQ ID NO: 2845368 - DNA, 13 bp, Homo sapiens
cttctgtcatccc

SEQ ID NO: 2845369 - DNA, 14 bp, Homo sapiens
cttctgtcatcccg

SEQ ID NO: 2845370 - DNA, 21 bp, Homo sapiens
cttctgtcctactctgtgtca

SEQ ID NO: 2845371 - DNA, 17 bp, Homo sapiens
cttcttaatgctttcct

SEQ ID NO: 2845372 - DNA, 23 bp, Homo sapiens
cttcttaatgctttcctccctgg

SEQ ID NO: 2845373 - DNA, 19 bp, Homo sapiens
ctgtcatcccgctcctgct

SEQ ID NO: 2845374 - DNA, 20 bp, Homo sapiens
ctgtcatcccgctcctgctg

SEQ ID NO: 2845375 - DNA, 23 bp, Homo sapiens
ctgtcattcaggaccccaacccc

SEQ ID NO: 2845376 - DNA, 14 bp, Homo sapiens
ctgtgtacccactc

SEQ ID NO: 2845377 - DNA, 16 bp, Homo sapiens
ctgtgtacccactcct

SEQ ID NO: 2845378 - DNA, 16 bp, Homo sapiens
ctgtgtagctgtgacc

SEQ ID NO: 2845379 - DNA, 17 bp, Homo sapiens
ctgtgtagctgtgacct

SEQ ID NO: 2845380 - DNA, 18 bp, Homo sapiens
ctgtgtagctgtgacctg

SEQ ID NO: 2845381 - DNA, 19 bp, Homo sapiens
ctgtgtagctgtgacctgc

SEQ ID NO: 2845382 - DNA, 20 bp, Homo sapiens
ctgtgtagctgtgacctgct

SEQ ID NO: 2845383 - DNA, 14 bp, Homo sapiens
ctgtgtcttgcaat

SEQ ID NO: 2845384 - DNA, 16 bp, Homo sapiens
ctgtgtcttgcaatgg

SEQ ID NO: 2845385 - DNA, 23 bp, Homo sapiens
ctgtgtcttgcaatggcagcctt

SEQ ID NO: 2845386 - DNA, 13 bp, Homo sapiens
ctgtgtgaagaaa

SEQ ID NO: 2845387 - DNA, 14 bp, Homo sapiens
ctgtgtgaagaaat

SEQ ID NO: 2845388 - DNA, 18 bp, Homo sapiens
ctgtgtgaattcccaggt

SEQ ID NO: 2845389 - DNA, 18 bp, Homo sapiens
ctgtgtgctcctccttgg

SEQ ID NO: 2845390 - DNA, 23 bp, Homo sapiens
ctgtgtgctcctccttggtgcct

SEQ ID NO: 2845391 - DNA, 14 bp, Homo sapiens
ctgtgtgggctgca

SEQ ID NO: 2845392 - DNA, 22 bp, Homo sapiens
ctgtgtgggctgcagatttcct

SEQ ID NO: 2845393 - DNA, 23 bp, Homo sapiens
ctgtgtgggctgcagatttcctg

SEQ ID NO: 2845394 - DNA, 15 bp, Homo sapiens
ctgtgttcagtgcct

SEQ ID NO: 2845395 - DNA, 23 bp, Homo sapiens
ctgtgtttttgctatcacacagt

SEQ ID NO: 2845396 - DNA, 18 bp, Homo sapiens
ctgttacccagagaatat

SEQ ID NO: 2845397 - DNA, 15 bp, Homo sapiens
ctgttacttaaatag

SEQ ID NO: 2845398 - DNA, 15 bp, Homo sapiens
ctgttacttacctaa

SEQ ID NO: 2845399 - DNA, 19 bp, Homo sapiens
ctgttacttacctaaacag

SEQ ID NO: 2845400 - DNA, 15 bp, Homo sapiens
ctgttagctgttatt

SEQ ID NO: 2845401 - DNA, 18 bp, Homo sapiens
ctgttagtcatttgctga

SEQ ID NO: 2845402 - DNA, 23 bp, Homo sapiens
ctgttatcaaacaccaacataaa

SEQ ID NO: 2845403 - DNA, 17 bp, Homo sapiens
ctgttatttctattttt

SEQ ID NO: 2845404 - DNA, 21 bp, Homo sapiens
ctgttattttttatttccaca

SEQ ID NO: 2845405 - DNA, 14 bp, Homo sapiens
ctgttcacccacag

SEQ ID NO: 2845406 - DNA, 17 bp, Homo sapiens
ctgttcaccttatgtat

SEQ ID NO: 2845407 - DNA, 18 bp, Homo sapiens
ctgttcaccttatgtatt

SEQ ID NO: 2845408 - DNA, 21 bp, Homo sapiens
ctgttcaccttatgtattatt

SEQ ID NO: 2845409 - DNA, 17 bp, Homo sapiens
ctgttcacttttcctcc

SEQ ID NO: 2845410 - DNA, 16 bp, Homo sapiens
ctgttcagctccagct

SEQ ID NO: 2845411 - DNA, 23 bp, Homo sapiens
ctgttcatggcagatgtaggagg

SEQ ID NO: 2845412 - DNA, 14 bp, Homo sapiens
ctgttccacttctc

SEQ ID NO: 2845413 - DNA, 22 bp, Homo sapiens
ctgttcccccgctggcagccac

SEQ ID NO: 2845414 - DNA, 14 bp, Homo sapiens
ctgttctcaaatgc

SEQ ID NO: 2845415 - DNA, 13 bp, Homo sapiens
ctgttctggagct

SEQ ID NO: 2845416 - DNA, 18 bp, Homo sapiens
ctgttctggagctgctgt

SEQ ID NO: 2845417 - DNA, 14 bp, Homo sapiens
ctgttctggcctca

SEQ ID NO: 2845418 - DNA, 16 bp, Homo sapiens
ctgttctggcctcaga

SEQ ID NO: 2845419 - DNA, 19 bp, Homo sapiens
ctgttctggcctcagacca

SEQ ID NO: 2845420 - DNA, 21 bp, Homo sapiens
ctgttgatgaggcctcttgga

SEQ ID NO: 2845421 - DNA, 15 bp, Homo sapiens
ctgttgattgcagga

SEQ ID NO: 2845422 - DNA, 17 bp, Homo sapiens
ctgttgcccaggctggc

SEQ ID NO: 2845423 - DNA, 14 bp, Homo sapiens
ctgttggctggggg

SEQ ID NO: 2845424 - DNA, 23 bp, Homo sapiens
ctgttgttgaggtggtggtagtg

SEQ ID NO: 2845425 - DNA, 23 bp, Homo sapiens
ctgttgttgttaatgaaaatgtc

SEQ ID NO: 2845426 - DNA, 19 bp, Homo sapiens
ctgtttaaaaaaagtatat

SEQ ID NO: 2845427 - DNA, 16 bp, Homo sapiens
ctgtttataaaaacaa

SEQ ID NO: 2845428 - DNA, 20 bp, Homo sapiens
ctgtttataaaaacaaaaac

SEQ ID NO: 2845429 - DNA, 21 bp, Homo sapiens
ctgtttatataattttgcagc

SEQ ID NO: 2845430 - DNA, 24 bp, Homo sapiens
ctgtttatattggtataattattt

SEQ ID NO: 2845431 - DNA, 19 bp, Homo sapiens
ctgtttcaatgacctgtat

SEQ ID NO: 2845432 - DNA, 15 bp, Homo sapiens
ctgtttcttacctta

SEQ ID NO: 2845433 - DNA, 11 bp, Homo sapiens
ctgtttgtcat

SEQ ID NO: 2845434 - DNA, 22 bp, Homo sapiens
ctgttttaaatttatttcaaaa

SEQ ID NO: 2845435 - DNA, 22 bp, Homo sapiens
ctgttttacaaaaaagaaaaga

SEQ ID NO: 2845436 - DNA, 18 bp, Homo sapiens
ctgttttcttctattcca

SEQ ID NO: 2845437 - DNA, 17 bp, Homo sapiens
ctgtttttaaaaatcat

SEQ ID NO: 2845438 - DNA, 19 bp, Homo sapiens
ctgtttttaagctgtttcc

SEQ ID NO: 2845439 - DNA, 23 bp, Homo sapiens
ctgtttttaagctgtttccatag

SEQ ID NO: 2845440 - DNA, 22 bp, Homo sapiens
ctgtttttcggacagtttattt

SEQ ID NO: 2845441 - DNA, 15 bp, Homo sapiens
cttaaaaaaatgaca

SEQ ID NO: 2845442 - DNA, 14 bp, Homo sapiens
cttaaaaaatgtcc

SEQ ID NO: 2845443 - DNA, 20 bp, Homo sapiens
cttaaaatattcctgcattt

SEQ ID NO: 2845444 - DNA, 14 bp, Homo sapiens
cttaaaatatttta

SEQ ID NO: 2845445 - DNA, 13 bp, Homo sapiens
cttaaagcacccg

SEQ ID NO: 2845446 - DNA, 18 bp, Homo sapiens
cttaaagctgcctgtagt

SEQ ID NO: 2845447 - DNA, 15 bp, Homo sapiens
cttaaataaattcaa

SEQ ID NO: 2845448 - DNA, 13 bp, Homo sapiens
cttaaatcactga

SEQ ID NO: 2845449 - DNA, 13 bp, Homo sapiens
cttaaatgcaata

SEQ ID NO: 2845450 - DNA, 21 bp, Homo sapiens
cttaactgtgtgaagaaatgg

SEQ ID NO: 2845451 - DNA, 22 bp, Homo sapiens
cttaactgtgtgaagaaatgga

SEQ ID NO: 2845452 - DNA, 12 bp, Homo sapiens
cttaataaattc

SEQ ID NO: 2845453 - DNA, 18 bp, Homo sapiens
cttaataaattcagatat

SEQ ID NO: 2845454 - DNA, 17 bp, Homo sapiens
cttaatagtatttatga

SEQ ID NO: 2845455 - DNA, 14 bp, Homo sapiens
cttaatatgttaac

SEQ ID NO: 2845456 - DNA, 14 bp, Homo sapiens
cttaatgagatagt

SEQ ID NO: 2845457 - DNA, 21 bp, Homo sapiens
cttaatgatccgttccattgc

SEQ ID NO: 2845458 - DNA, 14 bp, Homo sapiens
cttaatgctttcct

SEQ ID NO: 2845459 - DNA, 16 bp, Homo sapiens
cttaatgctttcctcc

SEQ ID NO: 2845460 - DNA, 23 bp, Homo sapiens
cttacccggagaaggccgctgcc

SEQ ID NO: 2845461 - DNA, 18 bp, Homo sapiens
cttacctaaacagatata

SEQ ID NO: 2845462 - DNA, 14 bp, Homo sapiens
cttacctcctgccc

SEQ ID NO: 2845463 - DNA, 16 bp, Homo sapiens
cttacctcctgcccag

SEQ ID NO: 2845464 - DNA, 20 bp, Homo sapiens
cttacctgtatgtctccagt

SEQ ID NO: 2845465 - DNA, 15 bp, Homo sapiens
ctgctacctcactgg

SEQ ID NO: 2845466 - DNA, 15 bp, Homo sapiens
ctgctagagaagggg

SEQ ID NO: 2845467 - DNA, 14 bp, Homo sapiens
ctgctagcacttgg

SEQ ID NO: 2845468 - DNA, 15 bp, Homo sapiens
ctgctagctgtagaa

SEQ ID NO: 2845469 - DNA, 18 bp, Homo sapiens
ctgctaggcgagtgccag

SEQ ID NO: 2845470 - DNA, 23 bp, Homo sapiens
ctgctaggcgagtgccaggactc

SEQ ID NO: 2845471 - DNA, 21 bp, Homo sapiens
ctgctatggttttctccaaga

SEQ ID NO: 2845472 - DNA, 14 bp, Homo sapiens
ctgctatttgaagt

SEQ ID NO: 2845473 - DNA, 14 bp, Homo sapiens
ctgctcaacctctc

SEQ ID NO: 2845474 - DNA, 16 bp, Homo sapiens
ctgctcacatatctgt

SEQ ID NO: 2845475 - DNA, 15 bp, Homo sapiens
ctgctcaggaattga

SEQ ID NO: 2845476 - DNA, 12 bp, Homo sapiens
ctgctcatcatt

SEQ ID NO: 2845477 - DNA, 17 bp, Homo sapiens
ctgctcccagcagccct

SEQ ID NO: 2845478 - DNA, 22 bp, Homo sapiens
ctgctcccagcagccctaagga

SEQ ID NO: 2845479 - DNA, 17 bp, Homo sapiens
ctgctcccccaccccct

SEQ ID NO: 2845480 - DNA, 21 bp, Homo sapiens
ctgctcccccaccccctcccc

SEQ ID NO: 2845481 - DNA, 17 bp, Homo sapiens
ctgctcctccagggcca

SEQ ID NO: 2845482 - DNA, 17 bp, Homo sapiens
ctgctcctctccccagc

SEQ ID NO: 2845483 - DNA, 18 bp, Homo sapiens
ctgctcctctccccagca

SEQ ID NO: 2845484 - DNA, 19 bp, Homo sapiens
ctgctcctctccccagcaa

SEQ ID NO: 2845485 - DNA, 23 bp, Homo sapiens
ctgctcctctccccagcaagtga

SEQ ID NO: 2845486 - DNA, 17 bp, Homo sapiens
ctgctcggggtgcacag

SEQ ID NO: 2845487 - DNA, 21 bp, Homo sapiens
ctgctcggggtgcacaggagg

SEQ ID NO: 2845488 - DNA, 23 bp, Homo sapiens
ctgctctattgtagcatttcttg

SEQ ID NO: 2845489 - DNA, 14 bp, Homo sapiens
ctgctctcagcctc

SEQ ID NO: 2845490 - DNA, 15 bp, Homo sapiens
ctgctctccgaccag

SEQ ID NO: 2845491 - DNA, 21 bp, Homo sapiens
ctgctctcctcttgccactgc

SEQ ID NO: 2845492 - DNA, 18 bp, Homo sapiens
ctgctctgaggcttccag

SEQ ID NO: 2845493 - DNA, 21 bp, Homo sapiens
ctgctctgaggcttccagaga

SEQ ID NO: 2845494 - DNA, 13 bp, Homo sapiens
ctgctctgatgca

SEQ ID NO: 2845495 - DNA, 17 bp, Homo sapiens
ctgctcttgcctgcacc

SEQ ID NO: 2845496 - DNA, 20 bp, Homo sapiens
ctgctgaaacacctcccagg

SEQ ID NO: 2845497 - DNA, 23 bp, Homo sapiens
ctgctgaatgatttccaaagaga

SEQ ID NO: 2845498 - DNA, 15 bp, Homo sapiens
ctgctgagaacctgg

SEQ ID NO: 2845499 - DNA, 17 bp, Homo sapiens
ctgctgagaacctggcc

SEQ ID NO: 2845500 - DNA, 16 bp, Homo sapiens
ctgctgagagacccaa

SEQ ID NO: 2845501 - DNA, 22 bp, Homo sapiens
ctgctgagagacccaaggagga

SEQ ID NO: 2845502 - DNA, 16 bp, Homo sapiens
ctgctgagctctgaga

SEQ ID NO: 2845503 - DNA, 17 bp, Homo sapiens
ctgctgagctctgagag

SEQ ID NO: 2845504 - DNA, 18 bp, Homo sapiens
ctgctgagctctgagagg

SEQ ID NO: 2845505 - DNA, 21 bp, Homo sapiens
ctgctgagctctgagaggccc

SEQ ID NO: 2845506 - DNA, 14 bp, Homo sapiens
ctgctgcaaagtgc

SEQ ID NO: 2845507 - DNA, 12 bp, Homo sapiens
ctgctgcccagc

SEQ ID NO: 2845508 - DNA, 23 bp, Homo sapiens
ctgctgccccgcttccccacaga

SEQ ID NO: 2845509 - DNA, 19 bp, Homo sapiens
ctgctgccgcctcccagcc

SEQ ID NO: 2845510 - DNA, 21 bp, Homo sapiens
ctgctgccgcctcccagcctg

SEQ ID NO: 2845511 - DNA, 13 bp, Homo sapiens
ctgctgctgagaa

SEQ ID NO: 2845512 - DNA, 14 bp, Homo sapiens
ctgctgctgagaac

SEQ ID NO: 2845513 - DNA, 13 bp, Homo sapiens
ctgctgctgtgtt

SEQ ID NO: 2845514 - DNA, 16 bp, Homo sapiens
ctgctggcctggatct

SEQ ID NO: 2845515 - DNA, 16 bp, Homo sapiens
ctgctggcctggccgg

SEQ ID NO: 2845516 - DNA, 20 bp, Homo sapiens
ctgctggcctggccggcaac

SEQ ID NO: 2845517 - DNA, 19 bp, Homo sapiens
ctgctgggaccccagctag

SEQ ID NO: 2845518 - DNA, 22 bp, Homo sapiens
ctgctgggaccccagctagggc

SEQ ID NO: 2845519 - DNA, 19 bp, Homo sapiens
ctgctgggactggccaggt

SEQ ID NO: 2845520 - DNA, 14 bp, Homo sapiens
ctgctgggctctcc

SEQ ID NO: 2845521 - DNA, 15 bp, Homo sapiens
ctgctgggctctcca

SEQ ID NO: 2845522 - DNA, 12 bp, Homo sapiens
ctgctgtgtagc

SEQ ID NO: 2845523 - DNA, 21 bp, Homo sapiens
ctgctgtgtgaattcccaggt

SEQ ID NO: 2845524 - DNA, 13 bp, Homo sapiens
ctgcttcagcctc

SEQ ID NO: 2845525 - DNA, 16 bp, Homo sapiens
ctgcttcagcctcccg

SEQ ID NO: 2845526 - DNA, 19 bp, Homo sapiens
ctgcttcagtgtatggaaa

SEQ ID NO: 2845527 - DNA, 21 bp, Homo sapiens
ctgcttcagtgtatggaaata

SEQ ID NO: 2845528 - DNA, 18 bp, Homo sapiens
ctgcttcccatgcctgca

SEQ ID NO: 2845529 - DNA, 14 bp, Homo sapiens
ctgcttgaaggaac

SEQ ID NO: 2845530 - DNA, 20 bp, Homo sapiens
ctgcttgaaggaacagtgct

SEQ ID NO: 2845531 - DNA, 19 bp, Homo sapiens
ctgcttggggggtgatgag

SEQ ID NO: 2845532 - DNA, 22 bp, Homo sapiens
ctgcttggggggtgatgagggc

SEQ ID NO: 2845533 - DNA, 17 bp, Homo sapiens
ctgcttgtccctgccca

SEQ ID NO: 2845534 - DNA, 18 bp, Homo sapiens
ctgctttaaatctatcta

SEQ ID NO: 2845535 - DNA, 22 bp, Homo sapiens
ctgctttcaacttaaatcactg

SEQ ID NO: 2845536 - DNA, 18 bp, Homo sapiens
ctgctttgcgctggtgga

SEQ ID NO: 2845537 - DNA, 21 bp, Homo sapiens
ctgcttttgtctatgggactc

SEQ ID NO: 2845538 - DNA, 15 bp, Homo sapiens
ctggaaaagaggagt

SEQ ID NO: 2845539 - DNA, 16 bp, Homo sapiens
ctggaaaagcacttta

SEQ ID NO: 2845540 - DNA, 17 bp, Homo sapiens
ctggaaaagtcacacag

SEQ ID NO: 2845541 - DNA, 18 bp, Homo sapiens
ctggaaaagtcacacaga

SEQ ID NO: 2845542 - DNA, 22 bp, Homo sapiens
ctggaaaagtcacacagacaca

SEQ ID NO: 2845543 - DNA, 23 bp, Homo sapiens
ctggaaaagtcacacagacacac

SEQ ID NO: 2845544 - DNA, 23 bp, Homo sapiens
ctggaaatatcagttactcagcc

SEQ ID NO: 2845545 - DNA, 15 bp, Homo sapiens
ctggaaatctggatt

SEQ ID NO: 2845546 - DNA, 17 bp, Homo sapiens
ctggaaatctggatttt

SEQ ID NO: 2845547 - DNA, 22 bp, Homo sapiens
ctggaaccaatcccgtgaaaga

SEQ ID NO: 2845548 - DNA, 19 bp, Homo sapiens
ctggaactgtctctcatga

SEQ ID NO: 2845549 - DNA, 23 bp, Homo sapiens
ctggaagggaagtgagaaaccag

SEQ ID NO: 2845550 - DNA, 15 bp, Homo sapiens
ctggaatacatgaaa

SEQ ID NO: 2845551 - DNA, 19 bp, Homo sapiens
ctggaatcgatctgtactg

SEQ ID NO: 2845552 - DNA, 13 bp, Homo sapiens
ctggaatgaagca

SEQ ID NO: 2845553 - DNA, 15 bp, Homo sapiens
ctggaatgtaatcaa

SEQ ID NO: 2845554 - DNA, 17 bp, Homo sapiens
ctggaattgctgctctc

SEQ ID NO: 2845555 - DNA, 14 bp, Homo sapiens
ctggacaacccaga

SEQ ID NO: 2845556 - DNA, 15 bp, Homo sapiens
ctggacaacccagaa

SEQ ID NO: 2845557 - DNA, 14 bp, Homo sapiens
ctggacaagaagct

SEQ ID NO: 2845558 - DNA, 15 bp, Homo sapiens
ctggacaagccaact

SEQ ID NO: 2845559 - DNA, 21 bp, Homo sapiens
ctggacaagccaacttgtaaa

SEQ ID NO: 2845560 - DNA, 20 bp, Homo sapiens
ctggacactagggtcaggcg

SEQ ID NO: 2845561 - DNA, 22 bp, Homo sapiens
ctggacactagggtcaggcggg

SEQ ID NO: 2845562 - DNA, 18 bp, Homo sapiens
ctggacagctgtgcctcg

SEQ ID NO: 2845563 - DNA, 17 bp, Homo sapiens
ctggacaggcatgttct

SEQ ID NO: 2845564 - DNA, 23 bp, Homo sapiens
ctggacaggcatgttctctgagg

SEQ ID NO: 2845565 - DNA, 21 bp, Homo sapiens
ctggaccaaccctgtttcctg

SEQ ID NO: 2845566 - DNA, 23 bp, Homo sapiens
ctggaccaaccctgtttcctgag

SEQ ID NO: 2845567 - DNA, 18 bp, Homo sapiens
ctggaccaccagccccag

SEQ ID NO: 2845568 - DNA, 15 bp, Homo sapiens
ctggaccactgggca

SEQ ID NO: 2845569 - DNA, 20 bp, Homo sapiens
ctggacggcattcctgctta

SEQ ID NO: 2845570 - DNA, 14 bp, Homo sapiens
ctggactcctctgt

SEQ ID NO: 2845571 - DNA, 20 bp, Homo sapiens
ctggactcctctgtccaggc

SEQ ID NO: 2845572 - DNA, 19 bp, Homo sapiens
ctggactgtcatagaaatt

SEQ ID NO: 2845573 - DNA, 22 bp, Homo sapiens
ctggactttggttctctccagg

SEQ ID NO: 2845574 - DNA, 23 bp, Homo sapiens
ctggactttggttctctccagga

SEQ ID NO: 2845575 - DNA, 17 bp, Homo sapiens
ctggagagaagtttctg

SEQ ID NO: 2845576 - DNA, 13 bp, Homo sapiens
ctggagcaccagg

SEQ ID NO: 2845577 - DNA, 12 bp, Homo sapiens
ctggagcatctg

SEQ ID NO: 2845578 - DNA, 23 bp, Homo sapiens
ctggagcatctgactcacaagaa

SEQ ID NO: 2845579 - DNA, 13 bp, Homo sapiens
ctggagcccagga

SEQ ID NO: 2845580 - DNA, 15 bp, Homo sapiens
ctggagcccttgggt

SEQ ID NO: 2845581 - DNA, 21 bp, Homo sapiens
ctggagcctcggtggccatgc

SEQ ID NO: 2845582 - DNA, 22 bp, Homo sapiens
ctggagcctcggtggccatgct

SEQ ID NO: 2845583 - DNA, 16 bp, Homo sapiens
ctggagcggctctcct

SEQ ID NO: 2845584 - DNA, 20 bp, Homo sapiens
ctggagcggctctcctgaga

SEQ ID NO: 2845585 - DNA, 16 bp, Homo sapiens
ctggagctgctgttcc

SEQ ID NO: 2845586 - DNA, 14 bp, Homo sapiens
ctggaggacctgag

SEQ ID NO: 2845587 - DNA, 15 bp, Homo sapiens
ctggaggacctgagc

SEQ ID NO: 2845588 - DNA, 16 bp, Homo sapiens
ctggaggacctgagcc

SEQ ID NO: 2845589 - DNA, 19 bp, Homo sapiens
ctggaggacctgagcctgc

SEQ ID NO: 2845590 - DNA, 13 bp, Homo sapiens
ctggaggcagggc

SEQ ID NO: 2845591 - DNA, 15 bp, Homo sapiens
ctggaggcagggcct

SEQ ID NO: 2845592 - DNA, 20 bp, Homo sapiens
ctggaggcagggccttgccc

SEQ ID NO: 2845593 - DNA, 18 bp, Homo sapiens
ctggatcagcgtggcctt

SEQ ID NO: 2845594 - DNA, 19 bp, Homo sapiens
ctggatcagcgtggccttg

SEQ ID NO: 2845595 - DNA, 21 bp, Homo sapiens
ctggatctgggaccctttcct

SEQ ID NO: 2845596 - DNA, 22 bp, Homo sapiens
ctggatctttcggactgaggcc

SEQ ID NO: 2845597 - DNA, 21 bp, Homo sapiens
ctggatggatttgaagcaaag

SEQ ID NO: 2845598 - DNA, 15 bp, Homo sapiens
ctggatggcaccaga

SEQ ID NO: 2845599 - DNA, 19 bp, Homo sapiens
ctggatgtcatattggcag

SEQ ID NO: 2845600 - DNA, 22 bp, Homo sapiens
ctggattgatcggagcctcctc

SEQ ID NO: 2845601 - DNA, 23 bp, Homo sapiens
ctggatttttacaaataaagatg

SEQ ID NO: 2845602 - DNA, 21 bp, Homo sapiens
ctggcaaaggtggctctccag

SEQ ID NO: 2845603 - DNA, 19 bp, Homo sapiens
ctggcaaagttatatttac

SEQ ID NO: 2845604 - DNA, 21 bp, Homo sapiens
ctggcaatgaaaaattctcag

SEQ ID NO: 2845605 - DNA, 20 bp, Homo sapiens
ctggcacccggcccctgctg

SEQ ID NO: 2845606 - DNA, 21 bp, Homo sapiens
ctggcacccggcccctgctgg

SEQ ID NO: 2845607 - DNA, 15 bp, Homo sapiens
ctggcacgtttgtga

SEQ ID NO: 2845608 - DNA, 22 bp, Homo sapiens
ctggcagagaaggcttcctcca

SEQ ID NO: 2845609 - DNA, 15 bp, Homo sapiens
ctggcagccacactt

SEQ ID NO: 2845610 - DNA, 22 bp, Homo sapiens
ctggcagccacacttctcagga

SEQ ID NO: 2845611 - DNA, 18 bp, Homo sapiens
ctggcagccaccccctcc

SEQ ID NO: 2845612 - DNA, 17 bp, Homo sapiens
ctggcagggtgggatgg

SEQ ID NO: 2845613 - DNA, 22 bp, Homo sapiens
ctggcagtttatatttaactct

SEQ ID NO: 2845614 - DNA, 19 bp, Homo sapiens
ctggcatgaccatcctgtc

SEQ ID NO: 2845615 - DNA, 14 bp, Homo sapiens
ctggccaagctgag

SEQ ID NO: 2845616 - DNA, 15 bp, Homo sapiens
ctggccaagctgagg

SEQ ID NO: 2845617 - DNA, 16 bp, Homo sapiens
ctggccaagctgaggt

SEQ ID NO: 2845618 - DNA, 22 bp, Homo sapiens
ctggccagatgcaccagccctt

SEQ ID NO: 2845619 - DNA, 13 bp, Homo sapiens
ctggcccccctcc

SEQ ID NO: 2845620 - DNA, 15 bp, Homo sapiens
ctggcccccctccag

SEQ ID NO: 2845621 - DNA, 17 bp, Homo sapiens
ctggcccccctccaggc

SEQ ID NO: 2845622 - DNA, 21 bp, Homo sapiens
ctggcccgtcatgttcctcaa

SEQ ID NO: 2845623 - DNA, 22 bp, Homo sapiens
ctggcccgtcatgttcctcaaa

SEQ ID NO: 2845624 - DNA, 14 bp, Homo sapiens
ctggccgcctccag

SEQ ID NO: 2845625 - DNA, 19 bp, Homo sapiens
ctggccgcctccaggagcc

SEQ ID NO: 2845626 - DNA, 15 bp, Homo sapiens
ctggccggctccagt

SEQ ID NO: 2845627 - DNA, 21 bp, Homo sapiens
ctggcctcaaagcaagcattc

SEQ ID NO: 2845628 - DNA, 22 bp, Homo sapiens
ctggcctcaagtgattctcctg

SEQ ID NO: 2845629 - DNA, 23 bp, Homo sapiens
ctggcctcaagtgattctcctgc

SEQ ID NO: 2845630 - DNA, 23 bp, Homo sapiens
ctggcctcccaataaagctggac

SEQ ID NO: 2845631 - DNA, 14 bp, Homo sapiens
ctggcctcctgcct

SEQ ID NO: 2845632 - DNA, 19 bp, Homo sapiens
ctggcctgctgggctctcc

SEQ ID NO: 2845633 - DNA, 20 bp, Homo sapiens
ctggcctgctgggctctcca

SEQ ID NO: 2845634 - DNA, 13 bp, Homo sapiens
ctgccagtgcctt

SEQ ID NO: 2845635 - DNA, 17 bp, Homo sapiens
ctgccagtgccttacct

SEQ ID NO: 2845636 - DNA, 21 bp, Homo sapiens
ctgccagtgccttacctcctg

SEQ ID NO: 2845637 - DNA, 23 bp, Homo sapiens
ctgccagtgccttacctcctgcc

SEQ ID NO: 2845638 - DNA, 12 bp, Homo sapiens
ctgccagtgttt

SEQ ID NO: 2845639 - DNA, 22 bp, Homo sapiens
ctgccagtgtttagaagagcct

SEQ ID NO: 2845640 - DNA, 16 bp, Homo sapiens
ctgccatattctgttg

SEQ ID NO: 2845641 - DNA, 18 bp, Homo sapiens
ctgccatccaggttcagc

SEQ ID NO: 2845642 - DNA, 20 bp, Homo sapiens
ctgccatttgcaccctccgc

SEQ ID NO: 2845643 - DNA, 21 bp, Homo sapiens
ctgcccagaattcccagctgt

SEQ ID NO: 2845644 - DNA, 22 bp, Homo sapiens
ctgcccagaattcccagctgtc

SEQ ID NO: 2845645 - DNA, 12 bp, Homo sapiens
ctgcccagcctc

SEQ ID NO: 2845646 - DNA, 17 bp, Homo sapiens
ctgcccagcctccaagc

SEQ ID NO: 2845647 - DNA, 17 bp, Homo sapiens
ctgcccaggagagccag

SEQ ID NO: 2845648 - DNA, 22 bp, Homo sapiens
ctgcccaggagagccagccctc

SEQ ID NO: 2845649 - DNA, 13 bp, Homo sapiens
ctgcccaggcccc

SEQ ID NO: 2845650 - DNA, 18 bp, Homo sapiens
ctgcccaggcccctgcca

SEQ ID NO: 2845651 - DNA, 17 bp, Homo sapiens
ctgcccaggcctgcctg

SEQ ID NO: 2845652 - DNA, 18 bp, Homo sapiens
ctgcccaggcctgcctgt

SEQ ID NO: 2845653 - DNA, 19 bp, Homo sapiens
ctgcccaggcctgcctgtt

SEQ ID NO: 2845654 - DNA, 19 bp, Homo sapiens
ctgcccagtgcacttgctg

SEQ ID NO: 2845655 - DNA, 16 bp, Homo sapiens
ctgccccaactcctgg

SEQ ID NO: 2845656 - DNA, 18 bp, Homo sapiens
ctgccccaactcctggaa

SEQ ID NO: 2845657 - DNA, 21 bp, Homo sapiens
ctgccccaactcctggaagct

SEQ ID NO: 2845658 - DNA, 13 bp, Homo sapiens
ctgccccagctct

SEQ ID NO: 2845659 - DNA, 18 bp, Homo sapiens
ctgccccagctctggctt

SEQ ID NO: 2845660 - DNA, 19 bp, Homo sapiens
ctgccccagctctggcttc

SEQ ID NO: 2845661 - DNA, 11 bp, Homo sapiens
ctgccccccgc

SEQ ID NO: 2845662 - DNA, 20 bp, Homo sapiens
ctgcccccgtcttctctcca

SEQ ID NO: 2845663 - DNA, 22 bp, Homo sapiens
ctgccccctggtggacagtcct

SEQ ID NO: 2845664 - DNA, 15 bp, Homo sapiens
ctgccccgcccagct

SEQ ID NO: 2845665 - DNA, 19 bp, Homo sapiens
ctgccccgggtccccagct

SEQ ID NO: 2845666 - DNA, 22 bp, Homo sapiens
ctgccccgggtccccagctccc

SEQ ID NO: 2845667 - DNA, 16 bp, Homo sapiens
ctgcccctgcagttgg

SEQ ID NO: 2845668 - DNA, 21 bp, Homo sapiens
ctgcccgtcttcagcctagcc

SEQ ID NO: 2845669 - DNA, 21 bp, Homo sapiens
ctgccctcccacctccgctgg

SEQ ID NO: 2845670 - DNA, 11 bp, Homo sapiens
ctgccctgcca

SEQ ID NO: 2845671 - DNA, 18 bp, Homo sapiens
ctgccctgccacctgtct

SEQ ID NO: 2845672 - DNA, 16 bp, Homo sapiens
ctgccctgccactttg

SEQ ID NO: 2845673 - DNA, 16 bp, Homo sapiens
ctgccctgtcctccag

SEQ ID NO: 2845674 - DNA, 17 bp, Homo sapiens
ctgccctgtcctccagc

SEQ ID NO: 2845675 - DNA, 21 bp, Homo sapiens
ctgccctgttgtgtatagatg

SEQ ID NO: 2845676 - DNA, 21 bp, Homo sapiens
ctgcccttgtttggggcagga

SEQ ID NO: 2845677 - DNA, 23 bp, Homo sapiens
ctgcccttgtttggggcaggagt

SEQ ID NO: 2845678 - DNA, 15 bp, Homo sapiens
ctgccgaccagagcc

SEQ ID NO: 2845679 - DNA, 16 bp, Homo sapiens
ctgccgaccagagccc

SEQ ID NO: 2845680 - DNA, 17 bp, Homo sapiens
ctgccgacctcgtcctc

SEQ ID NO: 2845681 - DNA, 17 bp, Homo sapiens
ctgccgcaacagttttt

SEQ ID NO: 2845682 - DNA, 14 bp, Homo sapiens
ctgccgcaccccag

SEQ ID NO: 2845683 - DNA, 16 bp, Homo sapiens
ctgccgcaccccagag

SEQ ID NO: 2845684 - DNA, 18 bp, Homo sapiens
ctgccgcctcccagcctg

SEQ ID NO: 2845685 - DNA, 14 bp, Homo sapiens
ctgccgggttctag

SEQ ID NO: 2845686 - DNA, 16 bp, Homo sapiens
ctgcctaagtggctgc

SEQ ID NO: 2845687 - DNA, 15 bp, Homo sapiens
ctgcctacattccct

SEQ ID NO: 2845688 - DNA, 16 bp, Homo sapiens
ctgcctacattccctg

SEQ ID NO: 2845689 - DNA, 18 bp, Homo sapiens
ctgcctagaaaatgcaaa

SEQ ID NO: 2845690 - DNA, 13 bp, Homo sapiens
ctgcctcagcctc

SEQ ID NO: 2845691 - DNA, 15 bp, Homo sapiens
ctgcctcagcctccc

SEQ ID NO: 2845692 - DNA, 19 bp, Homo sapiens
ctgcctcagcctcccaaag

SEQ ID NO: 2845693 - DNA, 21 bp, Homo sapiens
ctgcctcatgaccctcctgtc

SEQ ID NO: 2845694 - DNA, 14 bp, Homo sapiens
ctgcctcgaactgg

SEQ ID NO: 2845695 - DNA, 15 bp, Homo sapiens
ctgcctcgaactggc

SEQ ID NO: 2845696 - DNA, 17 bp, Homo sapiens
ctgcctctactgggaag

SEQ ID NO: 2845697 - DNA, 23 bp, Homo sapiens
ctgcctctgacacacagctctgt

SEQ ID NO: 2845698 - DNA, 12 bp, Homo sapiens
ctgcctcttcct

SEQ ID NO: 2845699 - DNA, 21 bp, Homo sapiens
ctgcctgcagtactttacctc

SEQ ID NO: 2845700 - DNA, 15 bp, Homo sapiens
ctgcctgcccaggcc

SEQ ID NO: 2845701 - DNA, 20 bp, Homo sapiens
ctgcctgcccaggcccctgc

SEQ ID NO: 2845702 - DNA, 11 bp, Homo sapiens
ctgcctggagg

SEQ ID NO: 2845703 - DNA, 22 bp, Homo sapiens
ctgcctggaggacctgagcctg

SEQ ID NO: 2845704 - DNA, 23 bp, Homo sapiens
ctgcctggaggacctgagcctgc

SEQ ID NO: 2845705 - DNA, 13 bp, Homo sapiens
ctgcctgtagtta

SEQ ID NO: 2845706 - DNA, 15 bp, Homo sapiens
ctgcctgttcagctc

SEQ ID NO: 2845707 - DNA, 18 bp, Homo sapiens
ctgccttcagccctggcc

SEQ ID NO: 2845708 - DNA, 24 bp, Homo sapiens
ctgccttcttcggggaactcctgg

SEQ ID NO: 2845709 - DNA, 13 bp, Homo sapiens
ctgccttgccatg

SEQ ID NO: 2845710 - DNA, 19 bp, Homo sapiens
ctgcgagatcgctggcaga

SEQ ID NO: 2845711 - DNA, 20 bp, Homo sapiens
ctgcgagctccttgggtcct

SEQ ID NO: 2845712 - DNA, 17 bp, Homo sapiens
ctgcgatcttcagagca

SEQ ID NO: 2845713 - DNA, 21 bp, Homo sapiens
ctgcggaatgaaccacatctt

SEQ ID NO: 2845714 - DNA, 17 bp, Homo sapiens
ctgcgggatggtcctgg

SEQ ID NO: 2845715 - DNA, 18 bp, Homo sapiens
ctgcgggatggtcctggg

SEQ ID NO: 2845716 - DNA, 19 bp, Homo sapiens
ctgcgggatggtcctgggg

SEQ ID NO: 2845717 - DNA, 24 bp, Homo sapiens
ctgatgggcaacccccagcctgct

SEQ ID NO: 2845718 - DNA, 21 bp, Homo sapiens
ctgatggggtggaaggcatgg

SEQ ID NO: 2845719 - DNA, 22 bp, Homo sapiens
ctgatgttgagggaacagacag

SEQ ID NO: 2845720 - DNA, 21 bp, Homo sapiens
ctgattcacatctcatttttc

SEQ ID NO: 2845721 - DNA, 15 bp, Homo sapiens
ctgattcccaagctc

SEQ ID NO: 2845722 - DNA, 18 bp, Homo sapiens
ctgattcccaagctctgc

SEQ ID NO: 2845723 - DNA, 12 bp, Homo sapiens
ctgatttctagg

SEQ ID NO: 2845724 - DNA, 21 bp, Homo sapiens
ctgattttcaaagctttttcc

SEQ ID NO: 2845725 - DNA, 13 bp, Homo sapiens
ctgcaaaatttta

SEQ ID NO: 2845726 - DNA, 22 bp, Homo sapiens
ctgcaaagggtatcaggtgctg

SEQ ID NO: 2845727 - DNA, 17 bp, Homo sapiens
ctgcaaccttgcatcca

SEQ ID NO: 2845728 - DNA, 13 bp, Homo sapiens
ctgcaagagcctt

SEQ ID NO: 2845729 - DNA, 15 bp, Homo sapiens
ctgcaagagccttgg

SEQ ID NO: 2845730 - DNA, 18 bp, Homo sapiens
ctgcaagagccttggtgt

SEQ ID NO: 2845731 - DNA, 18 bp, Homo sapiens
ctgcaagaggctcctgtc

SEQ ID NO: 2845732 - DNA, 19 bp, Homo sapiens
ctgcaagtgacatctcttt

SEQ ID NO: 2845733 - DNA, 21 bp, Homo sapiens
ctgcaatctccagggctgccc

SEQ ID NO: 2845734 - DNA, 20 bp, Homo sapiens
ctgcaattgcttaggatgtt

SEQ ID NO: 2845735 - DNA, 20 bp, Homo sapiens
ctgcacaaagcccttccatg

SEQ ID NO: 2845736 - DNA, 23 bp, Homo sapiens
ctgcacatgtcttgtacatgtgt

SEQ ID NO: 2845737 - DNA, 14 bp, Homo sapiens
ctgcacccgtaccc

SEQ ID NO: 2845738 - DNA, 20 bp, Homo sapiens
ctgcacccgtacccccgtgg

SEQ ID NO: 2845739 - DNA, 22 bp, Homo sapiens
ctgcacccttcctcctcctttg

SEQ ID NO: 2845740 - DNA, 18 bp, Homo sapiens
ctgcaccgggccacagag

SEQ ID NO: 2845741 - DNA, 22 bp, Homo sapiens
ctgcacctccccccactgcagg

SEQ ID NO: 2845742 - DNA, 20 bp, Homo sapiens
ctgcacctgccagcctggct

SEQ ID NO: 2845743 - DNA, 16 bp, Homo sapiens
ctgcactaatttgatg

SEQ ID NO: 2845744 - DNA, 20 bp, Homo sapiens
ctgcactatagcctaggtga

SEQ ID NO: 2845745 - DNA, 22 bp, Homo sapiens
ctgcactatagcctaggtgaca

SEQ ID NO: 2845746 - DNA, 20 bp, Homo sapiens
ctgcactccagcctgggcga

SEQ ID NO: 2845747 - DNA, 20 bp, Homo sapiens
ctgcactccggcctgatgac

SEQ ID NO: 2845748 - DNA, 23 bp, Homo sapiens
ctgcactctagcctggcaacaga

SEQ ID NO: 2845749 - DNA, 16 bp, Homo sapiens
ctgcacttgcagactc

SEQ ID NO: 2845750 - DNA, 17 bp, Homo sapiens
ctgcacttgcagactct

SEQ ID NO: 2845751 - DNA, 16 bp, Homo sapiens
ctgcagaaggccaaga

SEQ ID NO: 2845752 - DNA, 19 bp, Homo sapiens
ctgcagaaggccaagaatc

SEQ ID NO: 2845753 - DNA, 14 bp, Homo sapiens
ctgcagagagaagc

SEQ ID NO: 2845754 - DNA, 20 bp, Homo sapiens
ctgcagagcaggaaacatga

SEQ ID NO: 2845755 - DNA, 12 bp, Homo sapiens
ctgcagccagcc

SEQ ID NO: 2845756 - DNA, 16 bp, Homo sapiens
ctgcagccagcccagc

SEQ ID NO: 2845757 - DNA, 17 bp, Homo sapiens
ctgcagccagcccagcc

SEQ ID NO: 2845758 - DNA, 22 bp, Homo sapiens
ctgcagccagcccagcccagct

SEQ ID NO: 2845759 - DNA, 23 bp, Homo sapiens
ctgcagccagcccagcccagctg

SEQ ID NO: 2845760 - DNA, 19 bp, Homo sapiens
ctgcagcctcaacctcctg

SEQ ID NO: 2845761 - DNA, 22 bp, Homo sapiens
ctgcagcctcaacctcctgggc

SEQ ID NO: 2845762 - DNA, 24 bp, Homo sapiens
ctgcagcctcaacctcctgggcta

SEQ ID NO: 2845763 - DNA, 17 bp, Homo sapiens
ctgcagcctcctcctga

SEQ ID NO: 2845764 - DNA, 12 bp, Homo sapiens
ctgcagcttcct

SEQ ID NO: 2845765 - DNA, 15 bp, Homo sapiens
ctgcagcttcctgtc

SEQ ID NO: 2845766 - DNA, 19 bp, Homo sapiens
ctgcagcttcctgtcaaca

SEQ ID NO: 2845767 - DNA, 18 bp, Homo sapiens
ctgcagcttgtagccagc

SEQ ID NO: 2845768 - DNA, 19 bp, Homo sapiens
ctgcagcttgtagccagcc

SEQ ID NO: 2845769 - DNA, 21 bp, Homo sapiens
ctgcagcttgtagccagccgg

SEQ ID NO: 2845770 - DNA, 15 bp, Homo sapiens
ctgcaggaatcaaaa

SEQ ID NO: 2845771 - DNA, 11 bp, Homo sapiens
ctgcaggactt

SEQ ID NO: 2845772 - DNA, 16 bp, Homo sapiens
ctgcaggacttctgcc

SEQ ID NO: 2845773 - DNA, 19 bp, Homo sapiens
ctgcaggccaagagcagag

SEQ ID NO: 2845774 - DNA, 22 bp, Homo sapiens
ctgcaggccaagagcagaggca

SEQ ID NO: 2845775 - DNA, 20 bp, Homo sapiens
ctgcaggccccgcttgtcca

SEQ ID NO: 2845776 - DNA, 22 bp, Homo sapiens
ctgcaggccccgcttgtccagc

SEQ ID NO: 2845777 - DNA, 23 bp, Homo sapiens
ctgcaggccccgcttgtccagcg

SEQ ID NO: 2845778 - DNA, 20 bp, Homo sapiens
ctgcagggggtgtgtctgct

SEQ ID NO: 2845779 - DNA, 17 bp, Homo sapiens
ctgcagtcaacagttca

SEQ ID NO: 2845780 - DNA, 19 bp, Homo sapiens
ctgcatccgtagttccctg

SEQ ID NO: 2845781 - DNA, 14 bp, Homo sapiens
ctgcatctactcag

SEQ ID NO: 2845782 - DNA, 17 bp, Homo sapiens
ctgcatctactcaggcc

SEQ ID NO: 2845783 - DNA, 23 bp, Homo sapiens
ctgcattattggaatataattgt

SEQ ID NO: 2845784 - DNA, 16 bp, Homo sapiens
ctgcatttataaatgt

SEQ ID NO: 2845785 - DNA, 13 bp, Homo sapiens
ctgcatttgtgaa

SEQ ID NO: 2845786 - DNA, 17 bp, Homo sapiens
ctgcatttgtgaaatga

SEQ ID NO: 2845787 - DNA, 14 bp, Homo sapiens
ctgccaagccacct

SEQ ID NO: 2845788 - DNA, 22 bp, Homo sapiens
ctgccaagcctattgtgcctct

SEQ ID NO: 2845789 - DNA, 24 bp, Homo sapiens
ctgccaagcctattgtgcctctgg

SEQ ID NO: 2845790 - DNA, 15 bp, Homo sapiens
ctgccacaccctccc

SEQ ID NO: 2845791 - DNA, 14 bp, Homo sapiens
ctgccaccagtcac

SEQ ID NO: 2845792 - DNA, 17 bp, Homo sapiens
ctgccaccagtcactgt

SEQ ID NO: 2845793 - DNA, 15 bp, Homo sapiens
ctgccaccctgggga

SEQ ID NO: 2845794 - DNA, 20 bp, Homo sapiens
ctgccaccctggggagaaag

SEQ ID NO: 2845795 - DNA, 13 bp, Homo sapiens
ctgccacctcccc

SEQ ID NO: 2845796 - DNA, 14 bp, Homo sapiens
ctgccacctcccct

SEQ ID NO: 2845797 - DNA, 13 bp, Homo sapiens
ctgccacctgtct

SEQ ID NO: 2845798 - DNA, 22 bp, Homo sapiens
ctccccagcaagtgagagctgg

SEQ ID NO: 2845799 - DNA, 18 bp, Homo sapiens
ctccccaggactcaccct

SEQ ID NO: 2845800 - DNA, 12 bp, Homo sapiens
ctccccaggcca

SEQ ID NO: 2845801 - DNA, 11 bp, Homo sapiens
ctccccagggg

SEQ ID NO: 2845802 - DNA, 15 bp, Homo sapiens
ctccccattcacaga

SEQ ID NO: 2845803 - DNA, 16 bp, Homo sapiens
ctccccccactgcagg

SEQ ID NO: 2845804 - DNA, 16 bp, Homo sapiens
ctccccgcagagctcc

SEQ ID NO: 2845805 - DNA, 18 bp, Homo sapiens
ctcccctatccacccagc

SEQ ID NO: 2845806 - DNA, 19 bp, Homo sapiens
ctcccctatccacccagcc

SEQ ID NO: 2845807 - DNA, 15 bp, Homo sapiens
ctcccctgccctgct

SEQ ID NO: 2845808 - DNA, 11 bp, Homo sapiens
ctccccttcct

SEQ ID NO: 2845809 - DNA, 13 bp, Homo sapiens
ctccccttcctgc

SEQ ID NO: 2845810 - DNA, 15 bp, Homo sapiens
ctccccttcctgcac

SEQ ID NO: 2845811 - DNA, 16 bp, Homo sapiens
ctccccttcctgcacc

SEQ ID NO: 2845812 - DNA, 22 bp, Homo sapiens
ctcattcaggaaaactgacaga

SEQ ID NO: 2845813 - DNA, 14 bp, Homo sapiens
ctcattcccctcgt

SEQ ID NO: 2845814 - DNA, 14 bp, Homo sapiens
ctcattcttctgta

SEQ ID NO: 2845815 - DNA, 15 bp, Homo sapiens
ctcatttcatctcat

SEQ ID NO: 2845816 - DNA, 22 bp, Homo sapiens
ctccaaaggaagtctaggagct

SEQ ID NO: 2845817 - DNA, 18 bp, Homo sapiens
ctccaacaataaagagct

SEQ ID NO: 2845818 - DNA, 18 bp, Homo sapiens
ctccaactggattataaa

SEQ ID NO: 2845819 - DNA, 13 bp, Homo sapiens
ctccaagcttcaa

SEQ ID NO: 2845820 - DNA, 14 bp, Homo sapiens
ctccaaggaccagg

SEQ ID NO: 2845821 - DNA, 15 bp, Homo sapiens
ctccaaggaccaggt

SEQ ID NO: 2845822 - DNA, 21 bp, Homo sapiens
ctccaattccacagtctctgg

SEQ ID NO: 2845823 - DNA, 14 bp, Homo sapiens
ctccacagccgcag

SEQ ID NO: 2845824 - DNA, 14 bp, Homo sapiens
ctccacagtagcat

SEQ ID NO: 2845825 - DNA, 13 bp, Homo sapiens
ctccaccaaccca

SEQ ID NO: 2845826 - DNA, 11 bp, Homo sapiens
ctccaccccag

SEQ ID NO: 2845827 - DNA, 12 bp, Homo sapiens
ctccaccccagg

SEQ ID NO: 2845828 - DNA, 14 bp, Homo sapiens
ctccaccctgagcc

SEQ ID NO: 2845829 - DNA, 13 bp, Homo sapiens
ctccaccctgctc

SEQ ID NO: 2845830 - DNA, 15 bp, Homo sapiens
ctccaccctgctctc

SEQ ID NO: 2845831 - DNA, 19 bp, Homo sapiens
ctccaccgctgcctaagtg

SEQ ID NO: 2845832 - DNA, 12 bp, Homo sapiens
ctccacctcagc

SEQ ID NO: 2845833 - DNA, 13 bp, Homo sapiens
ctccacctgttca

SEQ ID NO: 2845834 - DNA, 18 bp, Homo sapiens
ctccacctgttcaggagc

SEQ ID NO: 2845835 - DNA, 23 bp, Homo sapiens
ctccacctgttcaggagctgaag

SEQ ID NO: 2845836 - DNA, 22 bp, Homo sapiens
ctccactaaatgagctcctgcg

SEQ ID NO: 2845837 - DNA, 17 bp, Homo sapiens
ctccactgctctcagcc

SEQ ID NO: 2845838 - DNA, 21 bp, Homo sapiens
ctccagaataccttcttcgct

SEQ ID NO: 2845839 - DNA, 24 bp, Homo sapiens
ctccagccagcaatgatgtccaga

SEQ ID NO: 2845840 - DNA, 12 bp, Homo sapiens
ctccagccagcg

SEQ ID NO: 2845841 - DNA, 13 bp, Homo sapiens
ctccagccagcgc

SEQ ID NO: 2845842 - DNA, 20 bp, Homo sapiens
ctccagccatcaagagactg

SEQ ID NO: 2845843 - DNA, 21 bp, Homo sapiens
ctccagccatcaagagactga

SEQ ID NO: 2845844 - DNA, 14 bp, Homo sapiens
ctccagccttctct

SEQ ID NO: 2845845 - DNA, 11 bp, Homo sapiens
ctccagctgga

SEQ ID NO: 2845846 - DNA, 23 bp, Homo sapiens
ctccagcttcccctcgctgtcct

SEQ ID NO: 2845847 - DNA, 16 bp, Homo sapiens
ctccagctttcctgta

SEQ ID NO: 2845848 - DNA, 11 bp, Homo sapiens
ctccaggaagg

SEQ ID NO: 2845849 - DNA, 23 bp, Homo sapiens
ctccaggaaggtagcccagcact

SEQ ID NO: 2845850 - DNA, 16 bp, Homo sapiens
ctccaggagcctaccc

SEQ ID NO: 2845851 - DNA, 15 bp, Homo sapiens
ctccaggcatgctgg

SEQ ID NO: 2845852 - DNA, 16 bp, Homo sapiens
ctccaggcatgctggc

SEQ ID NO: 2845853 - DNA, 17 bp, Homo sapiens
ctccaggcatgctggcc

SEQ ID NO: 2845854 - DNA, 23 bp, Homo sapiens
ctccaggcatgctggcctcccaa

SEQ ID NO: 2845855 - DNA, 23 bp, Homo sapiens
ctccagggccacgtgccaggccc

SEQ ID NO: 2845856 - DNA, 13 bp, Homo sapiens
ctccagggctgcc

SEQ ID NO: 2845857 - DNA, 23 bp, Homo sapiens
ctccagtagtggacaacaggttt

SEQ ID NO: 2845858 - DNA, 16 bp, Homo sapiens
ctccagtatggaagaa

SEQ ID NO: 2845859 - DNA, 15 bp, Homo sapiens
ctccagtggttgctg

SEQ ID NO: 2845860 - DNA, 17 bp, Homo sapiens
ctccagttttcagttga

SEQ ID NO: 2845861 - DNA, 18 bp, Homo sapiens
ctccatcccgcccttccc

SEQ ID NO: 2845862 - DNA, 22 bp, Homo sapiens
ctccatcccgcccttcccacag

SEQ ID NO: 2845863 - DNA, 16 bp, Homo sapiens
ctccatctggcagggt

SEQ ID NO: 2845864 - DNA, 11 bp, Homo sapiens
ctccatttctg

SEQ ID NO: 2845865 - DNA, 17 bp, Homo sapiens
ctcccaaccccagggcc

SEQ ID NO: 2845866 - DNA, 20 bp, Homo sapiens
ctcccaccaccctcccacca

SEQ ID NO: 2845867 - DNA, 22 bp, Homo sapiens
ctcccaccaccctcccaccatg

SEQ ID NO: 2845868 - DNA, 20 bp, Homo sapiens
ctcccaccatgcgctgctca

SEQ ID NO: 2845869 - DNA, 13 bp, Homo sapiens
ctcccaccccacc

SEQ ID NO: 2845870 - DNA, 22 bp, Homo sapiens
ctcccaccccacccccttcagt

SEQ ID NO: 2845871 - DNA, 18 bp, Homo sapiens
ctcccaccccatgcatta

SEQ ID NO: 2845872 - DNA, 13 bp, Homo sapiens
ctcccacccccag

SEQ ID NO: 2845873 - DNA, 14 bp, Homo sapiens
ctcccacccccagc

SEQ ID NO: 2845874 - DNA, 12 bp, Homo sapiens
ctcccacctcag

SEQ ID NO: 2845875 - DNA, 21 bp, Homo sapiens
ctcccagcaacacaagctgga

SEQ ID NO: 2845876 - DNA, 19 bp, Homo sapiens
ctcccagccctatggatgt

SEQ ID NO: 2845877 - DNA, 16 bp, Homo sapiens
ctcccaggagacagtt

SEQ ID NO: 2845878 - DNA, 19 bp, Homo sapiens
ctcccaggagacagttcaa

SEQ ID NO: 2845879 - DNA, 15 bp, Homo sapiens
ctcccaggccccatg

SEQ ID NO: 2845880 - DNA, 19 bp, Homo sapiens
ctcccagggccagggccct

SEQ ID NO: 2845881 - DNA, 14 bp, Homo sapiens
ctcccatttcctga

SEQ ID NO: 2845882 - DNA, 23 bp, Homo sapiens
ctccccaccttcaattcctgggc

SEQ ID NO: 2845883 - DNA, 12 bp, Homo sapiens
ctccccactctg

SEQ ID NO: 2845884 - DNA, 19 bp, Homo sapiens
ctccccactctgctctgat

SEQ ID NO: 2845885 - DNA, 21 bp, Homo sapiens
ctccccagcaagtgagagctg

SEQ ID NO: 2845886 - DNA, 19 bp, Homo sapiens
ctagccctctcacatttat

SEQ ID NO: 2845887 - DNA, 14 bp, Homo sapiens
ctagccgacctcag

SEQ ID NO: 2845888 - DNA, 15 bp, Homo sapiens
ctagccgacctcagc

SEQ ID NO: 2845889 - DNA, 18 bp, Homo sapiens
ctagccgacctcagcctt

SEQ ID NO: 2845890 - DNA, 19 bp, Homo sapiens
ctagccgacctcagccttc

SEQ ID NO: 2845891 - DNA, 19 bp, Homo sapiens
ctagcctggcaacagagca

SEQ ID NO: 2845892 - DNA, 16 bp, Homo sapiens
ctagcgctgccgcacc

SEQ ID NO: 2845893 - DNA, 19 bp, Homo sapiens
ctagctagaagtgggccag

SEQ ID NO: 2845894 - DNA, 14 bp, Homo sapiens
ctaggactctgagg

SEQ ID NO: 2845895 - DNA, 18 bp, Homo sapiens
ctaggacttgagcctcca

SEQ ID NO: 2845896 - DNA, 17 bp, Homo sapiens
ctaggagcaaagcctgt

SEQ ID NO: 2845897 - DNA, 20 bp, Homo sapiens
ctaggagcaaagcctgttca

SEQ ID NO: 2845898 - DNA, 19 bp, Homo sapiens
ctaggagctgggaggaaaa

SEQ ID NO: 2845899 - DNA, 13 bp, Homo sapiens
ctaggatttcatg

SEQ ID NO: 2845900 - DNA, 19 bp, Homo sapiens
ctaggccactcctccaaag

SEQ ID NO: 2845901 - DNA, 13 bp, Homo sapiens
ctaggcctggcca

SEQ ID NO: 2845902 - DNA, 19 bp, Homo sapiens
ctaggcctggccagatgca

SEQ ID NO: 2845903 - DNA, 17 bp, Homo sapiens
ctaggcgagtgccagga

SEQ ID NO: 2845904 - DNA, 18 bp, Homo sapiens
ctaggcgagtgccaggac

SEQ ID NO: 2845905 - DNA, 19 bp, Homo sapiens
ctaggcgagtgccaggact

SEQ ID NO: 2845906 - DNA, 13 bp, Homo sapiens
ctaggctccaccc

SEQ ID NO: 2845907 - DNA, 10 bp, Homo sapiens
ctagggagcc

SEQ ID NO: 2845908 - DNA, 16 bp, Homo sapiens
ctagggagtggtcttt

SEQ ID NO: 2845909 - DNA, 11 bp, Homo sapiens
ctagggctgga

SEQ ID NO: 2845910 - DNA, 16 bp, Homo sapiens
ctaggggtcaggctcc

SEQ ID NO: 2845911 - DNA, 18 bp, Homo sapiens
ctaggggtcaggctccat

SEQ ID NO: 2845912 - DNA, 12 bp, Homo sapiens
cgtgtccagcac

SEQ ID NO: 2845913 - DNA, 15 bp, Homo sapiens
cgtgtccctctcgga

SEQ ID NO: 2845914 - DNA, 18 bp, Homo sapiens
cgtgtgcagactgtggct

SEQ ID NO: 2845915 - DNA, 15 bp, Homo sapiens
cgttaaaagacagtg

SEQ ID NO: 2845916 - DNA, 20 bp, Homo sapiens
cgttaacactacttaaaagt

SEQ ID NO: 2845917 - DNA, 19 bp, Homo sapiens
cgttcaacttttcctttga

SEQ ID NO: 2845918 - DNA, 18 bp, Homo sapiens
cgttccttactgcagaat

SEQ ID NO: 2845919 - DNA, 12 bp, Homo sapiens
cgttctgctgcc

SEQ ID NO: 2845920 - DNA, 20 bp, Homo sapiens
cgttctgctgcccctgcagt

SEQ ID NO: 2845921 - DNA, 17 bp, Homo sapiens
cgtttaagccaaaacaa

SEQ ID NO: 2845922 - DNA, 18 bp, Homo sapiens
cgtttaagccaaaacaat

SEQ ID NO: 2845923 - DNA, 20 bp, Homo sapiens
cgtttattaatgcctctccc

SEQ ID NO: 2845924 - DNA, 15 bp, Homo sapiens
cgttttggaagctct

SEQ ID NO: 2845925 - DNA, 21 bp, Homo sapiens
cgtttttcaagaaaactggaa

SEQ ID NO: 2845926 - DNA, 15 bp, Homo sapiens
ctaaaaagtggctaa

SEQ ID NO: 2845927 - DNA, 17 bp, Homo sapiens
ctaaaaataaaatgatg

SEQ ID NO: 2845928 - DNA, 14 bp, Homo sapiens
ctaaaataaaaacc

SEQ ID NO: 2845929 - DNA, 15 bp, Homo sapiens
ctaaaataaaaacca

SEQ ID NO: 2845930 - DNA, 19 bp, Homo sapiens
ctaaaataaaaaccagaat

SEQ ID NO: 2845931 - DNA, 13 bp, Homo sapiens
ctaaaatagccac

SEQ ID NO: 2845932 - DNA, 15 bp, Homo sapiens
ctaaaatatttattt

SEQ ID NO: 2845933 - DNA, 13 bp, Homo sapiens
ctaaacagatata

SEQ ID NO: 2845934 - DNA, 17 bp, Homo sapiens
ctaaacattttgttatt

SEQ ID NO: 2845935 - DNA, 17 bp, Homo sapiens
ctaaacccaaataaatg

SEQ ID NO: 2845936 - DNA, 17 bp, Homo sapiens
ctaaagaaaaacaaact

SEQ ID NO: 2845937 - DNA, 20 bp, Homo sapiens
ctaaagaaaaacaaactcgt

SEQ ID NO: 2845938 - DNA, 17 bp, Homo sapiens
ctaaagcagtgttttca

SEQ ID NO: 2845939 - DNA, 12 bp, Homo sapiens
cctgctcccagc

SEQ ID NO: 2845940 - DNA, 16 bp, Homo sapiens
aacaggtggcaggacc

SEQ ID NO: 2845941 - DNA, 16 bp, Homo sapiens
aacaggttttataatt

SEQ ID NO: 2845942 - DNA, 13 bp, Homo sapiens
aacagtgagcctg

SEQ ID NO: 2845943 - DNA, 12 bp, Homo sapiens
aacagtgcctgc

SEQ ID NO: 2845944 - DNA, 15 bp, Homo sapiens
aacagtgctgttctg

SEQ ID NO: 2845945 - DNA, 13 bp, Homo sapiens
aacagttaacttt

SEQ ID NO: 2845946 - DNA, 17 bp, Homo sapiens
aacagttaactttcaga

SEQ ID NO: 2845947 - DNA, 17 bp, Homo sapiens
aacagttcaaagaagtc

SEQ ID NO: 2845948 - DNA, 14 bp, Homo sapiens
aacagtttgtacag

SEQ ID NO: 2845949 - DNA, 14 bp, Homo sapiens
aacataaaaatgat

SEQ ID NO: 2845950 - DNA, 17 bp, Homo sapiens
aacatacccttctttaa

SEQ ID NO: 2845951 - DNA, 21 bp, Homo sapiens
aacatacccttctttaaatca

SEQ ID NO: 2845952 - DNA, 19 bp, Homo sapiens
aacatagacagaagaaaca

SEQ ID NO: 2845953 - DNA, 13 bp, Homo sapiens
aacatataatgtt

SEQ ID NO: 2845954 - DNA, 14 bp, Homo sapiens
aacatatcaattca

SEQ ID NO: 2845955 - DNA, 17 bp, Homo sapiens
aacatatcaattcaaca

SEQ ID NO: 2845956 - DNA, 22 bp, Homo sapiens
aacatatcaattcaacacatta

SEQ ID NO: 2845957 - DNA, 13 bp, Homo sapiens
aacatatcatttt

SEQ ID NO: 2845958 - DNA, 20 bp, Homo sapiens
aacatatttgttaaatattt

SEQ ID NO: 2845959 - DNA, 22 bp, Homo sapiens
aacatatttgttaaatatttac

SEQ ID NO: 2845960 - DNA, 19 bp, Homo sapiens
aacatcatcaggcttggaa

SEQ ID NO: 2845961 - DNA, 19 bp, Homo sapiens
aacatccaaggagaaacag

SEQ ID NO: 2845962 - DNA, 19 bp, Homo sapiens
aacatcctccaattccaca

SEQ ID NO: 2845963 - DNA, 21 bp, Homo sapiens
aacatctattataaaaccatg

SEQ ID NO: 2845964 - DNA, 22 bp, Homo sapiens
aacatctattataaaaccatgt

SEQ ID NO: 2845965 - DNA, 15 bp, Homo sapiens
aacatctcactttgc

SEQ ID NO: 2845966 - DNA, 16 bp, Homo sapiens
aacatctgaaagccac

SEQ ID NO: 2845967 - DNA, 17 bp, Homo sapiens
aacatgagaaatgtgaa

SEQ ID NO: 2845968 - DNA, 23 bp, Homo sapiens
aacatgagaaatgtgaactgtga

SEQ ID NO: 2845969 - DNA, 17 bp, Homo sapiens
aacatgagtttatggga

SEQ ID NO: 2845970 - DNA, 14 bp, Homo sapiens
aacatgcacattta

SEQ ID NO: 2845971 - DNA, 14 bp, Homo sapiens
aacatgcctgattt

SEQ ID NO: 2845972 - DNA, 21 bp, Homo sapiens
aacattaaaagaagactggaa

SEQ ID NO: 2845973 - DNA, 13 bp, Homo sapiens
aacattaaacact

SEQ ID NO: 2845974 - DNA, 19 bp, Homo sapiens
aacatttacaataaatatt

SEQ ID NO: 2845975 - DNA, 21 bp, Homo sapiens
aacatttacaataaatattct

SEQ ID NO: 2845976 - DNA, 18 bp, Homo sapiens
aacatttatctaaaagaa

SEQ ID NO: 2845977 - DNA, 14 bp, Homo sapiens
aacatttgtacatt

SEQ ID NO: 2845978 - DNA, 21 bp, Homo sapiens
aaccaaaagaacaagaatttc

SEQ ID NO: 2845979 - DNA, 18 bp, Homo sapiens
aaccaatcccgtgaaaga

SEQ ID NO: 2845980 - DNA, 19 bp, Homo sapiens
aaccaatgattcataacaa

SEQ ID NO: 2845981 - DNA, 22 bp, Homo sapiens
aaccaatgattcataacaatgt

SEQ ID NO: 2845982 - DNA, 19 bp, Homo sapiens
aaccacaaccaggaagaac

SEQ ID NO: 2845983 - DNA, 18 bp, Homo sapiens
aaccacatcttgctctgc

SEQ ID NO: 2845984 - DNA, 20 bp, Homo sapiens
aaccacatcttgctctgctg

SEQ ID NO: 2845985 - DNA, 22 bp, Homo sapiens
aaccacatcttgctctgctgac

SEQ ID NO: 2845986 - DNA, 21 bp, Homo sapiens
aaccaccacacccagcccact

SEQ ID NO: 2845987 - DNA, 19 bp, Homo sapiens
aaccacctaatcaggctga

SEQ ID NO: 2845988 - DNA, 21 bp, Homo sapiens
aaccacgtgttttgacatcat

SEQ ID NO: 2845989 - DNA, 11 bp, Homo sapiens
aaccactttgc

SEQ ID NO: 2845990 - DNA, 17 bp, Homo sapiens
aaccagagccccccaca

SEQ ID NO: 2845991 - DNA, 20 bp, Homo sapiens
aaccagagccccccacaatg

SEQ ID NO: 2845992 - DNA, 13 bp, Homo sapiens
aaccagcagaaaa

SEQ ID NO: 2845993 - DNA, 18 bp, Homo sapiens
aaccagcagaaaagtgct

SEQ ID NO: 2845994 - DNA, 14 bp, Homo sapiens
aaccagcattttac

SEQ ID NO: 2845995 - DNA, 14 bp, Homo sapiens
aaccagccacacag

SEQ ID NO: 2845996 - DNA, 21 bp, Homo sapiens
aaccagggagcccctttgatg

SEQ ID NO: 2845997 - DNA, 14 bp, Homo sapiens
aaccagtgtagcct

SEQ ID NO: 2845998 - DNA, 18 bp, Homo sapiens
aaccataacaacttcata

SEQ ID NO: 2845999 - DNA, 22 bp, Homo sapiens
aaccatgagaccactgttatca

SEQ ID NO: 2846000 - DNA, 19 bp, Homo sapiens
aaccatgcaaatgctatga

SEQ ID NO: 2846001 - DNA, 18 bp, Homo sapiens
aaccatttaattcataat

SEQ ID NO: 2846002 - DNA, 19 bp, Homo sapiens
aaccatttaattcataatt

SEQ ID NO: 2846003 - DNA, 21 bp, Homo sapiens
aaccatttaattcataattag

SEQ ID NO: 2846004 - DNA, 21 bp, Homo sapiens
aaccattttagttcctttatt

SEQ ID NO: 2846005 - DNA, 14 bp, Homo sapiens
aacccaaaacctca

SEQ ID NO: 2846006 - DNA, 21 bp, Homo sapiens
aacccactgtgcttacagtga

SEQ ID NO: 2846007 - DNA, 23 bp, Homo sapiens
aacccactgtgcttacagtgact

SEQ ID NO: 2846008 - DNA, 16 bp, Homo sapiens
aacccaggacctctgg

SEQ ID NO: 2846009 - DNA, 19 bp, Homo sapiens
aaccccaccttgccaagct

SEQ ID NO: 2846010 - DNA, 20 bp, Homo sapiens
aaccccagggcccccacagg

SEQ ID NO: 2846011 - DNA, 16 bp, Homo sapiens
aaccccagttctgctc

SEQ ID NO: 2846012 - DNA, 13 bp, Homo sapiens
aacccccagcctg

SEQ ID NO: 2846013 - DNA, 19 bp, Homo sapiens
aacccccagtgccacagag

SEQ ID NO: 2846014 - DNA, 18 bp, Homo sapiens
aacccgtggaggctgctc

SEQ ID NO: 2846015 - DNA, 16 bp, Homo sapiens
aaccctgttttatact

SEQ ID NO: 2846016 - DNA, 20 bp, Homo sapiens
aaccctgttttatactgtac

SEQ ID NO: 2846017 - DNA, 14 bp, Homo sapiens
aaccgcttgccata

SEQ ID NO: 2846018 - DNA, 19 bp, Homo sapiens
aaccgtggcccttcctgga

SEQ ID NO: 2846019 - DNA, 16 bp, Homo sapiens
aaccgtgtccagcaca

SEQ ID NO: 2846020 - DNA, 14 bp, Homo sapiens
aaccgtttttcaag

SEQ ID NO: 2846021 - DNA, 22 bp, Homo sapiens
aacctaaatttggttctaggcc

SEQ ID NO: 2846022 - DNA, 20 bp, Homo sapiens
aacctaccaccccttcctgt

SEQ ID NO: 2846023 - DNA, 11 bp, Homo sapiens
aacctcaaact

SEQ ID NO: 2846024 - DNA, 19 bp, Homo sapiens
aacctcagtgtcatttatg

SEQ ID NO: 2846025 - DNA, 16 bp, Homo sapiens
aacctctctccttctg

SEQ ID NO: 2846026 - DNA, 17 bp, Homo sapiens
aacctgaattattccaa

SEQ ID NO: 2846027 - DNA, 22 bp, Homo sapiens
aacctgaggatgcaacaaatat

SEQ ID NO: 2846028 - DNA, 17 bp, Homo sapiens
aacctgatgttaaaatt

SEQ ID NO: 2846029 - DNA, 12 bp, Homo sapiens
aacctggccttc

SEQ ID NO: 2846030 - DNA, 14 bp, Homo sapiens
aagctgctgacagt

SEQ ID NO: 2846031 - DNA, 16 bp, Homo sapiens
aagctgctgacagtgt

SEQ ID NO: 2846032 - DNA, 21 bp, Homo sapiens
aagctgctgagaatctagcct

SEQ ID NO: 2846033 - DNA, 19 bp, Homo sapiens
aagctggacaagaagctgc

SEQ ID NO: 2846034 - DNA, 20 bp, Homo sapiens
aagctggacaagaagctgct

SEQ ID NO: 2846035 - DNA, 15 bp, Homo sapiens
aagctgggggaaggg

SEQ ID NO: 2846036 - DNA, 19 bp, Homo sapiens
aagctgtttatttattcac

SEQ ID NO: 2846037 - DNA, 14 bp, Homo sapiens
aagcttaaaacttt

SEQ ID NO: 2846038 - DNA, 15 bp, Homo sapiens
aagcttaaaactttg

SEQ ID NO: 2846039 - DNA, 15 bp, Homo sapiens
aagcttcaagtgata

SEQ ID NO: 2846040 - DNA, 19 bp, Homo sapiens
aagcttcaagtgatatatg

SEQ ID NO: 2846041 - DNA, 13 bp, Homo sapiens
aagcttgtatata

SEQ ID NO: 2846042 - DNA, 19 bp, Homo sapiens
aagcttgtatatacatatt

SEQ ID NO: 2846043 - DNA, 18 bp, Homo sapiens
aaggaactctggcttcca

SEQ ID NO: 2846044 - DNA, 22 bp, Homo sapiens
aaggaactctggcttccaggta

SEQ ID NO: 2846045 - DNA, 16 bp, Homo sapiens
aaggaaggaaagaaag

SEQ ID NO: 2846046 - DNA, 20 bp, Homo sapiens
aaggaaggagactcacctct

SEQ ID NO: 2846047 - DNA, 17 bp, Homo sapiens
aaggaaggttttctcca

SEQ ID NO: 2846048 - DNA, 14 bp, Homo sapiens
aaggaagtgaagag

SEQ ID NO: 2846049 - DNA, 17 bp, Homo sapiens
aaggaatctccagtttt

SEQ ID NO: 2846050 - DNA, 15 bp, Homo sapiens
aaggaattctaggca

SEQ ID NO: 2846051 - DNA, 14 bp, Homo sapiens
aaggacacactaat

SEQ ID NO: 2846052 - DNA, 15 bp, Homo sapiens
aaggaccctggctct

SEQ ID NO: 2846053 - DNA, 16 bp, Homo sapiens
aaggaccgtttttact

SEQ ID NO: 2846054 - DNA, 21 bp, Homo sapiens
aaggacggccttcaactgaaa

SEQ ID NO: 2846055 - DNA, 21 bp, Homo sapiens
aaggactacgttaagggaagg

SEQ ID NO: 2846056 - DNA, 21 bp, Homo sapiens
aaggactatgaaaagctagaa

SEQ ID NO: 2846057 - DNA, 19 bp, Homo sapiens
aaggagaaacagagacagg

SEQ ID NO: 2846058 - DNA, 23 bp, Homo sapiens
aaggagactcacctctgcctcaa

SEQ ID NO: 2846059 - DNA, 14 bp, Homo sapiens
aaggagatcagggc

SEQ ID NO: 2846060 - DNA, 19 bp, Homo sapiens
aaggagcccagaaaacctc

SEQ ID NO: 2846061 - DNA, 13 bp, Homo sapiens
aaggagcctgtga

SEQ ID NO: 2846062 - DNA, 22 bp, Homo sapiens
aaggagcctgtgaacccaggac

SEQ ID NO: 2846063 - DNA, 11 bp, Homo sapiens
aaggaggaaaa

SEQ ID NO: 2846064 - DNA, 18 bp, Homo sapiens
aaggagggttagggaggg

SEQ ID NO: 2846065 - DNA, 18 bp, Homo sapiens
aaggaggtagctcccagc

SEQ ID NO: 2846066 - DNA, 15 bp, Homo sapiens
aaggaggtgagggat

SEQ ID NO: 2846067 - DNA, 19 bp, Homo sapiens
aaggaggtgagggatgtga

SEQ ID NO: 2846068 - DNA, 20 bp, Homo sapiens
aaggagttccatgaagacca

SEQ ID NO: 2846069 - DNA, 16 bp, Homo sapiens
aaggatctctcaggag

SEQ ID NO: 2846070 - DNA, 22 bp, Homo sapiens
aaggatctctcaggagcacagg

SEQ ID NO: 2846071 - DNA, 17 bp, Homo sapiens
aaggatgtaaacagtgc

SEQ ID NO: 2846072 - DNA, 19 bp, Homo sapiens
aaggatgtaaacagtgcct

SEQ ID NO: 2846073 - DNA, 20 bp, Homo sapiens
aaggatgtaaacagtgcctg

SEQ ID NO: 2846074 - DNA, 21 bp, Homo sapiens
aaggatgttctggctttacat

SEQ ID NO: 2846075 - DNA, 22 bp, Homo sapiens
aaggatgttttgtcccatttcc

SEQ ID NO: 2846076 - DNA, 16 bp, Homo sapiens
aaggattcatgtggaa

SEQ ID NO: 2846077 - DNA, 21 bp, Homo sapiens
aaggattgatcactttgttaa

SEQ ID NO: 2846078 - DNA, 13 bp, Homo sapiens
aaggcaaaaatag

SEQ ID NO: 2846079 - DNA, 20 bp, Homo sapiens
aaggcaaagcacgaaatgtt

SEQ ID NO: 2846080 - DNA, 20 bp, Homo sapiens
aaggcacaaaccttactatg

SEQ ID NO: 2846081 - DNA, 18 bp, Homo sapiens
aaggcacgtttggcattt

SEQ ID NO: 2846082 - DNA, 16 bp, Homo sapiens
aaggcaggcagggctc

SEQ ID NO: 2846083 - DNA, 17 bp, Homo sapiens
aaggcccgagcagctga

SEQ ID NO: 2846084 - DNA, 21 bp, Homo sapiens
aaggcccgagcagctgagcag

SEQ ID NO: 2846085 - DNA, 11 bp, Homo sapiens
aaggcctgggg

SEQ ID NO: 2846086 - DNA, 21 bp, Homo sapiens
aaggcctggggtgacccggca

SEQ ID NO: 2846087 - DNA, 15 bp, Homo sapiens
aaggccttaatatgt

SEQ ID NO: 2846088 - DNA, 18 bp, Homo sapiens
aaggcgggagcatctctt

SEQ ID NO: 2846089 - DNA, 23 bp, Homo sapiens
aaggctacttcggggctgggaag

SEQ ID NO: 2846090 - DNA, 21 bp, Homo sapiens
aaggctagtttattttgttac

SEQ ID NO: 2846091 - DNA, 18 bp, Homo sapiens
aaggctctgaaagccagc

SEQ ID NO: 2846092 - DNA, 11 bp, Homo sapiens
aaggctgctgt

SEQ ID NO: 2846093 - DNA, 21 bp, Homo sapiens
aaggctggctgaaaatcacta

SEQ ID NO: 2846094 - DNA, 15 bp, Homo sapiens
aagggaaaaatatat

SEQ ID NO: 2846095 - DNA, 15 bp, Homo sapiens
aagggaaggctgctg

SEQ ID NO: 2846096 - DNA, 20 bp, Homo sapiens
aagggacttggaagctccgc

SEQ ID NO: 2846097 - DNA, 17 bp, Homo sapiens
aagggagagcggggcag

SEQ ID NO: 2846098 - DNA, 14 bp, Homo sapiens
aagggagggctctg

SEQ ID NO: 2846099 - DNA, 18 bp, Homo sapiens
aagggagggctctgaggc

SEQ ID NO: 2846100 - DNA, 19 bp, Homo sapiens
aagggagggctctgaggcg

SEQ ID NO: 2846101 - DNA, 21 bp, Homo sapiens
aagggagggctctgaggcgcc

SEQ ID NO: 2846102 - DNA, 24 bp, Homo sapiens
aagggatggaggtcacactggtag

SEQ ID NO: 2846103 - DNA, 9 bp, Homo sapiens
aagggccag

SEQ ID NO: 2846104 - DNA, 19 bp, Homo sapiens
aagggccatgctgaaggga

SEQ ID NO: 2846105 - DNA, 15 bp, Homo sapiens
aagggcccagagagg

SEQ ID NO: 2846106 - DNA, 19 bp, Homo sapiens
aaggggcacgcctgcccag

SEQ ID NO: 2846107 - DNA, 19 bp, Homo sapiens
aagggtatcaggtgctgcc

SEQ ID NO: 2846108 - DNA, 17 bp, Homo sapiens
aagggtcaacggccctg

SEQ ID NO: 2846109 - DNA, 17 bp, Homo sapiens
aagggtctagggagaga

SEQ ID NO: 2846110 - DNA, 18 bp, Homo sapiens
aagggtctagggagagac

SEQ ID NO: 2846111 - DNA, 21 bp, Homo sapiens
aagggttttccaccctggaat

SEQ ID NO: 2846112 - DNA, 18 bp, Homo sapiens
aaggtacaagaagcattt

SEQ ID NO: 2846113 - DNA, 18 bp, Homo sapiens
aaggtagcccagcactgt

SEQ ID NO: 2846114 - DNA, 20 bp, Homo sapiens
aaggtagcccagcactgtga

SEQ ID NO: 2846115 - DNA, 12 bp, Homo sapiens
aaggtagttttt

SEQ ID NO: 2846116 - DNA, 22 bp, Homo sapiens
aaggtattaaattgatgttgct

SEQ ID NO: 2846117 - DNA, 11 bp, Homo sapiens
aaggtgcctgt

SEQ ID NO: 2846118 - DNA, 18 bp, Homo sapiens
aaggtgcctgtgaggcag

SEQ ID NO: 2846119 - DNA, 20 bp, Homo sapiens
aaggtgcctgtgaggcaggg

SEQ ID NO: 2846120 - DNA, 20 bp, Homo sapiens
aatatatttaagataattat

SEQ ID NO: 2846121 - DNA, 15 bp, Homo sapiens
aatatatttcagata

SEQ ID NO: 2846122 - DNA, 16 bp, Homo sapiens
aatatattttatgatt

SEQ ID NO: 2846123 - DNA, 22 bp, Homo sapiens
aatatcagttactcagccctgg

SEQ ID NO: 2846124 - DNA, 20 bp, Homo sapiens
aatatctgacagttactctt

SEQ ID NO: 2846125 - DNA, 23 bp, Homo sapiens
aatatctgtgaggtgctgatgag

SEQ ID NO: 2846126 - DNA, 18 bp, Homo sapiens
aatatcttgaagaatatt

SEQ ID NO: 2846127 - DNA, 22 bp, Homo sapiens
aatatgaacaaagaaaaaaata

SEQ ID NO: 2846128 - DNA, 16 bp, Homo sapiens
aatatgatcatgtaaa

SEQ ID NO: 2846129 - DNA, 16 bp, Homo sapiens
aatatgatgttaaaaa

SEQ ID NO: 2846130 - DNA, 22 bp, Homo sapiens
aatatgctgccaaattttggcc

SEQ ID NO: 2846131 - DNA, 20 bp, Homo sapiens
aatattaatcccagccctac

SEQ ID NO: 2846132 - DNA, 12 bp, Homo sapiens
aatattcctgaa

SEQ ID NO: 2846133 - DNA, 15 bp, Homo sapiens
aatattcctgaatga

SEQ ID NO: 2846134 - DNA, 12 bp, Homo sapiens
aatattgatttc

SEQ ID NO: 2846135 - DNA, 9 bp, Homo sapiens
aatattgtg

SEQ ID NO: 2846136 - DNA, 13 bp, Homo sapiens
aatatttaagtat

SEQ ID NO: 2846137 - DNA, 18 bp, Homo sapiens
aatatttaagtatatagt

SEQ ID NO: 2846138 - DNA, 19 bp, Homo sapiens
aatatttaagtatatagta

SEQ ID NO: 2846139 - DNA, 20 bp, Homo sapiens
aatatttaagtatatagtat

SEQ ID NO: 2846140 - DNA, 12 bp, Homo sapiens
aatatttattac

SEQ ID NO: 2846141 - DNA, 13 bp, Homo sapiens
aatatttattacc

SEQ ID NO: 2846142 - DNA, 17 bp, Homo sapiens
aatatttattacctctg

SEQ ID NO: 2846143 - DNA, 12 bp, Homo sapiens
aatatttattat

SEQ ID NO: 2846144 - DNA, 14 bp, Homo sapiens
aatatttgtacata

SEQ ID NO: 2846145 - DNA, 18 bp, Homo sapiens
aatcaaaactctcctaca

SEQ ID NO: 2846146 - DNA, 12 bp, Homo sapiens
aatcaaaagctg

SEQ ID NO: 2846147 - DNA, 14 bp, Homo sapiens
aatcaaaagctgct

SEQ ID NO: 2846148 - DNA, 16 bp, Homo sapiens
aatcaaaagctgcttg

SEQ ID NO: 2846149 - DNA, 19 bp, Homo sapiens
aatcaaaagctgcttgact

SEQ ID NO: 2846150 - DNA, 18 bp, Homo sapiens
aatcaactttccttaaaa

SEQ ID NO: 2846151 - DNA, 12 bp, Homo sapiens
aatcaataaaaa

SEQ ID NO: 2846152 - DNA, 20 bp, Homo sapiens
aatcaatctatcaattacag

SEQ ID NO: 2846153 - DNA, 18 bp, Homo sapiens
aatcacgctttttgaaaa

SEQ ID NO: 2846154 - DNA, 17 bp, Homo sapiens
aatcactatctttctga

SEQ ID NO: 2846155 - DNA, 18 bp, Homo sapiens
aatcactatctttctgat

SEQ ID NO: 2846156 - DNA, 13 bp, Homo sapiens
aatcactgaggca

SEQ ID NO: 2846157 - DNA, 16 bp, Homo sapiens
aatcagatagatattc

SEQ ID NO: 2846158 - DNA, 17 bp, Homo sapiens
aatcagctgcagctgct

SEQ ID NO: 2846159 - DNA, 18 bp, Homo sapiens
aatcagcttttaataaaa

SEQ ID NO: 2846160 - DNA, 21 bp, Homo sapiens
aatcagcttttaataaaattg

SEQ ID NO: 2846161 - DNA, 16 bp, Homo sapiens
aatcaggattttagtg

SEQ ID NO: 2846162 - DNA, 18 bp, Homo sapiens
aatcaggattttagtgct

SEQ ID NO: 2846163 - DNA, 18 bp, Homo sapiens
aatcagggaggtcatttt

SEQ ID NO: 2846164 - DNA, 19 bp, Homo sapiens
aatcagggaggtcattttg

SEQ ID NO: 2846165 - DNA, 21 bp, Homo sapiens
aatcatataataaatgtacat

SEQ ID NO: 2846166 - DNA, 19 bp, Homo sapiens
aatcatgaatatttcaaaa

SEQ ID NO: 2846167 - DNA, 16 bp, Homo sapiens
aatcatgatctgactt

SEQ ID NO: 2846168 - DNA, 17 bp, Homo sapiens
aatcattttaattatta

SEQ ID NO: 2846169 - DNA, 22 bp, Homo sapiens
aatcattttaattattattctt

SEQ ID NO: 2846170 - DNA, 23 bp, Homo sapiens
aatccaagcgaggtcaacagaga

SEQ ID NO: 2846171 - DNA, 19 bp, Homo sapiens
aatccagtgtgcacccctc

SEQ ID NO: 2846172 - DNA, 20 bp, Homo sapiens
aatccagtgtgcacccctcc

SEQ ID NO: 2846173 - DNA, 19 bp, Homo sapiens
aatccatgttagtttttac

SEQ ID NO: 2846174 - DNA, 14 bp, Homo sapiens
aatcccagctactc

SEQ ID NO: 2846175 - DNA, 17 bp, Homo sapiens
aatccccaagctggcag

SEQ ID NO: 2846176 - DNA, 21 bp, Homo sapiens
aatcccttaatatcctaaaca

SEQ ID NO: 2846177 - DNA, 16 bp, Homo sapiens
aatcctaacacattat

SEQ ID NO: 2846178 - DNA, 13 bp, Homo sapiens
aatcctgtccctc

SEQ ID NO: 2846179 - DNA, 20 bp, Homo sapiens
aatcctgttacttaaatagc

SEQ ID NO: 2846180 - DNA, 13 bp, Homo sapiens
aatccttgcttat

SEQ ID NO: 2846181 - DNA, 18 bp, Homo sapiens
aatccttgcttatgacat

SEQ ID NO: 2846182 - DNA, 16 bp, Homo sapiens
aatcgaaatgaattta

SEQ ID NO: 2846183 - DNA, 16 bp, Homo sapiens
aatcgagtctacctct

SEQ ID NO: 2846184 - DNA, 14 bp, Homo sapiens
aatcgattggcttt

SEQ ID NO: 2846185 - DNA, 18 bp, Homo sapiens
aatcggagcgaagcagag

SEQ ID NO: 2846186 - DNA, 18 bp, Homo sapiens
aatcggcccacagctccc

SEQ ID NO: 2846187 - DNA, 15 bp, Homo sapiens
aatcggttcatcaat

SEQ ID NO: 2846188 - DNA, 16 bp, Homo sapiens
aatcgttatgtgtgta

SEQ ID NO: 2846189 - DNA, 13 bp, Homo sapiens
aatctatctatat

SEQ ID NO: 2846190 - DNA, 19 bp, Homo sapiens
aatctattcagacaagcaa

SEQ ID NO: 2846191 - DNA, 18 bp, Homo sapiens
aatctccagggctgcccc

SEQ ID NO: 2846192 - DNA, 15 bp, Homo sapiens
aatctcctcttttat

SEQ ID NO: 2846193 - DNA, 20 bp, Homo sapiens
aatctctgtgactcgcttag

SEQ ID NO: 2846194 - DNA, 20 bp, Homo sapiens
aatctgaagctattgatgtt

SEQ ID NO: 2846195 - DNA, 18 bp, Homo sapiens
aatctgcattattggaat

SEQ ID NO: 2846196 - DNA, 20 bp, Homo sapiens
aatctggactcctctgtcca

SEQ ID NO: 2846197 - DNA, 16 bp, Homo sapiens
aatctggcaaagttat

SEQ ID NO: 2846198 - DNA, 18 bp, Homo sapiens
aatctggcaaagttatat

SEQ ID NO: 2846199 - DNA, 15 bp, Homo sapiens
aatctgtagggctgg

SEQ ID NO: 2846200 - DNA, 16 bp, Homo sapiens
aatctgtagggctgga

SEQ ID NO: 2846201 - DNA, 15 bp, Homo sapiens
aatcttaaaagtgta

SEQ ID NO: 2846202 - DNA, 19 bp, Homo sapiens
aatcttggttgatgccaaa

SEQ ID NO: 2846203 - DNA, 17 bp, Homo sapiens
aatgaaaaattctcagt

SEQ ID NO: 2846204 - DNA, 23 bp, Homo sapiens
aatgaaaatgtcagaaaccagtt

SEQ ID NO: 2846205 - DNA, 16 bp, Homo sapiens
aatgaaacaaagagtt

SEQ ID NO: 2846206 - DNA, 23 bp, Homo sapiens
aatgaaacaaagagttcaagaaa

SEQ ID NO: 2846207 - DNA, 17 bp, Homo sapiens
aatgaaagcatgtctca

SEQ ID NO: 2846208 - DNA, 14 bp, Homo sapiens
aatgaaatacacaa

SEQ ID NO: 2846209 - DNA, 21 bp, Homo sapiens
aatgaaatcctgcttcagtgt

SEQ ID NO: 2846210 - DNA, 19 bp, Homo sapiens
aatgaaatgctctcctttc

SEQ ID NO: 2846211 - DNA, 14 bp, Homo sapiens
acaactaatcaaga

SEQ ID NO: 2846212 - DNA, 23 bp, Homo sapiens
acaactagatcaaggagcccaga

SEQ ID NO: 2846213 - DNA, 16 bp, Homo sapiens
acaactaggcttcagc

SEQ ID NO: 2846214 - DNA, 14 bp, Homo sapiens
acaacttctttgta

SEQ ID NO: 2846215 - DNA, 13 bp, Homo sapiens
acaagaaagaaac

SEQ ID NO: 2846216 - DNA, 13 bp, Homo sapiens
acaagaagaccag

SEQ ID NO: 2846217 - DNA, 13 bp, Homo sapiens
acaagatctttca

SEQ ID NO: 2846218 - DNA, 15 bp, Homo sapiens
acaagatctttcagg

SEQ ID NO: 2846219 - DNA, 14 bp, Homo sapiens
acaagattcccaga

SEQ ID NO: 2846220 - DNA, 17 bp, Homo sapiens
acaagattcccagagac

SEQ ID NO: 2846221 - DNA, 21 bp, Homo sapiens
acaagattcccagagacagga

SEQ ID NO: 2846222 - DNA, 17 bp, Homo sapiens
acaagcaataattagga

SEQ ID NO: 2846223 - DNA, 14 bp, Homo sapiens
acaagccaacttgt

SEQ ID NO: 2846224 - DNA, 12 bp, Homo sapiens
acaagccacaga

SEQ ID NO: 2846225 - DNA, 13 bp, Homo sapiens
acaagccacagaa

SEQ ID NO: 2846226 - DNA, 18 bp, Homo sapiens
acaagcgtgagccactgc

SEQ ID NO: 2846227 - DNA, 21 bp, Homo sapiens
acaagcgtgagccactgcacc

SEQ ID NO: 2846228 - DNA, 14 bp, Homo sapiens
acaagctaaaatta

SEQ ID NO: 2846229 - DNA, 15 bp, Homo sapiens
acaagcttgtatata

SEQ ID NO: 2846230 - DNA, 21 bp, Homo sapiens
acaagcttgtatatacatatt

SEQ ID NO: 2846231 - DNA, 22 bp, Homo sapiens
acaaggcagcaaggcccgagca

SEQ ID NO: 2846232 - DNA, 18 bp, Homo sapiens
acaaggctgaccaagaga

SEQ ID NO: 2846233 - DNA, 18 bp, Homo sapiens
acaagggtctagggagag

SEQ ID NO: 2846234 - DNA, 20 bp, Homo sapiens
acaaggttccctctgagaat

SEQ ID NO: 2846235 - DNA, 21 bp, Homo sapiens
acaagtagaatggcagctgga

SEQ ID NO: 2846236 - DNA, 23 bp, Homo sapiens
acaagtcattttaactttatcac

SEQ ID NO: 2846237 - DNA, 22 bp, Homo sapiens
acaagttatttaaatctgtttt

SEQ ID NO: 2846238 - DNA, 12 bp, Homo sapiens
acaataaaacat

SEQ ID NO: 2846239 - DNA, 13 bp, Homo sapiens
acaataaagagct

SEQ ID NO: 2846240 - DNA, 14 bp, Homo sapiens
acaataaagagctc

SEQ ID NO: 2846241 - DNA, 22 bp, Homo sapiens
acaataaatattctgcatggaa

SEQ ID NO: 2846242 - DNA, 18 bp, Homo sapiens
acaatagctattgcatgt

SEQ ID NO: 2846243 - DNA, 20 bp, Homo sapiens
acaatagctattgcatgtaa

SEQ ID NO: 2846244 - DNA, 10 bp, Homo sapiens
acaatattta

SEQ ID NO: 2846245 - DNA, 16 bp, Homo sapiens
acaatatttaaaattt

SEQ ID NO: 2846246 - DNA, 17 bp, Homo sapiens
acaatcctgtccctcac

SEQ ID NO: 2846247 - DNA, 22 bp, Homo sapiens
acaatcctttgagttatagttt

SEQ ID NO: 2846248 - DNA, 12 bp, Homo sapiens
acaatctcaaat

SEQ ID NO: 2846249 - DNA, 16 bp, Homo sapiens
acaatctgggactttc

SEQ ID NO: 2846250 - DNA, 19 bp, Homo sapiens
acaatgatgattaaacacc

SEQ ID NO: 2846251 - DNA, 14 bp, Homo sapiens
acaattccaaagga

SEQ ID NO: 2846252 - DNA, 14 bp, Homo sapiens
acaattccatttcc

SEQ ID NO: 2846253 - DNA, 19 bp, Homo sapiens
acaattgaacttaaataaa

SEQ ID NO: 2846254 - DNA, 14 bp, Homo sapiens
acaatttagaaaac

SEQ ID NO: 2846255 - DNA, 17 bp, Homo sapiens
acaatttagaaaacatt

SEQ ID NO: 2846256 - DNA, 18 bp, Homo sapiens
acaatttgagcaattcat

SEQ ID NO: 2846257 - DNA, 19 bp, Homo sapiens
acacaaaagtttctctttt

SEQ ID NO: 2846258 - DNA, 15 bp, Homo sapiens
acacaaaatgtcaca

SEQ ID NO: 2846259 - DNA, 13 bp, Homo sapiens
acacaacacacac

SEQ ID NO: 2846260 - DNA, 15 bp, Homo sapiens
acacaagctggaagc

SEQ ID NO: 2846261 - DNA, 13 bp, Homo sapiens
acacaagtaaaca

SEQ ID NO: 2846262 - DNA, 18 bp, Homo sapiens
acacacaaaatgtcacaa

SEQ ID NO: 2846263 - DNA, 22 bp, Homo sapiens
acacacagaggaagagcaggca

SEQ ID NO: 2846264 - DNA, 19 bp, Homo sapiens
acacacagctctgtcctgg

SEQ ID NO: 2846265 - DNA, 17 bp, Homo sapiens
acacacaggcaactgag

SEQ ID NO: 2846266 - DNA, 14 bp, Homo sapiens
acacaccagagccc

SEQ ID NO: 2846267 - DNA, 19 bp, Homo sapiens
acacacccctcaaaaaaag

SEQ ID NO: 2846268 - DNA, 14 bp, Homo sapiens
acacacgcaggaac

SEQ ID NO: 2846269 - DNA, 21 bp, Homo sapiens
acacacgcgtgcacacaccag

SEQ ID NO: 2846270 - DNA, 21 bp, Homo sapiens
acacacgtatttatatttgga

SEQ ID NO: 2846271 - DNA, 23 bp, Homo sapiens
acacacgtatttatatttggaaa

SEQ ID NO: 2846272 - DNA, 13 bp, Homo sapiens
acacactaatcga

SEQ ID NO: 2846273 - DNA, 12 bp, Homo sapiens
acacagaggaag

SEQ ID NO: 2846274 - DNA, 17 bp, Homo sapiens
acacagaggaagagcag

SEQ ID NO: 2846275 - DNA, 15 bp, Homo sapiens
acacagcctggactt

SEQ ID NO: 2846276 - DNA, 11 bp, Homo sapiens
acacagctctg

SEQ ID NO: 2846277 - DNA, 20 bp, Homo sapiens
acacagctctgtcctgggag

SEQ ID NO: 2846278 - DNA, 14 bp, Homo sapiens
acacagctcttctc

SEQ ID NO: 2846279 - DNA, 16 bp, Homo sapiens
acacaggcccggctcc

SEQ ID NO: 2846280 - DNA, 17 bp, Homo sapiens
acacaggcccggctcca

SEQ ID NO: 2846281 - DNA, 19 bp, Homo sapiens
acacaggcccggctccagg

SEQ ID NO: 2846282 - DNA, 20 bp, Homo sapiens
acacaggcccggctccaggc

SEQ ID NO: 2846283 - DNA, 22 bp, Homo sapiens
acacaggcccggctccaggctc

SEQ ID NO: 2846284 - DNA, 22 bp, Homo sapiens
acacagtattacttctgctaca

SEQ ID NO: 2846285 - DNA, 11 bp, Homo sapiens
acacagtgagt

SEQ ID NO: 2846286 - DNA, 13 bp, Homo sapiens
acacataatttga

SEQ ID NO: 2846287 - DNA, 19 bp, Homo sapiens
acacatactcatttttcat

SEQ ID NO: 2846288 - DNA, 16 bp, Homo sapiens
acacatatatgtatat

SEQ ID NO: 2846289 - DNA, 18 bp, Homo sapiens
acacattacttgcacaag

SEQ ID NO: 2846290 - DNA, 14 bp, Homo sapiens
acaccaaataaata

SEQ ID NO: 2846291 - DNA, 19 bp, Homo sapiens
acaccaaattccaaacttc

SEQ ID NO: 2846292 - DNA, 23 bp, Homo sapiens
acaccaccaaatgacaagtcaca

SEQ ID NO: 2846293 - DNA, 19 bp, Homo sapiens
acaccactttgtctctgag

SEQ ID NO: 2846294 - DNA, 12 bp, Homo sapiens
acaccagagccc

SEQ ID NO: 2846295 - DNA, 18 bp, Homo sapiens
acaccagagcccaccttg

SEQ ID NO: 2846296 - DNA, 23 bp, Homo sapiens
acaccagagcccaccttggctca

SEQ ID NO: 2846297 - DNA, 21 bp, Homo sapiens
acaccataggtagaatgtaaa

SEQ ID NO: 2846298 - DNA, 14 bp, Homo sapiens
acaccatcttttgt

SEQ ID NO: 2846299 - DNA, 23 bp, Homo sapiens
acaccatgtttgagctcagaccc

SEQ ID NO: 2846300 - DNA, 19 bp, Homo sapiens
acacccaaagaggtattta

SEQ ID NO: 2846301 - DNA, 19 bp, Homo sapiens
acaccccatctctcttccc

SEQ ID NO: 2846302 - DNA, 13 bp, Homo sapiens
acagccaacaggt

SEQ ID NO: 2846303 - DNA, 23 bp, Homo sapiens
acagccaacaggtggcaggacca

SEQ ID NO: 2846304 - DNA, 15 bp, Homo sapiens
acagccacggccagg

SEQ ID NO: 2846305 - DNA, 16 bp, Homo sapiens
acagccacggccaggc

SEQ ID NO: 2846306 - DNA, 17 bp, Homo sapiens
acagccacggccaggcc

SEQ ID NO: 2846307 - DNA, 20 bp, Homo sapiens
acagccgcagcctccctctg

SEQ ID NO: 2846308 - DNA, 20 bp, Homo sapiens
acagccgctcctgtctgcca

SEQ ID NO: 2846309 - DNA, 20 bp, Homo sapiens
acagccgtcagccaaatgta

SEQ ID NO: 2846310 - DNA, 14 bp, Homo sapiens
acagcctcacagaa

SEQ ID NO: 2846311 - DNA, 21 bp, Homo sapiens
acagcctgacaacatttctat

SEQ ID NO: 2846312 - DNA, 18 bp, Homo sapiens
acagcctgggaccagggc

SEQ ID NO: 2846313 - DNA, 20 bp, Homo sapiens
acagcctgggaccagggcat

SEQ ID NO: 2846314 - DNA, 18 bp, Homo sapiens
acagcgaactagaagaaa

SEQ ID NO: 2846315 - DNA, 14 bp, Homo sapiens
acagcggggaaggt

SEQ ID NO: 2846316 - DNA, 15 bp, Homo sapiens
acagctaatgggaca

SEQ ID NO: 2846317 - DNA, 23 bp, Homo sapiens
acagctcaagtcttccctgatca

SEQ ID NO: 2846318 - DNA, 18 bp, Homo sapiens
acagctcagaagtttctt

SEQ ID NO: 2846319 - DNA, 21 bp, Homo sapiens
acagctcagctttttgtcttt

SEQ ID NO: 2846320 - DNA, 18 bp, Homo sapiens
acagctcccaccccaccc

SEQ ID NO: 2846321 - DNA, 12 bp, Homo sapiens
acagctccctag

SEQ ID NO: 2846322 - DNA, 12 bp, Homo sapiens
acagctccttct

SEQ ID NO: 2846323 - DNA, 16 bp, Homo sapiens
acagctccttctgtcc

SEQ ID NO: 2846324 - DNA, 14 bp, Homo sapiens
acagctctgtcctg

SEQ ID NO: 2846325 - DNA, 16 bp, Homo sapiens
acagctctgtcctggg

SEQ ID NO: 2846326 - DNA, 19 bp, Homo sapiens
acagctcttctccaggctg

SEQ ID NO: 2846327 - DNA, 12 bp, Homo sapiens
acagctgcctgc

SEQ ID NO: 2846328 - DNA, 15 bp, Homo sapiens
acagctgtgcctcgc

SEQ ID NO: 2846329 - DNA, 20 bp, Homo sapiens
acagcttatggggtatttta

SEQ ID NO: 2846330 - DNA, 15 bp, Homo sapiens
acaggaaaagctgct

SEQ ID NO: 2846331 - DNA, 18 bp, Homo sapiens
acaggaaaagctgctgac

SEQ ID NO: 2846332 - DNA, 19 bp, Homo sapiens
acaggaaaagctgctgaca

SEQ ID NO: 2846333 - DNA, 16 bp, Homo sapiens
acaggaaaatcctctg

SEQ ID NO: 2846334 - DNA, 19 bp, Homo sapiens
acaggaatctcagagacag

SEQ ID NO: 2846335 - DNA, 17 bp, Homo sapiens
acaggacacctggccgc

SEQ ID NO: 2846336 - DNA, 22 bp, Homo sapiens
acaggacagtgcttcagcctga

SEQ ID NO: 2846337 - DNA, 14 bp, Homo sapiens
acaggaccagattt

SEQ ID NO: 2846338 - DNA, 22 bp, Homo sapiens
acaggactaacactcagaagcc

SEQ ID NO: 2846339 - DNA, 23 bp, Homo sapiens
acaggactaacactcagaagcct

SEQ ID NO: 2846340 - DNA, 21 bp, Homo sapiens
acaggatcctattctcaccag

SEQ ID NO: 2846341 - DNA, 14 bp, Homo sapiens
acaggcaaatgcat

SEQ ID NO: 2846342 - DNA, 15 bp, Homo sapiens
acaggcaagcacctc

SEQ ID NO: 2846343 - DNA, 23 bp, Homo sapiens
acaggcaagcacctcctgcctcg

SEQ ID NO: 2846344 - DNA, 14 bp, Homo sapiens
acaggcaatgctgg

SEQ ID NO: 2846345 - DNA, 15 bp, Homo sapiens
acaggcaatgctggc

SEQ ID NO: 2846346 - DNA, 16 bp, Homo sapiens
acaggcaatgctggct

SEQ ID NO: 2846347 - DNA, 23 bp, Homo sapiens
acaggcaatgctggctgttggct

SEQ ID NO: 2846348 - DNA, 15 bp, Homo sapiens
acaggcatgttctct

SEQ ID NO: 2846349 - DNA, 18 bp, Homo sapiens
acaggcatttcctgggtg

SEQ ID NO: 2846350 - DNA, 20 bp, Homo sapiens
acaggcatttcctgggtggc

SEQ ID NO: 2846351 - DNA, 15 bp, Homo sapiens
acaggccatttcatt

SEQ ID NO: 2846352 - DNA, 18 bp, Homo sapiens
acaggcccaagagatgaa

SEQ ID NO: 2846353 - DNA, 22 bp, Homo sapiens
acaggcccaagagatgaagagt

SEQ ID NO: 2846354 - DNA, 19 bp, Homo sapiens
acaggccccccgcagcacc

SEQ ID NO: 2846355 - DNA, 22 bp, Homo sapiens
acaggcccggcgcggtggctca

SEQ ID NO: 2846356 - DNA, 16 bp, Homo sapiens
acaggcccggctccag

SEQ ID NO: 2846357 - DNA, 17 bp, Homo sapiens
acaggcccggctccagg

SEQ ID NO: 2846358 - DNA, 21 bp, Homo sapiens
acaggcccggctccaggctcc

SEQ ID NO: 2846359 - DNA, 22 bp, Homo sapiens
acaggcccggctccaggctcct

SEQ ID NO: 2846360 - DNA, 19 bp, Homo sapiens
acaggcctgtgtagctgtg

SEQ ID NO: 2846361 - DNA, 14 bp, Homo sapiens
acaggctcaatatt

SEQ ID NO: 2846362 - DNA, 12 bp, Homo sapiens
acaggctgggct

SEQ ID NO: 2846363 - DNA, 17 bp, Homo sapiens
acaggctgggcttcagt

SEQ ID NO: 2846364 - DNA, 13 bp, Homo sapiens
acagggaaggcag

SEQ ID NO: 2846365 - DNA, 17 bp, Homo sapiens
acagggaaggcaggcag

SEQ ID NO: 2846366 - DNA, 20 bp, Homo sapiens
acagggaaggcaggcagggc

SEQ ID NO: 2846367 - DNA, 12 bp, Homo sapiens
acagggacccac

SEQ ID NO: 2846368 - DNA, 22 bp, Homo sapiens
acagggctaagagctagcgctg

SEQ ID NO: 2846369 - DNA, 15 bp, Homo sapiens
acaggggatcaaagt

SEQ ID NO: 2846370 - DNA, 16 bp, Homo sapiens
acaggggatcaaagtt

SEQ ID NO: 2846371 - DNA, 17 bp, Homo sapiens
acagggtagcaggtacc

SEQ ID NO: 2846372 - DNA, 15 bp, Homo sapiens
acaggtctagacttt

SEQ ID NO: 2846373 - DNA, 16 bp, Homo sapiens
acaggtggacacacaa

SEQ ID NO: 2846374 - DNA, 18 bp, Homo sapiens
acaggtggacacacaagg

SEQ ID NO: 2846375 - DNA, 15 bp, Homo sapiens
acaggtggcaggacc

SEQ ID NO: 2846376 - DNA, 19 bp, Homo sapiens
acaggtggcctagcaggca

SEQ ID NO: 2846377 - DNA, 12 bp, Homo sapiens
acaggtgtaaat

SEQ ID NO: 2846378 - DNA, 14 bp, Homo sapiens
acaggtgtttatac

SEQ ID NO: 2846379 - DNA, 14 bp, Homo sapiens
acaggttttataat

SEQ ID NO: 2846380 - DNA, 17 bp, Homo sapiens
acagtaaaaacttgtac

SEQ ID NO: 2846381 - DNA, 21 bp, Homo sapiens
acagtaaagtttaaaaaatac

SEQ ID NO: 2846382 - DNA, 17 bp, Homo sapiens
acagtagcttaaataaa

SEQ ID NO: 2846383 - DNA, 22 bp, Homo sapiens
acagtagcttaaataaattcaa

SEQ ID NO: 2846384 - DNA, 16 bp, Homo sapiens
acagtattacttctgc

SEQ ID NO: 2846385 - DNA, 18 bp, Homo sapiens
acagtattctcagtgctc

SEQ ID NO: 2846386 - DNA, 17 bp, Homo sapiens
acagtcatgaggcagct

SEQ ID NO: 2846387 - DNA, 21 bp, Homo sapiens
acagtcctgggagaacctcag

SEQ ID NO: 2846388 - DNA, 23 bp, Homo sapiens
acagtcctgggagaacctcaggc

SEQ ID NO: 2846389 - DNA, 12 bp, Homo sapiens
acagtctaaagc

SEQ ID NO: 2846390 - DNA, 15 bp, Homo sapiens
acagtctaaagctgg

SEQ ID NO: 2846391 - DNA, 18 bp, Homo sapiens
acagtctcaagcactaaa

SEQ ID NO: 2846392 - DNA, 11 bp, Homo sapiens
acagtctctgg

SEQ ID NO: 2846393 - DNA, 17 bp, Homo sapiens
acctaggccactcctcc

SEQ ID NO: 2846394 - DNA, 15 bp, Homo sapiens
acctatagtcccagc

SEQ ID NO: 2846395 - DNA, 22 bp, Homo sapiens
acctatagtcccagctactcag

SEQ ID NO: 2846396 - DNA, 17 bp, Homo sapiens
acctatgtcctaaggac

SEQ ID NO: 2846397 - DNA, 22 bp, Homo sapiens
acctatgtcctaaggacacact

SEQ ID NO: 2846398 - DNA, 14 bp, Homo sapiens
acctcaaactgggt

SEQ ID NO: 2846399 - DNA, 19 bp, Homo sapiens
acctcaacccccatttcta

SEQ ID NO: 2846400 - DNA, 21 bp, Homo sapiens
acctcaatcagtctcagaatg

SEQ ID NO: 2846401 - DNA, 16 bp, Homo sapiens
acctcacctttgcaaa

SEQ ID NO: 2846402 - DNA, 13 bp, Homo sapiens
acctcactcctgt

SEQ ID NO: 2846403 - DNA, 15 bp, Homo sapiens
acctcactgaggaag

SEQ ID NO: 2846404 - DNA, 15 bp, Homo sapiens
acctcagcctagacc

SEQ ID NO: 2846405 - DNA, 11 bp, Homo sapiens
acctcagcctg

SEQ ID NO: 2846406 - DNA, 12 bp, Homo sapiens
acctcagcctgt

SEQ ID NO: 2846407 - DNA, 14 bp, Homo sapiens
acctcagccttgga

SEQ ID NO: 2846408 - DNA, 13 bp, Homo sapiens
acctcaggccagg

SEQ ID NO: 2846409 - DNA, 19 bp, Homo sapiens
acctcaggcttccttggca

SEQ ID NO: 2846410 - DNA, 20 bp, Homo sapiens
acctcaggtgatccacccac

SEQ ID NO: 2846411 - DNA, 21 bp, Homo sapiens
acctcaggtgatccacccacc

SEQ ID NO: 2846412 - DNA, 15 bp, Homo sapiens
acctcagtaatttag

SEQ ID NO: 2846413 - DNA, 17 bp, Homo sapiens
acctcagtaatttagaa

SEQ ID NO: 2846414 - DNA, 14 bp, Homo sapiens
acctcatatgctat

SEQ ID NO: 2846415 - DNA, 19 bp, Homo sapiens
acctcatgacagccagagc

SEQ ID NO: 2846416 - DNA, 18 bp, Homo sapiens
acctccagctttcctgta

SEQ ID NO: 2846417 - DNA, 19 bp, Homo sapiens
acctcccagccctatggat

SEQ ID NO: 2846418 - DNA, 20 bp, Homo sapiens
acctcccaggggctccacct

SEQ ID NO: 2846419 - DNA, 13 bp, Homo sapiens
acctccccccact

SEQ ID NO: 2846420 - DNA, 17 bp, Homo sapiens
acctccccccactgcag

SEQ ID NO: 2846421 - DNA, 22 bp, Homo sapiens
acctccccccactgcaggcccc

SEQ ID NO: 2846422 - DNA, 18 bp, Homo sapiens
acctcccctatccaccca

SEQ ID NO: 2846423 - DNA, 20 bp, Homo sapiens
acctcccctatccacccagc

SEQ ID NO: 2846424 - DNA, 21 bp, Homo sapiens
acctcccctatccacccagcc

SEQ ID NO: 2846425 - DNA, 20 bp, Homo sapiens
acctccctgaaccatccctg

SEQ ID NO: 2846426 - DNA, 15 bp, Homo sapiens
acctcctgcccagga

SEQ ID NO: 2846427 - DNA, 17 bp, Homo sapiens
acctcctgcccaggaga

SEQ ID NO: 2846428 - DNA, 12 bp, Homo sapiens
acctcctgcctc

SEQ ID NO: 2846429 - DNA, 23 bp, Homo sapiens
acctcctgcctcgaactggctgc

SEQ ID NO: 2846430 - DNA, 22 bp, Homo sapiens
acctccttcctcagtcctggaa

SEQ ID NO: 2846431 - DNA, 15 bp, Homo sapiens
acctcgtcctccccc

SEQ ID NO: 2846432 - DNA, 18 bp, Homo sapiens
acctcgtcctccccctgc

SEQ ID NO: 2846433 - DNA, 22 bp, Homo sapiens
acctcgtcctccccctgccagt

SEQ ID NO: 2846434 - DNA, 19 bp, Homo sapiens
acctctcaatattcaataa

SEQ ID NO: 2846435 - DNA, 23 bp, Homo sapiens
acctctcaatattcaataaagct

SEQ ID NO: 2846436 - DNA, 18 bp, Homo sapiens
acctctcatcagtgtcct

SEQ ID NO: 2846437 - DNA, 12 bp, Homo sapiens
acctctgtgtgc

SEQ ID NO: 2846438 - DNA, 15 bp, Homo sapiens
acctctgtgtgctcc

SEQ ID NO: 2846439 - DNA, 21 bp, Homo sapiens
actctctccaccctatatgta

SEQ ID NO: 2846440 - DNA, 11 bp, Homo sapiens
actctgcacat

SEQ ID NO: 2846441 - DNA, 18 bp, Homo sapiens
actctgcacatgtcttgt

SEQ ID NO: 2846442 - DNA, 22 bp, Homo sapiens
actctgcacatgtcttgtacat

SEQ ID NO: 2846443 - DNA, 12 bp, Homo sapiens
actctgcctcct

SEQ ID NO: 2846444 - DNA, 16 bp, Homo sapiens
actctgcctcctcttc

SEQ ID NO: 2846445 - DNA, 15 bp, Homo sapiens
actctgctctgatgc

SEQ ID NO: 2846446 - DNA, 11 bp, Homo sapiens
actctggaagt

SEQ ID NO: 2846447 - DNA, 17 bp, Homo sapiens
actctggcagccacact

SEQ ID NO: 2846448 - DNA, 14 bp, Homo sapiens
actctggcttccag

SEQ ID NO: 2846449 - DNA, 13 bp, Homo sapiens
actctgggaaata

SEQ ID NO: 2846450 - DNA, 17 bp, Homo sapiens
actctgggctgctaccc

SEQ ID NO: 2846451 - DNA, 17 bp, Homo sapiens
actctgtgccagagcct

SEQ ID NO: 2846452 - DNA, 21 bp, Homo sapiens
actctgtgccagagcctgggg

SEQ ID NO: 2846453 - DNA, 22 bp, Homo sapiens
actctgtgccagagcctggggc

SEQ ID NO: 2846454 - DNA, 16 bp, Homo sapiens
actctgtgtcaggtgg

SEQ ID NO: 2846455 - DNA, 21 bp, Homo sapiens
actctgtgtcaggtggggcag

SEQ ID NO: 2846456 - DNA, 17 bp, Homo sapiens
actcttaggaagagaaa

SEQ ID NO: 2846457 - DNA, 19 bp, Homo sapiens
actcttaggaagagaaacc

SEQ ID NO: 2846458 - DNA, 16 bp, Homo sapiens
actcttgcctttccac

SEQ ID NO: 2846459 - DNA, 19 bp, Homo sapiens
actcttgcctttccacctg

SEQ ID NO: 2846460 - DNA, 13 bp, Homo sapiens
actctttgtaaga

SEQ ID NO: 2846461 - DNA, 19 bp, Homo sapiens
actgaaaagactcagtgtt

SEQ ID NO: 2846462 - DNA, 21 bp, Homo sapiens
actgaaggagaaggtgcccca

SEQ ID NO: 2846463 - DNA, 19 bp, Homo sapiens
actgaatctcccctcctca

SEQ ID NO: 2846464 - DNA, 21 bp, Homo sapiens
actgaatctcccctcctcaca

SEQ ID NO: 2846465 - DNA, 16 bp, Homo sapiens
actgaatgctctgtgc

SEQ ID NO: 2846466 - DNA, 21 bp, Homo sapiens
actgacacctcactgaggaag

SEQ ID NO: 2846467 - DNA, 18 bp, Homo sapiens
actgacattgttggccaa

SEQ ID NO: 2846468 - DNA, 23 bp, Homo sapiens
actgacattgttggccaaagcca

SEQ ID NO: 2846469 - DNA, 15 bp, Homo sapiens
actgaccctggagcg

SEQ ID NO: 2846470 - DNA, 18 bp, Homo sapiens
actgaccctggagcggct

SEQ ID NO: 2846471 - DNA, 20 bp, Homo sapiens
actgaccctggagcggctct

SEQ ID NO: 2846472 - DNA, 14 bp, Homo sapiens
actgactccttaga

SEQ ID NO: 2846473 - DNA, 23 bp, Homo sapiens
actgaggcagacagcagctcagg

SEQ ID NO: 2846474 - DNA, 19 bp, Homo sapiens
actgatcaatccttcttat

SEQ ID NO: 2846475 - DNA, 18 bp, Homo sapiens
actgatgacaaacccagg

SEQ ID NO: 2846476 - DNA, 23 bp, Homo sapiens
actgatgggcaacccccagcctg

SEQ ID NO: 2846477 - DNA, 16 bp, Homo sapiens
actgcaagagccttgg

SEQ ID NO: 2846478 - DNA, 21 bp, Homo sapiens
actgcactatagcctaggtga

SEQ ID NO: 2846479 - DNA, 17 bp, Homo sapiens
actgcactccagcctgg

SEQ ID NO: 2846480 - DNA, 13 bp, Homo sapiens
actgcactccagt

SEQ ID NO: 2846481 - DNA, 22 bp, Homo sapiens
actgcagcctcaacctcctggg

SEQ ID NO: 2846482 - DNA, 23 bp, Homo sapiens
actgcagcctcaacctcctgggc

SEQ ID NO: 2846483 - DNA, 17 bp, Homo sapiens
agagccttggtgtccac

SEQ ID NO: 2846484 - DNA, 21 bp, Homo sapiens
agagccttggtgtccacctgg

SEQ ID NO: 2846485 - DNA, 22 bp, Homo sapiens
agagccttggtgtccacctggc

SEQ ID NO: 2846486 - DNA, 23 bp, Homo sapiens
agagccttggtgtccacctggcc

SEQ ID NO: 2846487 - DNA, 23 bp, Homo sapiens
agagcctttggatgaccagaaca

SEQ ID NO: 2846488 - DNA, 11 bp, Homo sapiens
agagctacata

SEQ ID NO: 2846489 - DNA, 16 bp, Homo sapiens
agagctacataattta

SEQ ID NO: 2846490 - DNA, 18 bp, Homo sapiens
agagctacataatttagt

SEQ ID NO: 2846491 - DNA, 14 bp, Homo sapiens
agagctacgtattt

SEQ ID NO: 2846492 - DNA, 22 bp, Homo sapiens
agagctgatgtgagtgtgtgtg

SEQ ID NO: 2846493 - DNA, 15 bp, Homo sapiens
agagctgctctggaa

SEQ ID NO: 2846494 - DNA, 16 bp, Homo sapiens
agagctgctctggaaa

SEQ ID NO: 2846495 - DNA, 22 bp, Homo sapiens
agagctgctctggaaaatgtga

SEQ ID NO: 2846496 - DNA, 18 bp, Homo sapiens
agagctggcaaaggtggc

SEQ ID NO: 2846497 - DNA, 19 bp, Homo sapiens
agagctgggtgtcaagagg

SEQ ID NO: 2846498 - DNA, 15 bp, Homo sapiens
agagcttctggcact

SEQ ID NO: 2846499 - DNA, 13 bp, Homo sapiens
agaggaagagcag

SEQ ID NO: 2846500 - DNA, 14 bp, Homo sapiens
agaggagatcaggg

SEQ ID NO: 2846501 - DNA, 23 bp, Homo sapiens
agaggagatcagggcgacctgca

SEQ ID NO: 2846502 - DNA, 21 bp, Homo sapiens
agaggagggcgtgactcaccc

SEQ ID NO: 2846503 - DNA, 19 bp, Homo sapiens
agaggcagccccattctgc

SEQ ID NO: 2846504 - DNA, 22 bp, Homo sapiens
agaggcagccccattctgcctg

SEQ ID NO: 2846505 - DNA, 10 bp, Homo sapiens
agaggcaggg

SEQ ID NO: 2846506 - DNA, 16 bp, Homo sapiens
agaggccatggcagaa

SEQ ID NO: 2846507 - DNA, 23 bp, Homo sapiens
agaggccatggcagaataatctt

SEQ ID NO: 2846508 - DNA, 14 bp, Homo sapiens
agaggcgtcttgta

SEQ ID NO: 2846509 - DNA, 19 bp, Homo sapiens
agaggcgtcttgtattttc

SEQ ID NO: 2846510 - DNA, 13 bp, Homo sapiens
agaggctgaggca

SEQ ID NO: 2846511 - DNA, 22 bp, Homo sapiens
agaggctgcagaaggccaagaa

SEQ ID NO: 2846512 - DNA, 21 bp, Homo sapiens
agaggcttcttcagatcagtg

SEQ ID NO: 2846513 - DNA, 17 bp, Homo sapiens
agagggaagagtgcatt

SEQ ID NO: 2846514 - DNA, 24 bp, Homo sapiens
agagggaggagaatgagcctcggc

SEQ ID NO: 2846515 - DNA, 20 bp, Homo sapiens
agagggagtgacagaggcag

SEQ ID NO: 2846516 - DNA, 14 bp, Homo sapiens
agagggcccaggca

SEQ ID NO: 2846517 - DNA, 15 bp, Homo sapiens
agagggcctgtggga

SEQ ID NO: 2846518 - DNA, 19 bp, Homo sapiens
agagggcctgtgggagcct

SEQ ID NO: 2846519 - DNA, 22 bp, Homo sapiens
agaggggaacagactggaagca

SEQ ID NO: 2846520 - DNA, 15 bp, Homo sapiens
agaggggaggggcct

SEQ ID NO: 2846521 - DNA, 15 bp, Homo sapiens
agaggggcagaacag

SEQ ID NO: 2846522 - DNA, 22 bp, Homo sapiens
agagggtggtgacctctgcctg

SEQ ID NO: 2846523 - DNA, 20 bp, Homo sapiens
agaggtaaaagtgtgagcag

SEQ ID NO: 2846524 - DNA, 23 bp, Homo sapiens
agaggtaaaagtgtgagcagtga

SEQ ID NO: 2846525 - DNA, 15 bp, Homo sapiens
agaggtgaccccagg

SEQ ID NO: 2846526 - DNA, 18 bp, Homo sapiens
agaggtgaccccagggca

SEQ ID NO: 2846527 - DNA, 20 bp, Homo sapiens
agaggtggagaactgggatt

SEQ ID NO: 2846528 - DNA, 20 bp, Homo sapiens
agaggtgggcagcagctcag

SEQ ID NO: 2846529 - DNA, 17 bp, Homo sapiens
agaggtggtgggggcag

SEQ ID NO: 2846530 - DNA, 16 bp, Homo sapiens
agagtacagtgagcca

SEQ ID NO: 2846531 - DNA, 23 bp, Homo sapiens
agagtagcaagttctagagaaga

SEQ ID NO: 2846532 - DNA, 18 bp, Homo sapiens
agagtagccgagagcctg

SEQ ID NO: 2846533 - DNA, 12 bp, Homo sapiens
agagtcctattt

SEQ ID NO: 2846534 - DNA, 20 bp, Homo sapiens
agagtctcactgttgcccag

SEQ ID NO: 2846535 - DNA, 18 bp, Homo sapiens
agagtgaaataattaaaa

SEQ ID NO: 2846536 - DNA, 22 bp, Homo sapiens
agagtgacacccaagagggctg

SEQ ID NO: 2846537 - DNA, 13 bp, Homo sapiens
agagtgagaataa

SEQ ID NO: 2846538 - DNA, 22 bp, Homo sapiens
agagtgagaataattgtgtaca

SEQ ID NO: 2846539 - DNA, 23 bp, Homo sapiens
agagtgagaataattgtgtacaa

SEQ ID NO: 2846540 - DNA, 14 bp, Homo sapiens
agagtgagagggca

SEQ ID NO: 2846541 - DNA, 20 bp, Homo sapiens
agagtgctgagaaggacacc

SEQ ID NO: 2846542 - DNA, 23 bp, Homo sapiens
agagtggcccagaattgcattct

SEQ ID NO: 2846543 - DNA, 18 bp, Homo sapiens
agagttcaagaaataagt

SEQ ID NO: 2846544 - DNA, 16 bp, Homo sapiens
agagttcactataaat

SEQ ID NO: 2846545 - DNA, 21 bp, Homo sapiens
agagttctttaggtgcctcct

SEQ ID NO: 2846546 - DNA, 12 bp, Homo sapiens
agagttgaacct

SEQ ID NO: 2846547 - DNA, 13 bp, Homo sapiens
agagtttgaagga

SEQ ID NO: 2846548 - DNA, 14 bp, Homo sapiens
agagtttgcaaatg

SEQ ID NO: 2846549 - DNA, 21 bp, Homo sapiens
agataacaagatctttcagga

SEQ ID NO: 2846550 - DNA, 15 bp, Homo sapiens
agataactgaaaatt

SEQ ID NO: 2846551 - DNA, 18 bp, Homo sapiens
agataactgaaaattatt

SEQ ID NO: 2846552 - DNA, 15 bp, Homo sapiens
agataatcagcctct

SEQ ID NO: 2846553 - DNA, 12 bp, Homo sapiens
agataattataa

SEQ ID NO: 2846554 - DNA, 19 bp, Homo sapiens
agatacaggaaaagctgct

SEQ ID NO: 2846555 - DNA, 20 bp, Homo sapiens
agatacaggaaaagctgctg

SEQ ID NO: 2846556 - DNA, 21 bp, Homo sapiens
agatactggaagttttgcatt

SEQ ID NO: 2846557 - DNA, 15 bp, Homo sapiens
agatagaatgacagt

SEQ ID NO: 2846558 - DNA, 19 bp, Homo sapiens
agataggtttgagttcaaa

SEQ ID NO: 2846559 - DNA, 14 bp, Homo sapiens
agatatacaaatat

SEQ ID NO: 2846560 - DNA, 23 bp, Homo sapiens
agatatacaaatatatttaattg

SEQ ID NO: 2846561 - DNA, 22 bp, Homo sapiens
agatatatatttactaaaagaa

SEQ ID NO: 2846562 - DNA, 23 bp, Homo sapiens
agatatatatttactaaaagaat

SEQ ID NO: 2846563 - DNA, 17 bp, Homo sapiens
agatatatctgaaaact

SEQ ID NO: 2846564 - DNA, 14 bp, Homo sapiens
agatatatttttca

SEQ ID NO: 2846565 - DNA, 15 bp, Homo sapiens
agatatatttttcac

SEQ ID NO: 2846566 - DNA, 16 bp, Homo sapiens
agatatgatatgtaaa

SEQ ID NO: 2846567 - DNA, 19 bp, Homo sapiens
agatatgctaagcagtagt

SEQ ID NO: 2846568 - DNA, 23 bp, Homo sapiens
agatatttacatgaattgcattt

SEQ ID NO: 2846569 - DNA, 16 bp, Homo sapiens
agatatttccatttct

SEQ ID NO: 2846570 - DNA, 14 bp, Homo sapiens
agatcaaatttcac

SEQ ID NO: 2846571 - DNA, 16 bp, Homo sapiens
agatcaaggagcccag

SEQ ID NO: 2846572 - DNA, 18 bp, Homo sapiens
agatcaaggagcccagaa

SEQ ID NO: 2846573 - DNA, 12 bp, Homo sapiens
agcccctcctct

SEQ ID NO: 2846574 - DNA, 14 bp, Homo sapiens
agcccctcctctgc

SEQ ID NO: 2846575 - DNA, 16 bp, Homo sapiens
agcccctcctctgcca

SEQ ID NO: 2846576 - DNA, 22 bp, Homo sapiens
agcccctcctctgccacctccc

SEQ ID NO: 2846577 - DNA, 23 bp, Homo sapiens
agcccctcctctgccacctcccc

SEQ ID NO: 2846578 - DNA, 20 bp, Homo sapiens
agccccttgctctcccctgc

SEQ ID NO: 2846579 - DNA, 19 bp, Homo sapiens
agcccggcctgctcccagc

SEQ ID NO: 2846580 - DNA, 14 bp, Homo sapiens
agccctaaacatca

SEQ ID NO: 2846581 - DNA, 12 bp, Homo sapiens
agccctatggat

SEQ ID NO: 2846582 - DNA, 13 bp, Homo sapiens
agccctatggatg

SEQ ID NO: 2846583 - DNA, 16 bp, Homo sapiens
agccctatggatgtgg

SEQ ID NO: 2846584 - DNA, 11 bp, Homo sapiens
agccctccttc

SEQ ID NO: 2846585 - DNA, 21 bp, Homo sapiens
agccctgcagccaaacagagc

SEQ ID NO: 2846586 - DNA, 12 bp, Homo sapiens
agccctgcctgg

SEQ ID NO: 2846587 - DNA, 13 bp, Homo sapiens
agccctgcctgga

SEQ ID NO: 2846588 - DNA, 14 bp, Homo sapiens
agccctgcctggag

SEQ ID NO: 2846589 - DNA, 15 bp, Homo sapiens
agccctgcctggagg

SEQ ID NO: 2846590 - DNA, 17 bp, Homo sapiens
agccctgcctggaggac

SEQ ID NO: 2846591 - DNA, 19 bp, Homo sapiens
agccctgcctggaggacct

SEQ ID NO: 2846592 - DNA, 22 bp, Homo sapiens
agccctgcctggaggacctgag

SEQ ID NO: 2846593 - DNA, 23 bp, Homo sapiens
agccctgcctggaggacctgagc

SEQ ID NO: 2846594 - DNA, 16 bp, Homo sapiens
agccctgcggagccgg

SEQ ID NO: 2846595 - DNA, 12 bp, Homo sapiens
agccctggcagg

SEQ ID NO: 2846596 - DNA, 13 bp, Homo sapiens
agccctggcagga

SEQ ID NO: 2846597 - DNA, 18 bp, Homo sapiens
agccctggcccagagctg

SEQ ID NO: 2846598 - DNA, 15 bp, Homo sapiens
agccctgggaccgct

SEQ ID NO: 2846599 - DNA, 16 bp, Homo sapiens
agccctgggccccacc

SEQ ID NO: 2846600 - DNA, 23 bp, Homo sapiens
agccctgggccccaccacctagg

SEQ ID NO: 2846601 - DNA, 11 bp, Homo sapiens
agcccttccct

SEQ ID NO: 2846602 - DNA, 13 bp, Homo sapiens
agcccttccctgc

SEQ ID NO: 2846603 - DNA, 20 bp, Homo sapiens
agcccttgagctccccaaaa

SEQ ID NO: 2846604 - DNA, 22 bp, Homo sapiens
agccctttgggaggctgaggcg

SEQ ID NO: 2846605 - DNA, 12 bp, Homo sapiens
agccgacctcag

SEQ ID NO: 2846606 - DNA, 14 bp, Homo sapiens
agccgacctcagcc

SEQ ID NO: 2846607 - DNA, 13 bp, Homo sapiens
agccgagagcctg

SEQ ID NO: 2846608 - DNA, 21 bp, Homo sapiens
agccgagagcctgctccccca

SEQ ID NO: 2846609 - DNA, 17 bp, Homo sapiens
agccgagatcacgccac

SEQ ID NO: 2846610 - DNA, 18 bp, Homo sapiens
agccgagatcacgccact

SEQ ID NO: 2846611 - DNA, 16 bp, Homo sapiens
agccgagccgggcctg

SEQ ID NO: 2846612 - DNA, 17 bp, Homo sapiens
agccgagccgggcctgg

SEQ ID NO: 2846613 - DNA, 19 bp, Homo sapiens
agccgcagggacagaactg

SEQ ID NO: 2846614 - DNA, 21 bp, Homo sapiens
agccgcatcttctccatctgg

SEQ ID NO: 2846615 - DNA, 16 bp, Homo sapiens
agccgctcctgtctgc

SEQ ID NO: 2846616 - DNA, 17 bp, Homo sapiens
agccgctcctgtctgcc

SEQ ID NO: 2846617 - DNA, 21 bp, Homo sapiens
agccgctcctgtctgccagcc

SEQ ID NO: 2846618 - DNA, 20 bp, Homo sapiens
agccgtcagccaaatgtaat

SEQ ID NO: 2846619 - DNA, 18 bp, Homo sapiens
agccgtgatgctcaggct

SEQ ID NO: 2846620 - DNA, 20 bp, Homo sapiens
agccgtgatgctcaggcttg

SEQ ID NO: 2846621 - DNA, 15 bp, Homo sapiens
agcctaaatctaatc

SEQ ID NO: 2846622 - DNA, 13 bp, Homo sapiens
agcctaagaagct

SEQ ID NO: 2846623 - DNA, 13 bp, Homo sapiens
agcctaccccctg

SEQ ID NO: 2846624 - DNA, 14 bp, Homo sapiens
agcctaccccctga

SEQ ID NO: 2846625 - DNA, 18 bp, Homo sapiens
agcctagaccctcctcct

SEQ ID NO: 2846626 - DNA, 20 bp, Homo sapiens
agcctagccgacctcagcct

SEQ ID NO: 2846627 - DNA, 22 bp, Homo sapiens
agcctagctaccttctctaccc

SEQ ID NO: 2846628 - DNA, 18 bp, Homo sapiens
agcctcaacctcctgggc

SEQ ID NO: 2846629 - DNA, 19 bp, Homo sapiens
agcctcaacctcctgggct

SEQ ID NO: 2846630 - DNA, 22 bp, Homo sapiens
agcctcacttgaatgtgtcact

SEQ ID NO: 2846631 - DNA, 19 bp, Homo sapiens
agcctcatccgaggcaggg

SEQ ID NO: 2846632 - DNA, 21 bp, Homo sapiens
agcctccaagctccatctcca

SEQ ID NO: 2846633 - DNA, 16 bp, Homo sapiens
agcctcccaaagtgct

SEQ ID NO: 2846634 - DNA, 19 bp, Homo sapiens
agcctcccgaatagctggg

SEQ ID NO: 2846635 - DNA, 22 bp, Homo sapiens
agcctcccgaatagctgggact

SEQ ID NO: 2846636 - DNA, 17 bp, Homo sapiens
agcctcccgagtagctg

SEQ ID NO: 2846637 - DNA, 22 bp, Homo sapiens
agcctcccgagtagctgggact

SEQ ID NO: 2846638 - DNA, 13 bp, Homo sapiens
agcctccctctga

SEQ ID NO: 2846639 - DNA, 14 bp, Homo sapiens
agcctccctctgac

SEQ ID NO: 2846640 - DNA, 22 bp, Homo sapiens
agcctccctctgacctgcaggc

SEQ ID NO: 2846641 - DNA, 12 bp, Homo sapiens
agcctcctcctg

SEQ ID NO: 2846642 - DNA, 13 bp, Homo sapiens
agcctcctcctga

SEQ ID NO: 2846643 - DNA, 15 bp, Homo sapiens
agcctcggtggccat

SEQ ID NO: 2846644 - DNA, 16 bp, Homo sapiens
agcctcggtggccatg

SEQ ID NO: 2846645 - DNA, 20 bp, Homo sapiens
agcctcggtggccatgcttc

SEQ ID NO: 2846646 - DNA, 22 bp, Homo sapiens
agcctcggtggccatgcttctt

SEQ ID NO: 2846647 - DNA, 12 bp, Homo sapiens
agcctctgctgc

SEQ ID NO: 2846648 - DNA, 20 bp, Homo sapiens
agcctcttaaagctgcctgt

SEQ ID NO: 2846649 - DNA, 22 bp, Homo sapiens
agcctcttaaagctgcctgtag

SEQ ID NO: 2846650 - DNA, 21 bp, Homo sapiens
agcctgaattttgttgctgtt

SEQ ID NO: 2846651 - DNA, 20 bp, Homo sapiens
agcctgactgtgttcagtgc

SEQ ID NO: 2846652 - DNA, 18 bp, Homo sapiens
agcctgcaaactcactgc

SEQ ID NO: 2846653 - DNA, 17 bp, Homo sapiens
agcctgctcccccaccc

SEQ ID NO: 2846654 - DNA, 23 bp, Homo sapiens
agcctgctcccccaccccctccc

SEQ ID NO: 2846655 - DNA, 14 bp, Homo sapiens
agcctggactttgg

SEQ ID NO: 2846656 - DNA, 20 bp, Homo sapiens
agcctggcttctggagccct

SEQ ID NO: 2846657 - DNA, 21 bp, Homo sapiens
agcctggcttctggagccctt

SEQ ID NO: 2846658 - DNA, 17 bp, Homo sapiens
agcctgggcaacagagc

SEQ ID NO: 2846659 - DNA, 18 bp, Homo sapiens
agcctgggcaacagagca

SEQ ID NO: 2846660 - DNA, 20 bp, Homo sapiens
agcctgggcagcatagcaag

SEQ ID NO: 2846661 - DNA, 13 bp, Homo sapiens
agcctggggctct

SEQ ID NO: 2846662 - DNA, 22 bp, Homo sapiens
agcctggggctctaacgcctga

SEQ ID NO: 2846663 - DNA, 14 bp, Homo sapiens
agcctgggggcctg

SEQ ID NO: 2846664 - DNA, 16 bp, Homo sapiens
agctcagcctcccccc

SEQ ID NO: 2846665 - DNA, 22 bp, Homo sapiens
agctcagctttttgtcttttct

SEQ ID NO: 2846666 - DNA, 17 bp, Homo sapiens
agctcaggaggcttgga

SEQ ID NO: 2846667 - DNA, 17 bp, Homo sapiens
agctcaggtgtccctgc

SEQ ID NO: 2846668 - DNA, 18 bp, Homo sapiens
agctcaggtgtccctgca

SEQ ID NO: 2846669 - DNA, 22 bp, Homo sapiens
agctcaggtgtccctgcacttg

SEQ ID NO: 2846670 - DNA, 19 bp, Homo sapiens
agctccagaataccttctt

SEQ ID NO: 2846671 - DNA, 13 bp, Homo sapiens
agctccagctcac

SEQ ID NO: 2846672 - DNA, 18 bp, Homo sapiens
agctccagctcaccagcc

SEQ ID NO: 2846673 - DNA, 17 bp, Homo sapiens
agctcccaccccacccc

SEQ ID NO: 2846674 - DNA, 23 bp, Homo sapiens
agctcccaccccacccccttcag

SEQ ID NO: 2846675 - DNA, 10 bp, Homo sapiens
agctccccag

SEQ ID NO: 2846676 - DNA, 15 bp, Homo sapiens
agctccctagtggct

SEQ ID NO: 2846677 - DNA, 14 bp, Homo sapiens
agctcccttcctga

SEQ ID NO: 2846678 - DNA, 21 bp, Homo sapiens
agctccgctttctacccagcg

SEQ ID NO: 2846679 - DNA, 17 bp, Homo sapiens
agctcggtggacccagg

SEQ ID NO: 2846680 - DNA, 18 bp, Homo sapiens
agctcggtggacccaggg

SEQ ID NO: 2846681 - DNA, 14 bp, Homo sapiens
agctctagttcaaa

SEQ ID NO: 2846682 - DNA, 13 bp, Homo sapiens
agctctccctctg

SEQ ID NO: 2846683 - DNA, 14 bp, Homo sapiens
agctctccctctgg

SEQ ID NO: 2846684 - DNA, 16 bp, Homo sapiens
agctctccctctggcc

SEQ ID NO: 2846685 - DNA, 17 bp, Homo sapiens
agctctccctctggccc

SEQ ID NO: 2846686 - DNA, 22 bp, Homo sapiens
agctctccctctggccctgcct

SEQ ID NO: 2846687 - DNA, 23 bp, Homo sapiens
agctctgaagtcacatcacagga

SEQ ID NO: 2846688 - DNA, 16 bp, Homo sapiens
agctctgcatgtgtgt

SEQ ID NO: 2846689 - DNA, 12 bp, Homo sapiens
agctctggacca

SEQ ID NO: 2846690 - DNA, 17 bp, Homo sapiens
agctctggaccagcctg

SEQ ID NO: 2846691 - DNA, 18 bp, Homo sapiens
agctctggccccaggctt

SEQ ID NO: 2846692 - DNA, 20 bp, Homo sapiens
agctctggccccaggcttgt

SEQ ID NO: 2846693 - DNA, 23 bp, Homo sapiens
agctctgtcctgggagtgagctg

SEQ ID NO: 2846694 - DNA, 17 bp, Homo sapiens
agctctgtttataaaaa

SEQ ID NO: 2846695 - DNA, 13 bp, Homo sapiens
agctcttcatgtt

SEQ ID NO: 2846696 - DNA, 15 bp, Homo sapiens
agctcttcccctttc

SEQ ID NO: 2846697 - DNA, 14 bp, Homo sapiens
agctcttctaagga

SEQ ID NO: 2846698 - DNA, 14 bp, Homo sapiens
agctcttctattta

SEQ ID NO: 2846699 - DNA, 22 bp, Homo sapiens
agctcttctatttaaaaaataa

SEQ ID NO: 2846700 - DNA, 16 bp, Homo sapiens
agctgaacaatgaatg

SEQ ID NO: 2846701 - DNA, 16 bp, Homo sapiens
agctgaagattttgga

SEQ ID NO: 2846702 - DNA, 14 bp, Homo sapiens
agctgagcagggcc

SEQ ID NO: 2846703 - DNA, 19 bp, Homo sapiens
agctgagctcacaaggcag

SEQ ID NO: 2846704 - DNA, 22 bp, Homo sapiens
agctgaggggggccgtgcccag

SEQ ID NO: 2846705 - DNA, 12 bp, Homo sapiens
agctgaggtgcc

SEQ ID NO: 2846706 - DNA, 16 bp, Homo sapiens
agctgaggtgcccagg

SEQ ID NO: 2846707 - DNA, 18 bp, Homo sapiens
agctgaggtgcccaggag

SEQ ID NO: 2846708 - DNA, 22 bp, Homo sapiens
agctgatgtgagtgtgtgtgat

SEQ ID NO: 2846709 - DNA, 16 bp, Homo sapiens
agctgcacctgccagc

SEQ ID NO: 2846710 - DNA, 21 bp, Homo sapiens
agctgcacctgccagcctggc

SEQ ID NO: 2846711 - DNA, 20 bp, Homo sapiens
agctgcaggaatcaaaaatt

SEQ ID NO: 2846712 - DNA, 17 bp, Homo sapiens
agctgccaaaatcgtag

SEQ ID NO: 2846713 - DNA, 13 bp, Homo sapiens
agctgccgaccag

SEQ ID NO: 2846714 - DNA, 18 bp, Homo sapiens
agctgccgaccagagccc

SEQ ID NO: 2846715 - DNA, 15 bp, Homo sapiens
agctgcctgtagtta

SEQ ID NO: 2846716 - DNA, 23 bp, Homo sapiens
agctgcctgtagttaggaaataa

SEQ ID NO: 2846717 - DNA, 20 bp, Homo sapiens
agctgcctgttcagctccag

SEQ ID NO: 2846718 - DNA, 16 bp, Homo sapiens
agctgcggtccaccca

SEQ ID NO: 2846719 - DNA, 19 bp, Homo sapiens
agctgcggtccacccagga

SEQ ID NO: 2846720 - DNA, 21 bp, Homo sapiens
agctgcggtccacccaggagc

SEQ ID NO: 2846721 - DNA, 16 bp, Homo sapiens
agctgctcgcacagat

SEQ ID NO: 2846722 - DNA, 14 bp, Homo sapiens
agctgctctggaaa

SEQ ID NO: 2846723 - DNA, 15 bp, Homo sapiens
agctgctctggaaaa

SEQ ID NO: 2846724 - DNA, 14 bp, Homo sapiens
agctgctgacagtg

SEQ ID NO: 2846725 - DNA, 21 bp, Homo sapiens
agctgctgttccaacagacag

SEQ ID NO: 2846726 - DNA, 19 bp, Homo sapiens
agctgcttgactatcacat

SEQ ID NO: 2846727 - DNA, 21 bp, Homo sapiens
agctgcttgttgtcaagtata

SEQ ID NO: 2846728 - DNA, 21 bp, Homo sapiens
agctgcttttgtctatgggac

SEQ ID NO: 2846729 - DNA, 23 bp, Homo sapiens
agctgcttttgtctatgggactc

SEQ ID NO: 2846730 - DNA, 16 bp, Homo sapiens
agctggaagcactgct

SEQ ID NO: 2846731 - DNA, 22 bp, Homo sapiens
agctggaattgctgctctctga

SEQ ID NO: 2846732 - DNA, 16 bp, Homo sapiens
agctggacaagaagct

SEQ ID NO: 2846733 - DNA, 20 bp, Homo sapiens
agctggacaagaagctgcta

SEQ ID NO: 2846734 - DNA, 19 bp, Homo sapiens
agctggcaaaggtggctct

SEQ ID NO: 2846735 - DNA, 15 bp, Homo sapiens
agctgggactacagg

SEQ ID NO: 2846736 - DNA, 14 bp, Homo sapiens
agctgggaggaaaa

SEQ ID NO: 2846737 - DNA, 18 bp, Homo sapiens
agctgggaggaaaagaaa

SEQ ID NO: 2846738 - DNA, 23 bp, Homo sapiens
agctgggcaggtctcctctggga

SEQ ID NO: 2846739 - DNA, 18 bp, Homo sapiens
agctgggggaagggtggt

SEQ ID NO: 2846740 - DNA, 21 bp, Homo sapiens
agctggtcccactcagtccat

SEQ ID NO: 2846741 - DNA, 13 bp, Homo sapiens
agctggtgggaag

SEQ ID NO: 2846742 - DNA, 21 bp, Homo sapiens
agctggtttcctcattcctga

SEQ ID NO: 2846743 - DNA, 17 bp, Homo sapiens
agctgtaaatacatgtg

SEQ ID NO: 2846744 - DNA, 20 bp, Homo sapiens
agctgtaggtgtgcgggacc

SEQ ID NO: 2846745 - DNA, 14 bp, Homo sapiens
agctgtgacctgct

SEQ ID NO: 2846746 - DNA, 19 bp, Homo sapiens
agctgtgacctgctgagct

SEQ ID NO: 2846747 - DNA, 23 bp, Homo sapiens
agctgtgacctgctgagctctga

SEQ ID NO: 2846748 - DNA, 12 bp, Homo sapiens
agctgtgatttt

SEQ ID NO: 2846749 - DNA, 17 bp, Homo sapiens
agctgtgctctggacag

SEQ ID NO: 2846750 - DNA, 18 bp, Homo sapiens
agctgtgctctggacagg

SEQ ID NO: 2846751 - DNA, 19 bp, Homo sapiens
agctgtgctctggacaggc

SEQ ID NO: 2846752 - DNA, 20 bp, Homo sapiens
agctgtgctctggacaggca

SEQ ID NO: 2846753 - DNA, 13 bp, Homo sapiens
agctgtgtgaaat

SEQ ID NO: 2846754 - DNA, 20 bp, Homo sapiens
aggcggagagtacagtgagc

SEQ ID NO: 2846755 - DNA, 19 bp, Homo sapiens
aggcggcacattggcagtg

SEQ ID NO: 2846756 - DNA, 13 bp, Homo sapiens
aggcgtcttgtat

SEQ ID NO: 2846757 - DNA, 16 bp, Homo sapiens
aggcgtcttgtatttt

SEQ ID NO: 2846758 - DNA, 12 bp, Homo sapiens
aggctaattttt

SEQ ID NO: 2846759 - DNA, 22 bp, Homo sapiens
aggctaatttttttgtatttta

SEQ ID NO: 2846760 - DNA, 17 bp, Homo sapiens
aggctacttcggggctg

SEQ ID NO: 2846761 - DNA, 19 bp, Homo sapiens
aggctattattttcactgt

SEQ ID NO: 2846762 - DNA, 19 bp, Homo sapiens
aggctcagtctcaggagca

SEQ ID NO: 2846763 - DNA, 23 bp, Homo sapiens
aggctcagtctcaggagcatggg

SEQ ID NO: 2846764 - DNA, 22 bp, Homo sapiens
aggctccaccccatccagttca

SEQ ID NO: 2846765 - DNA, 18 bp, Homo sapiens
aggctctgaaagccagct

SEQ ID NO: 2846766 - DNA, 20 bp, Homo sapiens
aggctcttctccttggagga

SEQ ID NO: 2846767 - DNA, 21 bp, Homo sapiens
aggctcttctccttggaggac

SEQ ID NO: 2846768 - DNA, 15 bp, Homo sapiens
aggctctttctgggc

SEQ ID NO: 2846769 - DNA, 18 bp, Homo sapiens
aggctctttctgggccaa

SEQ ID NO: 2846770 - DNA, 20 bp, Homo sapiens
aggctctttctgggccaagt

SEQ ID NO: 2846771 - DNA, 22 bp, Homo sapiens
aggctgaccaagagagaaagaa

SEQ ID NO: 2846772 - DNA, 11 bp, Homo sapiens
aggctgaggac

SEQ ID NO: 2846773 - DNA, 13 bp, Homo sapiens
aggctgaggactt

SEQ ID NO: 2846774 - DNA, 18 bp, Homo sapiens
aggctgaggcaagagaat

SEQ ID NO: 2846775 - DNA, 14 bp, Homo sapiens
aggctgaggcagaa

SEQ ID NO: 2846776 - DNA, 15 bp, Homo sapiens
aggctgaggcaggag

SEQ ID NO: 2846777 - DNA, 17 bp, Homo sapiens
aggctgaggcaggagaa

SEQ ID NO: 2846778 - DNA, 18 bp, Homo sapiens
aggctgagtgagccacag

SEQ ID NO: 2846779 - DNA, 19 bp, Homo sapiens
aggctgagtgagccacaga

SEQ ID NO: 2846780 - DNA, 20 bp, Homo sapiens
aggctgcagaaggccaagaa

SEQ ID NO: 2846781 - DNA, 22 bp, Homo sapiens
aggctgcaggacttctgcctga

SEQ ID NO: 2846782 - DNA, 17 bp, Homo sapiens
aggctgctcggggtgca

SEQ ID NO: 2846783 - DNA, 20 bp, Homo sapiens
aggctgctcggggtgcacag

SEQ ID NO: 2846784 - DNA, 12 bp, Homo sapiens
aggctggagaag

SEQ ID NO: 2846785 - DNA, 14 bp, Homo sapiens
aggctggaggcagg

SEQ ID NO: 2846786 - DNA, 16 bp, Homo sapiens
aggctggaggcagggc

SEQ ID NO: 2846787 - DNA, 19 bp, Homo sapiens
aggctggaggcagggcctt

SEQ ID NO: 2846788 - DNA, 23 bp, Homo sapiens
aggctggaggcagggccttgccc

SEQ ID NO: 2846789 - DNA, 20 bp, Homo sapiens
aggctggagtgcagtggcat

SEQ ID NO: 2846790 - DNA, 18 bp, Homo sapiens
aggctggcgtgcagtggt

SEQ ID NO: 2846791 - DNA, 23 bp, Homo sapiens
aggctgggggcgggggagccaac

SEQ ID NO: 2846792 - DNA, 23 bp, Homo sapiens
aggctggtctccctccagctgga

SEQ ID NO: 2846793 - DNA, 23 bp, Homo sapiens
aggctggtgctgtggccagggtg

SEQ ID NO: 2846794 - DNA, 21 bp, Homo sapiens
aggctgtggtggctgtctctg

SEQ ID NO: 2846795 - DNA, 22 bp, Homo sapiens
aggctgtggtggctgtctctgt

SEQ ID NO: 2846796 - DNA, 15 bp, Homo sapiens
aggctgtttcttttt

SEQ ID NO: 2846797 - DNA, 15 bp, Homo sapiens
aggcttatcaaaatc

SEQ ID NO: 2846798 - DNA, 17 bp, Homo sapiens
aggcttatcaaaatctt

SEQ ID NO: 2846799 - DNA, 20 bp, Homo sapiens
aggcttcagcatatttatag

SEQ ID NO: 2846800 - DNA, 16 bp, Homo sapiens
aggcttccttcatttc

SEQ ID NO: 2846801 - DNA, 19 bp, Homo sapiens
aggcttccttcatttcctc

SEQ ID NO: 2846802 - DNA, 21 bp, Homo sapiens
aggcttccttcatttcctccg

SEQ ID NO: 2846803 - DNA, 16 bp, Homo sapiens
aggcttcttcagatca

SEQ ID NO: 2846804 - DNA, 16 bp, Homo sapiens
aggcttggaatgaatt

SEQ ID NO: 2846805 - DNA, 19 bp, Homo sapiens
aggcttgtcactagcagct

SEQ ID NO: 2846806 - DNA, 13 bp, Homo sapiens
agggaaaaatata

SEQ ID NO: 2846807 - DNA, 14 bp, Homo sapiens
agggaaaaatatat

SEQ ID NO: 2846808 - DNA, 18 bp, Homo sapiens
agggaaaggatattttct

SEQ ID NO: 2846809 - DNA, 17 bp, Homo sapiens
agggaacagacaggaga

SEQ ID NO: 2846810 - DNA, 19 bp, Homo sapiens
agggaacagacaggagaaa

SEQ ID NO: 2846811 - DNA, 20 bp, Homo sapiens
agggaacagacaggagaaat

SEQ ID NO: 2846812 - DNA, 19 bp, Homo sapiens
agggaacggggtccttcaa

SEQ ID NO: 2846813 - DNA, 21 bp, Homo sapiens
agggaagacaggtctagactt

SEQ ID NO: 2846814 - DNA, 14 bp, Homo sapiens
agggaagagtgcat

SEQ ID NO: 2846815 - DNA, 18 bp, Homo sapiens
agggaaggaactctggct

SEQ ID NO: 2846816 - DNA, 23 bp, Homo sapiens
agggaaggaactctggcttccag

SEQ ID NO: 2846817 - DNA, 12 bp, Homo sapiens
agggaaggcagg

SEQ ID NO: 2846818 - DNA, 15 bp, Homo sapiens
agggaaggcaggcag

SEQ ID NO: 2846819 - DNA, 19 bp, Homo sapiens
agggaataaggtacaagaa

SEQ ID NO: 2846820 - DNA, 17 bp, Homo sapiens
agggacaaaggagcctg

SEQ ID NO: 2846821 - DNA, 16 bp, Homo sapiens
agggacagtattctca

SEQ ID NO: 2846822 - DNA, 14 bp, Homo sapiens
agggaccttgaagg

SEQ ID NO: 2846823 - DNA, 15 bp, Homo sapiens
agggaccttgaaggg

SEQ ID NO: 2846824 - DNA, 16 bp, Homo sapiens
agggactgtcgctgct

SEQ ID NO: 2846825 - DNA, 12 bp, Homo sapiens
agggacttaaaa

SEQ ID NO: 2846826 - DNA, 13 bp, Homo sapiens
agggacttaaaaa

SEQ ID NO: 2846827 - DNA, 19 bp, Homo sapiens
agggacttggaagctccgc

SEQ ID NO: 2846828 - DNA, 15 bp, Homo sapiens
agggagaaggatcta

SEQ ID NO: 2846829 - DNA, 16 bp, Homo sapiens
agggagaaggatctag

SEQ ID NO: 2846830 - DNA, 23 bp, Homo sapiens
agggagaggctgtggtggctgtc

SEQ ID NO: 2846831 - DNA, 16 bp, Homo sapiens
agggagcgagggagaa

SEQ ID NO: 2846832 - DNA, 14 bp, Homo sapiens
agggagggctctga

SEQ ID NO: 2846833 - DNA, 17 bp, Homo sapiens
agggagggctctgaggc

SEQ ID NO: 2846834 - DNA, 18 bp, Homo sapiens
agggagggctctgaggcg

SEQ ID NO: 2846835 - DNA, 20 bp, Homo sapiens
agggagggctctgaggcgcc

SEQ ID NO: 2846836 - DNA, 17 bp, Homo sapiens
agggaggtgaccccagg

SEQ ID NO: 2846837 - DNA, 17 bp, Homo sapiens
agggagtgacagaggca

SEQ ID NO: 2846838 - DNA, 20 bp, Homo sapiens
agggagtgacagaggcagcc

SEQ ID NO: 2846839 - DNA, 15 bp, Homo sapiens
agggatcacagggcc

SEQ ID NO: 2846840 - DNA, 17 bp, Homo sapiens
agggatcacagggcccc

SEQ ID NO: 2846841 - DNA, 22 bp, Homo sapiens
agggatcacagggccccagaag

SEQ ID NO: 2846842 - DNA, 22 bp, Homo sapiens
agggatgactaaaatatttatt

SEQ ID NO: 2846843 - DNA, 15 bp, Homo sapiens
agggcaagaaggaaa

SEQ ID NO: 2846844 - DNA, 18 bp, Homo sapiens
agtaaagtgataatttct

SEQ ID NO: 2846845 - DNA, 12 bp, Homo sapiens
agtaaagtttaa

SEQ ID NO: 2846846 - DNA, 15 bp, Homo sapiens
agtaaagtttaaaaa

SEQ ID NO: 2846847 - DNA, 18 bp, Homo sapiens
agtaaagtttaaaaaata

SEQ ID NO: 2846848 - DNA, 21 bp, Homo sapiens
agtaaagtttaaaaaatacac

SEQ ID NO: 2846849 - DNA, 20 bp, Homo sapiens
agtaactactttttatactc

SEQ ID NO: 2846850 - DNA, 14 bp, Homo sapiens
agtaactcatctgt

SEQ ID NO: 2846851 - DNA, 19 bp, Homo sapiens
agtaactgccatcaagatg

SEQ ID NO: 2846852 - DNA, 18 bp, Homo sapiens
agtaagctgctctattgt

SEQ ID NO: 2846853 - DNA, 19 bp, Homo sapiens
agtaagtaccactcaggcc

SEQ ID NO: 2846854 - DNA, 22 bp, Homo sapiens
agtaatatgcctgctatttgaa

SEQ ID NO: 2846855 - DNA, 13 bp, Homo sapiens
agtaatctgcatt

SEQ ID NO: 2846856 - DNA, 13 bp, Homo sapiens
agtaattatcggg

SEQ ID NO: 2846857 - DNA, 20 bp, Homo sapiens
agtaattatcgggaacagtg

SEQ ID NO: 2846858 - DNA, 17 bp, Homo sapiens
agtaattgcatttctgc

SEQ ID NO: 2846859 - DNA, 22 bp, Homo sapiens
agtaattggtccgatctttgac

SEQ ID NO: 2846860 - DNA, 12 bp, Homo sapiens
agtaatttagaa

SEQ ID NO: 2846861 - DNA, 17 bp, Homo sapiens
agtaatttagaaatcat

SEQ ID NO: 2846862 - DNA, 23 bp, Homo sapiens
agtaatttagaaatcattttgca

SEQ ID NO: 2846863 - DNA, 22 bp, Homo sapiens
agtacataaaggtggtatgtgt

SEQ ID NO: 2846864 - DNA, 15 bp, Homo sapiens
agtaccaatcatttt

SEQ ID NO: 2846865 - DNA, 17 bp, Homo sapiens
agtacctgtagtgagaa

SEQ ID NO: 2846866 - DNA, 18 bp, Homo sapiens
agtactcctgcaaaattt

SEQ ID NO: 2846867 - DNA, 17 bp, Homo sapiens
agtacttctccaccctg

SEQ ID NO: 2846868 - DNA, 20 bp, Homo sapiens
agtacttctccaccctgctc

SEQ ID NO: 2846869 - DNA, 22 bp, Homo sapiens
agtacttctccaccctgctctc

SEQ ID NO: 2846870 - DNA, 19 bp, Homo sapiens
agtagaagcctgcagcggc

SEQ ID NO: 2846871 - DNA, 17 bp, Homo sapiens
agtagaatggcagctgg

SEQ ID NO: 2846872 - DNA, 18 bp, Homo sapiens
agtagaatggcagctgga

SEQ ID NO: 2846873 - DNA, 20 bp, Homo sapiens
agtagaattatatctaattt

SEQ ID NO: 2846874 - DNA, 12 bp, Homo sapiens
agtagagaagta

SEQ ID NO: 2846875 - DNA, 11 bp, Homo sapiens
agtagagacag

SEQ ID NO: 2846876 - DNA, 14 bp, Homo sapiens
agtagcagtgattg

SEQ ID NO: 2846877 - DNA, 23 bp, Homo sapiens
agtagcatgagagaattgtatca

SEQ ID NO: 2846878 - DNA, 13 bp, Homo sapiens
agtagccagcacg

SEQ ID NO: 2846879 - DNA, 16 bp, Homo sapiens
agtagccgagagcctg

SEQ ID NO: 2846880 - DNA, 13 bp, Homo sapiens
agtagctgagctc

SEQ ID NO: 2846881 - DNA, 23 bp, Homo sapiens
agtagctgagctcacaaggcagc

SEQ ID NO: 2846882 - DNA, 14 bp, Homo sapiens
agtagctgggacta

SEQ ID NO: 2846883 - DNA, 21 bp, Homo sapiens
agtagctgggactacaggcac

SEQ ID NO: 2846884 - DNA, 22 bp, Homo sapiens
agtagctgggactacaggcacc

SEQ ID NO: 2846885 - DNA, 16 bp, Homo sapiens
agtagcttaaataaat

SEQ ID NO: 2846886 - DNA, 19 bp, Homo sapiens
agtagcttaaataaattca

SEQ ID NO: 2846887 - DNA, 15 bp, Homo sapiens
agtagtagtgtcttc

SEQ ID NO: 2846888 - DNA, 22 bp, Homo sapiens
agtagttgatgaccaatctctg

SEQ ID NO: 2846889 - DNA, 14 bp, Homo sapiens
agtataaaagacaa

SEQ ID NO: 2846890 - DNA, 18 bp, Homo sapiens
agtataaatggttgtctg

SEQ ID NO: 2846891 - DNA, 21 bp, Homo sapiens
agtatatagtatatttatact

SEQ ID NO: 2846892 - DNA, 15 bp, Homo sapiens
agtatatatgtacag

SEQ ID NO: 2846893 - DNA, 16 bp, Homo sapiens
agtatatatgtacagt

SEQ ID NO: 2846894 - DNA, 18 bp, Homo sapiens
agtatatctggacaagcc

SEQ ID NO: 2846895 - DNA, 17 bp, Homo sapiens
agtatattatgtattta

SEQ ID NO: 2846896 - DNA, 16 bp, Homo sapiens
agtatatttatactct

SEQ ID NO: 2846897 - DNA, 18 bp, Homo sapiens
agtatattttcttttcct

SEQ ID NO: 2846898 - DNA, 18 bp, Homo sapiens
agtatccaattatgtgac

SEQ ID NO: 2846899 - DNA, 19 bp, Homo sapiens
agtatccaattatgtgaca

SEQ ID NO: 2846900 - DNA, 21 bp, Homo sapiens
agtatccaattatgtgacaac

SEQ ID NO: 2846901 - DNA, 16 bp, Homo sapiens
agtatctaacatgtat

SEQ ID NO: 2846902 - DNA, 13 bp, Homo sapiens
agtatgaatgatg

SEQ ID NO: 2846903 - DNA, 15 bp, Homo sapiens
agtatgaatgatgtt

SEQ ID NO: 2846904 - DNA, 21 bp, Homo sapiens
agtatgaatgatgttttagaa

SEQ ID NO: 2846905 - DNA, 16 bp, Homo sapiens
agtatgcaagaagaat

SEQ ID NO: 2846906 - DNA, 15 bp, Homo sapiens
agtatggcctgtgtc

SEQ ID NO: 2846907 - DNA, 15 bp, Homo sapiens
agtatggtggctggg

SEQ ID NO: 2846908 - DNA, 17 bp, Homo sapiens
agtatggtggctgggtt

SEQ ID NO: 2846909 - DNA, 14 bp, Homo sapiens
agtatgtaatcttt

SEQ ID NO: 2846910 - DNA, 17 bp, Homo sapiens
agtatgtgatatctgaa

SEQ ID NO: 2846911 - DNA, 20 bp, Homo sapiens
agtattccatttttactaaa

SEQ ID NO: 2846912 - DNA, 22 bp, Homo sapiens
agtattccatttttactaaagc

SEQ ID NO: 2846913 - DNA, 12 bp, Homo sapiens
agtattcttcat

SEQ ID NO: 2846914 - DNA, 20 bp, Homo sapiens
agtattcttcatcagcattt

SEQ ID NO: 2846915 - DNA, 13 bp, Homo sapiens
agtatttatatat

SEQ ID NO: 2846916 - DNA, 15 bp, Homo sapiens
agtatttatatattt

SEQ ID NO: 2846917 - DNA, 14 bp, Homo sapiens
agtatttgttaatt

SEQ ID NO: 2846918 - DNA, 15 bp, Homo sapiens
agtatttgttaattt

SEQ ID NO: 2846919 - DNA, 19 bp, Homo sapiens
agtatttttttaagttaga

SEQ ID NO: 2846920 - DNA, 21 bp, Homo sapiens
agtatttttttaagttagaga

SEQ ID NO: 2846921 - DNA, 17 bp, Homo sapiens
agtcaaaaggtgcctgt

SEQ ID NO: 2846922 - DNA, 18 bp, Homo sapiens
agtcaaaaggtgcctgtg

SEQ ID NO: 2846923 - DNA, 13 bp, Homo sapiens
agtcaaaccataa

SEQ ID NO: 2846924 - DNA, 18 bp, Homo sapiens
agtcaaaccataaacttc

SEQ ID NO: 2846925 - DNA, 12 bp, Homo sapiens
agtcaaagtaaa

SEQ ID NO: 2846926 - DNA, 19 bp, Homo sapiens
agtcaacagttcaaagaag

SEQ ID NO: 2846927 - DNA, 21 bp, Homo sapiens
agtcaacagttcaaagaagtc

SEQ ID NO: 2846928 - DNA, 12 bp, Homo sapiens
agtcaagaaaaa

SEQ ID NO: 2846929 - DNA, 19 bp, Homo sapiens
agtcaagaaaaattattgt

SEQ ID NO: 2846930 - DNA, 15 bp, Homo sapiens
agtcaattagtacag

SEQ ID NO: 2846931 - DNA, 13 bp, Homo sapiens
agtcaccaagccc

SEQ ID NO: 2846932 - DNA, 13 bp, Homo sapiens
agtcaccaggaat

SEQ ID NO: 2846933 - DNA, 16 bp, Homo sapiens
agtcacttatttcata

SEQ ID NO: 2846934 - DNA, 14 bp, Homo sapiens
agtcagaacagcag

SEQ ID NO: 2846935 - DNA, 15 bp, Homo sapiens
agttacatgtttgca

SEQ ID NO: 2846936 - DNA, 12 bp, Homo sapiens
agttactcagcc

SEQ ID NO: 2846937 - DNA, 13 bp, Homo sapiens
agttactcagccc

SEQ ID NO: 2846938 - DNA, 16 bp, Homo sapiens
agttactcagccctgg

SEQ ID NO: 2846939 - DNA, 19 bp, Homo sapiens
agttactcagccctgggcc

SEQ ID NO: 2846940 - DNA, 23 bp, Homo sapiens
agttactcagccctgggccccac

SEQ ID NO: 2846941 - DNA, 14 bp, Homo sapiens
agttagcaggaaat

SEQ ID NO: 2846942 - DNA, 16 bp, Homo sapiens
agttagctcaggaggc

SEQ ID NO: 2846943 - DNA, 18 bp, Homo sapiens
agttagctgctttaaatc

SEQ ID NO: 2846944 - DNA, 15 bp, Homo sapiens
agttaggaaataaaa

SEQ ID NO: 2846945 - DNA, 20 bp, Homo sapiens
agttaggaaataaaaccttt

SEQ ID NO: 2846946 - DNA, 17 bp, Homo sapiens
agttaggtgtgccaaac

SEQ ID NO: 2846947 - DNA, 15 bp, Homo sapiens
agttaggttataaga

SEQ ID NO: 2846948 - DNA, 18 bp, Homo sapiens
agttaggttataagaaac

SEQ ID NO: 2846949 - DNA, 23 bp, Homo sapiens
agttagttctctcgtaactggtt

SEQ ID NO: 2846950 - DNA, 22 bp, Homo sapiens
agttatctaagttaatttaaag

SEQ ID NO: 2846951 - DNA, 19 bp, Homo sapiens
agttattccccatcttcca

SEQ ID NO: 2846952 - DNA, 21 bp, Homo sapiens
agttatttatttattggagat

SEQ ID NO: 2846953 - DNA, 18 bp, Homo sapiens
agttattttaggagacag

SEQ ID NO: 2846954 - DNA, 19 bp, Homo sapiens
agttcaagaaataagtttt

SEQ ID NO: 2846955 - DNA, 21 bp, Homo sapiens
agttcactataaatggtgttt

SEQ ID NO: 2846956 - DNA, 14 bp, Homo sapiens
agttcataccctgt

SEQ ID NO: 2846957 - DNA, 20 bp, Homo sapiens
agttcatagggtctcttcag

SEQ ID NO: 2846958 - DNA, 22 bp, Homo sapiens
agttccatgaagaccacatcca

SEQ ID NO: 2846959 - DNA, 15 bp, Homo sapiens
agttcccatgttaaa

SEQ ID NO: 2846960 - DNA, 15 bp, Homo sapiens
agttccctacttcct

SEQ ID NO: 2846961 - DNA, 24 bp, Homo sapiens
agttccctgaaaacccagagagga

SEQ ID NO: 2846962 - DNA, 12 bp, Homo sapiens
agttcctcgccc

SEQ ID NO: 2846963 - DNA, 15 bp, Homo sapiens
agttcctcgccctgg

SEQ ID NO: 2846964 - DNA, 16 bp, Homo sapiens
agttcctcgccctggg

SEQ ID NO: 2846965 - DNA, 17 bp, Homo sapiens
agttcctcgccctgggt

SEQ ID NO: 2846966 - DNA, 18 bp, Homo sapiens
agttcctctagtgccctc

SEQ ID NO: 2846967 - DNA, 20 bp, Homo sapiens
agttccttcagcttccattt

SEQ ID NO: 2846968 - DNA, 20 bp, Homo sapiens
agttccttgatctgtatata

SEQ ID NO: 2846969 - DNA, 18 bp, Homo sapiens
agttcgagaccaacctga

SEQ ID NO: 2846970 - DNA, 19 bp, Homo sapiens
agttcgagaccagcctggc

SEQ ID NO: 2846971 - DNA, 21 bp, Homo sapiens
agttcgatgggcccaattctt

SEQ ID NO: 2846972 - DNA, 18 bp, Homo sapiens
agttcgcagccaccctga

SEQ ID NO: 2846973 - DNA, 14 bp, Homo sapiens
agttctagagaaga

SEQ ID NO: 2846974 - DNA, 22 bp, Homo sapiens
agttctgaaaactgtttatggt

SEQ ID NO: 2846975 - DNA, 20 bp, Homo sapiens
agttctgctcctctccaggc

SEQ ID NO: 2846976 - DNA, 22 bp, Homo sapiens
agttcttaaggattgtgatatt

SEQ ID NO: 2846977 - DNA, 22 bp, Homo sapiens
agttctttaggtgcctcctgtc

SEQ ID NO: 2846978 - DNA, 18 bp, Homo sapiens
agttgaaaataaagtgta

SEQ ID NO: 2846979 - DNA, 22 bp, Homo sapiens
agttgacttgacagaacactgt

SEQ ID NO: 2846980 - DNA, 19 bp, Homo sapiens
agttgagtctcctctctga

SEQ ID NO: 2846981 - DNA, 23 bp, Homo sapiens
agttgataaagattttttaataa

SEQ ID NO: 2846982 - DNA, 22 bp, Homo sapiens
agttgatgaccaatctctgtga

SEQ ID NO: 2846983 - DNA, 16 bp, Homo sapiens
agttgcacagctatga

SEQ ID NO: 2846984 - DNA, 17 bp, Homo sapiens
agttgcacagctatgaa

SEQ ID NO: 2846985 - DNA, 11 bp, Homo sapiens
agttgcagaaa

SEQ ID NO: 2846986 - DNA, 23 bp, Homo sapiens
agttgcagactcagtttgtcaga

SEQ ID NO: 2846987 - DNA, 14 bp, Homo sapiens
agttgctgtcataa

SEQ ID NO: 2846988 - DNA, 16 bp, Homo sapiens
agttggaaagttggaa

SEQ ID NO: 2846989 - DNA, 20 bp, Homo sapiens
agttggagaaaatgaagaaa

SEQ ID NO: 2846990 - DNA, 13 bp, Homo sapiens
agttgggagcact

SEQ ID NO: 2846991 - DNA, 19 bp, Homo sapiens
agttgggcttcctcatagt

SEQ ID NO: 2846992 - DNA, 16 bp, Homo sapiens
agttgtatctcttttg

SEQ ID NO: 2846993 - DNA, 22 bp, Homo sapiens
agttgtatctcttttgaatcca

SEQ ID NO: 2846994 - DNA, 13 bp, Homo sapiens
agttgtcttgtcc

SEQ ID NO: 2846995 - DNA, 17 bp, Homo sapiens
agttgtgggtgggagag

SEQ ID NO: 2846996 - DNA, 13 bp, Homo sapiens
agttgtttcattg

SEQ ID NO: 2846997 - DNA, 15 bp, Homo sapiens
agttgtttgtgcctt

SEQ ID NO: 2846998 - DNA, 14 bp, Homo sapiens
agtttaaaaaatac

SEQ ID NO: 2846999 - DNA, 20 bp, Homo sapiens
agtttaatggtgccttcatt

SEQ ID NO: 2847000 - DNA, 15 bp, Homo sapiens
agtttactattttac

SEQ ID NO: 2847001 - DNA, 18 bp, Homo sapiens
agtttagcagttaaaagt

SEQ ID NO: 2847002 - DNA, 16 bp, Homo sapiens
agtttataagcccaaa

SEQ ID NO: 2847003 - DNA, 18 bp, Homo sapiens
agtttatatttaactctc

SEQ ID NO: 2847004 - DNA, 18 bp, Homo sapiens
agtttcagagaagttctg

SEQ ID NO: 2847005 - DNA, 15 bp, Homo sapiens
agtttctattgtaaa

SEQ ID NO: 2847006 - DNA, 16 bp, Homo sapiens
agtttctggccctggc

SEQ ID NO: 2847007 - DNA, 22 bp, Homo sapiens
agtttcttactgttttgtatca

SEQ ID NO: 2847008 - DNA, 16 bp, Homo sapiens
agtttcttggtctcag

SEQ ID NO: 2847009 - DNA, 20 bp, Homo sapiens
agtttgcagaaaagcacctg

SEQ ID NO: 2847010 - DNA, 21 bp, Homo sapiens
agtttgcagaaaagcacctgc

SEQ ID NO: 2847011 - DNA, 22 bp, Homo sapiens
agtttggccgggtgcggtggct

SEQ ID NO: 2847012 - DNA, 13 bp, Homo sapiens
agtttgtgtgtct

SEQ ID NO: 2847013 - DNA, 21 bp, Homo sapiens
agttttagttgcagaaacatt

SEQ ID NO: 2847014 - DNA, 15 bp, Homo sapiens
agttttataaaactc

SEQ ID NO: 2847015 - DNA, 16 bp, Homo sapiens
agttttattgagaatt

SEQ ID NO: 2847016 - DNA, 21 bp, Homo sapiens
agttttattgagaattttaaa

SEQ ID NO: 2847017 - DNA, 17 bp, Homo sapiens
agttttctcctcccagg

SEQ ID NO: 2847018 - DNA, 16 bp, Homo sapiens
agttttgcatttatgg

SEQ ID NO: 2847019 - DNA, 22 bp, Homo sapiens
agtttttacctaccacagtgtc

SEQ ID NO: 2847020 - DNA, 23 bp, Homo sapiens
agtttttacctaccacagtgtct

SEQ ID NO: 2847021 - DNA, 17 bp, Homo sapiens
agtttttcagaaagcat

SEQ ID NO: 2847022 - DNA, 17 bp, Homo sapiens
ataaaaaaatacagtaa

SEQ ID NO: 2847023 - DNA, 20 bp, Homo sapiens
ataaaaaacatttgtacatt

SEQ ID NO: 2847024 - DNA, 12 bp, Homo sapiens
ataaaaaatgga

SEQ ID NO: 2847025 - DNA, 18 bp, Homo sapiens
atatcagttactcagccc

SEQ ID NO: 2847026 - DNA, 23 bp, Homo sapiens
atatcagttactcagccctgggc

SEQ ID NO: 2847027 - DNA, 16 bp, Homo sapiens
atatcctttgccccaa

SEQ ID NO: 2847028 - DNA, 20 bp, Homo sapiens
atatctatagtagtcaatta

SEQ ID NO: 2847029 - DNA, 23 bp, Homo sapiens
atatctatagtagtcaattagta

SEQ ID NO: 2847030 - DNA, 18 bp, Homo sapiens
atatctatctatttgagg

SEQ ID NO: 2847031 - DNA, 21 bp, Homo sapiens
atatctatcttatatagttta

SEQ ID NO: 2847032 - DNA, 23 bp, Homo sapiens
atatctattattataaaaataat

SEQ ID NO: 2847033 - DNA, 15 bp, Homo sapiens
atatctcctgaaaag

SEQ ID NO: 2847034 - DNA, 16 bp, Homo sapiens
atatctgaaaactgga

SEQ ID NO: 2847035 - DNA, 17 bp, Homo sapiens
atatctgagaagtgtat

SEQ ID NO: 2847036 - DNA, 18 bp, Homo sapiens
atatctgagaagtgtata

SEQ ID NO: 2847037 - DNA, 19 bp, Homo sapiens
atatctgagaagtgtatat

SEQ ID NO: 2847038 - DNA, 13 bp, Homo sapiens
atatcttgaagaa

SEQ ID NO: 2847039 - DNA, 15 bp, Homo sapiens
atatcttgaagaata

SEQ ID NO: 2847040 - DNA, 14 bp, Homo sapiens
atatgaaaaatatg

SEQ ID NO: 2847041 - DNA, 19 bp, Homo sapiens
atatgaaatgtttcactat

SEQ ID NO: 2847042 - DNA, 14 bp, Homo sapiens
atatgaaatttaat

SEQ ID NO: 2847043 - DNA, 15 bp, Homo sapiens
atatgacagctgtcc

SEQ ID NO: 2847044 - DNA, 14 bp, Homo sapiens
atatgatatgtaaa

SEQ ID NO: 2847045 - DNA, 16 bp, Homo sapiens
atatgatatgtaaaca

SEQ ID NO: 2847046 - DNA, 15 bp, Homo sapiens
atatgcacaatagca

SEQ ID NO: 2847047 - DNA, 15 bp, Homo sapiens
atatgcaccttgtgt

SEQ ID NO: 2847048 - DNA, 17 bp, Homo sapiens
atatgcaccttgtgtct

SEQ ID NO: 2847049 - DNA, 17 bp, Homo sapiens
atatgccaccgattgca

SEQ ID NO: 2847050 - DNA, 20 bp, Homo sapiens
atatgcctacttgtaatttc

SEQ ID NO: 2847051 - DNA, 21 bp, Homo sapiens
atatgcctacttgtaatttct

SEQ ID NO: 2847052 - DNA, 19 bp, Homo sapiens
atatggaaatcctgttact

SEQ ID NO: 2847053 - DNA, 13 bp, Homo sapiens
atatgtaaaataa

SEQ ID NO: 2847054 - DNA, 14 bp, Homo sapiens
atatgtaccatgta

SEQ ID NO: 2847055 - DNA, 14 bp, Homo sapiens
atatgtatatctat

SEQ ID NO: 2847056 - DNA, 16 bp, Homo sapiens
atatgtatatgtatat

SEQ ID NO: 2847057 - DNA, 15 bp, Homo sapiens
atatgtatttattgt

SEQ ID NO: 2847058 - DNA, 15 bp, Homo sapiens
atatgttcattaaat

SEQ ID NO: 2847059 - DNA, 18 bp, Homo sapiens
atatgttttaagaggcag

SEQ ID NO: 2847060 - DNA, 17 bp, Homo sapiens
atattaaacttctgatt

SEQ ID NO: 2847061 - DNA, 14 bp, Homo sapiens
atattaaaggagtt

SEQ ID NO: 2847062 - DNA, 23 bp, Homo sapiens
atattaaatatgttagcaaagag

SEQ ID NO: 2847063 - DNA, 14 bp, Homo sapiens
atattagaagtgtt

SEQ ID NO: 2847064 - DNA, 16 bp, Homo sapiens
atattagagtgccctt

SEQ ID NO: 2847065 - DNA, 23 bp, Homo sapiens
atattagagtgcccttaaaataa

SEQ ID NO: 2847066 - DNA, 22 bp, Homo sapiens
atattagcatttagtccaatgt

SEQ ID NO: 2847067 - DNA, 14 bp, Homo sapiens
atattataaataaa

SEQ ID NO: 2847068 - DNA, 14 bp, Homo sapiens
atattataataatg

SEQ ID NO: 2847069 - DNA, 22 bp, Homo sapiens
atattataatttttttcaatat

SEQ ID NO: 2847070 - DNA, 16 bp, Homo sapiens
atattatggaagattt

SEQ ID NO: 2847071 - DNA, 15 bp, Homo sapiens
atattatggtgtaat

SEQ ID NO: 2847072 - DNA, 18 bp, Homo sapiens
atattatggtgtaatgca

SEQ ID NO: 2847073 - DNA, 21 bp, Homo sapiens
atattatggtgtaatgcacaa

SEQ ID NO: 2847074 - DNA, 21 bp, Homo sapiens
atattatgtatttatattttg

SEQ ID NO: 2847075 - DNA, 13 bp, Homo sapiens
atattcaataaag

SEQ ID NO: 2847076 - DNA, 15 bp, Homo sapiens
atattcaataaagct

SEQ ID NO: 2847077 - DNA, 20 bp, Homo sapiens
atattcaataaagctgctga

SEQ ID NO: 2847078 - DNA, 19 bp, Homo sapiens
atattcagagatgtaccat

SEQ ID NO: 2847079 - DNA, 17 bp, Homo sapiens
atattcatgtaataaat

SEQ ID NO: 2847080 - DNA, 21 bp, Homo sapiens
atattcattgtataaaaatag

SEQ ID NO: 2847081 - DNA, 17 bp, Homo sapiens
atattccaccattcaca

SEQ ID NO: 2847082 - DNA, 17 bp, Homo sapiens
atattcctattgtgcaa

SEQ ID NO: 2847083 - DNA, 23 bp, Homo sapiens
atattcctattgtgcaatgtaaa

SEQ ID NO: 2847084 - DNA, 18 bp, Homo sapiens
atattcctgaatgaaata

SEQ ID NO: 2847085 - DNA, 23 bp, Homo sapiens
atattcctgaatgaaatatcaga

SEQ ID NO: 2847086 - DNA, 22 bp, Homo sapiens
atattctcacgggcagtagctg

SEQ ID NO: 2847087 - DNA, 17 bp, Homo sapiens
atattctctaagatata

SEQ ID NO: 2847088 - DNA, 16 bp, Homo sapiens
atattctgttggccag

SEQ ID NO: 2847089 - DNA, 14 bp, Homo sapiens
atattgcttatgtc

SEQ ID NO: 2847090 - DNA, 17 bp, Homo sapiens
atattgcttatgtctct

SEQ ID NO: 2847091 - DNA, 12 bp, Homo sapiens
atattgtaaata

SEQ ID NO: 2847092 - DNA, 20 bp, Homo sapiens
atatttaagtatatagtata

SEQ ID NO: 2847093 - DNA, 19 bp, Homo sapiens
atatttacatatgaaattt

SEQ ID NO: 2847094 - DNA, 21 bp, Homo sapiens
atatttacatgaattgcattt

SEQ ID NO: 2847095 - DNA, 14 bp, Homo sapiens
atatttacgtatga

SEQ ID NO: 2847096 - DNA, 13 bp, Homo sapiens
atatttactttaa

SEQ ID NO: 2847097 - DNA, 21 bp, Homo sapiens
atatttataactcatcataaa

SEQ ID NO: 2847098 - DNA, 22 bp, Homo sapiens
atatttataactcatcataaaa

SEQ ID NO: 2847099 - DNA, 23 bp, Homo sapiens
atatttataactcatcataaaat

SEQ ID NO: 2847100 - DNA, 14 bp, Homo sapiens
atatttatactcta

SEQ ID NO: 2847101 - DNA, 19 bp, Homo sapiens
atatttatggggggagaac

SEQ ID NO: 2847102 - DNA, 14 bp, Homo sapiens
atatttattacctc

SEQ ID NO: 2847103 - DNA, 21 bp, Homo sapiens
atatttattttctttctgtaa

SEQ ID NO: 2847104 - DNA, 15 bp, Homo sapiens
atatttcaaaataaa

SEQ ID NO: 2847105 - DNA, 16 bp, Homo sapiens
atatttccatttcttc

SEQ ID NO: 2847106 - DNA, 18 bp, Homo sapiens
atatttctcgtatttaat

SEQ ID NO: 2847107 - DNA, 17 bp, Homo sapiens
atatttgaatatcatta

SEQ ID NO: 2847108 - DNA, 16 bp, Homo sapiens
atatttgcttatttat

SEQ ID NO: 2847109 - DNA, 13 bp, Homo sapiens
atatttggaaaga

SEQ ID NO: 2847110 - DNA, 15 bp, Homo sapiens
atatttggaaagaga

SEQ ID NO: 2847111 - DNA, 13 bp, Homo sapiens
atatttgttaaat

SEQ ID NO: 2847112 - DNA, 11 bp, Homo sapiens
atattttaatt

SEQ ID NO: 2847113 - DNA, 23 bp, Homo sapiens
atattttacattcttggaaagtc

SEQ ID NO: 2847114 - DNA, 21 bp, Homo sapiens
atattttccctctcttgcctt

SEQ ID NO: 2847115 - DNA, 23 bp, Homo sapiens
atattttcttccaagcaaaggtg

SEQ ID NO: 2847116 - DNA, 17 bp, Homo sapiens
atctatctgtattttca

SEQ ID NO: 2847117 - DNA, 12 bp, Homo sapiens
atctatgcaatt

SEQ ID NO: 2847118 - DNA, 16 bp, Homo sapiens
atctatgcaattttta

SEQ ID NO: 2847119 - DNA, 22 bp, Homo sapiens
atctatgcaatttttaaactag

SEQ ID NO: 2847120 - DNA, 23 bp, Homo sapiens
atctatgcaatttttaaactagt

SEQ ID NO: 2847121 - DNA, 21 bp, Homo sapiens
atctatggcagtccagccagc

SEQ ID NO: 2847122 - DNA, 21 bp, Homo sapiens
atctattcagacaagcaacag

SEQ ID NO: 2847123 - DNA, 13 bp, Homo sapiens
atctcactttgcc

SEQ ID NO: 2847124 - DNA, 14 bp, Homo sapiens
atctcactttgccc

SEQ ID NO: 2847125 - DNA, 16 bp, Homo sapiens
atctcaggagcttgca

SEQ ID NO: 2847126 - DNA, 17 bp, Homo sapiens
atctcagggtccagacc

SEQ ID NO: 2847127 - DNA, 20 bp, Homo sapiens
atctcagtgaagaatacttc

SEQ ID NO: 2847128 - DNA, 21 bp, Homo sapiens
atctcatggaaactggccagg

SEQ ID NO: 2847129 - DNA, 19 bp, Homo sapiens
atctccaccctgagcctga

SEQ ID NO: 2847130 - DNA, 15 bp, Homo sapiens
atctccactccagat

SEQ ID NO: 2847131 - DNA, 12 bp, Homo sapiens
atctccaggatt

SEQ ID NO: 2847132 - DNA, 20 bp, Homo sapiens
atctccagggctgcccctgt

SEQ ID NO: 2847133 - DNA, 16 bp, Homo sapiens
atctcccctcctcaca

SEQ ID NO: 2847134 - DNA, 12 bp, Homo sapiens
atctcctgaaaa

SEQ ID NO: 2847135 - DNA, 15 bp, Homo sapiens
atctctaaactgctg

SEQ ID NO: 2847136 - DNA, 16 bp, Homo sapiens
atctctagaattttaa

SEQ ID NO: 2847137 - DNA, 13 bp, Homo sapiens
atctctcaggagc

SEQ ID NO: 2847138 - DNA, 17 bp, Homo sapiens
atctctcaggagcacag

SEQ ID NO: 2847139 - DNA, 22 bp, Homo sapiens
atctctctactcctacctcagc

SEQ ID NO: 2847140 - DNA, 22 bp, Homo sapiens
atctctgtgactcgcttagctg

SEQ ID NO: 2847141 - DNA, 19 bp, Homo sapiens
atctctgtgtacccactcc

SEQ ID NO: 2847142 - DNA, 23 bp, Homo sapiens
atctctgtgtacccactcctcac

SEQ ID NO: 2847143 - DNA, 15 bp, Homo sapiens
atctctgtgtgcaca

SEQ ID NO: 2847144 - DNA, 19 bp, Homo sapiens
atctctgtgtgcacaaata

SEQ ID NO: 2847145 - DNA, 14 bp, Homo sapiens
atctcttcttttaa

SEQ ID NO: 2847146 - DNA, 13 bp, Homo sapiens
atctgaaaactgg

SEQ ID NO: 2847147 - DNA, 19 bp, Homo sapiens
atctgaacacatactagaa

SEQ ID NO: 2847148 - DNA, 15 bp, Homo sapiens
atctgaagctattga

SEQ ID NO: 2847149 - DNA, 18 bp, Homo sapiens
atctgaagctattgatgt

SEQ ID NO: 2847150 - DNA, 19 bp, Homo sapiens
atctgaatttttaaacaag

SEQ ID NO: 2847151 - DNA, 20 bp, Homo sapiens
atctgaatttttaaacaagt

SEQ ID NO: 2847152 - DNA, 19 bp, Homo sapiens
atctgagaagtgtatatag

SEQ ID NO: 2847153 - DNA, 18 bp, Homo sapiens
atctgagcctaaatctaa

SEQ ID NO: 2847154 - DNA, 22 bp, Homo sapiens
atctgagcctaaatctaatcag

SEQ ID NO: 2847155 - DNA, 19 bp, Homo sapiens
atctgattggacattttct

SEQ ID NO: 2847156 - DNA, 21 bp, Homo sapiens
atctgcaccctcgatgaagcc

SEQ ID NO: 2847157 - DNA, 20 bp, Homo sapiens
atctgcagggggtgtgtctg

SEQ ID NO: 2847158 - DNA, 20 bp, Homo sapiens
atctgcatttataaatgtgt

SEQ ID NO: 2847159 - DNA, 19 bp, Homo sapiens
atctggactcctctgtcca

SEQ ID NO: 2847160 - DNA, 22 bp, Homo sapiens
atctggactcctctgtccaggc

SEQ ID NO: 2847161 - DNA, 12 bp, Homo sapiens
atctggcagggt

SEQ ID NO: 2847162 - DNA, 16 bp, Homo sapiens
atctgggaagatttct

SEQ ID NO: 2847163 - DNA, 17 bp, Homo sapiens
atctgggaccctttcct

SEQ ID NO: 2847164 - DNA, 20 bp, Homo sapiens
atctgggaccctttccttcc

SEQ ID NO: 2847165 - DNA, 13 bp, Homo sapiens
atctgggaggctg

SEQ ID NO: 2847166 - DNA, 22 bp, Homo sapiens
atctgggaggctggtctccctc

SEQ ID NO: 2847167 - DNA, 17 bp, Homo sapiens
atctgggttcactgcaa

SEQ ID NO: 2847168 - DNA, 15 bp, Homo sapiens
atctgtaaggaactg

SEQ ID NO: 2847169 - DNA, 18 bp, Homo sapiens
atctgtaaggaactggaa

SEQ ID NO: 2847170 - DNA, 13 bp, Homo sapiens
atctgtactgtaa

SEQ ID NO: 2847171 - DNA, 14 bp, Homo sapiens
atctgtactgtaat

SEQ ID NO: 2847172 - DNA, 20 bp, Homo sapiens
atctgtactgtaattttgtt

SEQ ID NO: 2847173 - DNA, 14 bp, Homo sapiens
atctgtagggctgg

SEQ ID NO: 2847174 - DNA, 15 bp, Homo sapiens
atctgtagggctgga

SEQ ID NO: 2847175 - DNA, 18 bp, Homo sapiens
atctgtagggctggacct

SEQ ID NO: 2847176 - DNA, 17 bp, Homo sapiens
atctgtcatttgagcag

SEQ ID NO: 2847177 - DNA, 17 bp, Homo sapiens
atctgtcttgccagcca

SEQ ID NO: 2847178 - DNA, 19 bp, Homo sapiens
atctgtcttgccagccaga

SEQ ID NO: 2847179 - DNA, 18 bp, Homo sapiens
atctgtgaggtgctgatg

SEQ ID NO: 2847180 - DNA, 16 bp, Homo sapiens
atctgtggaaatgaca

SEQ ID NO: 2847181 - DNA, 22 bp, Homo sapiens
atctgtgtaacctccacagtag

SEQ ID NO: 2847182 - DNA, 19 bp, Homo sapiens
atctgtgtgtgtcccccta

SEQ ID NO: 2847183 - DNA, 14 bp, Homo sapiens
atctgttttaaatt

SEQ ID NO: 2847184 - DNA, 20 bp, Homo sapiens
atctgtttttaaaaatcata

SEQ ID NO: 2847185 - DNA, 14 bp, Homo sapiens
atctgtttttctaa

SEQ ID NO: 2847186 - DNA, 15 bp, Homo sapiens
atcttaaaagtgtaa

SEQ ID NO: 2847187 - DNA, 16 bp, Homo sapiens
atcttagctttccaca

SEQ ID NO: 2847188 - DNA, 18 bp, Homo sapiens
atcttagctttccacagg

SEQ ID NO: 2847189 - DNA, 12 bp, Homo sapiens
atcttatttata

SEQ ID NO: 2847190 - DNA, 14 bp, Homo sapiens
atcttcagagcagg

SEQ ID NO: 2847191 - DNA, 20 bp, Homo sapiens
atcttcagttttatctttaa

SEQ ID NO: 2847192 - DNA, 22 bp, Homo sapiens
atcttcagttttatctttaatc

SEQ ID NO: 2847193 - DNA, 15 bp, Homo sapiens
atcttccttgtgagg

SEQ ID NO: 2847194 - DNA, 17 bp, Homo sapiens
atcttccttgtgaggat

SEQ ID NO: 2847195 - DNA, 17 bp, Homo sapiens
atcttctgcaattgctt

SEQ ID NO: 2847196 - DNA, 20 bp, Homo sapiens
atcttctggagtctccagtg

SEQ ID NO: 2847197 - DNA, 14 bp, Homo sapiens
atcttgctctgctg

SEQ ID NO: 2847198 - DNA, 16 bp, Homo sapiens
atcttgctctgctgac

SEQ ID NO: 2847199 - DNA, 17 bp, Homo sapiens
atcttgctctgctgaca

SEQ ID NO: 2847200 - DNA, 19 bp, Homo sapiens
atcttgctctgctgacaga

SEQ ID NO: 2847201 - DNA, 20 bp, Homo sapiens
atcttggttgatgccaaaaa

SEQ ID NO: 2847202 - DNA, 11 bp, Homo sapiens
atctttcttct

SEQ ID NO: 2847203 - DNA, 19 bp, Homo sapiens
atctttcttctattttatt

SEQ ID NO: 2847204 - DNA, 14 bp, Homo sapiens
atctttctttacct

SEQ ID NO: 2847205 - DNA, 18 bp, Homo sapiens
atctttctttacctgaga

SEQ ID NO: 2847206 - DNA, 21 bp, Homo sapiens
atctttctttacctgagacca

SEQ ID NO: 2847207 - DNA, 15 bp, Homo sapiens
atgctaagagaagta

SEQ ID NO: 2847208 - DNA, 18 bp, Homo sapiens
atgctaagagaagtagaa

SEQ ID NO: 2847209 - DNA, 21 bp, Homo sapiens
atgctactacaaaaaagttgt

SEQ ID NO: 2847210 - DNA, 13 bp, Homo sapiens
atgctatctctgt

SEQ ID NO: 2847211 - DNA, 18 bp, Homo sapiens
atgctcagccctgactgg

SEQ ID NO: 2847212 - DNA, 11 bp, Homo sapiens
atgctgaatta

SEQ ID NO: 2847213 - DNA, 21 bp, Homo sapiens
atgctgagattacaggtgtga

SEQ ID NO: 2847214 - DNA, 22 bp, Homo sapiens
atgctgagtatgttaagctctt

SEQ ID NO: 2847215 - DNA, 14 bp, Homo sapiens
atgctgccaaattt

SEQ ID NO: 2847216 - DNA, 15 bp, Homo sapiens
atgctgcctccagaa

SEQ ID NO: 2847217 - DNA, 21 bp, Homo sapiens
atgctggttttcctaaatgca

SEQ ID NO: 2847218 - DNA, 15 bp, Homo sapiens
atgctgttgcctcat

SEQ ID NO: 2847219 - DNA, 14 bp, Homo sapiens
atgctgttttaata

SEQ ID NO: 2847220 - DNA, 15 bp, Homo sapiens
atgcttcttgcccct

SEQ ID NO: 2847221 - DNA, 22 bp, Homo sapiens
atgcttcttgccccttgggcct

SEQ ID NO: 2847222 - DNA, 16 bp, Homo sapiens
atgctttatgtttaaa

SEQ ID NO: 2847223 - DNA, 18 bp, Homo sapiens
atgctttcctccctggca

SEQ ID NO: 2847224 - DNA, 13 bp, Homo sapiens
atggaaatcctgt

SEQ ID NO: 2847225 - DNA, 23 bp, Homo sapiens
atggaactcagctgtctgtggct

SEQ ID NO: 2847226 - DNA, 17 bp, Homo sapiens
atggaagattttaaatt

SEQ ID NO: 2847227 - DNA, 16 bp, Homo sapiens
atggaatacagtgtta

SEQ ID NO: 2847228 - DNA, 14 bp, Homo sapiens
atggagactcctgc

SEQ ID NO: 2847229 - DNA, 20 bp, Homo sapiens
atggagactcctgccctgtt

SEQ ID NO: 2847230 - DNA, 13 bp, Homo sapiens
atggagagccctg

SEQ ID NO: 2847231 - DNA, 15 bp, Homo sapiens
atggagcttgtacat

SEQ ID NO: 2847232 - DNA, 16 bp, Homo sapiens
atggagcttgtacata

SEQ ID NO: 2847233 - DNA, 17 bp, Homo sapiens
atggagcttgtacatat

SEQ ID NO: 2847234 - DNA, 13 bp, Homo sapiens
atggaggagaaga

SEQ ID NO: 2847235 - DNA, 11 bp, Homo sapiens
atggagtgacg

SEQ ID NO: 2847236 - DNA, 12 bp, Homo sapiens
atggatgtgctt

SEQ ID NO: 2847237 - DNA, 20 bp, Homo sapiens
atggatgtggggtccccatc

SEQ ID NO: 2847238 - DNA, 14 bp, Homo sapiens
atggattctaaaat

SEQ ID NO: 2847239 - DNA, 15 bp, Homo sapiens
atggatttgaagcaa

SEQ ID NO: 2847240 - DNA, 23 bp, Homo sapiens
atggcacagcccaaagaaggaaa

SEQ ID NO: 2847241 - DNA, 19 bp, Homo sapiens
atggcagatgtaggaggga

SEQ ID NO: 2847242 - DNA, 15 bp, Homo sapiens
atggcagtgtctttc

SEQ ID NO: 2847243 - DNA, 19 bp, Homo sapiens
atggcctgccttgaagcca

SEQ ID NO: 2847244 - DNA, 20 bp, Homo sapiens
atggcctgccttgaagccac

SEQ ID NO: 2847245 - DNA, 17 bp, Homo sapiens
atggctaattcccagag

SEQ ID NO: 2847246 - DNA, 15 bp, Homo sapiens
atggctgtgcctctg

SEQ ID NO: 2847247 - DNA, 16 bp, Homo sapiens
atggctgtgcctctgc

SEQ ID NO: 2847248 - DNA, 20 bp, Homo sapiens
atggctgtgcctctgcctgt

SEQ ID NO: 2847249 - DNA, 19 bp, Homo sapiens
atggcttatttgtataatg

SEQ ID NO: 2847250 - DNA, 15 bp, Homo sapiens
atgggagcctgaggc

SEQ ID NO: 2847251 - DNA, 21 bp, Homo sapiens
atgggagctggttagaaatgc

SEQ ID NO: 2847252 - DNA, 21 bp, Homo sapiens
atgggccaattaaaatatata

SEQ ID NO: 2847253 - DNA, 15 bp, Homo sapiens
atgggcctcctgtgt

SEQ ID NO: 2847254 - DNA, 18 bp, Homo sapiens
atgggcctcctgtgtgtg

SEQ ID NO: 2847255 - DNA, 18 bp, Homo sapiens
atgggcttgttttcttgc

SEQ ID NO: 2847256 - DNA, 22 bp, Homo sapiens
atggggctgaacggggagaaaa

SEQ ID NO: 2847257 - DNA, 20 bp, Homo sapiens
atggggctgcgggacagagg

SEQ ID NO: 2847258 - DNA, 20 bp, Homo sapiens
atggggggaggggggagggc

SEQ ID NO: 2847259 - DNA, 15 bp, Homo sapiens
atggggtggaaggca

SEQ ID NO: 2847260 - DNA, 19 bp, Homo sapiens
atggggtgggcagggctgg

SEQ ID NO: 2847261 - DNA, 14 bp, Homo sapiens
atgggtattaaact

SEQ ID NO: 2847262 - DNA, 17 bp, Homo sapiens
atgggtctggctgagct

SEQ ID NO: 2847263 - DNA, 23 bp, Homo sapiens
atggtaaaagttacttattctag

SEQ ID NO: 2847264 - DNA, 17 bp, Homo sapiens
atggtaagactgtaatt

SEQ ID NO: 2847265 - DNA, 21 bp, Homo sapiens
atggtattttcgtgcatttgt

SEQ ID NO: 2847266 - DNA, 19 bp, Homo sapiens
atggtcccacatccctggg

SEQ ID NO: 2847267 - DNA, 22 bp, Homo sapiens
atggtcccacatccctgggcct

SEQ ID NO: 2847268 - DNA, 22 bp, Homo sapiens
atggtccgccacgaggagcttc

SEQ ID NO: 2847269 - DNA, 17 bp, Homo sapiens
atggtcctggggctctg

SEQ ID NO: 2847270 - DNA, 19 bp, Homo sapiens
atggtcctggggctctgtg

SEQ ID NO: 2847271 - DNA, 15 bp, Homo sapiens
atggtcgcccaggag

SEQ ID NO: 2847272 - DNA, 23 bp, Homo sapiens
atggtgacttcctcgcctctccc

SEQ ID NO: 2847273 - DNA, 12 bp, Homo sapiens
atggtggctggg

SEQ ID NO: 2847274 - DNA, 17 bp, Homo sapiens
atggtggctgggttgga

SEQ ID NO: 2847275 - DNA, 14 bp, Homo sapiens
atggtggtttgtca

SEQ ID NO: 2847276 - DNA, 17 bp, Homo sapiens
atggttccatgcctgag

SEQ ID NO: 2847277 - DNA, 20 bp, Homo sapiens
atggttccatgcctgagggt

SEQ ID NO: 2847278 - DNA, 16 bp, Homo sapiens
atggttcccaataaaa

SEQ ID NO: 2847279 - DNA, 18 bp, Homo sapiens
atggttcccaataaaagt

SEQ ID NO: 2847280 - DNA, 12 bp, Homo sapiens
atggtttactgc

SEQ ID NO: 2847281 - DNA, 14 bp, Homo sapiens
atggtttactgctg

SEQ ID NO: 2847282 - DNA, 17 bp, Homo sapiens
atggtttactgctgtca

SEQ ID NO: 2847283 - DNA, 21 bp, Homo sapiens
atggtttgaatataaacacta

SEQ ID NO: 2847284 - DNA, 22 bp, Homo sapiens
atggtttgaatataaacactat

SEQ ID NO: 2847285 - DNA, 17 bp, Homo sapiens
atggtttgcaaggaagc

SEQ ID NO: 2847286 - DNA, 21 bp, Homo sapiens
atgtaaaaggtattaaattga

SEQ ID NO: 2847287 - DNA, 15 bp, Homo sapiens
atgtaaaatgcagtc

SEQ ID NO: 2847288 - DNA, 15 bp, Homo sapiens
atgtaaacagtgcct

SEQ ID NO: 2847289 - DNA, 20 bp, Homo sapiens
atgtaaacagtgcctgctga

SEQ ID NO: 2847290 - DNA, 15 bp, Homo sapiens
atgtaaatattttaa

SEQ ID NO: 2847291 - DNA, 20 bp, Homo sapiens
atgtaaatattttaaagaat

SEQ ID NO: 2847292 - DNA, 14 bp, Homo sapiens
atgtaaggaattga

SEQ ID NO: 2847293 - DNA, 15 bp, Homo sapiens
atgtaatcaatgttt

SEQ ID NO: 2847294 - DNA, 16 bp, Homo sapiens
atgtaatcaatgtttc

SEQ ID NO: 2847295 - DNA, 17 bp, Homo sapiens
atgtaatcccagctact

SEQ ID NO: 2847296 - DNA, 11 bp, Homo sapiens
atgtaattgtt

SEQ ID NO: 2847297 - DNA, 13 bp, Homo sapiens
atgtacatgtgta

SEQ ID NO: 2847298 - DNA, 14 bp, Homo sapiens
atgttgagggaaca

SEQ ID NO: 2847299 - DNA, 19 bp, Homo sapiens
atgttgccatgaggccttt

SEQ ID NO: 2847300 - DNA, 21 bp, Homo sapiens
atgttgccatgaggcctttcc

SEQ ID NO: 2847301 - DNA, 12 bp, Homo sapiens
atgttgcccagg

SEQ ID NO: 2847302 - DNA, 15 bp, Homo sapiens
atgttgcccaggcag

SEQ ID NO: 2847303 - DNA, 16 bp, Homo sapiens
atgttggccaggctgg

SEQ ID NO: 2847304 - DNA, 17 bp, Homo sapiens
atgttggccaggctggt

SEQ ID NO: 2847305 - DNA, 19 bp, Homo sapiens
atgttgggatttatatcta

SEQ ID NO: 2847306 - DNA, 23 bp, Homo sapiens
atgttgggatttatatctatagt

SEQ ID NO: 2847307 - DNA, 15 bp, Homo sapiens
atgttgtcaggaatc

SEQ ID NO: 2847308 - DNA, 21 bp, Homo sapiens
atgttgtgattaacatcatca

SEQ ID NO: 2847309 - DNA, 23 bp, Homo sapiens
atgttgttaaacacgtgtctata

SEQ ID NO: 2847310 - DNA, 15 bp, Homo sapiens
atgttgttatttaaa

SEQ ID NO: 2847311 - DNA, 15 bp, Homo sapiens
atgtttccagaaaat

SEQ ID NO: 2847312 - DNA, 17 bp, Homo sapiens
atgtttccagaaaatat

SEQ ID NO: 2847313 - DNA, 18 bp, Homo sapiens
atgtttccagaaaatata

SEQ ID NO: 2847314 - DNA, 22 bp, Homo sapiens
atgtttctgcagtagtctctgt

SEQ ID NO: 2847315 - DNA, 21 bp, Homo sapiens
atgtttgatagattttctgct

SEQ ID NO: 2847316 - DNA, 19 bp, Homo sapiens
atgtttgcacctttctagt

SEQ ID NO: 2847317 - DNA, 14 bp, Homo sapiens
atgtttgcctctgc

SEQ ID NO: 2847318 - DNA, 15 bp, Homo sapiens
atgtttgcctctgcc

SEQ ID NO: 2847319 - DNA, 17 bp, Homo sapiens
atgtttgcctctgcctc

SEQ ID NO: 2847320 - DNA, 16 bp, Homo sapiens
atgtttgctattgaca

SEQ ID NO: 2847321 - DNA, 21 bp, Homo sapiens
atgttttaaacatagaaagtt

SEQ ID NO: 2847322 - DNA, 20 bp, Homo sapiens
atgttttgtcccatttcctt

SEQ ID NO: 2847323 - DNA, 12 bp, Homo sapiens
atgtttttaatg

SEQ ID NO: 2847324 - DNA, 12 bp, Homo sapiens
attaaaaaacaa

SEQ ID NO: 2847325 - DNA, 12 bp, Homo sapiens
attaaaaaccac

SEQ ID NO: 2847326 - DNA, 13 bp, Homo sapiens
attaaaaagttaa

SEQ ID NO: 2847327 - DNA, 16 bp, Homo sapiens
attaaaacacagcttt

SEQ ID NO: 2847328 - DNA, 15 bp, Homo sapiens
attaaaatatatata

SEQ ID NO: 2847329 - DNA, 18 bp, Homo sapiens
attaaaatatatataaat

SEQ ID NO: 2847330 - DNA, 20 bp, Homo sapiens
attaaaatatatataaatat

SEQ ID NO: 2847331 - DNA, 22 bp, Homo sapiens
attaaaatatatataaatatat

SEQ ID NO: 2847332 - DNA, 18 bp, Homo sapiens
attaaaatgtaggaagaa

SEQ ID NO: 2847333 - DNA, 16 bp, Homo sapiens
attaaaattagtgaga

SEQ ID NO: 2847334 - DNA, 19 bp, Homo sapiens
attaaacacctgacacatc

SEQ ID NO: 2847335 - DNA, 20 bp, Homo sapiens
attaaacacctgacacatct

SEQ ID NO: 2847336 - DNA, 14 bp, Homo sapiens
attaaacactgtaa

SEQ ID NO: 2847337 - DNA, 20 bp, Homo sapiens
attaaagcatttactttgaa

SEQ ID NO: 2847338 - DNA, 16 bp, Homo sapiens
attaaaggaaggaaaa

SEQ ID NO: 2847339 - DNA, 13 bp, Homo sapiens
attaaaggctttt

SEQ ID NO: 2847340 - DNA, 14 bp, Homo sapiens
attaaaggcttttg

SEQ ID NO: 2847341 - DNA, 14 bp, Homo sapiens
attaaatacagaca

SEQ ID NO: 2847342 - DNA, 14 bp, Homo sapiens
attaacaaattatg

SEQ ID NO: 2847343 - DNA, 22 bp, Homo sapiens
attaacattgggaaatcttata

SEQ ID NO: 2847344 - DNA, 15 bp, Homo sapiens
attaagagatacatt

SEQ ID NO: 2847345 - DNA, 16 bp, Homo sapiens
attaagagatacattc

SEQ ID NO: 2847346 - DNA, 20 bp, Homo sapiens
attaagattgaggcctgccc

SEQ ID NO: 2847347 - DNA, 20 bp, Homo sapiens
attaatatggggatgcagca

SEQ ID NO: 2847348 - DNA, 22 bp, Homo sapiens
attaatatgttcattaaatttt

SEQ ID NO: 2847349 - DNA, 18 bp, Homo sapiens
attaatgcctctcccgca

SEQ ID NO: 2847350 - DNA, 14 bp, Homo sapiens
attaattagatttt

SEQ ID NO: 2847351 - DNA, 12 bp, Homo sapiens
attaattcatta

SEQ ID NO: 2847352 - DNA, 18 bp, Homo sapiens
attaattcttaataggct

SEQ ID NO: 2847353 - DNA, 16 bp, Homo sapiens
attaatttgtgtagat

SEQ ID NO: 2847354 - DNA, 19 bp, Homo sapiens
attacataatcaaagctac

SEQ ID NO: 2847355 - DNA, 15 bp, Homo sapiens
attacatttccaaat

SEQ ID NO: 2847356 - DNA, 18 bp, Homo sapiens
attacatttccaaatgaa

SEQ ID NO: 2847357 - DNA, 20 bp, Homo sapiens
attaccatgagaagagggcc

SEQ ID NO: 2847358 - DNA, 13 bp, Homo sapiens
attacgtgagcca

SEQ ID NO: 2847359 - DNA, 14 bp, Homo sapiens
attacgtgagccag

SEQ ID NO: 2847360 - DNA, 20 bp, Homo sapiens
attactacaaaatttgaaat

SEQ ID NO: 2847361 - DNA, 16 bp, Homo sapiens
attactgcctttggaa

SEQ ID NO: 2847362 - DNA, 18 bp, Homo sapiens
attacttatttttgacag

SEQ ID NO: 2847363 - DNA, 19 bp, Homo sapiens
attacttatttttgacagt

SEQ ID NO: 2847364 - DNA, 14 bp, Homo sapiens
attacttcagggct

SEQ ID NO: 2847365 - DNA, 15 bp, Homo sapiens
attacttcagggctg

SEQ ID NO: 2847366 - DNA, 13 bp, Homo sapiens
attacttctgcta

SEQ ID NO: 2847367 - DNA, 13 bp, Homo sapiens
attacttgcacaa

SEQ ID NO: 2847368 - DNA, 20 bp, Homo sapiens
attacttgcacaagcttgta

SEQ ID NO: 2847369 - DNA, 16 bp, Homo sapiens
attagaaatagacagt

SEQ ID NO: 2847370 - DNA, 17 bp, Homo sapiens
attagaaattggctgga

SEQ ID NO: 2847371 - DNA, 14 bp, Homo sapiens
attagaagtgttaa

SEQ ID NO: 2847372 - DNA, 18 bp, Homo sapiens
attagaagtgttaactta

SEQ ID NO: 2847373 - DNA, 19 bp, Homo sapiens
attagactggacagcttgt

SEQ ID NO: 2847374 - DNA, 21 bp, Homo sapiens
attagagggaggagaatgagc

SEQ ID NO: 2847375 - DNA, 21 bp, Homo sapiens
attagagtgcccttaaaataa

SEQ ID NO: 2847376 - DNA, 17 bp, Homo sapiens
attagccagtgaaaaac

SEQ ID NO: 2847377 - DNA, 12 bp, Homo sapiens
attagctctgga

SEQ ID NO: 2847378 - DNA, 16 bp, Homo sapiens
attagctgtaaataca

SEQ ID NO: 2847379 - DNA, 20 bp, Homo sapiens
attagctgtaaatacatgtg

SEQ ID NO: 2847380 - DNA, 17 bp, Homo sapiens
attaggatctatgcaat

SEQ ID NO: 2847381 - DNA, 20 bp, Homo sapiens
attaggatctatgcaatttt

SEQ ID NO: 2847382 - DNA, 16 bp, Homo sapiens
attaggatttcatgat

SEQ ID NO: 2847383 - DNA, 19 bp, Homo sapiens
attaggatttgccccttcc

SEQ ID NO: 2847384 - DNA, 15 bp, Homo sapiens
attaggggttgctaa

SEQ ID NO: 2847385 - DNA, 21 bp, Homo sapiens
attaggttttgtacaattgaa

SEQ ID NO: 2847386 - DNA, 23 bp, Homo sapiens
attagtatttatttaatgttatg

SEQ ID NO: 2847387 - DNA, 17 bp, Homo sapiens
attataaataaatgcca

SEQ ID NO: 2847388 - DNA, 22 bp, Homo sapiens
attataacttaaaaaaatgaca

SEQ ID NO: 2847389 - DNA, 12 bp, Homo sapiens
attcctctggga

SEQ ID NO: 2847390 - DNA, 13 bp, Homo sapiens
attcctctgggaa

SEQ ID NO: 2847391 - DNA, 17 bp, Homo sapiens
attcctgaatgaaatat

SEQ ID NO: 2847392 - DNA, 19 bp, Homo sapiens
attcctgaatgaaatatca

SEQ ID NO: 2847393 - DNA, 19 bp, Homo sapiens
attcctgatactgggtaca

SEQ ID NO: 2847394 - DNA, 18 bp, Homo sapiens
attcctgcatttgtgaaa

SEQ ID NO: 2847395 - DNA, 10 bp, Homo sapiens
attcctgggc

SEQ ID NO: 2847396 - DNA, 17 bp, Homo sapiens
attcctgtagcatcttc

SEQ ID NO: 2847397 - DNA, 21 bp, Homo sapiens
attccttagcttagacctcag

SEQ ID NO: 2847398 - DNA, 18 bp, Homo sapiens
attccttttgtgtacagt

SEQ ID NO: 2847399 - DNA, 16 bp, Homo sapiens
attcgaatgacactgt

SEQ ID NO: 2847400 - DNA, 15 bp, Homo sapiens
attctaaaatgcctt

SEQ ID NO: 2847401 - DNA, 17 bp, Homo sapiens
attctaaatgaatgttt

SEQ ID NO: 2847402 - DNA, 23 bp, Homo sapiens
attctaagattgtacatatggaa

SEQ ID NO: 2847403 - DNA, 15 bp, Homo sapiens
attctaattttatat

SEQ ID NO: 2847404 - DNA, 15 bp, Homo sapiens
attctacacatatat

SEQ ID NO: 2847405 - DNA, 16 bp, Homo sapiens
attctactaaatattt

SEQ ID NO: 2847406 - DNA, 17 bp, Homo sapiens
attctagccaaactatt

SEQ ID NO: 2847407 - DNA, 16 bp, Homo sapiens
attctaggcatcccag

SEQ ID NO: 2847408 - DNA, 19 bp, Homo sapiens
attctagtgtaacactgca

SEQ ID NO: 2847409 - DNA, 21 bp, Homo sapiens
attctatggccattactaaca

SEQ ID NO: 2847410 - DNA, 22 bp, Homo sapiens
attctattgcagttatagaaaa

SEQ ID NO: 2847411 - DNA, 16 bp, Homo sapiens
attctcaccaggaagg

SEQ ID NO: 2847412 - DNA, 15 bp, Homo sapiens
attctcactccacca

SEQ ID NO: 2847413 - DNA, 17 bp, Homo sapiens
attctcactccaccacc

SEQ ID NO: 2847414 - DNA, 23 bp, Homo sapiens
attctccagccatcaagagactg

SEQ ID NO: 2847415 - DNA, 20 bp, Homo sapiens
attctccaggattccaaagt

SEQ ID NO: 2847416 - DNA, 13 bp, Homo sapiens
attctcctgcctc

SEQ ID NO: 2847417 - DNA, 20 bp, Homo sapiens
attctcctgcctcagcctcc

SEQ ID NO: 2847418 - DNA, 16 bp, Homo sapiens
attctctcctcagact

SEQ ID NO: 2847419 - DNA, 19 bp, Homo sapiens
attctctcctcagactgct

SEQ ID NO: 2847420 - DNA, 17 bp, Homo sapiens
attctctctaaaaataa

SEQ ID NO: 2847421 - DNA, 10 bp, Homo sapiens
attctctctc

SEQ ID NO: 2847422 - DNA, 15 bp, Homo sapiens
attctctctcctgtc

SEQ ID NO: 2847423 - DNA, 16 bp, Homo sapiens
attctctctcctgtcc

SEQ ID NO: 2847424 - DNA, 17 bp, Homo sapiens
attctctctcctgtcca

SEQ ID NO: 2847425 - DNA, 14 bp, Homo sapiens
attctgaatgaata

SEQ ID NO: 2847426 - DNA, 16 bp, Homo sapiens
attctgagctggccct

SEQ ID NO: 2847427 - DNA, 20 bp, Homo sapiens
attctgattcgaatgacact

SEQ ID NO: 2847428 - DNA, 22 bp, Homo sapiens
attctgattcgaatgacactgt

SEQ ID NO: 2847429 - DNA, 15 bp, Homo sapiens
attctgcctgcccag

SEQ ID NO: 2847430 - DNA, 19 bp, Homo sapiens
attctgcctgcccaggccc

SEQ ID NO: 2847431 - DNA, 19 bp, Homo sapiens
attctgctcacatatctgt

SEQ ID NO: 2847432 - DNA, 20 bp, Homo sapiens
attctgctcacatatctgtc

SEQ ID NO: 2847433 - DNA, 22 bp, Homo sapiens
attctgctcacatatctgtcat

SEQ ID NO: 2847434 - DNA, 19 bp, Homo sapiens
attctgggctcctggaacc

SEQ ID NO: 2847435 - DNA, 14 bp, Homo sapiens
attctgtgaagaat

SEQ ID NO: 2847436 - DNA, 16 bp, Homo sapiens
attctgtgaagaatga

SEQ ID NO: 2847437 - DNA, 19 bp, Homo sapiens
attctgttaaaatcaggat

SEQ ID NO: 2847438 - DNA, 14 bp, Homo sapiens
attctgttggccag

SEQ ID NO: 2847439 - DNA, 22 bp, Homo sapiens
attcttcatcagcatttaataa

SEQ ID NO: 2847440 - DNA, 15 bp, Homo sapiens
attcttccatctgat

SEQ ID NO: 2847441 - DNA, 23 bp, Homo sapiens
attcttccatctgattgtgatgt

SEQ ID NO: 2847442 - DNA, 17 bp, Homo sapiens
attcttcctagttttct

SEQ ID NO: 2847443 - DNA, 16 bp, Homo sapiens
attcttgaaagctgtg

SEQ ID NO: 2847444 - DNA, 14 bp, Homo sapiens
attcttggagaact

SEQ ID NO: 2847445 - DNA, 16 bp, Homo sapiens
attcttggagaacttt

SEQ ID NO: 2847446 - DNA, 18 bp, Homo sapiens
attgaaagagaaccagtt

SEQ ID NO: 2847447 - DNA, 14 bp, Homo sapiens
attgaacccaggag

SEQ ID NO: 2847448 - DNA, 19 bp, Homo sapiens
attgaagagagatatatct

SEQ ID NO: 2847449 - DNA, 21 bp, Homo sapiens
attgaagagagatatatctga

SEQ ID NO: 2847450 - DNA, 20 bp, Homo sapiens
attgaagagatttcaacata

SEQ ID NO: 2847451 - DNA, 17 bp, Homo sapiens
attgaataagtattctt

SEQ ID NO: 2847452 - DNA, 23 bp, Homo sapiens
attgaatctgattggacattttc

SEQ ID NO: 2847453 - DNA, 23 bp, Homo sapiens
attgaatggctatgtttttaatg

SEQ ID NO: 2847454 - DNA, 20 bp, Homo sapiens
attgacacacagcactctct

SEQ ID NO: 2847455 - DNA, 22 bp, Homo sapiens
attgacacacagcactctctaa

SEQ ID NO: 2847456 - DNA, 20 bp, Homo sapiens
attgaccaagatgatcacat

SEQ ID NO: 2847457 - DNA, 21 bp, Homo sapiens
attgactatcaaactgaagcc

SEQ ID NO: 2847458 - DNA, 18 bp, Homo sapiens
attgagccattttttaaa

SEQ ID NO: 2847459 - DNA, 21 bp, Homo sapiens
attgaggcctgccctcaggga

SEQ ID NO: 2847460 - DNA, 17 bp, Homo sapiens
attgagggaaaacataa

SEQ ID NO: 2847461 - DNA, 19 bp, Homo sapiens
attgagtttaagtctctga

SEQ ID NO: 2847462 - DNA, 14 bp, Homo sapiens
attgatatgaaaaa

SEQ ID NO: 2847463 - DNA, 17 bp, Homo sapiens
attgatatgaaaaatat

SEQ ID NO: 2847464 - DNA, 23 bp, Homo sapiens
attgatcactttgttaaaaatat

SEQ ID NO: 2847465 - DNA, 15 bp, Homo sapiens
attgatccacttctt

SEQ ID NO: 2847466 - DNA, 18 bp, Homo sapiens
attgatgtttccagaaaa

SEQ ID NO: 2847467 - DNA, 21 bp, Homo sapiens
attgatgtttccagaaaatat

SEQ ID NO: 2847468 - DNA, 13 bp, Homo sapiens
attgatttcaaga

SEQ ID NO: 2847469 - DNA, 16 bp, Homo sapiens
attgatttcaagacct

SEQ ID NO: 2847470 - DNA, 16 bp, Homo sapiens
attgcaacaggctggg

SEQ ID NO: 2847471 - DNA, 17 bp, Homo sapiens
attgcaacaggctgggc

SEQ ID NO: 2847472 - DNA, 19 bp, Homo sapiens
attgcaacaggctgggctt

SEQ ID NO: 2847473 - DNA, 9 bp, Homo sapiens
attgcacaa

SEQ ID NO: 2847474 - DNA, 11 bp, Homo sapiens
attgcacaatt

SEQ ID NO: 2847475 - DNA, 15 bp, Homo sapiens
attgcacaatttgag

SEQ ID NO: 2847476 - DNA, 15 bp, Homo sapiens
attgcactccagtct

SEQ ID NO: 2847477 - DNA, 16 bp, Homo sapiens
attgcatatatacata

SEQ ID NO: 2847478 - DNA, 15 bp, Homo sapiens
attgcatgtaaaatg

SEQ ID NO: 2847479 - DNA, 17 bp, Homo sapiens
attgcatgtaaaatgca

SEQ ID NO: 2847480 - DNA, 15 bp, Homo sapiens
atttactttgaattt

SEQ ID NO: 2847481 - DNA, 18 bp, Homo sapiens
atttagaaaactttaaag

SEQ ID NO: 2847482 - DNA, 14 bp, Homo sapiens
atttagaatatatt

SEQ ID NO: 2847483 - DNA, 20 bp, Homo sapiens
atttagaatatattaaatcg

SEQ ID NO: 2847484 - DNA, 18 bp, Homo sapiens
atttagattgttaaaata

SEQ ID NO: 2847485 - DNA, 21 bp, Homo sapiens
atttaggtttctgagttcctg

SEQ ID NO: 2847486 - DNA, 23 bp, Homo sapiens
atttaggtttctgagttcctgca

SEQ ID NO: 2847487 - DNA, 12 bp, Homo sapiens
atttagttcttt

SEQ ID NO: 2847488 - DNA, 18 bp, Homo sapiens
atttataaactagatctc

SEQ ID NO: 2847489 - DNA, 19 bp, Homo sapiens
atttataaactagatctcc

SEQ ID NO: 2847490 - DNA, 15 bp, Homo sapiens
atttataaatgtgtg

SEQ ID NO: 2847491 - DNA, 17 bp, Homo sapiens
atttataactcatcata

SEQ ID NO: 2847492 - DNA, 14 bp, Homo sapiens
atttataagcagat

SEQ ID NO: 2847493 - DNA, 17 bp, Homo sapiens
atttataagcagattta

SEQ ID NO: 2847494 - DNA, 14 bp, Homo sapiens
atttataatgtttg

SEQ ID NO: 2847495 - DNA, 15 bp, Homo sapiens
atttatacaaaataa

SEQ ID NO: 2847496 - DNA, 16 bp, Homo sapiens
atttatacaaaataat

SEQ ID NO: 2847497 - DNA, 10 bp, Homo sapiens
atttatactc

SEQ ID NO: 2847498 - DNA, 16 bp, Homo sapiens
atttatatatatatgt

SEQ ID NO: 2847499 - DNA, 14 bp, Homo sapiens
atttatatatgtat

SEQ ID NO: 2847500 - DNA, 14 bp, Homo sapiens
atttatatatttat

SEQ ID NO: 2847501 - DNA, 16 bp, Homo sapiens
atttatatatttataa

SEQ ID NO: 2847502 - DNA, 17 bp, Homo sapiens
atttatatatttataac

SEQ ID NO: 2847503 - DNA, 19 bp, Homo sapiens
atttatatatttataactc

SEQ ID NO: 2847504 - DNA, 13 bp, Homo sapiens
atttatatctata

SEQ ID NO: 2847505 - DNA, 13 bp, Homo sapiens
atttatattagag

SEQ ID NO: 2847506 - DNA, 23 bp, Homo sapiens
atttatattcagagatgtaccat

SEQ ID NO: 2847507 - DNA, 15 bp, Homo sapiens
atttatattgtaaat

SEQ ID NO: 2847508 - DNA, 21 bp, Homo sapiens
atttatattgtaaatattgtg

SEQ ID NO: 2847509 - DNA, 16 bp, Homo sapiens
atttatatttggaaag

SEQ ID NO: 2847510 - DNA, 15 bp, Homo sapiens
atttatcagtgacag

SEQ ID NO: 2847511 - DNA, 23 bp, Homo sapiens
atttatcatctcgaccacttttc

SEQ ID NO: 2847512 - DNA, 18 bp, Homo sapiens
atttatcctgaaatttca

SEQ ID NO: 2847513 - DNA, 21 bp, Homo sapiens
atttatcctgaaatttcagat

SEQ ID NO: 2847514 - DNA, 17 bp, Homo sapiens
atttatcgcagaccttt

SEQ ID NO: 2847515 - DNA, 17 bp, Homo sapiens
atttatctaaaagaatt

SEQ ID NO: 2847516 - DNA, 23 bp, Homo sapiens
atttatctgaatataggaagcat

SEQ ID NO: 2847517 - DNA, 17 bp, Homo sapiens
atttatgagctcttcat

SEQ ID NO: 2847518 - DNA, 21 bp, Homo sapiens
atttatgtaatgctttatgtt

SEQ ID NO: 2847519 - DNA, 18 bp, Homo sapiens
atttattcaattcctctg

SEQ ID NO: 2847520 - DNA, 19 bp, Homo sapiens
atttattcaattcctctgg

SEQ ID NO: 2847521 - DNA, 14 bp, Homo sapiens
atttattcactgta

SEQ ID NO: 2847522 - DNA, 15 bp, Homo sapiens
atttattcactgtaa

SEQ ID NO: 2847523 - DNA, 18 bp, Homo sapiens
atttattcactgtaagtt

SEQ ID NO: 2847524 - DNA, 14 bp, Homo sapiens
atttattctgctca

SEQ ID NO: 2847525 - DNA, 14 bp, Homo sapiens
atttattgcttgat

SEQ ID NO: 2847526 - DNA, 17 bp, Homo sapiens
atttattgtcattactg

SEQ ID NO: 2847527 - DNA, 19 bp, Homo sapiens
atttattgtttatttatca

SEQ ID NO: 2847528 - DNA, 24 bp, Homo sapiens
atttatttactgagcttctctgtg

SEQ ID NO: 2847529 - DNA, 13 bp, Homo sapiens
atttattttgaca

SEQ ID NO: 2847530 - DNA, 14 bp, Homo sapiens
atttattttgacat

SEQ ID NO: 2847531 - DNA, 21 bp, Homo sapiens
atttattttgacataaagttg

SEQ ID NO: 2847532 - DNA, 17 bp, Homo sapiens
atttcaatgattgttta

SEQ ID NO: 2847533 - DNA, 23 bp, Homo sapiens
atttcaatgattgtttaattgta

SEQ ID NO: 2847534 - DNA, 21 bp, Homo sapiens
atttcaatttccaagagctga

SEQ ID NO: 2847535 - DNA, 21 bp, Homo sapiens
atttcacattaatatttgctg

SEQ ID NO: 2847536 - DNA, 15 bp, Homo sapiens
atttcagaggctgca

SEQ ID NO: 2847537 - DNA, 18 bp, Homo sapiens
atttcagaggctgcagga

SEQ ID NO: 2847538 - DNA, 16 bp, Homo sapiens
atttcatctatttctg

SEQ ID NO: 2847539 - DNA, 18 bp, Homo sapiens
atttcatctatttctgag

SEQ ID NO: 2847540 - DNA, 20 bp, Homo sapiens
atttcatctatttctgagaa

SEQ ID NO: 2847541 - DNA, 14 bp, Homo sapiens
atttcatctcattt

SEQ ID NO: 2847542 - DNA, 21 bp, Homo sapiens
atttcatctcatttaagggaa

SEQ ID NO: 2847543 - DNA, 14 bp, Homo sapiens
atttcatgtaacca

SEQ ID NO: 2847544 - DNA, 19 bp, Homo sapiens
atttcattgagggaaaaca

SEQ ID NO: 2847545 - DNA, 21 bp, Homo sapiens
atttccacataaaggtattta

SEQ ID NO: 2847546 - DNA, 13 bp, Homo sapiens
atttccatttctt

SEQ ID NO: 2847547 - DNA, 17 bp, Homo sapiens
atttccatttcttcctc

SEQ ID NO: 2847548 - DNA, 14 bp, Homo sapiens
atttcccccaggga

SEQ ID NO: 2847549 - DNA, 14 bp, Homo sapiens
atttccgggtggaa

SEQ ID NO: 2847550 - DNA, 14 bp, Homo sapiens
atttccgtgaaggg

SEQ ID NO: 2847551 - DNA, 13 bp, Homo sapiens
atttccttggagg

SEQ ID NO: 2847552 - DNA, 21 bp, Homo sapiens
atttcgccgttgaagaggaag

SEQ ID NO: 2847553 - DNA, 20 bp, Homo sapiens
atttctaaaaaacagaggcc

SEQ ID NO: 2847554 - DNA, 16 bp, Homo sapiens
atttctactgtgactg

SEQ ID NO: 2847555 - DNA, 17 bp, Homo sapiens
atttctactgtgactga

SEQ ID NO: 2847556 - DNA, 23 bp, Homo sapiens
atttctatagccaaaaatagcta

SEQ ID NO: 2847557 - DNA, 16 bp, Homo sapiens
atttctatttatttac

SEQ ID NO: 2847558 - DNA, 17 bp, Homo sapiens
atttctatttatttact

SEQ ID NO: 2847559 - DNA, 12 bp, Homo sapiens
atttctattttt

SEQ ID NO: 2847560 - DNA, 20 bp, Homo sapiens
atttctgtgtattttgagat

SEQ ID NO: 2847561 - DNA, 21 bp, Homo sapiens
atttcttaaacaaatgtatga

SEQ ID NO: 2847562 - DNA, 11 bp, Homo sapiens
atttcttatag

SEQ ID NO: 2847563 - DNA, 22 bp, Homo sapiens
atttcttatttgtttggtcact

SEQ ID NO: 2847564 - DNA, 19 bp, Homo sapiens
atttcttggtaagaagccg

SEQ ID NO: 2847565 - DNA, 22 bp, Homo sapiens
atttcttttttaaatgaagaaa

SEQ ID NO: 2847566 - DNA, 11 bp, Homo sapiens
atttgaaattt

SEQ ID NO: 2847567 - DNA, 17 bp, Homo sapiens
atttgaatatcattaaa

SEQ ID NO: 2847568 - DNA, 13 bp, Homo sapiens
atttgagcaattc

SEQ ID NO: 2847569 - DNA, 22 bp, Homo sapiens
atttgaggacaaccattccaga

SEQ ID NO: 2847570 - DNA, 15 bp, Homo sapiens
atttgataaactaaa

SEQ ID NO: 2847571 - DNA, 21 bp, Homo sapiens
attttgtacaaagatatgcta

SEQ ID NO: 2847572 - DNA, 20 bp, Homo sapiens
attttgtctgcttagtatct

SEQ ID NO: 2847573 - DNA, 19 bp, Homo sapiens
attttgttgctgttttgat

SEQ ID NO: 2847574 - DNA, 23 bp, Homo sapiens
attttgttgctgttttgatttgt

SEQ ID NO: 2847575 - DNA, 21 bp, Homo sapiens
attttgttgtgattttgtaca

SEQ ID NO: 2847576 - DNA, 13 bp, Homo sapiens
atttttaaacaag

SEQ ID NO: 2847577 - DNA, 18 bp, Homo sapiens
atttttaatgacttttta

SEQ ID NO: 2847578 - DNA, 19 bp, Homo sapiens
atttttactactattctgt

SEQ ID NO: 2847579 - DNA, 14 bp, Homo sapiens
atttttagacagag

SEQ ID NO: 2847580 - DNA, 14 bp, Homo sapiens
atttttatacatat

SEQ ID NO: 2847581 - DNA, 19 bp, Homo sapiens
atttttatacatatcagaa

SEQ ID NO: 2847582 - DNA, 14 bp, Homo sapiens
atttttatttttga

SEQ ID NO: 2847583 - DNA, 17 bp, Homo sapiens
atttttcaaccagcatt

SEQ ID NO: 2847584 - DNA, 22 bp, Homo sapiens
atttttcattgatatgaaaaat

SEQ ID NO: 2847585 - DNA, 14 bp, Homo sapiens
atttttgaataaaa

SEQ ID NO: 2847586 - DNA, 11 bp, Homo sapiens
atttttgcaat

SEQ ID NO: 2847587 - DNA, 19 bp, Homo sapiens
atttttgtagagccagggt

SEQ ID NO: 2847588 - DNA, 15 bp, Homo sapiens
atttttgtgtttcta

SEQ ID NO: 2847589 - DNA, 17 bp, Homo sapiens
atttttgtttcttccaa

SEQ ID NO: 2847590 - DNA, 17 bp, Homo sapiens
attttttaaaaaagctt

SEQ ID NO: 2847591 - DNA, 18 bp, Homo sapiens
attttttaaaaaagctta

SEQ ID NO: 2847592 - DNA, 22 bp, Homo sapiens
attttttaagtatttatatatt

SEQ ID NO: 2847593 - DNA, 15 bp, Homo sapiens
attttttaatcattt

SEQ ID NO: 2847594 - DNA, 19 bp, Homo sapiens
attttttacagctgcctgc

SEQ ID NO: 2847595 - DNA, 16 bp, Homo sapiens
attttttatttccaca

SEQ ID NO: 2847596 - DNA, 13 bp, Homo sapiens
attttttcagaaa

SEQ ID NO: 2847597 - DNA, 20 bp, Homo sapiens
attttttccttcaaagttta

SEQ ID NO: 2847598 - DNA, 21 bp, Homo sapiens
attttttccttcaaagtttaa

SEQ ID NO: 2847599 - DNA, 15 bp, Homo sapiens
attttttctacacag

SEQ ID NO: 2847600 - DNA, 14 bp, Homo sapiens
caaaaaaagccttt

SEQ ID NO: 2847601 - DNA, 15 bp, Homo sapiens
caaaaaaagccttta

SEQ ID NO: 2847602 - DNA, 14 bp, Homo sapiens
caaaaaaattaaat

SEQ ID NO: 2847603 - DNA, 22 bp, Homo sapiens
caaaaaacttttaatgccttcc

SEQ ID NO: 2847604 - DNA, 15 bp, Homo sapiens
caaaaaagtattttt

SEQ ID NO: 2847605 - DNA, 18 bp, Homo sapiens
caaaaacaaaaccagctg

SEQ ID NO: 2847606 - DNA, 13 bp, Homo sapiens
caaaaacagcctc

SEQ ID NO: 2847607 - DNA, 22 bp, Homo sapiens
caaaaacagcctcacagaagaa

SEQ ID NO: 2847608 - DNA, 22 bp, Homo sapiens
caaaaaggctagtttattttgt

SEQ ID NO: 2847609 - DNA, 19 bp, Homo sapiens
caaaaatgaaagcatgtct

SEQ ID NO: 2847610 - DNA, 19 bp, Homo sapiens
caaaaatggtggtttgtca

SEQ ID NO: 2847611 - DNA, 21 bp, Homo sapiens
caaaaatggtggtttgtcata

SEQ ID NO: 2847612 - DNA, 20 bp, Homo sapiens
caaaaattacactacaagtt

SEQ ID NO: 2847613 - DNA, 17 bp, Homo sapiens
caaaaattagccgggca

SEQ ID NO: 2847614 - DNA, 15 bp, Homo sapiens
caaaacaagaaagaa

SEQ ID NO: 2847615 - DNA, 18 bp, Homo sapiens
caaaacagattgtttgca

SEQ ID NO: 2847616 - DNA, 17 bp, Homo sapiens
caaaacatatcaattca

SEQ ID NO: 2847617 - DNA, 16 bp, Homo sapiens
caaaaccccatctcta

SEQ ID NO: 2847618 - DNA, 19 bp, Homo sapiens
caaaacctcatgacagcca

SEQ ID NO: 2847619 - DNA, 22 bp, Homo sapiens
caaaacctcatgacagccagag

SEQ ID NO: 2847620 - DNA, 18 bp, Homo sapiens
caaaacctgatgttaaaa

SEQ ID NO: 2847621 - DNA, 19 bp, Homo sapiens
caaaagaacaagaatttct

SEQ ID NO: 2847622 - DNA, 15 bp, Homo sapiens
caaaagaagaagttt

SEQ ID NO: 2847623 - DNA, 17 bp, Homo sapiens
caaaagaagtaaaagca

SEQ ID NO: 2847624 - DNA, 18 bp, Homo sapiens
caaaagaagtaaaagcaa

SEQ ID NO: 2847625 - DNA, 21 bp, Homo sapiens
caaaagaagtaaaagctaatt

SEQ ID NO: 2847626 - DNA, 15 bp, Homo sapiens
caaaagcaaatgaga

SEQ ID NO: 2847627 - DNA, 14 bp, Homo sapiens
caaaagcaagactg

SEQ ID NO: 2847628 - DNA, 23 bp, Homo sapiens
caaaagcaagactgttgctcaaa

SEQ ID NO: 2847629 - DNA, 18 bp, Homo sapiens
caaaaggtgcctgtgagg

SEQ ID NO: 2847630 - DNA, 15 bp, Homo sapiens
caaaataaaattatg

SEQ ID NO: 2847631 - DNA, 18 bp, Homo sapiens
caaaataaaattatggtg

SEQ ID NO: 2847632 - DNA, 15 bp, Homo sapiens
caaaataatttaact

SEQ ID NO: 2847633 - DNA, 16 bp, Homo sapiens
caaaataatttaacta

SEQ ID NO: 2847634 - DNA, 16 bp, Homo sapiens
caaaatagtgccacta

SEQ ID NO: 2847635 - DNA, 23 bp, Homo sapiens
caaaatatataatggtttactgc

SEQ ID NO: 2847636 - DNA, 23 bp, Homo sapiens
caaaatcatgaatatttcaaaat

SEQ ID NO: 2847637 - DNA, 16 bp, Homo sapiens
caaaatccttgcttat

SEQ ID NO: 2847638 - DNA, 20 bp, Homo sapiens
caaaatccttgcttatgaca

SEQ ID NO: 2847639 - DNA, 20 bp, Homo sapiens
caaaattaccaaaaatcttg

SEQ ID NO: 2847640 - DNA, 13 bp, Homo sapiens
caaaattacttct

SEQ ID NO: 2847641 - DNA, 14 bp, Homo sapiens
caaaatttccagta

SEQ ID NO: 2847642 - DNA, 15 bp, Homo sapiens
caaaatttccagtac

SEQ ID NO: 2847643 - DNA, 17 bp, Homo sapiens
caaaatttccagtacct

SEQ ID NO: 2847644 - DNA, 19 bp, Homo sapiens
caaaatttccagtaccttt

SEQ ID NO: 2847645 - DNA, 12 bp, Homo sapiens
caaaatttgaaa

SEQ ID NO: 2847646 - DNA, 12 bp, Homo sapiens
caaacaataata

SEQ ID NO: 2847647 - DNA, 14 bp, Homo sapiens
caaacacctcccag

SEQ ID NO: 2847648 - DNA, 12 bp, Homo sapiens
caaacatgaagt

SEQ ID NO: 2847649 - DNA, 21 bp, Homo sapiens
caaacatgaagtgtgtttcct

SEQ ID NO: 2847650 - DNA, 19 bp, Homo sapiens
caaacatgtggcaacctgt

SEQ ID NO: 2847651 - DNA, 12 bp, Homo sapiens
caaacatttctt

SEQ ID NO: 2847652 - DNA, 15 bp, Homo sapiens
caaaccataaacttc

SEQ ID NO: 2847653 - DNA, 23 bp, Homo sapiens
caaaccatttaattcataattag

SEQ ID NO: 2847654 - DNA, 14 bp, Homo sapiens
caaactgaagccag

SEQ ID NO: 2847655 - DNA, 13 bp, Homo sapiens
caaactgctccaa

SEQ ID NO: 2847656 - DNA, 21 bp, Homo sapiens
caaagaaaaaaatatatttta

SEQ ID NO: 2847657 - DNA, 19 bp, Homo sapiens
caaagaaggaaaaggcagg

SEQ ID NO: 2847658 - DNA, 14 bp, Homo sapiens
caaagaaggcacag

SEQ ID NO: 2847659 - DNA, 22 bp, Homo sapiens
caaagaaggcacaggtgtaaat

SEQ ID NO: 2847660 - DNA, 23 bp, Homo sapiens
caaagaaggcacaggtgtaaata

SEQ ID NO: 2847661 - DNA, 23 bp, Homo sapiens
caaagagaaaagattaaaattag

SEQ ID NO: 2847662 - DNA, 18 bp, Homo sapiens
caaccagccacacagagc

SEQ ID NO: 2847663 - DNA, 18 bp, Homo sapiens
caaccatgagaccactgt

SEQ ID NO: 2847664 - DNA, 23 bp, Homo sapiens
caaccatgagaccactgttatca

SEQ ID NO: 2847665 - DNA, 13 bp, Homo sapiens
caaccattccaga

SEQ ID NO: 2847666 - DNA, 16 bp, Homo sapiens
caaccattccagactg

SEQ ID NO: 2847667 - DNA, 21 bp, Homo sapiens
caaccccagggcccccacagg

SEQ ID NO: 2847668 - DNA, 22 bp, Homo sapiens
caaccccagggcccccacaggc

SEQ ID NO: 2847669 - DNA, 19 bp, Homo sapiens
caaccccagttctgctcct

SEQ ID NO: 2847670 - DNA, 14 bp, Homo sapiens
caacccccagcctg

SEQ ID NO: 2847671 - DNA, 16 bp, Homo sapiens
caacccccatttctat

SEQ ID NO: 2847672 - DNA, 16 bp, Homo sapiens
caaccccccacctgcc

SEQ ID NO: 2847673 - DNA, 17 bp, Homo sapiens
caacccgtgccaagtcc

SEQ ID NO: 2847674 - DNA, 23 bp, Homo sapiens
caacccgtgccaagtccaggtcc

SEQ ID NO: 2847675 - DNA, 16 bp, Homo sapiens
caaccctcagccttga

SEQ ID NO: 2847676 - DNA, 21 bp, Homo sapiens
caaccgtggcccttcctggac

SEQ ID NO: 2847677 - DNA, 15 bp, Homo sapiens
caacctaagcaacag

SEQ ID NO: 2847678 - DNA, 20 bp, Homo sapiens
caacctaccaccccttcctg

SEQ ID NO: 2847679 - DNA, 19 bp, Homo sapiens
caacctccccgcagagctc

SEQ ID NO: 2847680 - DNA, 23 bp, Homo sapiens
caacctccccgcagagctccctt

SEQ ID NO: 2847681 - DNA, 14 bp, Homo sapiens
caacctcctgggct

SEQ ID NO: 2847682 - DNA, 15 bp, Homo sapiens
caacctcctgggcta

SEQ ID NO: 2847683 - DNA, 16 bp, Homo sapiens
caacctctctccttct

SEQ ID NO: 2847684 - DNA, 24 bp, Homo sapiens
caacctgaatacccttttctgacc

SEQ ID NO: 2847685 - DNA, 21 bp, Homo sapiens
caacctgaccaacatggagaa

SEQ ID NO: 2847686 - DNA, 18 bp, Homo sapiens
caacctgtagagtggcca

SEQ ID NO: 2847687 - DNA, 14 bp, Homo sapiens
caacctgtgtctta

SEQ ID NO: 2847688 - DNA, 14 bp, Homo sapiens
caaccttgcatcca

SEQ ID NO: 2847689 - DNA, 16 bp, Homo sapiens
caacctttgtgtaata

SEQ ID NO: 2847690 - DNA, 13 bp, Homo sapiens
caacgacaaagcc

SEQ ID NO: 2847691 - DNA, 18 bp, Homo sapiens
caacgttaaaagacagtg

SEQ ID NO: 2847692 - DNA, 16 bp, Homo sapiens
caactaatcaagagtg

SEQ ID NO: 2847693 - DNA, 22 bp, Homo sapiens
caactatgatatggtaaaagtt

SEQ ID NO: 2847694 - DNA, 17 bp, Homo sapiens
caactcactcttatgaa

SEQ ID NO: 2847695 - DNA, 20 bp, Homo sapiens
caactcactcttatgaaatg

SEQ ID NO: 2847696 - DNA, 18 bp, Homo sapiens
caactccaggaaaactgt

SEQ ID NO: 2847697 - DNA, 21 bp, Homo sapiens
caactcctggaagctgtgtcc

SEQ ID NO: 2847698 - DNA, 17 bp, Homo sapiens
caactccttccagctag

SEQ ID NO: 2847699 - DNA, 16 bp, Homo sapiens
caactcggagagggct

SEQ ID NO: 2847700 - DNA, 15 bp, Homo sapiens
caactgaccagcctc

SEQ ID NO: 2847701 - DNA, 17 bp, Homo sapiens
caactgaccagcctcca

SEQ ID NO: 2847702 - DNA, 19 bp, Homo sapiens
caactgaccagcctccatg

SEQ ID NO: 2847703 - DNA, 13 bp, Homo sapiens
caactgaggcaga

SEQ ID NO: 2847704 - DNA, 14 bp, Homo sapiens
caactgaggcagac

SEQ ID NO: 2847705 - DNA, 16 bp, Homo sapiens
caactgaggcagacag

SEQ ID NO: 2847706 - DNA, 20 bp, Homo sapiens
caactgaggcagacagcagc

SEQ ID NO: 2847707 - DNA, 19 bp, Homo sapiens
caactgttggataataact

SEQ ID NO: 2847708 - DNA, 15 bp, Homo sapiens
caactgtttttgaag

SEQ ID NO: 2847709 - DNA, 22 bp, Homo sapiens
caactgtttttgaagaagggaa

SEQ ID NO: 2847710 - DNA, 15 bp, Homo sapiens
caacttaaatcactg

SEQ ID NO: 2847711 - DNA, 20 bp, Homo sapiens
caacttaaatcactgaggca

SEQ ID NO: 2847712 - DNA, 15 bp, Homo sapiens
caacttaatgttctg

SEQ ID NO: 2847713 - DNA, 17 bp, Homo sapiens
caacttcaagtgcatgc

SEQ ID NO: 2847714 - DNA, 22 bp, Homo sapiens
caacttcaagtgcatgctctct

SEQ ID NO: 2847715 - DNA, 14 bp, Homo sapiens
caagaaaactggaa

SEQ ID NO: 2847716 - DNA, 15 bp, Homo sapiens
caagaaaactggaaa

SEQ ID NO: 2847717 - DNA, 15 bp, Homo sapiens
caagaaaaggcatgg

SEQ ID NO: 2847718 - DNA, 17 bp, Homo sapiens
caagaagaatataaata

SEQ ID NO: 2847719 - DNA, 13 bp, Homo sapiens
caagaagtcttga

SEQ ID NO: 2847720 - DNA, 17 bp, Homo sapiens
caagaattctagaaaat

SEQ ID NO: 2847721 - DNA, 23 bp, Homo sapiens
caagaatttcttggtaagaagcc

SEQ ID NO: 2847722 - DNA, 17 bp, Homo sapiens
caagacaaagcaaagcc

SEQ ID NO: 2847723 - DNA, 15 bp, Homo sapiens
caagacacatcccta

SEQ ID NO: 2847724 - DNA, 19 bp, Homo sapiens
caagactccgtctcaaaaa

SEQ ID NO: 2847725 - DNA, 17 bp, Homo sapiens
caagactgttgctcaaa

SEQ ID NO: 2847726 - DNA, 15 bp, Homo sapiens
caagacttaaatagt

SEQ ID NO: 2847727 - DNA, 18 bp, Homo sapiens
caagagaagaaaaaatta

SEQ ID NO: 2847728 - DNA, 15 bp, Homo sapiens
caagagactgagtca

SEQ ID NO: 2847729 - DNA, 14 bp, Homo sapiens
caagagagaaagaa

SEQ ID NO: 2847730 - DNA, 16 bp, Homo sapiens
caagagcagaggcagc

SEQ ID NO: 2847731 - DNA, 22 bp, Homo sapiens
caagagcatcatgcctctgagg

SEQ ID NO: 2847732 - DNA, 17 bp, Homo sapiens
caagagccatgtaccag

SEQ ID NO: 2847733 - DNA, 13 bp, Homo sapiens
caagagcccagca

SEQ ID NO: 2847734 - DNA, 12 bp, Homo sapiens
caagagccttgg

SEQ ID NO: 2847735 - DNA, 22 bp, Homo sapiens
caagagccttggtgtccacctg

SEQ ID NO: 2847736 - DNA, 22 bp, Homo sapiens
caagagctacgtatttaatagc

SEQ ID NO: 2847737 - DNA, 15 bp, Homo sapiens
caagaggaagagaga

SEQ ID NO: 2847738 - DNA, 16 bp, Homo sapiens
caagaggctcctgtcc

SEQ ID NO: 2847739 - DNA, 12 bp, Homo sapiens
caagagggctgc

SEQ ID NO: 2847740 - DNA, 16 bp, Homo sapiens
caagagtattccattt

SEQ ID NO: 2847741 - DNA, 16 bp, Homo sapiens
caagatatttatatat

SEQ ID NO: 2847742 - DNA, 22 bp, Homo sapiens
caagatcctgtctttaaggaaa

SEQ ID NO: 2847743 - DNA, 16 bp, Homo sapiens
caagatcgcgccactg

SEQ ID NO: 2847744 - DNA, 12 bp, Homo sapiens
caagatctttca

SEQ ID NO: 2847745 - DNA, 15 bp, Homo sapiens
caagatctttcagga

SEQ ID NO: 2847746 - DNA, 17 bp, Homo sapiens
caagatgacagctcttc

SEQ ID NO: 2847747 - DNA, 15 bp, Homo sapiens
caagatgtcagactg

SEQ ID NO: 2847748 - DNA, 16 bp, Homo sapiens
caagatgtcagactgg

SEQ ID NO: 2847749 - DNA, 17 bp, Homo sapiens
caagatgtcagactggc

SEQ ID NO: 2847750 - DNA, 15 bp, Homo sapiens
caagattcccagaga

SEQ ID NO: 2847751 - DNA, 16 bp, Homo sapiens
caagattcccagagac

SEQ ID NO: 2847752 - DNA, 17 bp, Homo sapiens
caagattcccagagaca

SEQ ID NO: 2847753 - DNA, 11 bp, Homo sapiens
caattttgtaa

SEQ ID NO: 2847754 - DNA, 14 bp, Homo sapiens
caatttttaaacta

SEQ ID NO: 2847755 - DNA, 13 bp, Homo sapiens
caatttttataca

SEQ ID NO: 2847756 - DNA, 14 bp, Homo sapiens
caatttttatacat

SEQ ID NO: 2847757 - DNA, 15 bp, Homo sapiens
caatttttatacata

SEQ ID NO: 2847758 - DNA, 16 bp, Homo sapiens
caatttttatacatat

SEQ ID NO: 2847759 - DNA, 18 bp, Homo sapiens
caatttttatacatatca

SEQ ID NO: 2847760 - DNA, 21 bp, Homo sapiens
caatttttatacatatcagaa

SEQ ID NO: 2847761 - DNA, 23 bp, Homo sapiens
caatttttatacatatcagaaaa

SEQ ID NO: 2847762 - DNA, 18 bp, Homo sapiens
cacaaaagttagctgagc

SEQ ID NO: 2847763 - DNA, 16 bp, Homo sapiens
cacaaaatgtcacaat

SEQ ID NO: 2847764 - DNA, 16 bp, Homo sapiens
cacaaaggtataattt

SEQ ID NO: 2847765 - DNA, 13 bp, Homo sapiens
cacaaatatttat

SEQ ID NO: 2847766 - DNA, 17 bp, Homo sapiens
cacaaccagccacacag

SEQ ID NO: 2847767 - DNA, 19 bp, Homo sapiens
cacaagaagaccagactgt

SEQ ID NO: 2847768 - DNA, 14 bp, Homo sapiens
cacaagattcccag

SEQ ID NO: 2847769 - DNA, 15 bp, Homo sapiens
cacaagattcccaga

SEQ ID NO: 2847770 - DNA, 17 bp, Homo sapiens
cacaagattcccagaga

SEQ ID NO: 2847771 - DNA, 19 bp, Homo sapiens
cacaagattcccagagaca

SEQ ID NO: 2847772 - DNA, 22 bp, Homo sapiens
cacaagattcccagagacagga

SEQ ID NO: 2847773 - DNA, 14 bp, Homo sapiens
cacaagcaataatt

SEQ ID NO: 2847774 - DNA, 22 bp, Homo sapiens
cacaagcaataattaggatcta

SEQ ID NO: 2847775 - DNA, 17 bp, Homo sapiens
cacaagccacagaagcc

SEQ ID NO: 2847776 - DNA, 12 bp, Homo sapiens
cacaagctggaa

SEQ ID NO: 2847777 - DNA, 16 bp, Homo sapiens
cacaagctggaagcac

SEQ ID NO: 2847778 - DNA, 19 bp, Homo sapiens
cacaagcttgtatatacat

SEQ ID NO: 2847779 - DNA, 22 bp, Homo sapiens
cacaagcttgtatatacatatt

SEQ ID NO: 2847780 - DNA, 16 bp, Homo sapiens
cacaaggcagcaaggc

SEQ ID NO: 2847781 - DNA, 21 bp, Homo sapiens
cacaataaggtcaatgccaga

SEQ ID NO: 2847782 - DNA, 15 bp, Homo sapiens
cacaataattttcta

SEQ ID NO: 2847783 - DNA, 20 bp, Homo sapiens
cacaatctgggactttcact

SEQ ID NO: 2847784 - DNA, 23 bp, Homo sapiens
cacaatgatgattaaacacctga

SEQ ID NO: 2847785 - DNA, 22 bp, Homo sapiens
cacaattccatttccagttcat

SEQ ID NO: 2847786 - DNA, 20 bp, Homo sapiens
cacaatttgagcaattcatt

SEQ ID NO: 2847787 - DNA, 22 bp, Homo sapiens
cacaatttgagcaattcatttc

SEQ ID NO: 2847788 - DNA, 13 bp, Homo sapiens
cacacaaaggtat

SEQ ID NO: 2847789 - DNA, 21 bp, Homo sapiens
cacacacaggcaactgaggca

SEQ ID NO: 2847790 - DNA, 20 bp, Homo sapiens
cacacaccagagcccacctt

SEQ ID NO: 2847791 - DNA, 16 bp, Homo sapiens
cacacagagcctgcct

SEQ ID NO: 2847792 - DNA, 18 bp, Homo sapiens
cacacagagcctgcctca

SEQ ID NO: 2847793 - DNA, 19 bp, Homo sapiens
cacacagagcctgcctcag

SEQ ID NO: 2847794 - DNA, 22 bp, Homo sapiens
cacacagaggaagagcaggcac

SEQ ID NO: 2847795 - DNA, 15 bp, Homo sapiens
cacacagctctgtcc

SEQ ID NO: 2847796 - DNA, 20 bp, Homo sapiens
cacacaggcaactgaggcag

SEQ ID NO: 2847797 - DNA, 17 bp, Homo sapiens
cacacaggcatttcctg

SEQ ID NO: 2847798 - DNA, 23 bp, Homo sapiens
cacacagtgagtcgaggacaggg

SEQ ID NO: 2847799 - DNA, 19 bp, Homo sapiens
cacacatgtcctatccaaa

SEQ ID NO: 2847800 - DNA, 23 bp, Homo sapiens
cacaccccccagtcgagccctgc

SEQ ID NO: 2847801 - DNA, 19 bp, Homo sapiens
cacacgcaggaactcccag

SEQ ID NO: 2847802 - DNA, 22 bp, Homo sapiens
cacacgcaggaactcccagcaa

SEQ ID NO: 2847803 - DNA, 20 bp, Homo sapiens
cacacggaggcatctgcacc

SEQ ID NO: 2847804 - DNA, 22 bp, Homo sapiens
cacacgtatttatatttggaaa

SEQ ID NO: 2847805 - DNA, 18 bp, Homo sapiens
cacactagcctctccagg

SEQ ID NO: 2847806 - DNA, 18 bp, Homo sapiens
cacactattaccatgaga

SEQ ID NO: 2847807 - DNA, 19 bp, Homo sapiens
cacactattaccatgagaa

SEQ ID NO: 2847808 - DNA, 13 bp, Homo sapiens
cacactcagtccc

SEQ ID NO: 2847809 - DNA, 13 bp, Homo sapiens
cacactgagctgg

SEQ ID NO: 2847810 - DNA, 17 bp, Homo sapiens
cacactgcaagagcctt

SEQ ID NO: 2847811 - DNA, 21 bp, Homo sapiens
cacactgcaagagccttggtg

SEQ ID NO: 2847812 - DNA, 15 bp, Homo sapiens
cacactggtgactgc

SEQ ID NO: 2847813 - DNA, 16 bp, Homo sapiens
cacactgttactccac

SEQ ID NO: 2847814 - DNA, 18 bp, Homo sapiens
cacactgttactccacag

SEQ ID NO: 2847815 - DNA, 14 bp, Homo sapiens
cacacttctcagga

SEQ ID NO: 2847816 - DNA, 18 bp, Homo sapiens
cacagaagccaggagcaa

SEQ ID NO: 2847817 - DNA, 15 bp, Homo sapiens
cacagacagatccca

SEQ ID NO: 2847818 - DNA, 14 bp, Homo sapiens
cacagaccacctgc

SEQ ID NO: 2847819 - DNA, 17 bp, Homo sapiens
cacagactacagccaga

SEQ ID NO: 2847820 - DNA, 19 bp, Homo sapiens
cacagactacagccagaag

SEQ ID NO: 2847821 - DNA, 13 bp, Homo sapiens
cacagaggaagag

SEQ ID NO: 2847822 - DNA, 15 bp, Homo sapiens
cacagaggaagagca

SEQ ID NO: 2847823 - DNA, 16 bp, Homo sapiens
cacagaggaagagcag

SEQ ID NO: 2847824 - DNA, 19 bp, Homo sapiens
cacagataactgaaaatta

SEQ ID NO: 2847825 - DNA, 18 bp, Homo sapiens
cacagatatttccatttc

SEQ ID NO: 2847826 - DNA, 22 bp, Homo sapiens
cacagatgggtattaaacttgt

SEQ ID NO: 2847827 - DNA, 16 bp, Homo sapiens
cacagcactctctaaa

SEQ ID NO: 2847828 - DNA, 18 bp, Homo sapiens
cacagcagcatcttcaaa

SEQ ID NO: 2847829 - DNA, 17 bp, Homo sapiens
cacagcagtatgaatga

SEQ ID NO: 2847830 - DNA, 14 bp, Homo sapiens
cacagccgcagcct

SEQ ID NO: 2847831 - DNA, 21 bp, Homo sapiens
cacagccgcagcctccctctg

SEQ ID NO: 2847832 - DNA, 13 bp, Homo sapiens
cacagcctggact

SEQ ID NO: 2847833 - DNA, 16 bp, Homo sapiens
cacagcggaggagacc

SEQ ID NO: 2847834 - DNA, 17 bp, Homo sapiens
cacagcggaggagacca

SEQ ID NO: 2847835 - DNA, 19 bp, Homo sapiens
cacagcggaggagaccagc

SEQ ID NO: 2847836 - DNA, 22 bp, Homo sapiens
cacagctcccaccccaccccct

SEQ ID NO: 2847837 - DNA, 12 bp, Homo sapiens
cacagctcctcg

SEQ ID NO: 2847838 - DNA, 11 bp, Homo sapiens
cacagctctgt

SEQ ID NO: 2847839 - DNA, 19 bp, Homo sapiens
cacagctctgtcctgggag

SEQ ID NO: 2847840 - DNA, 23 bp, Homo sapiens
cacagctctgtcctgggagtgag

SEQ ID NO: 2847841 - DNA, 10 bp, Homo sapiens
cacagctctt

SEQ ID NO: 2847842 - DNA, 15 bp, Homo sapiens
cacagctcttctcca

SEQ ID NO: 2847843 - DNA, 17 bp, Homo sapiens
cacagctcttctccagg

SEQ ID NO: 2847844 - DNA, 20 bp, Homo sapiens
cacaggagggagagaactta

SEQ ID NO: 2847845 - DNA, 19 bp, Homo sapiens
cacaggatcctattctcac

SEQ ID NO: 2847846 - DNA, 20 bp, Homo sapiens
cacaggatcctattctcacc

SEQ ID NO: 2847847 - DNA, 13 bp, Homo sapiens
cacaggcaactga

SEQ ID NO: 2847848 - DNA, 14 bp, Homo sapiens
cacaggcaactgag

SEQ ID NO: 2847849 - DNA, 18 bp, Homo sapiens
cacaggcaactgaggcag

SEQ ID NO: 2847850 - DNA, 22 bp, Homo sapiens
cacaggcaactgaggcagacag

SEQ ID NO: 2847851 - DNA, 11 bp, Homo sapiens
cacaggcagct

SEQ ID NO: 2847852 - DNA, 16 bp, Homo sapiens
cacaggcagctggatg

SEQ ID NO: 2847853 - DNA, 21 bp, Homo sapiens
cacaggcagctggatgagact

SEQ ID NO: 2847854 - DNA, 18 bp, Homo sapiens
cacaggcatctacacagc

SEQ ID NO: 2847855 - DNA, 15 bp, Homo sapiens
cacaggcatttcctg

SEQ ID NO: 2847856 - DNA, 17 bp, Homo sapiens
cacaggcatttcctggg

SEQ ID NO: 2847857 - DNA, 23 bp, Homo sapiens
cacaggccccccgcagcaccctg

SEQ ID NO: 2847858 - DNA, 13 bp, Homo sapiens
cacaggcctgtgt

SEQ ID NO: 2847859 - DNA, 14 bp, Homo sapiens
cacaggcctgtgta

SEQ ID NO: 2847860 - DNA, 18 bp, Homo sapiens
cacaggcctgtgtagctg

SEQ ID NO: 2847861 - DNA, 13 bp, Homo sapiens
cacagggcagagc

SEQ ID NO: 2847862 - DNA, 14 bp, Homo sapiens
cacagggccccaga

SEQ ID NO: 2847863 - DNA, 19 bp, Homo sapiens
cacagggccccagaaggca

SEQ ID NO: 2847864 - DNA, 19 bp, Homo sapiens
cacaggtacagcaacagga

SEQ ID NO: 2847865 - DNA, 20 bp, Homo sapiens
cacagtaaaaacttgtacta

SEQ ID NO: 2847866 - DNA, 14 bp, Homo sapiens
cacagtctctggga

SEQ ID NO: 2847867 - DNA, 18 bp, Homo sapiens
cacagtgagtcgaggaca

SEQ ID NO: 2847868 - DNA, 19 bp, Homo sapiens
cacagtgagtcgaggacag

SEQ ID NO: 2847869 - DNA, 22 bp, Homo sapiens
cacagtgagtcgaggacaggga

SEQ ID NO: 2847870 - DNA, 19 bp, Homo sapiens
cacagtttctattgtaaat

SEQ ID NO: 2847871 - DNA, 10 bp, Homo sapiens
cacataaagg

SEQ ID NO: 2847872 - DNA, 13 bp, Homo sapiens
cacataaaggtat

SEQ ID NO: 2847873 - DNA, 15 bp, Homo sapiens
cacatacaatttgca

SEQ ID NO: 2847874 - DNA, 17 bp, Homo sapiens
cacatacaatttgcact

SEQ ID NO: 2847875 - DNA, 19 bp, Homo sapiens
cacatacaatttgcactgt

SEQ ID NO: 2847876 - DNA, 17 bp, Homo sapiens
cacatacacacacacgc

SEQ ID NO: 2847877 - DNA, 18 bp, Homo sapiens
cacatactcatttttcat

SEQ ID NO: 2847878 - DNA, 12 bp, Homo sapiens
cacatatatgta

SEQ ID NO: 2847879 - DNA, 14 bp, Homo sapiens
cacatatctgtcat

SEQ ID NO: 2847880 - DNA, 20 bp, Homo sapiens
cacatatgcaccttgtgtct

SEQ ID NO: 2847881 - DNA, 21 bp, Homo sapiens
cacatccacacacgcaggaac

SEQ ID NO: 2847882 - DNA, 22 bp, Homo sapiens
cacatcccaggcttcaccctga

SEQ ID NO: 2847883 - DNA, 13 bp, Homo sapiens
cacatccctgggc

SEQ ID NO: 2847884 - DNA, 17 bp, Homo sapiens
cacatccctgggcctgc

SEQ ID NO: 2847885 - DNA, 18 bp, Homo sapiens
cacatccctgggcctgct

SEQ ID NO: 2847886 - DNA, 22 bp, Homo sapiens
cacatccctgggcctgctgctg

SEQ ID NO: 2847887 - DNA, 19 bp, Homo sapiens
cacatctgtgtctctggaa

SEQ ID NO: 2847888 - DNA, 13 bp, Homo sapiens
cacatcttgctct

SEQ ID NO: 2847889 - DNA, 14 bp, Homo sapiens
cacatcttgctctg

SEQ ID NO: 2847890 - DNA, 19 bp, Homo sapiens
cacatcttgctctgctgac

SEQ ID NO: 2847891 - DNA, 23 bp, Homo sapiens
cacatcttgctctgctgacagac

SEQ ID NO: 2847892 - DNA, 23 bp, Homo sapiens
cacatgaaccatccttcccatga

SEQ ID NO: 2847893 - DNA, 24 bp, Homo sapiens
cacatgaatcccacccacatgtga

SEQ ID NO: 2847894 - DNA, 12 bp, Homo sapiens
cacatgtccagt

SEQ ID NO: 2847895 - DNA, 13 bp, Homo sapiens
cacatgtgacaca

SEQ ID NO: 2847896 - DNA, 17 bp, Homo sapiens
cacatgtgcacatgcac

SEQ ID NO: 2847897 - DNA, 17 bp, Homo sapiens
cacattacttgcacaag

SEQ ID NO: 2847898 - DNA, 20 bp, Homo sapiens
cacattacttgcacaagctt

SEQ ID NO: 2847899 - DNA, 16 bp, Homo sapiens
cacattatcgggagca

SEQ ID NO: 2847900 - DNA, 23 bp, Homo sapiens
cacattatcgggagcagtgtctt

SEQ ID NO: 2847901 - DNA, 14 bp, Homo sapiens
cacatttatatata

SEQ ID NO: 2847902 - DNA, 17 bp, Homo sapiens
cacatttattctgctca

SEQ ID NO: 2847903 - DNA, 14 bp, Homo sapiens
caccaacatcccat

SEQ ID NO: 2847904 - DNA, 14 bp, Homo sapiens
caccaaggtcttca

SEQ ID NO: 2847905 - DNA, 23 bp, Homo sapiens
caccaatgtacccaccgggccac

SEQ ID NO: 2847906 - DNA, 12 bp, Homo sapiens
caccacaggctg

SEQ ID NO: 2847907 - DNA, 15 bp, Homo sapiens
caccacatgtgcaca

SEQ ID NO: 2847908 - DNA, 19 bp, Homo sapiens
caccacatgtgcacatgca

SEQ ID NO: 2847909 - DNA, 18 bp, Homo sapiens
caccaccagatgagaagt

SEQ ID NO: 2847910 - DNA, 22 bp, Homo sapiens
caccaccagatgagaagttaag

SEQ ID NO: 2847911 - DNA, 11 bp, Homo sapiens
caccacccaaa

SEQ ID NO: 2847912 - DNA, 21 bp, Homo sapiens
caccaccctcccaccatgcgc

SEQ ID NO: 2847913 - DNA, 18 bp, Homo sapiens
caccacctcactcctgtt

SEQ ID NO: 2847914 - DNA, 18 bp, Homo sapiens
caccaccttggactcctc

SEQ ID NO: 2847915 - DNA, 20 bp, Homo sapiens
caccaccttggactcctccc

SEQ ID NO: 2847916 - DNA, 15 bp, Homo sapiens
caccactctggcagc

SEQ ID NO: 2847917 - DNA, 21 bp, Homo sapiens
caccactctggcagccacact

SEQ ID NO: 2847918 - DNA, 13 bp, Homo sapiens
caccactgcactc

SEQ ID NO: 2847919 - DNA, 22 bp, Homo sapiens
caccactttgtctctgagaaca

SEQ ID NO: 2847920 - DNA, 18 bp, Homo sapiens
caccagagcccaccttgg

SEQ ID NO: 2847921 - DNA, 16 bp, Homo sapiens
caccagaggctgcaga

SEQ ID NO: 2847922 - DNA, 21 bp, Homo sapiens
caccagaggctgcagaaggcc

SEQ ID NO: 2847923 - DNA, 16 bp, Homo sapiens
caccagcatgtcactc

SEQ ID NO: 2847924 - DNA, 20 bp, Homo sapiens
caccagcatgtcactcccag

SEQ ID NO: 2847925 - DNA, 21 bp, Homo sapiens
caccagcatgtcactcccaga

SEQ ID NO: 2847926 - DNA, 12 bp, Homo sapiens
caccagccacct

SEQ ID NO: 2847927 - DNA, 16 bp, Homo sapiens
caccagccccagcaag

SEQ ID NO: 2847928 - DNA, 21 bp, Homo sapiens
caccagccccagtgcccacag

SEQ ID NO: 2847929 - DNA, 22 bp, Homo sapiens
caccagccccagtgcccacagg

SEQ ID NO: 2847930 - DNA, 16 bp, Homo sapiens
caccagcccggcctgc

SEQ ID NO: 2847931 - DNA, 17 bp, Homo sapiens
caccagcccggcctgct

SEQ ID NO: 2847932 - DNA, 18 bp, Homo sapiens
caccagcccggcctgctc

SEQ ID NO: 2847933 - DNA, 19 bp, Homo sapiens
caccagcccttccctgctt

SEQ ID NO: 2847934 - DNA, 20 bp, Homo sapiens
caccagctgccaaaatcgta

SEQ ID NO: 2847935 - DNA, 16 bp, Homo sapiens
cactgaacatttgctt

SEQ ID NO: 2847936 - DNA, 19 bp, Homo sapiens
cactgaagaaaccttcaga

SEQ ID NO: 2847937 - DNA, 13 bp, Homo sapiens
cactgaagctggg

SEQ ID NO: 2847938 - DNA, 17 bp, Homo sapiens
cactgaagctgggattc

SEQ ID NO: 2847939 - DNA, 23 bp, Homo sapiens
cactgacattgttggccaaagcc

SEQ ID NO: 2847940 - DNA, 22 bp, Homo sapiens
cactgacccacagcctctgcct

SEQ ID NO: 2847941 - DNA, 20 bp, Homo sapiens
cactgagcaagatcttgtct

SEQ ID NO: 2847942 - DNA, 18 bp, Homo sapiens
cactgatatattttccag

SEQ ID NO: 2847943 - DNA, 18 bp, Homo sapiens
cactgatgggcaaccccc

SEQ ID NO: 2847944 - DNA, 14 bp, Homo sapiens
cactgatttggaga

SEQ ID NO: 2847945 - DNA, 16 bp, Homo sapiens
cactgatttggagata

SEQ ID NO: 2847946 - DNA, 16 bp, Homo sapiens
cactgcaagagccttg

SEQ ID NO: 2847947 - DNA, 14 bp, Homo sapiens
cactgcaccgggcc

SEQ ID NO: 2847948 - DNA, 16 bp, Homo sapiens
cactgcaccgggccac

SEQ ID NO: 2847949 - DNA, 18 bp, Homo sapiens
cactgcaccgggccacag

SEQ ID NO: 2847950 - DNA, 19 bp, Homo sapiens
cactgcactatagcctagg

SEQ ID NO: 2847951 - DNA, 19 bp, Homo sapiens
cactgcactccagcctggg

SEQ ID NO: 2847952 - DNA, 14 bp, Homo sapiens
cactgcagcctcaa

SEQ ID NO: 2847953 - DNA, 19 bp, Homo sapiens
cactgcagcctcaacctcc

SEQ ID NO: 2847954 - DNA, 20 bp, Homo sapiens
cactgcagcctcaacctcct

SEQ ID NO: 2847955 - DNA, 13 bp, Homo sapiens
cactgcaggcccc

SEQ ID NO: 2847956 - DNA, 23 bp, Homo sapiens
actcatctgttatcctgctagct

SEQ ID NO: 2847957 - DNA, 14 bp, Homo sapiens
actcattagactgg

SEQ ID NO: 2847958 - DNA, 23 bp, Homo sapiens
actcatttttcatgataatgaac

SEQ ID NO: 2847959 - DNA, 21 bp, Homo sapiens
actccaaacctcctgttagct

SEQ ID NO: 2847960 - DNA, 15 bp, Homo sapiens
actccaccaacccat

SEQ ID NO: 2847961 - DNA, 20 bp, Homo sapiens
actccaccaacccatcagaa

SEQ ID NO: 2847962 - DNA, 13 bp, Homo sapiens
actccagccagcg

SEQ ID NO: 2847963 - DNA, 17 bp, Homo sapiens
actccagccagcgcctc

SEQ ID NO: 2847964 - DNA, 20 bp, Homo sapiens
actccagccagcgcctccct

SEQ ID NO: 2847965 - DNA, 22 bp, Homo sapiens
actccagccagcgcctccctcc

SEQ ID NO: 2847966 - DNA, 13 bp, Homo sapiens
actccagcctggg

SEQ ID NO: 2847967 - DNA, 18 bp, Homo sapiens
actccagcctgggcaaca

SEQ ID NO: 2847968 - DNA, 20 bp, Homo sapiens
actccagcctgggcgacaga

SEQ ID NO: 2847969 - DNA, 21 bp, Homo sapiens
actccaggaaaactgtttttc

SEQ ID NO: 2847970 - DNA, 12 bp, Homo sapiens
actccccaggcc

SEQ ID NO: 2847971 - DNA, 15 bp, Homo sapiens
actccccaggccagg

SEQ ID NO: 2847972 - DNA, 17 bp, Homo sapiens
actccctggctctcaga

SEQ ID NO: 2847973 - DNA, 15 bp, Homo sapiens
actccctgggaaagg

SEQ ID NO: 2847974 - DNA, 19 bp, Homo sapiens
actccggcctgatgacaga

SEQ ID NO: 2847975 - DNA, 14 bp, Homo sapiens
actcctacctcagc

SEQ ID NO: 2847976 - DNA, 15 bp, Homo sapiens
actcctcactgcccc

SEQ ID NO: 2847977 - DNA, 23 bp, Homo sapiens
actcctctaagccactcttccaa

SEQ ID NO: 2847978 - DNA, 15 bp, Homo sapiens
actcctctgtctctg

SEQ ID NO: 2847979 - DNA, 12 bp, Homo sapiens
actcctggaaat

SEQ ID NO: 2847980 - DNA, 15 bp, Homo sapiens
actcctgtgggagcc

SEQ ID NO: 2847981 - DNA, 17 bp, Homo sapiens
actcctgtgggagcctc

SEQ ID NO: 2847982 - DNA, 20 bp, Homo sapiens
actcctgtgggagcctcgca

SEQ ID NO: 2847983 - DNA, 17 bp, Homo sapiens
actcctgttacttacct

SEQ ID NO: 2847984 - DNA, 15 bp, Homo sapiens
actccttcctgcccc

SEQ ID NO: 2847985 - DNA, 16 bp, Homo sapiens
actcggagagggctgc

SEQ ID NO: 2847986 - DNA, 21 bp, Homo sapiens
actcggcctcccaaagtgctg

SEQ ID NO: 2847987 - DNA, 20 bp, Homo sapiens
actcgggaggctgagacagg

SEQ ID NO: 2847988 - DNA, 20 bp, Homo sapiens
actctaagtctccaagaata

SEQ ID NO: 2847989 - DNA, 21 bp, Homo sapiens
actctaattcccattttgcaa

SEQ ID NO: 2847990 - DNA, 19 bp, Homo sapiens
actctacccatattacaga

SEQ ID NO: 2847991 - DNA, 22 bp, Homo sapiens
actctagcctggcaacagagca

SEQ ID NO: 2847992 - DNA, 19 bp, Homo sapiens
actctcaggatcaagaaag

SEQ ID NO: 2847993 - DNA, 14 bp, Homo sapiens
actctcattcccca

SEQ ID NO: 2847994 - DNA, 15 bp, Homo sapiens
actctcattccccag

SEQ ID NO: 2847995 - DNA, 16 bp, Homo sapiens
actctcattccccagg

SEQ ID NO: 2847996 - DNA, 17 bp, Homo sapiens
actctcattccccaggt

SEQ ID NO: 2847997 - DNA, 17 bp, Homo sapiens
actctccaacctggaca

SEQ ID NO: 2847998 - DNA, 13 bp, Homo sapiens
actctcccctccc

SEQ ID NO: 2847999 - DNA, 22 bp, Homo sapiens
actctcccctccctcttccttc

SEQ ID NO: 2848000 - DNA, 20 bp, Homo sapiens
actctcctcggccccctcca

SEQ ID NO: 2848001 - DNA, 19 bp, Homo sapiens
actctctaaatcttccttg

SEQ ID NO: 2848002 - DNA, 21 bp, Homo sapiens
ctctgctcctctccccagcaa

SEQ ID NO: 2848003 - DNA, 15 bp, Homo sapiens
ctctgctctgatgca

SEQ ID NO: 2848004 - DNA, 14 bp, Homo sapiens
ctctgctcttgcct

SEQ ID NO: 2848005 - DNA, 18 bp, Homo sapiens
ctctgctgacagacacag

SEQ ID NO: 2848006 - DNA, 21 bp, Homo sapiens
ctctgctgacagacacaggcc

SEQ ID NO: 2848007 - DNA, 13 bp, Homo sapiens
ctctgctgccatg

SEQ ID NO: 2848008 - DNA, 13 bp, Homo sapiens
ctctgctggcctg

SEQ ID NO: 2848009 - DNA, 21 bp, Homo sapiens
ctctgctggcctggccggcaa

SEQ ID NO: 2848010 - DNA, 17 bp, Homo sapiens
ctctggaaaactcagga

SEQ ID NO: 2848011 - DNA, 18 bp, Homo sapiens
ctctggaaaactcaggat

SEQ ID NO: 2848012 - DNA, 21 bp, Homo sapiens
ctctggaaaactcaggattct

SEQ ID NO: 2848013 - DNA, 14 bp, Homo sapiens
ctctggacaggcat

SEQ ID NO: 2848014 - DNA, 22 bp, Homo sapiens
ctctggacaggcatgttctctg

SEQ ID NO: 2848015 - DNA, 20 bp, Homo sapiens
ctctggaccagcctgttgga

SEQ ID NO: 2848016 - DNA, 23 bp, Homo sapiens
ctctggacctcaggttcctaaga

SEQ ID NO: 2848017 - DNA, 16 bp, Homo sapiens
ctctggatggcaccag

SEQ ID NO: 2848018 - DNA, 21 bp, Homo sapiens
ctctggcactccagaacaaac

SEQ ID NO: 2848019 - DNA, 13 bp, Homo sapiens
ctctggcagccac

SEQ ID NO: 2848020 - DNA, 15 bp, Homo sapiens
ctctggcagccacac

SEQ ID NO: 2848021 - DNA, 16 bp, Homo sapiens
ctctggcagccacact

SEQ ID NO: 2848022 - DNA, 18 bp, Homo sapiens
ctctggccccaggcttgt

SEQ ID NO: 2848023 - DNA, 13 bp, Homo sapiens
ctctggccctgcc

SEQ ID NO: 2848024 - DNA, 14 bp, Homo sapiens
ctctggccctgcct

SEQ ID NO: 2848025 - DNA, 18 bp, Homo sapiens
ctctggccctgccttctt

SEQ ID NO: 2848026 - DNA, 13 bp, Homo sapiens
ctctggcttccag

SEQ ID NO: 2848027 - DNA, 20 bp, Homo sapiens
ctctgggggcctctttctgt

SEQ ID NO: 2848028 - DNA, 21 bp, Homo sapiens
ctctgggtaggtgttgaaaat

SEQ ID NO: 2848029 - DNA, 15 bp, Homo sapiens
ctctggttatctaat

SEQ ID NO: 2848030 - DNA, 16 bp, Homo sapiens
ctctgtccactctgaa

SEQ ID NO: 2848031 - DNA, 20 bp, Homo sapiens
ctctgtccagggccctgagc

SEQ ID NO: 2848032 - DNA, 22 bp, Homo sapiens
ctctgtccagggccctgagctc

SEQ ID NO: 2848033 - DNA, 15 bp, Homo sapiens
ctctgtccctcactg

SEQ ID NO: 2848034 - DNA, 22 bp, Homo sapiens
ctctgtccctcactgccttcca

SEQ ID NO: 2848035 - DNA, 12 bp, Homo sapiens
ctctgtccctct

SEQ ID NO: 2848036 - DNA, 13 bp, Homo sapiens
ctctgtccctctt

SEQ ID NO: 2848037 - DNA, 14 bp, Homo sapiens
ctctgtcctgggag

SEQ ID NO: 2848038 - DNA, 13 bp, Homo sapiens
ctctgtcgcccag

SEQ ID NO: 2848039 - DNA, 23 bp, Homo sapiens
ctctgtctcgagcgccctgcaga

SEQ ID NO: 2848040 - DNA, 23 bp, Homo sapiens
ctctgtgaacgatttagaaagaa

SEQ ID NO: 2848041 - DNA, 15 bp, Homo sapiens
ctctgtgacctgccc

SEQ ID NO: 2848042 - DNA, 21 bp, Homo sapiens
ctctgtgactcgcttagctga

SEQ ID NO: 2848043 - DNA, 18 bp, Homo sapiens
ctctgtgccagagcctgg

SEQ ID NO: 2848044 - DNA, 20 bp, Homo sapiens
ctctgtgccagagcctgggg

SEQ ID NO: 2848045 - DNA, 19 bp, Homo sapiens
ctctgtgcccctgtaaata

SEQ ID NO: 2848046 - DNA, 18 bp, Homo sapiens
ctctgtgctttgactcac

SEQ ID NO: 2848047 - DNA, 23 bp, Homo sapiens
ctctgtgtacccactcctcactg

SEQ ID NO: 2848048 - DNA, 20 bp, Homo sapiens
ctctgtgtcaggtggggcag

SEQ ID NO: 2848049 - DNA, 13 bp, Homo sapiens
ctctgtgtgctcc

SEQ ID NO: 2848050 - DNA, 14 bp, Homo sapiens
ctctgttcatttcc

SEQ ID NO: 2848051 - DNA, 16 bp, Homo sapiens
ctctgttcatttcctc

SEQ ID NO: 2848052 - DNA, 17 bp, Homo sapiens
ctctgttcatttcctca

SEQ ID NO: 2848053 - DNA, 14 bp, Homo sapiens
ctctgttctttata

SEQ ID NO: 2848054 - DNA, 22 bp, Homo sapiens
ctctgttgcccaggctggagtg

SEQ ID NO: 2848055 - DNA, 18 bp, Homo sapiens
ctcttaaaaaataaaaac

SEQ ID NO: 2848056 - DNA, 19 bp, Homo sapiens
ctcttaaaaaataaaaact

SEQ ID NO: 2848057 - DNA, 18 bp, Homo sapiens
ctcttatagaatatttat

SEQ ID NO: 2848058 - DNA, 20 bp, Homo sapiens
ctcttatatagtattcattt

SEQ ID NO: 2848059 - DNA, 13 bp, Homo sapiens
ctcttattgccca

SEQ ID NO: 2848060 - DNA, 20 bp, Homo sapiens
ctcttattgcccacgctgga

SEQ ID NO: 2848061 - DNA, 23 bp, Homo sapiens
ctcttcagaatatggacaaagaa

SEQ ID NO: 2848062 - DNA, 22 bp, Homo sapiens
ctcttcaggttcttagtgtcac

SEQ ID NO: 2848063 - DNA, 14 bp, Homo sapiens
ctcttccagtttgc

SEQ ID NO: 2848064 - DNA, 15 bp, Homo sapiens
ctcttccccttgccc

SEQ ID NO: 2848065 - DNA, 16 bp, Homo sapiens
ctcttccccttgccct

SEQ ID NO: 2848066 - DNA, 23 bp, Homo sapiens
ctcttccccttgcccttgccctg

SEQ ID NO: 2848067 - DNA, 14 bp, Homo sapiens
ctcttcccctttcc

SEQ ID NO: 2848068 - DNA, 20 bp, Homo sapiens
ctcttccgtgacgtcactgg

SEQ ID NO: 2848069 - DNA, 12 bp, Homo sapiens
ctcttcctaccc

SEQ ID NO: 2848070 - DNA, 20 bp, Homo sapiens
ctcttcctacccaaccactc

SEQ ID NO: 2848071 - DNA, 12 bp, Homo sapiens
ctcttctccagg

SEQ ID NO: 2848072 - DNA, 13 bp, Homo sapiens
ctcttctccaggc

SEQ ID NO: 2848073 - DNA, 21 bp, Homo sapiens
ctcttctcttacgctctctgt

SEQ ID NO: 2848074 - DNA, 15 bp, Homo sapiens
ctcttctgtcatccc

SEQ ID NO: 2848075 - DNA, 16 bp, Homo sapiens
ctcttctgtcatcccg

SEQ ID NO: 2848076 - DNA, 23 bp, Homo sapiens
ctcttcttttaaaccattttctt

SEQ ID NO: 2848077 - DNA, 13 bp, Homo sapiens
ctcttgacctcag

SEQ ID NO: 2848078 - DNA, 17 bp, Homo sapiens
ctcttgaggccaggagt

SEQ ID NO: 2848079 - DNA, 17 bp, Homo sapiens
ctcttgccactgcctct

SEQ ID NO: 2848080 - DNA, 18 bp, Homo sapiens
ctcttgccactgcctctt

SEQ ID NO: 2848081 - DNA, 19 bp, Homo sapiens
ctcttgccactgcctcttc

SEQ ID NO: 2848082 - DNA, 21 bp, Homo sapiens
ctcttgcctgcacccttcctc

SEQ ID NO: 2848083 - DNA, 23 bp, Homo sapiens
ctcttgcctgcacccttcctcct

SEQ ID NO: 2848084 - DNA, 16 bp, Homo sapiens
ctcttgctattggaat

SEQ ID NO: 2848085 - DNA, 18 bp, Homo sapiens
ctcttgctattggaatgt

SEQ ID NO: 2848086 - DNA, 12 bp, Homo sapiens
ctcttggacctc

SEQ ID NO: 2848087 - DNA, 18 bp, Homo sapiens
ctcttggacctctgctct

SEQ ID NO: 2848088 - DNA, 20 bp, Homo sapiens
ctcttggacctctgctctga

SEQ ID NO: 2848089 - DNA, 16 bp, Homo sapiens
ctctttaatcttcagt

SEQ ID NO: 2848090 - DNA, 20 bp, Homo sapiens
ctctttaatgtcacaggcag

SEQ ID NO: 2848091 - DNA, 12 bp, Homo sapiens
ctctttctgggc

SEQ ID NO: 2848092 - DNA, 17 bp, Homo sapiens
ctgagcacctgcttcat

SEQ ID NO: 2848093 - DNA, 14 bp, Homo sapiens
ctgagcactgccag

SEQ ID NO: 2848094 - DNA, 15 bp, Homo sapiens
ctgagcactgccagg

SEQ ID NO: 2848095 - DNA, 16 bp, Homo sapiens
ctgagcactgccagga

SEQ ID NO: 2848096 - DNA, 17 bp, Homo sapiens
ctgagcactgccaggag

SEQ ID NO: 2848097 - DNA, 19 bp, Homo sapiens
ctgagcactgccaggaggg

SEQ ID NO: 2848098 - DNA, 22 bp, Homo sapiens
ctgagcactgccaggagggaca

SEQ ID NO: 2848099 - DNA, 13 bp, Homo sapiens
ctgagcccaggga

SEQ ID NO: 2848100 - DNA, 14 bp, Homo sapiens
ctgagcccagggag

SEQ ID NO: 2848101 - DNA, 19 bp, Homo sapiens
ctgagcccagggaggccga

SEQ ID NO: 2848102 - DNA, 11 bp, Homo sapiens
ctgagccctgg

SEQ ID NO: 2848103 - DNA, 14 bp, Homo sapiens
ctgagccctggcag

SEQ ID NO: 2848104 - DNA, 19 bp, Homo sapiens
ctgagcctaaatctaatca

SEQ ID NO: 2848105 - DNA, 16 bp, Homo sapiens
ctgagcctagctacct

SEQ ID NO: 2848106 - DNA, 16 bp, Homo sapiens
ctgagccttgtaattc

SEQ ID NO: 2848107 - DNA, 21 bp, Homo sapiens
ctgagccttgtaattctaaat

SEQ ID NO: 2848108 - DNA, 14 bp, Homo sapiens
ctgagctctgagag

SEQ ID NO: 2848109 - DNA, 16 bp, Homo sapiens
ctgagctctgagaggc

SEQ ID NO: 2848110 - DNA, 17 bp, Homo sapiens
ctgagctctgagaggcc

SEQ ID NO: 2848111 - DNA, 18 bp, Homo sapiens
ctgagctctgagaggccc

SEQ ID NO: 2848112 - DNA, 12 bp, Homo sapiens
ctgagctggccc

SEQ ID NO: 2848113 - DNA, 15 bp, Homo sapiens
ctgaggaagggagac

SEQ ID NO: 2848114 - DNA, 17 bp, Homo sapiens
ctgaggaatccagaccc

SEQ ID NO: 2848115 - DNA, 21 bp, Homo sapiens
ctgaggaatccagacccggct

SEQ ID NO: 2848116 - DNA, 23 bp, Homo sapiens
ctgaggaatccagacccggctgc

SEQ ID NO: 2848117 - DNA, 20 bp, Homo sapiens
ctgaggacactaaccacgct

SEQ ID NO: 2848118 - DNA, 12 bp, Homo sapiens
ctgaggagtctg

SEQ ID NO: 2848119 - DNA, 15 bp, Homo sapiens
ctgaggagtctgagg

SEQ ID NO: 2848120 - DNA, 17 bp, Homo sapiens
ctgaggagtctgaggtc

SEQ ID NO: 2848121 - DNA, 18 bp, Homo sapiens
ctgaggagtctgaggtcc

SEQ ID NO: 2848122 - DNA, 19 bp, Homo sapiens
ctgaggagtctgaggtcct

SEQ ID NO: 2848123 - DNA, 17 bp, Homo sapiens
ctgaggatttcaagcct

SEQ ID NO: 2848124 - DNA, 16 bp, Homo sapiens
ctgaggcaagagaatt

SEQ ID NO: 2848125 - DNA, 13 bp, Homo sapiens
ctgaggcagacag

SEQ ID NO: 2848126 - DNA, 15 bp, Homo sapiens
ctgaggcagacagca

SEQ ID NO: 2848127 - DNA, 18 bp, Homo sapiens
ctgaggcagacagcagct

SEQ ID NO: 2848128 - DNA, 15 bp, Homo sapiens
ctgaggcaggaggat

SEQ ID NO: 2848129 - DNA, 13 bp, Homo sapiens
ctgaggccagcct

SEQ ID NO: 2848130 - DNA, 15 bp, Homo sapiens
ctgaggccagcctgg

SEQ ID NO: 2848131 - DNA, 18 bp, Homo sapiens
ctgaggccagcctggcct

SEQ ID NO: 2848132 - DNA, 23 bp, Homo sapiens
ctgaggccagcctggcctcctgc

SEQ ID NO: 2848133 - DNA, 19 bp, Homo sapiens
ctgaggccccttaactcat

SEQ ID NO: 2848134 - DNA, 21 bp, Homo sapiens
ctgaggcctaaaagtaaacat

SEQ ID NO: 2848135 - DNA, 18 bp, Homo sapiens
ctgaggcgggtggatcac

SEQ ID NO: 2848136 - DNA, 20 bp, Homo sapiens
ctgaggctctttctgggcca

SEQ ID NO: 2848137 - DNA, 15 bp, Homo sapiens
ctgaggctgagactg

SEQ ID NO: 2848138 - DNA, 22 bp, Homo sapiens
ctgaggctgggggcgggggagc

SEQ ID NO: 2848139 - DNA, 19 bp, Homo sapiens
ctgagggcagttcgcagcc

SEQ ID NO: 2848140 - DNA, 21 bp, Homo sapiens
ctgaggggaggatcactggag

SEQ ID NO: 2848141 - DNA, 22 bp, Homo sapiens
ctgaggggggccgtgcccaggg

SEQ ID NO: 2848142 - DNA, 13 bp, Homo sapiens
ctgaggtcctgag

SEQ ID NO: 2848143 - DNA, 16 bp, Homo sapiens
ctgaggtcctgagcac

SEQ ID NO: 2848144 - DNA, 19 bp, Homo sapiens
ctgaggtcctgagcactgc

SEQ ID NO: 2848145 - DNA, 13 bp, Homo sapiens
ctgaggtgcccag

SEQ ID NO: 2848146 - DNA, 17 bp, Homo sapiens
ctgaggtgcccaggaga

SEQ ID NO: 2848147 - DNA, 20 bp, Homo sapiens
ctgaggtgcccaggagaaga

SEQ ID NO: 2848148 - DNA, 22 bp, Homo sapiens
ctgagtcaccctacctgtgcct

SEQ ID NO: 2848149 - DNA, 22 bp, Homo sapiens
ctgagtcatgatctccctgccg

SEQ ID NO: 2848150 - DNA, 11 bp, Homo sapiens
ctgagtgactc

SEQ ID NO: 2848151 - DNA, 15 bp, Homo sapiens
ctgagtgagccacag

SEQ ID NO: 2848152 - DNA, 20 bp, Homo sapiens
ctgagttgacttgacagaac

SEQ ID NO: 2848153 - DNA, 21 bp, Homo sapiens
ctgagttggtgttgacatgtg

SEQ ID NO: 2848154 - DNA, 12 bp, Homo sapiens
ctgatacctcaa

SEQ ID NO: 2848155 - DNA, 12 bp, Homo sapiens
ctgatactgggt

SEQ ID NO: 2848156 - DNA, 17 bp, Homo sapiens
ctgatcgtgctaaattt

SEQ ID NO: 2848157 - DNA, 21 bp, Homo sapiens
ctgatgaactcttaatcaaat

SEQ ID NO: 2848158 - DNA, 23 bp, Homo sapiens
ctgatgagtgattgacacacagc

SEQ ID NO: 2848159 - DNA, 14 bp, Homo sapiens
ctgatgcatcagaa

SEQ ID NO: 2848160 - DNA, 17 bp, Homo sapiens
ctgatgcatcagaaagg

SEQ ID NO: 2848161 - DNA, 21 bp, Homo sapiens
ctgatgcatcagaaagggagg

SEQ ID NO: 2848162 - DNA, 23 bp, Homo sapiens
ctgatgcatcagaaagggagggc

SEQ ID NO: 2848163 - DNA, 17 bp, Homo sapiens
ctgatgctttgcttcaa

SEQ ID NO: 2848164 - DNA, 17 bp, Homo sapiens
ctgattcccaagctctg

SEQ ID NO: 2848165 - DNA, 19 bp, Homo sapiens
ctgattcccaagctctgct

SEQ ID NO: 2848166 - DNA, 19 bp, Homo sapiens
ctgattcgaatgacactgt

SEQ ID NO: 2848167 - DNA, 15 bp, Homo sapiens
ctgattggacatttt

SEQ ID NO: 2848168 - DNA, 12 bp, Homo sapiens
ctgatttcagga

SEQ ID NO: 2848169 - DNA, 11 bp, Homo sapiens
ctgcaaaattt

SEQ ID NO: 2848170 - DNA, 16 bp, Homo sapiens
ctgcaaagtgcaaata

SEQ ID NO: 2848171 - DNA, 18 bp, Homo sapiens
ctgcaaagtgcaaatact

SEQ ID NO: 2848172 - DNA, 22 bp, Homo sapiens
ctgcaacctccgcctcttgggt

SEQ ID NO: 2848173 - DNA, 13 bp, Homo sapiens
ctgcaagaagtct

SEQ ID NO: 2848174 - DNA, 21 bp, Homo sapiens
ctgcaagagccttggtgtcca

SEQ ID NO: 2848175 - DNA, 23 bp, Homo sapiens
ctgcaagagccttggtgtccacc

SEQ ID NO: 2848176 - DNA, 17 bp, Homo sapiens
ctgcaaggtctttggtt

SEQ ID NO: 2848177 - DNA, 15 bp, Homo sapiens
ctgcaatctccaggg

SEQ ID NO: 2848178 - DNA, 17 bp, Homo sapiens
ctgcaatctccagggct

SEQ ID NO: 2848179 - DNA, 16 bp, Homo sapiens
ctgcaattctacagtt

SEQ ID NO: 2848180 - DNA, 21 bp, Homo sapiens
ctgcacaaagcccttccatgt

SEQ ID NO: 2848181 - DNA, 22 bp, Homo sapiens
ctgcacagatatttccatttct

SEQ ID NO: 2848182 - DNA, 14 bp, Homo sapiens
ctgcacatgtcttg

SEQ ID NO: 2848183 - DNA, 16 bp, Homo sapiens
ctgccccgcccagctg

SEQ ID NO: 2848184 - DNA, 18 bp, Homo sapiens
ccatgagcctcagcatcc

SEQ ID NO: 2848185 - DNA, 20 bp, Homo sapiens
ccatgaggagttgctgtttg

SEQ ID NO: 2848186 - DNA, 22 bp, Homo sapiens
ccatgaggcctttccccagtgt

SEQ ID NO: 2848187 - DNA, 19 bp, Homo sapiens
ccatgatgccgctcttctg

SEQ ID NO: 2848188 - DNA, 12 bp, Homo sapiens
ccatgattttac

SEQ ID NO: 2848189 - DNA, 14 bp, Homo sapiens
ccatgattttacag

SEQ ID NO: 2848190 - DNA, 15 bp, Homo sapiens
ccatgattttacaga

SEQ ID NO: 2848191 - DNA, 23 bp, Homo sapiens
ccatgcagcttcatcaattttta

SEQ ID NO: 2848192 - DNA, 17 bp, Homo sapiens
ccatgcctacagataat

SEQ ID NO: 2848193 - DNA, 12 bp, Homo sapiens
ccatgcctgagg

SEQ ID NO: 2848194 - DNA, 13 bp, Homo sapiens
ccatgcctgaggg

SEQ ID NO: 2848195 - DNA, 17 bp, Homo sapiens
ccatgcctgagggtgga

SEQ ID NO: 2848196 - DNA, 18 bp, Homo sapiens
ccatgcgctgctcaacct

SEQ ID NO: 2848197 - DNA, 19 bp, Homo sapiens
ccatgctcaaccactgtgg

SEQ ID NO: 2848198 - DNA, 12 bp, Homo sapiens
ccatgcttcttg

SEQ ID NO: 2848199 - DNA, 14 bp, Homo sapiens
ccatgcttcttgcc

SEQ ID NO: 2848200 - DNA, 18 bp, Homo sapiens
ccatgcttcttgcccctt

SEQ ID NO: 2848201 - DNA, 19 bp, Homo sapiens
ccatgcttcttgccccttg

SEQ ID NO: 2848202 - DNA, 21 bp, Homo sapiens
ccatgcttcttgccccttggg

SEQ ID NO: 2848203 - DNA, 14 bp, Homo sapiens
ccatggagcaggga

SEQ ID NO: 2848204 - DNA, 14 bp, Homo sapiens
ccatgggcctcctg

SEQ ID NO: 2848205 - DNA, 19 bp, Homo sapiens
ccatgggggtgctgcagcc

SEQ ID NO: 2848206 - DNA, 16 bp, Homo sapiens
ccatgtaccagtgtac

SEQ ID NO: 2848207 - DNA, 19 bp, Homo sapiens
ccatgtaccagtgtactgc

SEQ ID NO: 2848208 - DNA, 22 bp, Homo sapiens
ccatgtaccagtgtactgcttt

SEQ ID NO: 2848209 - DNA, 19 bp, Homo sapiens
ccatgtattcacacacccc

SEQ ID NO: 2848210 - DNA, 15 bp, Homo sapiens
ccatgtccaatggag

SEQ ID NO: 2848211 - DNA, 22 bp, Homo sapiens
ccatgtcctaggggccgaggga

SEQ ID NO: 2848212 - DNA, 15 bp, Homo sapiens
ccatgtcgcctctgc

SEQ ID NO: 2848213 - DNA, 17 bp, Homo sapiens
ccatgtcgcctctgcat

SEQ ID NO: 2848214 - DNA, 23 bp, Homo sapiens
ccatgtcgcctgcccccagcact

SEQ ID NO: 2848215 - DNA, 15 bp, Homo sapiens
ccatgtctttctcca

SEQ ID NO: 2848216 - DNA, 21 bp, Homo sapiens
ccatgtctttctccaaagtta

SEQ ID NO: 2848217 - DNA, 22 bp, Homo sapiens
ccatgtgcatggaaatgtcctc

SEQ ID NO: 2848218 - DNA, 13 bp, Homo sapiens
ccatgtgccaggt

SEQ ID NO: 2848219 - DNA, 13 bp, Homo sapiens
ccatgttggccag

SEQ ID NO: 2848220 - DNA, 15 bp, Homo sapiens
ccatgttggccaggc

SEQ ID NO: 2848221 - DNA, 17 bp, Homo sapiens
ccatgttggccaggctg

SEQ ID NO: 2848222 - DNA, 16 bp, Homo sapiens
ccatgtttgagctcag

SEQ ID NO: 2848223 - DNA, 14 bp, Homo sapiens
ccattaccatggag

SEQ ID NO: 2848224 - DNA, 18 bp, Homo sapiens
ccattactaaagacagaa

SEQ ID NO: 2848225 - DNA, 15 bp, Homo sapiens
ccattagtatcctgt

SEQ ID NO: 2848226 - DNA, 17 bp, Homo sapiens
ccattatgaagaagaga

SEQ ID NO: 2848227 - DNA, 14 bp, Homo sapiens
ccattctctctcct

SEQ ID NO: 2848228 - DNA, 20 bp, Homo sapiens
ccattctctctcctgtccaa

SEQ ID NO: 2848229 - DNA, 16 bp, Homo sapiens
ccattctgaccatttc

SEQ ID NO: 2848230 - DNA, 20 bp, Homo sapiens
ccattctgcctccattctga

SEQ ID NO: 2848231 - DNA, 17 bp, Homo sapiens
ccattctgcctgcccag

SEQ ID NO: 2848232 - DNA, 18 bp, Homo sapiens
ccattctgcctgcccagg

SEQ ID NO: 2848233 - DNA, 21 bp, Homo sapiens
ccattctgcctgcccaggccc

SEQ ID NO: 2848234 - DNA, 19 bp, Homo sapiens
ccattcttcctagttttct

SEQ ID NO: 2848235 - DNA, 14 bp, Homo sapiens
ccattgccctggtt

SEQ ID NO: 2848236 - DNA, 17 bp, Homo sapiens
ccattggctcccatctg

SEQ ID NO: 2848237 - DNA, 13 bp, Homo sapiens
ccatttccttgga

SEQ ID NO: 2848238 - DNA, 18 bp, Homo sapiens
ccatttccttggaggcca

SEQ ID NO: 2848239 - DNA, 22 bp, Homo sapiens
ccatttccttggaggccaccgg

SEQ ID NO: 2848240 - DNA, 14 bp, Homo sapiens
ccatttgtaatgta

SEQ ID NO: 2848241 - DNA, 13 bp, Homo sapiens
ccatttgtactga

SEQ ID NO: 2848242 - DNA, 20 bp, Homo sapiens
ccatttttagctctgatcag

SEQ ID NO: 2848243 - DNA, 15 bp, Homo sapiens
ccatttttgagccaa

SEQ ID NO: 2848244 - DNA, 23 bp, Homo sapiens
cccaaaacctcatgacagccaga

SEQ ID NO: 2848245 - DNA, 12 bp, Homo sapiens
cccaaagaagga

SEQ ID NO: 2848246 - DNA, 21 bp, Homo sapiens
cccaaatcccacagggccaga

SEQ ID NO: 2848247 - DNA, 17 bp, Homo sapiens
cccaacccgtggaggct

SEQ ID NO: 2848248 - DNA, 19 bp, Homo sapiens
cccaacccgtggaggctgc

SEQ ID NO: 2848249 - DNA, 20 bp, Homo sapiens
cccaacccgtggaggctgct

SEQ ID NO: 2848250 - DNA, 21 bp, Homo sapiens
cccaacccgtggaggctgctc

SEQ ID NO: 2848251 - DNA, 20 bp, Homo sapiens
cccaacctttccctcacccc

SEQ ID NO: 2848252 - DNA, 15 bp, Homo sapiens
cccaactccttccag

SEQ ID NO: 2848253 - DNA, 16 bp, Homo sapiens
cccaactccttccagc

SEQ ID NO: 2848254 - DNA, 18 bp, Homo sapiens
cccaactccttccagcta

SEQ ID NO: 2848255 - DNA, 20 bp, Homo sapiens
cccaagagcatcatgcctct

SEQ ID NO: 2848256 - DNA, 23 bp, Homo sapiens
cccaagagctacgtatttaatag

SEQ ID NO: 2848257 - DNA, 13 bp, Homo sapiens
cccaagagggctg

SEQ ID NO: 2848258 - DNA, 12 bp, Homo sapiens
cccaagctctgc

SEQ ID NO: 2848259 - DNA, 17 bp, Homo sapiens
cccaagctctgctcctc

SEQ ID NO: 2848260 - DNA, 19 bp, Homo sapiens
cccaagctgttttcttcta

SEQ ID NO: 2848261 - DNA, 20 bp, Homo sapiens
cccaaggcagtgttcctcac

SEQ ID NO: 2848262 - DNA, 12 bp, Homo sapiens
cccaaggctgct

SEQ ID NO: 2848263 - DNA, 15 bp, Homo sapiens
cccaaggctgctcag

SEQ ID NO: 2848264 - DNA, 19 bp, Homo sapiens
cccaagtatacaataaagt

SEQ ID NO: 2848265 - DNA, 23 bp, Homo sapiens
cccaagtgggggcagagggcaga

SEQ ID NO: 2848266 - DNA, 15 bp, Homo sapiens
cccaatattataatt

SEQ ID NO: 2848267 - DNA, 17 bp, Homo sapiens
cccaatattataatttt

SEQ ID NO: 2848268 - DNA, 12 bp, Homo sapiens
cccaatttaatt

SEQ ID NO: 2848269 - DNA, 14 bp, Homo sapiens
cccacaatgatgat

SEQ ID NO: 2848270 - DNA, 22 bp, Homo sapiens
cccacacggaggcatctgcacc

SEQ ID NO: 2848271 - DNA, 12 bp, Homo sapiens
cccacagaactg

SEQ ID NO: 2848272 - DNA, 14 bp, Homo sapiens
cccacagaactgct

SEQ ID NO: 2848273 - DNA, 17 bp, Homo sapiens
cccacagaactgcttac

SEQ ID NO: 2848274 - DNA, 18 bp, Homo sapiens
cccacagacagatcccat

SEQ ID NO: 2848275 - DNA, 21 bp, Homo sapiens
ccccaccttcaattcctgggc

SEQ ID NO: 2848276 - DNA, 13 bp, Homo sapiens
ccccaccttcccc

SEQ ID NO: 2848277 - DNA, 16 bp, Homo sapiens
ccccaccttccccaga

SEQ ID NO: 2848278 - DNA, 19 bp, Homo sapiens
ccccaccttgccaagcttt

SEQ ID NO: 2848279 - DNA, 23 bp, Homo sapiens
ccccactccctggctctcagaag

SEQ ID NO: 2848280 - DNA, 21 bp, Homo sapiens
ccccactctaggggtcaggct

SEQ ID NO: 2848281 - DNA, 12 bp, Homo sapiens
ccccactgcagg

SEQ ID NO: 2848282 - DNA, 16 bp, Homo sapiens
ccccactgcaggcccc

SEQ ID NO: 2848283 - DNA, 14 bp, Homo sapiens
ccccactgccacac

SEQ ID NO: 2848284 - DNA, 18 bp, Homo sapiens
ccccagacttctctttct

SEQ ID NO: 2848285 - DNA, 22 bp, Homo sapiens
ccccagagtgtgggaagggaga

SEQ ID NO: 2848286 - DNA, 20 bp, Homo sapiens
ccccagattgcaacaggctg

SEQ ID NO: 2848287 - DNA, 21 bp, Homo sapiens
ccccagattgcaacaggctgg

SEQ ID NO: 2848288 - DNA, 19 bp, Homo sapiens
ccccagcactaaagcagtg

SEQ ID NO: 2848289 - DNA, 13 bp, Homo sapiens
ccccagccagaag

SEQ ID NO: 2848290 - DNA, 17 bp, Homo sapiens
ccccagccccgactcca

SEQ ID NO: 2848291 - DNA, 18 bp, Homo sapiens
ccccagccccgactccag

SEQ ID NO: 2848292 - DNA, 13 bp, Homo sapiens
ccccagcctgggc

SEQ ID NO: 2848293 - DNA, 15 bp, Homo sapiens
ccccagcctgggcct

SEQ ID NO: 2848294 - DNA, 23 bp, Homo sapiens
ccccaggacgccactcatttcat

SEQ ID NO: 2848295 - DNA, 15 bp, Homo sapiens
ccccaggactcaccc

SEQ ID NO: 2848296 - DNA, 12 bp, Homo sapiens
ccccaggccagg

SEQ ID NO: 2848297 - DNA, 13 bp, Homo sapiens
ccccaggccaggc

SEQ ID NO: 2848298 - DNA, 15 bp, Homo sapiens
ccccaggccaggcca

SEQ ID NO: 2848299 - DNA, 14 bp, Homo sapiens
ccccagggcacagg

SEQ ID NO: 2848300 - DNA, 17 bp, Homo sapiens
ccccagggcacaggagc

SEQ ID NO: 2848301 - DNA, 19 bp, Homo sapiens
ccccagggcacaggagcta

SEQ ID NO: 2848302 - DNA, 23 bp, Homo sapiens
ccccagggcacaggagctacctg

SEQ ID NO: 2848303 - DNA, 16 bp, Homo sapiens
ccccaggtctctccac

SEQ ID NO: 2848304 - DNA, 13 bp, Homo sapiens
ccccaggtggctg

SEQ ID NO: 2848305 - DNA, 14 bp, Homo sapiens
ccccagtcgagccc

SEQ ID NO: 2848306 - DNA, 22 bp, Homo sapiens
ccccagtcgagccctgcagcca

SEQ ID NO: 2848307 - DNA, 15 bp, Homo sapiens
ccccagtgacagcta

SEQ ID NO: 2848308 - DNA, 14 bp, Homo sapiens
ccccagtgccacag

SEQ ID NO: 2848309 - DNA, 15 bp, Homo sapiens
ccccagtgcccacag

SEQ ID NO: 2848310 - DNA, 20 bp, Homo sapiens
ccccagtgcccacaggatca

SEQ ID NO: 2848311 - DNA, 18 bp, Homo sapiens
ccccagttacaaaaatag

SEQ ID NO: 2848312 - DNA, 16 bp, Homo sapiens
ccccagttctgctcct

SEQ ID NO: 2848313 - DNA, 20 bp, Homo sapiens
ccccagttctgctcctctcc

SEQ ID NO: 2848314 - DNA, 21 bp, Homo sapiens
ccccagttctgctcctctcca

SEQ ID NO: 2848315 - DNA, 23 bp, Homo sapiens
ccccagtttgcagaaaagcacct

SEQ ID NO: 2848316 - DNA, 12 bp, Homo sapiens
ccccatccccca

SEQ ID NO: 2848317 - DNA, 14 bp, Homo sapiens
ccccatctctacta

SEQ ID NO: 2848318 - DNA, 18 bp, Homo sapiens
ccccatggggctgcggga

SEQ ID NO: 2848319 - DNA, 17 bp, Homo sapiens
ccccatgtctctcagaa

SEQ ID NO: 2848320 - DNA, 20 bp, Homo sapiens
ccccattagtatcctgttag

SEQ ID NO: 2848321 - DNA, 15 bp, Homo sapiens
ccccattcacagagc

SEQ ID NO: 2848322 - DNA, 16 bp, Homo sapiens
ccccattcttcctagt

SEQ ID NO: 2848323 - DNA, 18 bp, Homo sapiens
ccccatttaggtttctga

SEQ ID NO: 2848324 - DNA, 13 bp, Homo sapiens
ccccatttctatt

SEQ ID NO: 2848325 - DNA, 15 bp, Homo sapiens
cccccaacctttccc

SEQ ID NO: 2848326 - DNA, 17 bp, Homo sapiens
cccccaccacactgaat

SEQ ID NO: 2848327 - DNA, 12 bp, Homo sapiens
cccccaccccct

SEQ ID NO: 2848328 - DNA, 23 bp, Homo sapiens
cccccacctccgccccagacaca

SEQ ID NO: 2848329 - DNA, 17 bp, Homo sapiens
cccccagcactcctctg

SEQ ID NO: 2848330 - DNA, 12 bp, Homo sapiens
cccccagcctgg

SEQ ID NO: 2848331 - DNA, 23 bp, Homo sapiens
cccccagctttgctaccaaagca

SEQ ID NO: 2848332 - DNA, 12 bp, Homo sapiens
ccccccactgca

SEQ ID NO: 2848333 - DNA, 13 bp, Homo sapiens
ccccccgcagcac

SEQ ID NO: 2848334 - DNA, 13 bp, Homo sapiens
cccccctccaggc

SEQ ID NO: 2848335 - DNA, 14 bp, Homo sapiens
cccccgtggtcttt

SEQ ID NO: 2848336 - DNA, 16 bp, Homo sapiens
cccccgtggtctttga

SEQ ID NO: 2848337 - DNA, 20 bp, Homo sapiens
ccccctcactccacactggc

SEQ ID NO: 2848338 - DNA, 12 bp, Homo sapiens
ccccctccaggc

SEQ ID NO: 2848339 - DNA, 20 bp, Homo sapiens
ccccctccaggcatgctggc

SEQ ID NO: 2848340 - DNA, 16 bp, Homo sapiens
ccccctcccaccccca

SEQ ID NO: 2848341 - DNA, 16 bp, Homo sapiens
ccccctgccagtgcct

SEQ ID NO: 2848342 - DNA, 18 bp, Homo sapiens
ccccctgcttctcagccc

SEQ ID NO: 2848343 - DNA, 13 bp, Homo sapiens
ccccctgggctct

SEQ ID NO: 2848344 - DNA, 21 bp, Homo sapiens
ccccctggggcttctcctgac

SEQ ID NO: 2848345 - DNA, 19 bp, Homo sapiens
ccccctggtggacagtcct

SEQ ID NO: 2848346 - DNA, 13 bp, Homo sapiens
ccccctgtgccct

SEQ ID NO: 2848347 - DNA, 17 bp, Homo sapiens
ccccgcccagctgcacc

SEQ ID NO: 2848348 - DNA, 19 bp, Homo sapiens
ccccgctggctcctccagg

SEQ ID NO: 2848349 - DNA, 16 bp, Homo sapiens
ccccgcttccccacag

SEQ ID NO: 2848350 - DNA, 15 bp, Homo sapiens
ccccgcttgtccagc

SEQ ID NO: 2848351 - DNA, 17 bp, Homo sapiens
ccccgggtccccagctc

SEQ ID NO: 2848352 - DNA, 18 bp, Homo sapiens
ccccgggtccccagctcc

SEQ ID NO: 2848353 - DNA, 22 bp, Homo sapiens
ccccgggtccccagctccccag

SEQ ID NO: 2848354 - DNA, 16 bp, Homo sapiens
ccccggtcccttgaga

SEQ ID NO: 2848355 - DNA, 20 bp, Homo sapiens
ccccgtctggggttcagccc

SEQ ID NO: 2848356 - DNA, 21 bp, Homo sapiens
ccccgtctggggttcagcccc

SEQ ID NO: 2848357 - DNA, 22 bp, Homo sapiens
ccccgtctggggttcagcccct

SEQ ID NO: 2848358 - DNA, 16 bp, Homo sapiens
ccccgtcttctctcca

SEQ ID NO: 2848359 - DNA, 17 bp, Homo sapiens
ccccgtggtctttgaat

SEQ ID NO: 2848360 - DNA, 20 bp, Homo sapiens
cccctatccacccagcccat

SEQ ID NO: 2848361 - DNA, 13 bp, Homo sapiens
cccctatgctcca

SEQ ID NO: 2848362 - DNA, 12 bp, Homo sapiens
cccctcagtgct

SEQ ID NO: 2848363 - DNA, 19 bp, Homo sapiens
cccctcagtgctcggcagt

SEQ ID NO: 2848364 - DNA, 20 bp, Homo sapiens
cccctccaggcatgctggcc

SEQ ID NO: 2848365 - DNA, 12 bp, Homo sapiens
cccctccatgtg

SEQ ID NO: 2848366 - DNA, 20 bp, Homo sapiens
cccttcctttcctctgcagc

SEQ ID NO: 2848367 - DNA, 13 bp, Homo sapiens
cccttctttaaat

SEQ ID NO: 2848368 - DNA, 13 bp, Homo sapiens
cccttctttcctc

SEQ ID NO: 2848369 - DNA, 14 bp, Homo sapiens
cccttctttcctct

SEQ ID NO: 2848370 - DNA, 14 bp, Homo sapiens
cccttgagacctca

SEQ ID NO: 2848371 - DNA, 15 bp, Homo sapiens
cccttgagacctcag

SEQ ID NO: 2848372 - DNA, 16 bp, Homo sapiens
cccttgagacctcagc

SEQ ID NO: 2848373 - DNA, 18 bp, Homo sapiens
cccttgagctccccaaaa

SEQ ID NO: 2848374 - DNA, 20 bp, Homo sapiens
cccttgagctccccaaaaac

SEQ ID NO: 2848375 - DNA, 14 bp, Homo sapiens
cccttgcccagggc

SEQ ID NO: 2848376 - DNA, 15 bp, Homo sapiens
cccttgcccagggct

SEQ ID NO: 2848377 - DNA, 20 bp, Homo sapiens
cccttgcccagggctcagcc

SEQ ID NO: 2848378 - DNA, 21 bp, Homo sapiens
cccttgcccagggctcagcct

SEQ ID NO: 2848379 - DNA, 12 bp, Homo sapiens
cccttgccctga

SEQ ID NO: 2848380 - DNA, 17 bp, Homo sapiens
cccttgggcctcccccc

SEQ ID NO: 2848381 - DNA, 22 bp, Homo sapiens
cccttgggcctccccccagccc

SEQ ID NO: 2848382 - DNA, 23 bp, Homo sapiens
ccctttattaattcattaaattt

SEQ ID NO: 2848383 - DNA, 12 bp, Homo sapiens
ccctttcctccc

SEQ ID NO: 2848384 - DNA, 20 bp, Homo sapiens
ccctttgggaggctgaggcg

SEQ ID NO: 2848385 - DNA, 23 bp, Homo sapiens
ccctttgggtactactgctgcaa

SEQ ID NO: 2848386 - DNA, 22 bp, Homo sapiens
cccttttctttttcccttgaac

SEQ ID NO: 2848387 - DNA, 17 bp, Homo sapiens
ccgaagaccgaatttta

SEQ ID NO: 2848388 - DNA, 23 bp, Homo sapiens
ccgaagaccttctgaagatctca

SEQ ID NO: 2848389 - DNA, 23 bp, Homo sapiens
ccgaattttattttacagagctt

SEQ ID NO: 2848390 - DNA, 21 bp, Homo sapiens
ccgacaaagggaaggctgctg

SEQ ID NO: 2848391 - DNA, 15 bp, Homo sapiens
ccgacctcagccttc

SEQ ID NO: 2848392 - DNA, 13 bp, Homo sapiens
ccgacctcgtcct

SEQ ID NO: 2848393 - DNA, 12 bp, Homo sapiens
ccgactcaggga

SEQ ID NO: 2848394 - DNA, 14 bp, Homo sapiens
ccgactcagggacc

SEQ ID NO: 2848395 - DNA, 10 bp, Homo sapiens
ccgactccag

SEQ ID NO: 2848396 - DNA, 12 bp, Homo sapiens
ccgactccagcc

SEQ ID NO: 2848397 - DNA, 13 bp, Homo sapiens
ccgactccagcca

SEQ ID NO: 2848398 - DNA, 16 bp, Homo sapiens
ccgactccagccagcg

SEQ ID NO: 2848399 - DNA, 15 bp, Homo sapiens
ccgagagcctgctcc

SEQ ID NO: 2848400 - DNA, 20 bp, Homo sapiens
ccgagagcctgctcccccac

SEQ ID NO: 2848401 - DNA, 16 bp, Homo sapiens
ccgagagtagccgaga

SEQ ID NO: 2848402 - DNA, 14 bp, Homo sapiens
ccgagcaaccgtgg

SEQ ID NO: 2848403 - DNA, 16 bp, Homo sapiens
ccgagcaaccgtggcc

SEQ ID NO: 2848404 - DNA, 23 bp, Homo sapiens
ccgagcaaccgtggcccttcctg

SEQ ID NO: 2848405 - DNA, 17 bp, Homo sapiens
ccgagcagctgagcagg

SEQ ID NO: 2848406 - DNA, 18 bp, Homo sapiens
ccgagcagctgagcaggg

SEQ ID NO: 2848407 - DNA, 12 bp, Homo sapiens
ccgagggaaatg

SEQ ID NO: 2848408 - DNA, 17 bp, Homo sapiens
ccgagtttgggccactg

SEQ ID NO: 2848409 - DNA, 11 bp, Homo sapiens
ccgcaccccag

SEQ ID NO: 2848410 - DNA, 13 bp, Homo sapiens
ccgcaccccccaa

SEQ ID NO: 2848411 - DNA, 14 bp, Homo sapiens
ccgcactcacccat

SEQ ID NO: 2848412 - DNA, 11 bp, Homo sapiens
ccgcagcaccc

SEQ ID NO: 2848413 - DNA, 23 bp, Homo sapiens
ccgcagccagccggtgcctggcg

SEQ ID NO: 2848414 - DNA, 17 bp, Homo sapiens
ccgcagggacagaactg

SEQ ID NO: 2848415 - DNA, 15 bp, Homo sapiens
ccgcatcttctccat

SEQ ID NO: 2848416 - DNA, 19 bp, Homo sapiens
ccgcatcttctccatctgg

SEQ ID NO: 2848417 - DNA, 19 bp, Homo sapiens
ccgccacgaggagcttcca

SEQ ID NO: 2848418 - DNA, 14 bp, Homo sapiens
ccgccatccttcac

SEQ ID NO: 2848419 - DNA, 20 bp, Homo sapiens
ccgccatccttcaccagagc

SEQ ID NO: 2848420 - DNA, 13 bp, Homo sapiens
ccgccccagacac

SEQ ID NO: 2848421 - DNA, 18 bp, Homo sapiens
ccgcccctctccaaacac

SEQ ID NO: 2848422 - DNA, 23 bp, Homo sapiens
ccgcctcaatgtggttgcaaggc

SEQ ID NO: 2848423 - DNA, 14 bp, Homo sapiens
ccgcctccaggagc

SEQ ID NO: 2848424 - DNA, 13 bp, Homo sapiens
ccgcgtctaccct

SEQ ID NO: 2848425 - DNA, 17 bp, Homo sapiens
ccgcgtctaccctggga

SEQ ID NO: 2848426 - DNA, 18 bp, Homo sapiens
ccgctaaaagaaactttc

SEQ ID NO: 2848427 - DNA, 17 bp, Homo sapiens
ccgctacaccactctgg

SEQ ID NO: 2848428 - DNA, 21 bp, Homo sapiens
ccgctacaccactctggcagc

SEQ ID NO: 2848429 - DNA, 15 bp, Homo sapiens
ccgctcctgtctgcc

SEQ ID NO: 2848430 - DNA, 14 bp, Homo sapiens
ccgctctggaccaa

SEQ ID NO: 2848431 - DNA, 16 bp, Homo sapiens
ccgctgccccagcccc

SEQ ID NO: 2848432 - DNA, 18 bp, Homo sapiens
ccgctggcagccaccccc

SEQ ID NO: 2848433 - DNA, 15 bp, Homo sapiens
ccgctggctcctcca

SEQ ID NO: 2848434 - DNA, 23 bp, Homo sapiens
ccgctggggagcgaaagtttctt

SEQ ID NO: 2848435 - DNA, 14 bp, Homo sapiens
ccgctgttcaccca

SEQ ID NO: 2848436 - DNA, 18 bp, Homo sapiens
ccgctgttcacccacagg

SEQ ID NO: 2848437 - DNA, 19 bp, Homo sapiens
ccgctgttcacccacaggg

SEQ ID NO: 2848438 - DNA, 21 bp, Homo sapiens
ccgctgttcacccacagggct

SEQ ID NO: 2848439 - DNA, 16 bp, Homo sapiens
ccgcttccccacagaa

SEQ ID NO: 2848440 - DNA, 18 bp, Homo sapiens
ccgcttgtccagcgccta

SEQ ID NO: 2848441 - DNA, 21 bp, Homo sapiens
ccggagctttcaaagaaggaa

SEQ ID NO: 2848442 - DNA, 17 bp, Homo sapiens
ccggaggtagaggttgt

SEQ ID NO: 2848443 - DNA, 21 bp, Homo sapiens
ccggcaaccccagttctgctc

SEQ ID NO: 2848444 - DNA, 17 bp, Homo sapiens
ccggcaccccctgcagc

SEQ ID NO: 2848445 - DNA, 19 bp, Homo sapiens
ccggcacctacatccccag

SEQ ID NO: 2848446 - DNA, 20 bp, Homo sapiens
ccggcacctacatccccagg

SEQ ID NO: 2848447 - DNA, 16 bp, Homo sapiens
ccggcccagagacccc

SEQ ID NO: 2848448 - DNA, 18 bp, Homo sapiens
ccggcccagagacccctt

SEQ ID NO: 2848449 - DNA, 20 bp, Homo sapiens
ccggcccagagaccccttcc

SEQ ID NO: 2848450 - DNA, 17 bp, Homo sapiens
ccggctatgggggcact

SEQ ID NO: 2848451 - DNA, 22 bp, Homo sapiens
ccggctatgggggcactgagga

SEQ ID NO: 2848452 - DNA, 23 bp, Homo sapiens
ccggctatgggggcactgaggac

SEQ ID NO: 2848453 - DNA, 12 bp, Homo sapiens
ccggctccaggc

SEQ ID NO: 2848454 - DNA, 15 bp, Homo sapiens
ccggctccaggctcc

SEQ ID NO: 2848455 - DNA, 15 bp, Homo sapiens
ccgggcactcagaag

SEQ ID NO: 2848456 - DNA, 22 bp, Homo sapiens
ccgggcatggtggcgcaagcct

SEQ ID NO: 2848457 - DNA, 21 bp, Homo sapiens
cctgaatacccttttctgacc

SEQ ID NO: 2848458 - DNA, 19 bp, Homo sapiens
cctgaatccatcaggactt

SEQ ID NO: 2848459 - DNA, 20 bp, Homo sapiens
cctgaatggttccatgcctg

SEQ ID NO: 2848460 - DNA, 21 bp, Homo sapiens
cctgaatggttccatgcctga

SEQ ID NO: 2848461 - DNA, 21 bp, Homo sapiens
cctgaattttgttgctgtttt

SEQ ID NO: 2848462 - DNA, 20 bp, Homo sapiens
cctgaccacgctttctagct

SEQ ID NO: 2848463 - DNA, 15 bp, Homo sapiens
cctgacccagtcccc

SEQ ID NO: 2848464 - DNA, 15 bp, Homo sapiens
cctgacccctgcacc

SEQ ID NO: 2848465 - DNA, 13 bp, Homo sapiens
cctgacctcccag

SEQ ID NO: 2848466 - DNA, 15 bp, Homo sapiens
cctgacctcccagcc

SEQ ID NO: 2848467 - DNA, 20 bp, Homo sapiens
cctgactcctctaagccact

SEQ ID NO: 2848468 - DNA, 18 bp, Homo sapiens
cctgactctctgtgacct

SEQ ID NO: 2848469 - DNA, 19 bp, Homo sapiens
cctgacttggggagatgga

SEQ ID NO: 2848470 - DNA, 18 bp, Homo sapiens
cctgagaaacccaccagc

SEQ ID NO: 2848471 - DNA, 22 bp, Homo sapiens
cctgagaccagttgggagcact

SEQ ID NO: 2848472 - DNA, 17 bp, Homo sapiens
cctgagaggtgctgcag

SEQ ID NO: 2848473 - DNA, 21 bp, Homo sapiens
cctgagcaacagagtgagacc

SEQ ID NO: 2848474 - DNA, 23 bp, Homo sapiens
cctgagcaacagagtgagaccct

SEQ ID NO: 2848475 - DNA, 12 bp, Homo sapiens
cctgagcccagg

SEQ ID NO: 2848476 - DNA, 16 bp, Homo sapiens
cctgagcccagggagg

SEQ ID NO: 2848477 - DNA, 18 bp, Homo sapiens
cctgagcccagggaggcc

SEQ ID NO: 2848478 - DNA, 15 bp, Homo sapiens
cctgagcctgccgag

SEQ ID NO: 2848479 - DNA, 16 bp, Homo sapiens
cctgagcctgccgagc

SEQ ID NO: 2848480 - DNA, 20 bp, Homo sapiens
cctgagcctgccgagcaacc

SEQ ID NO: 2848481 - DNA, 20 bp, Homo sapiens
cctgagctcggtggacccag

SEQ ID NO: 2848482 - DNA, 22 bp, Homo sapiens
cctgagctcggtggacccaggg

SEQ ID NO: 2848483 - DNA, 14 bp, Homo sapiens
cctgaggagtctga

SEQ ID NO: 2848484 - DNA, 15 bp, Homo sapiens
cctgagggtggagac

SEQ ID NO: 2848485 - DNA, 16 bp, Homo sapiens
cctgagggtggagact

SEQ ID NO: 2848486 - DNA, 14 bp, Homo sapiens
cctgaggtcacctg

SEQ ID NO: 2848487 - DNA, 15 bp, Homo sapiens
cctgaggtcacctgg

SEQ ID NO: 2848488 - DNA, 21 bp, Homo sapiens
cctgagtagctgggattacag

SEQ ID NO: 2848489 - DNA, 14 bp, Homo sapiens
cctgagtcaccagg

SEQ ID NO: 2848490 - DNA, 15 bp, Homo sapiens
cctgagtcaccagga

SEQ ID NO: 2848491 - DNA, 18 bp, Homo sapiens
cctgagtcacccatgaag

SEQ ID NO: 2848492 - DNA, 23 bp, Homo sapiens
cctgagtggatctccaaggacca

SEQ ID NO: 2848493 - DNA, 20 bp, Homo sapiens
cctgagtgtgggcttctgaa

SEQ ID NO: 2848494 - DNA, 23 bp, Homo sapiens
cctgatactgggtacaagagcca

SEQ ID NO: 2848495 - DNA, 13 bp, Homo sapiens
cctgatgacagag

SEQ ID NO: 2848496 - DNA, 14 bp, Homo sapiens
cctgcaaactcact

SEQ ID NO: 2848497 - DNA, 15 bp, Homo sapiens
cctgcaatctccagg

SEQ ID NO: 2848498 - DNA, 18 bp, Homo sapiens
cctgcaatctccagggct

SEQ ID NO: 2848499 - DNA, 17 bp, Homo sapiens
cctgcacccttcctcct

SEQ ID NO: 2848500 - DNA, 21 bp, Homo sapiens
cctgcactaatttgatgttta

SEQ ID NO: 2848501 - DNA, 20 bp, Homo sapiens
cctgcactgacccacagcct

SEQ ID NO: 2848502 - DNA, 11 bp, Homo sapiens
cctgcagagag

SEQ ID NO: 2848503 - DNA, 15 bp, Homo sapiens
cctgcagagagaagc

SEQ ID NO: 2848504 - DNA, 16 bp, Homo sapiens
cctgcagagagaagcc

SEQ ID NO: 2848505 - DNA, 14 bp, Homo sapiens
cctgcagagcacac

SEQ ID NO: 2848506 - DNA, 17 bp, Homo sapiens
cctgcagagcacacagg

SEQ ID NO: 2848507 - DNA, 19 bp, Homo sapiens
cctgcagaggggaaaccag

SEQ ID NO: 2848508 - DNA, 21 bp, Homo sapiens
cctgcagccaaacagagcctt

SEQ ID NO: 2848509 - DNA, 23 bp, Homo sapiens
cctgcagccaaacagagccttca

SEQ ID NO: 2848510 - DNA, 22 bp, Homo sapiens
cctgcagccccgcgcctccttc

SEQ ID NO: 2848511 - DNA, 19 bp, Homo sapiens
cctgcagcctcctcctgac

SEQ ID NO: 2848512 - DNA, 19 bp, Homo sapiens
cctgcagcttgtagccagc

SEQ ID NO: 2848513 - DNA, 20 bp, Homo sapiens
cctgcagcttgtagccagcc

SEQ ID NO: 2848514 - DNA, 21 bp, Homo sapiens
cctgcagcttgtagccagccg

SEQ ID NO: 2848515 - DNA, 15 bp, Homo sapiens
cctgcagggccaagc

SEQ ID NO: 2848516 - DNA, 18 bp, Homo sapiens
cctgcagtactttacctc

SEQ ID NO: 2848517 - DNA, 19 bp, Homo sapiens
cctgcatccgtagttccct

SEQ ID NO: 2848518 - DNA, 14 bp, Homo sapiens
cctgcatttctcag

SEQ ID NO: 2848519 - DNA, 12 bp, Homo sapiens
cctgccaagcca

SEQ ID NO: 2848520 - DNA, 16 bp, Homo sapiens
cctgccaccctgggga

SEQ ID NO: 2848521 - DNA, 22 bp, Homo sapiens
cctgccaccctggggagaaagt

SEQ ID NO: 2848522 - DNA, 15 bp, Homo sapiens
cctgccagcctggct

SEQ ID NO: 2848523 - DNA, 17 bp, Homo sapiens
cctgccagcctggcttc

SEQ ID NO: 2848524 - DNA, 20 bp, Homo sapiens
cctgccaggcccccgctggc

SEQ ID NO: 2848525 - DNA, 12 bp, Homo sapiens
cctgccagggcc

SEQ ID NO: 2848526 - DNA, 13 bp, Homo sapiens
cctgccagggccc

SEQ ID NO: 2848527 - DNA, 13 bp, Homo sapiens
cctgccagtgcct

SEQ ID NO: 2848528 - DNA, 23 bp, Homo sapiens
cctgccagtgtttagaagagcct

SEQ ID NO: 2848529 - DNA, 23 bp, Homo sapiens
cctgccatttgcaccctccgcct

SEQ ID NO: 2848530 - DNA, 15 bp, Homo sapiens
cctgcccagcctcgc

SEQ ID NO: 2848531 - DNA, 12 bp, Homo sapiens
cctgcccaggag

SEQ ID NO: 2848532 - DNA, 20 bp, Homo sapiens
cctgcccaggagagccagcc

SEQ ID NO: 2848533 - DNA, 21 bp, Homo sapiens
cctgcccaggcccctgccacc

SEQ ID NO: 2848534 - DNA, 18 bp, Homo sapiens
cctgcccccagcactcct

SEQ ID NO: 2848535 - DNA, 23 bp, Homo sapiens
cctgcccccagcactcctctgtc

SEQ ID NO: 2848536 - DNA, 12 bp, Homo sapiens
cctgccccctgg

SEQ ID NO: 2848537 - DNA, 16 bp, Homo sapiens
cctgccccctggtgga

SEQ ID NO: 2848538 - DNA, 16 bp, Homo sapiens
cctgccccgcccagct

SEQ ID NO: 2848539 - DNA, 18 bp, Homo sapiens
cctgccctagagcacact

SEQ ID NO: 2848540 - DNA, 22 bp, Homo sapiens
cctgccctagagcacactgtag

SEQ ID NO: 2848541 - DNA, 24 bp, Homo sapiens
cctgccctagagcacactgtagca

SEQ ID NO: 2848542 - DNA, 12 bp, Homo sapiens
cctgccctgcca

SEQ ID NO: 2848543 - DNA, 18 bp, Homo sapiens
cctgccctgccacctgtc

SEQ ID NO: 2848544 - DNA, 15 bp, Homo sapiens
cctgccctgccctgc

SEQ ID NO: 2848545 - DNA, 22 bp, Homo sapiens
cctgcctacattccctggcctg

SEQ ID NO: 2848546 - DNA, 16 bp, Homo sapiens
cctgcctatccatcct

SEQ ID NO: 2848547 - DNA, 23 bp, Homo sapiens
cgaggtggatcacagaggcttct

SEQ ID NO: 2848548 - DNA, 17 bp, Homo sapiens
cgagtctacctcttcag

SEQ ID NO: 2848549 - DNA, 11 bp, Homo sapiens
cgagtgccagg

SEQ ID NO: 2848550 - DNA, 13 bp, Homo sapiens
cgatgacagtgct

SEQ ID NO: 2848551 - DNA, 16 bp, Homo sapiens
cgatgacagtgctcta

SEQ ID NO: 2848552 - DNA, 15 bp, Homo sapiens
cgatgtggccctggc

SEQ ID NO: 2848553 - DNA, 17 bp, Homo sapiens
cgattcaaactgctcca

SEQ ID NO: 2848554 - DNA, 17 bp, Homo sapiens
cgattccctctcccagg

SEQ ID NO: 2848555 - DNA, 21 bp, Homo sapiens
cgattccctctcccaggcccc

SEQ ID NO: 2848556 - DNA, 23 bp, Homo sapiens
cgattccctctcccaggccccat

SEQ ID NO: 2848557 - DNA, 19 bp, Homo sapiens
cgattcttctgcttcagcc

SEQ ID NO: 2848558 - DNA, 16 bp, Homo sapiens
cgcacaaggctgacca

SEQ ID NO: 2848559 - DNA, 15 bp, Homo sapiens
cgcagagtaaaataa

SEQ ID NO: 2848560 - DNA, 14 bp, Homo sapiens
cgcagcaccctgca

SEQ ID NO: 2848561 - DNA, 13 bp, Homo sapiens
cgcagcatgtggg

SEQ ID NO: 2848562 - DNA, 12 bp, Homo sapiens
cgcagccaccct

SEQ ID NO: 2848563 - DNA, 14 bp, Homo sapiens
cgcagccaccctga

SEQ ID NO: 2848564 - DNA, 16 bp, Homo sapiens
cgcagccaccctgagg

SEQ ID NO: 2848565 - DNA, 14 bp, Homo sapiens
cgcatcttctccat

SEQ ID NO: 2848566 - DNA, 16 bp, Homo sapiens
cgcatgtaatcccagc

SEQ ID NO: 2848567 - DNA, 20 bp, Homo sapiens
cgcatgtaatcccagctact

SEQ ID NO: 2848568 - DNA, 12 bp, Homo sapiens
cgcattgtacac

SEQ ID NO: 2848569 - DNA, 15 bp, Homo sapiens
cgcattttctctagc

SEQ ID NO: 2848570 - DNA, 16 bp, Homo sapiens
cgcattttctctagct

SEQ ID NO: 2848571 - DNA, 20 bp, Homo sapiens
cgccacacccggctccccct

SEQ ID NO: 2848572 - DNA, 21 bp, Homo sapiens
cgccacacccggctccccctg

SEQ ID NO: 2848573 - DNA, 23 bp, Homo sapiens
cgccaccatcctgcagcctcctc

SEQ ID NO: 2848574 - DNA, 14 bp, Homo sapiens
cgccacgaggagct

SEQ ID NO: 2848575 - DNA, 21 bp, Homo sapiens
cgccactacactccagcctga

SEQ ID NO: 2848576 - DNA, 22 bp, Homo sapiens
cgccactacactccagcctgag

SEQ ID NO: 2848577 - DNA, 23 bp, Homo sapiens
cgccactgcactccagcctgggc

SEQ ID NO: 2848578 - DNA, 21 bp, Homo sapiens
cgccactgcactccagtctgg

SEQ ID NO: 2848579 - DNA, 21 bp, Homo sapiens
cgccatcaccccctaccccag

SEQ ID NO: 2848580 - DNA, 20 bp, Homo sapiens
cgccatccttcaccagagcc

SEQ ID NO: 2848581 - DNA, 18 bp, Homo sapiens
cgcccagctgaggctggg

SEQ ID NO: 2848582 - DNA, 18 bp, Homo sapiens
cgcccagctgcacctgcc

SEQ ID NO: 2848583 - DNA, 15 bp, Homo sapiens
cgcccaggagacatc

SEQ ID NO: 2848584 - DNA, 21 bp, Homo sapiens
cgccccaacccgtggaggctg

SEQ ID NO: 2848585 - DNA, 22 bp, Homo sapiens
cgccccaacccgtggaggctgc

SEQ ID NO: 2848586 - DNA, 11 bp, Homo sapiens
cgccctgcaga

SEQ ID NO: 2848587 - DNA, 20 bp, Homo sapiens
cgccctgcagaccctgccct

SEQ ID NO: 2848588 - DNA, 21 bp, Homo sapiens
cgccctgcagaccctgccctt

SEQ ID NO: 2848589 - DNA, 13 bp, Homo sapiens
cgcctccaggagc

SEQ ID NO: 2848590 - DNA, 15 bp, Homo sapiens
cgcctccaggagcct

SEQ ID NO: 2848591 - DNA, 15 bp, Homo sapiens
cgcctcccagcctgg

SEQ ID NO: 2848592 - DNA, 10 bp, Homo sapiens
cgcctccccg

SEQ ID NO: 2848593 - DNA, 19 bp, Homo sapiens
cgcctgagcccagggaggc

SEQ ID NO: 2848594 - DNA, 20 bp, Homo sapiens
cgcctgagcccagggaggcc

SEQ ID NO: 2848595 - DNA, 13 bp, Homo sapiens
cgcctgcccagcc

SEQ ID NO: 2848596 - DNA, 18 bp, Homo sapiens
cgcctgcccagcctcgca

SEQ ID NO: 2848597 - DNA, 21 bp, Homo sapiens
cgcctgcccccagcactcctc

SEQ ID NO: 2848598 - DNA, 17 bp, Homo sapiens
cgcctgcttgtccctgc

SEQ ID NO: 2848599 - DNA, 14 bp, Homo sapiens
cgcctggccggctc

SEQ ID NO: 2848600 - DNA, 17 bp, Homo sapiens
cgcctggccggctccag

SEQ ID NO: 2848601 - DNA, 22 bp, Homo sapiens
cgcctggccggctccagtttcc

SEQ ID NO: 2848602 - DNA, 18 bp, Homo sapiens
cgcctgtagtcccagcca

SEQ ID NO: 2848603 - DNA, 15 bp, Homo sapiens
cgcgtctaccctggg

SEQ ID NO: 2848604 - DNA, 19 bp, Homo sapiens
cgcgtgcacacaccagagc

SEQ ID NO: 2848605 - DNA, 13 bp, Homo sapiens
cgctaaaagaaac

SEQ ID NO: 2848606 - DNA, 15 bp, Homo sapiens
cgctaaaagaaactt

SEQ ID NO: 2848607 - DNA, 17 bp, Homo sapiens
cgctacaccactctggc

SEQ ID NO: 2848608 - DNA, 15 bp, Homo sapiens
cgctccccactctgc

SEQ ID NO: 2848609 - DNA, 16 bp, Homo sapiens
cgctccccactctgct

SEQ ID NO: 2848610 - DNA, 17 bp, Homo sapiens
cgctcctgtctgccagc

SEQ ID NO: 2848611 - DNA, 21 bp, Homo sapiens
cgctcctgtctgccagccagc

SEQ ID NO: 2848612 - DNA, 13 bp, Homo sapiens
cgctcctgtgtct

SEQ ID NO: 2848613 - DNA, 19 bp, Homo sapiens
cgctctgccctccctggcc

SEQ ID NO: 2848614 - DNA, 20 bp, Homo sapiens
cgctctgccctccctggcct

SEQ ID NO: 2848615 - DNA, 21 bp, Homo sapiens
cgctctgccctccctggcctc

SEQ ID NO: 2848616 - DNA, 15 bp, Homo sapiens
cgctctgctggcctg

SEQ ID NO: 2848617 - DNA, 20 bp, Homo sapiens
cgctctgctggcctggccgg

SEQ ID NO: 2848618 - DNA, 17 bp, Homo sapiens
cgctgcctaagtggctg

SEQ ID NO: 2848619 - DNA, 16 bp, Homo sapiens
cgctgctagagaaggg

SEQ ID NO: 2848620 - DNA, 20 bp, Homo sapiens
cgctgctttgcgctggtgga

SEQ ID NO: 2848621 - DNA, 16 bp, Homo sapiens
cgctggacaacccaga

SEQ ID NO: 2848622 - DNA, 17 bp, Homo sapiens
cgctggacaacccagaa

SEQ ID NO: 2848623 - DNA, 14 bp, Homo sapiens
cgctggcagccacc

SEQ ID NO: 2848624 - DNA, 15 bp, Homo sapiens
cgctggctcctccag

SEQ ID NO: 2848625 - DNA, 13 bp, Homo sapiens
cgctttcatgaac

SEQ ID NO: 2848626 - DNA, 22 bp, Homo sapiens
cgctttctagctgttgagctgt

SEQ ID NO: 2848627 - DNA, 22 bp, Homo sapiens
cgctttctggaaaagaggagtt

SEQ ID NO: 2848628 - DNA, 13 bp, Homo sapiens
cgctttgcctgct

SEQ ID NO: 2848629 - DNA, 16 bp, Homo sapiens
cgctttttgaaaaagc

SEQ ID NO: 2848630 - DNA, 14 bp, Homo sapiens
cggaatagttggct

SEQ ID NO: 2848631 - DNA, 16 bp, Homo sapiens
cggaatagttggctag

SEQ ID NO: 2848632 - DNA, 22 bp, Homo sapiens
cggacagccacggccaggccag

SEQ ID NO: 2848633 - DNA, 16 bp, Homo sapiens
cggacgtttccatcag

SEQ ID NO: 2848634 - DNA, 17 bp, Homo sapiens
cggagaaggccgctgcc

SEQ ID NO: 2848635 - DNA, 18 bp, Homo sapiens
cggagaaggccgctgccc

SEQ ID NO: 2848636 - DNA, 15 bp, Homo sapiens
cggagacagtgatct

SEQ ID NO: 2848637 - DNA, 14 bp, Homo sapiens
cggagagggctgcg

SEQ ID NO: 2848638 - DNA, 17 bp, Homo sapiens
ctactggtcttgtggaa

SEQ ID NO: 2848639 - DNA, 20 bp, Homo sapiens
ctactgtcctacccaccctc

SEQ ID NO: 2848640 - DNA, 17 bp, Homo sapiens
ctactgtggaaaaatat

SEQ ID NO: 2848641 - DNA, 22 bp, Homo sapiens
ctactgtggaaaaatatttaag

SEQ ID NO: 2848642 - DNA, 19 bp, Homo sapiens
ctacttgttacctttccca

SEQ ID NO: 2848643 - DNA, 17 bp, Homo sapiens
ctactttgatatgactg

SEQ ID NO: 2848644 - DNA, 14 bp, Homo sapiens
ctactttttatact

SEQ ID NO: 2848645 - DNA, 22 bp, Homo sapiens
ctagaaagctctgcatgtgtgt

SEQ ID NO: 2848646 - DNA, 14 bp, Homo sapiens
ctagaacacaggca

SEQ ID NO: 2848647 - DNA, 19 bp, Homo sapiens
ctagaacacaggcaaaatc

SEQ ID NO: 2848648 - DNA, 22 bp, Homo sapiens
ctagaacacaggcaaaatcctt

SEQ ID NO: 2848649 - DNA, 20 bp, Homo sapiens
ctagaacatgcacatttata

SEQ ID NO: 2848650 - DNA, 22 bp, Homo sapiens
ctagaacatgcacatttatata

SEQ ID NO: 2848651 - DNA, 19 bp, Homo sapiens
ctagaagtgggccaggaca

SEQ ID NO: 2848652 - DNA, 21 bp, Homo sapiens
ctagaagtgggccaggacagg

SEQ ID NO: 2848653 - DNA, 21 bp, Homo sapiens
ctagaattgagtgtttaaagt

SEQ ID NO: 2848654 - DNA, 17 bp, Homo sapiens
ctagaatttgtattttg

SEQ ID NO: 2848655 - DNA, 19 bp, Homo sapiens
ctagaattttaagtgcttt

SEQ ID NO: 2848656 - DNA, 13 bp, Homo sapiens
ctagacactgcca

SEQ ID NO: 2848657 - DNA, 20 bp, Homo sapiens
ctagactaggaggttccggt

SEQ ID NO: 2848658 - DNA, 15 bp, Homo sapiens
ctagagaagaggctg

SEQ ID NO: 2848659 - DNA, 19 bp, Homo sapiens
ctagaggcttccttcattt

SEQ ID NO: 2848660 - DNA, 17 bp, Homo sapiens
ctagaggtgagaaattt

SEQ ID NO: 2848661 - DNA, 17 bp, Homo sapiens
ctagatccacacacaga

SEQ ID NO: 2848662 - DNA, 19 bp, Homo sapiens
ctagatccacacacagagg

SEQ ID NO: 2848663 - DNA, 21 bp, Homo sapiens
ctagatctcctatttttcaga

SEQ ID NO: 2848664 - DNA, 13 bp, Homo sapiens
ctagatgtcttta

SEQ ID NO: 2848665 - DNA, 16 bp, Homo sapiens
ctagcacttggagcca

SEQ ID NO: 2848666 - DNA, 19 bp, Homo sapiens
ctagcagctgcagtcaaca

SEQ ID NO: 2848667 - DNA, 18 bp, Homo sapiens
ctagcaggcacaggacac

SEQ ID NO: 2848668 - DNA, 20 bp, Homo sapiens
ctagcaggcacaggacacct

SEQ ID NO: 2848669 - DNA, 20 bp, Homo sapiens
ctagccgacctcagccttcc

SEQ ID NO: 2848670 - DNA, 13 bp, Homo sapiens
ctagcctctccag

SEQ ID NO: 2848671 - DNA, 23 bp, Homo sapiens
ctagccttagaagtcacacagta

SEQ ID NO: 2848672 - DNA, 20 bp, Homo sapiens
ctagctaccttctctaccca

SEQ ID NO: 2848673 - DNA, 23 bp, Homo sapiens
ctagctagaagtgggccaggaca

SEQ ID NO: 2848674 - DNA, 16 bp, Homo sapiens
ctaggactctgaggct

SEQ ID NO: 2848675 - DNA, 13 bp, Homo sapiens
ctaggagcaaagc

SEQ ID NO: 2848676 - DNA, 18 bp, Homo sapiens
ctaggagcaaagcctgtt

SEQ ID NO: 2848677 - DNA, 16 bp, Homo sapiens
ctaggaggaaaaagaa

SEQ ID NO: 2848678 - DNA, 15 bp, Homo sapiens
ctaggccactcctcc

SEQ ID NO: 2848679 - DNA, 17 bp, Homo sapiens
ctaggccactcctccaa

SEQ ID NO: 2848680 - DNA, 15 bp, Homo sapiens
ctaggcgagtgccag

SEQ ID NO: 2848681 - DNA, 16 bp, Homo sapiens
ctaggcgagtgccagg

SEQ ID NO: 2848682 - DNA, 21 bp, Homo sapiens
ctaggcttcagcatatttata

SEQ ID NO: 2848683 - DNA, 15 bp, Homo sapiens
ctagggagagaccct

SEQ ID NO: 2848684 - DNA, 14 bp, Homo sapiens
ctaggtgacagagt

SEQ ID NO: 2848685 - DNA, 24 bp, Homo sapiens
ctaggtgacagagtgagactctgt

SEQ ID NO: 2848686 - DNA, 19 bp, Homo sapiens
ctagtaatgggccaattaa

SEQ ID NO: 2848687 - DNA, 11 bp, Homo sapiens
ctagtatatta

SEQ ID NO: 2848688 - DNA, 18 bp, Homo sapiens
ctagtattgtccatatca

SEQ ID NO: 2848689 - DNA, 18 bp, Homo sapiens
ctagtcagagagagtgtt

SEQ ID NO: 2848690 - DNA, 18 bp, Homo sapiens
ctagtcctattctattgc

SEQ ID NO: 2848691 - DNA, 15 bp, Homo sapiens
ctagtcctttactaa

SEQ ID NO: 2848692 - DNA, 21 bp, Homo sapiens
ctagtctcctttgcactgagg

SEQ ID NO: 2848693 - DNA, 19 bp, Homo sapiens
ctagtctggtgttctgagt

SEQ ID NO: 2848694 - DNA, 17 bp, Homo sapiens
ctagtgacccacatgcc

SEQ ID NO: 2848695 - DNA, 18 bp, Homo sapiens
ctagtgccctccacagcc

SEQ ID NO: 2848696 - DNA, 18 bp, Homo sapiens
ctagtggcttcctccgtc

SEQ ID NO: 2848697 - DNA, 18 bp, Homo sapiens
ctagtggggtctccctct

SEQ ID NO: 2848698 - DNA, 19 bp, Homo sapiens
ctagtgtaacactgcaaga

SEQ ID NO: 2848699 - DNA, 21 bp, Homo sapiens
ctagtgtaacactgcaagaag

SEQ ID NO: 2848700 - DNA, 20 bp, Homo sapiens
ctagttagcaggaaatagtg

SEQ ID NO: 2848701 - DNA, 14 bp, Homo sapiens
ctagtttattttgt

SEQ ID NO: 2848702 - DNA, 18 bp, Homo sapiens
ctagttttctcctcccag

SEQ ID NO: 2848703 - DNA, 19 bp, Homo sapiens
ctagttttctcctcccagg

SEQ ID NO: 2848704 - DNA, 20 bp, Homo sapiens
ctagttttctcctcccagga

SEQ ID NO: 2848705 - DNA, 21 bp, Homo sapiens
  misc_feature (4)..(4): n is a, c, g or t
  misc_feature (11)..(11): n is a, c, g or t
ctanccccccnacccccagtg

SEQ ID NO: 2848706 - DNA, 16 bp, Homo sapiens
ctataaatggtgtttt

SEQ ID NO: 2848707 - DNA, 18 bp, Homo sapiens
ctataaccccagctccct

SEQ ID NO: 2848708 - DNA, 17 bp, Homo sapiens
ctataatggaaacattt

SEQ ID NO: 2848709 - DNA, 15 bp, Homo sapiens
ctatacaactggaca

SEQ ID NO: 2848710 - DNA, 12 bp, Homo sapiens
ctatagagaaaa

SEQ ID NO: 2848711 - DNA, 22 bp, Homo sapiens
ctatagagaaaaactttcattt

SEQ ID NO: 2848712 - DNA, 13 bp, Homo sapiens
ctatagccaaaaa

SEQ ID NO: 2848713 - DNA, 14 bp, Homo sapiens
ctatagccaaaaat

SEQ ID NO: 2848714 - DNA, 20 bp, Homo sapiens
ctatagcctaggtgacagag

SEQ ID NO: 2848715 - DNA, 21 bp, Homo sapiens
ctatagcctaggtgacagagt

SEQ ID NO: 2848716 - DNA, 17 bp, Homo sapiens
ctatagctcttctattt

SEQ ID NO: 2848717 - DNA, 22 bp, Homo sapiens
ctataggctggagaagctcacc

SEQ ID NO: 2848718 - DNA, 23 bp, Homo sapiens
ctatagtagtcaattagtacagt

SEQ ID NO: 2848719 - DNA, 16 bp, Homo sapiens
ctatatatacatgtat

SEQ ID NO: 2848720 - DNA, 16 bp, Homo sapiens
ctatatttaacaagat

SEQ ID NO: 2848721 - DNA, 13 bp, Homo sapiens
ctatatttagatt

SEQ ID NO: 2848722 - DNA, 22 bp, Homo sapiens
ctatatttagattgttaaaata

SEQ ID NO: 2848723 - DNA, 17 bp, Homo sapiens
ctatcaaaacatatcaa

SEQ ID NO: 2848724 - DNA, 19 bp, Homo sapiens
ctatcaaaacatatcaatt

SEQ ID NO: 2848725 - DNA, 15 bp, Homo sapiens
ctatcaaaataaatt

SEQ ID NO: 2848726 - DNA, 20 bp, Homo sapiens
ctatcaaactgaagccagaa

SEQ ID NO: 2848727 - DNA, 21 bp, Homo sapiens
ctatcaatagtcaagaaaaat

SEQ ID NO: 2848728 - DNA, 17 bp, Homo sapiens
gaggcctggccaggcac

SEQ ID NO: 2848729 - DNA, 16 bp, Homo sapiens
gaggccttctctgaag

SEQ ID NO: 2848730 - DNA, 18 bp, Homo sapiens
gaggccttctctgaagga

SEQ ID NO: 2848731 - DNA, 19 bp, Homo sapiens
gaggccttctctgaaggac

SEQ ID NO: 2848732 - DNA, 21 bp, Homo sapiens
gatctcagataaagtgaccag

SEQ ID NO: 2848733 - DNA, 22 bp, Homo sapiens
gatctcaggagcttgcaagaag

SEQ ID NO: 2848734 - DNA, 21 bp, Homo sapiens
gatctcatggaaactggccag

SEQ ID NO: 2848735 - DNA, 13 bp, Homo sapiens
gatctccctgccg

SEQ ID NO: 2848736 - DNA, 15 bp, Homo sapiens
gatctccctgccgcc

SEQ ID NO: 2848737 - DNA, 16 bp, Homo sapiens
gatctctcaggagcac

SEQ ID NO: 2848738 - DNA, 18 bp, Homo sapiens
gatctctcaggagcacag

SEQ ID NO: 2848739 - DNA, 19 bp, Homo sapiens
gatctctcaggagcacagg

SEQ ID NO: 2848740 - DNA, 22 bp, Homo sapiens
gatctctcaggagcacaggcag

SEQ ID NO: 2848741 - DNA, 23 bp, Homo sapiens
gatctctcaggagcacaggcagc

SEQ ID NO: 2848742 - DNA, 24 bp, Homo sapiens
gatctctcaggagcacaggcagct

SEQ ID NO: 2848743 - DNA, 15 bp, Homo sapiens
gatctgtatatacaa

SEQ ID NO: 2848744 - DNA, 12 bp, Homo sapiens
gatcttctgaaa

SEQ ID NO: 2848745 - DNA, 17 bp, Homo sapiens
gatcttgttaatgcatt

SEQ ID NO: 2848746 - DNA, 12 bp, Homo sapiens
gatctttcagga

SEQ ID NO: 2848747 - DNA, 17 bp, Homo sapiens
gatctttgcagacaggc

SEQ ID NO: 2848748 - DNA, 20 bp, Homo sapiens
gatcttttaaaaaggcagta

SEQ ID NO: 2848749 - DNA, 14 bp, Homo sapiens
gatgacagagcgag

SEQ ID NO: 2848750 - DNA, 22 bp, Homo sapiens
gatgacagtgctctaggctgcc

SEQ ID NO: 2848751 - DNA, 13 bp, Homo sapiens
gatgaccagaaca

SEQ ID NO: 2848752 - DNA, 18 bp, Homo sapiens
gatgaccagaacaaggtt

SEQ ID NO: 2848753 - DNA, 19 bp, Homo sapiens
gatgacctaacctaagcaa

SEQ ID NO: 2848754 - DNA, 15 bp, Homo sapiens
gatgactaaaatatt

SEQ ID NO: 2848755 - DNA, 16 bp, Homo sapiens
gatgactagaggcagg

SEQ ID NO: 2848756 - DNA, 17 bp, Homo sapiens
gatgactgagtcctcgt

SEQ ID NO: 2848757 - DNA, 11 bp, Homo sapiens
gatgagaaagg

SEQ ID NO: 2848758 - DNA, 12 bp, Homo sapiens
gatgagaagtta

SEQ ID NO: 2848759 - DNA, 19 bp, Homo sapiens
gatgagaagttaagcagcc

SEQ ID NO: 2848760 - DNA, 23 bp, Homo sapiens
gatgagacttccaaacctgacag

SEQ ID NO: 2848761 - DNA, 17 bp, Homo sapiens
gatgagggcagcagcca

SEQ ID NO: 2848762 - DNA, 20 bp, Homo sapiens
gatgagtgattgacacacag

SEQ ID NO: 2848763 - DNA, 14 bp, Homo sapiens
gatgatctttgcag

SEQ ID NO: 2848764 - DNA, 20 bp, Homo sapiens
gatgatctttgcagacaggc

SEQ ID NO: 2848765 - DNA, 23 bp, Homo sapiens
gatgattaaacacctgacacatc

SEQ ID NO: 2848766 - DNA, 23 bp, Homo sapiens
gatgcaccagcccttagcaggga

SEQ ID NO: 2848767 - DNA, 18 bp, Homo sapiens
gatgcccagagggcccag

SEQ ID NO: 2848768 - DNA, 20 bp, Homo sapiens
gatgcccagagggcccaggc

SEQ ID NO: 2848769 - DNA, 17 bp, Homo sapiens
gatgccctaagtgttga

SEQ ID NO: 2848770 - DNA, 15 bp, Homo sapiens
gatgccgctcttctg

SEQ ID NO: 2848771 - DNA, 15 bp, Homo sapiens
gatgcctggtggcag

SEQ ID NO: 2848772 - DNA, 16 bp, Homo sapiens
gatgcctggtggcagc

SEQ ID NO: 2848773 - DNA, 14 bp, Homo sapiens
gatgctcaggcttg

SEQ ID NO: 2848774 - DNA, 20 bp, Homo sapiens
gatgctggtaccactggaat

SEQ ID NO: 2848775 - DNA, 21 bp, Homo sapiens
gatggaagttgcagtgagctg

SEQ ID NO: 2848776 - DNA, 14 bp, Homo sapiens
gatggagagagggg

SEQ ID NO: 2848777 - DNA, 16 bp, Homo sapiens
gatggagttcttgtgc

SEQ ID NO: 2848778 - DNA, 15 bp, Homo sapiens
gatggcccttcccac

SEQ ID NO: 2848779 - DNA, 22 bp, Homo sapiens
gatggcccttcccactggaggt

SEQ ID NO: 2848780 - DNA, 13 bp, Homo sapiens
gatggctgtgcct

SEQ ID NO: 2848781 - DNA, 17 bp, Homo sapiens
gatggctgtgcctctgc

SEQ ID NO: 2848782 - DNA, 18 bp, Homo sapiens
gatggctgtgcctctgcc

SEQ ID NO: 2848783 - DNA, 20 bp, Homo sapiens
gatggctgtgcctctgcctg

SEQ ID NO: 2848784 - DNA, 21 bp, Homo sapiens
gatgggcaacccccagcctgc

SEQ ID NO: 2848785 - DNA, 16 bp, Homo sapiens
gatggggtgggcaggg

SEQ ID NO: 2848786 - DNA, 21 bp, Homo sapiens
gatggtccgccacgaggagct

SEQ ID NO: 2848787 - DNA, 15 bp, Homo sapiens
gatggtcctggggct

SEQ ID NO: 2848788 - DNA, 24 bp, Homo sapiens
gatggtcctggggctctgtgcagg

SEQ ID NO: 2848789 - DNA, 21 bp, Homo sapiens
gatgtaaggaattgaagatag

SEQ ID NO: 2848790 - DNA, 13 bp, Homo sapiens
gatgtaggaggga

SEQ ID NO: 2848791 - DNA, 14 bp, Homo sapiens
gatgtaggagggac

SEQ ID NO: 2848792 - DNA, 16 bp, Homo sapiens
gatgtaggagggactg

SEQ ID NO: 2848793 - DNA, 15 bp, Homo sapiens
gatgtagtctgaggc

SEQ ID NO: 2848794 - DNA, 22 bp, Homo sapiens
gatgtcagccgagccgggcctg

SEQ ID NO: 2848795 - DNA, 16 bp, Homo sapiens
gatgtgagtgtgtgtg

SEQ ID NO: 2848796 - DNA, 19 bp, Homo sapiens
gatgtgagttgcacagcta

SEQ ID NO: 2848797 - DNA, 14 bp, Homo sapiens
gatgttaaccagaa

SEQ ID NO: 2848798 - DNA, 20 bp, Homo sapiens
gatgttacatcacagtgttt

SEQ ID NO: 2848799 - DNA, 16 bp, Homo sapiens
gatgttctgggacaca

SEQ ID NO: 2848800 - DNA, 23 bp, Homo sapiens
gatgttgaatgcccacaggcaaa

SEQ ID NO: 2848801 - DNA, 23 bp, Homo sapiens
gatgtttacaggtggacacacaa

SEQ ID NO: 2848802 - DNA, 16 bp, Homo sapiens
gatgtttccagaaaat

SEQ ID NO: 2848803 - DNA, 23 bp, Homo sapiens
gatgttttgtcccatttccttgg

SEQ ID NO: 2848804 - DNA, 13 bp, Homo sapiens
gattaaacacctg

SEQ ID NO: 2848805 - DNA, 14 bp, Homo sapiens
gattaaacacctga

SEQ ID NO: 2848806 - DNA, 16 bp, Homo sapiens
gattaaacacctgaca

SEQ ID NO: 2848807 - DNA, 19 bp, Homo sapiens
gattaaacacctgacacat

SEQ ID NO: 2848808 - DNA, 13 bp, Homo sapiens
gattaaaggaagg

SEQ ID NO: 2848809 - DNA, 14 bp, Homo sapiens
gattaatttgtgta

SEQ ID NO: 2848810 - DNA, 16 bp, Homo sapiens
gattaatttgtgtaga

SEQ ID NO: 2848811 - DNA, 20 bp, Homo sapiens
gattacataatcaaagctac

SEQ ID NO: 2848812 - DNA, 17 bp, Homo sapiens
gattagaatgaaaattg

SEQ ID NO: 2848813 - DNA, 18 bp, Homo sapiens
gattagactggacagctt

SEQ ID NO: 2848814 - DNA, 13 bp, Homo sapiens
gattatatatcat

SEQ ID NO: 2848815 - DNA, 15 bp, Homo sapiens
gattatatatcataa

SEQ ID NO: 2848816 - DNA, 13 bp, Homo sapiens
gattatgggtcct

SEQ ID NO: 2848817 - DNA, 18 bp, Homo sapiens
gattattttagtctgtca

SEQ ID NO: 2848818 - DNA, 17 bp, Homo sapiens
gattcaggaaaaggcct

SEQ ID NO: 2848819 - DNA, 23 bp, Homo sapiens
gattcaggaaaaggcctggggtg

SEQ ID NO: 2848820 - DNA, 14 bp, Homo sapiens
gattcataacaatg

SEQ ID NO: 2848821 - DNA, 18 bp, Homo sapiens
gattcccaagctctgctc

SEQ ID NO: 2848822 - DNA, 17 bp, Homo sapiens
gcaagcattcagaagaa

SEQ ID NO: 2848823 - DNA, 19 bp, Homo sapiens
gcaagcctgtaatcccagc

SEQ ID NO: 2848824 - DNA, 20 bp, Homo sapiens
gcaagcctgtaatcccagct

SEQ ID NO: 2848825 - DNA, 14 bp, Homo sapiens
gcaaggaaggaaag

SEQ ID NO: 2848826 - DNA, 15 bp, Homo sapiens
gcaaggaaggaaaga

SEQ ID NO: 2848827 - DNA, 17 bp, Homo sapiens
gcaaggcccgagcagct

SEQ ID NO: 2848828 - DNA, 18 bp, Homo sapiens
gcaaggcccgagcagctg

SEQ ID NO: 2848829 - DNA, 21 bp, Homo sapiens
gcaaggccgctgttcacccac

SEQ ID NO: 2848830 - DNA, 21 bp, Homo sapiens
gcaagtctgcagcccggcgcc

SEQ ID NO: 2848831 - DNA, 16 bp, Homo sapiens
gcaagtgagagctggg

SEQ ID NO: 2848832 - DNA, 18 bp, Homo sapiens
gcaagtgagagctgggtg

SEQ ID NO: 2848833 - DNA, 17 bp, Homo sapiens
gcaagttctagagaaga

SEQ ID NO: 2848834 - DNA, 20 bp, Homo sapiens
gcaagttctagagaagaggc

SEQ ID NO: 2848835 - DNA, 21 bp, Homo sapiens
gcaataacgtttaagccaaaa

SEQ ID NO: 2848836 - DNA, 20 bp, Homo sapiens
gcaataagttccatgttaaa

SEQ ID NO: 2848837 - DNA, 21 bp, Homo sapiens
gcaatccatgttagtttttac

SEQ ID NO: 2848838 - DNA, 20 bp, Homo sapiens
gcaatctccagggctgcccc

SEQ ID NO: 2848839 - DNA, 17 bp, Homo sapiens
gcaatgatgtccagaag

SEQ ID NO: 2848840 - DNA, 13 bp, Homo sapiens
gcaatggcagcct

SEQ ID NO: 2848841 - DNA, 20 bp, Homo sapiens
gcaatggtgttgccctgagt

SEQ ID NO: 2848842 - DNA, 23 bp, Homo sapiens
gcaatggtgttgccctgagtgga

SEQ ID NO: 2848843 - DNA, 13 bp, Homo sapiens
gcaatgtaaatat

SEQ ID NO: 2848844 - DNA, 15 bp, Homo sapiens
gcaatgtaaatattt

SEQ ID NO: 2848845 - DNA, 14 bp, Homo sapiens
gcaattctacagtt

SEQ ID NO: 2848846 - DNA, 17 bp, Homo sapiens
gcacaagcttgtatata

SEQ ID NO: 2848847 - DNA, 19 bp, Homo sapiens
gcacaagcttgtatataca

SEQ ID NO: 2848848 - DNA, 21 bp, Homo sapiens
gcacaagcttgtatatacata

SEQ ID NO: 2848849 - DNA, 17 bp, Homo sapiens
gcacaagttatttaaat

SEQ ID NO: 2848850 - DNA, 18 bp, Homo sapiens
gcacaatttagaaaacat

SEQ ID NO: 2848851 - DNA, 16 bp, Homo sapiens
gcacacaccagagccc

SEQ ID NO: 2848852 - DNA, 18 bp, Homo sapiens
gcacacaccagagcccac

SEQ ID NO: 2848853 - DNA, 20 bp, Homo sapiens
gcacaccgggcactcagaag

SEQ ID NO: 2848854 - DNA, 18 bp, Homo sapiens
gcacacttgtatattgaa

SEQ ID NO: 2848855 - DNA, 20 bp, Homo sapiens
gcacagaaacacaatatttt

SEQ ID NO: 2848856 - DNA, 16 bp, Homo sapiens
gcacagatatttccat

SEQ ID NO: 2848857 - DNA, 17 bp, Homo sapiens
gcacagatatttccatt

SEQ ID NO: 2848858 - DNA, 21 bp, Homo sapiens
gcacagcggggccccagggct

SEQ ID NO: 2848859 - DNA, 13 bp, Homo sapiens
gcacagctatgaa

SEQ ID NO: 2848860 - DNA, 15 bp, Homo sapiens
gcacaggacacctgg

SEQ ID NO: 2848861 - DNA, 12 bp, Homo sapiens
gcacaggagcta

SEQ ID NO: 2848862 - DNA, 20 bp, Homo sapiens
gcacaggagctacctgtgtg

SEQ ID NO: 2848863 - DNA, 12 bp, Homo sapiens
gcacaggagggg

SEQ ID NO: 2848864 - DNA, 21 bp, Homo sapiens
gcacaggagggggtcgtggag

SEQ ID NO: 2848865 - DNA, 22 bp, Homo sapiens
gcacaggagggggtcgtggaga

SEQ ID NO: 2848866 - DNA, 14 bp, Homo sapiens
gcacaggcagctgg

SEQ ID NO: 2848867 - DNA, 14 bp, Homo sapiens
gcacaggtgtaaat

SEQ ID NO: 2848868 - DNA, 15 bp, Homo sapiens
gcacagttttaagag

SEQ ID NO: 2848869 - DNA, 23 bp, Homo sapiens
gcacatctgggaggctggtctcc

SEQ ID NO: 2848870 - DNA, 22 bp, Homo sapiens
gcacatggaggagcttggggga

SEQ ID NO: 2848871 - DNA, 21 bp, Homo sapiens
gcacatgtcttgtacatgtgt

SEQ ID NO: 2848872 - DNA, 14 bp, Homo sapiens
gcacatttatatat

SEQ ID NO: 2848873 - DNA, 21 bp, Homo sapiens
gcaccagaggctgcagaaggc

SEQ ID NO: 2848874 - DNA, 17 bp, Homo sapiens
gcaccagcccttccctg

SEQ ID NO: 2848875 - DNA, 18 bp, Homo sapiens
gcaccagcccttccctgc

SEQ ID NO: 2848876 - DNA, 19 bp, Homo sapiens
gcaccagcccttccctgct

SEQ ID NO: 2848877 - DNA, 17 bp, Homo sapiens
gcaccagcttctccagg

SEQ ID NO: 2848878 - DNA, 20 bp, Homo sapiens
gcaccagcttctccaggctc

SEQ ID NO: 2848879 - DNA, 20 bp, Homo sapiens
gcaccaggcacgaacccacc

SEQ ID NO: 2848880 - DNA, 23 bp, Homo sapiens
gcaccaggcacgaacccacctgc

SEQ ID NO: 2848881 - DNA, 21 bp, Homo sapiens
gcaccagtgccgcctgtgccc

SEQ ID NO: 2848882 - DNA, 22 bp, Homo sapiens
gcacccaccatcatgtctggct

SEQ ID NO: 2848883 - DNA, 14 bp, Homo sapiens
gcacccccagcctg

SEQ ID NO: 2848884 - DNA, 17 bp, Homo sapiens
gcacccccagcctgggc

SEQ ID NO: 2848885 - DNA, 14 bp, Homo sapiens
gcaccccccaagct

SEQ ID NO: 2848886 - DNA, 18 bp, Homo sapiens
gcaccccctcattcccct

SEQ ID NO: 2848887 - DNA, 14 bp, Homo sapiens
gcaccccctgcagc

SEQ ID NO: 2848888 - DNA, 15 bp, Homo sapiens
gcacccggcccctgc

SEQ ID NO: 2848889 - DNA, 14 bp, Homo sapiens
gcacccgtaccccc

SEQ ID NO: 2848890 - DNA, 22 bp, Homo sapiens
gcacccgtacccccgtggtctt

SEQ ID NO: 2848891 - DNA, 13 bp, Homo sapiens
gcaccctgcagag

SEQ ID NO: 2848892 - DNA, 20 bp, Homo sapiens
gcaccctgcagagcacacag

SEQ ID NO: 2848893 - DNA, 17 bp, Homo sapiens
gcacccttctttcctct

SEQ ID NO: 2848894 - DNA, 18 bp, Homo sapiens
gcacccttctttcctctt

SEQ ID NO: 2848895 - DNA, 21 bp, Homo sapiens
gcacccttctttcctcttccc

SEQ ID NO: 2848896 - DNA, 14 bp, Homo sapiens
gcacctaaagaaaa

SEQ ID NO: 2848897 - DNA, 17 bp, Homo sapiens
gcacctaaagaaaaaca

SEQ ID NO: 2848898 - DNA, 13 bp, Homo sapiens
gcacctcccccca

SEQ ID NO: 2848899 - DNA, 19 bp, Homo sapiens
gcacctccccccactgcag

SEQ ID NO: 2848900 - DNA, 23 bp, Homo sapiens
gcacctccccccactgcaggccc

SEQ ID NO: 2848901 - DNA, 14 bp, Homo sapiens
gcacctgccagcct

SEQ ID NO: 2848902 - DNA, 15 bp, Homo sapiens
gcacctgccagcctg

SEQ ID NO: 2848903 - DNA, 17 bp, Homo sapiens
gcacctgccagcctggc

SEQ ID NO: 2848904 - DNA, 17 bp, Homo sapiens
gcacctgccccctggtg

SEQ ID NO: 2848905 - DNA, 18 bp, Homo sapiens
gcacctgccccctggtgg

SEQ ID NO: 2848906 - DNA, 22 bp, Homo sapiens
gcacctgccccctggtggacag

SEQ ID NO: 2848907 - DNA, 20 bp, Homo sapiens
gcacctgcttcatgctcagc

SEQ ID NO: 2848908 - DNA, 19 bp, Homo sapiens
gcacctgtcccagaaaaag

SEQ ID NO: 2848909 - DNA, 16 bp, Homo sapiens
gcacgaacccacctgc

SEQ ID NO: 2848910 - DNA, 16 bp, Homo sapiens
gcacgccgtggagcat

SEQ ID NO: 2848911 - DNA, 12 bp, Homo sapiens
gcacgcctgccc

SEQ ID NO: 2848912 - DNA, 16 bp, Homo sapiens
gcagccaggaggagag

SEQ ID NO: 2848913 - DNA, 17 bp, Homo sapiens
gcagccaggaggagagg

SEQ ID NO: 2848914 - DNA, 23 bp, Homo sapiens
gcagccccgcgcctccttccttg

SEQ ID NO: 2848915 - DNA, 23 bp, Homo sapiens
gcagccctaaggatctctcagga

SEQ ID NO: 2848916 - DNA, 24 bp, Homo sapiens
gcagccctaaggatctctcaggag

SEQ ID NO: 2848917 - DNA, 13 bp, Homo sapiens
gcagccctcctca

SEQ ID NO: 2848918 - DNA, 13 bp, Homo sapiens
gcagccctttggg

SEQ ID NO: 2848919 - DNA, 14 bp, Homo sapiens
gcagcctcctcctg

SEQ ID NO: 2848920 - DNA, 18 bp, Homo sapiens
gcagcctcctcctgacca

SEQ ID NO: 2848921 - DNA, 15 bp, Homo sapiens
gcagccttggcaaac

SEQ ID NO: 2848922 - DNA, 13 bp, Homo sapiens
gcagcctttctgt

SEQ ID NO: 2848923 - DNA, 24 bp, Homo sapiens
gcagcgagttgtggaaagcctctg

SEQ ID NO: 2848924 - DNA, 22 bp, Homo sapiens
gcagctcccctgggggctagca

SEQ ID NO: 2848925 - DNA, 22 bp, Homo sapiens
gcagctcttcccctttcctggg

SEQ ID NO: 2848926 - DNA, 16 bp, Homo sapiens
gcagctgagcagggcc

SEQ ID NO: 2848927 - DNA, 17 bp, Homo sapiens
gcagctgcttgttgtca

SEQ ID NO: 2848928 - DNA, 13 bp, Homo sapiens
gcagctgcttttg

SEQ ID NO: 2848929 - DNA, 17 bp, Homo sapiens
gcagctgtcattcagga

SEQ ID NO: 2848930 - DNA, 19 bp, Homo sapiens
gcagcttcatcaattttta

SEQ ID NO: 2848931 - DNA, 23 bp, Homo sapiens
gcagcttcatcaatttttataca

SEQ ID NO: 2848932 - DNA, 14 bp, Homo sapiens
gcagcttgagcctg

SEQ ID NO: 2848933 - DNA, 19 bp, Homo sapiens
gcagcttgagggttgggct

SEQ ID NO: 2848934 - DNA, 14 bp, Homo sapiens
gcagcttgtagcca

SEQ ID NO: 2848935 - DNA, 16 bp, Homo sapiens
gcagcttgtagccagc

SEQ ID NO: 2848936 - DNA, 20 bp, Homo sapiens
gcagcttgtagccagccggg

SEQ ID NO: 2848937 - DNA, 23 bp, Homo sapiens
gcagcttgtagccagccggggcg

SEQ ID NO: 2848938 - DNA, 11 bp, Homo sapiens
gcaggaaatag

SEQ ID NO: 2848939 - DNA, 16 bp, Homo sapiens
gcaggaactcccagca

SEQ ID NO: 2848940 - DNA, 15 bp, Homo sapiens
gcaggaagccaggct

SEQ ID NO: 2848941 - DNA, 15 bp, Homo sapiens
gcaggacaggagaca

SEQ ID NO: 2848942 - DNA, 14 bp, Homo sapiens
gcaggaggattgct

SEQ ID NO: 2848943 - DNA, 14 bp, Homo sapiens
gcaggagtagctga

SEQ ID NO: 2848944 - DNA, 15 bp, Homo sapiens
gcaggagtagctgag

SEQ ID NO: 2848945 - DNA, 16 bp, Homo sapiens
gcaggagtagctgagc

SEQ ID NO: 2848946 - DNA, 17 bp, Homo sapiens
gcaggagtagctgagct

SEQ ID NO: 2848947 - DNA, 22 bp, Homo sapiens
gcaggccaagagcagaggcagc

SEQ ID NO: 2848948 - DNA, 14 bp, Homo sapiens
gcaggccctgcctt

SEQ ID NO: 2848949 - DNA, 17 bp, Homo sapiens
gcaggccgaggcaggtg

SEQ ID NO: 2848950 - DNA, 19 bp, Homo sapiens
gcagggatgataggccctg

SEQ ID NO: 2848951 - DNA, 13 bp, Homo sapiens
gcagggccgggga

SEQ ID NO: 2848952 - DNA, 14 bp, Homo sapiens
gcagggccggggaa

SEQ ID NO: 2848953 - DNA, 14 bp, Homo sapiens
gcagggctcagcgg

SEQ ID NO: 2848954 - DNA, 15 bp, Homo sapiens
gcagggctctcctgg

SEQ ID NO: 2848955 - DNA, 12 bp, Homo sapiens
gcagggctggga

SEQ ID NO: 2848956 - DNA, 19 bp, Homo sapiens
gcaggggtccttggtgtga

SEQ ID NO: 2848957 - DNA, 15 bp, Homo sapiens
gcaggggtgggagag

SEQ ID NO: 2848958 - DNA, 20 bp, Homo sapiens
gcaggggtgggagagccagc

SEQ ID NO: 2848959 - DNA, 13 bp, Homo sapiens
gcaggggttccca

SEQ ID NO: 2848960 - DNA, 14 bp, Homo sapiens
gcagggtcaggaga

SEQ ID NO: 2848961 - DNA, 15 bp, Homo sapiens
gcagggtcaggagag

SEQ ID NO: 2848962 - DNA, 16 bp, Homo sapiens
gcagggtcaggagagg

SEQ ID NO: 2848963 - DNA, 18 bp, Homo sapiens
gcagggtctcactctgtc

SEQ ID NO: 2848964 - DNA, 15 bp, Homo sapiens
gcagggtgggatgga

SEQ ID NO: 2848965 - DNA, 19 bp, Homo sapiens
gcaggtcttgaactcctgg

SEQ ID NO: 2848966 - DNA, 15 bp, Homo sapiens
gcaggtggtcctgag

SEQ ID NO: 2848967 - DNA, 16 bp, Homo sapiens
gcaggtggtcctgaga

SEQ ID NO: 2848968 - DNA, 21 bp, Homo sapiens
gcaggtggtcctgagacctga

SEQ ID NO: 2848969 - DNA, 19 bp, Homo sapiens
gcaggttgaggggctcctg

SEQ ID NO: 2848970 - DNA, 22 bp, Homo sapiens
gcaggttgaggggctcctggaa

SEQ ID NO: 2848971 - DNA, 12 bp, Homo sapiens
gcagtagtctct

SEQ ID NO: 2848972 - DNA, 17 bp, Homo sapiens
gcagtagtctctgtgct

SEQ ID NO: 2848973 - DNA, 18 bp, Homo sapiens
gcagtatgaatgatgttt

SEQ ID NO: 2848974 - DNA, 19 bp, Homo sapiens
gcagtcaacagttcaaaga

SEQ ID NO: 2848975 - DNA, 13 bp, Homo sapiens
gcagtccagaata

SEQ ID NO: 2848976 - DNA, 21 bp, Homo sapiens
gcagtccagaataagtgctgt

SEQ ID NO: 2848977 - DNA, 15 bp, Homo sapiens
gcagtccagccagct

SEQ ID NO: 2848978 - DNA, 19 bp, Homo sapiens
gcagtgagttacagcgaga

SEQ ID NO: 2848979 - DNA, 20 bp, Homo sapiens
gcagtgagttacagcgagag

SEQ ID NO: 2848980 - DNA, 16 bp, Homo sapiens
gcagtgcttctctaca

SEQ ID NO: 2848981 - DNA, 16 bp, Homo sapiens
gcagtggctcacgcct

SEQ ID NO: 2848982 - DNA, 21 bp, Homo sapiens
gcagtggtgcgatctgggttc

SEQ ID NO: 2848983 - DNA, 21 bp, Homo sapiens
gcagtgttcctatttggggct

SEQ ID NO: 2848984 - DNA, 19 bp, Homo sapiens
gcagtgttcctcaccaata

SEQ ID NO: 2848985 - DNA, 14 bp, Homo sapiens
gcagttaccgagga

SEQ ID NO: 2848986 - DNA, 21 bp, Homo sapiens
gcagttaccgaggagctaaac

SEQ ID NO: 2848987 - DNA, 14 bp, Homo sapiens
gcagttatagaaaa

SEQ ID NO: 2848988 - DNA, 20 bp, Homo sapiens
gcagttcgcagccaccctga

SEQ ID NO: 2848989 - DNA, 22 bp, Homo sapiens
gcagttcgcagccaccctgagg

SEQ ID NO: 2848990 - DNA, 17 bp, Homo sapiens
gcagttgacagcaggtg

SEQ ID NO: 2848991 - DNA, 15 bp, Homo sapiens
gcagtttatatttaa

SEQ ID NO: 2848992 - DNA, 18 bp, Homo sapiens
gcagtttatatttaactc

SEQ ID NO: 2848993 - DNA, 23 bp, Homo sapiens
gcataagattaaaggaaggaaaa

SEQ ID NO: 2848994 - DNA, 12 bp, Homo sapiens
gcatattaaagg

SEQ ID NO: 2848995 - DNA, 15 bp, Homo sapiens
gcatcacagggcaga

SEQ ID NO: 2848996 - DNA, 13 bp, Homo sapiens
gcatcacctcagg

SEQ ID NO: 2848997 - DNA, 18 bp, Homo sapiens
gcatcagaaagggagggc

SEQ ID NO: 2848998 - DNA, 23 bp, Homo sapiens
gcatcagaaagggagggctctga

SEQ ID NO: 2848999 - DNA, 18 bp, Homo sapiens
gcatcatgcctctgaggc

SEQ ID NO: 2849000 - DNA, 22 bp, Homo sapiens
gcatcattatttgcagagacag

SEQ ID NO: 2849001 - DNA, 16 bp, Homo sapiens
gcatccattcctcagg

SEQ ID NO: 2849002 - DNA, 18 bp, Homo sapiens
gcatccattcctcaggga

SEQ ID NO: 2849003 - DNA, 23 bp, Homo sapiens
gcccacgctggagtgcagtgagc

SEQ ID NO: 2849004 - DNA, 14 bp, Homo sapiens
gcccacttctgcca

SEQ ID NO: 2849005 - DNA, 16 bp, Homo sapiens
gcccacttgaggctgg

SEQ ID NO: 2849006 - DNA, 17 bp, Homo sapiens
gcccagagaccccttcc

SEQ ID NO: 2849007 - DNA, 19 bp, Homo sapiens
gcccagagatgcctccacc

SEQ ID NO: 2849008 - DNA, 13 bp, Homo sapiens
gcccagcactgtg

SEQ ID NO: 2849009 - DNA, 21 bp, Homo sapiens
gcccagccattaccatggaga

SEQ ID NO: 2849010 - DNA, 16 bp, Homo sapiens
gcccagcctcctccca

SEQ ID NO: 2849011 - DNA, 21 bp, Homo sapiens
gcccagcctcctcccaccacc

SEQ ID NO: 2849012 - DNA, 12 bp, Homo sapiens
gcccagcctctg

SEQ ID NO: 2849013 - DNA, 16 bp, Homo sapiens
gcccagcctctgtccc

SEQ ID NO: 2849014 - DNA, 20 bp, Homo sapiens
gcccagcctctgtccctctt

SEQ ID NO: 2849015 - DNA, 16 bp, Homo sapiens
gcccagctgaggctgg

SEQ ID NO: 2849016 - DNA, 24 bp, Homo sapiens
gcccagctgcacctgccagcctgg

SEQ ID NO: 2849017 - DNA, 19 bp, Homo sapiens
gcccaggagagccagccct

SEQ ID NO: 2849018 - DNA, 11 bp, Homo sapiens
gcccaggcagg

SEQ ID NO: 2849019 - DNA, 12 bp, Homo sapiens
gcccaggcaggt

SEQ ID NO: 2849020 - DNA, 16 bp, Homo sapiens
gcccaggcaggtcttg

SEQ ID NO: 2849021 - DNA, 11 bp, Homo sapiens
gcccaggcccc

SEQ ID NO: 2849022 - DNA, 12 bp, Homo sapiens
gcccaggcccct

SEQ ID NO: 2849023 - DNA, 13 bp, Homo sapiens
gcccaggcccctg

SEQ ID NO: 2849024 - DNA, 18 bp, Homo sapiens
gcccaggcccctgccacc

SEQ ID NO: 2849025 - DNA, 21 bp, Homo sapiens
gcccaggcccctgccaccctg

SEQ ID NO: 2849026 - DNA, 17 bp, Homo sapiens
gcccaggcctgcctgtt

SEQ ID NO: 2849027 - DNA, 15 bp, Homo sapiens
gcccaggctggcgtg

SEQ ID NO: 2849028 - DNA, 13 bp, Homo sapiens
gcccagggaggcc

SEQ ID NO: 2849029 - DNA, 13 bp, Homo sapiens
gcccagggctcag

SEQ ID NO: 2849030 - DNA, 17 bp, Homo sapiens
gcccagggctcagcctg

SEQ ID NO: 2849031 - DNA, 20 bp, Homo sapiens
gcccaggggcccacagggaa

SEQ ID NO: 2849032 - DNA, 15 bp, Homo sapiens
gcccaggtcctctga

SEQ ID NO: 2849033 - DNA, 19 bp, Homo sapiens
gcccagtgcacttgctgga

SEQ ID NO: 2849034 - DNA, 21 bp, Homo sapiens
gcccagttgggtggatgcctg

SEQ ID NO: 2849035 - DNA, 22 bp, Homo sapiens
gcccatgctcaaccactgtggc

SEQ ID NO: 2849036 - DNA, 14 bp, Homo sapiens
gcccatggagcagg

SEQ ID NO: 2849037 - DNA, 17 bp, Homo sapiens
gcccattctctctcctg

SEQ ID NO: 2849038 - DNA, 20 bp, Homo sapiens
gcccattctctctcctgtcc

SEQ ID NO: 2849039 - DNA, 21 bp, Homo sapiens
gcccattctctctcctgtcca

SEQ ID NO: 2849040 - DNA, 15 bp, Homo sapiens
gccccaacccgtgga

SEQ ID NO: 2849041 - DNA, 19 bp, Homo sapiens
gccccaacccgtggaggct

SEQ ID NO: 2849042 - DNA, 15 bp, Homo sapiens
gccccaactcctgga

SEQ ID NO: 2849043 - DNA, 16 bp, Homo sapiens
gccccaactcctggaa

SEQ ID NO: 2849044 - DNA, 17 bp, Homo sapiens
gccccaaggctgctcag

SEQ ID NO: 2849045 - DNA, 22 bp, Homo sapiens
gccccaaggggtttctgtttct

SEQ ID NO: 2849046 - DNA, 20 bp, Homo sapiens
gccccacacggaggcatctg

SEQ ID NO: 2849047 - DNA, 14 bp, Homo sapiens
gccccaccacctag

SEQ ID NO: 2849048 - DNA, 20 bp, Homo sapiens
gccccaccacctaggccact

SEQ ID NO: 2849049 - DNA, 23 bp, Homo sapiens
gccccaccacctaggccactcct

SEQ ID NO: 2849050 - DNA, 23 bp, Homo sapiens
gccccaccctcgtggacacctgc

SEQ ID NO: 2849051 - DNA, 13 bp, Homo sapiens
gccccagacacac

SEQ ID NO: 2849052 - DNA, 21 bp, Homo sapiens
gccccagcaagagcacaagag

SEQ ID NO: 2849053 - DNA, 19 bp, Homo sapiens
gccccagcactaacgtaaa

SEQ ID NO: 2849054 - DNA, 15 bp, Homo sapiens
gccccagcccgacag

SEQ ID NO: 2849055 - DNA, 14 bp, Homo sapiens
gccccagctctggc

SEQ ID NO: 2849056 - DNA, 16 bp, Homo sapiens
gccccagggctaccct

SEQ ID NO: 2849057 - DNA, 14 bp, Homo sapiens
gccccagtgcccac

SEQ ID NO: 2849058 - DNA, 17 bp, Homo sapiens
gccccagtgcccacagg

SEQ ID NO: 2849059 - DNA, 16 bp, Homo sapiens
gccccatcagaggctg

SEQ ID NO: 2849060 - DNA, 15 bp, Homo sapiens
gccccatgacctcca

SEQ ID NO: 2849061 - DNA, 16 bp, Homo sapiens
gccccatgacctccag

SEQ ID NO: 2849062 - DNA, 17 bp, Homo sapiens
gccccatgacctccagc

SEQ ID NO: 2849063 - DNA, 18 bp, Homo sapiens
gccccatgacctccagct

SEQ ID NO: 2849064 - DNA, 14 bp, Homo sapiens
gccccattctgcct

SEQ ID NO: 2849065 - DNA, 15 bp, Homo sapiens
gccccattctgcctg

SEQ ID NO: 2849066 - DNA, 12 bp, Homo sapiens
gcccccacaggc

SEQ ID NO: 2849067 - DNA, 13 bp, Homo sapiens
gcccccacaggcc

SEQ ID NO: 2849068 - DNA, 21 bp, Homo sapiens
gcccccaccactaggactctg

SEQ ID NO: 2849069 - DNA, 20 bp, Homo sapiens
gcccccacctccgccccaga

SEQ ID NO: 2849070 - DNA, 15 bp, Homo sapiens
gccccccgcagcacc

SEQ ID NO: 2849071 - DNA, 21 bp, Homo sapiens
gcccccgctggctcctccagg

SEQ ID NO: 2849072 - DNA, 23 bp, Homo sapiens
gccccctggtggacagtcctggg

SEQ ID NO: 2849073 - DNA, 23 bp, Homo sapiens
gccccgaggccttctctgaagga

SEQ ID NO: 2849074 - DNA, 16 bp, Homo sapiens
gccccgcttccccaca

SEQ ID NO: 2849075 - DNA, 17 bp, Homo sapiens
gccccgcttccccacag

SEQ ID NO: 2849076 - DNA, 18 bp, Homo sapiens
gccccgcttccccacaga

SEQ ID NO: 2849077 - DNA, 14 bp, Homo sapiens
gccccgcttgtcca

SEQ ID NO: 2849078 - DNA, 24 bp, Homo sapiens
gccccgggcctgcctctgactcac

SEQ ID NO: 2849079 - DNA, 18 bp, Homo sapiens
gccccgggtccccagctc

SEQ ID NO: 2849080 - DNA, 19 bp, Homo sapiens
gccccgggtccccagctcc

SEQ ID NO: 2849081 - DNA, 22 bp, Homo sapiens
gccccggtcctggccccagccc

SEQ ID NO: 2849082 - DNA, 23 bp, Homo sapiens
gcccctcctccccttcctgcacc

SEQ ID NO: 2849083 - DNA, 12 bp, Homo sapiens
gcccctcctctg

SEQ ID NO: 2849084 - DNA, 13 bp, Homo sapiens
gcccctcctctgc

SEQ ID NO: 2849085 - DNA, 16 bp, Homo sapiens
gcccctgaacaagaat

SEQ ID NO: 2849086 - DNA, 13 bp, Homo sapiens
gcccctgcacaaa

SEQ ID NO: 2849087 - DNA, 17 bp, Homo sapiens
gcccctgccaccctggg

SEQ ID NO: 2849088 - DNA, 13 bp, Homo sapiens
gcccctgcccggc

SEQ ID NO: 2849089 - DNA, 15 bp, Homo sapiens
gcccctgcccggctg

SEQ ID NO: 2849090 - DNA, 18 bp, Homo sapiens
gcccctgtgtgagttgag

SEQ ID NO: 2849091 - DNA, 15 bp, Homo sapiens
gccccttcccatctc

SEQ ID NO: 2849092 - DNA, 20 bp, Homo sapiens
gccccttgctctcccctgcc

SEQ ID NO: 2849093 - DNA, 12 bp, Homo sapiens
gcccgagcagct

SEQ ID NO: 2849094 - DNA, 15 bp, Homo sapiens
gcctgcccaggcccc

SEQ ID NO: 2849095 - DNA, 20 bp, Homo sapiens
gcctgcccaggcccctgcca

SEQ ID NO: 2849096 - DNA, 18 bp, Homo sapiens
gcctgcccccagcactcc

SEQ ID NO: 2849097 - DNA, 14 bp, Homo sapiens
gcctgccctcaggg

SEQ ID NO: 2849098 - DNA, 19 bp, Homo sapiens
gcctgccgagcaaccgtgg

SEQ ID NO: 2849099 - DNA, 22 bp, Homo sapiens
gcctgctcccagcagccctaag

SEQ ID NO: 2849100 - DNA, 11 bp, Homo sapiens
gcctgctcccc

SEQ ID NO: 2849101 - DNA, 13 bp, Homo sapiens
gcctgctccccca

SEQ ID NO: 2849102 - DNA, 19 bp, Homo sapiens
gcctgctcccccaccccct

SEQ ID NO: 2849103 - DNA, 12 bp, Homo sapiens
gcctgctgctga

SEQ ID NO: 2849104 - DNA, 14 bp, Homo sapiens
gcctgctgctgaga

SEQ ID NO: 2849105 - DNA, 21 bp, Homo sapiens
gcctgctgctgagaacctggc

SEQ ID NO: 2849106 - DNA, 17 bp, Homo sapiens
gcctgctgggctctcca

SEQ ID NO: 2849107 - DNA, 19 bp, Homo sapiens
gcctgctgggctctccacc

SEQ ID NO: 2849108 - DNA, 20 bp, Homo sapiens
gcctgctgggctctccacct

SEQ ID NO: 2849109 - DNA, 12 bp, Homo sapiens
gcctggagaagc

SEQ ID NO: 2849110 - DNA, 13 bp, Homo sapiens
gcctggagaagct

SEQ ID NO: 2849111 - DNA, 14 bp, Homo sapiens
gcctggaggacctg

SEQ ID NO: 2849112 - DNA, 15 bp, Homo sapiens
gcctggaggacctga

SEQ ID NO: 2849113 - DNA, 22 bp, Homo sapiens
gcctggaggacctgagcctgcc

SEQ ID NO: 2849114 - DNA, 18 bp, Homo sapiens
gcctggcaacagagcaag

SEQ ID NO: 2849115 - DNA, 15 bp, Homo sapiens
gcctggcaaggcctc

SEQ ID NO: 2849116 - DNA, 14 bp, Homo sapiens
gcctggcacacatc

SEQ ID NO: 2849117 - DNA, 16 bp, Homo sapiens
gcctggccagatgcac

SEQ ID NO: 2849118 - DNA, 15 bp, Homo sapiens
gcctggccaggcacc

SEQ ID NO: 2849119 - DNA, 17 bp, Homo sapiens
gcctggcccccctccag

SEQ ID NO: 2849120 - DNA, 18 bp, Homo sapiens
gcctggcccccctccagg

SEQ ID NO: 2849121 - DNA, 16 bp, Homo sapiens
gcctggctccgtccag

SEQ ID NO: 2849122 - DNA, 13 bp, Homo sapiens
gcctggctctcct

SEQ ID NO: 2849123 - DNA, 21 bp, Homo sapiens
gcctggctggctgagggcagt

SEQ ID NO: 2849124 - DNA, 14 bp, Homo sapiens
gcctggcttctgga

SEQ ID NO: 2849125 - DNA, 15 bp, Homo sapiens
gcctggcttctggag

SEQ ID NO: 2849126 - DNA, 16 bp, Homo sapiens
gcctggcttctggagc

SEQ ID NO: 2849127 - DNA, 22 bp, Homo sapiens
gcctggcttctggagcccttgg

SEQ ID NO: 2849128 - DNA, 19 bp, Homo sapiens
gcctgggcctatggagagc

SEQ ID NO: 2849129 - DNA, 23 bp, Homo sapiens
gcctgggcctatggagagccctg

SEQ ID NO: 2849130 - DNA, 23 bp, Homo sapiens
gcctggggctcctttctccagcc

SEQ ID NO: 2849131 - DNA, 15 bp, Homo sapiens
gcctgggggcctggc

SEQ ID NO: 2849132 - DNA, 20 bp, Homo sapiens
gcctgggggcctggctggct

SEQ ID NO: 2849133 - DNA, 19 bp, Homo sapiens
gcctggggtgacccggcac

SEQ ID NO: 2849134 - DNA, 20 bp, Homo sapiens
gcctgggtggggctgctcct

SEQ ID NO: 2849135 - DNA, 15 bp, Homo sapiens
gcctggtgggccacg

SEQ ID NO: 2849136 - DNA, 19 bp, Homo sapiens
gcctgtaacaagccagatt

SEQ ID NO: 2849137 - DNA, 16 bp, Homo sapiens
gcctgtaatcccagca

SEQ ID NO: 2849138 - DNA, 18 bp, Homo sapiens
gcctgtaatcccagcact

SEQ ID NO: 2849139 - DNA, 17 bp, Homo sapiens
gcctgtaatcccagcta

SEQ ID NO: 2849140 - DNA, 19 bp, Homo sapiens
gcctgtaatcccagctact

SEQ ID NO: 2849141 - DNA, 13 bp, Homo sapiens
gcctgtactgcct

SEQ ID NO: 2849142 - DNA, 15 bp, Homo sapiens
gcctgtactgcctgc

SEQ ID NO: 2849143 - DNA, 18 bp, Homo sapiens
gcctgtactgcctgcttg

SEQ ID NO: 2849144 - DNA, 19 bp, Homo sapiens
gcctgtagtcccagccact

SEQ ID NO: 2849145 - DNA, 14 bp, Homo sapiens
gcctgtagttagga

SEQ ID NO: 2849146 - DNA, 23 bp, Homo sapiens
gcctgtagttaggaaataaaacc

SEQ ID NO: 2849147 - DNA, 16 bp, Homo sapiens
gcctgtgaacccagga

SEQ ID NO: 2849148 - DNA, 22 bp, Homo sapiens
gcctgtgaataaaaaccctgta

SEQ ID NO: 2849149 - DNA, 19 bp, Homo sapiens
gcctgtgcatgtatgtctt

SEQ ID NO: 2849150 - DNA, 19 bp, Homo sapiens
gcctgtgcctcctcacccc

SEQ ID NO: 2849151 - DNA, 23 bp, Homo sapiens
gcctgtgctgcccgtcttcagcc

SEQ ID NO: 2849152 - DNA, 16 bp, Homo sapiens
gcctgtgtagctgtga

SEQ ID NO: 2849153 - DNA, 16 bp, Homo sapiens
gcctgtgtgagcatct

SEQ ID NO: 2849154 - DNA, 18 bp, Homo sapiens
gcctgtgtgagcatctct

SEQ ID NO: 2849155 - DNA, 20 bp, Homo sapiens
gcctgtgtgagcatctctgt

SEQ ID NO: 2849156 - DNA, 15 bp, Homo sapiens
gcctgttcagctcca

SEQ ID NO: 2849157 - DNA, 17 bp, Homo sapiens
gcctgttcagctccagc

SEQ ID NO: 2849158 - DNA, 12 bp, Homo sapiens
gccttacctcct

SEQ ID NO: 2849159 - DNA, 13 bp, Homo sapiens
gccttacctcctg

SEQ ID NO: 2849160 - DNA, 17 bp, Homo sapiens
gccttacctcctgccca

SEQ ID NO: 2849161 - DNA, 18 bp, Homo sapiens
gccttagaagtcacacag

SEQ ID NO: 2849162 - DNA, 13 bp, Homo sapiens
gccttagcacttc

SEQ ID NO: 2849163 - DNA, 16 bp, Homo sapiens
gccttagcacttcttt

SEQ ID NO: 2849164 - DNA, 18 bp, Homo sapiens
gccttcacaaccagccac

SEQ ID NO: 2849165 - DNA, 19 bp, Homo sapiens
gccttcacaaccagccaca

SEQ ID NO: 2849166 - DNA, 22 bp, Homo sapiens
gccttcacaaccagccacacag

SEQ ID NO: 2849167 - DNA, 23 bp, Homo sapiens
gccttcacaaccagccacacaga

SEQ ID NO: 2849168 - DNA, 21 bp, Homo sapiens
gccttccataattatgacagt

SEQ ID NO: 2849169 - DNA, 18 bp, Homo sapiens
gccttccccctcccaggg

SEQ ID NO: 2849170 - DNA, 17 bp, Homo sapiens
gccttctcctgcctaca

SEQ ID NO: 2849171 - DNA, 14 bp, Homo sapiens
gccttctcgcattt

SEQ ID NO: 2849172 - DNA, 16 bp, Homo sapiens
gccttctctgaaggac

SEQ ID NO: 2849173 - DNA, 14 bp, Homo sapiens
gccttctctgttca

SEQ ID NO: 2849174 - DNA, 18 bp, Homo sapiens
gccttcttattctcactc

SEQ ID NO: 2849175 - DNA, 21 bp, Homo sapiens
gccttcttattctcactccac

SEQ ID NO: 2849176 - DNA, 22 bp, Homo sapiens
gccttcttcggggaactcctgg

SEQ ID NO: 2849177 - DNA, 23 bp, Homo sapiens
gccttcttcggggaactcctgga

SEQ ID NO: 2849178 - DNA, 19 bp, Homo sapiens
gccttgaaaaacaagtctt

SEQ ID NO: 2849179 - DNA, 15 bp, Homo sapiens
gccttgaagccactg

SEQ ID NO: 2849180 - DNA, 12 bp, Homo sapiens
gccttggagcag

SEQ ID NO: 2849181 - DNA, 18 bp, Homo sapiens
gccttggagcagaaagcc

SEQ ID NO: 2849182 - DNA, 14 bp, Homo sapiens
gccttgtctgggga

SEQ ID NO: 2849183 - DNA, 21 bp, Homo sapiens
gcctttattaaaaactgagtg

SEQ ID NO: 2849184 - DNA, 14 bp, Homo sapiens
gcctttccccagtg

SEQ ID NO: 2849185 - DNA, 16 bp, Homo sapiens
gctctcccctgccctg

SEQ ID NO: 2849186 - DNA, 18 bp, Homo sapiens
gctctcccgtagtcagcg

SEQ ID NO: 2849187 - DNA, 20 bp, Homo sapiens
gctctccctctggccctgcc

SEQ ID NO: 2849188 - DNA, 17 bp, Homo sapiens
gctctcctaccccacct

SEQ ID NO: 2849189 - DNA, 15 bp, Homo sapiens
gctctcctcttgcca

SEQ ID NO: 2849190 - DNA, 19 bp, Homo sapiens
gctctcctcttgccactgc

SEQ ID NO: 2849191 - DNA, 21 bp, Homo sapiens
gctctcctgagaggtgctgca

SEQ ID NO: 2849192 - DNA, 20 bp, Homo sapiens
gctctcctgcctacatccca

SEQ ID NO: 2849193 - DNA, 13 bp, Homo sapiens
gctctcctggctt

SEQ ID NO: 2849194 - DNA, 23 bp, Homo sapiens
gctctcctggcttcccatcccca

SEQ ID NO: 2849195 - DNA, 23 bp, Homo sapiens
gctctctctacccggcccagaga

SEQ ID NO: 2849196 - DNA, 21 bp, Homo sapiens
gctctctgcagccagcccagc

SEQ ID NO: 2849197 - DNA, 22 bp, Homo sapiens
gctctctgcagccagcccagcc

SEQ ID NO: 2849198 - DNA, 17 bp, Homo sapiens
gctctgaaagccagctg

SEQ ID NO: 2849199 - DNA, 15 bp, Homo sapiens
gctctgagaggccct

SEQ ID NO: 2849200 - DNA, 16 bp, Homo sapiens
gctctgaggcttccag

SEQ ID NO: 2849201 - DNA, 14 bp, Homo sapiens
gctctgatcagcat

SEQ ID NO: 2849202 - DNA, 22 bp, Homo sapiens
gctctgatcatccactgtgcca

SEQ ID NO: 2849203 - DNA, 18 bp, Homo sapiens
gctctgccccagctctgg

SEQ ID NO: 2849204 - DNA, 12 bp, Homo sapiens
gctctgccctcc

SEQ ID NO: 2849205 - DNA, 14 bp, Homo sapiens
gctctgccctccct

SEQ ID NO: 2849206 - DNA, 20 bp, Homo sapiens
gctctgccctccctggcctc

SEQ ID NO: 2849207 - DNA, 13 bp, Homo sapiens
gctctgctgacag

SEQ ID NO: 2849208 - DNA, 14 bp, Homo sapiens
gctctgctgacaga

SEQ ID NO: 2849209 - DNA, 22 bp, Homo sapiens
gctctggaaaatgtgacccaga

SEQ ID NO: 2849210 - DNA, 16 bp, Homo sapiens
gctctggacaggcatg

SEQ ID NO: 2849211 - DNA, 21 bp, Homo sapiens
gctctggacaggcatgttctc

SEQ ID NO: 2849212 - DNA, 14 bp, Homo sapiens
gctctggccccagg

SEQ ID NO: 2849213 - DNA, 12 bp, Homo sapiens
gctctgtccact

SEQ ID NO: 2849214 - DNA, 15 bp, Homo sapiens
gctctgtcctgggag

SEQ ID NO: 2849215 - DNA, 23 bp, Homo sapiens
gctctgtgaaatcagaagtgcaa

SEQ ID NO: 2849216 - DNA, 14 bp, Homo sapiens
gctcttcatgtttc

SEQ ID NO: 2849217 - DNA, 23 bp, Homo sapiens
gctcttctacgtataaatatgaa

SEQ ID NO: 2849218 - DNA, 18 bp, Homo sapiens
gctcttctatttaaaaaa

SEQ ID NO: 2849219 - DNA, 19 bp, Homo sapiens
gctcttctccttggaggac

SEQ ID NO: 2849220 - DNA, 16 bp, Homo sapiens
gctcttctgttctcaa

SEQ ID NO: 2849221 - DNA, 13 bp, Homo sapiens
gctcttgcctgca

SEQ ID NO: 2849222 - DNA, 19 bp, Homo sapiens
gctcttggcaggtactcag

SEQ ID NO: 2849223 - DNA, 16 bp, Homo sapiens
gctcttggcccctgtg

SEQ ID NO: 2849224 - DNA, 17 bp, Homo sapiens
gctgaaacacctcccag

SEQ ID NO: 2849225 - DNA, 22 bp, Homo sapiens
gctgaactgagcctagctacct

SEQ ID NO: 2849226 - DNA, 19 bp, Homo sapiens
gctgacacataatttgaat

SEQ ID NO: 2849227 - DNA, 20 bp, Homo sapiens
gctgacagacacaggcccgg

SEQ ID NO: 2849228 - DNA, 20 bp, Homo sapiens
gctgaccaagagagaaagaa

SEQ ID NO: 2849229 - DNA, 22 bp, Homo sapiens
gctgacccagccccttgagaaa

SEQ ID NO: 2849230 - DNA, 17 bp, Homo sapiens
gctgacccagtccctgg

SEQ ID NO: 2849231 - DNA, 18 bp, Homo sapiens
gctgactttgctctttct

SEQ ID NO: 2849232 - DNA, 13 bp, Homo sapiens
gctgagaacctgg

SEQ ID NO: 2849233 - DNA, 14 bp, Homo sapiens
gctgagaacctggc

SEQ ID NO: 2849234 - DNA, 17 bp, Homo sapiens
gctgagagacccaagga

SEQ ID NO: 2849235 - DNA, 22 bp, Homo sapiens
gctgagaggcagacttccctga

SEQ ID NO: 2849236 - DNA, 22 bp, Homo sapiens
gctgagattgcgccactgcact

SEQ ID NO: 2849237 - DNA, 11 bp, Homo sapiens
gctgagccctg

SEQ ID NO: 2849238 - DNA, 12 bp, Homo sapiens
gctgagccctgg

SEQ ID NO: 2849239 - DNA, 15 bp, Homo sapiens
gctgagccctggcag

SEQ ID NO: 2849240 - DNA, 16 bp, Homo sapiens
gctgagctcacaaggc

SEQ ID NO: 2849241 - DNA, 19 bp, Homo sapiens
gctgagctcacaaggcagc

SEQ ID NO: 2849242 - DNA, 21 bp, Homo sapiens
gctgagctcacaaggcagcaa

SEQ ID NO: 2849243 - DNA, 16 bp, Homo sapiens
gctgagctctgagagg

SEQ ID NO: 2849244 - DNA, 19 bp, Homo sapiens
gctgagctctgagaggccc

SEQ ID NO: 2849245 - DNA, 19 bp, Homo sapiens
gctgaggatttcaagcctg

SEQ ID NO: 2849246 - DNA, 13 bp, Homo sapiens
gctgaggcagaag

SEQ ID NO: 2849247 - DNA, 15 bp, Homo sapiens
gctgaggcagaagaa

SEQ ID NO: 2849248 - DNA, 12 bp, Homo sapiens
gctgagggcagt

SEQ ID NO: 2849249 - DNA, 21 bp, Homo sapiens
gctgagggcagttcgcagcca

SEQ ID NO: 2849250 - DNA, 22 bp, Homo sapiens
gctgagggcagttcgcagccac

SEQ ID NO: 2849251 - DNA, 22 bp, Homo sapiens
gctgagtcatgatctccctgcc

SEQ ID NO: 2849252 - DNA, 12 bp, Homo sapiens
gctgataatttt

SEQ ID NO: 2849253 - DNA, 16 bp, Homo sapiens
gctgatgtgagtgtgt

SEQ ID NO: 2849254 - DNA, 23 bp, Homo sapiens
gctgatttctaggtaggaaatgt

SEQ ID NO: 2849255 - DNA, 22 bp, Homo sapiens
gctgcaaagggtatcaggtgct

SEQ ID NO: 2849256 - DNA, 18 bp, Homo sapiens
gctgcacctgccagcctg

SEQ ID NO: 2849257 - DNA, 20 bp, Homo sapiens
gctgcacctgccagcctggc

SEQ ID NO: 2849258 - DNA, 21 bp, Homo sapiens
gctgcacctgccagcctggct

SEQ ID NO: 2849259 - DNA, 22 bp, Homo sapiens
gctgcacctgccagcctggctt

SEQ ID NO: 2849260 - DNA, 17 bp, Homo sapiens
gctgcagaaggccaaga

SEQ ID NO: 2849261 - DNA, 19 bp, Homo sapiens
gctgcagtcaacagttcaa

SEQ ID NO: 2849262 - DNA, 15 bp, Homo sapiens
gctgcatctactcag

SEQ ID NO: 2849263 - DNA, 21 bp, Homo sapiens
gctgccatccaggttcagctt

SEQ ID NO: 2849264 - DNA, 23 bp, Homo sapiens
gctgccatccaggttcagcttgt

SEQ ID NO: 2849265 - DNA, 23 bp, Homo sapiens
gctgccatggcgtgtccctctcg

SEQ ID NO: 2849266 - DNA, 19 bp, Homo sapiens
gctgcccctgtaggttgct

SEQ ID NO: 2849267 - DNA, 16 bp, Homo sapiens
gctgcccgtcttcagc

SEQ ID NO: 2849268 - DNA, 19 bp, Homo sapiens
gctgcccgtcttcagccta

SEQ ID NO: 2849269 - DNA, 20 bp, Homo sapiens
gctgcccgtcttcagcctag

SEQ ID NO: 2849270 - DNA, 15 bp, Homo sapiens
gctgccctgccactt

SEQ ID NO: 2849271 - DNA, 18 bp, Homo sapiens
gctgccctgtaccccagc

SEQ ID NO: 2849272 - DNA, 16 bp, Homo sapiens
gctgccgaccagagcc

SEQ ID NO: 2849273 - DNA, 13 bp, Homo sapiens
gctgccgcctccc

SEQ ID NO: 2849274 - DNA, 15 bp, Homo sapiens
gctgccgcctcccag

SEQ ID NO: 2849275 - DNA, 21 bp, Homo sapiens
gctttgcttatggtaataaaa

SEQ ID NO: 2849276 - DNA, 16 bp, Homo sapiens
gctttgtgtgattgaa

SEQ ID NO: 2849277 - DNA, 18 bp, Homo sapiens
gcttttttttgagaatac

SEQ ID NO: 2849278 - DNA, 18 bp, Homo sapiens
ggaaaagaatacagaaag

SEQ ID NO: 2849279 - DNA, 22 bp, Homo sapiens
ggaaaagagcgcatcaggcctg

SEQ ID NO: 2849280 - DNA, 18 bp, Homo sapiens
ggaaaagctgctgacagt

SEQ ID NO: 2849281 - DNA, 20 bp, Homo sapiens
ggaaaagctgctgacagtgt

SEQ ID NO: 2849282 - DNA, 13 bp, Homo sapiens
ggaaaaggcctgg

SEQ ID NO: 2849283 - DNA, 15 bp, Homo sapiens
ggaaacaggaccaca

SEQ ID NO: 2849284 - DNA, 16 bp, Homo sapiens
ggaaagaaagaaggaa

SEQ ID NO: 2849285 - DNA, 12 bp, Homo sapiens
ggaaagagacca

SEQ ID NO: 2849286 - DNA, 11 bp, Homo sapiens
ggaaagcaggt

SEQ ID NO: 2849287 - DNA, 19 bp, Homo sapiens
ggaaagcaggtggcatctc

SEQ ID NO: 2849288 - DNA, 19 bp, Homo sapiens
ggaaagcatcacctcaggc

SEQ ID NO: 2849289 - DNA, 13 bp, Homo sapiens
ggaaagcctctgc

SEQ ID NO: 2849290 - DNA, 14 bp, Homo sapiens
ggaaagcctctgct

SEQ ID NO: 2849291 - DNA, 12 bp, Homo sapiens
ggaaaggctcag

SEQ ID NO: 2849292 - DNA, 15 bp, Homo sapiens
ggaaaggctctgaaa

SEQ ID NO: 2849293 - DNA, 20 bp, Homo sapiens
ggaaataaaacctttcaaat

SEQ ID NO: 2849294 - DNA, 13 bp, Homo sapiens
ggaaataaatgat

SEQ ID NO: 2849295 - DNA, 16 bp, Homo sapiens
ggaaatatcagttact

SEQ ID NO: 2849296 - DNA, 16 bp, Homo sapiens
ggaaattctgctcaga

SEQ ID NO: 2849297 - DNA, 16 bp, Homo sapiens
ggaacacccggaaaga

SEQ ID NO: 2849298 - DNA, 11 bp, Homo sapiens
ggaacagaagg

SEQ ID NO: 2849299 - DNA, 12 bp, Homo sapiens
ggaacagaagga

SEQ ID NO: 2849300 - DNA, 19 bp, Homo sapiens
ggaacagaaggatgaatga

SEQ ID NO: 2849301 - DNA, 13 bp, Homo sapiens
ggaacagacagga

SEQ ID NO: 2849302 - DNA, 19 bp, Homo sapiens
ggaacagactggaagcaca

SEQ ID NO: 2849303 - DNA, 20 bp, Homo sapiens
ggaacagactggaagcacag

SEQ ID NO: 2849304 - DNA, 18 bp, Homo sapiens
ggaacagagtatatatgt

SEQ ID NO: 2849305 - DNA, 20 bp, Homo sapiens
ggaacagagtatatatgtac

SEQ ID NO: 2849306 - DNA, 17 bp, Homo sapiens
ggaacccgactgtgaaa

SEQ ID NO: 2849307 - DNA, 13 bp, Homo sapiens
ggaacctcaaact

SEQ ID NO: 2849308 - DNA, 15 bp, Homo sapiens
ggaacctcaaactgg

SEQ ID NO: 2849309 - DNA, 18 bp, Homo sapiens
ggaacggggtccttcaag

SEQ ID NO: 2849310 - DNA, 16 bp, Homo sapiens
ggaacgtgactgcccc

SEQ ID NO: 2849311 - DNA, 20 bp, Homo sapiens
ggaactctggcttccaggta

SEQ ID NO: 2849312 - DNA, 12 bp, Homo sapiens
ggaactggaaca

SEQ ID NO: 2849313 - DNA, 11 bp, Homo sapiens
ggaagaaacag

SEQ ID NO: 2849314 - DNA, 15 bp, Homo sapiens
ggaagagcaggcaca

SEQ ID NO: 2849315 - DNA, 23 bp, Homo sapiens
ggaagagtgtgcttgtcatctgc

SEQ ID NO: 2849316 - DNA, 19 bp, Homo sapiens
ggaagcaagacgtcctgga

SEQ ID NO: 2849317 - DNA, 23 bp, Homo sapiens
ggaagcacatgtttatttattct

SEQ ID NO: 2849318 - DNA, 17 bp, Homo sapiens
ggaagcatgtaggagaa

SEQ ID NO: 2849319 - DNA, 21 bp, Homo sapiens
ggaagcatgtaggagaatcca

SEQ ID NO: 2849320 - DNA, 19 bp, Homo sapiens
ggaagcatttgtttctact

SEQ ID NO: 2849321 - DNA, 11 bp, Homo sapiens
ggaagccctcc

SEQ ID NO: 2849322 - DNA, 12 bp, Homo sapiens
ggaagccctcct

SEQ ID NO: 2849323 - DNA, 15 bp, Homo sapiens
ggaagccctggattt

SEQ ID NO: 2849324 - DNA, 23 bp, Homo sapiens
ggaagccctggatttcagaaaga

SEQ ID NO: 2849325 - DNA, 23 bp, Homo sapiens
ggaagcgatgaatttggagactc

SEQ ID NO: 2849326 - DNA, 20 bp, Homo sapiens
ggaagcggaggttgcaggga

SEQ ID NO: 2849327 - DNA, 17 bp, Homo sapiens
ggaagctggcagcactc

SEQ ID NO: 2849328 - DNA, 21 bp, Homo sapiens
ggaagctgtgtccttgcacct

SEQ ID NO: 2849329 - DNA, 16 bp, Homo sapiens
ggaaggaactctggct

SEQ ID NO: 2849330 - DNA, 14 bp, Homo sapiens
ggaaggcaggcagg

SEQ ID NO: 2849331 - DNA, 17 bp, Homo sapiens
ggaaggcaggcagggct

SEQ ID NO: 2849332 - DNA, 19 bp, Homo sapiens
ggaaggcaggcagggctct

SEQ ID NO: 2849333 - DNA, 21 bp, Homo sapiens
ggaaggcaggcagggctctcc

SEQ ID NO: 2849334 - DNA, 19 bp, Homo sapiens
ggaaggctacttcggggct

SEQ ID NO: 2849335 - DNA, 23 bp, Homo sapiens
ggaaggctacttcggggctggga

SEQ ID NO: 2849336 - DNA, 14 bp, Homo sapiens
ggaaggctgctgtg

SEQ ID NO: 2849337 - DNA, 21 bp, Homo sapiens
ggaagggccagtctgggctgc

SEQ ID NO: 2849338 - DNA, 21 bp, Homo sapiens
ggaaggtagcccagcactgtg

SEQ ID NO: 2849339 - DNA, 19 bp, Homo sapiens
ggaaggtttggtgtgtgga

SEQ ID NO: 2849340 - DNA, 18 bp, Homo sapiens
ggaaggtttgtatattgt

SEQ ID NO: 2849341 - DNA, 23 bp, Homo sapiens
ggaagtcgtccttactcctgtgg

SEQ ID NO: 2849342 - DNA, 14 bp, Homo sapiens
ggaagtctaggagc

SEQ ID NO: 2849343 - DNA, 18 bp, Homo sapiens
ggaagtgttccctgagaa

SEQ ID NO: 2849344 - DNA, 11 bp, Homo sapiens
ggaagttttca

SEQ ID NO: 2849345 - DNA, 15 bp, Homo sapiens
ggaataatagaagaa

SEQ ID NO: 2849346 - DNA, 14 bp, Homo sapiens
ggaatcaaaaattg

SEQ ID NO: 2849347 - DNA, 22 bp, Homo sapiens
ggaatcaagatgtcagactggc

SEQ ID NO: 2849348 - DNA, 14 bp, Homo sapiens
ggaatgaagcatgt

SEQ ID NO: 2849349 - DNA, 21 bp, Homo sapiens
ggaatggaaaaagcagaaggc

SEQ ID NO: 2849350 - DNA, 20 bp, Homo sapiens
ggaattcatctctctttaat

SEQ ID NO: 2849351 - DNA, 15 bp, Homo sapiens
ggaattgctgctctc

SEQ ID NO: 2849352 - DNA, 16 bp, Homo sapiens
ggacaaaggagcctgt

SEQ ID NO: 2849353 - DNA, 12 bp, Homo sapiens
ggacacactaat

SEQ ID NO: 2849354 - DNA, 13 bp, Homo sapiens
ggacacagctctt

SEQ ID NO: 2849355 - DNA, 14 bp, Homo sapiens
ggacacagctcttc

SEQ ID NO: 2849356 - DNA, 21 bp, Homo sapiens
ggacacagctcttctccaggc

SEQ ID NO: 2849357 - DNA, 19 bp, Homo sapiens
ggacaccccttatccagga

SEQ ID NO: 2849358 - DNA, 15 bp, Homo sapiens
ggacacctgccctgc

SEQ ID NO: 2849359 - DNA, 17 bp, Homo sapiens
ggacactagggtcaggc

SEQ ID NO: 2849360 - DNA, 14 bp, Homo sapiens
ggacagaagaaggc

SEQ ID NO: 2849361 - DNA, 14 bp, Homo sapiens
ggacagagacacct

SEQ ID NO: 2849362 - DNA, 18 bp, Homo sapiens
ggacagagacacctgcac

SEQ ID NO: 2849363 - DNA, 20 bp, Homo sapiens
ggacagccacggccaggcca

SEQ ID NO: 2849364 - DNA, 21 bp, Homo sapiens
ggacagccacggccaggccag

SEQ ID NO: 2849365 - DNA, 23 bp, Homo sapiens
ggacagcctgtggcggtgcctgg

SEQ ID NO: 2849366 - DNA, 19 bp, Homo sapiens
ggcacctatagtcccagct

SEQ ID NO: 2849367 - DNA, 16 bp, Homo sapiens
ggcacctgggccctgg

SEQ ID NO: 2849368 - DNA, 17 bp, Homo sapiens
ggcacctgggccctggg

SEQ ID NO: 2849369 - DNA, 23 bp, Homo sapiens
ggcactcagaagacactgatggg

SEQ ID NO: 2849370 - DNA, 13 bp, Homo sapiens
ggcactcccctga

SEQ ID NO: 2849371 - DNA, 17 bp, Homo sapiens
ggcactgagatatttat

SEQ ID NO: 2849372 - DNA, 23 bp, Homo sapiens
ggcagaaaacggagagtgcttgg

SEQ ID NO: 2849373 - DNA, 14 bp, Homo sapiens
ggcagaaagtggcc

SEQ ID NO: 2849374 - DNA, 14 bp, Homo sapiens
ggcagaacagccgc

SEQ ID NO: 2849375 - DNA, 20 bp, Homo sapiens
ggcagaacagccgctcctgt

SEQ ID NO: 2849376 - DNA, 22 bp, Homo sapiens
ggcagaagaattgaacccagga

SEQ ID NO: 2849377 - DNA, 23 bp, Homo sapiens
ggcagaagaattgaacccaggag

SEQ ID NO: 2849378 - DNA, 15 bp, Homo sapiens
ggcagaagggagaag

SEQ ID NO: 2849379 - DNA, 19 bp, Homo sapiens
ggcagaataatctttgggt

SEQ ID NO: 2849380 - DNA, 19 bp, Homo sapiens
ggcagacagcagctcaggc

SEQ ID NO: 2849381 - DNA, 20 bp, Homo sapiens
ggcagacagcagctcaggca

SEQ ID NO: 2849382 - DNA, 21 bp, Homo sapiens
ggcagagaaagaagagacagg

SEQ ID NO: 2849383 - DNA, 22 bp, Homo sapiens
ggcagagaaggcttcctccagc

SEQ ID NO: 2849384 - DNA, 22 bp, Homo sapiens
ggcagagcctttggatgaccag

SEQ ID NO: 2849385 - DNA, 12 bp, Homo sapiens
ggcagaggctgg

SEQ ID NO: 2849386 - DNA, 22 bp, Homo sapiens
ggcagaggctggaggcagggcc

SEQ ID NO: 2849387 - DNA, 14 bp, Homo sapiens
ggcagagggcagag

SEQ ID NO: 2849388 - DNA, 16 bp, Homo sapiens
ggcagagggcagaggc

SEQ ID NO: 2849389 - DNA, 20 bp, Homo sapiens
ggcagataatcagcctctta

SEQ ID NO: 2849390 - DNA, 18 bp, Homo sapiens
ggcagatcaccagaggtc

SEQ ID NO: 2849391 - DNA, 17 bp, Homo sapiens
ggcagatgtaggaggga

SEQ ID NO: 2849392 - DNA, 24 bp, Homo sapiens
ggcagatttagtgaaagctagaga

SEQ ID NO: 2849393 - DNA, 16 bp, Homo sapiens
ggcagcaaggcccgag

SEQ ID NO: 2849394 - DNA, 19 bp, Homo sapiens
ggcagcaaggcccgagcag

SEQ ID NO: 2849395 - DNA, 21 bp, Homo sapiens
ggcagcaaggcccgagcagct

SEQ ID NO: 2849396 - DNA, 22 bp, Homo sapiens
ggcagcaaggcccgagcagctg

SEQ ID NO: 2849397 - DNA, 12 bp, Homo sapiens
ggcagcagccag

SEQ ID NO: 2849398 - DNA, 14 bp, Homo sapiens
ggcagcagccagcc

SEQ ID NO: 2849399 - DNA, 13 bp, Homo sapiens
ggcagcagctcag

SEQ ID NO: 2849400 - DNA, 19 bp, Homo sapiens
ggcagcatagcaagacaca

SEQ ID NO: 2849401 - DNA, 19 bp, Homo sapiens
ggcagccaaacccatgagg

SEQ ID NO: 2849402 - DNA, 21 bp, Homo sapiens
ggcagccacacttctcaggac

SEQ ID NO: 2849403 - DNA, 20 bp, Homo sapiens
ggcagccccattctgcctgc

SEQ ID NO: 2849404 - DNA, 21 bp, Homo sapiens
ggcagccccattctgcctgcc

SEQ ID NO: 2849405 - DNA, 18 bp, Homo sapiens
ggcagctcctctgtctcg

SEQ ID NO: 2849406 - DNA, 23 bp, Homo sapiens
ggcagctgcggtccacccaggag

SEQ ID NO: 2849407 - DNA, 24 bp, Homo sapiens
ggcagctgcggtccacccaggagc

SEQ ID NO: 2849408 - DNA, 10 bp, Homo sapiens
ggcagctgga

SEQ ID NO: 2849409 - DNA, 16 bp, Homo sapiens
ggcagcttgagcctgt

SEQ ID NO: 2849410 - DNA, 21 bp, Homo sapiens
ggcagcttgagcctgtcacgt

SEQ ID NO: 2849411 - DNA, 24 bp, Homo sapiens
ggcaggaggattgcttgagcccag

SEQ ID NO: 2849412 - DNA, 14 bp, Homo sapiens
ggcaggagtagctg

SEQ ID NO: 2849413 - DNA, 15 bp, Homo sapiens
ggcaggatgaccctg

SEQ ID NO: 2849414 - DNA, 13 bp, Homo sapiens
ggcaggcagggct

SEQ ID NO: 2849415 - DNA, 23 bp, Homo sapiens
ggcaggcagggctctcctggctt

SEQ ID NO: 2849416 - DNA, 16 bp, Homo sapiens
ggcagggccttgccca

SEQ ID NO: 2849417 - DNA, 18 bp, Homo sapiens
ggcagggccttgcccaga

SEQ ID NO: 2849418 - DNA, 16 bp, Homo sapiens
ggcagggctctcctgg

SEQ ID NO: 2849419 - DNA, 17 bp, Homo sapiens
ggcagggctctcctggc

SEQ ID NO: 2849420 - DNA, 10 bp, Homo sapiens
ggcagggctg

SEQ ID NO: 2849421 - DNA, 11 bp, Homo sapiens
ggcagggctgg

SEQ ID NO: 2849422 - DNA, 18 bp, Homo sapiens
ggcaggggtgggagagcc

SEQ ID NO: 2849423 - DNA, 13 bp, Homo sapiens
ggcaggtccaggg

SEQ ID NO: 2849424 - DNA, 14 bp, Homo sapiens
ggcagtccagccag

SEQ ID NO: 2849425 - DNA, 15 bp, Homo sapiens
ggcagtccagccagc

SEQ ID NO: 2849426 - DNA, 17 bp, Homo sapiens
ggcagtccagccagctc

SEQ ID NO: 2849427 - DNA, 18 bp, Homo sapiens
ggcagtccagccagctcc

SEQ ID NO: 2849428 - DNA, 16 bp, Homo sapiens
ggcagtgggagctgcc

SEQ ID NO: 2849429 - DNA, 17 bp, Homo sapiens
ggcagttcgcagccacc

SEQ ID NO: 2849430 - DNA, 23 bp, Homo sapiens
ggcagttcgcagccaccctgagg

SEQ ID NO: 2849431 - DNA, 14 bp, Homo sapiens
ggcatcacagggca

SEQ ID NO: 2849432 - DNA, 16 bp, Homo sapiens
ggcatctacacagcct

SEQ ID NO: 2849433 - DNA, 18 bp, Homo sapiens
ggcatctacacagcctgg

SEQ ID NO: 2849434 - DNA, 20 bp, Homo sapiens
ggcatctacacagcctggac

SEQ ID NO: 2849435 - DNA, 21 bp, Homo sapiens
ggcatctacacagcctggact

SEQ ID NO: 2849436 - DNA, 14 bp, Homo sapiens
ggcatgctcagccc

SEQ ID NO: 2849437 - DNA, 19 bp, Homo sapiens
ggcatggtacggagatgtt

SEQ ID NO: 2849438 - DNA, 21 bp, Homo sapiens
ggcatggtggcgcaagcctgt

SEQ ID NO: 2849439 - DNA, 23 bp, Homo sapiens
ggcatgtgaattctgtgaagaat

SEQ ID NO: 2849440 - DNA, 23 bp, Homo sapiens
ggcatgtgtttactttatgttac

SEQ ID NO: 2849441 - DNA, 12 bp, Homo sapiens
ggcatttcctgg

SEQ ID NO: 2849442 - DNA, 13 bp, Homo sapiens
ggccaaagtgtta

SEQ ID NO: 2849443 - DNA, 23 bp, Homo sapiens
ggccaagctgaggtgcccaggag

SEQ ID NO: 2849444 - DNA, 19 bp, Homo sapiens
ggccaattaaaatatatat

SEQ ID NO: 2849445 - DNA, 23 bp, Homo sapiens
ggccaattaaaatatatataaat

SEQ ID NO: 2849446 - DNA, 21 bp, Homo sapiens
ggccacactattaccatgaga

SEQ ID NO: 2849447 - DNA, 14 bp, Homo sapiens
ctgtgctctggaca

SEQ ID NO: 2849448 - DNA, 18 bp, Homo sapiens
ctgtgctctggacaggca

SEQ ID NO: 2849449 - DNA, 20 bp, Homo sapiens
ctgtgctgcccgtcttcagc

SEQ ID NO: 2849450 - DNA, 22 bp, Homo sapiens
ctgtgctgcccgtcttcagcct

SEQ ID NO: 2849451 - DNA, 13 bp, Homo sapiens
ctgtgcttacagt

SEQ ID NO: 2849452 - DNA, 15 bp, Homo sapiens
ctgtgcttctctttg

SEQ ID NO: 2849453 - DNA, 18 bp, Homo sapiens
ctgtgctttgactcacct

SEQ ID NO: 2849454 - DNA, 14 bp, Homo sapiens
ctgtggaaaaatat

SEQ ID NO: 2849455 - DNA, 18 bp, Homo sapiens
ctgtggaaaaatatttaa

SEQ ID NO: 2849456 - DNA, 19 bp, Homo sapiens
ctgtggaaaaatatttaag

SEQ ID NO: 2849457 - DNA, 16 bp, Homo sapiens
ctgtggagagtgagaa

SEQ ID NO: 2849458 - DNA, 14 bp, Homo sapiens
ctgtggcggtgcct

SEQ ID NO: 2849459 - DNA, 15 bp, Homo sapiens
ctgtggcggtgcctg

SEQ ID NO: 2849460 - DNA, 14 bp, Homo sapiens
ctgtgggagcctcg

SEQ ID NO: 2849461 - DNA, 16 bp, Homo sapiens
ctgtgggagcctcgca

SEQ ID NO: 2849462 - DNA, 20 bp, Homo sapiens
ctgtgggggaggtccctgcc

SEQ ID NO: 2849463 - DNA, 15 bp, Homo sapiens
ctgtgggtagtatga

SEQ ID NO: 2849464 - DNA, 23 bp, Homo sapiens
ctgtggtagtactcctgcaaaat

SEQ ID NO: 2849465 - DNA, 14 bp, Homo sapiens
ctgtggtggctgtc

SEQ ID NO: 2849466 - DNA, 18 bp, Homo sapiens
ctgtggtggctgtctctg

SEQ ID NO: 2849467 - DNA, 15 bp, Homo sapiens
ctgtgtaacctccac

SEQ ID NO: 2849468 - DNA, 20 bp, Homo sapiens
ctgtgtacccactcctcact

SEQ ID NO: 2849469 - DNA, 16 bp, Homo sapiens
ctgtgtagctctgtcc

SEQ ID NO: 2849470 - DNA, 18 bp, Homo sapiens
ctgtgtagctctgtccac

SEQ ID NO: 2849471 - DNA, 23 bp, Homo sapiens
ctgtgtagctgtgacctgctgag

SEQ ID NO: 2849472 - DNA, 15 bp, Homo sapiens
ctgtgtattttgaga

SEQ ID NO: 2849473 - DNA, 16 bp, Homo sapiens
ctgtgtcagcctgtcc

SEQ ID NO: 2849474 - DNA, 21 bp, Homo sapiens
ctgtgtcaggtggggcagctt

SEQ ID NO: 2849475 - DNA, 18 bp, Homo sapiens
ctgtgtccttgcacctgc

SEQ ID NO: 2849476 - DNA, 19 bp, Homo sapiens
ctgtgtccttgcacctgca

SEQ ID NO: 2849477 - DNA, 22 bp, Homo sapiens
ctgtgtcttgcaatggcagcct

SEQ ID NO: 2849478 - DNA, 19 bp, Homo sapiens
ctgtgtgaaataccagtgt

SEQ ID NO: 2849479 - DNA, 15 bp, Homo sapiens
ctgtgtgaagaaatg

SEQ ID NO: 2849480 - DNA, 16 bp, Homo sapiens
ctgtgtgaagaaatgg

SEQ ID NO: 2849481 - DNA, 20 bp, Homo sapiens
ctgtgtgagcatctctgtgt

SEQ ID NO: 2849482 - DNA, 21 bp, Homo sapiens
ctgtgtgagcatctctgtgta

SEQ ID NO: 2849483 - DNA, 16 bp, Homo sapiens
ctgtgtgcacaaatat

SEQ ID NO: 2849484 - DNA, 16 bp, Homo sapiens
ctgtgtgtgtccccct

SEQ ID NO: 2849485 - DNA, 18 bp, Homo sapiens
ctgtgtttcttgcctcat

SEQ ID NO: 2849486 - DNA, 18 bp, Homo sapiens
ctgttaaaatgtacactg

SEQ ID NO: 2849487 - DNA, 15 bp, Homo sapiens
ctgttactccacagc

SEQ ID NO: 2849488 - DNA, 18 bp, Homo sapiens
ctgttacttgaaatacca

SEQ ID NO: 2849489 - DNA, 16 bp, Homo sapiens
ctgttagctgttattt

SEQ ID NO: 2849490 - DNA, 13 bp, Homo sapiens
ctgttagtcattt

SEQ ID NO: 2849491 - DNA, 16 bp, Homo sapiens
ctgttatttctatttt

SEQ ID NO: 2849492 - DNA, 15 bp, Homo sapiens
ctgttcagctccagc

SEQ ID NO: 2849493 - DNA, 18 bp, Homo sapiens
ctgttcagctccagctca

SEQ ID NO: 2849494 - DNA, 19 bp, Homo sapiens
ctgttcagctccagctcac

SEQ ID NO: 2849495 - DNA, 22 bp, Homo sapiens
ctgttcagctccagctcaccag

SEQ ID NO: 2849496 - DNA, 17 bp, Homo sapiens
ctgttcatttcctcaaa

SEQ ID NO: 2849497 - DNA, 12 bp, Homo sapiens
ctgttctcaaat

SEQ ID NO: 2849498 - DNA, 17 bp, Homo sapiens
ctgttctggagctgctg

SEQ ID NO: 2849499 - DNA, 19 bp, Homo sapiens
ctgttctggagctgctgtt

SEQ ID NO: 2849500 - DNA, 20 bp, Homo sapiens
ctgttgatgaggcctcttgg

SEQ ID NO: 2849501 - DNA, 16 bp, Homo sapiens
ctgttgcccaggctgg

SEQ ID NO: 2849502 - DNA, 18 bp, Homo sapiens
ctgttgcccaggctggcg

SEQ ID NO: 2849503 - DNA, 12 bp, Homo sapiens
ctgttgcctcat

SEQ ID NO: 2849504 - DNA, 21 bp, Homo sapiens
ctgttgctcaaatctattcag

SEQ ID NO: 2849505 - DNA, 20 bp, Homo sapiens
ctgttggacccgctctggac

SEQ ID NO: 2849506 - DNA, 12 bp, Homo sapiens
ctgttggccagt

SEQ ID NO: 2849507 - DNA, 19 bp, Homo sapiens
ctgttggctgggggcctca

SEQ ID NO: 2849508 - DNA, 21 bp, Homo sapiens
ctgttgtgtatagatgcaaga

SEQ ID NO: 2849509 - DNA, 13 bp, Homo sapiens
ctgttgttgttaa

SEQ ID NO: 2849510 - DNA, 17 bp, Homo sapiens
ctgttgttgttaatgaa

SEQ ID NO: 2849511 - DNA, 18 bp, Homo sapiens
ctgtttaaaaaaagtata

SEQ ID NO: 2849512 - DNA, 21 bp, Homo sapiens
ctgtttaaaaaaagtatatat

SEQ ID NO: 2849513 - DNA, 23 bp, Homo sapiens
ctgtttaaaaaaagtatatattc

SEQ ID NO: 2849514 - DNA, 16 bp, Homo sapiens
ctgtttatggtatttt

SEQ ID NO: 2849515 - DNA, 16 bp, Homo sapiens
ctgtttgagatgtgat

SEQ ID NO: 2849516 - DNA, 19 bp, Homo sapiens
ctgtttgagatgtgatgct

SEQ ID NO: 2849517 - DNA, 22 bp, Homo sapiens
ctgtttgagatgtgatgctggt

SEQ ID NO: 2849518 - DNA, 20 bp, Homo sapiens
ctgtttgtttgacaaagaaa

SEQ ID NO: 2849519 - DNA, 12 bp, Homo sapiens
ctgttttcttct

SEQ ID NO: 2849520 - DNA, 23 bp, Homo sapiens
ctgttttgtatcaaaatcactat

SEQ ID NO: 2849521 - DNA, 16 bp, Homo sapiens
ctgtttttaagctgtt

SEQ ID NO: 2849522 - DNA, 18 bp, Homo sapiens
ctgtttttaagctgtttc

SEQ ID NO: 2849523 - DNA, 17 bp, Homo sapiens
ctgtttttctaactggg

SEQ ID NO: 2849524 - DNA, 22 bp, Homo sapiens
ctgtttttgaagaagggaaatt

SEQ ID NO: 2849525 - DNA, 17 bp, Homo sapiens
cttaaaaaaatgacaga

SEQ ID NO: 2849526 - DNA, 16 bp, Homo sapiens
cttaaaaagtaattgt

SEQ ID NO: 2849527 - DNA, 14 bp, Homo sapiens
cttaaaacaacact

SEQ ID NO: 2849528 - DNA, 13 bp, Homo sapiens
cttaaaataactt

SEQ ID NO: 2849529 - DNA, 16 bp, Homo sapiens
cttaaaataatgattt

SEQ ID NO: 2849530 - DNA, 22 bp, Homo sapiens
cttaaaatagcaacactctata

SEQ ID NO: 2849531 - DNA, 13 bp, Homo sapiens
cttaaaatatttt

SEQ ID NO: 2849532 - DNA, 14 bp, Homo sapiens
cttaaacaaatgta

SEQ ID NO: 2849533 - DNA, 14 bp, Homo sapiens
cttaaacctgggag

SEQ ID NO: 2849534 - DNA, 23 bp, Homo sapiens
cttaaagctgcctgtagttagga

SEQ ID NO: 2849535 - DNA, 13 bp, Homo sapiens
cttaaagcttgtt

SEQ ID NO: 2849536 - DNA, 21 bp, Homo sapiens
cttaaaggctgtggtagtact

SEQ ID NO: 2849537 - DNA, 23 bp, Homo sapiens
cttaaaggctgtggtagtactcc

SEQ ID NO: 2849538 - DNA, 23 bp, Homo sapiens
cttggaaagcatcacctcaggcc

SEQ ID NO: 2849539 - DNA, 13 bp, Homo sapiens
cttggaagctccg

SEQ ID NO: 2849540 - DNA, 14 bp, Homo sapiens
cttggacctctgct

SEQ ID NO: 2849541 - DNA, 18 bp, Homo sapiens
cttggagaactttccatc

SEQ ID NO: 2849542 - DNA, 12 bp, Homo sapiens
cttggaggacag

SEQ ID NO: 2849543 - DNA, 15 bp, Homo sapiens
cttggaggacagtgg

SEQ ID NO: 2849544 - DNA, 20 bp, Homo sapiens
cttggcatcacagggcagag

SEQ ID NO: 2849545 - DNA, 22 bp, Homo sapiens
cttggcatcacagggcagagcc

SEQ ID NO: 2849546 - DNA, 17 bp, Homo sapiens
cttggccgactcaggga

SEQ ID NO: 2849547 - DNA, 12 bp, Homo sapiens
cttggctgcagg

SEQ ID NO: 2849548 - DNA, 13 bp, Homo sapiens
cttggctgcaggg

SEQ ID NO: 2849549 - DNA, 17 bp, Homo sapiens
cttggctgcagggagtc

SEQ ID NO: 2849550 - DNA, 23 bp, Homo sapiens
cttgggaaacagagaaccctgtg

SEQ ID NO: 2849551 - DNA, 18 bp, Homo sapiens
cttgggcacccccagcct

SEQ ID NO: 2849552 - DNA, 20 bp, Homo sapiens
cttgggcacccccagcctgg

SEQ ID NO: 2849553 - DNA, 14 bp, Homo sapiens
cttgggcatgctca

SEQ ID NO: 2849554 - DNA, 16 bp, Homo sapiens
cttgggccctgcacag

SEQ ID NO: 2849555 - DNA, 19 bp, Homo sapiens
cttgggccctgcacagata

SEQ ID NO: 2849556 - DNA, 24 bp, Homo sapiens
cttgggggatgactagaggcaggg

SEQ ID NO: 2849557 - DNA, 24 bp, Homo sapiens
cttggggggtgatgagggcagcag

SEQ ID NO: 2849558 - DNA, 21 bp, Homo sapiens
cttgggtgtaacaggtctcct

SEQ ID NO: 2849559 - DNA, 17 bp, Homo sapiens
cttgggtttttgttacc

SEQ ID NO: 2849560 - DNA, 14 bp, Homo sapiens
cttggtctcagctt

SEQ ID NO: 2849561 - DNA, 16 bp, Homo sapiens
cttggtctcagcttca

SEQ ID NO: 2849562 - DNA, 15 bp, Homo sapiens
cttggtcttatttat

SEQ ID NO: 2849563 - DNA, 15 bp, Homo sapiens
cttggtgtccacctg

SEQ ID NO: 2849564 - DNA, 19 bp, Homo sapiens
cttggtgtccacctggccc

SEQ ID NO: 2849565 - DNA, 17 bp, Homo sapiens
cttggttcccttgtgtg

SEQ ID NO: 2849566 - DNA, 18 bp, Homo sapiens
cttgtaaaaattaaaagt

SEQ ID NO: 2849567 - DNA, 17 bp, Homo sapiens
cttgtaaatagctcagg

SEQ ID NO: 2849568 - DNA, 14 bp, Homo sapiens
cttgtaactccacc

SEQ ID NO: 2849569 - DNA, 21 bp, Homo sapiens
cttgtaactccaccaacccat

SEQ ID NO: 2849570 - DNA, 16 bp, Homo sapiens
cttgtaattctaaatg

SEQ ID NO: 2849571 - DNA, 19 bp, Homo sapiens
cttgtacctatggctgcct

SEQ ID NO: 2849572 - DNA, 23 bp, Homo sapiens
cttgtatattccaccattcacat

SEQ ID NO: 2849573 - DNA, 20 bp, Homo sapiens
cttgtatttaaatattaaat

SEQ ID NO: 2849574 - DNA, 15 bp, Homo sapiens
cttgtattttccata

SEQ ID NO: 2849575 - DNA, 17 bp, Homo sapiens
cttgtcactagcagctg

SEQ ID NO: 2849576 - DNA, 20 bp, Homo sapiens
cttgtcactagcagctgcag

SEQ ID NO: 2849577 - DNA, 15 bp, Homo sapiens
cttgtcactggtaga

SEQ ID NO: 2849578 - DNA, 22 bp, Homo sapiens
cttgtcactggtagaccaaaat

SEQ ID NO: 2849579 - DNA, 14 bp, Homo sapiens
cttgtccagcgcct

SEQ ID NO: 2849580 - DNA, 16 bp, Homo sapiens
cttgtcctatgtcaat

SEQ ID NO: 2849581 - DNA, 20 bp, Homo sapiens
cttgtctccactaaatgagc

SEQ ID NO: 2849582 - DNA, 22 bp, Homo sapiens
cttgtgaggattatgggtcctg

SEQ ID NO: 2849583 - DNA, 19 bp, Homo sapiens
cttgtgccatagtcacatg

SEQ ID NO: 2849584 - DNA, 17 bp, Homo sapiens
cttgtgtctctgtgctt

SEQ ID NO: 2849585 - DNA, 18 bp, Homo sapiens
cttgtgtctgtacacgtg

SEQ ID NO: 2849586 - DNA, 22 bp, Homo sapiens
cttgtgtttttaactcaatatt

SEQ ID NO: 2849587 - DNA, 13 bp, Homo sapiens
cttgttctactca

SEQ ID NO: 2849588 - DNA, 22 bp, Homo sapiens
cttgttctactcatatatatct

SEQ ID NO: 2849589 - DNA, 13 bp, Homo sapiens
cttgttctgtcac

SEQ ID NO: 2849590 - DNA, 23 bp, Homo sapiens
cttgttgctgagtctgcagatga

SEQ ID NO: 2849591 - DNA, 22 bp, Homo sapiens
cttgtttgattttagctgcaga

SEQ ID NO: 2849592 - DNA, 18 bp, Homo sapiens
cttgtttggggcaggagt

SEQ ID NO: 2849593 - DNA, 19 bp, Homo sapiens
cttgtttggggcaggagta

SEQ ID NO: 2849594 - DNA, 14 bp, Homo sapiens
cttgtttgttctag

SEQ ID NO: 2849595 - DNA, 14 bp, Homo sapiens
cttgttttcagttt

SEQ ID NO: 2849596 - DNA, 15 bp, Homo sapiens
ctttaaaataaaata

SEQ ID NO: 2849597 - DNA, 16 bp, Homo sapiens
ctttaaagtacctgta

SEQ ID NO: 2849598 - DNA, 17 bp, Homo sapiens
ctttaaagtacctgtag

SEQ ID NO: 2849599 - DNA, 23 bp, Homo sapiens
ctttaaagtacctgtagtgagaa

SEQ ID NO: 2849600 - DNA, 16 bp, Homo sapiens
ctttaaatcaaaagct

SEQ ID NO: 2849601 - DNA, 23 bp, Homo sapiens
ctttaaccgtttttcaagaaaac

SEQ ID NO: 2849602 - DNA, 12 bp, Homo sapiens
ctttaaggaaaa

SEQ ID NO: 2849603 - DNA, 16 bp, Homo sapiens
ctttaagtattgtttt

SEQ ID NO: 2849604 - DNA, 12 bp, Homo sapiens
ctttaatataaa

SEQ ID NO: 2849605 - DNA, 14 bp, Homo sapiens
ctttaatcttcagt

SEQ ID NO: 2849606 - DNA, 17 bp, Homo sapiens
ctttaatcttcagtttt

SEQ ID NO: 2849607 - DNA, 22 bp, Homo sapiens
ctttaatcttcagttttatctt

SEQ ID NO: 2849608 - DNA, 20 bp, Homo sapiens
ctttaatgtcacaggcaggt

SEQ ID NO: 2849609 - DNA, 17 bp, Homo sapiens
ctttaattctcatgtga

SEQ ID NO: 2849610 - DNA, 20 bp, Homo sapiens
ctttacagatgagattccct

SEQ ID NO: 2849611 - DNA, 20 bp, Homo sapiens
ctttacatggggttttcaat

SEQ ID NO: 2849612 - DNA, 18 bp, Homo sapiens
ctttagaatgagagtgtg

SEQ ID NO: 2849613 - DNA, 15 bp, Homo sapiens
ctttagcgcccagtt

SEQ ID NO: 2849614 - DNA, 15 bp, Homo sapiens
ctttaggagcagtgg

SEQ ID NO: 2849615 - DNA, 12 bp, Homo sapiens
ctttataaactt

SEQ ID NO: 2849616 - DNA, 22 bp, Homo sapiens
ctttatcagtgatggtctcaca

SEQ ID NO: 2849617 - DNA, 23 bp, Homo sapiens
ctttatgactgtttttgtagtgg

SEQ ID NO: 2849618 - DNA, 17 bp, Homo sapiens
ctttattaaaaactgag

SEQ ID NO: 2849619 - DNA, 22 bp, Homo sapiens
ctttattaatgaactgtgacag

SEQ ID NO: 2849620 - DNA, 21 bp, Homo sapiens
ctttattcctccctcatgagc

SEQ ID NO: 2849621 - DNA, 14 bp, Homo sapiens
ctttattgtgatct

SEQ ID NO: 2849622 - DNA, 17 bp, Homo sapiens
ctttcaacttaaatcac

SEQ ID NO: 2849623 - DNA, 19 bp, Homo sapiens
ctttcaacttaaatcactg

SEQ ID NO: 2849624 - DNA, 20 bp, Homo sapiens
ctttcaacttaaatcactga

SEQ ID NO: 2849625 - DNA, 21 bp, Homo sapiens
ctttcaatggtttgcaaggaa

SEQ ID NO: 2849626 - DNA, 22 bp, Homo sapiens
ctttcaatggtttgcaaggaag

SEQ ID NO: 2849627 - DNA, 20 bp, Homo sapiens
ctttcacaaaattttattcc

SEQ ID NO: 2849628 - DNA, 21 bp, Homo sapiens
ctttttaaaaagttgcacatt

SEQ ID NO: 2849629 - DNA, 18 bp, Homo sapiens
ctttttagtcttttactc

SEQ ID NO: 2849630 - DNA, 12 bp, Homo sapiens
ctttttatactc

SEQ ID NO: 2849631 - DNA, 21 bp, Homo sapiens
ctttttcagagttgctttaaa

SEQ ID NO: 2849632 - DNA, 16 bp, Homo sapiens
ctttttctttataaac

SEQ ID NO: 2849633 - DNA, 22 bp, Homo sapiens
ctttttgtgaaattcaacctgt

SEQ ID NO: 2849634 - DNA, 16 bp, Homo sapiens
cttttttcttatttaa

SEQ ID NO: 2849635 - DNA, 21 bp, Homo sapiens
gaaaaaaaaagtcagactgct

SEQ ID NO: 2849636 - DNA, 15 bp, Homo sapiens
gaaaaaaaagaaagc

SEQ ID NO: 2849637 - DNA, 19 bp, Homo sapiens
gaaaaaaaagtttcagaga

SEQ ID NO: 2849638 - DNA, 22 bp, Homo sapiens
gaaaaaaaagtttcagagaagt

SEQ ID NO: 2849639 - DNA, 18 bp, Homo sapiens
gaaaaaccaatgattcat

SEQ ID NO: 2849640 - DNA, 10 bp, Homo sapiens
gaaaaatatg

SEQ ID NO: 2849641 - DNA, 15 bp, Homo sapiens
gaaaaatatgatatt

SEQ ID NO: 2849642 - DNA, 19 bp, Homo sapiens
gaaaacatcactgaaatgc

SEQ ID NO: 2849643 - DNA, 17 bp, Homo sapiens
gaaaacattcatccagt

SEQ ID NO: 2849644 - DNA, 14 bp, Homo sapiens
gaaaacccagagag

SEQ ID NO: 2849645 - DNA, 11 bp, Homo sapiens
gaaaacctttc

SEQ ID NO: 2849646 - DNA, 16 bp, Homo sapiens
gaaaactgacagagga

SEQ ID NO: 2849647 - DNA, 17 bp, Homo sapiens
gaaaactggaataagaa

SEQ ID NO: 2849648 - DNA, 12 bp, Homo sapiens
gaaaactttaaa

SEQ ID NO: 2849649 - DNA, 19 bp, Homo sapiens
gaaaagaatacagaaagat

SEQ ID NO: 2849650 - DNA, 20 bp, Homo sapiens
gaaaagaggagtttcgaggt

SEQ ID NO: 2849651 - DNA, 14 bp, Homo sapiens
gaaaagcacctgcc

SEQ ID NO: 2849652 - DNA, 17 bp, Homo sapiens
gaaaagctgctgacagt

SEQ ID NO: 2849653 - DNA, 22 bp, Homo sapiens
gaaaaggcatggagacagcgaa

SEQ ID NO: 2849654 - DNA, 13 bp, Homo sapiens
gaaaaggcctggg

SEQ ID NO: 2849655 - DNA, 14 bp, Homo sapiens
gaaaaggcctgggg

SEQ ID NO: 2849656 - DNA, 16 bp, Homo sapiens
gaaaaggcctggggtg

SEQ ID NO: 2849657 - DNA, 18 bp, Homo sapiens
gaaaagtagaattatatc

SEQ ID NO: 2849658 - DNA, 22 bp, Homo sapiens
gaaaagtagaattatatctaat

SEQ ID NO: 2849659 - DNA, 16 bp, Homo sapiens
gaaaagtcacacagac

SEQ ID NO: 2849660 - DNA, 21 bp, Homo sapiens
gaaaagtcacacagacacaca

SEQ ID NO: 2849661 - DNA, 13 bp, Homo sapiens
gaaaataattgtt

SEQ ID NO: 2849662 - DNA, 17 bp, Homo sapiens
gaaaataattgttccaa

SEQ ID NO: 2849663 - DNA, 16 bp, Homo sapiens
gaaaatataaatgcat

SEQ ID NO: 2849664 - DNA, 20 bp, Homo sapiens
gaaaatataaatgcatgatt

SEQ ID NO: 2849665 - DNA, 21 bp, Homo sapiens
gaaaatataaatgcatgattt

SEQ ID NO: 2849666 - DNA, 13 bp, Homo sapiens
gaaaatcctctgg

SEQ ID NO: 2849667 - DNA, 23 bp, Homo sapiens
gaaaatgagtttttatggggctg

SEQ ID NO: 2849668 - DNA, 20 bp, Homo sapiens
gaaaatgcaacaacatgtat

SEQ ID NO: 2849669 - DNA, 21 bp, Homo sapiens
gaaaatgtcagaaaccagtta

SEQ ID NO: 2849670 - DNA, 14 bp, Homo sapiens
gaaacaaaaacact

SEQ ID NO: 2849671 - DNA, 17 bp, Homo sapiens
gaaacaaataatcacat

SEQ ID NO: 2849672 - DNA, 17 bp, Homo sapiens
gaaacacctcccagggg

SEQ ID NO: 2849673 - DNA, 22 bp, Homo sapiens
gaaacagaaacaaaaacactaa

SEQ ID NO: 2849674 - DNA, 14 bp, Homo sapiens
gaaacagagacagg

SEQ ID NO: 2849675 - DNA, 16 bp, Homo sapiens
gaaacagagacaggcc

SEQ ID NO: 2849676 - DNA, 22 bp, Homo sapiens
gaaacagaggcgtctcacattt

SEQ ID NO: 2849677 - DNA, 23 bp, Homo sapiens
gaaaccagccgaccggccctgcc

SEQ ID NO: 2849678 - DNA, 17 bp, Homo sapiens
gaaaccgtaattttatt

SEQ ID NO: 2849679 - DNA, 19 bp, Homo sapiens
gaaaccttattgtacctct

SEQ ID NO: 2849680 - DNA, 22 bp, Homo sapiens
gaaacgtacttaactgtgtgaa

SEQ ID NO: 2849681 - DNA, 13 bp, Homo sapiens
gaaactggccagg

SEQ ID NO: 2849682 - DNA, 23 bp, Homo sapiens
gaaagaaacgtacttaactgtgt

SEQ ID NO: 2849683 - DNA, 16 bp, Homo sapiens
gaaagaaataattgtt

SEQ ID NO: 2849684 - DNA, 15 bp, Homo sapiens
gaaagaagagacagg

SEQ ID NO: 2849685 - DNA, 18 bp, Homo sapiens
gaaagaaggacacttgta

SEQ ID NO: 2849686 - DNA, 14 bp, Homo sapiens
gaaagacagagctg

SEQ ID NO: 2849687 - DNA, 21 bp, Homo sapiens
gaaagacggattgcattagaa

SEQ ID NO: 2849688 - DNA, 13 bp, Homo sapiens
gaaagactgaaag

SEQ ID NO: 2849689 - DNA, 10 bp, Homo sapiens
gaaagagacc

SEQ ID NO: 2849690 - DNA, 11 bp, Homo sapiens
gaaagagacca

SEQ ID NO: 2849691 - DNA, 19 bp, Homo sapiens
gaaagaggtgaccccaggg

SEQ ID NO: 2849692 - DNA, 23 bp, Homo sapiens
gaaagatggctgtgcctctgcct

SEQ ID NO: 2849693 - DNA, 19 bp, Homo sapiens
gaaagcatcacctcaggcc

SEQ ID NO: 2849694 - DNA, 22 bp, Homo sapiens
gaaagcatgtggcatgttcatc

SEQ ID NO: 2849695 - DNA, 15 bp, Homo sapiens
gaaagcctctggaaa

SEQ ID NO: 2849696 - DNA, 16 bp, Homo sapiens
gaaagctagagatatg

SEQ ID NO: 2849697 - DNA, 15 bp, Homo sapiens
gaaagctgtttattt

SEQ ID NO: 2849698 - DNA, 21 bp, Homo sapiens
gaaagctgtttatttattcac

SEQ ID NO: 2849699 - DNA, 17 bp, Homo sapiens
gaaagcttcaaactgca

SEQ ID NO: 2849700 - DNA, 14 bp, Homo sapiens
gaaaggattcatgt

SEQ ID NO: 2849701 - DNA, 18 bp, Homo sapiens
gaaaggctcagtctcagg

SEQ ID NO: 2849702 - DNA, 21 bp, Homo sapiens
gaaaggctcagtctcaggagc

SEQ ID NO: 2849703 - DNA, 19 bp, Homo sapiens
gaaaggctctgaaagccag

SEQ ID NO: 2849704 - DNA, 13 bp, Homo sapiens
gaaagggagggct

SEQ ID NO: 2849705 - DNA, 19 bp, Homo sapiens
gaaagggtcaacggccctg

SEQ ID NO: 2849706 - DNA, 17 bp, Homo sapiens
gaaagtcagatgcccag

SEQ ID NO: 2849707 - DNA, 15 bp, Homo sapiens
gaaagtgaataaact

SEQ ID NO: 2849708 - DNA, 17 bp, Homo sapiens
gaaagtgtaaaatagaa

SEQ ID NO: 2849709 - DNA, 11 bp, Homo sapiens
gaaagtttctt

SEQ ID NO: 2849710 - DNA, 22 bp, Homo sapiens
gaaagtttcttggtctcagctt

SEQ ID NO: 2849711 - DNA, 18 bp, Homo sapiens
gaaataaaacctttcaaa

SEQ ID NO: 2849712 - DNA, 21 bp, Homo sapiens
gaaataaatgtatcatagaaa

SEQ ID NO: 2849713 - DNA, 21 bp, Homo sapiens
gaaataaattggtgataagtg

SEQ ID NO: 2849714 - DNA, 21 bp, Homo sapiens
gaaataagtttttgtttcaca

SEQ ID NO: 2849715 - DNA, 13 bp, Homo sapiens
gaaatatttaagt

SEQ ID NO: 2849716 - DNA, 18 bp, Homo sapiens
gaaatatttgcttattta

SEQ ID NO: 2849717 - DNA, 20 bp, Homo sapiens
gaaatatttgcttatttata

SEQ ID NO: 2849718 - DNA, 20 bp, Homo sapiens
gaaatccagtttcccaccac

SEQ ID NO: 2849719 - DNA, 23 bp, Homo sapiens
gaagaaagaggtgaccccagggc

SEQ ID NO: 2849720 - DNA, 16 bp, Homo sapiens
gaagaacatccaagga

SEQ ID NO: 2849721 - DNA, 17 bp, Homo sapiens
gaagaacatccaaggag

SEQ ID NO: 2849722 - DNA, 22 bp, Homo sapiens
gaagaagggaaattcacactgt

SEQ ID NO: 2849723 - DNA, 19 bp, Homo sapiens
gaagaagtttcatcatttt

SEQ ID NO: 2849724 - DNA, 23 bp, Homo sapiens
gaagaatacttctcattttttaa

SEQ ID NO: 2849725 - DNA, 13 bp, Homo sapiens
gaagaatataaat

SEQ ID NO: 2849726 - DNA, 14 bp, Homo sapiens
gaagaatattcagg

SEQ ID NO: 2849727 - DNA, 14 bp, Homo sapiens
gaagaatattgtta

SEQ ID NO: 2849728 - DNA, 24 bp, Homo sapiens
gaagaatgcttaatcagatagata

SEQ ID NO: 2849729 - DNA, 18 bp, Homo sapiens
gaagaattgaacccagga

SEQ ID NO: 2849730 - DNA, 19 bp, Homo sapiens
gaagaattgaacccaggag

SEQ ID NO: 2849731 - DNA, 12 bp, Homo sapiens
gaagacacagac

SEQ ID NO: 2849732 - DNA, 20 bp, Homo sapiens
gaagacatggagactcctgc

SEQ ID NO: 2849733 - DNA, 21 bp, Homo sapiens
gaagacatggagactcctgcc

SEQ ID NO: 2849734 - DNA, 20 bp, Homo sapiens
gaagaccacatccacacacg

SEQ ID NO: 2849735 - DNA, 18 bp, Homo sapiens
gaagaccagactgtggag

SEQ ID NO: 2849736 - DNA, 15 bp, Homo sapiens
gaagacccagcagga

SEQ ID NO: 2849737 - DNA, 18 bp, Homo sapiens
gaagacccagtgtaaaga

SEQ ID NO: 2849738 - DNA, 14 bp, Homo sapiens
gaagaccctccccg

SEQ ID NO: 2849739 - DNA, 16 bp, Homo sapiens
gaagaccgaattttat

SEQ ID NO: 2849740 - DNA, 11 bp, Homo sapiens
gaagactgtgg

SEQ ID NO: 2849741 - DNA, 13 bp, Homo sapiens
gaagagagaaaca

SEQ ID NO: 2849742 - DNA, 18 bp, Homo sapiens
gaagagcaggcacatgga

SEQ ID NO: 2849743 - DNA, 17 bp, Homo sapiens
gaagagcctgactgtgt

SEQ ID NO: 2849744 - DNA, 10 bp, Homo sapiens
gaagaggact

SEQ ID NO: 2849745 - DNA, 16 bp, Homo sapiens
gaagagtcaggaaggg

SEQ ID NO: 2849746 - DNA, 13 bp, Homo sapiens
gaagatgaaagag

SEQ ID NO: 2849747 - DNA, 15 bp, Homo sapiens
gaagcaaataaatat

SEQ ID NO: 2849748 - DNA, 17 bp, Homo sapiens
gaagcaaatcgaatgaa

SEQ ID NO: 2849749 - DNA, 22 bp, Homo sapiens
gaagcaacctcagtaatttaga

SEQ ID NO: 2849750 - DNA, 14 bp, Homo sapiens
gaagcactgctgtg

SEQ ID NO: 2849751 - DNA, 17 bp, Homo sapiens
gaagcagtgccttccat

SEQ ID NO: 2849752 - DNA, 17 bp, Homo sapiens
gaagcatttactttgtg

SEQ ID NO: 2849753 - DNA, 18 bp, Homo sapiens
gaagcatttactttgtgt

SEQ ID NO: 2849754 - DNA, 13 bp, Homo sapiens
gaagcatttgttt

SEQ ID NO: 2849755 - DNA, 15 bp, Homo sapiens
gaagccactgaagct

SEQ ID NO: 2849756 - DNA, 18 bp, Homo sapiens
gaagccactgaagctggg

SEQ ID NO: 2849757 - DNA, 15 bp, Homo sapiens
gaagccaggagcaaa

SEQ ID NO: 2849758 - DNA, 13 bp, Homo sapiens
gaagccaggctga

SEQ ID NO: 2849759 - DNA, 16 bp, Homo sapiens
gaagcccatgctttcc

SEQ ID NO: 2849760 - DNA, 12 bp, Homo sapiens
gaagccctcctt

SEQ ID NO: 2849761 - DNA, 15 bp, Homo sapiens
gaagccctccttcca

SEQ ID NO: 2849762 - DNA, 21 bp, Homo sapiens
gaagccctggatttcagaaag

SEQ ID NO: 2849763 - DNA, 22 bp, Homo sapiens
gaagccctggatttcagaaaga

SEQ ID NO: 2849764 - DNA, 16 bp, Homo sapiens
gaagcccttccagtgg

SEQ ID NO: 2849765 - DNA, 16 bp, Homo sapiens
gaagccgggaacagac

SEQ ID NO: 2849766 - DNA, 19 bp, Homo sapiens
gaagcctgggggcctggct

SEQ ID NO: 2849767 - DNA, 19 bp, Homo sapiens
gaagctaacagggaaggca

SEQ ID NO: 2849768 - DNA, 20 bp, Homo sapiens
gaagctattgatgtttccag

SEQ ID NO: 2849769 - DNA, 22 bp, Homo sapiens
gaagctccgctttctacccagc

SEQ ID NO: 2849770 - DNA, 24 bp, Homo sapiens
gaagctgtgtccttgcacctgcat

SEQ ID NO: 2849771 - DNA, 19 bp, Homo sapiens
gaaggaaagaaagaaggaa

SEQ ID NO: 2849772 - DNA, 22 bp, Homo sapiens
gaaggagactcacctctgcctc

SEQ ID NO: 2849773 - DNA, 21 bp, Homo sapiens
gaaggcacaggtgtaaatata

SEQ ID NO: 2849774 - DNA, 17 bp, Homo sapiens
gaaggcagcaggtggca

SEQ ID NO: 2849775 - DNA, 23 bp, Homo sapiens
gaaggcaggcagggctctcctgg

SEQ ID NO: 2849776 - DNA, 21 bp, Homo sapiens
gaaggccgctgccccagcccc

SEQ ID NO: 2849777 - DNA, 13 bp, Homo sapiens
gaaggctggctgg

SEQ ID NO: 2849778 - DNA, 15 bp, Homo sapiens
gaagggaaaacagtc

SEQ ID NO: 2849779 - DNA, 17 bp, Homo sapiens
gaagggaccttgaaggg

SEQ ID NO: 2849780 - DNA, 15 bp, Homo sapiens
gaagggcaccgagaa

SEQ ID NO: 2849781 - DNA, 13 bp, Homo sapiens
gaagggtaaagaa

SEQ ID NO: 2849782 - DNA, 13 bp, Homo sapiens
gaaggtagcccag

SEQ ID NO: 2849783 - DNA, 19 bp, Homo sapiens
gaaggtagcccagcactgt

SEQ ID NO: 2849784 - DNA, 21 bp, Homo sapiens
gaaggtcactcttcctgcaag

SEQ ID NO: 2849785 - DNA, 22 bp, Homo sapiens
gaaggtgccccaaaatgcaaga

SEQ ID NO: 2849786 - DNA, 21 bp, Homo sapiens
gaaggtttttatgtgcctttt

SEQ ID NO: 2849787 - DNA, 17 bp, Homo sapiens
gaagtaagttctgaaaa

SEQ ID NO: 2849788 - DNA, 20 bp, Homo sapiens
gaagtatccaattatgtgac

SEQ ID NO: 2849789 - DNA, 22 bp, Homo sapiens
gaagtatccaattatgtgacaa

SEQ ID NO: 2849790 - DNA, 13 bp, Homo sapiens
gaagtcacacagt

SEQ ID NO: 2849791 - DNA, 19 bp, Homo sapiens
gaagtcatgaagcccaagt

SEQ ID NO: 2849792 - DNA, 23 bp, Homo sapiens
gaagtcgtccttactcctgtggg

SEQ ID NO: 2849793 - DNA, 24 bp, Homo sapiens
gaagtcgtccttactcctgtggga

SEQ ID NO: 2849794 - DNA, 18 bp, Homo sapiens
gaagtgcaaatttgatac

SEQ ID NO: 2849795 - DNA, 18 bp, Homo sapiens
gaagtggaccaggacagg

SEQ ID NO: 2849796 - DNA, 18 bp, Homo sapiens
gaagtgggccaggacagg

SEQ ID NO: 2849797 - DNA, 18 bp, Homo sapiens
gaagtggtaggaaagcct

SEQ ID NO: 2849798 - DNA, 15 bp, Homo sapiens
gaagttaacagagac

SEQ ID NO: 2849799 - DNA, 23 bp, Homo sapiens
gaagttaagcagcctttctgtgg

SEQ ID NO: 2849800 - DNA, 17 bp, Homo sapiens
gaagttagctttaactt

SEQ ID NO: 2849801 - DNA, 19 bp, Homo sapiens
gaagttagctttaacttaa

SEQ ID NO: 2849802 - DNA, 13 bp, Homo sapiens
gaagttttcagga

SEQ ID NO: 2849803 - DNA, 17 bp, Homo sapiens
gaagttttgcatttatg

SEQ ID NO: 2849804 - DNA, 20 bp, Homo sapiens
gaataaaaaacatttgtaca

SEQ ID NO: 2849805 - DNA, 14 bp, Homo sapiens
gaataaaaaccctg

SEQ ID NO: 2849806 - DNA, 15 bp, Homo sapiens
gaataaacttcagca

SEQ ID NO: 2849807 - DNA, 14 bp, Homo sapiens
gaataaagttctga

SEQ ID NO: 2849808 - DNA, 16 bp, Homo sapiens
gaataaagttgaagct

SEQ ID NO: 2849809 - DNA, 21 bp, Homo sapiens
gaccaagatgatcacatggaa

SEQ ID NO: 2849810 - DNA, 21 bp, Homo sapiens
gaccaagttataaatcaatgt

SEQ ID NO: 2849811 - DNA, 17 bp, Homo sapiens
gaccaccagccccagca

SEQ ID NO: 2849812 - DNA, 19 bp, Homo sapiens
gaccaccagccccagcaag

SEQ ID NO: 2849813 - DNA, 14 bp, Homo sapiens
gaccacctgcccaa

SEQ ID NO: 2849814 - DNA, 19 bp, Homo sapiens
gaccacctgcttctgaact

SEQ ID NO: 2849815 - DNA, 14 bp, Homo sapiens
gaccacgctttcta

SEQ ID NO: 2849816 - DNA, 22 bp, Homo sapiens
gaccagacaccttgacagggca

SEQ ID NO: 2849817 - DNA, 17 bp, Homo sapiens
gaccagaggaagcccct

SEQ ID NO: 2849818 - DNA, 23 bp, Homo sapiens
gaccaggcatcctccacaatagc

SEQ ID NO: 2849819 - DNA, 23 bp, Homo sapiens
gaccaggggtgatttcagagagg

SEQ ID NO: 2849820 - DNA, 20 bp, Homo sapiens
gaccagttgggagcactgga

SEQ ID NO: 2849821 - DNA, 14 bp, Homo sapiens
gaccatcctgtcct

SEQ ID NO: 2849822 - DNA, 15 bp, Homo sapiens
gaccatcctgtcctt

SEQ ID NO: 2849823 - DNA, 13 bp, Homo sapiens
gacccaaggagga

SEQ ID NO: 2849824 - DNA, 23 bp, Homo sapiens
gacccagccccttgagaaacctt

SEQ ID NO: 2849825 - DNA, 11 bp, Homo sapiens
gaccccagggc

SEQ ID NO: 2849826 - DNA, 13 bp, Homo sapiens
gaccccagggcac

SEQ ID NO: 2849827 - DNA, 12 bp, Homo sapiens
gacccccaacca

SEQ ID NO: 2849828 - DNA, 21 bp, Homo sapiens
gacccccaaccaagtggctcc

SEQ ID NO: 2849829 - DNA, 23 bp, Homo sapiens
gacccccactctcattccccagg

SEQ ID NO: 2849830 - DNA, 20 bp, Homo sapiens
gacccctggaccaccagccc

SEQ ID NO: 2849831 - DNA, 18 bp, Homo sapiens
gaccccttcctttcctct

SEQ ID NO: 2849832 - DNA, 21 bp, Homo sapiens
gacccggcaccccctgcagct

SEQ ID NO: 2849833 - DNA, 13 bp, Homo sapiens
gacccggctgcgt

SEQ ID NO: 2849834 - DNA, 14 bp, Homo sapiens
gaccctacaggaga

SEQ ID NO: 2849835 - DNA, 15 bp, Homo sapiens
gaccctacaggagag

SEQ ID NO: 2849836 - DNA, 19 bp, Homo sapiens
gaccctcactgctggggag

SEQ ID NO: 2849837 - DNA, 17 bp, Homo sapiens
gaccctcctgtccagca

SEQ ID NO: 2849838 - DNA, 20 bp, Homo sapiens
gaccctctgaatggtccagg

SEQ ID NO: 2849839 - DNA, 23 bp, Homo sapiens
gaccctctgaatggtccagggtt

SEQ ID NO: 2849840 - DNA, 20 bp, Homo sapiens
gaccctgcgaaggggccctg

SEQ ID NO: 2849841 - DNA, 21 bp, Homo sapiens
gaccctgcgaaggggccctgg

SEQ ID NO: 2849842 - DNA, 19 bp, Homo sapiens
gaccgctacaccactctgg

SEQ ID NO: 2849843 - DNA, 23 bp, Homo sapiens
gaccgctacaccactctggcagc

SEQ ID NO: 2849844 - DNA, 23 bp, Homo sapiens
gacctatgtcctaaggacacact

SEQ ID NO: 2849845 - DNA, 12 bp, Homo sapiens
gacctcagcctg

SEQ ID NO: 2849846 - DNA, 19 bp, Homo sapiens
gacctcagcctgtgctgcc

SEQ ID NO: 2849847 - DNA, 20 bp, Homo sapiens
gacctcaggtgatccaccca

SEQ ID NO: 2849848 - DNA, 16 bp, Homo sapiens
gacctccagctttcct

SEQ ID NO: 2849849 - DNA, 21 bp, Homo sapiens
gacctcccagccctatggatg

SEQ ID NO: 2849850 - DNA, 23 bp, Homo sapiens
gacctcccagccctatggatgtg

SEQ ID NO: 2849851 - DNA, 17 bp, Homo sapiens
gacctcctaacaagtag

SEQ ID NO: 2849852 - DNA, 16 bp, Homo sapiens
gacctcctcctgccct

SEQ ID NO: 2849853 - DNA, 18 bp, Homo sapiens
gacctcgtcctccccctg

SEQ ID NO: 2849854 - DNA, 19 bp, Homo sapiens
gacctcgtcctccccctgc

SEQ ID NO: 2849855 - DNA, 21 bp, Homo sapiens
gacctcgtcctccccctgcca

SEQ ID NO: 2849856 - DNA, 13 bp, Homo sapiens
gacctctgcctga

SEQ ID NO: 2849857 - DNA, 11 bp, Homo sapiens
gacctgagcct

SEQ ID NO: 2849858 - DNA, 18 bp, Homo sapiens
gacctgagcctgccgagc

SEQ ID NO: 2849859 - DNA, 17 bp, Homo sapiens
gacctgctgagctctga

SEQ ID NO: 2849860 - DNA, 19 bp, Homo sapiens
gacctgctgagctctgaga

SEQ ID NO: 2849861 - DNA, 20 bp, Homo sapiens
gacctggttggccgtggtcc

SEQ ID NO: 2849862 - DNA, 18 bp, Homo sapiens
gacctgtctccctggggt

SEQ ID NO: 2849863 - DNA, 15 bp, Homo sapiens
gaccttctgaagatc

SEQ ID NO: 2849864 - DNA, 19 bp, Homo sapiens
gaccttgaagggtaaagaa

SEQ ID NO: 2849865 - DNA, 16 bp, Homo sapiens
gaccttggtggtggga

SEQ ID NO: 2849866 - DNA, 14 bp, Homo sapiens
gaccttgttgcatg

SEQ ID NO: 2849867 - DNA, 21 bp, Homo sapiens
gacgagggatgggatttcatg

SEQ ID NO: 2849868 - DNA, 19 bp, Homo sapiens
gacgcaagggcctgatggg

SEQ ID NO: 2849869 - DNA, 16 bp, Homo sapiens
gacgccactcatttca

SEQ ID NO: 2849870 - DNA, 18 bp, Homo sapiens
gacgccactcatttcatc

SEQ ID NO: 2849871 - DNA, 20 bp, Homo sapiens
gacgcccagctgaggctggg

SEQ ID NO: 2849872 - DNA, 16 bp, Homo sapiens
gacggaggttgcagtg

SEQ ID NO: 2849873 - DNA, 21 bp, Homo sapiens
gacggaggttgcagtgagccg

SEQ ID NO: 2849874 - DNA, 23 bp, Homo sapiens
gacggagtcccaccttggctgca

SEQ ID NO: 2849875 - DNA, 17 bp, Homo sapiens
gacggttaacttgtata

SEQ ID NO: 2849876 - DNA, 23 bp, Homo sapiens
gacggttaacttgtatattccac

SEQ ID NO: 2849877 - DNA, 22 bp, Homo sapiens
gactaacactcagaagcctggg

SEQ ID NO: 2849878 - DNA, 23 bp, Homo sapiens
gactaagccctgtcgagacactt

SEQ ID NO: 2849879 - DNA, 17 bp, Homo sapiens
gactagaggcagggagg

SEQ ID NO: 2849880 - DNA, 20 bp, Homo sapiens
gactagaggcagggagggga

SEQ ID NO: 2849881 - DNA, 15 bp, Homo sapiens
gactaggaggttccg

SEQ ID NO: 2849882 - DNA, 16 bp, Homo sapiens
gactataaacattaaa

SEQ ID NO: 2849883 - DNA, 18 bp, Homo sapiens
gactatcacatacaattt

SEQ ID NO: 2849884 - DNA, 19 bp, Homo sapiens
gactatgtgtcatgatttc

SEQ ID NO: 2849885 - DNA, 15 bp, Homo sapiens
gactcaagccccgga

SEQ ID NO: 2849886 - DNA, 18 bp, Homo sapiens
gactcaagtttttacaaa

SEQ ID NO: 2849887 - DNA, 12 bp, Homo sapiens
gactcacccaag

SEQ ID NO: 2849888 - DNA, 13 bp, Homo sapiens
gactcacctctgc

SEQ ID NO: 2849889 - DNA, 17 bp, Homo sapiens
gactcacctctgcctca

SEQ ID NO: 2849890 - DNA, 18 bp, Homo sapiens
gactcacctctgcctcaa

SEQ ID NO: 2849891 - DNA, 12 bp, Homo sapiens
gactcagctctg

SEQ ID NO: 2849892 - DNA, 23 bp, Homo sapiens
gactcagctctgacattctgatt

SEQ ID NO: 2849893 - DNA, 12 bp, Homo sapiens
gactcagggacc

SEQ ID NO: 2849894 - DNA, 20 bp, Homo sapiens
gactcagggccccagcacta

SEQ ID NO: 2849895 - DNA, 14 bp, Homo sapiens
gactcattcttctg

SEQ ID NO: 2849896 - DNA, 15 bp, Homo sapiens
gactcattcttctgt

SEQ ID NO: 2849897 - DNA, 13 bp, Homo sapiens
gactccagccagc

SEQ ID NO: 2849898 - DNA, 21 bp, Homo sapiens
gactccagccagcgcctccct

SEQ ID NO: 2849899 - DNA, 23 bp, Homo sapiens
gagccctggcaggatgaccctgc

SEQ ID NO: 2849900 - DNA, 16 bp, Homo sapiens
gagccctggtggcagt

SEQ ID NO: 2849901 - DNA, 21 bp, Homo sapiens
gagccgagatcacgccactgc

SEQ ID NO: 2849902 - DNA, 22 bp, Homo sapiens
gagccgagatcacgccactgca

SEQ ID NO: 2849903 - DNA, 14 bp, Homo sapiens
gagccgggcctggg

SEQ ID NO: 2849904 - DNA, 13 bp, Homo sapiens
gagcctcagcatc

SEQ ID NO: 2849905 - DNA, 17 bp, Homo sapiens
gagcctcatccgaggca

SEQ ID NO: 2849906 - DNA, 18 bp, Homo sapiens
gagcctcatccgaggcag

SEQ ID NO: 2849907 - DNA, 20 bp, Homo sapiens
gagcctcatccgaggcaggg

SEQ ID NO: 2849908 - DNA, 23 bp, Homo sapiens
gagcctcgcaacccgtgccaagt

SEQ ID NO: 2849909 - DNA, 17 bp, Homo sapiens
gagcctcggtggccatg

SEQ ID NO: 2849910 - DNA, 18 bp, Homo sapiens
gagcctcggtggccatgc

SEQ ID NO: 2849911 - DNA, 20 bp, Homo sapiens
gagcctgactgtgttcagtg

SEQ ID NO: 2849912 - DNA, 16 bp, Homo sapiens
gagcctgaggcatgag

SEQ ID NO: 2849913 - DNA, 18 bp, Homo sapiens
gagcctgccgagcaaccg

SEQ ID NO: 2849914 - DNA, 13 bp, Homo sapiens
gagcctggagaag

SEQ ID NO: 2849915 - DNA, 15 bp, Homo sapiens
gagcctggggctcta

SEQ ID NO: 2849916 - DNA, 19 bp, Homo sapiens
gagcctgtctttcagcatt

SEQ ID NO: 2849917 - DNA, 20 bp, Homo sapiens
gagcctgtgaacccaggaca

SEQ ID NO: 2849918 - DNA, 19 bp, Homo sapiens
gagcctgtgcctcctcacc

SEQ ID NO: 2849919 - DNA, 21 bp, Homo sapiens
gagccttcacaaccagccaca

SEQ ID NO: 2849920 - DNA, 19 bp, Homo sapiens
gagccttggtgtccacctg

SEQ ID NO: 2849921 - DNA, 18 bp, Homo sapiens
gagcgcacctgccccctg

SEQ ID NO: 2849922 - DNA, 23 bp, Homo sapiens
gagcgccctgcagaccctgccct

SEQ ID NO: 2849923 - DNA, 18 bp, Homo sapiens
gagcgctttctggaaaag

SEQ ID NO: 2849924 - DNA, 19 bp, Homo sapiens
gagctaaattacaattgtc

SEQ ID NO: 2849925 - DNA, 14 bp, Homo sapiens
gagctagcgctgcc

SEQ ID NO: 2849926 - DNA, 18 bp, Homo sapiens
gagctagcgctgccgcac

SEQ ID NO: 2849927 - DNA, 17 bp, Homo sapiens
gagctaggagcaaagcc

SEQ ID NO: 2849928 - DNA, 19 bp, Homo sapiens
gagctaggagcaaagcctg

SEQ ID NO: 2849929 - DNA, 14 bp, Homo sapiens
gagctcacaaggca

SEQ ID NO: 2849930 - DNA, 18 bp, Homo sapiens
gagctcacaaggcagcaa

SEQ ID NO: 2849931 - DNA, 14 bp, Homo sapiens
gagctcagaccccc

SEQ ID NO: 2849932 - DNA, 18 bp, Homo sapiens
gagctcagacccccactc

SEQ ID NO: 2849933 - DNA, 14 bp, Homo sapiens
gagctcaggacact

SEQ ID NO: 2849934 - DNA, 17 bp, Homo sapiens
gagctcaggacactaat

SEQ ID NO: 2849935 - DNA, 22 bp, Homo sapiens
gagctctgagaggccctggatc

SEQ ID NO: 2849936 - DNA, 17 bp, Homo sapiens
gagctgaggcaattcta

SEQ ID NO: 2849937 - DNA, 15 bp, Homo sapiens
gagctgcctgttcag

SEQ ID NO: 2849938 - DNA, 20 bp, Homo sapiens
gagcttgggggatgactaga

SEQ ID NO: 2849939 - DNA, 16 bp, Homo sapiens
gagcttgtacatattg

SEQ ID NO: 2849940 - DNA, 15 bp, Homo sapiens
gagctttcaaagaag

SEQ ID NO: 2849941 - DNA, 18 bp, Homo sapiens
gagctttcaaagaaggaa

SEQ ID NO: 2849942 - DNA, 21 bp, Homo sapiens
gagctttctgtccttttggca

SEQ ID NO: 2849943 - DNA, 13 bp, Homo sapiens
gaggaagagcagg

SEQ ID NO: 2849944 - DNA, 17 bp, Homo sapiens
gaggaagagcaggcaca

SEQ ID NO: 2849945 - DNA, 19 bp, Homo sapiens
gaggaagagcaggcacatg

SEQ ID NO: 2849946 - DNA, 19 bp, Homo sapiens
gaggaatatgactgttttt

SEQ ID NO: 2849947 - DNA, 12 bp, Homo sapiens
gaggacacatgt

SEQ ID NO: 2849948 - DNA, 14 bp, Homo sapiens
gaggacacatgtcc

SEQ ID NO: 2849949 - DNA, 18 bp, Homo sapiens
gaggacatgatggagcgc

SEQ ID NO: 2849950 - DNA, 12 bp, Homo sapiens
gaggacctgagc

SEQ ID NO: 2849951 - DNA, 13 bp, Homo sapiens
gaggacctgagcc

SEQ ID NO: 2849952 - DNA, 14 bp, Homo sapiens
gaggacctgagcct

SEQ ID NO: 2849953 - DNA, 16 bp, Homo sapiens
gaggacctgagcctgc

SEQ ID NO: 2849954 - DNA, 14 bp, Homo sapiens
gaggacttgtgtct

SEQ ID NO: 2849955 - DNA, 18 bp, Homo sapiens
gaggacttgtgtctctgt

SEQ ID NO: 2849956 - DNA, 20 bp, Homo sapiens
gaggacttttctttgtggct

SEQ ID NO: 2849957 - DNA, 16 bp, Homo sapiens
gaggagaccagctcag

SEQ ID NO: 2849958 - DNA, 20 bp, Homo sapiens
gaggagaggggaagggccag

SEQ ID NO: 2849959 - DNA, 20 bp, Homo sapiens
gaggagcttccagtgcatgt

SEQ ID NO: 2849960 - DNA, 21 bp, Homo sapiens
gaggagcttccagtgcatgtt

SEQ ID NO: 2849961 - DNA, 21 bp, Homo sapiens
gaggagcttgggggatgacta

SEQ ID NO: 2849962 - DNA, 20 bp, Homo sapiens
gaggagggcgtgactcaccc

SEQ ID NO: 2849963 - DNA, 18 bp, Homo sapiens
gaggagtccagggcggga

SEQ ID NO: 2849964 - DNA, 23 bp, Homo sapiens
gaggagtctgaggtcctgagcac

SEQ ID NO: 2849965 - DNA, 20 bp, Homo sapiens
gaggatgttctgggacacag

SEQ ID NO: 2849966 - DNA, 22 bp, Homo sapiens
gaggattgcttgagcccaggag

SEQ ID NO: 2849967 - DNA, 16 bp, Homo sapiens
gaggcaaacatttctt

SEQ ID NO: 2849968 - DNA, 19 bp, Homo sapiens
gaggcaatgtcaggaacag

SEQ ID NO: 2849969 - DNA, 15 bp, Homo sapiens
gaggcagacagcagc

SEQ ID NO: 2849970 - DNA, 19 bp, Homo sapiens
gaggcagacagcagctcag

SEQ ID NO: 2849971 - DNA, 18 bp, Homo sapiens
gaggcagccccattctgc

SEQ ID NO: 2849972 - DNA, 23 bp, Homo sapiens
gaggcagccccattctgcctgcc

SEQ ID NO: 2849973 - DNA, 9 bp, Homo sapiens
gaggcaggg

SEQ ID NO: 2849974 - DNA, 16 bp, Homo sapiens
gaggcagggaggggac

SEQ ID NO: 2849975 - DNA, 17 bp, Homo sapiens
gaggcagggccttgccc

SEQ ID NO: 2849976 - DNA, 14 bp, Homo sapiens
gaggcaggggcgga

SEQ ID NO: 2849977 - DNA, 15 bp, Homo sapiens
gaggcatggctgggg

SEQ ID NO: 2849978 - DNA, 15 bp, Homo sapiens
gaggccagcctggcc

SEQ ID NO: 2849979 - DNA, 22 bp, Homo sapiens
gaggccaggagtttgagaccag

SEQ ID NO: 2849980 - DNA, 13 bp, Homo sapiens
gaggccctggatc

SEQ ID NO: 2849981 - DNA, 22 bp, Homo sapiens
gaggccctggatcagcgtggcc

SEQ ID NO: 2849982 - DNA, 23 bp, Homo sapiens
gaggccctggatcagcgtggcct

SEQ ID NO: 2849983 - DNA, 20 bp, Homo sapiens
gaggcctgccctcagggatc

SEQ ID NO: 2849984 - DNA, 16 bp, Homo sapiens
gaggcctggccaggca

SEQ ID NO: 2849985 - DNA, 19 bp, Homo sapiens
ggcctcttccgtgacgtca

SEQ ID NO: 2849986 - DNA, 19 bp, Homo sapiens
ggcctgatggggtggaagg

SEQ ID NO: 2849987 - DNA, 17 bp, Homo sapiens
ggcctgccctcagggat

SEQ ID NO: 2849988 - DNA, 10 bp, Homo sapiens
ggcctgctgc

SEQ ID NO: 2849989 - DNA, 13 bp, Homo sapiens
ggcctgctgctga

SEQ ID NO: 2849990 - DNA, 19 bp, Homo sapiens
ggcctgctgctgagaacct

SEQ ID NO: 2849991 - DNA, 20 bp, Homo sapiens
ggcctgctgctgagaacctg

SEQ ID NO: 2849992 - DNA, 23 bp, Homo sapiens
ggcctgctgctgagaacctggcc

SEQ ID NO: 2849993 - DNA, 17 bp, Homo sapiens
ggcctgctgggctctcc

SEQ ID NO: 2849994 - DNA, 22 bp, Homo sapiens
ggcctgctgggctctccacctc

SEQ ID NO: 2849995 - DNA, 23 bp, Homo sapiens
ggcctgctgggctctccacctca

SEQ ID NO: 2849996 - DNA, 21 bp, Homo sapiens
ggcctggatctccccactcta

SEQ ID NO: 2849997 - DNA, 16 bp, Homo sapiens
ggcctggccagatgca

SEQ ID NO: 2849998 - DNA, 21 bp, Homo sapiens
ggcctggccagatgcaccagc

SEQ ID NO: 2849999 - DNA, 13 bp, Homo sapiens
ggcctggccaggc

SEQ ID NO: 2850000 - DNA, 14 bp, Homo sapiens
ggcctggccaggca

SEQ ID NO: 2850001 - DNA, 11 bp, Homo sapiens
ggcctggctgg

SEQ ID NO: 2850002 - DNA, 14 bp, Homo sapiens
ggcctggctggctg

SEQ ID NO: 2850003 - DNA, 16 bp, Homo sapiens
ggcctggggctccttt

SEQ ID NO: 2850004 - DNA, 18 bp, Homo sapiens
ggcctggggctcctttct

SEQ ID NO: 2850005 - DNA, 23 bp, Homo sapiens
ggcctggggctcctttctccagc

SEQ ID NO: 2850006 - DNA, 19 bp, Homo sapiens
ggcctggggtgacccggca

SEQ ID NO: 2850007 - DNA, 21 bp, Homo sapiens
ggcctggggtgacccggcacc

SEQ ID NO: 2850008 - DNA, 20 bp, Homo sapiens
ggcctgtgggagcctgcaaa

SEQ ID NO: 2850009 - DNA, 22 bp, Homo sapiens
ggcctgtgtagctgtgacctgc

SEQ ID NO: 2850010 - DNA, 13 bp, Homo sapiens
ggccttgttctgt

SEQ ID NO: 2850011 - DNA, 17 bp, Homo sapiens
ggcgacccctcagtgct

SEQ ID NO: 2850012 - DNA, 18 bp, Homo sapiens
ggcgacttcctctccagc

SEQ ID NO: 2850013 - DNA, 16 bp, Homo sapiens
ggcgagtgccaggact

SEQ ID NO: 2850014 - DNA, 15 bp, Homo sapiens
ggcgccaccatcctg

SEQ ID NO: 2850015 - DNA, 20 bp, Homo sapiens
ggcgcctgtagtcccagcca

SEQ ID NO: 2850016 - DNA, 22 bp, Homo sapiens
ggcgctattgcactccagtctg

SEQ ID NO: 2850017 - DNA, 14 bp, Homo sapiens
ggcgggggagccaa

SEQ ID NO: 2850018 - DNA, 22 bp, Homo sapiens
ggcgtcgctggacaacccagaa

SEQ ID NO: 2850019 - DNA, 15 bp, Homo sapiens
ggcgtgactcaccca

SEQ ID NO: 2850020 - DNA, 18 bp, Homo sapiens
ggcgttctgctgcccctg

SEQ ID NO: 2850021 - DNA, 16 bp, Homo sapiens
ggcgttgcaggccagg

SEQ ID NO: 2850022 - DNA, 20 bp, Homo sapiens
ggctaaatgcctaataaaca

SEQ ID NO: 2850023 - DNA, 19 bp, Homo sapiens
ggctaagagctagcgctgc

SEQ ID NO: 2850024 - DNA, 19 bp, Homo sapiens
ggctaattcccagagtgtg

SEQ ID NO: 2850025 - DNA, 12 bp, Homo sapiens
ggctaccctccc

SEQ ID NO: 2850026 - DNA, 17 bp, Homo sapiens
ggctactcagcagccct

SEQ ID NO: 2850027 - DNA, 18 bp, Homo sapiens
ggctactcagcagccctc

SEQ ID NO: 2850028 - DNA, 21 bp, Homo sapiens
ggctactcagcagccctcctc

SEQ ID NO: 2850029 - DNA, 15 bp, Homo sapiens
ggctactctgtgcca

SEQ ID NO: 2850030 - DNA, 19 bp, Homo sapiens
ggctactctgtgccagagc

SEQ ID NO: 2850031 - DNA, 23 bp, Homo sapiens
ggctacttcggggctgggaagtc

SEQ ID NO: 2850032 - DNA, 20 bp, Homo sapiens
ggctagagtgcggtggcgcg

SEQ ID NO: 2850033 - DNA, 13 bp, Homo sapiens
ggctagtcagaga

SEQ ID NO: 2850034 - DNA, 18 bp, Homo sapiens
ggctagtcagagagagtg

SEQ ID NO: 2850035 - DNA, 15 bp, Homo sapiens
ggctatgccttgtct

SEQ ID NO: 2850036 - DNA, 19 bp, Homo sapiens
ggctcacccaagcaaggcc

SEQ ID NO: 2850037 - DNA, 18 bp, Homo sapiens
ggctcaccttgtgctggg

SEQ ID NO: 2850038 - DNA, 23 bp, Homo sapiens
ggctcacgcctataatcccagca

SEQ ID NO: 2850039 - DNA, 15 bp, Homo sapiens
ggctcactgcagcct

SEQ ID NO: 2850040 - DNA, 12 bp, Homo sapiens
ggctcagcctgg

SEQ ID NO: 2850041 - DNA, 18 bp, Homo sapiens
ggctcagcggggacagct

SEQ ID NO: 2850042 - DNA, 21 bp, Homo sapiens
ggctcagcggggacagctcct

SEQ ID NO: 2850043 - DNA, 22 bp, Homo sapiens
ggctcagcggggacagctcctt

SEQ ID NO: 2850044 - DNA, 21 bp, Homo sapiens
ggctccccgggggcagacacc

SEQ ID NO: 2850045 - DNA, 12 bp, Homo sapiens
ggctcctttctc

SEQ ID NO: 2850046 - DNA, 17 bp, Homo sapiens
ggctcctttctccagcc

SEQ ID NO: 2850047 - DNA, 16 bp, Homo sapiens
ggctctaacgcctgag

SEQ ID NO: 2850048 - DNA, 19 bp, Homo sapiens
ggctctaacgcctgagccc

SEQ ID NO: 2850049 - DNA, 14 bp, Homo sapiens
ggctctccacctca

SEQ ID NO: 2850050 - DNA, 19 bp, Homo sapiens
ggctctccacctcagcctt

SEQ ID NO: 2850051 - DNA, 20 bp, Homo sapiens
ggctctccacctcagccttg

SEQ ID NO: 2850052 - DNA, 12 bp, Homo sapiens
ggctctcctgag

SEQ ID NO: 2850053 - DNA, 12 bp, Homo sapiens
ggctctcctggc

SEQ ID NO: 2850054 - DNA, 13 bp, Homo sapiens
ggctctcctggct

SEQ ID NO: 2850055 - DNA, 12 bp, Homo sapiens
ggctctgcccca

SEQ ID NO: 2850056 - DNA, 21 bp, Homo sapiens
ggctctgccccagctctggct

SEQ ID NO: 2850057 - DNA, 14 bp, Homo sapiens
ggctcttctctcgg

SEQ ID NO: 2850058 - DNA, 22 bp, Homo sapiens
ggctctttggggtcagccaggg

SEQ ID NO: 2850059 - DNA, 17 bp, Homo sapiens
ggctgaacggggagaaa

SEQ ID NO: 2850060 - DNA, 17 bp, Homo sapiens
ggctgacccagtccctg

SEQ ID NO: 2850061 - DNA, 21 bp, Homo sapiens
ggctgaggatttcaagcctgc

SEQ ID NO: 2850062 - DNA, 17 bp, Homo sapiens
ggctgagtgagccacag

SEQ ID NO: 2850063 - DNA, 14 bp, Homo sapiens
ggctgatttctagg

SEQ ID NO: 2850064 - DNA, 22 bp, Homo sapiens
ggctgcaaagggtatcaggtgc

SEQ ID NO: 2850065 - DNA, 13 bp, Homo sapiens
ggctgcagggagt

SEQ ID NO: 2850066 - DNA, 19 bp, Homo sapiens
ggctgccccgggtccccag

SEQ ID NO: 2850067 - DNA, 22 bp, Homo sapiens
ggctgccccgggtccccagctc

SEQ ID NO: 2850068 - DNA, 23 bp, Homo sapiens
ggctgccccgggtccccagctcc

SEQ ID NO: 2850069 - DNA, 13 bp, Homo sapiens
ggctgccctgcca

SEQ ID NO: 2850070 - DNA, 15 bp, Homo sapiens
ggctgctacccagaa

SEQ ID NO: 2850071 - DNA, 13 bp, Homo sapiens
ggctgctcagagg

SEQ ID NO: 2850072 - DNA, 18 bp, Homo sapiens
ggctgctgtgtagctctg

SEQ ID NO: 2850073 - DNA, 19 bp, Homo sapiens
ggctgctgtgtagctctgt

SEQ ID NO: 2850074 - DNA, 22 bp, Homo sapiens
ggctggacctatgtcctaagga

SEQ ID NO: 2850075 - DNA, 16 bp, Homo sapiens
tgtcggagtagaaatt

SEQ ID NO: 2850076 - DNA, 23 bp, Homo sapiens
tgtcgtgtttacaaaaggcagcc

SEQ ID NO: 2850077 - DNA, 13 bp, Homo sapiens
tgtctaaaaacac

SEQ ID NO: 2850078 - DNA, 16 bp, Homo sapiens
tgtctatgggactcaa

SEQ ID NO: 2850079 - DNA, 16 bp, Homo sapiens
tgtctcaggtccctgc

SEQ ID NO: 2850080 - DNA, 17 bp, Homo sapiens
tgtctcaggtccctgca

SEQ ID NO: 2850081 - DNA, 22 bp, Homo sapiens
tgtctccactaaatgagctcct

SEQ ID NO: 2850082 - DNA, 23 bp, Homo sapiens
tgtctccactaaatgagctcctg

SEQ ID NO: 2850083 - DNA, 19 bp, Homo sapiens
tgtctcgagcgccctgcag

SEQ ID NO: 2850084 - DNA, 20 bp, Homo sapiens
tgtctcgagcgccctgcaga

SEQ ID NO: 2850085 - DNA, 13 bp, Homo sapiens
tgtctctgctctt

SEQ ID NO: 2850086 - DNA, 17 bp, Homo sapiens
tgtctctgctcttgcct

SEQ ID NO: 2850087 - DNA, 20 bp, Homo sapiens
tgtctctgctcttgcctgca

SEQ ID NO: 2850088 - DNA, 16 bp, Homo sapiens
tgtctctgtccctcac

SEQ ID NO: 2850089 - DNA, 14 bp, Homo sapiens
tgtctgcacccagg

SEQ ID NO: 2850090 - DNA, 14 bp, Homo sapiens
tgtctggctgtacg

SEQ ID NO: 2850091 - DNA, 15 bp, Homo sapiens
tgtctggctgtacgt

SEQ ID NO: 2850092 - DNA, 13 bp, Homo sapiens
tgtctgtaagaga

SEQ ID NO: 2850093 - DNA, 18 bp, Homo sapiens
tgtctgtaagagaattct

SEQ ID NO: 2850094 - DNA, 19 bp, Homo sapiens
tgtctgtacacgtgtcctg

SEQ ID NO: 2850095 - DNA, 21 bp, Homo sapiens
tgtctgtacacgtgtcctgta

SEQ ID NO: 2850096 - DNA, 16 bp, Homo sapiens
tgtctgtctgtctgtc

SEQ ID NO: 2850097 - DNA, 15 bp, Homo sapiens
tgtctgtgcagctgc

SEQ ID NO: 2850098 - DNA, 19 bp, Homo sapiens
tgtcttataggtttccact

SEQ ID NO: 2850099 - DNA, 20 bp, Homo sapiens
tgtcttcctagtatattagt

SEQ ID NO: 2850100 - DNA, 14 bp, Homo sapiens
tgtcttgccagcca

SEQ ID NO: 2850101 - DNA, 16 bp, Homo sapiens
tgtcttgccagccaga

SEQ ID NO: 2850102 - DNA, 17 bp, Homo sapiens
tgtcttgtacatgtgta

SEQ ID NO: 2850103 - DNA, 15 bp, Homo sapiens
tgtctttaaggaaaa

SEQ ID NO: 2850104 - DNA, 23 bp, Homo sapiens
tgtctttcagcattcagtccgcc

SEQ ID NO: 2850105 - DNA, 17 bp, Homo sapiens
tgtctttctccaaagtt

SEQ ID NO: 2850106 - DNA, 13 bp, Homo sapiens
tgtcttttgtcat

SEQ ID NO: 2850107 - DNA, 18 bp, Homo sapiens
tgtgaaagtatgtgatat

SEQ ID NO: 2850108 - DNA, 19 bp, Homo sapiens
tgtgaaattcaacctgtgt

SEQ ID NO: 2850109 - DNA, 17 bp, Homo sapiens
tgtgaaccaccacaccc

SEQ ID NO: 2850110 - DNA, 15 bp, Homo sapiens
tgtgaacccaggaca

SEQ ID NO: 2850111 - DNA, 16 bp, Homo sapiens
tgtgaaggtcttgcct

SEQ ID NO: 2850112 - DNA, 22 bp, Homo sapiens
tgtgaattcccaggttggcctg

SEQ ID NO: 2850113 - DNA, 18 bp, Homo sapiens
tgtgaattgcctgcagag

SEQ ID NO: 2850114 - DNA, 22 bp, Homo sapiens
tgtgaattgcctgcagagagaa

SEQ ID NO: 2850115 - DNA, 17 bp, Homo sapiens
tgtgaccaaaagttaca

SEQ ID NO: 2850116 - DNA, 15 bp, Homo sapiens
tgtgaccaggggtga

SEQ ID NO: 2850117 - DNA, 14 bp, Homo sapiens
tgtgaccctctgaa

SEQ ID NO: 2850118 - DNA, 17 bp, Homo sapiens
tgtgacctgctgagctc

SEQ ID NO: 2850119 - DNA, 21 bp, Homo sapiens
tgtgactcgcttagctgaaac

SEQ ID NO: 2850120 - DNA, 21 bp, Homo sapiens
tgtgagatatacaaatatatt

SEQ ID NO: 2850121 - DNA, 14 bp, Homo sapiens
tgtgagatgtaatt

SEQ ID NO: 2850122 - DNA, 14 bp, Homo sapiens
tgtgagcaagaagt

SEQ ID NO: 2850123 - DNA, 14 bp, Homo sapiens
tgtgagcttctaca

SEQ ID NO: 2850124 - DNA, 14 bp, Homo sapiens
tgtgaggcctggcc

SEQ ID NO: 2850125 - DNA, 19 bp, Homo sapiens
tgtgagttgagtctcctct

SEQ ID NO: 2850126 - DNA, 13 bp, Homo sapiens
tgtgatatctgaa

SEQ ID NO: 2850127 - DNA, 20 bp, Homo sapiens
tgtgatcaggctatgtatgg

SEQ ID NO: 2850128 - DNA, 21 bp, Homo sapiens
tgtgatccttttatgttattt

SEQ ID NO: 2850129 - DNA, 17 bp, Homo sapiens
tgtgcaatgtaaatatt

SEQ ID NO: 2850130 - DNA, 22 bp, Homo sapiens
tgtgcacatgcacgtgtgtgca

SEQ ID NO: 2850131 - DNA, 17 bp, Homo sapiens
tgtgcacccctccccat

SEQ ID NO: 2850132 - DNA, 14 bp, Homo sapiens
tgtgcacgtacaca

SEQ ID NO: 2850133 - DNA, 19 bp, Homo sapiens
tgtgcagactcaataaaat

SEQ ID NO: 2850134 - DNA, 23 bp, Homo sapiens
tgtgcagactcaataaaatcatg

SEQ ID NO: 2850135 - DNA, 15 bp, Homo sapiens
tgtgcagactgtggc

SEQ ID NO: 2850136 - DNA, 12 bp, Homo sapiens
tgtgcagtgttg

SEQ ID NO: 2850137 - DNA, 19 bp, Homo sapiens
tgtgcatagagccacgtat

SEQ ID NO: 2850138 - DNA, 17 bp, Homo sapiens
tgtgcatttctgtctct

SEQ ID NO: 2850139 - DNA, 12 bp, Homo sapiens
tgtgccagagcc

SEQ ID NO: 2850140 - DNA, 20 bp, Homo sapiens
tgtgccagagcctggggctc

SEQ ID NO: 2850141 - DNA, 21 bp, Homo sapiens
tgtgccatgtcaaacaaatag

SEQ ID NO: 2850142 - DNA, 16 bp, Homo sapiens
tgtgccatgtgccagg

SEQ ID NO: 2850143 - DNA, 15 bp, Homo sapiens
tgtgcccctgtaaat

SEQ ID NO: 2850144 - DNA, 17 bp, Homo sapiens
tgtgccgtgaactgcgt

SEQ ID NO: 2850145 - DNA, 14 bp, Homo sapiens
tgtgcctcctcacc

SEQ ID NO: 2850146 - DNA, 15 bp, Homo sapiens
tgtgcctcctcaccc

SEQ ID NO: 2850147 - DNA, 13 bp, Homo sapiens
tgtgcctctgcct

SEQ ID NO: 2850148 - DNA, 15 bp, Homo sapiens
tgtgcctctgcctgt

SEQ ID NO: 2850149 - DNA, 14 bp, Homo sapiens
tgtgcgcctacagg

SEQ ID NO: 2850150 - DNA, 15 bp, Homo sapiens
tgtgcgttttagagt

SEQ ID NO: 2850151 - DNA, 16 bp, Homo sapiens
tgtgctctggacaggc

SEQ ID NO: 2850152 - DNA, 16 bp, Homo sapiens
tgtgcttacagtgact

SEQ ID NO: 2850153 - DNA, 17 bp, Homo sapiens
tgtggaaaatgaaaatt

SEQ ID NO: 2850154 - DNA, 14 bp, Homo sapiens
tgtggaaagcctct

SEQ ID NO: 2850155 - DNA, 17 bp, Homo sapiens
tgtggaaagcctctgct

SEQ ID NO: 2850156 - DNA, 23 bp, Homo sapiens
tgtggagaaataaaaatacctct

SEQ ID NO: 2850157 - DNA, 20 bp, Homo sapiens
tgtggagagtgagaataatt

SEQ ID NO: 2850158 - DNA, 21 bp, Homo sapiens
tgtggaggtacactcttatag

SEQ ID NO: 2850159 - DNA, 23 bp, Homo sapiens
tgtggatttcctattttaaaacc

SEQ ID NO: 2850160 - DNA, 13 bp, Homo sapiens
tgtggccccagcc

SEQ ID NO: 2850161 - DNA, 12 bp, Homo sapiens
tgtggccctggc

SEQ ID NO: 2850162 - DNA, 17 bp, Homo sapiens
tgtggccctggcctgct

SEQ ID NO: 2850163 - DNA, 21 bp, Homo sapiens
tgtggctaaatgcctaataaa

SEQ ID NO: 2850164 - DNA, 17 bp, Homo sapiens
tgtggctgtattcagat

SEQ ID NO: 2850165 - DNA, 15 bp, Homo sapiens
tgtgggaagggagag

SEQ ID NO: 2850166 - DNA, 18 bp, Homo sapiens
ttaacctgtttatataat

SEQ ID NO: 2850167 - DNA, 17 bp, Homo sapiens
ttaacgtcatctcaggg

SEQ ID NO: 2850168 - DNA, 12 bp, Homo sapiens
ttaactaattta

SEQ ID NO: 2850169 - DNA, 19 bp, Homo sapiens
ttaactaatttaaaccagc

SEQ ID NO: 2850170 - DNA, 23 bp, Homo sapiens
ttaactaatttaaaccagcagaa

SEQ ID NO: 2850171 - DNA, 15 bp, Homo sapiens
ttaactctctttatg

SEQ ID NO: 2850172 - DNA, 19 bp, Homo sapiens
ttaactctctttatgtctg

SEQ ID NO: 2850173 - DNA, 21 bp, Homo sapiens
ttaactgggtaatgaaacaaa

SEQ ID NO: 2850174 - DNA, 18 bp, Homo sapiens
ttaactgtgtgaagaaat

SEQ ID NO: 2850175 - DNA, 22 bp, Homo sapiens
ttaacttaaaagattcactaaa

SEQ ID NO: 2850176 - DNA, 18 bp, Homo sapiens
ttaacttaacattctgta

SEQ ID NO: 2850177 - DNA, 18 bp, Homo sapiens
ttaacttagcttgaagga

SEQ ID NO: 2850178 - DNA, 13 bp, Homo sapiens
ttaacttgtatat

SEQ ID NO: 2850179 - DNA, 21 bp, Homo sapiens
ttaagactgagcacctgcttc

SEQ ID NO: 2850180 - DNA, 13 bp, Homo sapiens
ttaagacttgaca

SEQ ID NO: 2850181 - DNA, 13 bp, Homo sapiens
ttaagcagccttt

SEQ ID NO: 2850182 - DNA, 19 bp, Homo sapiens
ttaagcagcctttctgtgg

SEQ ID NO: 2850183 - DNA, 21 bp, Homo sapiens
ttaagcagcctttctgtggag

SEQ ID NO: 2850184 - DNA, 21 bp, Homo sapiens
ttaagcattttactgtctgta

SEQ ID NO: 2850185 - DNA, 16 bp, Homo sapiens
ttaagccaaaacaatg

SEQ ID NO: 2850186 - DNA, 20 bp, Homo sapiens
ttaaggaggtagctcccagc

SEQ ID NO: 2850187 - DNA, 14 bp, Homo sapiens
ttaaggcagtgact

SEQ ID NO: 2850188 - DNA, 15 bp, Homo sapiens
ttaagggaaaaatat

SEQ ID NO: 2850189 - DNA, 16 bp, Homo sapiens
ttaagggaaaaatata

SEQ ID NO: 2850190 - DNA, 21 bp, Homo sapiens
ttaagtccaaggagaagaaga

SEQ ID NO: 2850191 - DNA, 22 bp, Homo sapiens
ttaagtctctgactcttgcctt

SEQ ID NO: 2850192 - DNA, 14 bp, Homo sapiens
ttaagttagagaat

SEQ ID NO: 2850193 - DNA, 13 bp, Homo sapiens
ttaataaaattga

SEQ ID NO: 2850194 - DNA, 17 bp, Homo sapiens
ttaataaacgaagataa

SEQ ID NO: 2850195 - DNA, 19 bp, Homo sapiens
ttaataatttagacttcaa

SEQ ID NO: 2850196 - DNA, 15 bp, Homo sapiens
ttaatatagctattt

SEQ ID NO: 2850197 - DNA, 17 bp, Homo sapiens
ttaatatagctattttt

SEQ ID NO: 2850198 - DNA, 17 bp, Homo sapiens
ttaatatcctaaacatc

SEQ ID NO: 2850199 - DNA, 19 bp, Homo sapiens
ttaatatcctaaacatcat

SEQ ID NO: 2850200 - DNA, 17 bp, Homo sapiens
ttaatatctgagaagtg

SEQ ID NO: 2850201 - DNA, 22 bp, Homo sapiens
ttaatatggggatgcagcatta

SEQ ID NO: 2850202 - DNA, 12 bp, Homo sapiens
ttaatatttgct

SEQ ID NO: 2850203 - DNA, 19 bp, Homo sapiens
ttaatatttgctgacagct

SEQ ID NO: 2850204 - DNA, 20 bp, Homo sapiens
ttaatcaggtcctcagagaa

SEQ ID NO: 2850205 - DNA, 22 bp, Homo sapiens
ttaatcattttgcctcttttct

SEQ ID NO: 2850206 - DNA, 15 bp, Homo sapiens
ttaatcttcagtttt

SEQ ID NO: 2850207 - DNA, 17 bp, Homo sapiens
ttaatcttcagttttat

SEQ ID NO: 2850208 - DNA, 23 bp, Homo sapiens
ttaatctttctttacctgagacc

SEQ ID NO: 2850209 - DNA, 24 bp, Homo sapiens
ttaatctttctttacctgagacca

SEQ ID NO: 2850210 - DNA, 16 bp, Homo sapiens
ttaatgaaaatgtcag

SEQ ID NO: 2850211 - DNA, 17 bp, Homo sapiens
ttaatgaactgtgacag

SEQ ID NO: 2850212 - DNA, 23 bp, Homo sapiens
ttaatgaagacccagtgtaaaga

SEQ ID NO: 2850213 - DNA, 12 bp, Homo sapiens
ttaatgactttt

SEQ ID NO: 2850214 - DNA, 16 bp, Homo sapiens
ttaatgcatttttgat

SEQ ID NO: 2850215 - DNA, 16 bp, Homo sapiens
ttaatggctgataatt

SEQ ID NO: 2850216 - DNA, 19 bp, Homo sapiens
ttaatggtgccttcatttg

SEQ ID NO: 2850217 - DNA, 23 bp, Homo sapiens
ttaatgttctgaataatttctta

SEQ ID NO: 2850218 - DNA, 22 bp, Homo sapiens
ttaattaatatgttcattaaat

SEQ ID NO: 2850219 - DNA, 14 bp, Homo sapiens
ttaattattattct

SEQ ID NO: 2850220 - DNA, 14 bp, Homo sapiens
ttaattattattta

SEQ ID NO: 2850221 - DNA, 15 bp, Homo sapiens
ttaattctactaaat

SEQ ID NO: 2850222 - DNA, 23 bp, Homo sapiens
ttaattgtaggtcaatgaaatat

SEQ ID NO: 2850223 - DNA, 18 bp, Homo sapiens
ttaatttatgagtttttg

SEQ ID NO: 2850224 - DNA, 20 bp, Homo sapiens
ttaatttatgagtttttgat

SEQ ID NO: 2850225 - DNA, 20 bp, Homo sapiens
ttaattttcctggaaagact

SEQ ID NO: 2850226 - DNA, 12 bp, Homo sapiens
ttaatttttgat

SEQ ID NO: 2850227 - DNA, 13 bp, Homo sapiens
ttaatttttgcaa

SEQ ID NO: 2850228 - DNA, 17 bp, Homo sapiens
ttacaaaaatagtagaa

SEQ ID NO: 2850229 - DNA, 14 bp, Homo sapiens
ttacaaaaggcagc

SEQ ID NO: 2850230 - DNA, 12 bp, Homo sapiens
ttacaaacatgt

SEQ ID NO: 2850231 - DNA, 15 bp, Homo sapiens
ttacaaatttaattt

SEQ ID NO: 2850232 - DNA, 13 bp, Homo sapiens
ttacaacttccat

SEQ ID NO: 2850233 - DNA, 20 bp, Homo sapiens
ttacaagcgtgagccactgc

SEQ ID NO: 2850234 - DNA, 21 bp, Homo sapiens
ttacaagcgtgagccactgca

SEQ ID NO: 2850235 - DNA, 19 bp, Homo sapiens
ttacaataaatattctgca

SEQ ID NO: 2850236 - DNA, 21 bp, Homo sapiens
ttacactacaagtttataagc

SEQ ID NO: 2850237 - DNA, 22 bp, Homo sapiens
ttacactacacactgtgtactg

SEQ ID NO: 2850238 - DNA, 21 bp, Homo sapiens
ttacagagaatctgaagctat

SEQ ID NO: 2850239 - DNA, 15 bp, Homo sapiens
ttacagcgagaggca

SEQ ID NO: 2850240 - DNA, 21 bp, Homo sapiens
ttacagcgagaggcagagaaa

SEQ ID NO: 2850241 - DNA, 17 bp, Homo sapiens
ttacataatcaaagcta

SEQ ID NO: 2850242 - DNA, 18 bp, Homo sapiens
ttacatcaaggcttcaaa

SEQ ID NO: 2850243 - DNA, 14 bp, Homo sapiens
ttacatgtttgcac

SEQ ID NO: 2850244 - DNA, 19 bp, Homo sapiens
ttacattattatcaacaat

SEQ ID NO: 2850245 - DNA, 17 bp, Homo sapiens
ttacatttccaaatgaa

SEQ ID NO: 2850246 - DNA, 16 bp, Homo sapiens
ttaccaaaaaagtatt

SEQ ID NO: 2850247 - DNA, 21 bp, Homo sapiens
ttaccagatttttacacatgt

SEQ ID NO: 2850248 - DNA, 23 bp, Homo sapiens
ttaccaggcaccaaaagaagtaa

SEQ ID NO: 2850249 - DNA, 11 bp, Homo sapiens
ttaccatgaga

SEQ ID NO: 2850250 - DNA, 23 bp, Homo sapiens
ttaccattttggggtacccactg

SEQ ID NO: 2850251 - DNA, 21 bp, Homo sapiens
ttacccagagaatatatacat

SEQ ID NO: 2850252 - DNA, 16 bp, Homo sapiens
ttacctaaacagatat

SEQ ID NO: 2850253 - DNA, 20 bp, Homo sapiens
ttacctaaacagatataaat

SEQ ID NO: 2850254 - DNA, 15 bp, Homo sapiens
ttacctcctgcccag

SEQ ID NO: 2850255 - DNA, 22 bp, Homo sapiens
ttaccttagattagctctggac

SEQ ID NO: 2850256 - DNA, 17 bp, Homo sapiens
ttatatctaatttatac

SEQ ID NO: 2850257 - DNA, 19 bp, Homo sapiens
ttatatctaatttatacaa

SEQ ID NO: 2850258 - DNA, 19 bp, Homo sapiens
ttatatgaaatgtttcact

SEQ ID NO: 2850259 - DNA, 18 bp, Homo sapiens
ttatattagagtgccctt

SEQ ID NO: 2850260 - DNA, 19 bp, Homo sapiens
ttatattagagtgccctta

SEQ ID NO: 2850261 - DNA, 16 bp, Homo sapiens
ttatattccatatatt

SEQ ID NO: 2850262 - DNA, 14 bp, Homo sapiens
ttatatttggaaag

SEQ ID NO: 2850263 - DNA, 19 bp, Homo sapiens
ttatatttggaaagagacc

SEQ ID NO: 2850264 - DNA, 15 bp, Homo sapiens
ttatcaaaactttct

SEQ ID NO: 2850265 - DNA, 15 bp, Homo sapiens
ttatcaacaatagtg

SEQ ID NO: 2850266 - DNA, 23 bp, Homo sapiens
ttatcagtgatggtctcacagag

SEQ ID NO: 2850267 - DNA, 13 bp, Homo sapiens
ttatcatgctgtc

SEQ ID NO: 2850268 - DNA, 12 bp, Homo sapiens
ttatccaggact

SEQ ID NO: 2850269 - DNA, 18 bp, Homo sapiens
ttatccaggactctgtca

SEQ ID NO: 2850270 - DNA, 14 bp, Homo sapiens
ttatccctgaggtc

SEQ ID NO: 2850271 - DNA, 14 bp, Homo sapiens
ttatcggaagcagt

SEQ ID NO: 2850272 - DNA, 14 bp, Homo sapiens
ttatcgggaacagt

SEQ ID NO: 2850273 - DNA, 19 bp, Homo sapiens
ttatctaatacctctgtgt

SEQ ID NO: 2850274 - DNA, 20 bp, Homo sapiens
ttatctgaatataggaagca

SEQ ID NO: 2850275 - DNA, 18 bp, Homo sapiens
ttatctgaatttttaaac

SEQ ID NO: 2850276 - DNA, 23 bp, Homo sapiens
ttatctgatcgggataacaaaat

SEQ ID NO: 2850277 - DNA, 16 bp, Homo sapiens
ttatcttgtctctggg

SEQ ID NO: 2850278 - DNA, 14 bp, Homo sapiens
ttatgaaaaagaag

SEQ ID NO: 2850279 - DNA, 19 bp, Homo sapiens
ttatgaaaaagaagaatct

SEQ ID NO: 2850280 - DNA, 18 bp, Homo sapiens
ttatgacatcacttgtac

SEQ ID NO: 2850281 - DNA, 18 bp, Homo sapiens
ttatgcaaggaaggaaag

SEQ ID NO: 2850282 - DNA, 22 bp, Homo sapiens
ttatgcaaggaaggaaagaaag

SEQ ID NO: 2850283 - DNA, 16 bp, Homo sapiens
ttatgctaactgtaga

SEQ ID NO: 2850284 - DNA, 18 bp, Homo sapiens
ttatgggaatgccttttc

SEQ ID NO: 2850285 - DNA, 13 bp, Homo sapiens
ttatggtattttc

SEQ ID NO: 2850286 - DNA, 14 bp, Homo sapiens
ttatggtattttcg

SEQ ID NO: 2850287 - DNA, 21 bp, Homo sapiens
ttatggtattttcgtgcattt

SEQ ID NO: 2850288 - DNA, 22 bp, Homo sapiens
ttatggtattttcgtgcatttg

SEQ ID NO: 2850289 - DNA, 16 bp, Homo sapiens
ttatggtgtaatgcac

SEQ ID NO: 2850290 - DNA, 14 bp, Homo sapiens
ttatgtaatgcttt

SEQ ID NO: 2850291 - DNA, 19 bp, Homo sapiens
ttatgtattattttctata

SEQ ID NO: 2850292 - DNA, 23 bp, Homo sapiens
ttatgtattattttctatagctc

SEQ ID NO: 2850293 - DNA, 23 bp, Homo sapiens
ttatgtgaatgatctctctgaat

SEQ ID NO: 2850294 - DNA, 17 bp, Homo sapiens
ttatgtgacaacctttg

SEQ ID NO: 2850295 - DNA, 19 bp, Homo sapiens
ttatgtgacaacctttgtg

SEQ ID NO: 2850296 - DNA, 19 bp, Homo sapiens
ttattaacaaattatgtta

SEQ ID NO: 2850297 - DNA, 16 bp, Homo sapiens
ttattattttcacctg

SEQ ID NO: 2850298 - DNA, 15 bp, Homo sapiens
ttattcactgtaagt

SEQ ID NO: 2850299 - DNA, 19 bp, Homo sapiens
ttattcactgtaagtttat

SEQ ID NO: 2850300 - DNA, 20 bp, Homo sapiens
ttattccccattcttcctag

SEQ ID NO: 2850301 - DNA, 16 bp, Homo sapiens
ttattccctgtacaat

SEQ ID NO: 2850302 - DNA, 22 bp, Homo sapiens
ttattcctatatagtttattga

SEQ ID NO: 2850303 - DNA, 17 bp, Homo sapiens
ttattctcactccacca

SEQ ID NO: 2850304 - DNA, 19 bp, Homo sapiens
ttattgagaattttaaatt

SEQ ID NO: 2850305 - DNA, 23 bp, Homo sapiens
ttattgcttgatacttttgacaa

SEQ ID NO: 2850306 - DNA, 20 bp, Homo sapiens
ttattgggcaagtgattgaa

SEQ ID NO: 2850307 - DNA, 12 bp, Homo sapiens
ttattgtacctc

SEQ ID NO: 2850308 - DNA, 15 bp, Homo sapiens
ttattgtacctctct

SEQ ID NO: 2850309 - DNA, 21 bp, Homo sapiens
ttatttaaaatagcaaaagaa

SEQ ID NO: 2850310 - DNA, 22 bp, Homo sapiens
ttatttaaaatagcaaaagaag

SEQ ID NO: 2850311 - DNA, 14 bp, Homo sapiens
ttatttaattaaaa

SEQ ID NO: 2850312 - DNA, 17 bp, Homo sapiens
ttatttactgagcttct

SEQ ID NO: 2850313 - DNA, 14 bp, Homo sapiens
ttatttatatatga

SEQ ID NO: 2850314 - DNA, 15 bp, Homo sapiens
ttatttattggagat

SEQ ID NO: 2850315 - DNA, 18 bp, Homo sapiens
ttatttcataaacaactt

SEQ ID NO: 2850316 - DNA, 19 bp, Homo sapiens
ttatttcttaaacaaatgt

SEQ ID NO: 2850317 - DNA, 11 bp, Homo sapiens
ttatttgcaat

SEQ ID NO: 2850318 - DNA, 14 bp, Homo sapiens
ttatttgcaataaa

SEQ ID NO: 2850319 - DNA, 20 bp, Homo sapiens
ttatttggaataataatttt

SEQ ID NO: 2850320 - DNA, 16 bp, Homo sapiens
ttatttgtaatagatg

SEQ ID NO: 2850321 - DNA, 12 bp, Homo sapiens
ttatttgttgag

SEQ ID NO: 2850322 - DNA, 14 bp, Homo sapiens
ttattttgtaataa

SEQ ID NO: 2850323 - DNA, 19 bp, Homo sapiens
ttattttgttacactaaag

SEQ ID NO: 2850324 - DNA, 17 bp, Homo sapiens
ttatttttagacagagt

SEQ ID NO: 2850325 - DNA, 17 bp, Homo sapiens
ttattttttaaaataat

SEQ ID NO: 2850326 - DNA, 14 bp, Homo sapiens
ttattttttaatta

SEQ ID NO: 2850327 - DNA, 18 bp, Homo sapiens
ttattttttctacacagt

SEQ ID NO: 2850328 - DNA, 21 bp, Homo sapiens
ttcaaaaattacactacaagt

SEQ ID NO: 2850329 - DNA, 18 bp, Homo sapiens
ttcaaaacattgtgccat

SEQ ID NO: 2850330 - DNA, 11 bp, Homo sapiens
ttcaaaagtgg

SEQ ID NO: 2850331 - DNA, 20 bp, Homo sapiens
ttcaaaccatttaattcata

SEQ ID NO: 2850332 - DNA, 18 bp, Homo sapiens
ttcaaagttaattttccc

SEQ ID NO: 2850333 - DNA, 22 bp, Homo sapiens
ttcaacacattacttgcacaag

SEQ ID NO: 2850334 - DNA, 17 bp, Homo sapiens
ttcaaccagcattttac

SEQ ID NO: 2850335 - DNA, 21 bp, Homo sapiens
ttcaaccagcattttactact

SEQ ID NO: 2850336 - DNA, 18 bp, Homo sapiens
ttcaaccgcttgccatat

SEQ ID NO: 2850337 - DNA, 17 bp, Homo sapiens
ttcaactgaccagcctc

SEQ ID NO: 2850338 - DNA, 22 bp, Homo sapiens
ttcaagaaagcttcaaactgca

SEQ ID NO: 2850339 - DNA, 22 bp, Homo sapiens
ttcaagacaccaaattccaaac

SEQ ID NO: 2850340 - DNA, 14 bp, Homo sapiens
ttcaagtgatatat

SEQ ID NO: 2850341 - DNA, 18 bp, Homo sapiens
ttcaagtgatatatgtat

SEQ ID NO: 2850342 - DNA, 17 bp, Homo sapiens
ttcaagttagctcagga

SEQ ID NO: 2850343 - DNA, 12 bp, Homo sapiens
ttcaataaagct

SEQ ID NO: 2850344 - DNA, 13 bp, Homo sapiens
ttcaataaagctg

SEQ ID NO: 2850345 - DNA, 13 bp, Homo sapiens
ttcaataaagtat

SEQ ID NO: 2850346 - DNA, 15 bp, Homo sapiens
ttcaatgttagcctc

SEQ ID NO: 2850347 - DNA, 17 bp, Homo sapiens
ttcctcaccaataactt

SEQ ID NO: 2850348 - DNA, 17 bp, Homo sapiens
ttcctcagtcctggaag

SEQ ID NO: 2850349 - DNA, 23 bp, Homo sapiens
ttcctccccattagagtcagcct

SEQ ID NO: 2850350 - DNA, 14 bp, Homo sapiens
ttcctcgccctggg

SEQ ID NO: 2850351 - DNA, 15 bp, Homo sapiens
ttcctcgcctctccc

SEQ ID NO: 2850352 - DNA, 23 bp, Homo sapiens
ttcctctagtgccctccacagcc

SEQ ID NO: 2850353 - DNA, 15 bp, Homo sapiens
ttcctctccaattgt

SEQ ID NO: 2850354 - DNA, 12 bp, Homo sapiens
ttcctctccagc

SEQ ID NO: 2850355 - DNA, 16 bp, Homo sapiens
ttcctctccagccttc

SEQ ID NO: 2850356 - DNA, 12 bp, Homo sapiens
ttcctctgggaa

SEQ ID NO: 2850357 - DNA, 13 bp, Homo sapiens
ttcctcttcccca

SEQ ID NO: 2850358 - DNA, 18 bp, Homo sapiens
ttcctgaaagaaacagtt

SEQ ID NO: 2850359 - DNA, 14 bp, Homo sapiens
ttcctgaatattaa

SEQ ID NO: 2850360 - DNA, 16 bp, Homo sapiens
ttcctgaatgaaatat

SEQ ID NO: 2850361 - DNA, 23 bp, Homo sapiens
ttcctgagtgtgggcttctgaaa

SEQ ID NO: 2850362 - DNA, 17 bp, Homo sapiens
ttcctgatgtgccagaa

SEQ ID NO: 2850363 - DNA, 14 bp, Homo sapiens
ttcctgcacccgta

SEQ ID NO: 2850364 - DNA, 16 bp, Homo sapiens
ttcctgcacccgtacc

SEQ ID NO: 2850365 - DNA, 14 bp, Homo sapiens
ttcctgccaagcca

SEQ ID NO: 2850366 - DNA, 12 bp, Homo sapiens
ttcctgccacca

SEQ ID NO: 2850367 - DNA, 19 bp, Homo sapiens
ttcctggacagctgtgcct

SEQ ID NO: 2850368 - DNA, 19 bp, Homo sapiens
ttcctgtaacacaagccac

SEQ ID NO: 2850369 - DNA, 17 bp, Homo sapiens
ttcctgtagcatcttct

SEQ ID NO: 2850370 - DNA, 21 bp, Homo sapiens
ttcctgtatttgttcccaaga

SEQ ID NO: 2850371 - DNA, 14 bp, Homo sapiens
ttcctgttcacctt

SEQ ID NO: 2850372 - DNA, 15 bp, Homo sapiens
ttcctgttcacctta

SEQ ID NO: 2850373 - DNA, 20 bp, Homo sapiens
ttccttaagtcagaacagca

SEQ ID NO: 2850374 - DNA, 23 bp, Homo sapiens
ttccttcccccatcccctttcct

SEQ ID NO: 2850375 - DNA, 20 bp, Homo sapiens
ttccttggaggccaccggga

SEQ ID NO: 2850376 - DNA, 18 bp, Homo sapiens
ttccttttctaactctcc

SEQ ID NO: 2850377 - DNA, 20 bp, Homo sapiens
ttccttttgcaacaagacaa

SEQ ID NO: 2850378 - DNA, 20 bp, Homo sapiens
ttcgaccctttctctgagag

SEQ ID NO: 2850379 - DNA, 14 bp, Homo sapiens
ttcgagaccagcct

SEQ ID NO: 2850380 - DNA, 16 bp, Homo sapiens
ttcgagaccagcctgg

SEQ ID NO: 2850381 - DNA, 19 bp, Homo sapiens
ttcgaggcggtttccagga

SEQ ID NO: 2850382 - DNA, 21 bp, Homo sapiens
ttcgaggcggtttccaggaag

SEQ ID NO: 2850383 - DNA, 15 bp, Homo sapiens
ttcgcagccaccctg

SEQ ID NO: 2850384 - DNA, 13 bp, Homo sapiens
ttcgctcctgtgt

SEQ ID NO: 2850385 - DNA, 17 bp, Homo sapiens
ttcggaagggaaaacag

SEQ ID NO: 2850386 - DNA, 17 bp, Homo sapiens
ttcggggaactcctgga

SEQ ID NO: 2850387 - DNA, 16 bp, Homo sapiens
ttcggggcaagtgaga

SEQ ID NO: 2850388 - DNA, 12 bp, Homo sapiens
ttcgtgcatttg

SEQ ID NO: 2850389 - DNA, 15 bp, Homo sapiens
ttctaaaatgattgt

SEQ ID NO: 2850390 - DNA, 14 bp, Homo sapiens
ttctaaatgaagtg

SEQ ID NO: 2850391 - DNA, 15 bp, Homo sapiens
ttctaactccagtga

SEQ ID NO: 2850392 - DNA, 15 bp, Homo sapiens
ttctaataaaacaaa

SEQ ID NO: 2850393 - DNA, 17 bp, Homo sapiens
ttctacaaccagagccc

SEQ ID NO: 2850394 - DNA, 18 bp, Homo sapiens
ttctacaaccagagcccc

SEQ ID NO: 2850395 - DNA, 22 bp, Homo sapiens
ttctacacagtaaaaacttgta

SEQ ID NO: 2850396 - DNA, 17 bp, Homo sapiens
ttctacacatatatgta

SEQ ID NO: 2850397 - DNA, 14 bp, Homo sapiens
ttctaccatttcag

SEQ ID NO: 2850398 - DNA, 15 bp, Homo sapiens
ttctaccatttcaga

SEQ ID NO: 2850399 - DNA, 19 bp, Homo sapiens
ttctacccagcgagccctg

SEQ ID NO: 2850400 - DNA, 22 bp, Homo sapiens
ttctacgttatgaaaacagatg

SEQ ID NO: 2850401 - DNA, 18 bp, Homo sapiens
ttctactcatatatatct

SEQ ID NO: 2850402 - DNA, 12 bp, Homo sapiens
ttctagctgttg

SEQ ID NO: 2850403 - DNA, 15 bp, Homo sapiens
ttctaggttctaaaa

SEQ ID NO: 2850404 - DNA, 16 bp, Homo sapiens
ttctagtctggtgttc

SEQ ID NO: 2850405 - DNA, 21 bp, Homo sapiens
ttctagtctggtgttctgagt

SEQ ID NO: 2850406 - DNA, 21 bp, Homo sapiens
ttctatagccaaaaatagcta

SEQ ID NO: 2850407 - DNA, 14 bp, Homo sapiens
ttctatcacatatt

SEQ ID NO: 2850408 - DNA, 18 bp, Homo sapiens
ttctattgcagttataga

SEQ ID NO: 2850409 - DNA, 18 bp, Homo sapiens
ttctatttaaaaaataaa

SEQ ID NO: 2850410 - DNA, 17 bp, Homo sapiens
ttctatttttcttctaa

SEQ ID NO: 2850411 - DNA, 16 bp, Homo sapiens
ttctcaatgcttttct

SEQ ID NO: 2850412 - DNA, 12 bp, Homo sapiens
ttctcaccagga

SEQ ID NO: 2850413 - DNA, 18 bp, Homo sapiens
ttctcagaatccaaagat

SEQ ID NO: 2850414 - DNA, 13 bp, Homo sapiens
ttctcagctccca

SEQ ID NO: 2850415 - DNA, 19 bp, Homo sapiens
ttctcagtcggtgtgtaat

SEQ ID NO: 2850416 - DNA, 17 bp, Homo sapiens
ttctcatcatattgtat

SEQ ID NO: 2850417 - DNA, 18 bp, Homo sapiens
ttctcatgtgatcctttt

SEQ ID NO: 2850418 - DNA, 17 bp, Homo sapiens
ttctcattttttaaaaa

SEQ ID NO: 2850419 - DNA, 14 bp, Homo sapiens
ttctccaaatgaga

SEQ ID NO: 2850420 - DNA, 23 bp, Homo sapiens
ttctccaaatgattttcatcaat

SEQ ID NO: 2850421 - DNA, 19 bp, Homo sapiens
ttctccagacccaccacac

SEQ ID NO: 2850422 - DNA, 11 bp, Homo sapiens
ttctccaggct

SEQ ID NO: 2850423 - DNA, 14 bp, Homo sapiens
ttctccccctgggc

SEQ ID NO: 2850424 - DNA, 17 bp, Homo sapiens
ttctccccctgggctct

SEQ ID NO: 2850425 - DNA, 18 bp, Homo sapiens
ttctccttggaggacagt

SEQ ID NO: 2850426 - DNA, 16 bp, Homo sapiens
ttctcctttattgctc

SEQ ID NO: 2850427 - DNA, 20 bp, Homo sapiens
ttctcctttattgctcctgt

SEQ ID NO: 2850428 - DNA, 20 bp, Homo sapiens
ttctcgcattttctctagct

SEQ ID NO: 2850429 - DNA, 16 bp, Homo sapiens
ttctctacccatctcc

SEQ ID NO: 2850430 - DNA, 19 bp, Homo sapiens
ttctctccaggctgtttct

SEQ ID NO: 2850431 - DNA, 16 bp, Homo sapiens
ttctctctcctgtcca

SEQ ID NO: 2850432 - DNA, 13 bp, Homo sapiens
ttctctctctggt

SEQ ID NO: 2850433 - DNA, 20 bp, Homo sapiens
ttctctgaggacactaacca

SEQ ID NO: 2850434 - DNA, 23 bp, Homo sapiens
ttctctgggtaggtgttgaaaat

SEQ ID NO: 2850435 - DNA, 12 bp, Homo sapiens
ttctctgtgaac

SEQ ID NO: 2850436 - DNA, 18 bp, Homo sapiens
ttctctgtgcccctgtaa

SEQ ID NO: 2850437 - DNA, 20 bp, Homo sapiens
ttctctgtgcccctgtaaat

SEQ ID NO: 2850438 - DNA, 16 bp, Homo sapiens
ttgaatataaacacta

SEQ ID NO: 2850439 - DNA, 13 bp, Homo sapiens
ttgaatatattat

SEQ ID NO: 2850440 - DNA, 19 bp, Homo sapiens
ttgaatccatgcttgggtg

SEQ ID NO: 2850441 - DNA, 23 bp, Homo sapiens
ttgaatctgattggacattttct

SEQ ID NO: 2850442 - DNA, 24 bp, Homo sapiens
ttgaatctgattggacattttctt

SEQ ID NO: 2850443 - DNA, 18 bp, Homo sapiens
ttgaatgtaagaacatga

SEQ ID NO: 2850444 - DNA, 13 bp, Homo sapiens
ttgaattctggag

SEQ ID NO: 2850445 - DNA, 18 bp, Homo sapiens
ttgacaataaatgtgctt

SEQ ID NO: 2850446 - DNA, 14 bp, Homo sapiens
ttgacacacagcac

SEQ ID NO: 2850447 - DNA, 15 bp, Homo sapiens
ttgacataaagttga

SEQ ID NO: 2850448 - DNA, 19 bp, Homo sapiens
ttgacataaagttgataaa

SEQ ID NO: 2850449 - DNA, 19 bp, Homo sapiens
ttgaccaagatgatcacat

SEQ ID NO: 2850450 - DNA, 21 bp, Homo sapiens
ttgacctcaggtgatccaccc

SEQ ID NO: 2850451 - DNA, 19 bp, Homo sapiens
ttgactatcacatacaatt

SEQ ID NO: 2850452 - DNA, 20 bp, Homo sapiens
ttgactatcacatacaattt

SEQ ID NO: 2850453 - DNA, 13 bp, Homo sapiens
ttgactcaagttt

SEQ ID NO: 2850454 - DNA, 15 bp, Homo sapiens
ttgactcttttgcca

SEQ ID NO: 2850455 - DNA, 23 bp, Homo sapiens
ttgactgggtttctctgtatagt

SEQ ID NO: 2850456 - DNA, 19 bp, Homo sapiens
ttgacttgacagaacactg

SEQ ID NO: 2850457 - DNA, 21 bp, Homo sapiens
ttgacttgacagaacactgtc

SEQ ID NO: 2850458 - DNA, 14 bp, Homo sapiens
ttgactttcaggta

SEQ ID NO: 2850459 - DNA, 22 bp, Homo sapiens
ttgagaaaccttattgtacctc

SEQ ID NO: 2850460 - DNA, 16 bp, Homo sapiens
ttgagaccagcctggc

SEQ ID NO: 2850461 - DNA, 19 bp, Homo sapiens
ttgagaggccctggggttc

SEQ ID NO: 2850462 - DNA, 21 bp, Homo sapiens
ttgagataatatctgtgaggt

SEQ ID NO: 2850463 - DNA, 13 bp, Homo sapiens
ttgagatgtgatg

SEQ ID NO: 2850464 - DNA, 16 bp, Homo sapiens
ttgagcaattcatttc

SEQ ID NO: 2850465 - DNA, 18 bp, Homo sapiens
ttgagcaattcatttcac

SEQ ID NO: 2850466 - DNA, 19 bp, Homo sapiens
ttgagcaattcatttcact

SEQ ID NO: 2850467 - DNA, 17 bp, Homo sapiens
ttgagcctccatttctg

SEQ ID NO: 2850468 - DNA, 18 bp, Homo sapiens
ttgagcctccatttctgg

SEQ ID NO: 2850469 - DNA, 23 bp, Homo sapiens
ttgagcctccatttctggcttct

SEQ ID NO: 2850470 - DNA, 13 bp, Homo sapiens
ttgagcctgtcac

SEQ ID NO: 2850471 - DNA, 18 bp, Homo sapiens
ttgagctgttttccctga

SEQ ID NO: 2850472 - DNA, 15 bp, Homo sapiens
ttgaggacaaagaga

SEQ ID NO: 2850473 - DNA, 13 bp, Homo sapiens
ttgaggacacatg

SEQ ID NO: 2850474 - DNA, 21 bp, Homo sapiens
ttgaggcaaaggccagcagca

SEQ ID NO: 2850475 - DNA, 16 bp, Homo sapiens
ttgagggttgggctgg

SEQ ID NO: 2850476 - DNA, 23 bp, Homo sapiens
ttgagtactagaatttgtatttt

SEQ ID NO: 2850477 - DNA, 14 bp, Homo sapiens
ttgagtgactcgag

SEQ ID NO: 2850478 - DNA, 17 bp, Homo sapiens
ttgagtgttttaagata

SEQ ID NO: 2850479 - DNA, 16 bp, Homo sapiens
ttgagttcaaattttg

SEQ ID NO: 2850480 - DNA, 17 bp, Homo sapiens
ttgagttttgactgctt

SEQ ID NO: 2850481 - DNA, 14 bp, Homo sapiens
ttgataaagatttt

SEQ ID NO: 2850482 - DNA, 18 bp, Homo sapiens
ttgataaattccactgga

SEQ ID NO: 2850483 - DNA, 21 bp, Homo sapiens
ttgatatacttttttcttatt

SEQ ID NO: 2850484 - DNA, 21 bp, Homo sapiens
ttgatatgaaaaatatgatat

SEQ ID NO: 2850485 - DNA, 15 bp, Homo sapiens
ttgatatgactgttt

SEQ ID NO: 2850486 - DNA, 21 bp, Homo sapiens
ttgatccctgttacccagaga

SEQ ID NO: 2850487 - DNA, 20 bp, Homo sapiens
ttgatgaccaatctctgtga

SEQ ID NO: 2850488 - DNA, 15 bp, Homo sapiens
ttgatgtacatgtgt

SEQ ID NO: 2850489 - DNA, 11 bp, Homo sapiens
ttgattacata

SEQ ID NO: 2850490 - DNA, 22 bp, Homo sapiens
ttgatttattttttaatcattt

SEQ ID NO: 2850491 - DNA, 22 bp, Homo sapiens
ttgcaaaatttccagtaccttt

SEQ ID NO: 2850492 - DNA, 17 bp, Homo sapiens
ttgcaaagttacagatg

SEQ ID NO: 2850493 - DNA, 13 bp, Homo sapiens
ttgcaaggaagcc

SEQ ID NO: 2850494 - DNA, 22 bp, Homo sapiens
ttgcaataaaatagtattgaaa

SEQ ID NO: 2850495 - DNA, 18 bp, Homo sapiens
ttgcaatcccttaatatc

SEQ ID NO: 2850496 - DNA, 14 bp, Homo sapiens
ttgcaatggcagcc

SEQ ID NO: 2850497 - DNA, 22 bp, Homo sapiens
ttgcacaagcttgtatatacat

SEQ ID NO: 2850498 - DNA, 19 bp, Homo sapiens
ttgcacaatttgagcaatt

SEQ ID NO: 2850499 - DNA, 23 bp, Homo sapiens
ttgcacaatttgagcaattcatt

SEQ ID NO: 2850500 - DNA, 13 bp, Homo sapiens
ttgcactgagggc

SEQ ID NO: 2850501 - DNA, 19 bp, Homo sapiens
ttgcagaaaagcacctgcc

SEQ ID NO: 2850502 - DNA, 20 bp, Homo sapiens
ttgcagaaaagcacctgccg

SEQ ID NO: 2850503 - DNA, 21 bp, Homo sapiens
ttgcagaaaagcacctgccga

SEQ ID NO: 2850504 - DNA, 15 bp, Homo sapiens
ttgcagaaacatttt

SEQ ID NO: 2850505 - DNA, 23 bp, Homo sapiens
ttgcagacaggcaagcacctcct

SEQ ID NO: 2850506 - DNA, 19 bp, Homo sapiens
ttgcagactcagtttgtca

SEQ ID NO: 2850507 - DNA, 19 bp, Homo sapiens
ttgcagagacaggacctga

SEQ ID NO: 2850508 - DNA, 22 bp, Homo sapiens
ttgcagcagaagccaaattttt

SEQ ID NO: 2850509 - DNA, 23 bp, Homo sapiens
ttgcagcagtgagtctcttcaga

SEQ ID NO: 2850510 - DNA, 16 bp, Homo sapiens
ttgcaggacacaagca

SEQ ID NO: 2850511 - DNA, 17 bp, Homo sapiens
ttgcataagattaaagg

SEQ ID NO: 2850512 - DNA, 22 bp, Homo sapiens
ttgcataagattaaaggaagga

SEQ ID NO: 2850513 - DNA, 14 bp, Homo sapiens
ttgcatatatacat

SEQ ID NO: 2850514 - DNA, 13 bp, Homo sapiens
ttgcattccatga

SEQ ID NO: 2850515 - DNA, 21 bp, Homo sapiens
ttgccaccaccagatgagaag

SEQ ID NO: 2850516 - DNA, 15 bp, Homo sapiens
ttgccacctgttaaa

SEQ ID NO: 2850517 - DNA, 18 bp, Homo sapiens
ttgccactgcctcttcct

SEQ ID NO: 2850518 - DNA, 22 bp, Homo sapiens
ttgccagacatgtggtgggaca

SEQ ID NO: 2850519 - DNA, 14 bp, Homo sapiens
ttgccagacttaaa

SEQ ID NO: 2850520 - DNA, 14 bp, Homo sapiens
ttgccatgaggcct

SEQ ID NO: 2850521 - DNA, 15 bp, Homo sapiens
ttgccatgaggcctt

SEQ ID NO: 2850522 - DNA, 20 bp, Homo sapiens
ttgccatggagttgtgatca

SEQ ID NO: 2850523 - DNA, 16 bp, Homo sapiens
ttgccatgttggccag

SEQ ID NO: 2850524 - DNA, 17 bp, Homo sapiens
ttgccatgttggccagg

SEQ ID NO: 2850525 - DNA, 12 bp, Homo sapiens
ttgcccagagat

SEQ ID NO: 2850526 - DNA, 20 bp, Homo sapiens
ttgcccaggctggagtgcag

SEQ ID NO: 2850527 - DNA, 14 bp, Homo sapiens
ttgcccaggctggc

SEQ ID NO: 2850528 - DNA, 14 bp, Homo sapiens
tttaaatcaaaagc

SEQ ID NO: 2850529 - DNA, 18 bp, Homo sapiens
tttaaatgcataaatgca

SEQ ID NO: 2850530 - DNA, 19 bp, Homo sapiens
tttaaattcacaatagaaa

SEQ ID NO: 2850531 - DNA, 12 bp, Homo sapiens
tttaacaaaaca

SEQ ID NO: 2850532 - DNA, 19 bp, Homo sapiens
tttaacaaaacaagaaaga

SEQ ID NO: 2850533 - DNA, 19 bp, Homo sapiens
tttaacacataactagaaa

SEQ ID NO: 2850534 - DNA, 21 bp, Homo sapiens
tttaacctgtttatataattt

SEQ ID NO: 2850535 - DNA, 22 bp, Homo sapiens
tttaacgaatgaagatgtctaa

SEQ ID NO: 2850536 - DNA, 19 bp, Homo sapiens
tttaactaatttaaaccag

SEQ ID NO: 2850537 - DNA, 20 bp, Homo sapiens
tttaactaatttaaaccagc

SEQ ID NO: 2850538 - DNA, 13 bp, Homo sapiens
tttaacttaaata

SEQ ID NO: 2850539 - DNA, 14 bp, Homo sapiens
tttaacttaaatag

SEQ ID NO: 2850540 - DNA, 14 bp, Homo sapiens
tttaagaggcaggg

SEQ ID NO: 2850541 - DNA, 13 bp, Homo sapiens
tttaagcatttta

SEQ ID NO: 2850542 - DNA, 11 bp, Homo sapiens
tttaagctgtt

SEQ ID NO: 2850543 - DNA, 21 bp, Homo sapiens
tttaagtatatagtatattta

SEQ ID NO: 2850544 - DNA, 13 bp, Homo sapiens
tttaagtatttag

SEQ ID NO: 2850545 - DNA, 14 bp, Homo sapiens
tttaagtatttata

SEQ ID NO: 2850546 - DNA, 20 bp, Homo sapiens
tttaagtatttatatattta

SEQ ID NO: 2850547 - DNA, 22 bp, Homo sapiens
tttaataattatgtgccatttt

SEQ ID NO: 2850548 - DNA, 14 bp, Homo sapiens
tttaatacagggta

SEQ ID NO: 2850549 - DNA, 15 bp, Homo sapiens
tttaatatagctatt

SEQ ID NO: 2850550 - DNA, 23 bp, Homo sapiens
tttaatatctgagaagtgtatat

SEQ ID NO: 2850551 - DNA, 13 bp, Homo sapiens
tttaatcttcagt

SEQ ID NO: 2850552 - DNA, 22 bp, Homo sapiens
tttaatgaagacccagtgtaaa

SEQ ID NO: 2850553 - DNA, 20 bp, Homo sapiens
tttaatgtatagtaaatcac

SEQ ID NO: 2850554 - DNA, 21 bp, Homo sapiens
tttaattaggggttgctaaga

SEQ ID NO: 2850555 - DNA, 14 bp, Homo sapiens
tttaattattattc

SEQ ID NO: 2850556 - DNA, 17 bp, Homo sapiens
tttaattcataattaga

SEQ ID NO: 2850557 - DNA, 21 bp, Homo sapiens
tttaattgtaggtcaatgaaa

SEQ ID NO: 2850558 - DNA, 19 bp, Homo sapiens
tttaatttttttgagacag

SEQ ID NO: 2850559 - DNA, 19 bp, Homo sapiens
tttacaaatttaattttgc

SEQ ID NO: 2850560 - DNA, 16 bp, Homo sapiens
tttacactctttgtaa

SEQ ID NO: 2850561 - DNA, 24 bp, Homo sapiens
tttacagatgagattccctctcct

SEQ ID NO: 2850562 - DNA, 20 bp, Homo sapiens
tttacagcctcacttgaatg

SEQ ID NO: 2850563 - DNA, 15 bp, Homo sapiens
tttacagctgcctgc

SEQ ID NO: 2850564 - DNA, 18 bp, Homo sapiens
tttacatggggttttcaa

SEQ ID NO: 2850565 - DNA, 13 bp, Homo sapiens
tttacattttatt

SEQ ID NO: 2850566 - DNA, 16 bp, Homo sapiens
tttacctgcaaaaaat

SEQ ID NO: 2850567 - DNA, 17 bp, Homo sapiens
tttacctttattaatga

SEQ ID NO: 2850568 - DNA, 21 bp, Homo sapiens
tttactactgtggaaaaatat

SEQ ID NO: 2850569 - DNA, 13 bp, Homo sapiens
tttactccagtgg

SEQ ID NO: 2850570 - DNA, 14 bp, Homo sapiens
tttactgacagaaa

SEQ ID NO: 2850571 - DNA, 15 bp, Homo sapiens
tttactgacagaaat

SEQ ID NO: 2850572 - DNA, 21 bp, Homo sapiens
tttactgagcttctctgtgaa

SEQ ID NO: 2850573 - DNA, 13 bp, Homo sapiens
tttactgtctgta

SEQ ID NO: 2850574 - DNA, 13 bp, Homo sapiens
tttacttcatgag

SEQ ID NO: 2850575 - DNA, 18 bp, Homo sapiens
tttacttgcattgaatat

SEQ ID NO: 2850576 - DNA, 15 bp, Homo sapiens
tttactttgtgttca

SEQ ID NO: 2850577 - DNA, 16 bp, Homo sapiens
tttagaaaactttaaa

SEQ ID NO: 2850578 - DNA, 23 bp, Homo sapiens
tttagaaagaagcccaatattat

SEQ ID NO: 2850579 - DNA, 16 bp, Homo sapiens
tttagaaatcattttg

SEQ ID NO: 2850580 - DNA, 18 bp, Homo sapiens
tttagaaatcattttgca

SEQ ID NO: 2850581 - DNA, 15 bp, Homo sapiens
tttagacttcaagca

SEQ ID NO: 2850582 - DNA, 22 bp, Homo sapiens
tttagagtatgcaagaagaata

SEQ ID NO: 2850583 - DNA, 23 bp, Homo sapiens
tttagagtatgcaagaagaatat

SEQ ID NO: 2850584 - DNA, 13 bp, Homo sapiens
tttagattttatg

SEQ ID NO: 2850585 - DNA, 17 bp, Homo sapiens
tttagctctgttcttta

SEQ ID NO: 2850586 - DNA, 15 bp, Homo sapiens
tttagtagagacagg

SEQ ID NO: 2850587 - DNA, 11 bp, Homo sapiens
tttagttcttt

SEQ ID NO: 2850588 - DNA, 13 bp, Homo sapiens
tttataaatgtgt

SEQ ID NO: 2850589 - DNA, 18 bp, Homo sapiens
tttataactcatcataaa

SEQ ID NO: 2850590 - DNA, 19 bp, Homo sapiens
tttataatgtggatttcct

SEQ ID NO: 2850591 - DNA, 22 bp, Homo sapiens
tttatacaaaataatttaacta

SEQ ID NO: 2850592 - DNA, 18 bp, Homo sapiens
tttatacatagtcacaaa

SEQ ID NO: 2850593 - DNA, 21 bp, Homo sapiens
tttatacatagtcacaaaaat

SEQ ID NO: 2850594 - DNA, 22 bp, Homo sapiens
tttatacatagtcacaaaaatg

SEQ ID NO: 2850595 - DNA, 17 bp, Homo sapiens
tttatacatatcagaaa

SEQ ID NO: 2850596 - DNA, 19 bp, Homo sapiens
tttatatatgaagtaagtt

SEQ ID NO: 2850597 - DNA, 14 bp, Homo sapiens
tttatatgccaccg

SEQ ID NO: 2850598 - DNA, 16 bp, Homo sapiens
tttatattgtaaatat

SEQ ID NO: 2850599 - DNA, 19 bp, Homo sapiens
tttatattgtaaatattgt

SEQ ID NO: 2850600 - DNA, 12 bp, Homo sapiens
tttatatttctc

SEQ ID NO: 2850601 - DNA, 14 bp, Homo sapiens
tttatatttctcgt

SEQ ID NO: 2850602 - DNA, 21 bp, Homo sapiens
tttatatttggaaagagacca

SEQ ID NO: 2850603 - DNA, 12 bp, Homo sapiens
tttatcattttc

SEQ ID NO: 2850604 - DNA, 18 bp, Homo sapiens
tttatcctgaaatttcag

SEQ ID NO: 2850605 - DNA, 19 bp, Homo sapiens
tttatcctgaaatttcaga

SEQ ID NO: 2850606 - DNA, 20 bp, Homo sapiens
tttatctaaaagaatttaaa

SEQ ID NO: 2850607 - DNA, 21 bp, Homo sapiens
tttatctaaaagaatttaaat

SEQ ID NO: 2850608 - DNA, 16 bp, Homo sapiens
tttatctgaattttta

SEQ ID NO: 2850609 - DNA, 19 bp, Homo sapiens
tttatgaagaaaaaataca

SEQ ID NO: 2850610 - DNA, 17 bp, Homo sapiens
tttatgcaaggaaggaa

SEQ ID NO: 2850611 - DNA, 20 bp, Homo sapiens
tttatgccttttatttctta

SEQ ID NO: 2850612 - DNA, 13 bp, Homo sapiens
tttatgttattta

SEQ ID NO: 2850613 - DNA, 12 bp, Homo sapiens
tttattaacaaa

SEQ ID NO: 2850614 - DNA, 14 bp, Homo sapiens
tttattacctctga

SEQ ID NO: 2850615 - DNA, 17 bp, Homo sapiens
tttattcaattcctctg

SEQ ID NO: 2850616 - DNA, 14 bp, Homo sapiens
tttatttatcagtg

SEQ ID NO: 2850617 - DNA, 13 bp, Homo sapiens
tttatttcttaaa

SEQ ID NO: 2850618 - DNA, 15 bp, Homo sapiens
tttatttggaataat

SEQ ID NO: 2850619 - DNA, 14 bp, Homo sapiens
ttttaagttgctga

SEQ ID NO: 2850620 - DNA, 16 bp, Homo sapiens
ttttaatgaacaaatg

SEQ ID NO: 2850621 - DNA, 16 bp, Homo sapiens
ttttaatgacttttta

SEQ ID NO: 2850622 - DNA, 13 bp, Homo sapiens
ttttaattaaata

SEQ ID NO: 2850623 - DNA, 11 bp, Homo sapiens
ttttaattatt

SEQ ID NO: 2850624 - DNA, 19 bp, Homo sapiens
ttttacaaaaaagaaaaga

SEQ ID NO: 2850625 - DNA, 12 bp, Homo sapiens
ttttacaaaaca

SEQ ID NO: 2850626 - DNA, 19 bp, Homo sapiens
ttttacaaaacatacccag

SEQ ID NO: 2850627 - DNA, 16 bp, Homo sapiens
ttttacaaatttaatt

SEQ ID NO: 2850628 - DNA, 17 bp, Homo sapiens
ttttacaataaaatctt

SEQ ID NO: 2850629 - DNA, 17 bp, Homo sapiens
ttttacagagaatctga

SEQ ID NO: 2850630 - DNA, 20 bp, Homo sapiens
ttttacagagcttgaaaact

SEQ ID NO: 2850631 - DNA, 19 bp, Homo sapiens
ttttacctaccacagtgtc

SEQ ID NO: 2850632 - DNA, 21 bp, Homo sapiens
ttttacctaccacagtgtctg

SEQ ID NO: 2850633 - DNA, 13 bp, Homo sapiens
ttttactcctttg

SEQ ID NO: 2850634 - DNA, 14 bp, Homo sapiens
ttttactgacagaa

SEQ ID NO: 2850635 - DNA, 21 bp, Homo sapiens
ttttacttggtgtaattaata

SEQ ID NO: 2850636 - DNA, 15 bp, Homo sapiens
ttttacttttgttct

SEQ ID NO: 2850637 - DNA, 16 bp, Homo sapiens
ttttagccttctctgt

SEQ ID NO: 2850638 - DNA, 18 bp, Homo sapiens
ttttaggaagcaagctta

SEQ ID NO: 2850639 - DNA, 15 bp, Homo sapiens
ttttaggagacagtc

SEQ ID NO: 2850640 - DNA, 15 bp, Homo sapiens
ttttagtagagacag

SEQ ID NO: 2850641 - DNA, 17 bp, Homo sapiens
ttttataatgtggattt

SEQ ID NO: 2850642 - DNA, 14 bp, Homo sapiens
ttttatacatagtc

SEQ ID NO: 2850643 - DNA, 12 bp, Homo sapiens
ttttatacatat

SEQ ID NO: 2850644 - DNA, 20 bp, Homo sapiens
ttttatactccatacataac

SEQ ID NO: 2850645 - DNA, 12 bp, Homo sapiens
ttttatactgta

SEQ ID NO: 2850646 - DNA, 23 bp, Homo sapiens
ttttatgaagaaaaaatacattt

SEQ ID NO: 2850647 - DNA, 22 bp, Homo sapiens
ttttatttggaataataatttt

SEQ ID NO: 2850648 - DNA, 12 bp, Homo sapiens
ttttcaaacttt

SEQ ID NO: 2850649 - DNA, 14 bp, Homo sapiens
ttttcaagaaactg

SEQ ID NO: 2850650 - DNA, 14 bp, Homo sapiens
ttttcaatatttat

SEQ ID NO: 2850651 - DNA, 19 bp, Homo sapiens
ttttcaccagatttgctaa

SEQ ID NO: 2850652 - DNA, 16 bp, Homo sapiens
ttttcactgtagaatg

SEQ ID NO: 2850653 - DNA, 13 bp, Homo sapiens
ttttcatttaact

SEQ ID NO: 2850654 - DNA, 18 bp, Homo sapiens
ttttcatttaactacaaa

SEQ ID NO: 2850655 - DNA, 22 bp, Homo sapiens
ttttccacaagattcccagaga

SEQ ID NO: 2850656 - DNA, 15 bp, Homo sapiens
ttttccaccctggaa

SEQ ID NO: 2850657 - DNA, 20 bp, Homo sapiens
ttttccagggcaatcaatgt

SEQ ID NO: 2850658 - DNA, 18 bp, Homo sapiens
ttttccatgaaaatgcaa

SEQ ID NO: 2850659 - DNA, 19 bp, Homo sapiens
ttttccatgaaaatgcaac

SEQ ID NO: 2850660 - DNA, 15 bp, Homo sapiens
ttttcgtgcatttgt

SEQ ID NO: 2850661 - DNA, 20 bp, Homo sapiens
ttttctacacagtaaaaact

SEQ ID NO: 2850662 - DNA, 22 bp, Homo sapiens
ttttctatagctcttctattta

SEQ ID NO: 2850663 - DNA, 20 bp, Homo sapiens
ttttctatttttcttctaaa

SEQ ID NO: 2850664 - DNA, 15 bp, Homo sapiens
ttttctccaccaact

SEQ ID NO: 2850665 - DNA, 17 bp, Homo sapiens
ttttctctttaaaagaa

SEQ ID NO: 2850666 - DNA, 17 bp, Homo sapiens
ttttctgaataacattt

SEQ ID NO: 2850667 - DNA, 21 bp, Homo sapiens
ttttctgatgacataataaag

SEQ ID NO: 2850668 - DNA, 12 bp, Homo sapiens
ttttcttgcagt

SEQ ID NO: 2850669 - DNA, 14 bp, Homo sapiens
ttttcttgcagttt

SEQ ID NO: 2850670 - DNA, 15 bp, Homo sapiens
ttttgaagtcatctt

SEQ ID NO: 2850671 - DNA, 22 bp, Homo sapiens
ttttgcataagattaaaggaag

SEQ ID NO: 2850672 - DNA, 15 bp, Homo sapiens
ttttggccaaagtgt

SEQ ID NO: 2850673 - DNA, 22 bp, Homo sapiens
ttttggttgtcaatattaaata

SEQ ID NO: 2850674 - DNA, 21 bp, Homo sapiens
ttttgtaaagatgccgggttt

SEQ ID NO: 2850675 - DNA, 15 bp, Homo sapiens
ttttgtacagaattt

SEQ ID NO: 2850676 - DNA, 20 bp, Homo sapiens
ttttgtacagaatttttaat

SEQ ID NO: 2850677 - DNA, 19 bp, Homo sapiens
ttttgtagagccagggtct

SEQ ID NO: 2850678 - DNA, 21 bp, Homo sapiens
ttttgtagtagttgatgacca

SEQ ID NO: 2850679 - DNA, 16 bp, Homo sapiens
ttttgtatagtaaagt

SEQ ID NO: 2850680 - DNA, 14 bp, Homo sapiens
ttttgtatttttga

SEQ ID NO: 2850681 - DNA, 15 bp, Homo sapiens
ttttgtcctgttatt

SEQ ID NO: 2850682 - DNA, 21 bp, Homo sapiens
ttttgtggtcattaagcattg

SEQ ID NO: 2850683 - DNA, 15 bp, Homo sapiens
ttttgtttcttccaa

SEQ ID NO: 2850684 - DNA, 16 bp, Homo sapiens
ttttgtttgtaatcct

SEQ ID NO: 2850685 - DNA, 14 bp, Homo sapiens
tttttaataattta

SEQ ID NO: 2850686 - DNA, 21 bp, Homo sapiens
tttttaattgaggacagcctg

SEQ ID NO: 2850687 - DNA, 19 bp, Homo sapiens
tttttagagattaatttgt

SEQ ID NO: 2850688 - DNA, 21 bp, Homo sapiens
tttttatactccatacataac

SEQ ID NO: 2850689 - DNA, 13 bp, Homo sapiens
tttttatttaaaa

SEQ ID NO: 2850690 - DNA, 19 bp, Homo sapiens
tttttatttgtttgtgcat

SEQ ID NO: 2850691 - DNA, 22 bp, Homo sapiens
tttttcaaccagcattttacta

SEQ ID NO: 2850692 - DNA, 14 bp, Homo sapiens
tttttcagaaatat

SEQ ID NO: 2850693 - DNA, 14 bp, Homo sapiens
tttttccccaaagt

SEQ ID NO: 2850694 - DNA, 16 bp, Homo sapiens
tttttccccaaagtct

SEQ ID NO: 2850695 - DNA, 14 bp, Homo sapiens
tttttccgtaaaaa

SEQ ID NO: 2850696 - DNA, 17 bp, Homo sapiens
tttttccttgtatttaa

SEQ ID NO: 2850697 - DNA, 22 bp, Homo sapiens
tttttctacacagtaaaaactt

SEQ ID NO: 2850698 - DNA, 13 bp, Homo sapiens
tttttctttataa

SEQ ID NO: 2850699 - DNA, 16 bp, Homo sapiens
tttttctttataaact

SEQ ID NO: 2850700 - DNA, 13 bp, Homo sapiens
tttttgatactaa

SEQ ID NO: 2850701 - DNA, 15 bp, Homo sapiens
tttttgatactaagc

SEQ ID NO: 2850702 - DNA, 22 bp, Homo sapiens
tttttggaagaggactccttaa

SEQ ID NO: 2850703 - DNA, 20 bp, Homo sapiens
tttttgtagagccagggtct

SEQ ID NO: 2850704 - DNA, 13 bp, Homo sapiens
tttttgtcttttc

SEQ ID NO: 2850705 - DNA, 13 bp, Homo sapiens
ttttttatgctaa

SEQ ID NO: 2850706 - DNA, 18 bp, Homo sapiens
ttttttcaatatttatta

SEQ ID NO: 2850707 - DNA, 14 bp, Homo sapiens
ctcagtgctcggca

SEQ ID NO: 2850708 - DNA, 18 bp, Homo sapiens
ctcagtgctcggcagtca

SEQ ID NO: 2850709 - DNA, 19 bp, Homo sapiens
ctcagtgctcggcagtcat

SEQ ID NO: 2850710 - DNA, 14 bp, Homo sapiens
ctcagttaaaatgt

SEQ ID NO: 2850711 - DNA, 18 bp, Homo sapiens
ctcataagttggaccaga

SEQ ID NO: 2850712 - DNA, 13 bp, Homo sapiens
ctcataccatctg

SEQ ID NO: 2850713 - DNA, 22 bp, Homo sapiens
ctcataccatctgctgccccgc

SEQ ID NO: 2850714 - DNA, 24 bp, Homo sapiens
ctcatcagtgtcctcttgctcaaa

SEQ ID NO: 2850715 - DNA, 16 bp, Homo sapiens
ctcatcataaaataaa

SEQ ID NO: 2850716 - DNA, 13 bp, Homo sapiens
ctcatcatattgt

SEQ ID NO: 2850717 - DNA, 14 bp, Homo sapiens
ctcatcatattgta

SEQ ID NO: 2850718 - DNA, 15 bp, Homo sapiens
ctcatcatattgtat

SEQ ID NO: 2850719 - DNA, 11 bp, Homo sapiens
ctcatctcagt

SEQ ID NO: 2850720 - DNA, 12 bp, Homo sapiens
ctcatctcttct

SEQ ID NO: 2850721 - DNA, 15 bp, Homo sapiens
ctcatctcttctttt

SEQ ID NO: 2850722 - DNA, 12 bp, Homo sapiens
ctcatctgtcac

SEQ ID NO: 2850723 - DNA, 21 bp, Homo sapiens
ctcatgaacctcaagctgcat

SEQ ID NO: 2850724 - DNA, 12 bp, Homo sapiens
ctcatgacagcc

SEQ ID NO: 2850725 - DNA, 18 bp, Homo sapiens
ctcatgaccctcctgtcc

SEQ ID NO: 2850726 - DNA, 16 bp, Homo sapiens
ctcatgcctggccccc

SEQ ID NO: 2850727 - DNA, 21 bp, Homo sapiens
ctcatgcctggcccccctcca

SEQ ID NO: 2850728 - DNA, 12 bp, Homo sapiens
ctcatgtgatcc

SEQ ID NO: 2850729 - DNA, 13 bp, Homo sapiens
ctcattcccctcg

SEQ ID NO: 2850730 - DNA, 18 bp, Homo sapiens
ctcatttgtcacacactt

SEQ ID NO: 2850731 - DNA, 21 bp, Homo sapiens
ctcatttgtcacacactttgg

SEQ ID NO: 2850732 - DNA, 13 bp, Homo sapiens
ctcattttttaaa

SEQ ID NO: 2850733 - DNA, 19 bp, Homo sapiens
ctcatttttttccttgcaa

SEQ ID NO: 2850734 - DNA, 16 bp, Homo sapiens
ctccaaacaccggcag

SEQ ID NO: 2850735 - DNA, 22 bp, Homo sapiens
ctccaaacctcctgttagctgt

SEQ ID NO: 2850736 - DNA, 17 bp, Homo sapiens
ctccaacgttaaaagac

SEQ ID NO: 2850737 - DNA, 20 bp, Homo sapiens
ctccaacgttaaaagacagt

SEQ ID NO: 2850738 - DNA, 21 bp, Homo sapiens
ctccaagaatacagaaaatgc

SEQ ID NO: 2850739 - DNA, 14 bp, Homo sapiens
ctccaagagctaca

SEQ ID NO: 2850740 - DNA, 18 bp, Homo sapiens
ctccaagctccatctcca

SEQ ID NO: 2850741 - DNA, 17 bp, Homo sapiens
ctccaagcttcaagtga

SEQ ID NO: 2850742 - DNA, 14 bp, Homo sapiens
ctccaattgtaaaa

SEQ ID NO: 2850743 - DNA, 12 bp, Homo sapiens
ctccaccaaccc

SEQ ID NO: 2850744 - DNA, 16 bp, Homo sapiens
ctccaccacccaaaag

SEQ ID NO: 2850745 - DNA, 22 bp, Homo sapiens
ctccaccccaggacgccactca

SEQ ID NO: 2850746 - DNA, 15 bp, Homo sapiens
ctccaccctgagcct

SEQ ID NO: 2850747 - DNA, 19 bp, Homo sapiens
ctccaccctgagcctgacc

SEQ ID NO: 2850748 - DNA, 20 bp, Homo sapiens
ctccaccctgagcctgacct

SEQ ID NO: 2850749 - DNA, 13 bp, Homo sapiens
ctccacctcagcc

SEQ ID NO: 2850750 - DNA, 14 bp, Homo sapiens
ctccacctcagcct

SEQ ID NO: 2850751 - DNA, 17 bp, Homo sapiens
ctccacctcagccttgg

SEQ ID NO: 2850752 - DNA, 20 bp, Homo sapiens
ctccactaaatgagctcctg

SEQ ID NO: 2850753 - DNA, 18 bp, Homo sapiens
ctccactgctctcagcct

SEQ ID NO: 2850754 - DNA, 22 bp, Homo sapiens
ctccagaacaaacctctatatg

SEQ ID NO: 2850755 - DNA, 23 bp, Homo sapiens
ctccagccagcaatgatgtccag

SEQ ID NO: 2850756 - DNA, 15 bp, Homo sapiens
ctccagccagcgcct

SEQ ID NO: 2850757 - DNA, 17 bp, Homo sapiens
ctccagccagcgcctcc

SEQ ID NO: 2850758 - DNA, 19 bp, Homo sapiens
ctccagccagcgcctccct

SEQ ID NO: 2850759 - DNA, 12 bp, Homo sapiens
ctccagcctggg

SEQ ID NO: 2850760 - DNA, 24 bp, Homo sapiens
ctccagccttctctctctggtcag

SEQ ID NO: 2850761 - DNA, 17 bp, Homo sapiens
ctccagcggctgggtgg

SEQ ID NO: 2850762 - DNA, 16 bp, Homo sapiens
ctccagctcaccagcc

SEQ ID NO: 2850763 - DNA, 18 bp, Homo sapiens
ctccagctcaccagcccc

SEQ ID NO: 2850764 - DNA, 21 bp, Homo sapiens
ctccagctggaattgctgctc

SEQ ID NO: 2850765 - DNA, 20 bp, Homo sapiens
ctccagcttcccctcgctgt

SEQ ID NO: 2850766 - DNA, 15 bp, Homo sapiens
ctccagctttcctgt

SEQ ID NO: 2850767 - DNA, 20 bp, Homo sapiens
ctccaggaaggtagcccagc

SEQ ID NO: 2850768 - DNA, 19 bp, Homo sapiens
ctccaggagcctaccccct

SEQ ID NO: 2850769 - DNA, 11 bp, Homo sapiens
ctccaggctcc

SEQ ID NO: 2850770 - DNA, 22 bp, Homo sapiens
ctccaggctgtatcccatgagc

SEQ ID NO: 2850771 - DNA, 23 bp, Homo sapiens
ctccaggctgtatcccatgagcc

SEQ ID NO: 2850772 - DNA, 18 bp, Homo sapiens
ctccagggccacgtgcca

SEQ ID NO: 2850773 - DNA, 15 bp, Homo sapiens
ctccagggctgcccc

SEQ ID NO: 2850774 - DNA, 16 bp, Homo sapiens
ctccagggctgcccct

SEQ ID NO: 2850775 - DNA, 16 bp, Homo sapiens
ctccagtagtggacaa

SEQ ID NO: 2850776 - DNA, 22 bp, Homo sapiens
ctccagtatggaagaatggggt

SEQ ID NO: 2850777 - DNA, 19 bp, Homo sapiens
ctccagtggttgctgttga

SEQ ID NO: 2850778 - DNA, 19 bp, Homo sapiens
ctccatcccgcccttccca

SEQ ID NO: 2850779 - DNA, 12 bp, Homo sapiens
ctccatcttatt

SEQ ID NO: 2850780 - DNA, 13 bp, Homo sapiens
ctccatgctgcct

SEQ ID NO: 2850781 - DNA, 14 bp, Homo sapiens
ctccatgctgcctc

SEQ ID NO: 2850782 - DNA, 13 bp, Homo sapiens
ctccatgtgggct

SEQ ID NO: 2850783 - DNA, 17 bp, Homo sapiens
ctccatttctggcttct

SEQ ID NO: 2850784 - DNA, 14 bp, Homo sapiens
ctcccaccaccctc

SEQ ID NO: 2850785 - DNA, 23 bp, Homo sapiens
ctcccaccccacccccttcagtg

SEQ ID NO: 2850786 - DNA, 11 bp, Homo sapiens
ctcccaccccc

SEQ ID NO: 2850787 - DNA, 15 bp, Homo sapiens
ctcccacccccagcc

SEQ ID NO: 2850788 - DNA, 16 bp, Homo sapiens
ctcccacccccagccc

SEQ ID NO: 2850789 - DNA, 16 bp, Homo sapiens
ctcccacctcagcctc

SEQ ID NO: 2850790 - DNA, 15 bp, Homo sapiens
ctcccacctccgctg

SEQ ID NO: 2850791 - DNA, 19 bp, Homo sapiens
ctcccagcagccctaagga

SEQ ID NO: 2850792 - DNA, 16 bp, Homo sapiens
ctcccagccctatgga

SEQ ID NO: 2850793 - DNA, 18 bp, Homo sapiens
ctcccagccctatggatg

SEQ ID NO: 2850794 - DNA, 13 bp, Homo sapiens
ctcctctgtctct

SEQ ID NO: 2850795 - DNA, 15 bp, Homo sapiens
ctcctctgtctctgc

SEQ ID NO: 2850796 - DNA, 23 bp, Homo sapiens
ctcctctgtctctgctcttgcct

SEQ ID NO: 2850797 - DNA, 15 bp, Homo sapiens
ctgtacactgcacga

SEQ ID NO: 2850798 - DNA, 22 bp, Homo sapiens
ctgtacccttcgggagggcact

SEQ ID NO: 2850799 - DNA, 15 bp, Homo sapiens
ctgtacgtctgacag

SEQ ID NO: 2850800 - DNA, 16 bp, Homo sapiens
ctgtacgtctgacagg

SEQ ID NO: 2850801 - DNA, 18 bp, Homo sapiens
ctgtacgtctgacaggca

SEQ ID NO: 2850802 - DNA, 13 bp, Homo sapiens
ctgtactcaggag

SEQ ID NO: 2850803 - DNA, 16 bp, Homo sapiens
ctgtactgcctgcttg

SEQ ID NO: 2850804 - DNA, 18 bp, Homo sapiens
ctgtactgcctgcttggg

SEQ ID NO: 2850805 - DNA, 21 bp, Homo sapiens
ctgtacttattttccaataaa

SEQ ID NO: 2850806 - DNA, 22 bp, Homo sapiens
ctgtacttattttccaataaaa

SEQ ID NO: 2850807 - DNA, 19 bp, Homo sapiens
ctgtagcatcttctggagt

SEQ ID NO: 2850808 - DNA, 18 bp, Homo sapiens
ctgtagcattacagtggg

SEQ ID NO: 2850809 - DNA, 14 bp, Homo sapiens
ctgtagctctcctg

SEQ ID NO: 2850810 - DNA, 15 bp, Homo sapiens
ctgtagctctcctgg

SEQ ID NO: 2850811 - DNA, 17 bp, Homo sapiens
ctgtagggctggaccta

SEQ ID NO: 2850812 - DNA, 18 bp, Homo sapiens
ctgtagggctggacctat

SEQ ID NO: 2850813 - DNA, 14 bp, Homo sapiens
ctgtagtcccagcc

SEQ ID NO: 2850814 - DNA, 22 bp, Homo sapiens
ctgtagtcctagccactcagga

SEQ ID NO: 2850815 - DNA, 19 bp, Homo sapiens
ctgtagtgagaaactgatt

SEQ ID NO: 2850816 - DNA, 21 bp, Homo sapiens
ctgtagtgccccctctaaccc

SEQ ID NO: 2850817 - DNA, 15 bp, Homo sapiens
ctgtagttaggaaat

SEQ ID NO: 2850818 - DNA, 17 bp, Homo sapiens
ctgtagttaggaaataa

SEQ ID NO: 2850819 - DNA, 18 bp, Homo sapiens
ctgtagttaggaaataaa

SEQ ID NO: 2850820 - DNA, 13 bp, Homo sapiens
ctgtatattatgg

SEQ ID NO: 2850821 - DNA, 23 bp, Homo sapiens
ctgtatcccatgagcctcagcat

SEQ ID NO: 2850822 - DNA, 22 bp, Homo sapiens
ctgtattcagatcgtattaatt

SEQ ID NO: 2850823 - DNA, 18 bp, Homo sapiens
ctgtatttgttcccaaga

SEQ ID NO: 2850824 - DNA, 17 bp, Homo sapiens
ctgtcaatttccctgac

SEQ ID NO: 2850825 - DNA, 23 bp, Homo sapiens
ctgtcaccaagctcacagttcct

SEQ ID NO: 2850826 - DNA, 19 bp, Homo sapiens
ctgtcacgtgaaatattta

SEQ ID NO: 2850827 - DNA, 18 bp, Homo sapiens
ctgtcatccagaaaatgt

SEQ ID NO: 2850828 - DNA, 13 bp, Homo sapiens
ctgtcattcagga

SEQ ID NO: 2850829 - DNA, 22 bp, Homo sapiens
ctgtcattcaggaccccaaccc

SEQ ID NO: 2850830 - DNA, 14 bp, Homo sapiens
ctgtcattgtccat

SEQ ID NO: 2850831 - DNA, 23 bp, Homo sapiens
ctgtccaacctaacccctttcct

SEQ ID NO: 2850832 - DNA, 19 bp, Homo sapiens
ctgtccaggcactgctgcc

SEQ ID NO: 2850833 - DNA, 18 bp, Homo sapiens
ctgtccagggccctgagc

SEQ ID NO: 2850834 - DNA, 23 bp, Homo sapiens
ctgtccagggccctgagctcggt

SEQ ID NO: 2850835 - DNA, 13 bp, Homo sapiens
ctgtccataaagt

SEQ ID NO: 2850836 - DNA, 23 bp, Homo sapiens
ctgtccataaagtaattttgtga

SEQ ID NO: 2850837 - DNA, 14 bp, Homo sapiens
ctgtcccacctctt

SEQ ID NO: 2850838 - DNA, 23 bp, Homo sapiens
ctgtccccctgagatcagagtcc

SEQ ID NO: 2850839 - DNA, 17 bp, Homo sapiens
ctgtccctgtcaccaag

SEQ ID NO: 2850840 - DNA, 11 bp, Homo sapiens
ctgtcctccag

SEQ ID NO: 2850841 - DNA, 12 bp, Homo sapiens
ctgtcctcctcg

SEQ ID NO: 2850842 - DNA, 23 bp, Homo sapiens
ctgtcctcctcggatcaccgaga

SEQ ID NO: 2850843 - DNA, 17 bp, Homo sapiens
ctgtcgattagactgga

SEQ ID NO: 2850844 - DNA, 23 bp, Homo sapiens
ctgtctcaaaaaaacacaaaagt

SEQ ID NO: 2850845 - DNA, 12 bp, Homo sapiens
ctgtctccctgg

SEQ ID NO: 2850846 - DNA, 15 bp, Homo sapiens
ctgtctccctggggt

SEQ ID NO: 2850847 - DNA, 19 bp, Homo sapiens
ctgtctcgagcgccctgca

SEQ ID NO: 2850848 - DNA, 13 bp, Homo sapiens
ctgtctctcatga

SEQ ID NO: 2850849 - DNA, 13 bp, Homo sapiens
ctgtctctgctct

SEQ ID NO: 2850850 - DNA, 17 bp, Homo sapiens
ctgtctctgctcttgcc

SEQ ID NO: 2850851 - DNA, 16 bp, Homo sapiens
ctgtctgccagccagc

SEQ ID NO: 2850852 - DNA, 20 bp, Homo sapiens
ctgtctgccagccagcagcc

SEQ ID NO: 2850853 - DNA, 21 bp, Homo sapiens
ctgtctgccagccagcagcca

SEQ ID NO: 2850854 - DNA, 14 bp, Homo sapiens
ctgtctgtctgtcc

SEQ ID NO: 2850855 - DNA, 14 bp, Homo sapiens
ctgtctgtctgtct

SEQ ID NO: 2850856 - DNA, 22 bp, Homo sapiens
ctgtcttcatagcagattttaa

SEQ ID NO: 2850857 - DNA, 16 bp, Homo sapiens
ctgtcttgccagccag

SEQ ID NO: 2850858 - DNA, 19 bp, Homo sapiens
ctgtcttgccagccagaag

SEQ ID NO: 2850859 - DNA, 15 bp, Homo sapiens
ctgtcttgcctgcca

SEQ ID NO: 2850860 - DNA, 20 bp, Homo sapiens
ctgtcttgcctgccagggcc

SEQ ID NO: 2850861 - DNA, 21 bp, Homo sapiens
ctgtcttgcctgccagggccc

SEQ ID NO: 2850862 - DNA, 15 bp, Homo sapiens
ctgtctttcagcatt

SEQ ID NO: 2850863 - DNA, 14 bp, Homo sapiens
ctgtgaaagtatgt

SEQ ID NO: 2850864 - DNA, 17 bp, Homo sapiens
ctgtgaaagtatgtgat

SEQ ID NO: 2850865 - DNA, 19 bp, Homo sapiens
ctgtgaaagtatgtgatat

SEQ ID NO: 2850866 - DNA, 14 bp, Homo sapiens
ctgtgaacccagga

SEQ ID NO: 2850867 - DNA, 17 bp, Homo sapiens
ctgtgaacccaggacaa

SEQ ID NO: 2850868 - DNA, 15 bp, Homo sapiens
ctgtgaagaatgaag

SEQ ID NO: 2850869 - DNA, 22 bp, Homo sapiens
ctgtgacaggaagcccaaggca

SEQ ID NO: 2850870 - DNA, 22 bp, Homo sapiens
ctgtgacctgctgagctctgag

SEQ ID NO: 2850871 - DNA, 23 bp, Homo sapiens
ctgtgacctgctgagctctgaga

SEQ ID NO: 2850872 - DNA, 20 bp, Homo sapiens
ctgtgactcgcttagctgaa

SEQ ID NO: 2850873 - DNA, 22 bp, Homo sapiens
ctgtgacttcagctctgtttta

SEQ ID NO: 2850874 - DNA, 20 bp, Homo sapiens
ctgtgagataaccacaacca

SEQ ID NO: 2850875 - DNA, 15 bp, Homo sapiens
ctgtgaggtgctgat

SEQ ID NO: 2850876 - DNA, 17 bp, Homo sapiens
ctgtgaggtgctgatga

SEQ ID NO: 2850877 - DNA, 19 bp, Homo sapiens
ctgtgaggtgctgatgagt

SEQ ID NO: 2850878 - DNA, 16 bp, Homo sapiens
ctgtgatggggtgggc

SEQ ID NO: 2850879 - DNA, 13 bp, Homo sapiens
ctgtgcagggagg

SEQ ID NO: 2850880 - DNA, 16 bp, Homo sapiens
ctgtgccagagcctgg

SEQ ID NO: 2850881 - DNA, 14 bp, Homo sapiens
ctgtgccatgtgcc

SEQ ID NO: 2850882 - DNA, 16 bp, Homo sapiens
ctgtgccatgtgccag

SEQ ID NO: 2850883 - DNA, 22 bp, Homo sapiens
ctgtgcccacatcccaggcttc

SEQ ID NO: 2850884 - DNA, 17 bp, Homo sapiens
ctgtgcctcgctcccca

SEQ ID NO: 2850885 - DNA, 13 bp, Homo sapiens
ctgtgcctctgcc

SEQ ID NO: 2850886 - DNA, 15 bp, Homo sapiens
ccacctccgccccag

SEQ ID NO: 2850887 - DNA, 15 bp, Homo sapiens
ccacctctctttttc

SEQ ID NO: 2850888 - DNA, 16 bp, Homo sapiens
ccacctcttctcttcc

SEQ ID NO: 2850889 - DNA, 18 bp, Homo sapiens
ccacctcttctcttcctg

SEQ ID NO: 2850890 - DNA, 19 bp, Homo sapiens
ccacctcttctcttcctgt

SEQ ID NO: 2850891 - DNA, 20 bp, Homo sapiens
ccacctcttgggcatgctca

SEQ ID NO: 2850892 - DNA, 23 bp, Homo sapiens
ccacctcttgggcatgctcagcc

SEQ ID NO: 2850893 - DNA, 20 bp, Homo sapiens
ccacctgaagtgatgatgga

SEQ ID NO: 2850894 - DNA, 19 bp, Homo sapiens
ccacctgcctatccatcct

SEQ ID NO: 2850895 - DNA, 15 bp, Homo sapiens
ccacctgctgagaga

SEQ ID NO: 2850896 - DNA, 13 bp, Homo sapiens
ccacctgctttct

SEQ ID NO: 2850897 - DNA, 12 bp, Homo sapiens
ccacctggcccc

SEQ ID NO: 2850898 - DNA, 16 bp, Homo sapiens
ccacctgtctgtctgt

SEQ ID NO: 2850899 - DNA, 19 bp, Homo sapiens
ccacctgttaaaatgtaca

SEQ ID NO: 2850900 - DNA, 19 bp, Homo sapiens
ccaccttcccagctctccc

SEQ ID NO: 2850901 - DNA, 21 bp, Homo sapiens
ccaccttcccagctctccctc

SEQ ID NO: 2850902 - DNA, 19 bp, Homo sapiens
ccaccttgccaagctttct

SEQ ID NO: 2850903 - DNA, 16 bp, Homo sapiens
ccaccttggactcctc

SEQ ID NO: 2850904 - DNA, 18 bp, Homo sapiens
ccaccttggactcctccc

SEQ ID NO: 2850905 - DNA, 15 bp, Homo sapiens
ccaccttggctgcag

SEQ ID NO: 2850906 - DNA, 18 bp, Homo sapiens
ccaccttggctgcaggga

SEQ ID NO: 2850907 - DNA, 19 bp, Homo sapiens
ccaccttggctgcagggag

SEQ ID NO: 2850908 - DNA, 22 bp, Homo sapiens
ccacgaatttggtgtggctgta

SEQ ID NO: 2850909 - DNA, 20 bp, Homo sapiens
ccacgaggagcttccagtgc

SEQ ID NO: 2850910 - DNA, 18 bp, Homo sapiens
ccacgatgtggccctggc

SEQ ID NO: 2850911 - DNA, 18 bp, Homo sapiens
ccacgctggagtgcagtg

SEQ ID NO: 2850912 - DNA, 19 bp, Homo sapiens
ccacggacgtttccatcag

SEQ ID NO: 2850913 - DNA, 20 bp, Homo sapiens
ccacggacgtttccatcagg

SEQ ID NO: 2850914 - DNA, 18 bp, Homo sapiens
ccacggatgttgtcagga

SEQ ID NO: 2850915 - DNA, 12 bp, Homo sapiens
ccacggccaggc

SEQ ID NO: 2850916 - DNA, 13 bp, Homo sapiens
ccacggccaggcc

SEQ ID NO: 2850917 - DNA, 14 bp, Homo sapiens
ccacgtgccaggcc

SEQ ID NO: 2850918 - DNA, 15 bp, Homo sapiens
ccacgtgccaggccc

SEQ ID NO: 2850919 - DNA, 22 bp, Homo sapiens
ccactaaaacaaaacaaaaaac

SEQ ID NO: 2850920 - DNA, 14 bp, Homo sapiens
ccactaaatgagct

SEQ ID NO: 2850921 - DNA, 19 bp, Homo sapiens
ccactaaatgagctcctgc

SEQ ID NO: 2850922 - DNA, 23 bp, Homo sapiens
ccactaaatgagctcctgcggga

SEQ ID NO: 2850923 - DNA, 21 bp, Homo sapiens
ccactacactccagcctgagc

SEQ ID NO: 2850924 - DNA, 22 bp, Homo sapiens
ccactacactccagcctgagca

SEQ ID NO: 2850925 - DNA, 16 bp, Homo sapiens
ccactaggactctgag

SEQ ID NO: 2850926 - DNA, 19 bp, Homo sapiens
ccactaggactctgaggct

SEQ ID NO: 2850927 - DNA, 13 bp, Homo sapiens
ccactcaggaggc

SEQ ID NO: 2850928 - DNA, 18 bp, Homo sapiens
ccactcagtccatagcag

SEQ ID NO: 2850929 - DNA, 13 bp, Homo sapiens
ccactcctcactg

SEQ ID NO: 2850930 - DNA, 16 bp, Homo sapiens
ccactcctgcttctct

SEQ ID NO: 2850931 - DNA, 20 bp, Homo sapiens
ccactcctgcttctctgggg

SEQ ID NO: 2850932 - DNA, 16 bp, Homo sapiens
ccactccttcctgccc

SEQ ID NO: 2850933 - DNA, 20 bp, Homo sapiens
ccactcgggaggctgagaca

SEQ ID NO: 2850934 - DNA, 23 bp, Homo sapiens
ccactcgggaggctgagacagga

SEQ ID NO: 2850935 - DNA, 15 bp, Homo sapiens
ccactctcccctccc

SEQ ID NO: 2850936 - DNA, 22 bp, Homo sapiens
ccactctcccctccctcttcct

SEQ ID NO: 2850937 - DNA, 21 bp, Homo sapiens
ccactctgaataccaagtgtg

SEQ ID NO: 2850938 - DNA, 13 bp, Homo sapiens
ccactctgctctg

SEQ ID NO: 2850939 - DNA, 15 bp, Homo sapiens
ccactctgctctgat

SEQ ID NO: 2850940 - DNA, 18 bp, Homo sapiens
ccactctgctctgatgca

SEQ ID NO: 2850941 - DNA, 14 bp, Homo sapiens
ccactctggcagcc

SEQ ID NO: 2850942 - DNA, 17 bp, Homo sapiens
ccactctggcagccaca

SEQ ID NO: 2850943 - DNA, 18 bp, Homo sapiens
ccactctggcagccacac

SEQ ID NO: 2850944 - DNA, 14 bp, Homo sapiens
ccactgaagctggg

SEQ ID NO: 2850945 - DNA, 14 bp, Homo sapiens
ccactgcaccgggc

SEQ ID NO: 2850946 - DNA, 18 bp, Homo sapiens
ccactgcactccagcctg

SEQ ID NO: 2850947 - DNA, 19 bp, Homo sapiens
ccactgcactccagcctgg

SEQ ID NO: 2850948 - DNA, 14 bp, Homo sapiens
ccactgcaggcccc

SEQ ID NO: 2850949 - DNA, 11 bp, Homo sapiens
ccactgcctct

SEQ ID NO: 2850950 - DNA, 14 bp, Homo sapiens
ccactgctctcagc

SEQ ID NO: 2850951 - DNA, 12 bp, Homo sapiens
ccactgctctgg

SEQ ID NO: 2850952 - DNA, 20 bp, Homo sapiens
ccactgcttttggtctgtgt

SEQ ID NO: 2850953 - DNA, 18 bp, Homo sapiens
ccactgtaaaatgaaatt

SEQ ID NO: 2850954 - DNA, 18 bp, Homo sapiens
ccactgtcttgcctgcca

SEQ ID NO: 2850955 - DNA, 19 bp, Homo sapiens
ccacttaaaaaatgtccat

SEQ ID NO: 2850956 - DNA, 19 bp, Homo sapiens
ccacttaccttcaataaag

SEQ ID NO: 2850957 - DNA, 18 bp, Homo sapiens
ccacttctctactctgga

SEQ ID NO: 2850958 - DNA, 21 bp, Homo sapiens
ccacttctctactctggaagt

SEQ ID NO: 2850959 - DNA, 16 bp, Homo sapiens
ccacttgggtcttccc

SEQ ID NO: 2850960 - DNA, 17 bp, Homo sapiens
ccacttgggtcttccct

SEQ ID NO: 2850961 - DNA, 16 bp, Homo sapiens
ccagaaaaccccagca

SEQ ID NO: 2850962 - DNA, 16 bp, Homo sapiens
ccagaaaacctccagt

SEQ ID NO: 2850963 - DNA, 14 bp, Homo sapiens
ccagaaaatataaa

SEQ ID NO: 2850964 - DNA, 15 bp, Homo sapiens
ccagaaaatataaat

SEQ ID NO: 2850965 - DNA, 22 bp, Homo sapiens
ccagaacaaggttccctctgag

SEQ ID NO: 2850966 - DNA, 17 bp, Homo sapiens
ccagaacagtttgtaca

SEQ ID NO: 2850967 - DNA, 15 bp, Homo sapiens
ccagaagcctctgcc

SEQ ID NO: 2850968 - DNA, 18 bp, Homo sapiens
ccagaaggggcacgcctg

SEQ ID NO: 2850969 - DNA, 13 bp, Homo sapiens
ccagaataagtgc

SEQ ID NO: 2850970 - DNA, 22 bp, Homo sapiens
ccagaattgcattctgaatgaa

SEQ ID NO: 2850971 - DNA, 17 bp, Homo sapiens
ccagacaccttgacagg

SEQ ID NO: 2850972 - DNA, 13 bp, Homo sapiens
ccagacactggtt

SEQ ID NO: 2850973 - DNA, 13 bp, Homo sapiens
ccagactcagctc

SEQ ID NO: 2850974 - DNA, 14 bp, Homo sapiens
ccagactcagctcc

SEQ ID NO: 2850975 - DNA, 13 bp, Homo sapiens
ccagactgtggag

SEQ ID NO: 2850976 - DNA, 19 bp, Homo sapiens
ccagacttctctttcttat

SEQ ID NO: 2850977 - DNA, 15 bp, Homo sapiens
ccagggtgagagctg

SEQ ID NO: 2850978 - DNA, 16 bp, Homo sapiens
ccagggtgagagctgc

SEQ ID NO: 2850979 - DNA, 17 bp, Homo sapiens
ccagggtgagagctgct

SEQ ID NO: 2850980 - DNA, 22 bp, Homo sapiens
ccagggtgagagctgctctgga

SEQ ID NO: 2850981 - DNA, 23 bp, Homo sapiens
ccagggtgagagctgctctggaa

SEQ ID NO: 2850982 - DNA, 14 bp, Homo sapiens
ccaggtagaacaca

SEQ ID NO: 2850983 - DNA, 17 bp, Homo sapiens
ccaggtatctccaggat

SEQ ID NO: 2850984 - DNA, 18 bp, Homo sapiens
ccaggtatctccaggatt

SEQ ID NO: 2850985 - DNA, 13 bp, Homo sapiens
ccaggtcctctga

SEQ ID NO: 2850986 - DNA, 21 bp, Homo sapiens
ccaggtcctggtggggcagct

SEQ ID NO: 2850987 - DNA, 16 bp, Homo sapiens
ccaggtctctccactg

SEQ ID NO: 2850988 - DNA, 22 bp, Homo sapiens
ccaggtgcagtggctcacgcct

SEQ ID NO: 2850989 - DNA, 22 bp, Homo sapiens
ccaggtggctgacccagtccct

SEQ ID NO: 2850990 - DNA, 10 bp, Homo sapiens
aaaaaaatac

SEQ ID NO: 2850991 - DNA, 12 bp, Homo sapiens
aaaaaaatgaca

SEQ ID NO: 2850992 - DNA, 12 bp, Homo sapiens
aaaaaaattgca

SEQ ID NO: 2850993 - DNA, 21 bp, Homo sapiens
aaaaaagagaaaaaccaatga

SEQ ID NO: 2850994 - DNA, 21 bp, Homo sapiens
aaaaaataaatataattggga

SEQ ID NO: 2850995 - DNA, 20 bp, Homo sapiens
aaaaaatacaccacgaattt

SEQ ID NO: 2850996 - DNA, 13 bp, Homo sapiens
aaaaaatacagta

SEQ ID NO: 2850997 - DNA, 11 bp, Homo sapiens
aaaaaattgca

SEQ ID NO: 2850998 - DNA, 17 bp, Homo sapiens
aaaaacaaaaccagctg

SEQ ID NO: 2850999 - DNA, 13 bp, Homo sapiens
aaaaacatttgta

SEQ ID NO: 2851000 - DNA, 15 bp, Homo sapiens
aaaaaccagaatcat

SEQ ID NO: 2851001 - DNA, 20 bp, Homo sapiens
aaaaaccagaatcataattt

SEQ ID NO: 2851002 - DNA, 23 bp, Homo sapiens
aaaaaccagaatcataattttca

SEQ ID NO: 2851003 - DNA, 15 bp, Homo sapiens
aaaaactgagtgact

SEQ ID NO: 2851004 - DNA, 13 bp, Homo sapiens
aaaaactttcatt

SEQ ID NO: 2851005 - DNA, 11 bp, Homo sapiens
aaaaagaaatg

SEQ ID NO: 2851006 - DNA, 20 bp, Homo sapiens
aaaaagagaaaaaccaatga

SEQ ID NO: 2851007 - DNA, 15 bp, Homo sapiens
aaaaagcttaaaact

SEQ ID NO: 2851008 - DNA, 17 bp, Homo sapiens
aaaaagcttaaaacttt

SEQ ID NO: 2851009 - DNA, 17 bp, Homo sapiens
aaaaaggctagtttatt

SEQ ID NO: 2851010 - DNA, 20 bp, Homo sapiens
aaaaaggctagtttattttg

SEQ ID NO: 2851011 - DNA, 22 bp, Homo sapiens
aaaaaggctagtttattttgtt

SEQ ID NO: 2851012 - DNA, 22 bp, Homo sapiens
aaaaagtctacgctctcctttc

SEQ ID NO: 2851013 - DNA, 11 bp, Homo sapiens
aaaaataaata

SEQ ID NO: 2851014 - DNA, 14 bp, Homo sapiens
aaaaatacatttta

SEQ ID NO: 2851015 - DNA, 16 bp, Homo sapiens
aaaaatattataactt

SEQ ID NO: 2851016 - DNA, 20 bp, Homo sapiens
aaaaatgactaaaaatatta

SEQ ID NO: 2851017 - DNA, 14 bp, Homo sapiens
aaaaatgatctaaa

SEQ ID NO: 2851018 - DNA, 20 bp, Homo sapiens
aaaaatgatttcagtagcac

SEQ ID NO: 2851019 - DNA, 19 bp, Homo sapiens
aaaaatggtggtttgtcat

SEQ ID NO: 2851020 - DNA, 22 bp, Homo sapiens
aaaaatgtcttgggtaggcggg

SEQ ID NO: 2851021 - DNA, 14 bp, Homo sapiens
aaaaattgcacaat

SEQ ID NO: 2851022 - DNA, 18 bp, Homo sapiens
aaaaattgcacaatttga

SEQ ID NO: 2851023 - DNA, 16 bp, Homo sapiens
aaaacaaaaataaata

SEQ ID NO: 2851024 - DNA, 13 bp, Homo sapiens
aaaacaaaaccag

SEQ ID NO: 2851025 - DNA, 15 bp, Homo sapiens
aaaacaaaaccagct

SEQ ID NO: 2851026 - DNA, 18 bp, Homo sapiens
aaaacaacttctttgtaa

SEQ ID NO: 2851027 - DNA, 16 bp, Homo sapiens
aaaacatatcaattca

SEQ ID NO: 2851028 - DNA, 20 bp, Homo sapiens
aaaacatatcaattcaacac

SEQ ID NO: 2851029 - DNA, 22 bp, Homo sapiens
aaaacatttattttgacataaa

SEQ ID NO: 2851030 - DNA, 12 bp, Homo sapiens
aaaacatttgta

SEQ ID NO: 2851031 - DNA, 13 bp, Homo sapiens
aaaaccaatgatt

SEQ ID NO: 2851032 - DNA, 16 bp, Homo sapiens
aaaaccactagaactc

SEQ ID NO: 2851033 - DNA, 17 bp, Homo sapiens
aaaaccactagaactct

SEQ ID NO: 2851034 - DNA, 21 bp, Homo sapiens
aaaaccagaatcataattttc

SEQ ID NO: 2851035 - DNA, 22 bp, Homo sapiens
aaaaccagctgctactcataag

SEQ ID NO: 2851036 - DNA, 15 bp, Homo sapiens
aaaaccatgcagctt

SEQ ID NO: 2851037 - DNA, 18 bp, Homo sapiens
aaaaccatgcagcttcat

SEQ ID NO: 2851038 - DNA, 23 bp, Homo sapiens
aaaaccatgcagcttcatcaatt

SEQ ID NO: 2851039 - DNA, 12 bp, Homo sapiens
aaaacccagaga

SEQ ID NO: 2851040 - DNA, 21 bp, Homo sapiens
aaaacctcatgacagccagag

SEQ ID NO: 2851041 - DNA, 13 bp, Homo sapiens
aaaactaaaaact

SEQ ID NO: 2851042 - DNA, 16 bp, Homo sapiens
aaaactaaaaactaga

SEQ ID NO: 2851043 - DNA, 22 bp, Homo sapiens
aaaactagaggtgagaaattta

SEQ ID NO: 2851044 - DNA, 18 bp, Homo sapiens
aaaactcagttaaaatgt

SEQ ID NO: 2851045 - DNA, 16 bp, Homo sapiens
aaaactgactccttag

SEQ ID NO: 2851046 - DNA, 17 bp, Homo sapiens
aaaactggaaatctgga

SEQ ID NO: 2851047 - DNA, 12 bp, Homo sapiens
aaaactgtaaat

SEQ ID NO: 2851048 - DNA, 18 bp, Homo sapiens
aaaactgtaaatacaaaa

SEQ ID NO: 2851049 - DNA, 11 bp, Homo sapiens
aaaagaaaacc

SEQ ID NO: 2851050 - DNA, 14 bp, Homo sapiens
aaaagaaaaccatt

SEQ ID NO: 2851051 - DNA, 18 bp, Homo sapiens
aaaagattaaaattagtg

SEQ ID NO: 2851052 - DNA, 13 bp, Homo sapiens
aaaagattatata

SEQ ID NO: 2851053 - DNA, 22 bp, Homo sapiens
aaaagattatatatcataaagt

SEQ ID NO: 2851054 - DNA, 14 bp, Homo sapiens
aaaagcacttttta

SEQ ID NO: 2851055 - DNA, 13 bp, Homo sapiens
aaaagcataaatg

SEQ ID NO: 2851056 - DNA, 15 bp, Homo sapiens
aaaagcataaatgca

SEQ ID NO: 2851057 - DNA, 16 bp, Homo sapiens
aaaagcctctggtgga

SEQ ID NO: 2851058 - DNA, 11 bp, Homo sapiens
aaaagctaatt

SEQ ID NO: 2851059 - DNA, 14 bp, Homo sapiens
aaaagctgcttgac

SEQ ID NO: 2851060 - DNA, 21 bp, Homo sapiens
aaaagctttgaaccctgggac

SEQ ID NO: 2851061 - DNA, 20 bp, Homo sapiens
aaaaggctaggtacacagct

SEQ ID NO: 2851062 - DNA, 14 bp, Homo sapiens
aaaaggctagttta

SEQ ID NO: 2851063 - DNA, 22 bp, Homo sapiens
aaaaggtgcctgtgaggcaggg

SEQ ID NO: 2851064 - DNA, 19 bp, Homo sapiens
aaaaggttgactcaagttt

SEQ ID NO: 2851065 - DNA, 19 bp, Homo sapiens
aaaagtagaattatatcta

SEQ ID NO: 2851066 - DNA, 20 bp, Homo sapiens
aaaagtaggtttacattcat

SEQ ID NO: 2851067 - DNA, 14 bp, Homo sapiens
aaaagtcacacaga

SEQ ID NO: 2851068 - DNA, 17 bp, Homo sapiens
aaaagtgactctcagcg

SEQ ID NO: 2851069 - DNA, 14 bp, Homo sapiens
aaaagtgcaaagtt

SEQ ID NO: 2851070 - DNA, 19 bp, Homo sapiens
aaaagtgttgattacataa

SEQ ID NO: 2851071 - DNA, 17 bp, Homo sapiens
aaaagtttgccagaagt

SEQ ID NO: 2851072 - DNA, 16 bp, Homo sapiens
aaaataaaaaaataca

SEQ ID NO: 2851073 - DNA, 18 bp, Homo sapiens
aaaataaaaaaatacagt

SEQ ID NO: 2851074 - DNA, 14 bp, Homo sapiens
aaaataaaaaccag

SEQ ID NO: 2851075 - DNA, 21 bp, Homo sapiens
aaaggctcagtctcaggagca

SEQ ID NO: 2851076 - DNA, 18 bp, Homo sapiens
aaagggaaggctgctgtg

SEQ ID NO: 2851077 - DNA, 19 bp, Homo sapiens
aaagggaaggctgctgtgt

SEQ ID NO: 2851078 - DNA, 19 bp, Homo sapiens
aaagggagggctctgaggc

SEQ ID NO: 2851079 - DNA, 18 bp, Homo sapiens
aaaggggcagaaaaactc

SEQ ID NO: 2851080 - DNA, 19 bp, Homo sapiens
aaagggtcaacggccctgt

SEQ ID NO: 2851081 - DNA, 14 bp, Homo sapiens
aaaggtataatttt

SEQ ID NO: 2851082 - DNA, 18 bp, Homo sapiens
aaaggtcattgtggctat

SEQ ID NO: 2851083 - DNA, 21 bp, Homo sapiens
aaaggtggtatgtgtgtgtat

SEQ ID NO: 2851084 - DNA, 19 bp, Homo sapiens
aaagtaagtaccactcagg

SEQ ID NO: 2851085 - DNA, 19 bp, Homo sapiens
aaagtacttctccaccctg

SEQ ID NO: 2851086 - DNA, 23 bp, Homo sapiens
aaagtacttctccaccctgctct

SEQ ID NO: 2851087 - DNA, 22 bp, Homo sapiens
aaagtagaattatatctaattt

SEQ ID NO: 2851088 - DNA, 15 bp, Homo sapiens
aaagtagagaagtat

SEQ ID NO: 2851089 - DNA, 20 bp, Homo sapiens
aaagtagagaagtatccaat

SEQ ID NO: 2851090 - DNA, 13 bp, Homo sapiens
aaagtatatatag

SEQ ID NO: 2851091 - DNA, 17 bp, Homo sapiens
aaagtatatatagaatc

SEQ ID NO: 2851092 - DNA, 14 bp, Homo sapiens
aaagtatatattta

SEQ ID NO: 2851093 - DNA, 23 bp, Homo sapiens
aaagtatatatttatttaagctt

SEQ ID NO: 2851094 - DNA, 21 bp, Homo sapiens
aaagtatttttttaagttaga

SEQ ID NO: 2851095 - DNA, 18 bp, Homo sapiens
aaagtctgagtgggcggc

SEQ ID NO: 2851096 - DNA, 15 bp, Homo sapiens
aaagtgaataaactt

SEQ ID NO: 2851097 - DNA, 20 bp, Homo sapiens
aaagtgaataaacttcagca

SEQ ID NO: 2851098 - DNA, 21 bp, Homo sapiens
aaagtgaataaacttcagcac

SEQ ID NO: 2851099 - DNA, 23 bp, Homo sapiens
aaagtgaccaggctcacaactgt

SEQ ID NO: 2851100 - DNA, 23 bp, Homo sapiens
aaagtgagactgacacctcactg

SEQ ID NO: 2851101 - DNA, 14 bp, Homo sapiens
aaagtgctgggatt

SEQ ID NO: 2851102 - DNA, 17 bp, Homo sapiens
aaagtggattttcctga

SEQ ID NO: 2851103 - DNA, 16 bp, Homo sapiens
aaagttaatcttcatg

SEQ ID NO: 2851104 - DNA, 23 bp, Homo sapiens
aaagttaggttataagaaacaga

SEQ ID NO: 2851105 - DNA, 23 bp, Homo sapiens
aaagttagtgtgttgtctgtgca

SEQ ID NO: 2851106 - DNA, 22 bp, Homo sapiens
aaagttattgtgttgccttagc

SEQ ID NO: 2851107 - DNA, 18 bp, Homo sapiens
aaagttcaacatgttatt

SEQ ID NO: 2851108 - DNA, 21 bp, Homo sapiens
aaagttccctacttcctgtga

SEQ ID NO: 2851109 - DNA, 23 bp, Homo sapiens
aaagttccctacttcctgtgact

SEQ ID NO: 2851110 - DNA, 13 bp, Homo sapiens
aaagtttaaaaaa

SEQ ID NO: 2851111 - DNA, 14 bp, Homo sapiens
aaagtttaaaaaat

SEQ ID NO: 2851112 - DNA, 15 bp, Homo sapiens
aaagtttaataaatt

SEQ ID NO: 2851113 - DNA, 21 bp, Homo sapiens
aaagtttctcttttcaaaaca

SEQ ID NO: 2851114 - DNA, 22 bp, Homo sapiens
aaataaaaaccagaatcataat

SEQ ID NO: 2851115 - DNA, 13 bp, Homo sapiens
aaataaaaatatt

SEQ ID NO: 2851116 - DNA, 15 bp, Homo sapiens
aaataaaacctttca

SEQ ID NO: 2851117 - DNA, 16 bp, Homo sapiens
aaataaagtatatata

SEQ ID NO: 2851118 - DNA, 13 bp, Homo sapiens
aaataaatataat

SEQ ID NO: 2851119 - DNA, 21 bp, Homo sapiens
aaataaatgtatcatagaaat

SEQ ID NO: 2851120 - DNA, 13 bp, Homo sapiens
aaataaattcaaa

SEQ ID NO: 2851121 - DNA, 16 bp, Homo sapiens
aaataaattgaaatat

SEQ ID NO: 2851122 - DNA, 23 bp, Homo sapiens
aaataaattggtgataagtggaa

SEQ ID NO: 2851123 - DNA, 14 bp, Homo sapiens
aaataacaatgtgc

SEQ ID NO: 2851124 - DNA, 14 bp, Homo sapiens
aaataagaagaatg

SEQ ID NO: 2851125 - DNA, 13 bp, Homo sapiens
aaataatgattta

SEQ ID NO: 2851126 - DNA, 19 bp, Homo sapiens
aaataatttaactaattta

SEQ ID NO: 2851127 - DNA, 21 bp, Homo sapiens
aaataatttaactaatttaaa

SEQ ID NO: 2851128 - DNA, 18 bp, Homo sapiens
aaatacaaaataaaatta

SEQ ID NO: 2851129 - DNA, 17 bp, Homo sapiens
aaatacacaagtaaaca

SEQ ID NO: 2851130 - DNA, 23 bp, Homo sapiens
aaatacaccacctcactcctgtt

SEQ ID NO: 2851131 - DNA, 17 bp, Homo sapiens
aaatacaccacgaattt

SEQ ID NO: 2851132 - DNA, 22 bp, Homo sapiens
aaatacagacactaagttatag

SEQ ID NO: 2851133 - DNA, 14 bp, Homo sapiens
aaatacagtaaagt

SEQ ID NO: 2851134 - DNA, 15 bp, Homo sapiens
aaatacagtaaagtt

SEQ ID NO: 2851135 - DNA, 16 bp, Homo sapiens
aaatacagtaaagttt

SEQ ID NO: 2851136 - DNA, 21 bp, Homo sapiens
aaataccagtgaaccaaagag

SEQ ID NO: 2851137 - DNA, 15 bp, Homo sapiens
aaatactccaagctt

SEQ ID NO: 2851138 - DNA, 16 bp, Homo sapiens
aaatagcaaaagaaga

SEQ ID NO: 2851139 - DNA, 23 bp, Homo sapiens
aaatagccacttaccttcaataa

SEQ ID NO: 2851140 - DNA, 21 bp, Homo sapiens
aaatagccgggcatggtggcg

SEQ ID NO: 2851141 - DNA, 19 bp, Homo sapiens
aaatagcctcttaggtaaa

SEQ ID NO: 2851142 - DNA, 20 bp, Homo sapiens
aaatagtaggaccaatgttg

SEQ ID NO: 2851143 - DNA, 20 bp, Homo sapiens
aaatagttttaaatatgaac

SEQ ID NO: 2851144 - DNA, 14 bp, Homo sapiens
aaatataaacttgt

SEQ ID NO: 2851145 - DNA, 20 bp, Homo sapiens
aaatataaacttgtgtatga

SEQ ID NO: 2851146 - DNA, 12 bp, Homo sapiens
aaatataaatgc

SEQ ID NO: 2851147 - DNA, 13 bp, Homo sapiens
aaatataaatgca

SEQ ID NO: 2851148 - DNA, 14 bp, Homo sapiens
aaatataaatgcat

SEQ ID NO: 2851149 - DNA, 15 bp, Homo sapiens
aaatataaatgcatg

SEQ ID NO: 2851150 - DNA, 14 bp, Homo sapiens
aaatatatataaat

SEQ ID NO: 2851151 - DNA, 21 bp, Homo sapiens
aaatatatataaatatatatt

SEQ ID NO: 2851152 - DNA, 17 bp, Homo sapiens
aaatatatatttttcaa

SEQ ID NO: 2851153 - DNA, 18 bp, Homo sapiens
aaatatatatttttcaac

SEQ ID NO: 2851154 - DNA, 23 bp, Homo sapiens
aaatatatatttttcaaccagca

SEQ ID NO: 2851155 - DNA, 17 bp, Homo sapiens
aaatatattttatgatt

SEQ ID NO: 2851156 - DNA, 20 bp, Homo sapiens
aaatatattttatgatttaa

SEQ ID NO: 2851157 - DNA, 13 bp, Homo sapiens
aaatatgaaatga

SEQ ID NO: 2851158 - DNA, 15 bp, Homo sapiens
aaatatgatgttaaa

SEQ ID NO: 2851159 - DNA, 22 bp, Homo sapiens
aaatattaccaaaaaagtattt

SEQ ID NO: 2851160 - DNA, 20 bp, Homo sapiens
aaatattataacttaaaaaa

SEQ ID NO: 2851161 - DNA, 15 bp, Homo sapiens
aaatattcctgcatt

SEQ ID NO: 2851162 - DNA, 15 bp, Homo sapiens
aaatatttatatatt

SEQ ID NO: 2851163 - DNA, 14 bp, Homo sapiens
aaatattttaaaga

SEQ ID NO: 2851164 - DNA, 17 bp, Homo sapiens
aaatattttaaagaatt

SEQ ID NO: 2851165 - DNA, 16 bp, Homo sapiens
aactgaaaactgtaaa

SEQ ID NO: 2851166 - DNA, 18 bp, Homo sapiens
aactgaaaactgtaaata

SEQ ID NO: 2851167 - DNA, 13 bp, Homo sapiens
aactgaaggagaa

SEQ ID NO: 2851168 - DNA, 15 bp, Homo sapiens
aactgaaggagaagg

SEQ ID NO: 2851169 - DNA, 10 bp, Homo sapiens
aactgagcct

SEQ ID NO: 2851170 - DNA, 11 bp, Homo sapiens
aactgagccta

SEQ ID NO: 2851171 - DNA, 13 bp, Homo sapiens
aactgagcctagc

SEQ ID NO: 2851172 - DNA, 13 bp, Homo sapiens
aactgaggaattt

SEQ ID NO: 2851173 - DNA, 17 bp, Homo sapiens
aactgattcacatctca

SEQ ID NO: 2851174 - DNA, 14 bp, Homo sapiens
aactgcattagaaa

SEQ ID NO: 2851175 - DNA, 15 bp, Homo sapiens
aactggaataagaag

SEQ ID NO: 2851176 - DNA, 16 bp, Homo sapiens
aactggccaagctgag

SEQ ID NO: 2851177 - DNA, 17 bp, Homo sapiens
aactggccaagctgagg

SEQ ID NO: 2851178 - DNA, 11 bp, Homo sapiens
aactggctgca

SEQ ID NO: 2851179 - DNA, 20 bp, Homo sapiens
aactggggagttataaaaat

SEQ ID NO: 2851180 - DNA, 21 bp, Homo sapiens
aactggtttgttgcagccaaa

SEQ ID NO: 2851181 - DNA, 14 bp, Homo sapiens
aactgtatgtgtct

SEQ ID NO: 2851182 - DNA, 19 bp, Homo sapiens
aactgtctctcatgaacct

SEQ ID NO: 2851183 - DNA, 11 bp, Homo sapiens
aactgtgacag

SEQ ID NO: 2851184 - DNA, 22 bp, Homo sapiens
aactgtgatggggtgggcaggg

SEQ ID NO: 2851185 - DNA, 19 bp, Homo sapiens
aactgtttatggtattttc

SEQ ID NO: 2851186 - DNA, 16 bp, Homo sapiens
aactgtttttgaagaa

SEQ ID NO: 2851187 - DNA, 11 bp, Homo sapiens
aacttaaaaga

SEQ ID NO: 2851188 - DNA, 13 bp, Homo sapiens
aacttaaaatatt

SEQ ID NO: 2851189 - DNA, 20 bp, Homo sapiens
aacttaatgttctgaataat

SEQ ID NO: 2851190 - DNA, 16 bp, Homo sapiens
aacttagcatgtgttg

SEQ ID NO: 2851191 - DNA, 13 bp, Homo sapiens
aacttcagagaag

SEQ ID NO: 2851192 - DNA, 19 bp, Homo sapiens
aacttgaaattatatctgt

SEQ ID NO: 2851193 - DNA, 14 bp, Homo sapiens
aacttgaggacaca

SEQ ID NO: 2851194 - DNA, 15 bp, Homo sapiens
aacttgaggacacat

SEQ ID NO: 2851195 - DNA, 17 bp, Homo sapiens
aacttgaggacacatgt

SEQ ID NO: 2851196 - DNA, 19 bp, Homo sapiens
aacttgaggacacatgtcc

SEQ ID NO: 2851197 - DNA, 22 bp, Homo sapiens
aacttggttttgctacataatt

SEQ ID NO: 2851198 - DNA, 14 bp, Homo sapiens
aacttgtaaataca

SEQ ID NO: 2851199 - DNA, 15 bp, Homo sapiens
aacttgtaaatacac

SEQ ID NO: 2851200 - DNA, 15 bp, Homo sapiens
aacttgtaaatgctg

SEQ ID NO: 2851201 - DNA, 22 bp, Homo sapiens
aacttgtcagaatttctttgtc

SEQ ID NO: 2851202 - DNA, 22 bp, Homo sapiens
aactttagagtagcatgagaga

SEQ ID NO: 2851203 - DNA, 21 bp, Homo sapiens
aactttatcacattatttgca

SEQ ID NO: 2851204 - DNA, 21 bp, Homo sapiens
aacttttaatgccttccacat

SEQ ID NO: 2851205 - DNA, 21 bp, Homo sapiens
aagaaaaaaatatattttatg

SEQ ID NO: 2851206 - DNA, 12 bp, Homo sapiens
aagaaaaaatac

SEQ ID NO: 2851207 - DNA, 20 bp, Homo sapiens
aagaaaaacaaactcgtttt

SEQ ID NO: 2851208 - DNA, 18 bp, Homo sapiens
aagaaacaggggatcaaa

SEQ ID NO: 2851209 - DNA, 16 bp, Homo sapiens
aagaaactgaggaatt

SEQ ID NO: 2851210 - DNA, 19 bp, Homo sapiens
aagaaactgaggaattttc

SEQ ID NO: 2851211 - DNA, 15 bp, Homo sapiens
aagaaagaaggaagt

SEQ ID NO: 2851212 - DNA, 18 bp, Homo sapiens
aagaaagcacctgttttt

SEQ ID NO: 2851213 - DNA, 20 bp, Homo sapiens
aagaaagcacctgtttttac

SEQ ID NO: 2851214 - DNA, 21 bp, Homo sapiens
aagaaagttaggttataagaa

SEQ ID NO: 2851215 - DNA, 17 bp, Homo sapiens
aagaaattcctgtagca

SEQ ID NO: 2851216 - DNA, 16 bp, Homo sapiens
aagaaattgtttcttt

SEQ ID NO: 2851217 - DNA, 17 bp, Homo sapiens
aagaagacatggagact

SEQ ID NO: 2851218 - DNA, 19 bp, Homo sapiens
aagaagaccagactgtgga

SEQ ID NO: 2851219 - DNA, 15 bp, Homo sapiens
aagaagagtttgcaa

SEQ ID NO: 2851220 - DNA, 16 bp, Homo sapiens
aagaagcaaataaata

SEQ ID NO: 2851221 - DNA, 21 bp, Homo sapiens
aagaagcaacctcagtaattt

SEQ ID NO: 2851222 - DNA, 22 bp, Homo sapiens
aagaagcattttgtaagttgaa

SEQ ID NO: 2851223 - DNA, 11 bp, Homo sapiens
aagaaggaagt

SEQ ID NO: 2851224 - DNA, 23 bp, Homo sapiens
aagaaggcacaggtgtaaatata

SEQ ID NO: 2851225 - DNA, 14 bp, Homo sapiens
aagaagggaaattc

SEQ ID NO: 2851226 - DNA, 15 bp, Homo sapiens
aagaagggaaattca

SEQ ID NO: 2851227 - DNA, 18 bp, Homo sapiens
aagaatacagaaaatgct

SEQ ID NO: 2851228 - DNA, 12 bp, Homo sapiens
aagaatacttct

SEQ ID NO: 2851229 - DNA, 16 bp, Homo sapiens
aagaatacttctcatt

SEQ ID NO: 2851230 - DNA, 21 bp, Homo sapiens
aagaatcacaataattttcta

SEQ ID NO: 2851231 - DNA, 18 bp, Homo sapiens
aagaatgctggttttcct

SEQ ID NO: 2851232 - DNA, 19 bp, Homo sapiens
aagaatgctggttttccta

SEQ ID NO: 2851233 - DNA, 12 bp, Homo sapiens
aagaatgttaag

SEQ ID NO: 2851234 - DNA, 15 bp, Homo sapiens
aagaattatttttgt

SEQ ID NO: 2851235 - DNA, 20 bp, Homo sapiens
aagaatttcttggtaagaag

SEQ ID NO: 2851236 - DNA, 22 bp, Homo sapiens
aagaatttcttggtaagaagcc

SEQ ID NO: 2851237 - DNA, 20 bp, Homo sapiens
aagaattttcagaccccagc

SEQ ID NO: 2851238 - DNA, 23 bp, Homo sapiens
aagacaatggcttactccaggag

SEQ ID NO: 2851239 - DNA, 14 bp, Homo sapiens
aagacaccaaattc

SEQ ID NO: 2851240 - DNA, 16 bp, Homo sapiens
aagacagagctgggat

SEQ ID NO: 2851241 - DNA, 23 bp, Homo sapiens
aagacaggacagtgcttcagcct

SEQ ID NO: 2851242 - DNA, 18 bp, Homo sapiens
aagacatggagactcctg

SEQ ID NO: 2851243 - DNA, 20 bp, Homo sapiens
aagacccagtgtaaagaata

SEQ ID NO: 2851244 - DNA, 13 bp, Homo sapiens
aagaccctccccg

SEQ ID NO: 2851245 - DNA, 15 bp, Homo sapiens
aagaccttctgaaga

SEQ ID NO: 2851246 - DNA, 22 bp, Homo sapiens
aagactatcttactatttcaca

SEQ ID NO: 2851247 - DNA, 17 bp, Homo sapiens
aagactcattcttctgt

SEQ ID NO: 2851248 - DNA, 13 bp, Homo sapiens
aagactgaaagaa

SEQ ID NO: 2851249 - DNA, 14 bp, Homo sapiens
aagactgaaagaat

SEQ ID NO: 2851250 - DNA, 13 bp, Homo sapiens
aagactggaagca

SEQ ID NO: 2851251 - DNA, 16 bp, Homo sapiens
aagactgttgctcaaa

SEQ ID NO: 2851252 - DNA, 12 bp, Homo sapiens
aagagaaaagat

SEQ ID NO: 2851253 - DNA, 12 bp, Homo sapiens
aagagaagaaaa

SEQ ID NO: 2851254 - DNA, 14 bp, Homo sapiens
aagagaagaaaaaa

SEQ ID NO: 2851255 - DNA, 22 bp, Homo sapiens
aagagaagaaaaaattaagaga

SEQ ID NO: 2851256 - DNA, 19 bp, Homo sapiens
aagtatttgttaatttaga

SEQ ID NO: 2851257 - DNA, 16 bp, Homo sapiens
aagtcacacagacaca

SEQ ID NO: 2851258 - DNA, 17 bp, Homo sapiens
aagtcacatataaaagt

SEQ ID NO: 2851259 - DNA, 16 bp, Homo sapiens
aagtcaggacctggct

SEQ ID NO: 2851260 - DNA, 21 bp, Homo sapiens
aagtcaggcccttattttcaa

SEQ ID NO: 2851261 - DNA, 18 bp, Homo sapiens
aagtcagttggagaaaat

SEQ ID NO: 2851262 - DNA, 17 bp, Homo sapiens
aagtccaggtcctggtg

SEQ ID NO: 2851263 - DNA, 18 bp, Homo sapiens
aagtccaggtcctggtgg

SEQ ID NO: 2851264 - DNA, 22 bp, Homo sapiens
aagtcgtccttactcctgtggg

SEQ ID NO: 2851265 - DNA, 22 bp, Homo sapiens
aagtctaggagctgggaggaaa

SEQ ID NO: 2851266 - DNA, 19 bp, Homo sapiens
aagtctccaagaatacaga

SEQ ID NO: 2851267 - DNA, 14 bp, Homo sapiens
aagtctctgactct

SEQ ID NO: 2851268 - DNA, 20 bp, Homo sapiens
aagtctctgactcttgcctt

SEQ ID NO: 2851269 - DNA, 13 bp, Homo sapiens
aagtctgagtggg

SEQ ID NO: 2851270 - DNA, 18 bp, Homo sapiens
aagtcttaaaataactta

SEQ ID NO: 2851271 - DNA, 18 bp, Homo sapiens
aagtcttccctgatcaag

SEQ ID NO: 2851272 - DNA, 16 bp, Homo sapiens
aagtgaataaacttca

SEQ ID NO: 2851273 - DNA, 20 bp, Homo sapiens
aagtgaataaacttcagcac

SEQ ID NO: 2851274 - DNA, 16 bp, Homo sapiens
aagtgaatttgcctgt

SEQ ID NO: 2851275 - DNA, 20 bp, Homo sapiens
aagtgaatttgcctgtaaca

SEQ ID NO: 2851276 - DNA, 15 bp, Homo sapiens
aagtgactctcagcg

SEQ ID NO: 2851277 - DNA, 13 bp, Homo sapiens
aagtgatatatgt

SEQ ID NO: 2851278 - DNA, 21 bp, Homo sapiens
aagtgatatatgtatttattg

SEQ ID NO: 2851279 - DNA, 13 bp, Homo sapiens
aagtgatcctccc

SEQ ID NO: 2851280 - DNA, 23 bp, Homo sapiens
aagtgatcctcccacctcagcct

SEQ ID NO: 2851281 - DNA, 14 bp, Homo sapiens
aagtgattgaaaat

SEQ ID NO: 2851282 - DNA, 12 bp, Homo sapiens
aagtgcaaagtt

SEQ ID NO: 2851283 - DNA, 23 bp, Homo sapiens
aagtgctgtttgagatgtgatgc

SEQ ID NO: 2851284 - DNA, 14 bp, Homo sapiens
aagtgcttagaaag

SEQ ID NO: 2851285 - DNA, 10 bp, Homo sapiens
aagtggaaaa

SEQ ID NO: 2851286 - DNA, 18 bp, Homo sapiens
aagtggctaattcaattt

SEQ ID NO: 2851287 - DNA, 14 bp, Homo sapiens
aagtgtaaaataga

SEQ ID NO: 2851288 - DNA, 14 bp, Homo sapiens
aagtgtaattgaga

SEQ ID NO: 2851289 - DNA, 24 bp, Homo sapiens
aagtgtcatatgtaggtgtctgca

SEQ ID NO: 2851290 - DNA, 22 bp, Homo sapiens
aagtgttccctgagaaacccac

SEQ ID NO: 2851291 - DNA, 12 bp, Homo sapiens
aagtgttgaaga

SEQ ID NO: 2851292 - DNA, 19 bp, Homo sapiens
aagtgttgaagaagagttt

SEQ ID NO: 2851293 - DNA, 17 bp, Homo sapiens
aagttaaagtgaataac

SEQ ID NO: 2851294 - DNA, 14 bp, Homo sapiens
aagttaaattttat

SEQ ID NO: 2851295 - DNA, 20 bp, Homo sapiens
aagttaagcagcctttctgt

SEQ ID NO: 2851296 - DNA, 15 bp, Homo sapiens
aagttaatttaaagt

SEQ ID NO: 2851297 - DNA, 16 bp, Homo sapiens
aagttaatttaaagtt

SEQ ID NO: 2851298 - DNA, 17 bp, Homo sapiens
aagttaatttaaagttg

SEQ ID NO: 2851299 - DNA, 20 bp, Homo sapiens
aagttacatgtttgcacctt

SEQ ID NO: 2851300 - DNA, 18 bp, Homo sapiens
aagttagagaatatattt

SEQ ID NO: 2851301 - DNA, 21 bp, Homo sapiens
aagttagtgtgttgtctgtgc

SEQ ID NO: 2851302 - DNA, 17 bp, Homo sapiens
aagttatagtatatctg

SEQ ID NO: 2851303 - DNA, 12 bp, Homo sapiens
aagttattgtgt

SEQ ID NO: 2851304 - DNA, 24 bp, Homo sapiens
aagttattgtgttgccttagcact

SEQ ID NO: 2851305 - DNA, 16 bp, Homo sapiens
aagttatttaaatctg

SEQ ID NO: 2851306 - DNA, 16 bp, Homo sapiens
aagttcaacatgttat

SEQ ID NO: 2851307 - DNA, 19 bp, Homo sapiens
aagttccagtgttctctct

SEQ ID NO: 2851308 - DNA, 17 bp, Homo sapiens
aagttccctacttcctg

SEQ ID NO: 2851309 - DNA, 21 bp, Homo sapiens
aagttctagagaagaggctgg

SEQ ID NO: 2851310 - DNA, 15 bp, Homo sapiens
aagttctgagtgttt

SEQ ID NO: 2851311 - DNA, 17 bp, Homo sapiens
aagttgaagctaagatt

SEQ ID NO: 2851312 - DNA, 18 bp, Homo sapiens
aagttgaagctaagattt

SEQ ID NO: 2851313 - DNA, 16 bp, Homo sapiens
aagttgcagtgagctg

SEQ ID NO: 2851314 - DNA, 19 bp, Homo sapiens
aagttggaccagaggaagc

SEQ ID NO: 2851315 - DNA, 20 bp, Homo sapiens
aagttgttcacatatatgta

SEQ ID NO: 2851316 - DNA, 20 bp, Homo sapiens
aagttgttccttaagtcaga

SEQ ID NO: 2851317 - DNA, 15 bp, Homo sapiens
aagttgtttcattga

SEQ ID NO: 2851318 - DNA, 16 bp, Homo sapiens
aagtttaaaaaataca

SEQ ID NO: 2851319 - DNA, 20 bp, Homo sapiens
aagtttaatggtgccttcat

SEQ ID NO: 2851320 - DNA, 21 bp, Homo sapiens
aagtttattttttctacacag

SEQ ID NO: 2851321 - DNA, 14 bp, Homo sapiens
aagtttgcactgta

SEQ ID NO: 2851322 - DNA, 21 bp, Homo sapiens
aagtttgcactgtatgctgga

SEQ ID NO: 2851323 - DNA, 16 bp, Homo sapiens
aagtttgccctggatg

SEQ ID NO: 2851324 - DNA, 14 bp, Homo sapiens
aagtttgtttttaa

SEQ ID NO: 2851325 - DNA, 12 bp, Homo sapiens
aagtttttacaa

SEQ ID NO: 2851326 - DNA, 16 bp, Homo sapiens
aataaaaaaatacagt

SEQ ID NO: 2851327 - DNA, 15 bp, Homo sapiens
aataaaaaacatttg

SEQ ID NO: 2851328 - DNA, 16 bp, Homo sapiens
aataaaaaccagaatc

SEQ ID NO: 2851329 - DNA, 22 bp, Homo sapiens
aataaaacctttcaaatttcac

SEQ ID NO: 2851330 - DNA, 18 bp, Homo sapiens
aataaaatcatgtacatt

SEQ ID NO: 2851331 - DNA, 14 bp, Homo sapiens
aataaaattttcaa

SEQ ID NO: 2851332 - DNA, 19 bp, Homo sapiens
aataaaattttcaaacttt

SEQ ID NO: 2851333 - DNA, 13 bp, Homo sapiens
aataaacaaataa

SEQ ID NO: 2851334 - DNA, 23 bp, Homo sapiens
aataaacatccttcaagaactct

SEQ ID NO: 2851335 - DNA, 11 bp, Homo sapiens
aataaactctc

SEQ ID NO: 2851336 - DNA, 15 bp, Homo sapiens
aataaactctctagg

SEQ ID NO: 2851337 - DNA, 12 bp, Homo sapiens
aataaagaaaaa

SEQ ID NO: 2851338 - DNA, 15 bp, Homo sapiens
aataaagcctgcttt

SEQ ID NO: 2851339 - DNA, 23 bp, Homo sapiens
aataaagctggacaagaagctgc

SEQ ID NO: 2851340 - DNA, 16 bp, Homo sapiens
aataaagtatctacat

SEQ ID NO: 2851341 - DNA, 13 bp, Homo sapiens
aataaagtctgag

SEQ ID NO: 2851342 - DNA, 12 bp, Homo sapiens
aataaagtgtat

SEQ ID NO: 2851343 - DNA, 12 bp, Homo sapiens
aataaataaatg

SEQ ID NO: 2851344 - DNA, 14 bp, Homo sapiens
aataaataaatgca

SEQ ID NO: 2851345 - DNA, 15 bp, Homo sapiens
aataaatagcctctt

SEQ ID NO: 2851346 - DNA, 13 bp, Homo sapiens
aataaatgaatct

SEQ ID NO: 2851347 - DNA, 15 bp, Homo sapiens
aatgttaaagtcagt

SEQ ID NO: 2851348 - DNA, 15 bp, Homo sapiens
aatgttacattgttt

SEQ ID NO: 2851349 - DNA, 19 bp, Homo sapiens
aatgttcacgcaacttgaa

SEQ ID NO: 2851350 - DNA, 24 bp, Homo sapiens
aatgttgggatttatatctatagt

SEQ ID NO: 2851351 - DNA, 15 bp, Homo sapiens
aatgttgttatttaa

SEQ ID NO: 2851352 - DNA, 20 bp, Homo sapiens
aatgtttacactctttgtaa

SEQ ID NO: 2851353 - DNA, 23 bp, Homo sapiens
aatgtttatgcaaggaaggaaag

SEQ ID NO: 2851354 - DNA, 14 bp, Homo sapiens
aatgtttcactatg

SEQ ID NO: 2851355 - DNA, 23 bp, Homo sapiens
aatgtttcactatgattttctat

SEQ ID NO: 2851356 - DNA, 15 bp, Homo sapiens
aatgtttcattttca

SEQ ID NO: 2851357 - DNA, 15 bp, Homo sapiens
aatgtttctgcagta

SEQ ID NO: 2851358 - DNA, 22 bp, Homo sapiens
aatgtttcttctaggttctaaa

SEQ ID NO: 2851359 - DNA, 22 bp, Homo sapiens
aatgtttgaactgccaagaaaa

SEQ ID NO: 2851360 - DNA, 18 bp, Homo sapiens
aatgtttgggcagaaggg

SEQ ID NO: 2851361 - DNA, 21 bp, Homo sapiens
aattaaaaaccactgaacatt

SEQ ID NO: 2851362 - DNA, 12 bp, Homo sapiens
aattaaaatata

SEQ ID NO: 2851363 - DNA, 23 bp, Homo sapiens
aattaaaccctgccccacttctc

SEQ ID NO: 2851364 - DNA, 20 bp, Homo sapiens
aattaacattgggaaatctt

SEQ ID NO: 2851365 - DNA, 22 bp, Homo sapiens
aattaactgggtaatgaaacaa

SEQ ID NO: 2851366 - DNA, 18 bp, Homo sapiens
aattaagtaaaccaaaaa

SEQ ID NO: 2851367 - DNA, 15 bp, Homo sapiens
aattaatatgttcat

SEQ ID NO: 2851368 - DNA, 14 bp, Homo sapiens
aattacaattgtca

SEQ ID NO: 2851369 - DNA, 21 bp, Homo sapiens
aattaccttagattagctctg

SEQ ID NO: 2851370 - DNA, 17 bp, Homo sapiens
aattactacaaaatttg

SEQ ID NO: 2851371 - DNA, 15 bp, Homo sapiens
aattaggatctatgc

SEQ ID NO: 2851372 - DNA, 17 bp, Homo sapiens
aattaggggttgctaag

SEQ ID NO: 2851373 - DNA, 14 bp, Homo sapiens
aattagtacagtag

SEQ ID NO: 2851374 - DNA, 16 bp, Homo sapiens
aattagtacagtagct

SEQ ID NO: 2851375 - DNA, 20 bp, Homo sapiens
aattagtacagtagcttaaa

SEQ ID NO: 2851376 - DNA, 23 bp, Homo sapiens
aattagtacagtagcttaaataa

SEQ ID NO: 2851377 - DNA, 18 bp, Homo sapiens
aattagtatttatttaat

SEQ ID NO: 2851378 - DNA, 11 bp, Homo sapiens
aattatatcta

SEQ ID NO: 2851379 - DNA, 14 bp, Homo sapiens
aattatatctaatt

SEQ ID NO: 2851380 - DNA, 21 bp, Homo sapiens
aattatatctaatttatacaa

SEQ ID NO: 2851381 - DNA, 21 bp, Homo sapiens
aattatatctgtggtcttcaa

SEQ ID NO: 2851382 - DNA, 19 bp, Homo sapiens
aattatcgggaacagtgtt

SEQ ID NO: 2851383 - DNA, 23 bp, Homo sapiens
aattatcgggaacagtgtttccc

SEQ ID NO: 2851384 - DNA, 22 bp, Homo sapiens
aattatctgatcgggataacaa

SEQ ID NO: 2851385 - DNA, 16 bp, Homo sapiens
aattatcttatttaat

SEQ ID NO: 2851386 - DNA, 14 bp, Homo sapiens
aattatggtgaaat

SEQ ID NO: 2851387 - DNA, 16 bp, Homo sapiens
aattatgtgacaacct

SEQ ID NO: 2851388 - DNA, 13 bp, Homo sapiens
aattattattctt

SEQ ID NO: 2851389 - DNA, 12 bp, Homo sapiens
aattattctaat

SEQ ID NO: 2851390 - DNA, 21 bp, Homo sapiens
aattattctaattttatatat

SEQ ID NO: 2851391 - DNA, 20 bp, Homo sapiens
aattatttatttatggagga

SEQ ID NO: 2851392 - DNA, 23 bp, Homo sapiens
aattattttgttgtgattttgta

SEQ ID NO: 2851393 - DNA, 12 bp, Homo sapiens
aattatttttgt

SEQ ID NO: 2851394 - DNA, 21 bp, Homo sapiens
aattcaaaccatttaattcat

SEQ ID NO: 2851395 - DNA, 17 bp, Homo sapiens
aattcaacacattactt

SEQ ID NO: 2851396 - DNA, 18 bp, Homo sapiens
aattcaacctgtgtctta

SEQ ID NO: 2851397 - DNA, 21 bp, Homo sapiens
aattcaaggagatataaaatc

SEQ ID NO: 2851398 - DNA, 17 bp, Homo sapiens
aattcataattagaaca

SEQ ID NO: 2851399 - DNA, 19 bp, Homo sapiens
aattcataattagaacaat

SEQ ID NO: 2851400 - DNA, 22 bp, Homo sapiens
aattcattaaatttctggattt

SEQ ID NO: 2851401 - DNA, 17 bp, Homo sapiens
aattcatttcactttaa

SEQ ID NO: 2851402 - DNA, 18 bp, Homo sapiens
aattcatttcactttaaa

SEQ ID NO: 2851403 - DNA, 14 bp, Homo sapiens
aattccaaaggaat

SEQ ID NO: 2851404 - DNA, 12 bp, Homo sapiens
aattccaaggag

SEQ ID NO: 2851405 - DNA, 17 bp, Homo sapiens
aattccacagtctctgg

SEQ ID NO: 2851406 - DNA, 13 bp, Homo sapiens
aattccactggac

SEQ ID NO: 2851407 - DNA, 12 bp, Homo sapiens
aattccccagat

SEQ ID NO: 2851408 - DNA, 17 bp, Homo sapiens
aattcctgtagcatctt

SEQ ID NO: 2851409 - DNA, 21 bp, Homo sapiens
aattcctgtagcatcttctgg

SEQ ID NO: 2851410 - DNA, 23 bp, Homo sapiens
aattccttagcttagacctcagc

SEQ ID NO: 2851411 - DNA, 14 bp, Homo sapiens
aattctaaaatgat

SEQ ID NO: 2851412 - DNA, 18 bp, Homo sapiens
aattctaagattgtacat

SEQ ID NO: 2851413 - DNA, 19 bp, Homo sapiens
aattctaagattgtacata

SEQ ID NO: 2851414 - DNA, 20 bp, Homo sapiens
aattctactaaatattttat

SEQ ID NO: 2851415 - DNA, 17 bp, Homo sapiens
aattctcaacctaccac

SEQ ID NO: 2851416 - DNA, 13 bp, Homo sapiens
aattctcatgtga

SEQ ID NO: 2851417 - DNA, 16 bp, Homo sapiens
aattctcatgtgatcc

SEQ ID NO: 2851418 - DNA, 19 bp, Homo sapiens
aattctcatgtgatccttt

SEQ ID NO: 2851419 - DNA, 23 bp, Homo sapiens
aattctctctaaaaataaaatga

SEQ ID NO: 2851420 - DNA, 19 bp, Homo sapiens
aattctgctacctcactgg

SEQ ID NO: 2851421 - DNA, 20 bp, Homo sapiens
aattctggaggaagaagaca

SEQ ID NO: 2851422 - DNA, 14 bp, Homo sapiens
aattctgtgaagaa

SEQ ID NO: 2851423 - DNA, 14 bp, Homo sapiens
aattcttaaaatat

SEQ ID NO: 2851424 - DNA, 13 bp, Homo sapiens
aattcttggaata

SEQ ID NO: 2851425 - DNA, 14 bp, Homo sapiens
aattctttttcaaa

SEQ ID NO: 2851426 - DNA, 22 bp, Homo sapiens
aattctttttcaaaaattacac

SEQ ID NO: 2851427 - DNA, 20 bp, Homo sapiens
aattgaaggagaaaatgcat

SEQ ID NO: 2851428 - DNA, 14 bp, Homo sapiens
aattgactgtcact

SEQ ID NO: 2851429 - DNA, 15 bp, Homo sapiens
aattgatttcaagac

SEQ ID NO: 2851430 - DNA, 12 bp, Homo sapiens
aattgcacaatt

SEQ ID NO: 2851431 - DNA, 13 bp, Homo sapiens
aattgcacaattt

SEQ ID NO: 2851432 - DNA, 14 bp, Homo sapiens
aattgcacaatttg

SEQ ID NO: 2851433 - DNA, 22 bp, Homo sapiens
aattgcacgcggagtgagtttt

SEQ ID NO: 2851434 - DNA, 15 bp, Homo sapiens
aattgcctgacgaac

SEQ ID NO: 2851435 - DNA, 15 bp, Homo sapiens
aattgcttattctag

SEQ ID NO: 2851436 - DNA, 20 bp, Homo sapiens
aattggaagctgccctgccc

SEQ ID NO: 2851437 - DNA, 18 bp, Homo sapiens
acagaatttttaatgact

SEQ ID NO: 2851438 - DNA, 18 bp, Homo sapiens
acagacaaaaacagcctc

SEQ ID NO: 2851439 - DNA, 19 bp, Homo sapiens
acagacaaaaacagcctca

SEQ ID NO: 2851440 - DNA, 20 bp, Homo sapiens
acagacaaaaacagcctcac

SEQ ID NO: 2851441 - DNA, 21 bp, Homo sapiens
acagacacacaaaatgtcaca

SEQ ID NO: 2851442 - DNA, 11 bp, Homo sapiens
acagacacagg

SEQ ID NO: 2851443 - DNA, 13 bp, Homo sapiens
acagacacaggcc

SEQ ID NO: 2851444 - DNA, 19 bp, Homo sapiens
acagactggaagcacagct

SEQ ID NO: 2851445 - DNA, 15 bp, Homo sapiens
acagagaaggcagga

SEQ ID NO: 2851446 - DNA, 15 bp, Homo sapiens
acagagacacctgca

SEQ ID NO: 2851447 - DNA, 17 bp, Homo sapiens
acagagacacctgcacc

SEQ ID NO: 2851448 - DNA, 20 bp, Homo sapiens
acagagacccagatctcatg

SEQ ID NO: 2851449 - DNA, 13 bp, Homo sapiens
acagagcctgcct

SEQ ID NO: 2851450 - DNA, 14 bp, Homo sapiens
acagagccttcaca

SEQ ID NO: 2851451 - DNA, 21 bp, Homo sapiens
acagagcgagagtctgtctca

SEQ ID NO: 2851452 - DNA, 14 bp, Homo sapiens
acagagctgggatg

SEQ ID NO: 2851453 - DNA, 21 bp, Homo sapiens
acagagctgggatgtttctgt

SEQ ID NO: 2851454 - DNA, 14 bp, Homo sapiens
acagaggaagagca

SEQ ID NO: 2851455 - DNA, 17 bp, Homo sapiens
acagaggaagagcaggc

SEQ ID NO: 2851456 - DNA, 20 bp, Homo sapiens
acagaggagggcgtgactca

SEQ ID NO: 2851457 - DNA, 13 bp, Homo sapiens
acagaggcagccc

SEQ ID NO: 2851458 - DNA, 17 bp, Homo sapiens
acagaggccatggcaga

SEQ ID NO: 2851459 - DNA, 15 bp, Homo sapiens
acagagtatatatgt

SEQ ID NO: 2851460 - DNA, 17 bp, Homo sapiens
acagagtatatatgtac

SEQ ID NO: 2851461 - DNA, 20 bp, Homo sapiens
acagagtatatatgtacagt

SEQ ID NO: 2851462 - DNA, 19 bp, Homo sapiens
acagagtctcactgttgcc

SEQ ID NO: 2851463 - DNA, 18 bp, Homo sapiens
acagagttttcactctta

SEQ ID NO: 2851464 - DNA, 14 bp, Homo sapiens
acagataactgaaa

SEQ ID NO: 2851465 - DNA, 18 bp, Homo sapiens
acagatatttccatttct

SEQ ID NO: 2851466 - DNA, 20 bp, Homo sapiens
acagatgagattccctctcc

SEQ ID NO: 2851467 - DNA, 16 bp, Homo sapiens
acagatgggcaaatta

SEQ ID NO: 2851468 - DNA, 18 bp, Homo sapiens
acagatgggtattaaact

SEQ ID NO: 2851469 - DNA, 20 bp, Homo sapiens
acagatgggtattaaacttg

SEQ ID NO: 2851470 - DNA, 22 bp, Homo sapiens
acagattctagccaaactattc

SEQ ID NO: 2851471 - DNA, 21 bp, Homo sapiens
acagcaacaggaatctcagag

SEQ ID NO: 2851472 - DNA, 18 bp, Homo sapiens
acagcagactcagctctg

SEQ ID NO: 2851473 - DNA, 23 bp, Homo sapiens
acagcagactcagctctgacatt

SEQ ID NO: 2851474 - DNA, 17 bp, Homo sapiens
acagcagcccctgcaca

SEQ ID NO: 2851475 - DNA, 14 bp, Homo sapiens
acagcagctcaggc

SEQ ID NO: 2851476 - DNA, 15 bp, Homo sapiens
acagcagctcaggca

SEQ ID NO: 2851477 - DNA, 15 bp, Homo sapiens
acagcattcctccat

SEQ ID NO: 2851478 - DNA, 16 bp, Homo sapiens
acagcattcctccatc

SEQ ID NO: 2851479 - DNA, 12 bp, Homo sapiens
acagccagagcc

SEQ ID NO: 2851480 - DNA, 16 bp, Homo sapiens
acagcccaaagaagga

SEQ ID NO: 2851481 - DNA, 17 bp, Homo sapiens
acagcccaaagaaggaa

SEQ ID NO: 2851482 - DNA, 18 bp, Homo sapiens
acagcccaaagaaggaaa

SEQ ID NO: 2851483 - DNA, 22 bp, Homo sapiens
acagccgcagcctccctctgac

SEQ ID NO: 2851484 - DNA, 14 bp, Homo sapiens
acagccgctcctgt

SEQ ID NO: 2851485 - DNA, 19 bp, Homo sapiens
acagccgctcctgtctgcc

SEQ ID NO: 2851486 - DNA, 24 bp, Homo sapiens
acagccgctcctgtctgccagcca

SEQ ID NO: 2851487 - DNA, 17 bp, Homo sapiens
acagcctgacaacattt

SEQ ID NO: 2851488 - DNA, 20 bp, Homo sapiens
acagcctgtggcggtgcctg

SEQ ID NO: 2851489 - DNA, 14 bp, Homo sapiens
acagcgagaggcag

SEQ ID NO: 2851490 - DNA, 19 bp, Homo sapiens
acagcgagaggcagagaaa

SEQ ID NO: 2851491 - DNA, 22 bp, Homo sapiens
acagcggaggagaccagctcag

SEQ ID NO: 2851492 - DNA, 23 bp, Homo sapiens
acagcggaggagaccagctcaga

SEQ ID NO: 2851493 - DNA, 16 bp, Homo sapiens
acagcggggccccagg

SEQ ID NO: 2851494 - DNA, 19 bp, Homo sapiens
acagctaatgggacactaa

SEQ ID NO: 2851495 - DNA, 15 bp, Homo sapiens
acagctcccacccca

SEQ ID NO: 2851496 - DNA, 14 bp, Homo sapiens
acagctccttctgt

SEQ ID NO: 2851497 - DNA, 15 bp, Homo sapiens
acagctccttctgtc

SEQ ID NO: 2851498 - DNA, 18 bp, Homo sapiens
acagctcttctccaggct

SEQ ID NO: 2851499 - DNA, 15 bp, Homo sapiens
acagctgtccctgtc

SEQ ID NO: 2851500 - DNA, 13 bp, Homo sapiens
acagctgtgcctc

SEQ ID NO: 2851501 - DNA, 16 bp, Homo sapiens
acaggaaaagctgctg

SEQ ID NO: 2851502 - DNA, 18 bp, Homo sapiens
acaggaaaatcctctggc

SEQ ID NO: 2851503 - DNA, 23 bp, Homo sapiens
acaggaaaatcctctggctggct

SEQ ID NO: 2851504 - DNA, 23 bp, Homo sapiens
acaggaagcccaaggcagtgttc

SEQ ID NO: 2851505 - DNA, 14 bp, Homo sapiens
acaggaatctcaga

SEQ ID NO: 2851506 - DNA, 16 bp, Homo sapiens
acaggacacctggccg

SEQ ID NO: 2851507 - DNA, 17 bp, Homo sapiens
acaggacagtgcttcag

SEQ ID NO: 2851508 - DNA, 19 bp, Homo sapiens
acaggactaacactcagaa

SEQ ID NO: 2851509 - DNA, 13 bp, Homo sapiens
acaggagctacct

SEQ ID NO: 2851510 - DNA, 14 bp, Homo sapiens
acaggagctacctg

SEQ ID NO: 2851511 - DNA, 23 bp, Homo sapiens
acaggagctacctgtgtggacag

SEQ ID NO: 2851512 - DNA, 14 bp, Homo sapiens
acaggagggagaga

SEQ ID NO: 2851513 - DNA, 16 bp, Homo sapiens
acaggagtgagcacta

SEQ ID NO: 2851514 - DNA, 14 bp, Homo sapiens
acaggatcagtctg

SEQ ID NO: 2851515 - DNA, 18 bp, Homo sapiens
acaggcaactgaggcaga

SEQ ID NO: 2851516 - DNA, 19 bp, Homo sapiens
acaggcaactgaggcagac

SEQ ID NO: 2851517 - DNA, 19 bp, Homo sapiens
acaggcaagcacctcctgc

SEQ ID NO: 2851518 - DNA, 17 bp, Homo sapiens
acaggcaatgctggctg

SEQ ID NO: 2851519 - DNA, 21 bp, Homo sapiens
acaggcagctggatgagactt

SEQ ID NO: 2851520 - DNA, 14 bp, Homo sapiens
acaggcaggtccag

SEQ ID NO: 2851521 - DNA, 17 bp, Homo sapiens
acaggcatctacacagc

SEQ ID NO: 2851522 - DNA, 19 bp, Homo sapiens
acaggcatctacacagcct

SEQ ID NO: 2851523 - DNA, 20 bp, Homo sapiens
acaggcatctacacagcctg

SEQ ID NO: 2851524 - DNA, 21 bp, Homo sapiens
acaggcatctacacagcctgg

SEQ ID NO: 2851525 - DNA, 22 bp, Homo sapiens
acaggcatctacacagcctgga

SEQ ID NO: 2851526 - DNA, 18 bp, Homo sapiens
acaggcatgttctctgag

SEQ ID NO: 2851527 - DNA, 18 bp, Homo sapiens
acccatttttgagccaag

SEQ ID NO: 2851528 - DNA, 15 bp, Homo sapiens
accccaaagagcctg

SEQ ID NO: 2851529 - DNA, 19 bp, Homo sapiens
accccaaagagcctggaga

SEQ ID NO: 2851530 - DNA, 15 bp, Homo sapiens
accccaaagcccctt

SEQ ID NO: 2851531 - DNA, 18 bp, Homo sapiens
accccaaagccccttgct

SEQ ID NO: 2851532 - DNA, 22 bp, Homo sapiens
accccaagtccacctgcctatc

SEQ ID NO: 2851533 - DNA, 22 bp, Homo sapiens
accccacctcatgcctggcccc

SEQ ID NO: 2851534 - DNA, 14 bp, Homo sapiens
accccagctcccta

SEQ ID NO: 2851535 - DNA, 17 bp, Homo sapiens
accccaggacgccactc

SEQ ID NO: 2851536 - DNA, 20 bp, Homo sapiens
accccaggacgccactcatt

SEQ ID NO: 2851537 - DNA, 21 bp, Homo sapiens
accccaggacgccactcattt

SEQ ID NO: 2851538 - DNA, 10 bp, Homo sapiens
accccagggc

SEQ ID NO: 2851539 - DNA, 20 bp, Homo sapiens
accccagggcccccacaggc

SEQ ID NO: 2851540 - DNA, 13 bp, Homo sapiens
accccaggtttct

SEQ ID NO: 2851541 - DNA, 15 bp, Homo sapiens
accccagttctgctc

SEQ ID NO: 2851542 - DNA, 19 bp, Homo sapiens
accccagttctgctcctct

SEQ ID NO: 2851543 - DNA, 23 bp, Homo sapiens
accccatcacctactcacacagg

SEQ ID NO: 2851544 - DNA, 14 bp, Homo sapiens
accccatctctctt

SEQ ID NO: 2851545 - DNA, 13 bp, Homo sapiens
acccccactctca

SEQ ID NO: 2851546 - DNA, 21 bp, Homo sapiens
acccccactctcattccccag

SEQ ID NO: 2851547 - DNA, 12 bp, Homo sapiens
acccccagcccc

SEQ ID NO: 2851548 - DNA, 23 bp, Homo sapiens
acccccagccccgactccagcca

SEQ ID NO: 2851549 - DNA, 15 bp, Homo sapiens
acccccagcctgcta

SEQ ID NO: 2851550 - DNA, 18 bp, Homo sapiens
acccccagtgccacagag

SEQ ID NO: 2851551 - DNA, 21 bp, Homo sapiens
acccccagtgccacagagaag

SEQ ID NO: 2851552 - DNA, 20 bp, Homo sapiens
acccccagtgtggctgtctg

SEQ ID NO: 2851553 - DNA, 17 bp, Homo sapiens
acccccatttctattta

SEQ ID NO: 2851554 - DNA, 17 bp, Homo sapiens
acccccgtggtctttga

SEQ ID NO: 2851555 - DNA, 18 bp, Homo sapiens
acccccgtggtctttgaa

SEQ ID NO: 2851556 - DNA, 21 bp, Homo sapiens
acccccgtggtctttgaataa

SEQ ID NO: 2851557 - DNA, 11 bp, Homo sapiens
accccctcatt

SEQ ID NO: 2851558 - DNA, 14 bp, Homo sapiens
accccctcccaccc

SEQ ID NO: 2851559 - DNA, 13 bp, Homo sapiens
accccctccccag

SEQ ID NO: 2851560 - DNA, 16 bp, Homo sapiens
accccctccccagggg

SEQ ID NO: 2851561 - DNA, 15 bp, Homo sapiens
accccctgcagcttg

SEQ ID NO: 2851562 - DNA, 20 bp, Homo sapiens
acccccttcagtgcccacca

SEQ ID NO: 2851563 - DNA, 11 bp, Homo sapiens
acccctcagtg

SEQ ID NO: 2851564 - DNA, 12 bp, Homo sapiens
acccctcagtgc

SEQ ID NO: 2851565 - DNA, 15 bp, Homo sapiens
acccctcagtgctcg

SEQ ID NO: 2851566 - DNA, 17 bp, Homo sapiens
acccctcagtgctcggc

SEQ ID NO: 2851567 - DNA, 22 bp, Homo sapiens
acccctcagtgctcggcagtca

SEQ ID NO: 2851568 - DNA, 21 bp, Homo sapiens
acccctccccattcacagagc

SEQ ID NO: 2851569 - DNA, 13 bp, Homo sapiens
acccctcccctcc

SEQ ID NO: 2851570 - DNA, 19 bp, Homo sapiens
acccctggaccaccagccc

SEQ ID NO: 2851571 - DNA, 15 bp, Homo sapiens
accccttatccagga

SEQ ID NO: 2851572 - DNA, 15 bp, Homo sapiens
accccttcctttcct

SEQ ID NO: 2851573 - DNA, 18 bp, Homo sapiens
accccttcctttcctctg

SEQ ID NO: 2851574 - DNA, 15 bp, Homo sapiens
accccttcgctcctg

SEQ ID NO: 2851575 - DNA, 16 bp, Homo sapiens
accccttcgctcctgt

SEQ ID NO: 2851576 - DNA, 19 bp, Homo sapiens
accccttcgctcctgtgtc

SEQ ID NO: 2851577 - DNA, 20 bp, Homo sapiens
accccttcgctcctgtgtct

SEQ ID NO: 2851578 - DNA, 12 bp, Homo sapiens
acccctttcctg

SEQ ID NO: 2851579 - DNA, 13 bp, Homo sapiens
acccgctctggac

SEQ ID NO: 2851580 - DNA, 13 bp, Homo sapiens
acccggaaagact

SEQ ID NO: 2851581 - DNA, 20 bp, Homo sapiens
acccggcaccccctgcagct

SEQ ID NO: 2851582 - DNA, 12 bp, Homo sapiens
acccggctcccc

SEQ ID NO: 2851583 - DNA, 21 bp, Homo sapiens
acccggctccccctgcttctc

SEQ ID NO: 2851584 - DNA, 13 bp, Homo sapiens
acccgtggaggct

SEQ ID NO: 2851585 - DNA, 15 bp, Homo sapiens
acccgtggaggctgc

SEQ ID NO: 2851586 - DNA, 17 bp, Homo sapiens
acccgtggaggctgctc

SEQ ID NO: 2851587 - DNA, 13 bp, Homo sapiens
acccgttcaactt

SEQ ID NO: 2851588 - DNA, 18 bp, Homo sapiens
acccgttctgctggcctg

SEQ ID NO: 2851589 - DNA, 23 bp, Homo sapiens
acccgttctgctggcctggatct

SEQ ID NO: 2851590 - DNA, 16 bp, Homo sapiens
accctaagcctccttt

SEQ ID NO: 2851591 - DNA, 14 bp, Homo sapiens
accctaccccacca

SEQ ID NO: 2851592 - DNA, 16 bp, Homo sapiens
accctacctgtgcctg

SEQ ID NO: 2851593 - DNA, 17 bp, Homo sapiens
accctacctgtgcctga

SEQ ID NO: 2851594 - DNA, 22 bp, Homo sapiens
accctacttcattttcagagtg

SEQ ID NO: 2851595 - DNA, 23 bp, Homo sapiens
accctacttcattttcagagtga

SEQ ID NO: 2851596 - DNA, 22 bp, Homo sapiens
accctcactgctggggagtccc

SEQ ID NO: 2851597 - DNA, 14 bp, Homo sapiens
accctcagccttga

SEQ ID NO: 2851598 - DNA, 18 bp, Homo sapiens
accctcataccatctgct

SEQ ID NO: 2851599 - DNA, 19 bp, Homo sapiens
accctcataccatctgctg

SEQ ID NO: 2851600 - DNA, 12 bp, Homo sapiens
accctcccacca

SEQ ID NO: 2851601 - DNA, 14 bp, Homo sapiens
accctccccattca

SEQ ID NO: 2851602 - DNA, 23 bp, Homo sapiens
accctccccgcaccccccaagct

SEQ ID NO: 2851603 - DNA, 15 bp, Homo sapiens
accctcgtggacacc

SEQ ID NO: 2851604 - DNA, 12 bp, Homo sapiens
accctctcttcc

SEQ ID NO: 2851605 - DNA, 14 bp, Homo sapiens
accctctcttccct

SEQ ID NO: 2851606 - DNA, 22 bp, Homo sapiens
accctctgaatggtccagggtt

SEQ ID NO: 2851607 - DNA, 21 bp, Homo sapiens
accctgaatggttccatgcct

SEQ ID NO: 2851608 - DNA, 22 bp, Homo sapiens
accctgaatggttccatgcctg

SEQ ID NO: 2851609 - DNA, 21 bp, Homo sapiens
accctgaatttggcctgcact

SEQ ID NO: 2851610 - DNA, 12 bp, Homo sapiens
accctgagcctg

SEQ ID NO: 2851611 - DNA, 13 bp, Homo sapiens
accctgagcctga

SEQ ID NO: 2851612 - DNA, 17 bp, Homo sapiens
accctgaggagtctgag

SEQ ID NO: 2851613 - DNA, 22 bp, Homo sapiens
accctgaggagtctgaggtcct

SEQ ID NO: 2851614 - DNA, 23 bp, Homo sapiens
accctgaggagtctgaggtcctg

SEQ ID NO: 2851615 - DNA, 13 bp, Homo sapiens
accctgcagagca

SEQ ID NO: 2851616 - DNA, 21 bp, Homo sapiens
accctgcccttgtttggggca

SEQ ID NO: 2851617 - DNA, 20 bp, Homo sapiens
accctggagcggctctcctg

SEQ ID NO: 2851618 - DNA, 18 bp, Homo sapiens
actagtaatgggccaatt

SEQ ID NO: 2851619 - DNA, 22 bp, Homo sapiens
actagtaatgggccaattaaaa

SEQ ID NO: 2851620 - DNA, 19 bp, Homo sapiens
actagtattgtccatatca

SEQ ID NO: 2851621 - DNA, 20 bp, Homo sapiens
actataaacattaaaagaag

SEQ ID NO: 2851622 - DNA, 22 bp, Homo sapiens
actataaccatcagttactggt

SEQ ID NO: 2851623 - DNA, 23 bp, Homo sapiens
actataaccatcagttactggtt

SEQ ID NO: 2851624 - DNA, 20 bp, Homo sapiens
actataagcaagaaggcaaa

SEQ ID NO: 2851625 - DNA, 20 bp, Homo sapiens
actatagcccaggtcctctg

SEQ ID NO: 2851626 - DNA, 17 bp, Homo sapiens
actatagcctaggtgac

SEQ ID NO: 2851627 - DNA, 18 bp, Homo sapiens
actatagcctaggtgaca

SEQ ID NO: 2851628 - DNA, 20 bp, Homo sapiens
actatagcctaggtgacaga

SEQ ID NO: 2851629 - DNA, 15 bp, Homo sapiens
actatattgtacaca

SEQ ID NO: 2851630 - DNA, 19 bp, Homo sapiens
actatcaaactgaagccag

SEQ ID NO: 2851631 - DNA, 11 bp, Homo sapiens
actatcacata

SEQ ID NO: 2851632 - DNA, 13 bp, Homo sapiens
actatcacataca

SEQ ID NO: 2851633 - DNA, 22 bp, Homo sapiens
actatcacatacaatttgcact

SEQ ID NO: 2851634 - DNA, 13 bp, Homo sapiens
actatctttctga

SEQ ID NO: 2851635 - DNA, 19 bp, Homo sapiens
actatgaaaagctagaatt

SEQ ID NO: 2851636 - DNA, 21 bp, Homo sapiens
actatgaaaagctagaattga

SEQ ID NO: 2851637 - DNA, 12 bp, Homo sapiens
actatgacactg

SEQ ID NO: 2851638 - DNA, 15 bp, Homo sapiens
actatgatctcagga

SEQ ID NO: 2851639 - DNA, 16 bp, Homo sapiens
actatgcacaatttaa

SEQ ID NO: 2851640 - DNA, 16 bp, Homo sapiens
actatgtgtcatgatt

SEQ ID NO: 2851641 - DNA, 19 bp, Homo sapiens
actatgttgcccaggcagg

SEQ ID NO: 2851642 - DNA, 21 bp, Homo sapiens
actattataatttaatgcatg

SEQ ID NO: 2851643 - DNA, 18 bp, Homo sapiens
actattgaagttgcagat

SEQ ID NO: 2851644 - DNA, 19 bp, Homo sapiens
actcaaattaatctttctt

SEQ ID NO: 2851645 - DNA, 18 bp, Homo sapiens
actcaaccaacctccccg

SEQ ID NO: 2851646 - DNA, 14 bp, Homo sapiens
actcaagaggctga

SEQ ID NO: 2851647 - DNA, 17 bp, Homo sapiens
actcaagtttttacaaa

SEQ ID NO: 2851648 - DNA, 19 bp, Homo sapiens
actcaagtttttacaaaat

SEQ ID NO: 2851649 - DNA, 18 bp, Homo sapiens
actcaataaaatcatgta

SEQ ID NO: 2851650 - DNA, 12 bp, Homo sapiens
actcaatatttt

SEQ ID NO: 2851651 - DNA, 15 bp, Homo sapiens
actcaatattttcca

SEQ ID NO: 2851652 - DNA, 14 bp, Homo sapiens
actcacaagaagac

SEQ ID NO: 2851653 - DNA, 20 bp, Homo sapiens
actcacacaggcatttcctg

SEQ ID NO: 2851654 - DNA, 22 bp, Homo sapiens
actcacacaggcatttcctggg

SEQ ID NO: 2851655 - DNA, 16 bp, Homo sapiens
actcacatggctatgt

SEQ ID NO: 2851656 - DNA, 11 bp, Homo sapiens
actcacctctg

SEQ ID NO: 2851657 - DNA, 14 bp, Homo sapiens
actcacctctgcct

SEQ ID NO: 2851658 - DNA, 15 bp, Homo sapiens
actcacctctgcctc

SEQ ID NO: 2851659 - DNA, 23 bp, Homo sapiens
actcacgataaataatcggccca

SEQ ID NO: 2851660 - DNA, 19 bp, Homo sapiens
actcagaaaagaaaaccat

SEQ ID NO: 2851661 - DNA, 16 bp, Homo sapiens
actcagaagacactga

SEQ ID NO: 2851662 - DNA, 16 bp, Homo sapiens
actcagaagcctgagg

SEQ ID NO: 2851663 - DNA, 14 bp, Homo sapiens
actcagaagcctgg

SEQ ID NO: 2851664 - DNA, 16 bp, Homo sapiens
actcagaagcctgggg

SEQ ID NO: 2851665 - DNA, 21 bp, Homo sapiens
actcagaagcctgggggcctg

SEQ ID NO: 2851666 - DNA, 23 bp, Homo sapiens
actcagaagcctgggggcctggc

SEQ ID NO: 2851667 - DNA, 13 bp, Homo sapiens
actcagcagccct

SEQ ID NO: 2851668 - DNA, 17 bp, Homo sapiens
actcagcagccctcctc

SEQ ID NO: 2851669 - DNA, 21 bp, Homo sapiens
actcagcagccctcctcaccc

SEQ ID NO: 2851670 - DNA, 22 bp, Homo sapiens
actcagctccagaataccttct

SEQ ID NO: 2851671 - DNA, 16 bp, Homo sapiens
actcaggaggctgagg

SEQ ID NO: 2851672 - DNA, 20 bp, Homo sapiens
actcaggaggctgaggcaga

SEQ ID NO: 2851673 - DNA, 17 bp, Homo sapiens
actcaggaggctgaggg

SEQ ID NO: 2851674 - DNA, 13 bp, Homo sapiens
actcaggattctc

SEQ ID NO: 2851675 - DNA, 12 bp, Homo sapiens
actcagggacct

SEQ ID NO: 2851676 - DNA, 13 bp, Homo sapiens
actcagggcccca

SEQ ID NO: 2851677 - DNA, 14 bp, Homo sapiens
actcagggccccag

SEQ ID NO: 2851678 - DNA, 18 bp, Homo sapiens
actcagtcccccaccaca

SEQ ID NO: 2851679 - DNA, 22 bp, Homo sapiens
actcagtcccccaccacactga

SEQ ID NO: 2851680 - DNA, 22 bp, Homo sapiens
actcagttaaaatgtctgtttc

SEQ ID NO: 2851681 - DNA, 22 bp, Homo sapiens
actcagtttgtcagactttaaa

SEQ ID NO: 2851682 - DNA, 15 bp, Homo sapiens
actcagttttaacta

SEQ ID NO: 2851683 - DNA, 23 bp, Homo sapiens
actcataagttggaccagaggaa

SEQ ID NO: 2851684 - DNA, 12 bp, Homo sapiens
actcatcataaa

SEQ ID NO: 2851685 - DNA, 14 bp, Homo sapiens
actcatcataaaat

SEQ ID NO: 2851686 - DNA, 16 bp, Homo sapiens
actcatcataaaataa

SEQ ID NO: 2851687 - DNA, 15 bp, Homo sapiens
actcatctgttatcc

SEQ ID NO: 2851688 - DNA, 15 bp, Homo sapiens
actcattagactgga

SEQ ID NO: 2851689 - DNA, 15 bp, Homo sapiens
actcattcttctgta

SEQ ID NO: 2851690 - DNA, 12 bp, Homo sapiens
actcatttcatc

SEQ ID NO: 2851691 - DNA, 17 bp, Homo sapiens
actcatttcatctcatt

SEQ ID NO: 2851692 - DNA, 20 bp, Homo sapiens
actcatttttcatgataatg

SEQ ID NO: 2851693 - DNA, 19 bp, Homo sapiens
actccaagcttcaagtgat

SEQ ID NO: 2851694 - DNA, 11 bp, Homo sapiens
actccagccag

SEQ ID NO: 2851695 - DNA, 21 bp, Homo sapiens
actccagccagcgcctccctc

SEQ ID NO: 2851696 - DNA, 23 bp, Homo sapiens
actccagccagcgcctccctcca

SEQ ID NO: 2851697 - DNA, 15 bp, Homo sapiens
actccagcctgagca

SEQ ID NO: 2851698 - DNA, 19 bp, Homo sapiens
actccagcctgagcaacag

SEQ ID NO: 2851699 - DNA, 20 bp, Homo sapiens
actccagcctgagcaacaga

SEQ ID NO: 2851700 - DNA, 11 bp, Homo sapiens
actccagctcc

SEQ ID NO: 2851701 - DNA, 18 bp, Homo sapiens
actccaggaaaactgttt

SEQ ID NO: 2851702 - DNA, 16 bp, Homo sapiens
actccagtggtgaaga

SEQ ID NO: 2851703 - DNA, 13 bp, Homo sapiens
actccccaggcca

SEQ ID NO: 2851704 - DNA, 19 bp, Homo sapiens
actccccaggccaggccac

SEQ ID NO: 2851705 - DNA, 13 bp, Homo sapiens
actccctccctgg

SEQ ID NO: 2851706 - DNA, 23 bp, Homo sapiens
actccctgggaaaggggttgtca

SEQ ID NO: 2851707 - DNA, 23 bp, Homo sapiens
actccggcctgatgacagagcga

SEQ ID NO: 2851708 - DNA, 15 bp, Homo sapiens
actccggtgtgcctg

SEQ ID NO: 2851709 - DNA, 14 bp, Homo sapiens
agaagtcatggccc

SEQ ID NO: 2851710 - DNA, 17 bp, Homo sapiens
agaagtgcaaaggtgtg

SEQ ID NO: 2851711 - DNA, 19 bp, Homo sapiens
agaagtgcaaaggtgtgca

SEQ ID NO: 2851712 - DNA, 18 bp, Homo sapiens
agaagtgggccaggacag

SEQ ID NO: 2851713 - DNA, 13 bp, Homo sapiens
agaagtgtatata

SEQ ID NO: 2851714 - DNA, 12 bp, Homo sapiens
agaagtgtttta

SEQ ID NO: 2851715 - DNA, 16 bp, Homo sapiens
agaagttgccaagagt

SEQ ID NO: 2851716 - DNA, 21 bp, Homo sapiens
agaataaagttctgagtgttt

SEQ ID NO: 2851717 - DNA, 13 bp, Homo sapiens
agaataaatgaat

SEQ ID NO: 2851718 - DNA, 14 bp, Homo sapiens
agaataagagaaag

SEQ ID NO: 2851719 - DNA, 21 bp, Homo sapiens
agaataagagaaagaaaatga

SEQ ID NO: 2851720 - DNA, 14 bp, Homo sapiens
agaataagtgctgt

SEQ ID NO: 2851721 - DNA, 22 bp, Homo sapiens
agaataattgtgtacaaagtag

SEQ ID NO: 2851722 - DNA, 12 bp, Homo sapiens
agaatacagaaa

SEQ ID NO: 2851723 - DNA, 14 bp, Homo sapiens
agaatacagaaaat

SEQ ID NO: 2851724 - DNA, 20 bp, Homo sapiens
agaatacagaaaatgctttt

SEQ ID NO: 2851725 - DNA, 23 bp, Homo sapiens
agaatataattatcggaagcagt

SEQ ID NO: 2851726 - DNA, 15 bp, Homo sapiens
agaatattcaggact

SEQ ID NO: 2851727 - DNA, 16 bp, Homo sapiens
agaatatttattacct

SEQ ID NO: 2851728 - DNA, 22 bp, Homo sapiens
agaatatttattacctctgata

SEQ ID NO: 2851729 - DNA, 17 bp, Homo sapiens
agaatcataattttcaa

SEQ ID NO: 2851730 - DNA, 18 bp, Homo sapiens
agaatcataattttcaag

SEQ ID NO: 2851731 - DNA, 16 bp, Homo sapiens
agaatctgaagctatt

SEQ ID NO: 2851732 - DNA, 17 bp, Homo sapiens
agaatgaaaattgtatg

SEQ ID NO: 2851733 - DNA, 16 bp, Homo sapiens
agaatgaaagggccca

SEQ ID NO: 2851734 - DNA, 14 bp, Homo sapiens
agaatgagagtgtg

SEQ ID NO: 2851735 - DNA, 16 bp, Homo sapiens
agaatgagggccaaga

SEQ ID NO: 2851736 - DNA, 13 bp, Homo sapiens
agaatgatttcat

SEQ ID NO: 2851737 - DNA, 15 bp, Homo sapiens
agaatggcagctgga

SEQ ID NO: 2851738 - DNA, 12 bp, Homo sapiens
agaatgtaaagc

SEQ ID NO: 2851739 - DNA, 13 bp, Homo sapiens
agaatgtaaagct

SEQ ID NO: 2851740 - DNA, 23 bp, Homo sapiens
agaatgtatattaaggtgtggct

SEQ ID NO: 2851741 - DNA, 23 bp, Homo sapiens
agaatgtcattttggtactttgg

SEQ ID NO: 2851742 - DNA, 17 bp, Homo sapiens
agaatgtgttttctgaa

SEQ ID NO: 2851743 - DNA, 19 bp, Homo sapiens
agaatgttaagacttgaca

SEQ ID NO: 2851744 - DNA, 17 bp, Homo sapiens
agaattatatctaattt

SEQ ID NO: 2851745 - DNA, 23 bp, Homo sapiens
agaattatatctaatttatacaa

SEQ ID NO: 2851746 - DNA, 24 bp, Homo sapiens
agaattatatctaatttatacaaa

SEQ ID NO: 2851747 - DNA, 21 bp, Homo sapiens
agaattatttttgtgtttcta

SEQ ID NO: 2851748 - DNA, 14 bp, Homo sapiens
agaattccaaggag

SEQ ID NO: 2851749 - DNA, 17 bp, Homo sapiens
agaattcttcaggtgga

SEQ ID NO: 2851750 - DNA, 16 bp, Homo sapiens
agaattgaacccagga

SEQ ID NO: 2851751 - DNA, 17 bp, Homo sapiens
agaattgagtgtttaaa

SEQ ID NO: 2851752 - DNA, 14 bp, Homo sapiens
agaattgggaagct

SEQ ID NO: 2851753 - DNA, 23 bp, Homo sapiens
agaattgtgcgacttcacaaaat

SEQ ID NO: 2851754 - DNA, 19 bp, Homo sapiens
agaattgtgtcagactgtt

SEQ ID NO: 2851755 - DNA, 22 bp, Homo sapiens
agaatttaaattctttttcaaa

SEQ ID NO: 2851756 - DNA, 22 bp, Homo sapiens
agaatttcttggtaagaagccg

SEQ ID NO: 2851757 - DNA, 16 bp, Homo sapiens
agaatttgtattttgc

SEQ ID NO: 2851758 - DNA, 13 bp, Homo sapiens
agaattttaaatt

SEQ ID NO: 2851759 - DNA, 21 bp, Homo sapiens
agaattttaagtgctttgtaa

SEQ ID NO: 2851760 - DNA, 22 bp, Homo sapiens
agaattttaagtgctttgtaat

SEQ ID NO: 2851761 - DNA, 17 bp, Homo sapiens
agaatttttaatgactt

SEQ ID NO: 2851762 - DNA, 12 bp, Homo sapiens
agacaaagcaaa

SEQ ID NO: 2851763 - DNA, 18 bp, Homo sapiens
agacaaaggttttcctct

SEQ ID NO: 2851764 - DNA, 13 bp, Homo sapiens
agacaacagaagt

SEQ ID NO: 2851765 - DNA, 14 bp, Homo sapiens
agacaacagaagtc

SEQ ID NO: 2851766 - DNA, 20 bp, Homo sapiens
agacaactcttccatttatt

SEQ ID NO: 2851767 - DNA, 14 bp, Homo sapiens
agacaagcaacagg

SEQ ID NO: 2851768 - DNA, 14 bp, Homo sapiens
agacaataaaacat

SEQ ID NO: 2851769 - DNA, 16 bp, Homo sapiens
agacaataaaacattc

SEQ ID NO: 2851770 - DNA, 12 bp, Homo sapiens
agacacagactg

SEQ ID NO: 2851771 - DNA, 17 bp, Homo sapiens
agacacaggcccggctc

SEQ ID NO: 2851772 - DNA, 20 bp, Homo sapiens
agacacaggcccggctccag

SEQ ID NO: 2851773 - DNA, 23 bp, Homo sapiens
agacacattcctagttccccgtg

SEQ ID NO: 2851774 - DNA, 16 bp, Homo sapiens
agacacctgcacctcc

SEQ ID NO: 2851775 - DNA, 20 bp, Homo sapiens
agacacctgcacctcccccc

SEQ ID NO: 2851776 - DNA, 17 bp, Homo sapiens
agacaccttgacagggc

SEQ ID NO: 2851777 - DNA, 15 bp, Homo sapiens
agacactaagttata

SEQ ID NO: 2851778 - DNA, 13 bp, Homo sapiens
agacacttcatgg

SEQ ID NO: 2851779 - DNA, 17 bp, Homo sapiens
agacagaaaaaaataaa

SEQ ID NO: 2851780 - DNA, 17 bp, Homo sapiens
agacagaacccctacat

SEQ ID NO: 2851781 - DNA, 14 bp, Homo sapiens
agacagaagaaaca

SEQ ID NO: 2851782 - DNA, 15 bp, Homo sapiens
agacagaagaaacaa

SEQ ID NO: 2851783 - DNA, 19 bp, Homo sapiens
agacagagtctcactgttg

SEQ ID NO: 2851784 - DNA, 20 bp, Homo sapiens
agacagagtctcactgttgc

SEQ ID NO: 2851785 - DNA, 23 bp, Homo sapiens
agacagagtctcactgttgccca

SEQ ID NO: 2851786 - DNA, 16 bp, Homo sapiens
agacagcagctcaggc

SEQ ID NO: 2851787 - DNA, 19 bp, Homo sapiens
agacagcgaactagaagaa

SEQ ID NO: 2851788 - DNA, 20 bp, Homo sapiens
agacagcgaactagaagaaa

SEQ ID NO: 2851789 - DNA, 14 bp, Homo sapiens
agacaggagaaatg

SEQ ID NO: 2851790 - DNA, 16 bp, Homo sapiens
agacaggcccaagaga

SEQ ID NO: 2851791 - DNA, 21 bp, Homo sapiens
agacagggttttgccatgttg

SEQ ID NO: 2851792 - DNA, 16 bp, Homo sapiens
agacaggtggcctagc

SEQ ID NO: 2851793 - DNA, 17 bp, Homo sapiens
agacatgaatgcacact

SEQ ID NO: 2851794 - DNA, 22 bp, Homo sapiens
agacatggagactcctgccctg

SEQ ID NO: 2851795 - DNA, 20 bp, Homo sapiens
agacattaactcattagact

SEQ ID NO: 2851796 - DNA, 22 bp, Homo sapiens
agacatttgtaaatgtaaaact

SEQ ID NO: 2851797 - DNA, 12 bp, Homo sapiens
agaccacctctc

SEQ ID NO: 2851798 - DNA, 22 bp, Homo sapiens
agaccacctgcttctgaactca

SEQ ID NO: 2851799 - DNA, 18 bp, Homo sapiens
agaccagactgtggagaa

SEQ ID NO: 2851800 - DNA, 16 bp, Homo sapiens
agcaaagtgtcagtgt

SEQ ID NO: 2851801 - DNA, 15 bp, Homo sapiens
agcaaatcgaatgaa

SEQ ID NO: 2851802 - DNA, 22 bp, Homo sapiens
agcaaatcgaatgaaattaact

SEQ ID NO: 2851803 - DNA, 16 bp, Homo sapiens
agcaaatgtggctcct

SEQ ID NO: 2851804 - DNA, 17 bp, Homo sapiens
agcaaatgtttctgcag

SEQ ID NO: 2851805 - DNA, 14 bp, Homo sapiens
agcaacacaagctg

SEQ ID NO: 2851806 - DNA, 17 bp, Homo sapiens
agcaacacaagctggaa

SEQ ID NO: 2851807 - DNA, 18 bp, Homo sapiens
agcaacacaagctggaag

SEQ ID NO: 2851808 - DNA, 20 bp, Homo sapiens
agcaacagagtgagaccctg

SEQ ID NO: 2851809 - DNA, 19 bp, Homo sapiens
agcaacaggaatctcagag

SEQ ID NO: 2851810 - DNA, 15 bp, Homo sapiens
agcaaccgtggccct

SEQ ID NO: 2851811 - DNA, 23 bp, Homo sapiens
agcaaccgtggcccttcctggac

SEQ ID NO: 2851812 - DNA, 21 bp, Homo sapiens
agcaactacagtctaaagctg

SEQ ID NO: 2851813 - DNA, 20 bp, Homo sapiens
agcaactgttggataataac

SEQ ID NO: 2851814 - DNA, 16 bp, Homo sapiens
agcaagactgttgctc

SEQ ID NO: 2851815 - DNA, 13 bp, Homo sapiens
agcaagagctggc

SEQ ID NO: 2851816 - DNA, 17 bp, Homo sapiens
agcaagagctggcaaag

SEQ ID NO: 2851817 - DNA, 21 bp, Homo sapiens
agcaagatcctgtctttaagg

SEQ ID NO: 2851818 - DNA, 16 bp, Homo sapiens
agcaagatcttgtctc

SEQ ID NO: 2851819 - DNA, 15 bp, Homo sapiens
agcaagcattcagaa

SEQ ID NO: 2851820 - DNA, 14 bp, Homo sapiens
agcaaggcccgagc

SEQ ID NO: 2851821 - DNA, 16 bp, Homo sapiens
agcaagtgagagctgg

SEQ ID NO: 2851822 - DNA, 17 bp, Homo sapiens
agcaagtgagagctggg

SEQ ID NO: 2851823 - DNA, 20 bp, Homo sapiens
agcaatccatgttagttttt

SEQ ID NO: 2851824 - DNA, 19 bp, Homo sapiens
agcaatgatgtccagaaga

SEQ ID NO: 2851825 - DNA, 20 bp, Homo sapiens
agcaatgatgtccagaagaa

SEQ ID NO: 2851826 - DNA, 14 bp, Homo sapiens
agcaattcatttca

SEQ ID NO: 2851827 - DNA, 18 bp, Homo sapiens
agcaattcatttcacttt

SEQ ID NO: 2851828 - DNA, 23 bp, Homo sapiens
agcaattcatttcactttaaagt

SEQ ID NO: 2851829 - DNA, 14 bp, Homo sapiens
agcaattctaccca

SEQ ID NO: 2851830 - DNA, 23 bp, Homo sapiens
agcaattctacccagagccttct

SEQ ID NO: 2851831 - DNA, 21 bp, Homo sapiens
agcaatttcgccgttgaagag

SEQ ID NO: 2851832 - DNA, 14 bp, Homo sapiens
agcaatttgcacat

SEQ ID NO: 2851833 - DNA, 15 bp, Homo sapiens
agcaatttgcacatg

SEQ ID NO: 2851834 - DNA, 19 bp, Homo sapiens
agcacaagaggaagagaga

SEQ ID NO: 2851835 - DNA, 19 bp, Homo sapiens
agcacaagttatttaaatc

SEQ ID NO: 2851836 - DNA, 16 bp, Homo sapiens
agcacagcttcatttc

SEQ ID NO: 2851837 - DNA, 21 bp, Homo sapiens
agcacagcttcatttcctgtg

SEQ ID NO: 2851838 - DNA, 12 bp, Homo sapiens
agcacaggcagc

SEQ ID NO: 2851839 - DNA, 15 bp, Homo sapiens
agcacaggcagctgg

SEQ ID NO: 2851840 - DNA, 14 bp, Homo sapiens
agcacagttttaag

SEQ ID NO: 2851841 - DNA, 19 bp, Homo sapiens
agcaccagcttctccaggc

SEQ ID NO: 2851842 - DNA, 21 bp, Homo sapiens
agcaccagcttctccaggctc

SEQ ID NO: 2851843 - DNA, 13 bp, Homo sapiens
agcaccccctcat

SEQ ID NO: 2851844 - DNA, 18 bp, Homo sapiens
agcacccgttcaccttct

SEQ ID NO: 2851845 - DNA, 14 bp, Homo sapiens
agcaccctgcagag

SEQ ID NO: 2851846 - DNA, 20 bp, Homo sapiens
agcaccctgcagagcacaca

SEQ ID NO: 2851847 - DNA, 15 bp, Homo sapiens
agcacctacttacat

SEQ ID NO: 2851848 - DNA, 17 bp, Homo sapiens
agcacctagcctcgctc

SEQ ID NO: 2851849 - DNA, 15 bp, Homo sapiens
agcacctgccgacct

SEQ ID NO: 2851850 - DNA, 20 bp, Homo sapiens
agcacctgccgacctcgtcc

SEQ ID NO: 2851851 - DNA, 22 bp, Homo sapiens
agcacctgccgacctcgtcctc

SEQ ID NO: 2851852 - DNA, 17 bp, Homo sapiens
agcacgaaatgttattt

SEQ ID NO: 2851853 - DNA, 20 bp, Homo sapiens
agcactaaagcagtggacac

SEQ ID NO: 2851854 - DNA, 23 bp, Homo sapiens
agcactaaagcagtggacaccag

SEQ ID NO: 2851855 - DNA, 19 bp, Homo sapiens
agcactaaggtgtgctctg

SEQ ID NO: 2851856 - DNA, 22 bp, Homo sapiens
agcactcagaaaagaaaaccat

SEQ ID NO: 2851857 - DNA, 14 bp, Homo sapiens
agcactcctctgtc

SEQ ID NO: 2851858 - DNA, 16 bp, Homo sapiens
agcactcctctgtctc

SEQ ID NO: 2851859 - DNA, 14 bp, Homo sapiens
agcactctctaaat

SEQ ID NO: 2851860 - DNA, 20 bp, Homo sapiens
agcactctctaaatcttcct

SEQ ID NO: 2851861 - DNA, 22 bp, Homo sapiens
agcactctctaaatcttccttg

SEQ ID NO: 2851862 - DNA, 12 bp, Homo sapiens
agcactgccagg

SEQ ID NO: 2851863 - DNA, 14 bp, Homo sapiens
agcactgccaggag

SEQ ID NO: 2851864 - DNA, 17 bp, Homo sapiens
agcactgccaggaggga

SEQ ID NO: 2851865 - DNA, 21 bp, Homo sapiens
agcactgctaggcgagtgcca

SEQ ID NO: 2851866 - DNA, 20 bp, Homo sapiens
agcactgctgtgtccgcttt

SEQ ID NO: 2851867 - DNA, 16 bp, Homo sapiens
agcactggagtgcagg

SEQ ID NO: 2851868 - DNA, 19 bp, Homo sapiens
agcactggagtgcagggag

SEQ ID NO: 2851869 - DNA, 15 bp, Homo sapiens
agcactgtgaagacc

SEQ ID NO: 2851870 - DNA, 18 bp, Homo sapiens
agcactgtgaagacccag

SEQ ID NO: 2851871 - DNA, 22 bp, Homo sapiens
agcactgtgaagacccagcagg

SEQ ID NO: 2851872 - DNA, 14 bp, Homo sapiens
agcacttggagcca

SEQ ID NO: 2851873 - DNA, 17 bp, Homo sapiens
agcacttggagccaagg

SEQ ID NO: 2851874 - DNA, 23 bp, Homo sapiens
agcactttaaccctctcttccct

SEQ ID NO: 2851875 - DNA, 15 bp, Homo sapiens
agcactttgggaggc

SEQ ID NO: 2851876 - DNA, 21 bp, Homo sapiens
agcactttgggaggccaaggt

SEQ ID NO: 2851877 - DNA, 16 bp, Homo sapiens
agcactttgggaggct

SEQ ID NO: 2851878 - DNA, 13 bp, Homo sapiens
agcagattttaat

SEQ ID NO: 2851879 - DNA, 21 bp, Homo sapiens
agcagattttaattttgaata

SEQ ID NO: 2851880 - DNA, 22 bp, Homo sapiens
agcagattttaattttgaataa

SEQ ID NO: 2851881 - DNA, 18 bp, Homo sapiens
agcagcatctgctaataa

SEQ ID NO: 2851882 - DNA, 11 bp, Homo sapiens
agcagccagcc

SEQ ID NO: 2851883 - DNA, 14 bp, Homo sapiens
agcagccagccctg

SEQ ID NO: 2851884 - DNA, 17 bp, Homo sapiens
agcagccagccctgcct

SEQ ID NO: 2851885 - DNA, 15 bp, Homo sapiens
agcagccagctctca

SEQ ID NO: 2851886 - DNA, 17 bp, Homo sapiens
agcagccagctctcagc

SEQ ID NO: 2851887 - DNA, 23 bp, Homo sapiens
agcagccagctctcagccaacga

SEQ ID NO: 2851888 - DNA, 14 bp, Homo sapiens
agcagccctaagga

SEQ ID NO: 2851889 - DNA, 17 bp, Homo sapiens
agcagccctcctcaccc

SEQ ID NO: 2851890 - DNA, 19 bp, Homo sapiens
agcctcagcatcctggcac

SEQ ID NO: 2851891 - DNA, 20 bp, Homo sapiens
agcctcagcatcctggcacc

SEQ ID NO: 2851892 - DNA, 21 bp, Homo sapiens
agcctcagcatcctggcaccc

SEQ ID NO: 2851893 - DNA, 23 bp, Homo sapiens
agcctcagcatcctggcacccgg

SEQ ID NO: 2851894 - DNA, 14 bp, Homo sapiens
agcctcatccgagg

SEQ ID NO: 2851895 - DNA, 18 bp, Homo sapiens
agcctcatccgaggcagg

SEQ ID NO: 2851896 - DNA, 21 bp, Homo sapiens
agcctccatttagttctttgt

SEQ ID NO: 2851897 - DNA, 17 bp, Homo sapiens
agcctcccaaagtgctg

SEQ ID NO: 2851898 - DNA, 18 bp, Homo sapiens
agcctcccaaagtgctgg

SEQ ID NO: 2851899 - DNA, 19 bp, Homo sapiens
agcctcccaaagtgctggg

SEQ ID NO: 2851900 - DNA, 20 bp, Homo sapiens
agcctcccaaagtgctggga

SEQ ID NO: 2851901 - DNA, 21 bp, Homo sapiens
agcctcccaaagtgctgggat

SEQ ID NO: 2851902 - DNA, 18 bp, Homo sapiens
agcctcccgaatagctgg

SEQ ID NO: 2851903 - DNA, 20 bp, Homo sapiens
agcctcccgaatagctggga

SEQ ID NO: 2851904 - DNA, 20 bp, Homo sapiens
agcctcccgagtagctggga

SEQ ID NO: 2851905 - DNA, 21 bp, Homo sapiens
agcctccctctgacctgcagg

SEQ ID NO: 2851906 - DNA, 14 bp, Homo sapiens
agcctcctcccacc

SEQ ID NO: 2851907 - DNA, 21 bp, Homo sapiens
agcctcctcccaccaccctcc

SEQ ID NO: 2851908 - DNA, 19 bp, Homo sapiens
agcctcctcctgaccacgg

SEQ ID NO: 2851909 - DNA, 21 bp, Homo sapiens
agcctcgcaacccgtgccaag

SEQ ID NO: 2851910 - DNA, 20 bp, Homo sapiens
agcctcgccgtctgtgaatt

SEQ ID NO: 2851911 - DNA, 12 bp, Homo sapiens
agcctctccagg

SEQ ID NO: 2851912 - DNA, 16 bp, Homo sapiens
agcctctgcctgtgca

SEQ ID NO: 2851913 - DNA, 13 bp, Homo sapiens
agcctctgctgcc

SEQ ID NO: 2851914 - DNA, 14 bp, Homo sapiens
agcctctgctgcca

SEQ ID NO: 2851915 - DNA, 23 bp, Homo sapiens
agcctctgtccctctttgcctgt

SEQ ID NO: 2851916 - DNA, 23 bp, Homo sapiens
agcctcttaaagctgcctgtagt

SEQ ID NO: 2851917 - DNA, 23 bp, Homo sapiens
agcctgacctttctgagtgacat

SEQ ID NO: 2851918 - DNA, 15 bp, Homo sapiens
agcctgagtctcctg

SEQ ID NO: 2851919 - DNA, 16 bp, Homo sapiens
agcctgagtctcctgt

SEQ ID NO: 2851920 - DNA, 19 bp, Homo sapiens
agcctgcaaactcactgct

SEQ ID NO: 2851921 - DNA, 15 bp, Homo sapiens
agcctgcctcagctg

SEQ ID NO: 2851922 - DNA, 13 bp, Homo sapiens
agcctggactttg

SEQ ID NO: 2851923 - DNA, 11 bp, Homo sapiens
agcctggagaa

SEQ ID NO: 2851924 - DNA, 13 bp, Homo sapiens
agcctggagaagc

SEQ ID NO: 2851925 - DNA, 13 bp, Homo sapiens
agcctggcctcct

SEQ ID NO: 2851926 - DNA, 14 bp, Homo sapiens
agcctggcctcctg

SEQ ID NO: 2851927 - DNA, 18 bp, Homo sapiens
agcctggcttctggagcc

SEQ ID NO: 2851928 - DNA, 19 bp, Homo sapiens
agcctggcttctggagccc

SEQ ID NO: 2851929 - DNA, 14 bp, Homo sapiens
agcctgggaccagg

SEQ ID NO: 2851930 - DNA, 15 bp, Homo sapiens
agcctgggaccaggg

SEQ ID NO: 2851931 - DNA, 20 bp, Homo sapiens
agcctgggcaacagagcaag

SEQ ID NO: 2851932 - DNA, 17 bp, Homo sapiens
agcctgggcagcatagc

SEQ ID NO: 2851933 - DNA, 21 bp, Homo sapiens
agcctgggcctatggagagcc

SEQ ID NO: 2851934 - DNA, 22 bp, Homo sapiens
agcctgggcctatggagagccc

SEQ ID NO: 2851935 - DNA, 23 bp, Homo sapiens
agcctgggcctatggagagccct

SEQ ID NO: 2851936 - DNA, 14 bp, Homo sapiens
agcctgggcgacag

SEQ ID NO: 2851937 - DNA, 17 bp, Homo sapiens
agcctgggggcctggct

SEQ ID NO: 2851938 - DNA, 16 bp, Homo sapiens
agcctggtgggcctcc

SEQ ID NO: 2851939 - DNA, 21 bp, Homo sapiens
agcctggtgggcctcctctgt

SEQ ID NO: 2851940 - DNA, 17 bp, Homo sapiens
agcctggttttcacata

SEQ ID NO: 2851941 - DNA, 15 bp, Homo sapiens
agcctgtaatcccag

SEQ ID NO: 2851942 - DNA, 15 bp, Homo sapiens
agcctgtgaacccag

SEQ ID NO: 2851943 - DNA, 23 bp, Homo sapiens
agcctgtgaataaaaaccctgta

SEQ ID NO: 2851944 - DNA, 20 bp, Homo sapiens
agcctgtggcggtgcctggg

SEQ ID NO: 2851945 - DNA, 19 bp, Homo sapiens
agcctgttcatggcagatg

SEQ ID NO: 2851946 - DNA, 14 bp, Homo sapiens
agcctgttgagact

SEQ ID NO: 2851947 - DNA, 18 bp, Homo sapiens
agccttaatcaggtcctc

SEQ ID NO: 2851948 - DNA, 20 bp, Homo sapiens
agccttcacaaccagccaca

SEQ ID NO: 2851949 - DNA, 23 bp, Homo sapiens
agccttcagtcttgaatttctaa

SEQ ID NO: 2851950 - DNA, 22 bp, Homo sapiens
agccttccccttgcccagggct

SEQ ID NO: 2851951 - DNA, 17 bp, Homo sapiens
agccttctctctctggt

SEQ ID NO: 2851952 - DNA, 19 bp, Homo sapiens
agccttctctgttcatttc

SEQ ID NO: 2851953 - DNA, 15 bp, Homo sapiens
agccttgaaaaacaa

SEQ ID NO: 2851954 - DNA, 18 bp, Homo sapiens
agccttgaaaaacaagtc

SEQ ID NO: 2851955 - DNA, 21 bp, Homo sapiens
agccttgccttttaaaagaaa

SEQ ID NO: 2851956 - DNA, 22 bp, Homo sapiens
agccttggataatgctgttgcc

SEQ ID NO: 2851957 - DNA, 23 bp, Homo sapiens
agccttggggattcttccatctg

SEQ ID NO: 2851958 - DNA, 16 bp, Homo sapiens
agccttggtgtccacc

SEQ ID NO: 2851959 - DNA, 16 bp, Homo sapiens
agccttgtaattctaa

SEQ ID NO: 2851960 - DNA, 22 bp, Homo sapiens
agcctttccataaggaatgtag

SEQ ID NO: 2851961 - DNA, 23 bp, Homo sapiens
agcctttccataaggaatgtagc

SEQ ID NO: 2851962 - DNA, 12 bp, Homo sapiens
agcctttttcac

SEQ ID NO: 2851963 - DNA, 14 bp, Homo sapiens
agcgaaagtttctt

SEQ ID NO: 2851964 - DNA, 18 bp, Homo sapiens
agcgaaccaatatttgta

SEQ ID NO: 2851965 - DNA, 15 bp, Homo sapiens
agcgagggcgtgtct

SEQ ID NO: 2851966 - DNA, 14 bp, Homo sapiens
agcgagttgtggaa

SEQ ID NO: 2851967 - DNA, 21 bp, Homo sapiens
agcgattccctctcccaggcc

SEQ ID NO: 2851968 - DNA, 19 bp, Homo sapiens
agcgattcttctgcttcag

SEQ ID NO: 2851969 - DNA, 14 bp, Homo sapiens
agcgcacctgcccc

SEQ ID NO: 2851970 - DNA, 17 bp, Homo sapiens
agcgcacctgccccctg

SEQ ID NO: 2851971 - DNA, 21 bp, Homo sapiens
agcgcacctgccccctggtgg

SEQ ID NO: 2851972 - DNA, 16 bp, Homo sapiens
agcgccctgcagaccc

SEQ ID NO: 2851973 - DNA, 19 bp, Homo sapiens
agcgccctgcagaccctgc

SEQ ID NO: 2851974 - DNA, 12 bp, Homo sapiens
agcgcctccctc

SEQ ID NO: 2851975 - DNA, 15 bp, Homo sapiens
agcgcctccctccac

SEQ ID NO: 2851976 - DNA, 20 bp, Homo sapiens
agcgcctccctccaccccag

SEQ ID NO: 2851977 - DNA, 22 bp, Homo sapiens
agcgcctccctccaccccagga

SEQ ID NO: 2851978 - DNA, 17 bp, Homo sapiens
agcgctgccgcacccca

SEQ ID NO: 2851979 - DNA, 20 bp, Homo sapiens
agcgctgccgcaccccagag

SEQ ID NO: 2851980 - DNA, 21 bp, Homo sapiens
aggagagataccttgaaaaag

SEQ ID NO: 2851981 - DNA, 16 bp, Homo sapiens
aggagagcccttcatt

SEQ ID NO: 2851982 - DNA, 13 bp, Homo sapiens
aggagatataaaa

SEQ ID NO: 2851983 - DNA, 14 bp, Homo sapiens
aggagatgggcctt

SEQ ID NO: 2851984 - DNA, 13 bp, Homo sapiens
aggagcaaagcct

SEQ ID NO: 2851985 - DNA, 14 bp, Homo sapiens
aggagcaaagcctg

SEQ ID NO: 2851986 - DNA, 15 bp, Homo sapiens
aggagcaaagcctgt

SEQ ID NO: 2851987 - DNA, 18 bp, Homo sapiens
aggagcaaatgtttctgc

SEQ ID NO: 2851988 - DNA, 19 bp, Homo sapiens
aggagcaaatgtttctgca

SEQ ID NO: 2851989 - DNA, 15 bp, Homo sapiens
aggagcaatttgcac

SEQ ID NO: 2851990 - DNA, 13 bp, Homo sapiens
aggagcctgtgaa

SEQ ID NO: 2851991 - DNA, 19 bp, Homo sapiens
aggagcctgtgaacccagg

SEQ ID NO: 2851992 - DNA, 16 bp, Homo sapiens
aggagctacctgtgtg

SEQ ID NO: 2851993 - DNA, 23 bp, Homo sapiens
aggagctacctgtgtggacagga

SEQ ID NO: 2851994 - DNA, 17 bp, Homo sapiens
aggagctgggaggaaaa

SEQ ID NO: 2851995 - DNA, 19 bp, Homo sapiens
aggagcttccagtgcatgt

SEQ ID NO: 2851996 - DNA, 16 bp, Homo sapiens
aggaggagaggaaagg

SEQ ID NO: 2851997 - DNA, 23 bp, Homo sapiens
aggaggattgcttgagcccagga

SEQ ID NO: 2851998 - DNA, 17 bp, Homo sapiens
aggaggctgaggcagaa

SEQ ID NO: 2851999 - DNA, 17 bp, Homo sapiens
aggaggctgaggcagga

SEQ ID NO: 2852000 - DNA, 20 bp, Homo sapiens
aggaggcttggaaagcatca

SEQ ID NO: 2852001 - DNA, 14 bp, Homo sapiens
aggagggacaaagg

SEQ ID NO: 2852002 - DNA, 21 bp, Homo sapiens
aggagggacaaaggagcctgt

SEQ ID NO: 2852003 - DNA, 15 bp, Homo sapiens
aggagggacaagaat

SEQ ID NO: 2852004 - DNA, 19 bp, Homo sapiens
aggagggactgtcgctgct

SEQ ID NO: 2852005 - DNA, 14 bp, Homo sapiens
aggaggtagctccc

SEQ ID NO: 2852006 - DNA, 21 bp, Homo sapiens
aggaggtagctcccagcactc

SEQ ID NO: 2852007 - DNA, 14 bp, Homo sapiens
aggaggtggcagcc

SEQ ID NO: 2852008 - DNA, 18 bp, Homo sapiens
aggaggtggcagccctgt

SEQ ID NO: 2852009 - DNA, 20 bp, Homo sapiens
aggaggtggcagccctgtag

SEQ ID NO: 2852010 - DNA, 21 bp, Homo sapiens
aggaggtggcagccctgtagg

SEQ ID NO: 2852011 - DNA, 13 bp, Homo sapiens
aggagtagctgag

SEQ ID NO: 2852012 - DNA, 16 bp, Homo sapiens
aggagtagctgagctc

SEQ ID NO: 2852013 - DNA, 14 bp, Homo sapiens
aggagtccagggcg

SEQ ID NO: 2852014 - DNA, 17 bp, Homo sapiens
aggagtccagggcggga

SEQ ID NO: 2852015 - DNA, 14 bp, Homo sapiens
aggagtcccaagga

SEQ ID NO: 2852016 - DNA, 16 bp, Homo sapiens
aggagtcccaaggaaa

SEQ ID NO: 2852017 - DNA, 18 bp, Homo sapiens
aggagtctgaggtcctga

SEQ ID NO: 2852018 - DNA, 21 bp, Homo sapiens
aggagtgagatcattttctta

SEQ ID NO: 2852019 - DNA, 19 bp, Homo sapiens
aggagtggccggggaagct

SEQ ID NO: 2852020 - DNA, 20 bp, Homo sapiens
aggagttccttgatctgtat

SEQ ID NO: 2852021 - DNA, 22 bp, Homo sapiens
aggagttcgagaccagcctggc

SEQ ID NO: 2852022 - DNA, 19 bp, Homo sapiens
aggagtttgaggctgcagc

SEQ ID NO: 2852023 - DNA, 17 bp, Homo sapiens
aggagttttttttaacc

SEQ ID NO: 2852024 - DNA, 22 bp, Homo sapiens
aggataccatatacagctcaga

SEQ ID NO: 2852025 - DNA, 16 bp, Homo sapiens
aggatactctgtcaga

SEQ ID NO: 2852026 - DNA, 15 bp, Homo sapiens
aggatcactggagcc

SEQ ID NO: 2852027 - DNA, 16 bp, Homo sapiens
aggatcactggagccc

SEQ ID NO: 2852028 - DNA, 18 bp, Homo sapiens
aggatcactggagcccag

SEQ ID NO: 2852029 - DNA, 19 bp, Homo sapiens
aggatcactggagcccagg

SEQ ID NO: 2852030 - DNA, 13 bp, Homo sapiens
aggatcagtctga

SEQ ID NO: 2852031 - DNA, 21 bp, Homo sapiens
aggatcatttgttggaatgaa

SEQ ID NO: 2852032 - DNA, 13 bp, Homo sapiens
aggatctctcagg

SEQ ID NO: 2852033 - DNA, 22 bp, Homo sapiens
aggatgaatgaggtcccaggca

SEQ ID NO: 2852034 - DNA, 20 bp, Homo sapiens
aggatggacgaacaggggcc

SEQ ID NO: 2852035 - DNA, 18 bp, Homo sapiens
aggatgtaaacagtgcct

SEQ ID NO: 2852036 - DNA, 20 bp, Homo sapiens
aggatgtaaacagtgcctgc

SEQ ID NO: 2852037 - DNA, 22 bp, Homo sapiens
aggatgtaaacagtgcctgctg

SEQ ID NO: 2852038 - DNA, 20 bp, Homo sapiens
aggatgttctgggacacagt

SEQ ID NO: 2852039 - DNA, 22 bp, Homo sapiens
aggatgttttgtcccatttcct

SEQ ID NO: 2852040 - DNA, 23 bp, Homo sapiens
aggatgttttgtcccatttcctt

SEQ ID NO: 2852041 - DNA, 21 bp, Homo sapiens
aggattatgggtcctgcaatt

SEQ ID NO: 2852042 - DNA, 13 bp, Homo sapiens
aggattgaagagc

SEQ ID NO: 2852043 - DNA, 22 bp, Homo sapiens
aggattgaagagcattgcatgg

SEQ ID NO: 2852044 - DNA, 17 bp, Homo sapiens
aggattgctactgtcct

SEQ ID NO: 2852045 - DNA, 17 bp, Homo sapiens
aggattgcttgagccca

SEQ ID NO: 2852046 - DNA, 20 bp, Homo sapiens
aggattgcttgagcccagga

SEQ ID NO: 2852047 - DNA, 22 bp, Homo sapiens
aggattgcttgagcccaggagt

SEQ ID NO: 2852048 - DNA, 16 bp, Homo sapiens
aggatttcaagcctgc

SEQ ID NO: 2852049 - DNA, 20 bp, Homo sapiens
aggatttcatgatttcattt

SEQ ID NO: 2852050 - DNA, 15 bp, Homo sapiens
aggcaaacatttctt

SEQ ID NO: 2852051 - DNA, 18 bp, Homo sapiens
aggcaagcacctcctgcc

SEQ ID NO: 2852052 - DNA, 20 bp, Homo sapiens
aggcaagcacctcctgcctc

SEQ ID NO: 2852053 - DNA, 13 bp, Homo sapiens
aggcaagtgaaga

SEQ ID NO: 2852054 - DNA, 19 bp, Homo sapiens
aggcaatgtcaggaacaga

SEQ ID NO: 2852055 - DNA, 22 bp, Homo sapiens
aggcaatgtcaggaacagaagg

SEQ ID NO: 2852056 - DNA, 12 bp, Homo sapiens
aggcacacttct

SEQ ID NO: 2852057 - DNA, 13 bp, Homo sapiens
aggcacatggagg

SEQ ID NO: 2852058 - DNA, 18 bp, Homo sapiens
aggcaccaaaagaagtaa

SEQ ID NO: 2852059 - DNA, 21 bp, Homo sapiens
aggcacccaccatcatgtctg

SEQ ID NO: 2852060 - DNA, 16 bp, Homo sapiens
aggcaccccctggaga

SEQ ID NO: 2852061 - DNA, 20 bp, Homo sapiens
aggcacccttctttcctctt

SEQ ID NO: 2852062 - DNA, 20 bp, Homo sapiens
aggcacgaacccacctgctg

SEQ ID NO: 2852063 - DNA, 20 bp, Homo sapiens
aggcacgtttggcatttctc

SEQ ID NO: 2852064 - DNA, 14 bp, Homo sapiens
aggcactgctgccc

SEQ ID NO: 2852065 - DNA, 21 bp, Homo sapiens
aggcagaagaattgaacccag

SEQ ID NO: 2852066 - DNA, 23 bp, Homo sapiens
aggcagaagaattgaacccagga

SEQ ID NO: 2852067 - DNA, 14 bp, Homo sapiens
aggcagacagcagc

SEQ ID NO: 2852068 - DNA, 19 bp, Homo sapiens
aggcagacagcagctcagg

SEQ ID NO: 2852069 - DNA, 22 bp, Homo sapiens
aggcagacttccctgaatgtat

SEQ ID NO: 2852070 - DNA, 11 bp, Homo sapiens
aggtctcctct

SEQ ID NO: 2852071 - DNA, 17 bp, Homo sapiens
aggtctcctcttaaaaa

SEQ ID NO: 2852072 - DNA, 16 bp, Homo sapiens
aggtctctccactgct

SEQ ID NO: 2852073 - DNA, 22 bp, Homo sapiens
aggtctctccactgctctcagc

SEQ ID NO: 2852074 - DNA, 13 bp, Homo sapiens
aggtctgaaatgg

SEQ ID NO: 2852075 - DNA, 20 bp, Homo sapiens
aggtctgacacgtctgccta

SEQ ID NO: 2852076 - DNA, 16 bp, Homo sapiens
aggtcttcagccatca

SEQ ID NO: 2852077 - DNA, 22 bp, Homo sapiens
aggtcttgaactcctggcctca

SEQ ID NO: 2852078 - DNA, 23 bp, Homo sapiens
aggtcttgaactcctggcctcaa

SEQ ID NO: 2852079 - DNA, 18 bp, Homo sapiens
aggtctttggttcagcta

SEQ ID NO: 2852080 - DNA, 23 bp, Homo sapiens
aggtgaacaccactttgtctctg

SEQ ID NO: 2852081 - DNA, 19 bp, Homo sapiens
aggtgaccccagggcacag

SEQ ID NO: 2852082 - DNA, 13 bp, Homo sapiens
aggtgagaaattt

SEQ ID NO: 2852083 - DNA, 14 bp, Homo sapiens
aggtgatccaccca

SEQ ID NO: 2852084 - DNA, 23 bp, Homo sapiens
aggtgcatctggggaactagagg

SEQ ID NO: 2852085 - DNA, 14 bp, Homo sapiens
aggtgcctcctgtc

SEQ ID NO: 2852086 - DNA, 17 bp, Homo sapiens
aggtgcctcctgtctta

SEQ ID NO: 2852087 - DNA, 18 bp, Homo sapiens
aggtgcctggtgggccac

SEQ ID NO: 2852088 - DNA, 18 bp, Homo sapiens
aggtgcctgtgaggcagg

SEQ ID NO: 2852089 - DNA, 17 bp, Homo sapiens
aggtgctgccatccagg

SEQ ID NO: 2852090 - DNA, 14 bp, Homo sapiens
aggtggcagccctg

SEQ ID NO: 2852091 - DNA, 17 bp, Homo sapiens
aggtggcaggaccagga

SEQ ID NO: 2852092 - DNA, 19 bp, Homo sapiens
aggtggctctccagttagt

SEQ ID NO: 2852093 - DNA, 20 bp, Homo sapiens
aggtggctgacccagtccct

SEQ ID NO: 2852094 - DNA, 22 bp, Homo sapiens
aggtggctgacccagtccctgg

SEQ ID NO: 2852095 - DNA, 23 bp, Homo sapiens
aggtggctgacccagtccctggg

SEQ ID NO: 2852096 - DNA, 15 bp, Homo sapiens
aggtgggcagcagct

SEQ ID NO: 2852097 - DNA, 15 bp, Homo sapiens
aggtgggctgagccc

SEQ ID NO: 2852098 - DNA, 20 bp, Homo sapiens
aggtgggctgagccctggca

SEQ ID NO: 2852099 - DNA, 13 bp, Homo sapiens
aggtggggcagct

SEQ ID NO: 2852100 - DNA, 14 bp, Homo sapiens
aggtggggcagctt

SEQ ID NO: 2852101 - DNA, 22 bp, Homo sapiens
aggtggggtatttaccacagca

SEQ ID NO: 2852102 - DNA, 23 bp, Homo sapiens
aggtggggtatttaccacagcag

SEQ ID NO: 2852103 - DNA, 23 bp, Homo sapiens
aggtgggttttcttcccatcact

SEQ ID NO: 2852104 - DNA, 18 bp, Homo sapiens
aggtggtatgtgtgtgta

SEQ ID NO: 2852105 - DNA, 19 bp, Homo sapiens
aggtggtcctgagacctga

SEQ ID NO: 2852106 - DNA, 18 bp, Homo sapiens
aggtggtgggggcaggga

SEQ ID NO: 2852107 - DNA, 11 bp, Homo sapiens
aggtgtaaata

SEQ ID NO: 2852108 - DNA, 15 bp, Homo sapiens
aggtgtcatacagat

SEQ ID NO: 2852109 - DNA, 21 bp, Homo sapiens
aggtgtcatacagatttgcaa

SEQ ID NO: 2852110 - DNA, 16 bp, Homo sapiens
aggtgtccctgcactt

SEQ ID NO: 2852111 - DNA, 14 bp, Homo sapiens
aggtgtctgcaccc

SEQ ID NO: 2852112 - DNA, 23 bp, Homo sapiens
aggtgtggctttaggagcagtgg

SEQ ID NO: 2852113 - DNA, 14 bp, Homo sapiens
aggtgttgaaaatg

SEQ ID NO: 2852114 - DNA, 16 bp, Homo sapiens
aggtgttgaaaatgag

SEQ ID NO: 2852115 - DNA, 21 bp, Homo sapiens
aggttaggagttcgagaccag

SEQ ID NO: 2852116 - DNA, 21 bp, Homo sapiens
aggttagtgacaaaattggcc

SEQ ID NO: 2852117 - DNA, 15 bp, Homo sapiens
aggttccagtgagcc

SEQ ID NO: 2852118 - DNA, 16 bp, Homo sapiens
aggttccctctgagaa

SEQ ID NO: 2852119 - DNA, 12 bp, Homo sapiens
aggttcctaaga

SEQ ID NO: 2852120 - DNA, 14 bp, Homo sapiens
aggttgaagcacca

SEQ ID NO: 2852121 - DNA, 21 bp, Homo sapiens
aggttgagaagactcctgggc

SEQ ID NO: 2852122 - DNA, 21 bp, Homo sapiens
aggtttatgaaaaagaagaat

SEQ ID NO: 2852123 - DNA, 15 bp, Homo sapiens
aggtttctgaaaatt

SEQ ID NO: 2852124 - DNA, 23 bp, Homo sapiens
aggtttctgaaaattaacactgc

SEQ ID NO: 2852125 - DNA, 21 bp, Homo sapiens
aggtttggatgggagtgagac

SEQ ID NO: 2852126 - DNA, 10 bp, Homo sapiens
aggttttcag

SEQ ID NO: 2852127 - DNA, 22 bp, Homo sapiens
aggttttcctcttctattttgt

SEQ ID NO: 2852128 - DNA, 13 bp, Homo sapiens
aggttttctccac

SEQ ID NO: 2852129 - DNA, 15 bp, Homo sapiens
aggttttgtaaagat

SEQ ID NO: 2852130 - DNA, 17 bp, Homo sapiens
aggtttttatgtgcctt

SEQ ID NO: 2852131 - DNA, 22 bp, Homo sapiens
aggtttttttgtatagtaaagt

SEQ ID NO: 2852132 - DNA, 16 bp, Homo sapiens
agtaaagtcaaggaga

SEQ ID NO: 2852133 - DNA, 16 bp, Homo sapiens
agtaaagtttaaaaaa

SEQ ID NO: 2852134 - DNA, 11 bp, Homo sapiens
agtaaagtttt

SEQ ID NO: 2852135 - DNA, 19 bp, Homo sapiens
agtaaatcacgctttttga

SEQ ID NO: 2852136 - DNA, 13 bp, Homo sapiens
agtaactactttt

SEQ ID NO: 2852137 - DNA, 19 bp, Homo sapiens
agtaactactttttatact

SEQ ID NO: 2852138 - DNA, 21 bp, Homo sapiens
agtaactactttttatactcc

SEQ ID NO: 2852139 - DNA, 20 bp, Homo sapiens
agtaagtaccactcaggcca

SEQ ID NO: 2852140 - DNA, 23 bp, Homo sapiens
agtaatctgcattattggaatat

SEQ ID NO: 2852141 - DNA, 19 bp, Homo sapiens
agtaatgggccaattaaaa

SEQ ID NO: 2852142 - DNA, 20 bp, Homo sapiens
agtaatgggccaattaaaat

SEQ ID NO: 2852143 - DNA, 23 bp, Homo sapiens
agtaatgggccaattaaaatata

SEQ ID NO: 2852144 - DNA, 22 bp, Homo sapiens
agtaatttattgtttttccttg

SEQ ID NO: 2852145 - DNA, 23 bp, Homo sapiens
agtaatttattgtttttccttgt

SEQ ID NO: 2852146 - DNA, 15 bp, Homo sapiens
agtaatttgaggaca

SEQ ID NO: 2852147 - DNA, 20 bp, Homo sapiens
agtacacagcaccagaatgt

SEQ ID NO: 2852148 - DNA, 21 bp, Homo sapiens
agtacagtagcttaaataaat

SEQ ID NO: 2852149 - DNA, 23 bp, Homo sapiens
agtacagtagcttaaataaattc

SEQ ID NO: 2852150 - DNA, 18 bp, Homo sapiens
agtacgtgctaacaggct

SEQ ID NO: 2852151 - DNA, 17 bp, Homo sapiens
agtactagaatttgtat

SEQ ID NO: 2852152 - DNA, 19 bp, Homo sapiens
agtactcctgcaaaatttt

SEQ ID NO: 2852153 - DNA, 20 bp, Homo sapiens
agtactcctgcaaaatttta

SEQ ID NO: 2852154 - DNA, 15 bp, Homo sapiens
agtactggcatggta

SEQ ID NO: 2852155 - DNA, 16 bp, Homo sapiens
agtactgtgtacagaa

SEQ ID NO: 2852156 - DNA, 21 bp, Homo sapiens
agtacttctccaccctgctct

SEQ ID NO: 2852157 - DNA, 12 bp, Homo sapiens
agtacttctttt

SEQ ID NO: 2852158 - DNA, 20 bp, Homo sapiens
agtagaaagacagagctggg

SEQ ID NO: 2852159 - DNA, 21 bp, Homo sapiens
agtagaaagacagagctggga

SEQ ID NO: 2852160 - DNA, 22 bp, Homo sapiens
agtttgagaccagcctggccaa

SEQ ID NO: 2852161 - DNA, 19 bp, Homo sapiens
agtttgcaaatgcaacaaa

SEQ ID NO: 2852162 - DNA, 20 bp, Homo sapiens
agtttgcactgtatgctgga

SEQ ID NO: 2852163 - DNA, 13 bp, Homo sapiens
agtttgcagaaaa

SEQ ID NO: 2852164 - DNA, 16 bp, Homo sapiens
agtttggatatgtaaa

SEQ ID NO: 2852165 - DNA, 17 bp, Homo sapiens
agtttggatatgtaaaa

SEQ ID NO: 2852166 - DNA, 20 bp, Homo sapiens
agtttggatatgtaaaacat

SEQ ID NO: 2852167 - DNA, 18 bp, Homo sapiens
agtttgggccactgcact

SEQ ID NO: 2852168 - DNA, 20 bp, Homo sapiens
agtttgggggttttgctgtt

SEQ ID NO: 2852169 - DNA, 22 bp, Homo sapiens
agtttgtacagacgtatgctta

SEQ ID NO: 2852170 - DNA, 14 bp, Homo sapiens
agtttgtcagactt

SEQ ID NO: 2852171 - DNA, 11 bp, Homo sapiens
agttttaaata

SEQ ID NO: 2852172 - DNA, 12 bp, Homo sapiens
agttttaaatat

SEQ ID NO: 2852173 - DNA, 15 bp, Homo sapiens
agttttagttgcaga

SEQ ID NO: 2852174 - DNA, 14 bp, Homo sapiens
agttttataaaact

SEQ ID NO: 2852175 - DNA, 15 bp, Homo sapiens
agttttatcattttc

SEQ ID NO: 2852176 - DNA, 22 bp, Homo sapiens
agttttcactcttattgcccac

SEQ ID NO: 2852177 - DNA, 17 bp, Homo sapiens
agtttttacctaccaca

SEQ ID NO: 2852178 - DNA, 16 bp, Homo sapiens
agtttttactttctgt

SEQ ID NO: 2852179 - DNA, 17 bp, Homo sapiens
agtttttatggggctga

SEQ ID NO: 2852180 - DNA, 12 bp, Homo sapiens
ataaaaaaatac

SEQ ID NO: 2852181 - DNA, 13 bp, Homo sapiens
ataaaaaaataca

SEQ ID NO: 2852182 - DNA, 14 bp, Homo sapiens
ataaaaaaatacag

SEQ ID NO: 2852183 - DNA, 16 bp, Homo sapiens
ataaaaaacatttgta

SEQ ID NO: 2852184 - DNA, 12 bp, Homo sapiens
ataaaaaccaga

SEQ ID NO: 2852185 - DNA, 13 bp, Homo sapiens
ataaaaaccagaa

SEQ ID NO: 2852186 - DNA, 13 bp, Homo sapiens
ataaaaataaatt

SEQ ID NO: 2852187 - DNA, 22 bp, Homo sapiens
ataaaaataaatttggttctaa

SEQ ID NO: 2852188 - DNA, 17 bp, Homo sapiens
ataaaaatgatctaaac

SEQ ID NO: 2852189 - DNA, 14 bp, Homo sapiens
ataaaacctttcaa

SEQ ID NO: 2852190 - DNA, 21 bp, Homo sapiens
ataaaacctttcaaatttcac

SEQ ID NO: 2852191 - DNA, 18 bp, Homo sapiens
ataaaagcataaatgcaa

SEQ ID NO: 2852192 - DNA, 12 bp, Homo sapiens
ataaaatagtat

SEQ ID NO: 2852193 - DNA, 13 bp, Homo sapiens
ataaaatagtatt

SEQ ID NO: 2852194 - DNA, 19 bp, Homo sapiens
ataaaatatacaaacatgt

SEQ ID NO: 2852195 - DNA, 20 bp, Homo sapiens
ataaaatcatgtacatttct

SEQ ID NO: 2852196 - DNA, 13 bp, Homo sapiens
ataaaattatgcc

SEQ ID NO: 2852197 - DNA, 19 bp, Homo sapiens
ataaacaacttaatgttct

SEQ ID NO: 2852198 - DNA, 21 bp, Homo sapiens
ataaacatccttcaagaactc

SEQ ID NO: 2852199 - DNA, 20 bp, Homo sapiens
ataaacattaaaagaagact

SEQ ID NO: 2852200 - DNA, 14 bp, Homo sapiens
ataaactagatctc

SEQ ID NO: 2852201 - DNA, 23 bp, Homo sapiens
ataaactggggagttataaaaat

SEQ ID NO: 2852202 - DNA, 12 bp, Homo sapiens
ataaactgtgtg

SEQ ID NO: 2852203 - DNA, 23 bp, Homo sapiens
ataaacttagtgcggacaagttt

SEQ ID NO: 2852204 - DNA, 13 bp, Homo sapiens
ataaacttcagca

SEQ ID NO: 2852205 - DNA, 13 bp, Homo sapiens
ataaacttgtgta

SEQ ID NO: 2852206 - DNA, 12 bp, Homo sapiens
ataaagaaaaac

SEQ ID NO: 2852207 - DNA, 16 bp, Homo sapiens
ataaagacttcatgtt

SEQ ID NO: 2852208 - DNA, 11 bp, Homo sapiens
ataaagagctc

SEQ ID NO: 2852209 - DNA, 23 bp, Homo sapiens
ataaagatgtcaaatatctcaga

SEQ ID NO: 2852210 - DNA, 21 bp, Homo sapiens
ataaagattttttaataattt

SEQ ID NO: 2852211 - DNA, 21 bp, Homo sapiens
ataaagctggacaagaagctg

SEQ ID NO: 2852212 - DNA, 22 bp, Homo sapiens
ataaagctggacaagaagctgc

SEQ ID NO: 2852213 - DNA, 23 bp, Homo sapiens
ataaagctggacaagaagctgct

SEQ ID NO: 2852214 - DNA, 19 bp, Homo sapiens
ataaaggccccaaatacca

SEQ ID NO: 2852215 - DNA, 21 bp, Homo sapiens
ataaaggtggtatgtgtgtgt

SEQ ID NO: 2852216 - DNA, 19 bp, Homo sapiens
ataaagtcaggacctggct

SEQ ID NO: 2852217 - DNA, 15 bp, Homo sapiens
ataaagttagtgtgt

SEQ ID NO: 2852218 - DNA, 22 bp, Homo sapiens
ataaagttgaagctaagattta

SEQ ID NO: 2852219 - DNA, 16 bp, Homo sapiens
ataaagttgataaaga

SEQ ID NO: 2852220 - DNA, 16 bp, Homo sapiens
ataaagttggtgacag

SEQ ID NO: 2852221 - DNA, 17 bp, Homo sapiens
ataaagttggtgacaga

SEQ ID NO: 2852222 - DNA, 18 bp, Homo sapiens
ataaataaaaatattctc

SEQ ID NO: 2852223 - DNA, 16 bp, Homo sapiens
ataaataaatgcaata

SEQ ID NO: 2852224 - DNA, 14 bp, Homo sapiens
ataaataaatgcca

SEQ ID NO: 2852225 - DNA, 12 bp, Homo sapiens
ataaataaatgt

SEQ ID NO: 2852226 - DNA, 15 bp, Homo sapiens
ataaatataattggg

SEQ ID NO: 2852227 - DNA, 20 bp, Homo sapiens
ataaatatatatttttcaac

SEQ ID NO: 2852228 - DNA, 21 bp, Homo sapiens
ataaatctgagcctaaatcta

SEQ ID NO: 2852229 - DNA, 18 bp, Homo sapiens
ataaatgcaatatgtatt

SEQ ID NO: 2852230 - DNA, 13 bp, Homo sapiens
ataaatgcatgat

SEQ ID NO: 2852231 - DNA, 14 bp, Homo sapiens
ataaatgcatgatt

SEQ ID NO: 2852232 - DNA, 17 bp, Homo sapiens
ataaatgccctctctga

SEQ ID NO: 2852233 - DNA, 17 bp, Homo sapiens
ataaatgtcattaaaat

SEQ ID NO: 2852234 - DNA, 21 bp, Homo sapiens
ataaatgtcattaaaataaat

SEQ ID NO: 2852235 - DNA, 11 bp, Homo sapiens
ataaatgtgtg

SEQ ID NO: 2852236 - DNA, 12 bp, Homo sapiens
ataaatgtgtgg

SEQ ID NO: 2852237 - DNA, 13 bp, Homo sapiens
ataaattcaaacc

SEQ ID NO: 2852238 - DNA, 14 bp, Homo sapiens
ataaattcaaacca

SEQ ID NO: 2852239 - DNA, 15 bp, Homo sapiens
ataaattcaaaccat

SEQ ID NO: 2852240 - DNA, 17 bp, Homo sapiens
ataaattcaaaccattt

SEQ ID NO: 2852241 - DNA, 13 bp, Homo sapiens
ataaattcagata

SEQ ID NO: 2852242 - DNA, 22 bp, Homo sapiens
ataaattcagatatatttttca

SEQ ID NO: 2852243 - DNA, 13 bp, Homo sapiens
ataaattgctcct

SEQ ID NO: 2852244 - DNA, 13 bp, Homo sapiens
ataacaaaatcac

SEQ ID NO: 2852245 - DNA, 21 bp, Homo sapiens
ataacaaaatcacaagcaata

SEQ ID NO: 2852246 - DNA, 14 bp, Homo sapiens
ataacaagatcttt

SEQ ID NO: 2852247 - DNA, 17 bp, Homo sapiens
ataacaagatctttcag

SEQ ID NO: 2852248 - DNA, 19 bp, Homo sapiens
ataacaagatctttcagga

SEQ ID NO: 2852249 - DNA, 22 bp, Homo sapiens
ataacaaggttcttctaaaatt

SEQ ID NO: 2852250 - DNA, 17 bp, Homo sapiens
ataacaatgtatgtgaa

SEQ ID NO: 2852251 - DNA, 20 bp, Homo sapiens
atattaaatacagacactaa

SEQ ID NO: 2852252 - DNA, 14 bp, Homo sapiens
atattaatcccagc

SEQ ID NO: 2852253 - DNA, 19 bp, Homo sapiens
atattaccaaaaaagtatt

SEQ ID NO: 2852254 - DNA, 17 bp, Homo sapiens
atattagagtgccctta

SEQ ID NO: 2852255 - DNA, 15 bp, Homo sapiens
atattagcatttagt

SEQ ID NO: 2852256 - DNA, 22 bp, Homo sapiens
atattagtttgatttaatatct

SEQ ID NO: 2852257 - DNA, 18 bp, Homo sapiens
atattataaataaatgcc

SEQ ID NO: 2852258 - DNA, 20 bp, Homo sapiens
atattataataatgttctct

SEQ ID NO: 2852259 - DNA, 16 bp, Homo sapiens
atattatggtgtaatg

SEQ ID NO: 2852260 - DNA, 23 bp, Homo sapiens
atattatggtgtaatgcacaatt

SEQ ID NO: 2852261 - DNA, 22 bp, Homo sapiens
atattatgtagtccgttaacac

SEQ ID NO: 2852262 - DNA, 23 bp, Homo sapiens
atattatttgctaattaaaaagt

SEQ ID NO: 2852263 - DNA, 23 bp, Homo sapiens
atattcagtgctgtggcctgggc

SEQ ID NO: 2852264 - DNA, 15 bp, Homo sapiens
atattcattgtataa

SEQ ID NO: 2852265 - DNA, 20 bp, Homo sapiens
atattccaccattcacattt

SEQ ID NO: 2852266 - DNA, 22 bp, Homo sapiens
atattcctattgtgcaatgtaa

SEQ ID NO: 2852267 - DNA, 17 bp, Homo sapiens
atattcctgaatgaaat

SEQ ID NO: 2852268 - DNA, 21 bp, Homo sapiens
atattctagtgtaacactgca

SEQ ID NO: 2852269 - DNA, 14 bp, Homo sapiens
atattgaaaagata

SEQ ID NO: 2852270 - DNA, 12 bp, Homo sapiens
atattgtatgta

SEQ ID NO: 2852271 - DNA, 13 bp, Homo sapiens
atattgtatgtaa

SEQ ID NO: 2852272 - DNA, 15 bp, Homo sapiens
atattgtcagatatt

SEQ ID NO: 2852273 - DNA, 19 bp, Homo sapiens
atattgtgggtgttaattt

SEQ ID NO: 2852274 - DNA, 21 bp, Homo sapiens
atattgtgggtgttaattttt

SEQ ID NO: 2852275 - DNA, 19 bp, Homo sapiens
atatttaactctctttatg

SEQ ID NO: 2852276 - DNA, 16 bp, Homo sapiens
atatttacatatgaaa

SEQ ID NO: 2852277 - DNA, 20 bp, Homo sapiens
atatttacatatgaaattta

SEQ ID NO: 2852278 - DNA, 11 bp, Homo sapiens
atatttataac

SEQ ID NO: 2852279 - DNA, 20 bp, Homo sapiens
atatttatactctagaacat

SEQ ID NO: 2852280 - DNA, 15 bp, Homo sapiens
atatttatatatatt

SEQ ID NO: 2852281 - DNA, 16 bp, Homo sapiens
atatttattacctctg

SEQ ID NO: 2852282 - DNA, 23 bp, Homo sapiens
atatttattattttcacctgttt

SEQ ID NO: 2852283 - DNA, 22 bp, Homo sapiens
atatttattgtttatttatcag

SEQ ID NO: 2852284 - DNA, 15 bp, Homo sapiens
atatttccatttctt

SEQ ID NO: 2852285 - DNA, 17 bp, Homo sapiens
atatttctcgtatttaa

SEQ ID NO: 2852286 - DNA, 14 bp, Homo sapiens
atatttgcttattt

SEQ ID NO: 2852287 - DNA, 20 bp, Homo sapiens
atatttgcttatttatattc

SEQ ID NO: 2852288 - DNA, 16 bp, Homo sapiens
atatttggaaagagac

SEQ ID NO: 2852289 - DNA, 12 bp, Homo sapiens
atatttgtacat

SEQ ID NO: 2852290 - DNA, 15 bp, Homo sapiens
atattttaaagaatt

SEQ ID NO: 2852291 - DNA, 16 bp, Homo sapiens
atattttaaagaattg

SEQ ID NO: 2852292 - DNA, 13 bp, Homo sapiens
atattttatgatt

SEQ ID NO: 2852293 - DNA, 16 bp, Homo sapiens
atattttccatgaaaa

SEQ ID NO: 2852294 - DNA, 18 bp, Homo sapiens
atattttccatgaaaatg

SEQ ID NO: 2852295 - DNA, 15 bp, Homo sapiens
atatttttaattaaa

SEQ ID NO: 2852296 - DNA, 15 bp, Homo sapiens
atatttttcaaccag

SEQ ID NO: 2852297 - DNA, 21 bp, Homo sapiens
atatttttcaaccagcatttt

SEQ ID NO: 2852298 - DNA, 18 bp, Homo sapiens
atcaaaacatatcaattc

SEQ ID NO: 2852299 - DNA, 19 bp, Homo sapiens
atcaaaacatatcaattca

SEQ ID NO: 2852300 - DNA, 15 bp, Homo sapiens
atcaaaagctgcttg

SEQ ID NO: 2852301 - DNA, 21 bp, Homo sapiens
atcaaaatcactatctttctg

SEQ ID NO: 2852302 - DNA, 22 bp, Homo sapiens
atcaaaatcactatctttctga

SEQ ID NO: 2852303 - DNA, 14 bp, Homo sapiens
atcaaactgaagcc

SEQ ID NO: 2852304 - DNA, 22 bp, Homo sapiens
atcaaagttcctgttcacctta

SEQ ID NO: 2852305 - DNA, 19 bp, Homo sapiens
atcaaccccttcgctcctg

SEQ ID NO: 2852306 - DNA, 15 bp, Homo sapiens
atcaactccagctcc

SEQ ID NO: 2852307 - DNA, 21 bp, Homo sapiens
atcaacttaccaggcaccaaa

SEQ ID NO: 2852308 - DNA, 13 bp, Homo sapiens
atcaagagactga

SEQ ID NO: 2852309 - DNA, 13 bp, Homo sapiens
atcaagcccttta

SEQ ID NO: 2852310 - DNA, 16 bp, Homo sapiens
atcaagctagaaggcc

SEQ ID NO: 2852311 - DNA, 17 bp, Homo sapiens
atcaagctagaaggcca

SEQ ID NO: 2852312 - DNA, 12 bp, Homo sapiens
atcaataaaaat

SEQ ID NO: 2852313 - DNA, 22 bp, Homo sapiens
atcaatgttcacgcaacttgaa

SEQ ID NO: 2852314 - DNA, 17 bp, Homo sapiens
atcaattaattcttaat

SEQ ID NO: 2852315 - DNA, 23 bp, Homo sapiens
atcaattcaacacattacttgca

SEQ ID NO: 2852316 - DNA, 24 bp, Homo sapiens
atcaattcaacacattacttgcac

SEQ ID NO: 2852317 - DNA, 23 bp, Homo sapiens
atcaatttaaaatcattcaatat

SEQ ID NO: 2852318 - DNA, 15 bp, Homo sapiens
atcaattttcacttg

SEQ ID NO: 2852319 - DNA, 15 bp, Homo sapiens
atcaatttttataca

SEQ ID NO: 2852320 - DNA, 18 bp, Homo sapiens
atcaatttttatacatat

SEQ ID NO: 2852321 - DNA, 21 bp, Homo sapiens
atcaatttttatacatatcag

SEQ ID NO: 2852322 - DNA, 16 bp, Homo sapiens
atcacaacaagaaatt

SEQ ID NO: 2852323 - DNA, 15 bp, Homo sapiens
atcacaagcaataat

SEQ ID NO: 2852324 - DNA, 16 bp, Homo sapiens
atcacaagcaataatt

SEQ ID NO: 2852325 - DNA, 15 bp, Homo sapiens
atcacagaggcttct

SEQ ID NO: 2852326 - DNA, 21 bp, Homo sapiens
atcacagatgggtattaaact

SEQ ID NO: 2852327 - DNA, 12 bp, Homo sapiens
atcacagggcag

SEQ ID NO: 2852328 - DNA, 20 bp, Homo sapiens
atcacagggcagagccggga

SEQ ID NO: 2852329 - DNA, 16 bp, Homo sapiens
atcacagggccccaga

SEQ ID NO: 2852330 - DNA, 14 bp, Homo sapiens
atcacatacaattt

SEQ ID NO: 2852331 - DNA, 17 bp, Homo sapiens
atcacatacaatttgca

SEQ ID NO: 2852332 - DNA, 22 bp, Homo sapiens
atcacattatttgcatgttacc

SEQ ID NO: 2852333 - DNA, 13 bp, Homo sapiens
atcacgccactgc

SEQ ID NO: 2852334 - DNA, 15 bp, Homo sapiens
atcacgccactgcac

SEQ ID NO: 2852335 - DNA, 19 bp, Homo sapiens
atcactataaccatcagtt

SEQ ID NO: 2852336 - DNA, 12 bp, Homo sapiens
atcactggagcc

SEQ ID NO: 2852337 - DNA, 14 bp, Homo sapiens
atcactggagccca

SEQ ID NO: 2852338 - DNA, 17 bp, Homo sapiens
atcactggagcccagga

SEQ ID NO: 2852339 - DNA, 23 bp, Homo sapiens
atcactggcaatgaaaaattctc

SEQ ID NO: 2852340 - DNA, 13 bp, Homo sapiens
atcacttgaaccc

SEQ ID NO: 2852341 - DNA, 21 bp, Homo sapiens
atcacttgtacaaaataaaca

SEQ ID NO: 2852342 - DNA, 17 bp, Homo sapiens
atcctggccaacatggt

SEQ ID NO: 2852343 - DNA, 17 bp, Homo sapiens
atcctgtatattatggt

SEQ ID NO: 2852344 - DNA, 21 bp, Homo sapiens
atcctgtatattatggtgtaa

SEQ ID NO: 2852345 - DNA, 19 bp, Homo sapiens
atcctgtcgattagactgg

SEQ ID NO: 2852346 - DNA, 23 bp, Homo sapiens
atcctgtctttaaggaaaaaaag

SEQ ID NO: 2852347 - DNA, 20 bp, Homo sapiens
atccttcaagaactctgggc

SEQ ID NO: 2852348 - DNA, 20 bp, Homo sapiens
atccttcttatgtttgcttt

SEQ ID NO: 2852349 - DNA, 14 bp, Homo sapiens
atcctttgccccaa

SEQ ID NO: 2852350 - DNA, 15 bp, Homo sapiens
atccttttctgcaga

SEQ ID NO: 2852351 - DNA, 18 bp, Homo sapiens
atcctttttctttataaa

SEQ ID NO: 2852352 - DNA, 13 bp, Homo sapiens
atcgaatgaaatt

SEQ ID NO: 2852353 - DNA, 14 bp, Homo sapiens
atcgacctcactgt

SEQ ID NO: 2852354 - DNA, 15 bp, Homo sapiens
atcgacctcactgtc

SEQ ID NO: 2852355 - DNA, 18 bp, Homo sapiens
atcgattcaaactgctcc

SEQ ID NO: 2852356 - DNA, 18 bp, Homo sapiens
atcggaagcagtgccttc

SEQ ID NO: 2852357 - DNA, 15 bp, Homo sapiens
atcggagcctcctct

SEQ ID NO: 2852358 - DNA, 16 bp, Homo sapiens
atcggagcctcctctc

SEQ ID NO: 2852359 - DNA, 20 bp, Homo sapiens
atcggcccacagctcccacc

SEQ ID NO: 2852360 - DNA, 23 bp, Homo sapiens
atcggcccacagctcccacccca

SEQ ID NO: 2852361 - DNA, 17 bp, Homo sapiens
atcgggaacagtgtttc

SEQ ID NO: 2852362 - DNA, 14 bp, Homo sapiens
atcgtgacaacact

SEQ ID NO: 2852363 - DNA, 15 bp, Homo sapiens
atcgtgacaacactt

SEQ ID NO: 2852364 - DNA, 17 bp, Homo sapiens
atcgtgctaaattttca

SEQ ID NO: 2852365 - DNA, 23 bp, Homo sapiens
atcgttcctatacatttctgttc

SEQ ID NO: 2852366 - DNA, 21 bp, Homo sapiens
atctaaaagaatttaaattct

SEQ ID NO: 2852367 - DNA, 17 bp, Homo sapiens
atctaagcctttccata

SEQ ID NO: 2852368 - DNA, 18 bp, Homo sapiens
atctaagcctttccataa

SEQ ID NO: 2852369 - DNA, 14 bp, Homo sapiens
atctaagctgcagc

SEQ ID NO: 2852370 - DNA, 19 bp, Homo sapiens
atctaatacctctgtgtgc

SEQ ID NO: 2852371 - DNA, 18 bp, Homo sapiens
atctaatatgtaacaagc

SEQ ID NO: 2852372 - DNA, 23 bp, Homo sapiens
atctaatatgtaacaagccaccc

SEQ ID NO: 2852373 - DNA, 22 bp, Homo sapiens
atctaatgtaagaaaatttgaa

SEQ ID NO: 2852374 - DNA, 14 bp, Homo sapiens
atctaatttataca

SEQ ID NO: 2852375 - DNA, 15 bp, Homo sapiens
atctaatttatacaa

SEQ ID NO: 2852376 - DNA, 15 bp, Homo sapiens
atctacacagcctgg

SEQ ID NO: 2852377 - DNA, 21 bp, Homo sapiens
atctagaacacaggcaaaatc

SEQ ID NO: 2852378 - DNA, 17 bp, Homo sapiens
atctagaggcttccttc

SEQ ID NO: 2852379 - DNA, 22 bp, Homo sapiens
atctagatcaattaattcttaa

SEQ ID NO: 2852380 - DNA, 18 bp, Homo sapiens
atctatagtagtcaatta

SEQ ID NO: 2852381 - DNA, 21 bp, Homo sapiens
atctatagtagtcaattagta

SEQ ID NO: 2852382 - DNA, 22 bp, Homo sapiens
atctatcaatagtcaagaaaaa

SEQ ID NO: 2852383 - DNA, 17 bp, Homo sapiens
atctatctatataatgt

SEQ ID NO: 2852384 - DNA, 16 bp, Homo sapiens
atctatctatttgagg

SEQ ID NO: 2852385 - DNA, 18 bp, Homo sapiens
atctatcttatatagttt

SEQ ID NO: 2852386 - DNA, 14 bp, Homo sapiens
atctatgcaatttt

SEQ ID NO: 2852387 - DNA, 19 bp, Homo sapiens
atctatgcaatttttaaac

SEQ ID NO: 2852388 - DNA, 21 bp, Homo sapiens
atctatgcaatttttaaacta

SEQ ID NO: 2852389 - DNA, 16 bp, Homo sapiens
atctatgcattttctg

SEQ ID NO: 2852390 - DNA, 18 bp, Homo sapiens
atctatgcattttctgga

SEQ ID NO: 2852391 - DNA, 22 bp, Homo sapiens
atctattcagacaagcaacagg

SEQ ID NO: 2852392 - DNA, 12 bp, Homo sapiens
atctatttgagg

SEQ ID NO: 2852393 - DNA, 19 bp, Homo sapiens
atctcaaattctcaaccta

SEQ ID NO: 2852394 - DNA, 14 bp, Homo sapiens
atctcagagacagg

SEQ ID NO: 2852395 - DNA, 18 bp, Homo sapiens
atctcagggtccagaccc

SEQ ID NO: 2852396 - DNA, 17 bp, Homo sapiens
atctcagtgaagaatac

SEQ ID NO: 2852397 - DNA, 16 bp, Homo sapiens
atctcatcaacaaaga

SEQ ID NO: 2852398 - DNA, 19 bp, Homo sapiens
atctcatctcagtgaagaa

SEQ ID NO: 2852399 - DNA, 16 bp, Homo sapiens
atctcatttaagggaa

SEQ ID NO: 2852400 - DNA, 17 bp, Homo sapiens
atctcatttaagggaaa

SEQ ID NO: 2852401 - DNA, 18 bp, Homo sapiens
atctcatttaagggaaaa

SEQ ID NO: 2852402 - DNA, 23 bp, Homo sapiens
atctcatttaagggaaaaatata

SEQ ID NO: 2852403 - DNA, 23 bp, Homo sapiens
atctcatttttccgtaaaaatga

SEQ ID NO: 2852404 - DNA, 18 bp, Homo sapiens
atctccagggctgcccct

SEQ ID NO: 2852405 - DNA, 14 bp, Homo sapiens
atctccccactcta

SEQ ID NO: 2852406 - DNA, 23 bp, Homo sapiens
atctcccccatcccccactgcca

SEQ ID NO: 2852407 - DNA, 13 bp, Homo sapiens
atctcccctcctc

SEQ ID NO: 2852408 - DNA, 12 bp, Homo sapiens
atctccctgccg

SEQ ID NO: 2852409 - DNA, 19 bp, Homo sapiens
atctccctgccgcctcaat

SEQ ID NO: 2852410 - DNA, 19 bp, Homo sapiens
atctcctgtaattttgtag

SEQ ID NO: 2852411 - DNA, 18 bp, Homo sapiens
atctctactaaaaataca

SEQ ID NO: 2852412 - DNA, 18 bp, Homo sapiens
atctctcaggagcacagg

SEQ ID NO: 2852413 - DNA, 11 bp, Homo sapiens
atctctcttcc

SEQ ID NO: 2852414 - DNA, 17 bp, Homo sapiens
atctctctttaatataa

SEQ ID NO: 2852415 - DNA, 21 bp, Homo sapiens
atctctgtgactcgcttagct

SEQ ID NO: 2852416 - DNA, 17 bp, Homo sapiens
atctctgtgtgcacaaa

SEQ ID NO: 2852417 - DNA, 22 bp, Homo sapiens
atctcttcctacccaaccactc

SEQ ID NO: 2852418 - DNA, 22 bp, Homo sapiens
atctcttttgaatccatgcttg

SEQ ID NO: 2852419 - DNA, 13 bp, Homo sapiens
atctgaagctatt

SEQ ID NO: 2852420 - DNA, 17 bp, Homo sapiens
atctgaagctattgatg

SEQ ID NO: 2852421 - DNA, 17 bp, Homo sapiens
atctgaatataggaagc

SEQ ID NO: 2852422 - DNA, 12 bp, Homo sapiens
atctgaattttt

SEQ ID NO: 2852423 - DNA, 14 bp, Homo sapiens
atctgaatttttaa

SEQ ID NO: 2852424 - DNA, 22 bp, Homo sapiens
atctgagaaaagctttgaaccc

SEQ ID NO: 2852425 - DNA, 18 bp, Homo sapiens
atctgagaagtgtatata

SEQ ID NO: 2852426 - DNA, 21 bp, Homo sapiens
atctgagcctaaatctaatca

SEQ ID NO: 2852427 - DNA, 17 bp, Homo sapiens
atctgattgtgatgtga

SEQ ID NO: 2852428 - DNA, 19 bp, Homo sapiens
atctgcatttataaatgtg

SEQ ID NO: 2852429 - DNA, 15 bp, Homo sapiens
atctggactcctctg

SEQ ID NO: 2852430 - DNA, 18 bp, Homo sapiens
atctggactcctctgtcc

SEQ ID NO: 2852431 - DNA, 14 bp, Homo sapiens
atctgggactttca

SEQ ID NO: 2852432 - DNA, 17 bp, Homo sapiens
atgggggcactgaggac

SEQ ID NO: 2852433 - DNA, 14 bp, Homo sapiens
atggggtgggcagg

SEQ ID NO: 2852434 - DNA, 18 bp, Homo sapiens
atggggtgggcagggctg

SEQ ID NO: 2852435 - DNA, 20 bp, Homo sapiens
atggggtgggcagggctggg

SEQ ID NO: 2852436 - DNA, 15 bp, Homo sapiens
atgggtattaaactt

SEQ ID NO: 2852437 - DNA, 13 bp, Homo sapiens
atgggtcctgcaa

SEQ ID NO: 2852438 - DNA, 19 bp, Homo sapiens
atgggtctggctgagctga

SEQ ID NO: 2852439 - DNA, 23 bp, Homo sapiens
atggtattttcgtgcatttgtga

SEQ ID NO: 2852440 - DNA, 20 bp, Homo sapiens
atggtcaacacttaagggtt

SEQ ID NO: 2852441 - DNA, 17 bp, Homo sapiens
atggtcagttgaggaat

SEQ ID NO: 2852442 - DNA, 16 bp, Homo sapiens
atggtgccttcatttg

SEQ ID NO: 2852443 - DNA, 13 bp, Homo sapiens
atggtggctgggt

SEQ ID NO: 2852444 - DNA, 13 bp, Homo sapiens
atggtgtaatgca

SEQ ID NO: 2852445 - DNA, 18 bp, Homo sapiens
atggtgtgaaagtcagat

SEQ ID NO: 2852446 - DNA, 20 bp, Homo sapiens
atggtgttgccctgagtgga

SEQ ID NO: 2852447 - DNA, 18 bp, Homo sapiens
atggttccatgcctgagg

SEQ ID NO: 2852448 - DNA, 23 bp, Homo sapiens
atggttgccaggacgaattgaga

SEQ ID NO: 2852449 - DNA, 15 bp, Homo sapiens
atggtttactgctgt

SEQ ID NO: 2852450 - DNA, 16 bp, Homo sapiens
atggtttactgctgtc

SEQ ID NO: 2852451 - DNA, 20 bp, Homo sapiens
atggttttctccaagagcta

SEQ ID NO: 2852452 - DNA, 21 bp, Homo sapiens
atggttttctccaagagctac

SEQ ID NO: 2852453 - DNA, 15 bp, Homo sapiens
atgtaaaacatttat

SEQ ID NO: 2852454 - DNA, 20 bp, Homo sapiens
atgtaaaacatttattttga

SEQ ID NO: 2852455 - DNA, 21 bp, Homo sapiens
atgtaaaagagtcatctggta

SEQ ID NO: 2852456 - DNA, 15 bp, Homo sapiens
atgtaaaataagtat

SEQ ID NO: 2852457 - DNA, 12 bp, Homo sapiens
atgtaaaatgca

SEQ ID NO: 2852458 - DNA, 17 bp, Homo sapiens
atgtaaacagtgcctgc

SEQ ID NO: 2852459 - DNA, 22 bp, Homo sapiens
atgtaaacagtgcctgctgaat

SEQ ID NO: 2852460 - DNA, 23 bp, Homo sapiens
atgtaaacataattcttgtatat

SEQ ID NO: 2852461 - DNA, 14 bp, Homo sapiens
atgtaaagcttgtc

SEQ ID NO: 2852462 - DNA, 16 bp, Homo sapiens
atgtaaagcttgtctg

SEQ ID NO: 2852463 - DNA, 13 bp, Homo sapiens
atgtaaatatttt

SEQ ID NO: 2852464 - DNA, 19 bp, Homo sapiens
atgtaaatattttaaagaa

SEQ ID NO: 2852465 - DNA, 13 bp, Homo sapiens
atgtaacattaat

SEQ ID NO: 2852466 - DNA, 15 bp, Homo sapiens
atgtaattgaataaa

SEQ ID NO: 2852467 - DNA, 18 bp, Homo sapiens
atgtacactggatatgtt

SEQ ID NO: 2852468 - DNA, 14 bp, Homo sapiens
atgtacattaatta

SEQ ID NO: 2852469 - DNA, 16 bp, Homo sapiens
atgtacccaccgggcc

SEQ ID NO: 2852470 - DNA, 20 bp, Homo sapiens
atgtacccaccgggccactc

SEQ ID NO: 2852471 - DNA, 18 bp, Homo sapiens
atgtactgagccttgtaa

SEQ ID NO: 2852472 - DNA, 15 bp, Homo sapiens
atgtagctggtttcc

SEQ ID NO: 2852473 - DNA, 17 bp, Homo sapiens
atgtagtatgatgtaat

SEQ ID NO: 2852474 - DNA, 19 bp, Homo sapiens
atgtagtccgttaacacta

SEQ ID NO: 2852475 - DNA, 17 bp, Homo sapiens
atgtatatatatatagt

SEQ ID NO: 2852476 - DNA, 20 bp, Homo sapiens
atgtatatctatatctctaa

SEQ ID NO: 2852477 - DNA, 16 bp, Homo sapiens
atgtatatgtatatat

SEQ ID NO: 2852478 - DNA, 18 bp, Homo sapiens
atgtatatgtatatctat

SEQ ID NO: 2852479 - DNA, 13 bp, Homo sapiens
atgtatcttattt

SEQ ID NO: 2852480 - DNA, 17 bp, Homo sapiens
atgtatcttatttatat

SEQ ID NO: 2852481 - DNA, 22 bp, Homo sapiens
atgtatcttatttatatatgaa

SEQ ID NO: 2852482 - DNA, 21 bp, Homo sapiens
atgtatggaatacagtgttat

SEQ ID NO: 2852483 - DNA, 17 bp, Homo sapiens
atgtatgtgaaagtgta

SEQ ID NO: 2852484 - DNA, 16 bp, Homo sapiens
atgtattaatattcat

SEQ ID NO: 2852485 - DNA, 14 bp, Homo sapiens
atgtatttatattt

SEQ ID NO: 2852486 - DNA, 12 bp, Homo sapiens
atgtcaaaatca

SEQ ID NO: 2852487 - DNA, 13 bp, Homo sapiens
atgtcaaaatcat

SEQ ID NO: 2852488 - DNA, 17 bp, Homo sapiens
atgtcaaatatctcaga

SEQ ID NO: 2852489 - DNA, 19 bp, Homo sapiens
atgtcaaatatctcagagg

SEQ ID NO: 2852490 - DNA, 20 bp, Homo sapiens
atgtcacaatcctgtccctc

SEQ ID NO: 2852491 - DNA, 19 bp, Homo sapiens
atgtcacaggcaggtccag

SEQ ID NO: 2852492 - DNA, 15 bp, Homo sapiens
atgtcaccaccttcc

SEQ ID NO: 2852493 - DNA, 19 bp, Homo sapiens
atgtcaccaccttcccagc

SEQ ID NO: 2852494 - DNA, 17 bp, Homo sapiens
atgtcacgtcttgaaaa

SEQ ID NO: 2852495 - DNA, 18 bp, Homo sapiens
atgtcacgtcttgaaaag

SEQ ID NO: 2852496 - DNA, 14 bp, Homo sapiens
atgtcactcccaga

SEQ ID NO: 2852497 - DNA, 15 bp, Homo sapiens
atgtcaggaacagaa

SEQ ID NO: 2852498 - DNA, 17 bp, Homo sapiens
atgtcaggaacagaagg

SEQ ID NO: 2852499 - DNA, 14 bp, Homo sapiens
atgtcatcatacat

SEQ ID NO: 2852500 - DNA, 15 bp, Homo sapiens
atgtcatcatacatg

SEQ ID NO: 2852501 - DNA, 12 bp, Homo sapiens
atgtccagaaga

SEQ ID NO: 2852502 - DNA, 23 bp, Homo sapiens
atgtccagaagaatattcaggac

SEQ ID NO: 2852503 - DNA, 15 bp, Homo sapiens
atgtcccatctgctc

SEQ ID NO: 2852504 - DNA, 16 bp, Homo sapiens
atgtcccatctgctcc

SEQ ID NO: 2852505 - DNA, 16 bp, Homo sapiens
atgtcctaaggacaca

SEQ ID NO: 2852506 - DNA, 17 bp, Homo sapiens
atgtcctaaggacacac

SEQ ID NO: 2852507 - DNA, 19 bp, Homo sapiens
atgtcctaaggacacacta

SEQ ID NO: 2852508 - DNA, 17 bp, Homo sapiens
atgtcctccttgttcta

SEQ ID NO: 2852509 - DNA, 13 bp, Homo sapiens
atgtcgcctctgc

SEQ ID NO: 2852510 - DNA, 14 bp, Homo sapiens
atgtcgcctgcccc

SEQ ID NO: 2852511 - DNA, 19 bp, Homo sapiens
atgtcggagtagaaattgt

SEQ ID NO: 2852512 - DNA, 20 bp, Homo sapiens
atgtcggcacgtcccatgtg

SEQ ID NO: 2852513 - DNA, 17 bp, Homo sapiens
atgtctctcagaattct

SEQ ID NO: 2852514 - DNA, 23 bp, Homo sapiens
atgtctctttaatgtcacaggca

SEQ ID NO: 2852515 - DNA, 13 bp, Homo sapiens
atgtcttggacac

SEQ ID NO: 2852516 - DNA, 14 bp, Homo sapiens
atgtcttgtacatg

SEQ ID NO: 2852517 - DNA, 22 bp, Homo sapiens
atgtctttaggcagcagctttt

SEQ ID NO: 2852518 - DNA, 18 bp, Homo sapiens
atgtctttctccaaagtt

SEQ ID NO: 2852519 - DNA, 20 bp, Homo sapiens
atgtctttgttggaaaagaa

SEQ ID NO: 2852520 - DNA, 23 bp, Homo sapiens
atgtctttgttggaaaagaatac

SEQ ID NO: 2852521 - DNA, 14 bp, Homo sapiens
atgtgaaagtgtaa

SEQ ID NO: 2852522 - DNA, 15 bp, Homo sapiens
atgtgaaagtgtaaa

SEQ ID NO: 2852523 - DNA, 17 bp, Homo sapiens
attaagattgaggcctg

SEQ ID NO: 2852524 - DNA, 19 bp, Homo sapiens
attaataaaaaatggaaag

SEQ ID NO: 2852525 - DNA, 19 bp, Homo sapiens
attaatatgttcattaaat

SEQ ID NO: 2852526 - DNA, 19 bp, Homo sapiens
attaatattcattgtataa

SEQ ID NO: 2852527 - DNA, 17 bp, Homo sapiens
attaatcgaaatgaatt

SEQ ID NO: 2852528 - DNA, 14 bp, Homo sapiens
attaatgaactgtg

SEQ ID NO: 2852529 - DNA, 17 bp, Homo sapiens
attaatgaactgtgaca

SEQ ID NO: 2852530 - DNA, 18 bp, Homo sapiens
attaatgaactgtgacag

SEQ ID NO: 2852531 - DNA, 15 bp, Homo sapiens
attaattagattttc

SEQ ID NO: 2852532 - DNA, 20 bp, Homo sapiens
attaattagattttcttgca

SEQ ID NO: 2852533 - DNA, 14 bp, Homo sapiens
attaattatctgat

SEQ ID NO: 2852534 - DNA, 11 bp, Homo sapiens
attaattcatt

SEQ ID NO: 2852535 - DNA, 14 bp, Homo sapiens
attaattctactaa

SEQ ID NO: 2852536 - DNA, 16 bp, Homo sapiens
attaattctactaaat

SEQ ID NO: 2852537 - DNA, 14 bp, Homo sapiens
attacacccaaaga

SEQ ID NO: 2852538 - DNA, 21 bp, Homo sapiens
attacactacaagtttataag

SEQ ID NO: 2852539 - DNA, 19 bp, Homo sapiens
attacagatgggcaaatta

SEQ ID NO: 2852540 - DNA, 21 bp, Homo sapiens
attacagatgggcaaattaag

SEQ ID NO: 2852541 - DNA, 15 bp, Homo sapiens
attacagctggagaa

SEQ ID NO: 2852542 - DNA, 15 bp, Homo sapiens
attacagtgggtgcc

SEQ ID NO: 2852543 - DNA, 17 bp, Homo sapiens
attacatttccaaatga

SEQ ID NO: 2852544 - DNA, 17 bp, Homo sapiens
attaccaaaaaagtatt

SEQ ID NO: 2852545 - DNA, 18 bp, Homo sapiens
attaccaaaaatcttggg

SEQ ID NO: 2852546 - DNA, 16 bp, Homo sapiens
attacgtgagccaggt

SEQ ID NO: 2852547 - DNA, 20 bp, Homo sapiens
attacgtgagccaggtaatg

SEQ ID NO: 2852548 - DNA, 21 bp, Homo sapiens
attactacaaaatttgaaatt

SEQ ID NO: 2852549 - DNA, 17 bp, Homo sapiens
attactgcatgcacttc

SEQ ID NO: 2852550 - DNA, 24 bp, Homo sapiens
attactgcctttggaagaaacagg

SEQ ID NO: 2852551 - DNA, 17 bp, Homo sapiens
attacttatttttgaca

SEQ ID NO: 2852552 - DNA, 12 bp, Homo sapiens
attacttgcaca

SEQ ID NO: 2852553 - DNA, 14 bp, Homo sapiens
attacttgcacaag

SEQ ID NO: 2852554 - DNA, 23 bp, Homo sapiens
attagaaactgaaaactgtaaat

SEQ ID NO: 2852555 - DNA, 22 bp, Homo sapiens
attagaaatagacagtatattt

SEQ ID NO: 2852556 - DNA, 13 bp, Homo sapiens
attagaacaatag

SEQ ID NO: 2852557 - DNA, 14 bp, Homo sapiens
attagaatgaaaat

SEQ ID NO: 2852558 - DNA, 22 bp, Homo sapiens
attagactggaacttgaactga

SEQ ID NO: 2852559 - DNA, 15 bp, Homo sapiens
attagactggacagc

SEQ ID NO: 2852560 - DNA, 16 bp, Homo sapiens
attagactggacagct

SEQ ID NO: 2852561 - DNA, 20 bp, Homo sapiens
attagactggacagcttgtg

SEQ ID NO: 2852562 - DNA, 22 bp, Homo sapiens
attagcaattgactgtcactgt

SEQ ID NO: 2852563 - DNA, 13 bp, Homo sapiens
attagctgtaaat

SEQ ID NO: 2852564 - DNA, 21 bp, Homo sapiens
attaggaacagagtatatatg

SEQ ID NO: 2852565 - DNA, 16 bp, Homo sapiens
attaggatctatgcaa

SEQ ID NO: 2852566 - DNA, 23 bp, Homo sapiens
attaggatctatgcaatttttaa

SEQ ID NO: 2852567 - DNA, 14 bp, Homo sapiens
attaggatttcatg

SEQ ID NO: 2852568 - DNA, 22 bp, Homo sapiens
attagtacagtagcttaaataa

SEQ ID NO: 2852569 - DNA, 18 bp, Homo sapiens
attagtatttatttaatg

SEQ ID NO: 2852570 - DNA, 20 bp, Homo sapiens
attagtgagatttgtattta

SEQ ID NO: 2852571 - DNA, 21 bp, Homo sapiens
attagtttgatttaatatctg

SEQ ID NO: 2852572 - DNA, 13 bp, Homo sapiens
attataaataaat

SEQ ID NO: 2852573 - DNA, 15 bp, Homo sapiens
attataaataaatgc

SEQ ID NO: 2852574 - DNA, 18 bp, Homo sapiens
attataaataaatgccaa

SEQ ID NO: 2852575 - DNA, 19 bp, Homo sapiens
attataaataaatgccaac

SEQ ID NO: 2852576 - DNA, 15 bp, Homo sapiens
attataacttaaaaa

SEQ ID NO: 2852577 - DNA, 22 bp, Homo sapiens
attataatttttttcaatattt

SEQ ID NO: 2852578 - DNA, 23 bp, Homo sapiens
attataatttttttcaatattta

SEQ ID NO: 2852579 - DNA, 20 bp, Homo sapiens
attatagagtatactaaaaa

SEQ ID NO: 2852580 - DNA, 13 bp, Homo sapiens
attatatatcata

SEQ ID NO: 2852581 - DNA, 19 bp, Homo sapiens
attatatatcataaagtat

SEQ ID NO: 2852582 - DNA, 13 bp, Homo sapiens
attatatctaatt

SEQ ID NO: 2852583 - DNA, 21 bp, Homo sapiens
attatcggaagcagtgccttc

SEQ ID NO: 2852584 - DNA, 18 bp, Homo sapiens
attatgaggctattaaaa

SEQ ID NO: 2852585 - DNA, 21 bp, Homo sapiens
attatgatgtgggtcaaggaa

SEQ ID NO: 2852586 - DNA, 20 bp, Homo sapiens
attatggaagattttaaatt

SEQ ID NO: 2852587 - DNA, 15 bp, Homo sapiens
attatgggtcctgca

SEQ ID NO: 2852588 - DNA, 21 bp, Homo sapiens
attatggtgtaatgcacaatt

SEQ ID NO: 2852589 - DNA, 12 bp, Homo sapiens
attatgtgacaa

SEQ ID NO: 2852590 - DNA, 15 bp, Homo sapiens
attatgtgacaacct

SEQ ID NO: 2852591 - DNA, 22 bp, Homo sapiens
attatgtgacaacctttgtgta

SEQ ID NO: 2852592 - DNA, 17 bp, Homo sapiens
attattctaattttata

SEQ ID NO: 2852593 - DNA, 21 bp, Homo sapiens
attatttcaaccgcttgccat

SEQ ID NO: 2852594 - DNA, 20 bp, Homo sapiens
attattttagtctgtcatcc

SEQ ID NO: 2852595 - DNA, 16 bp, Homo sapiens
attattttgttgtgat

SEQ ID NO: 2852596 - DNA, 17 bp, Homo sapiens
attattttgttgtgatt

SEQ ID NO: 2852597 - DNA, 11 bp, Homo sapiens
attcaaaacat

SEQ ID NO: 2852598 - DNA, 16 bp, Homo sapiens
attcaaactgctccaa

SEQ ID NO: 2852599 - DNA, 17 bp, Homo sapiens
attcaaactgctccaag

SEQ ID NO: 2852600 - DNA, 19 bp, Homo sapiens
attcaacacattacttgca

SEQ ID NO: 2852601 - DNA, 18 bp, Homo sapiens
attcaacctgtgtcttat

SEQ ID NO: 2852602 - DNA, 12 bp, Homo sapiens
attcaataaagc

SEQ ID NO: 2852603 - DNA, 13 bp, Homo sapiens
attcaatatctga

SEQ ID NO: 2852604 - DNA, 15 bp, Homo sapiens
attcaatatctgaca

SEQ ID NO: 2852605 - DNA, 22 bp, Homo sapiens
attcaatgtttatgcaaggaag

SEQ ID NO: 2852606 - DNA, 14 bp, Homo sapiens
attcaattcctctg

SEQ ID NO: 2852607 - DNA, 13 bp, Homo sapiens
attcacaatagaa

SEQ ID NO: 2852608 - DNA, 14 bp, Homo sapiens
attcacacacccct

SEQ ID NO: 2852609 - DNA, 20 bp, Homo sapiens
attcacacacccctcaaaaa

SEQ ID NO: 2852610 - DNA, 14 bp, Homo sapiens
attcacagagcctt

SEQ ID NO: 2852611 - DNA, 16 bp, Homo sapiens
attcacatctcatttt

SEQ ID NO: 2852612 - DNA, 18 bp, Homo sapiens
attcacatttgatgtaca

SEQ ID NO: 2852613 - DNA, 19 bp, Homo sapiens
attcacatttgatgtacat

SEQ ID NO: 2852614 - DNA, 16 bp, Homo sapiens
atttggaaagagacca

SEQ ID NO: 2852615 - DNA, 21 bp, Homo sapiens
atttggtgtggctgtattcag

SEQ ID NO: 2852616 - DNA, 22 bp, Homo sapiens
atttggtgtggctgtattcaga

SEQ ID NO: 2852617 - DNA, 19 bp, Homo sapiens
atttgtacatatgtaaaat

SEQ ID NO: 2852618 - DNA, 21 bp, Homo sapiens
atttgtacatatgtaaaataa

SEQ ID NO: 2852619 - DNA, 15 bp, Homo sapiens
atttgtacattcctg

SEQ ID NO: 2852620 - DNA, 23 bp, Homo sapiens
atttgtactgaaaaatggtaatt

SEQ ID NO: 2852621 - DNA, 15 bp, Homo sapiens
atttgtatttatatt

SEQ ID NO: 2852622 - DNA, 19 bp, Homo sapiens
atttgtgagccaaagagaa

SEQ ID NO: 2852623 - DNA, 21 bp, Homo sapiens
atttgtgtagattgtgtaaat

SEQ ID NO: 2852624 - DNA, 17 bp, Homo sapiens
atttgttcccaagagca

SEQ ID NO: 2852625 - DNA, 13 bp, Homo sapiens
atttgttggaatg

SEQ ID NO: 2852626 - DNA, 13 bp, Homo sapiens
atttgtttctact

SEQ ID NO: 2852627 - DNA, 20 bp, Homo sapiens
attttaaaaggttgactcaa

SEQ ID NO: 2852628 - DNA, 22 bp, Homo sapiens
attttaaacaaaggttgagatg

SEQ ID NO: 2852629 - DNA, 12 bp, Homo sapiens
attttaaagaat

SEQ ID NO: 2852630 - DNA, 16 bp, Homo sapiens
attttaacaaaagcaa

SEQ ID NO: 2852631 - DNA, 15 bp, Homo sapiens
attttaactttatca

SEQ ID NO: 2852632 - DNA, 20 bp, Homo sapiens
attttaagcattcttagact

SEQ ID NO: 2852633 - DNA, 21 bp, Homo sapiens
attttaagcattcttagacta

SEQ ID NO: 2852634 - DNA, 16 bp, Homo sapiens
attttaagtgctttgt

SEQ ID NO: 2852635 - DNA, 20 bp, Homo sapiens
attttaataaaatgaaaggg

SEQ ID NO: 2852636 - DNA, 15 bp, Homo sapiens
attttactgacagaa

SEQ ID NO: 2852637 - DNA, 18 bp, Homo sapiens
attttactgacagaaatg

SEQ ID NO: 2852638 - DNA, 19 bp, Homo sapiens
attttactgacagaaatgc

SEQ ID NO: 2852639 - DNA, 21 bp, Homo sapiens
attttactgacagaaatgcaa

SEQ ID NO: 2852640 - DNA, 15 bp, Homo sapiens
attttagctgcagaa

SEQ ID NO: 2852641 - DNA, 19 bp, Homo sapiens
attttaggagacagtctca

SEQ ID NO: 2852642 - DNA, 18 bp, Homo sapiens
attttagtctgtcatcca

SEQ ID NO: 2852643 - DNA, 20 bp, Homo sapiens
attttagtctgtcatccaga

SEQ ID NO: 2852644 - DNA, 12 bp, Homo sapiens
attttataattt

SEQ ID NO: 2852645 - DNA, 12 bp, Homo sapiens
attttatacata

SEQ ID NO: 2852646 - DNA, 22 bp, Homo sapiens
attttatacatagtcacaaaaa

SEQ ID NO: 2852647 - DNA, 19 bp, Homo sapiens
attttatatgaaatgtttc

SEQ ID NO: 2852648 - DNA, 18 bp, Homo sapiens
attttatattacactaca

SEQ ID NO: 2852649 - DNA, 20 bp, Homo sapiens
attttatattagaagtgtta

SEQ ID NO: 2852650 - DNA, 21 bp, Homo sapiens
attttatctgtgttgtctctc

SEQ ID NO: 2852651 - DNA, 20 bp, Homo sapiens
attttatgatttaaaaaata

SEQ ID NO: 2852652 - DNA, 21 bp, Homo sapiens
attttatgccttttatttctt

SEQ ID NO: 2852653 - DNA, 22 bp, Homo sapiens
attttatttattagctgtaaat

SEQ ID NO: 2852654 - DNA, 15 bp, Homo sapiens
attttcaaaaattgt

SEQ ID NO: 2852655 - DNA, 14 bp, Homo sapiens
attttcaagaaact

SEQ ID NO: 2852656 - DNA, 22 bp, Homo sapiens
attttcaagagaagaaaaaatt

SEQ ID NO: 2852657 - DNA, 20 bp, Homo sapiens
attttcacatgacgtaaaat

SEQ ID NO: 2852658 - DNA, 16 bp, Homo sapiens
attttcacttgcttaa

SEQ ID NO: 2852659 - DNA, 12 bp, Homo sapiens
attttcagaccc

SEQ ID NO: 2852660 - DNA, 15 bp, Homo sapiens
attttcagagtgaca

SEQ ID NO: 2852661 - DNA, 19 bp, Homo sapiens
attttcagcgaacatgcct

SEQ ID NO: 2852662 - DNA, 19 bp, Homo sapiens
attttcattaaaaatgaaa

SEQ ID NO: 2852663 - DNA, 14 bp, Homo sapiens
attttcatttaact

SEQ ID NO: 2852664 - DNA, 22 bp, Homo sapiens
attttccagggcaatcaatgtt

SEQ ID NO: 2852665 - DNA, 15 bp, Homo sapiens
attttccatgaaaat

SEQ ID NO: 2852666 - DNA, 14 bp, Homo sapiens
attttccctctctt

SEQ ID NO: 2852667 - DNA, 18 bp, Homo sapiens
attttcgtgcatttgtga

SEQ ID NO: 2852668 - DNA, 19 bp, Homo sapiens
attttctatagctcttcta

SEQ ID NO: 2852669 - DNA, 22 bp, Homo sapiens
attttctatagctcttctattt

SEQ ID NO: 2852670 - DNA, 21 bp, Homo sapiens
attttctctttaaaagaaagt

SEQ ID NO: 2852671 - DNA, 21 bp, Homo sapiens
attttcttccaagcaaaggtg

SEQ ID NO: 2852672 - DNA, 16 bp, Homo sapiens
attttcttcccatttg

SEQ ID NO: 2852673 - DNA, 18 bp, Homo sapiens
attttcttcccatttgta

SEQ ID NO: 2852674 - DNA, 15 bp, Homo sapiens
attttcttgcagttt

SEQ ID NO: 2852675 - DNA, 20 bp, Homo sapiens
attttgaataaataaatgta

SEQ ID NO: 2852676 - DNA, 17 bp, Homo sapiens
attttgacataaagttg

SEQ ID NO: 2852677 - DNA, 19 bp, Homo sapiens
attttgcaaaatttccagt

SEQ ID NO: 2852678 - DNA, 18 bp, Homo sapiens
attttgcagcagaagcca

SEQ ID NO: 2852679 - DNA, 14 bp, Homo sapiens
attttgcagcagtg

SEQ ID NO: 2852680 - DNA, 23 bp, Homo sapiens
attttgcattgtgtgagcttcta

SEQ ID NO: 2852681 - DNA, 18 bp, Homo sapiens
attttgcctcttttctct

SEQ ID NO: 2852682 - DNA, 21 bp, Homo sapiens
attttgcctcttttctctgtg

SEQ ID NO: 2852683 - DNA, 14 bp, Homo sapiens
attttgcttaaaat

SEQ ID NO: 2852684 - DNA, 21 bp, Homo sapiens
attttggggtacccactgctc

SEQ ID NO: 2852685 - DNA, 18 bp, Homo sapiens
attttggtccaagttgtg

SEQ ID NO: 2852686 - DNA, 19 bp, Homo sapiens
attttgtaaactcaaaata

SEQ ID NO: 2852687 - DNA, 12 bp, Homo sapiens
attttgtaataa

SEQ ID NO: 2852688 - DNA, 14 bp, Homo sapiens
attttgtaataaac

SEQ ID NO: 2852689 - DNA, 13 bp, Homo sapiens
attttgtacagaa

SEQ ID NO: 2852690 - DNA, 14 bp, Homo sapiens
attttgtacagaat

SEQ ID NO: 2852691 - DNA, 15 bp, Homo sapiens
attttgtacagaatt

SEQ ID NO: 2852692 - DNA, 17 bp, Homo sapiens
attttgtacagaatttt

SEQ ID NO: 2852693 - DNA, 18 bp, Homo sapiens
attttgtacagaattttt

SEQ ID NO: 2852694 - DNA, 15 bp, Homo sapiens
attttgtatttttga

SEQ ID NO: 2852695 - DNA, 14 bp, Homo sapiens
attttgttgtgatt

SEQ ID NO: 2852696 - DNA, 23 bp, Homo sapiens
attttgttgtgattttgtacaga

SEQ ID NO: 2852697 - DNA, 24 bp, Homo sapiens
attttgttgtgattttgtacagaa

SEQ ID NO: 2852698 - DNA, 20 bp, Homo sapiens
attttgtttgtaatcctgta

SEQ ID NO: 2852699 - DNA, 15 bp, Homo sapiens
atttttaaactagta

SEQ ID NO: 2852700 - DNA, 15 bp, Homo sapiens
atttttactaaagca

SEQ ID NO: 2852701 - DNA, 17 bp, Homo sapiens
atttttactaaagcagt

SEQ ID NO: 2852702 - DNA, 19 bp, Homo sapiens
atttttactaaagcagtgt

SEQ ID NO: 2852703 - DNA, 23 bp, Homo sapiens
atttttagctctgttctttataa

SEQ ID NO: 2852704 - DNA, 19 bp, Homo sapiens
caagcttgtatatacatat

SEQ ID NO: 2852705 - DNA, 22 bp, Homo sapiens
caagcttgtatatacatattat

SEQ ID NO: 2852706 - DNA, 24 bp, Homo sapiens
caagcttgtatatacatattataa

SEQ ID NO: 2852707 - DNA, 13 bp, Homo sapiens
caaggaaggaaag

SEQ ID NO: 2852708 - DNA, 17 bp, Homo sapiens
caaggaaggaaagaaag

SEQ ID NO: 2852709 - DNA, 18 bp, Homo sapiens
caaggaaggaaagaaaga

SEQ ID NO: 2852710 - DNA, 22 bp, Homo sapiens
caaggactgcagggactgccag

SEQ ID NO: 2852711 - DNA, 16 bp, Homo sapiens
caaggagatataaaat

SEQ ID NO: 2852712 - DNA, 21 bp, Homo sapiens
caaggagttccatgaagacca

SEQ ID NO: 2852713 - DNA, 20 bp, Homo sapiens
caaggattgctactgtccta

SEQ ID NO: 2852714 - DNA, 14 bp, Homo sapiens
caaggcagcaaggc

SEQ ID NO: 2852715 - DNA, 15 bp, Homo sapiens
caaggcagcaaggcc

SEQ ID NO: 2852716 - DNA, 14 bp, Homo sapiens
caaggcagtgttcc

SEQ ID NO: 2852717 - DNA, 13 bp, Homo sapiens
caaggcccgagca

SEQ ID NO: 2852718 - DNA, 19 bp, Homo sapiens
caaggcccgagcagctgag

SEQ ID NO: 2852719 - DNA, 20 bp, Homo sapiens
caaggccgctgttcacccac

SEQ ID NO: 2852720 - DNA, 22 bp, Homo sapiens
caaggccgctgttcacccacag

SEQ ID NO: 2852721 - DNA, 21 bp, Homo sapiens
caaggctgctcagaggggccc

SEQ ID NO: 2852722 - DNA, 21 bp, Homo sapiens
caaggggaatgtttgcctctg

SEQ ID NO: 2852723 - DNA, 17 bp, Homo sapiens
caagggtctagggagag

SEQ ID NO: 2852724 - DNA, 16 bp, Homo sapiens
caaggtcttcagccat

SEQ ID NO: 2852725 - DNA, 14 bp, Homo sapiens
caaggtctttggtt

SEQ ID NO: 2852726 - DNA, 22 bp, Homo sapiens
caaggtggggggatcacaaggt

SEQ ID NO: 2852727 - DNA, 16 bp, Homo sapiens
caaggttccctctgag

SEQ ID NO: 2852728 - DNA, 13 bp, Homo sapiens
caagtaaacattc

SEQ ID NO: 2852729 - DNA, 13 bp, Homo sapiens
caagtactgctgt

SEQ ID NO: 2852730 - DNA, 16 bp, Homo sapiens
caagtactgctgtaaa

SEQ ID NO: 2852731 - DNA, 20 bp, Homo sapiens
caagtagaatggcagctgga

SEQ ID NO: 2852732 - DNA, 16 bp, Homo sapiens
caagtccaggtcctgg

SEQ ID NO: 2852733 - DNA, 21 bp, Homo sapiens
caagtccctgactctctgtga

SEQ ID NO: 2852734 - DNA, 14 bp, Homo sapiens
caagtctccttccc

SEQ ID NO: 2852735 - DNA, 15 bp, Homo sapiens
caagtgacatctctt

SEQ ID NO: 2852736 - DNA, 14 bp, Homo sapiens
caagtgagagctgg

SEQ ID NO: 2852737 - DNA, 15 bp, Homo sapiens
caagtgagagctggg

SEQ ID NO: 2852738 - DNA, 19 bp, Homo sapiens
caagtgatatatgtattta

SEQ ID NO: 2852739 - DNA, 17 bp, Homo sapiens
caagtgattctcctgcc

SEQ ID NO: 2852740 - DNA, 18 bp, Homo sapiens
caagtgattctcctgcct

SEQ ID NO: 2852741 - DNA, 19 bp, Homo sapiens
caagtgattctcctgcctc

SEQ ID NO: 2852742 - DNA, 20 bp, Homo sapiens
caagtgattctcctgcctca

SEQ ID NO: 2852743 - DNA, 15 bp, Homo sapiens
caagtgattgaaaat

SEQ ID NO: 2852744 - DNA, 13 bp, Homo sapiens
caagtgggggcag

SEQ ID NO: 2852745 - DNA, 17 bp, Homo sapiens
caagttagctcaggagg

SEQ ID NO: 2852746 - DNA, 16 bp, Homo sapiens
caagttataaatcaat

SEQ ID NO: 2852747 - DNA, 16 bp, Homo sapiens
caagttgtttcattga

SEQ ID NO: 2852748 - DNA, 13 bp, Homo sapiens
caataaaacattc

SEQ ID NO: 2852749 - DNA, 12 bp, Homo sapiens
caataaaagtga

SEQ ID NO: 2852750 - DNA, 19 bp, Homo sapiens
caataaaagtgactctcag

SEQ ID NO: 2852751 - DNA, 13 bp, Homo sapiens
caataaaatcatg

SEQ ID NO: 2852752 - DNA, 15 bp, Homo sapiens
caataaaatcatgta

SEQ ID NO: 2852753 - DNA, 20 bp, Homo sapiens
caataaaatcatgtacattt

SEQ ID NO: 2852754 - DNA, 11 bp, Homo sapiens
caataaagctg

SEQ ID NO: 2852755 - DNA, 12 bp, Homo sapiens
caataaagctgg

SEQ ID NO: 2852756 - DNA, 14 bp, Homo sapiens
caataaagctggac

SEQ ID NO: 2852757 - DNA, 15 bp, Homo sapiens
caataacgtttaagc

SEQ ID NO: 2852758 - DNA, 22 bp, Homo sapiens
caataatttcaggttttgtaaa

SEQ ID NO: 2852759 - DNA, 19 bp, Homo sapiens
caatagctattgcatgtaa

SEQ ID NO: 2852760 - DNA, 21 bp, Homo sapiens
caatattaaatacagacacta

SEQ ID NO: 2852761 - DNA, 22 bp, Homo sapiens
caatattaaatacagacactaa

SEQ ID NO: 2852762 - DNA, 13 bp, Homo sapiens
caatattataatt

SEQ ID NO: 2852763 - DNA, 22 bp, Homo sapiens
caatattataatttttttcaat

SEQ ID NO: 2852764 - DNA, 14 bp, Homo sapiens
caatattcaataaa

SEQ ID NO: 2852765 - DNA, 15 bp, Homo sapiens
caatattcaataaag

SEQ ID NO: 2852766 - DNA, 16 bp, Homo sapiens
caatattcaataaagc

SEQ ID NO: 2852767 - DNA, 17 bp, Homo sapiens
caatattcaataaagct

SEQ ID NO: 2852768 - DNA, 21 bp, Homo sapiens
caatattcctgaatgaaatat

SEQ ID NO: 2852769 - DNA, 14 bp, Homo sapiens
caatatttgtagaa

SEQ ID NO: 2852770 - DNA, 15 bp, Homo sapiens
caatattttccatga

SEQ ID NO: 2852771 - DNA, 15 bp, Homo sapiens
caatcacagctcctc

SEQ ID NO: 2852772 - DNA, 15 bp, Homo sapiens
caatcccctcattca

SEQ ID NO: 2852773 - DNA, 13 bp, Homo sapiens
caatcctgtccct

SEQ ID NO: 2852774 - DNA, 15 bp, Homo sapiens
caatcctgtccctca

SEQ ID NO: 2852775 - DNA, 16 bp, Homo sapiens
caatcctgtccctcac

SEQ ID NO: 2852776 - DNA, 21 bp, Homo sapiens
caatccttcttatgtttgctt

SEQ ID NO: 2852777 - DNA, 21 bp, Homo sapiens
caatctcaaattctcaaccta

SEQ ID NO: 2852778 - DNA, 18 bp, Homo sapiens
caatctccagggctgccc

SEQ ID NO: 2852779 - DNA, 19 bp, Homo sapiens
caatctccagggctgcccc

SEQ ID NO: 2852780 - DNA, 15 bp, Homo sapiens
caatctgggactttc

SEQ ID NO: 2852781 - DNA, 17 bp, Homo sapiens
caatgaaagtttgcact

SEQ ID NO: 2852782 - DNA, 22 bp, Homo sapiens
caatgaaatacacaagtaaaca

SEQ ID NO: 2852783 - DNA, 22 bp, Homo sapiens
caatgaaatatttgcttattta

SEQ ID NO: 2852784 - DNA, 21 bp, Homo sapiens
caatgaaatgctctcctttcc

SEQ ID NO: 2852785 - DNA, 15 bp, Homo sapiens
caatgaacaaaggga

SEQ ID NO: 2852786 - DNA, 22 bp, Homo sapiens
caatgaacaaagggattctcca

SEQ ID NO: 2852787 - DNA, 15 bp, Homo sapiens
caatgacatcttcaa

SEQ ID NO: 2852788 - DNA, 15 bp, Homo sapiens
caatgacctgtattt

SEQ ID NO: 2852789 - DNA, 17 bp, Homo sapiens
caatgaggtctgaaatg

SEQ ID NO: 2852790 - DNA, 19 bp, Homo sapiens
caatgaggtctgaaatgga

SEQ ID NO: 2852791 - DNA, 19 bp, Homo sapiens
caatgattcataacaatgt

SEQ ID NO: 2852792 - DNA, 17 bp, Homo sapiens
caatgcacctaaagaaa

SEQ ID NO: 2852793 - DNA, 18 bp, Homo sapiens
caatgcacctaaagaaaa

SEQ ID NO: 2852794 - DNA, 13 bp, Homo sapiens
caatggcagcctt

SEQ ID NO: 2852795 - DNA, 17 bp, Homo sapiens
caccctgtctaaaaaac

SEQ ID NO: 2852796 - DNA, 15 bp, Homo sapiens
caccctgttccctct

SEQ ID NO: 2852797 - DNA, 20 bp, Homo sapiens
cacccttcacataccctccc

SEQ ID NO: 2852798 - DNA, 16 bp, Homo sapiens
cacccttctttcctct

SEQ ID NO: 2852799 - DNA, 13 bp, Homo sapiens
caccgctgcctaa

SEQ ID NO: 2852800 - DNA, 12 bp, Homo sapiens
caccgggccact

SEQ ID NO: 2852801 - DNA, 13 bp, Homo sapiens
cacctaaagaaaa

SEQ ID NO: 2852802 - DNA, 17 bp, Homo sapiens
cacctaaagaaaaacaa

SEQ ID NO: 2852803 - DNA, 21 bp, Homo sapiens
cacctacatccccaggtctct

SEQ ID NO: 2852804 - DNA, 22 bp, Homo sapiens
cacctacttttctttcctcaga

SEQ ID NO: 2852805 - DNA, 19 bp, Homo sapiens
cacctaggccactcctcca

SEQ ID NO: 2852806 - DNA, 23 bp, Homo sapiens
  misc_feature (7)..(7): n is a, c, g or t
  misc_feature (14)..(14): n is a, c, g or t
cacctanccccccnacccccagt

SEQ ID NO: 2852807 - DNA, 23 bp, Homo sapiens
cacctatgtcatttcatttccta

SEQ ID NO: 2852808 - DNA, 13 bp, Homo sapiens
cacctcactcctg

SEQ ID NO: 2852809 - DNA, 14 bp, Homo sapiens
cacctcactcctgt

SEQ ID NO: 2852810 - DNA, 20 bp, Homo sapiens
cacctcagagacatacacct

SEQ ID NO: 2852811 - DNA, 11 bp, Homo sapiens
cacctcagcct

SEQ ID NO: 2852812 - DNA, 12 bp, Homo sapiens
cacctcagcctc

SEQ ID NO: 2852813 - DNA, 14 bp, Homo sapiens
cacctcagcctccc

SEQ ID NO: 2852814 - DNA, 13 bp, Homo sapiens
cacctcagccttg

SEQ ID NO: 2852815 - DNA, 23 bp, Homo sapiens
cacctcaggccaggtgcagtggc

SEQ ID NO: 2852816 - DNA, 10 bp, Homo sapiens
cacctcccag

SEQ ID NO: 2852817 - DNA, 12 bp, Homo sapiens
cacctcccagga

SEQ ID NO: 2852818 - DNA, 23 bp, Homo sapiens
cacctcccaggggctccacctgt

SEQ ID NO: 2852819 - DNA, 14 bp, Homo sapiens
cacctccccccact

SEQ ID NO: 2852820 - DNA, 15 bp, Homo sapiens
cacctccccccactg

SEQ ID NO: 2852821 - DNA, 14 bp, Homo sapiens
cacctcccctatcc

SEQ ID NO: 2852822 - DNA, 18 bp, Homo sapiens
cacctcccctatccaccc

SEQ ID NO: 2852823 - DNA, 19 bp, Homo sapiens
cacctcccctatccaccca

SEQ ID NO: 2852824 - DNA, 20 bp, Homo sapiens
cacctcccctatccacccag

SEQ ID NO: 2852825 - DNA, 15 bp, Homo sapiens
cacctccgccccaga

SEQ ID NO: 2852826 - DNA, 19 bp, Homo sapiens
cacctccgccccagacaca

SEQ ID NO: 2852827 - DNA, 13 bp, Homo sapiens
cacctcctgcctc

SEQ ID NO: 2852828 - DNA, 13 bp, Homo sapiens
cacctctgcctca

SEQ ID NO: 2852829 - DNA, 18 bp, Homo sapiens
cacctcttctcttcctgt

SEQ ID NO: 2852830 - DNA, 18 bp, Homo sapiens
cacctcttgggcatgctc

SEQ ID NO: 2852831 - DNA, 23 bp, Homo sapiens
cacctgaagactcattcttctgt

SEQ ID NO: 2852832 - DNA, 17 bp, Homo sapiens
cacctgacgtcagtagt

SEQ ID NO: 2852833 - DNA, 22 bp, Homo sapiens
cacctgaggctgaggcaggaga

SEQ ID NO: 2852834 - DNA, 19 bp, Homo sapiens
cacctgagtcaccctacct

SEQ ID NO: 2852835 - DNA, 23 bp, Homo sapiens
cacctgagtcaccctacctgtgc

SEQ ID NO: 2852836 - DNA, 15 bp, Homo sapiens
cacctgccagcctgg

SEQ ID NO: 2852837 - DNA, 17 bp, Homo sapiens
cacctgccatttgcacc

SEQ ID NO: 2852838 - DNA, 14 bp, Homo sapiens
cacctgccccctgg

SEQ ID NO: 2852839 - DNA, 16 bp, Homo sapiens
cacctgccctgccctg

SEQ ID NO: 2852840 - DNA, 17 bp, Homo sapiens
cacctgccctgccctgc

SEQ ID NO: 2852841 - DNA, 18 bp, Homo sapiens
cacctgccctgccctgcc

SEQ ID NO: 2852842 - DNA, 21 bp, Homo sapiens
cacctgccctgccctgccacc

SEQ ID NO: 2852843 - DNA, 22 bp, Homo sapiens
cacctgccctgccctgccacct

SEQ ID NO: 2852844 - DNA, 20 bp, Homo sapiens
cacctgcctatccatcctgc

SEQ ID NO: 2852845 - DNA, 13 bp, Homo sapiens
cacctgcttctga

SEQ ID NO: 2852846 - DNA, 14 bp, Homo sapiens
cacctggaatcaga

SEQ ID NO: 2852847 - DNA, 11 bp, Homo sapiens
cacctggcccc

SEQ ID NO: 2852848 - DNA, 14 bp, Homo sapiens
cacctggccccatg

SEQ ID NO: 2852849 - DNA, 22 bp, Homo sapiens
cacctggccccatgtctctcag

SEQ ID NO: 2852850 - DNA, 23 bp, Homo sapiens
cacctggccgcctccaggagcct

SEQ ID NO: 2852851 - DNA, 19 bp, Homo sapiens
cacctgggccctggggcct

SEQ ID NO: 2852852 - DNA, 21 bp, Homo sapiens
cacctgggccctggggcctgt

SEQ ID NO: 2852853 - DNA, 20 bp, Homo sapiens
cacctggtactgcacatttt

SEQ ID NO: 2852854 - DNA, 21 bp, Homo sapiens
cacctgtaatcccagctactt

SEQ ID NO: 2852855 - DNA, 15 bp, Homo sapiens
cacctgtactcagga

SEQ ID NO: 2852856 - DNA, 11 bp, Homo sapiens
cacctgtctgt

SEQ ID NO: 2852857 - DNA, 12 bp, Homo sapiens
cacctgtctgtc

SEQ ID NO: 2852858 - DNA, 13 bp, Homo sapiens
cacctgtctgtct

SEQ ID NO: 2852859 - DNA, 15 bp, Homo sapiens
cacctgttaaaatgt

SEQ ID NO: 2852860 - DNA, 20 bp, Homo sapiens
cacctgtttttaagctgttt

SEQ ID NO: 2852861 - DNA, 13 bp, Homo sapiens
caccttagctggc

SEQ ID NO: 2852862 - DNA, 15 bp, Homo sapiens
caccttatatttacg

SEQ ID NO: 2852863 - DNA, 22 bp, Homo sapiens
caccttatgtattattttctat

SEQ ID NO: 2852864 - DNA, 19 bp, Homo sapiens
caccttcccagctctccct

SEQ ID NO: 2852865 - DNA, 14 bp, Homo sapiens
caccttcccatgcc

SEQ ID NO: 2852866 - DNA, 19 bp, Homo sapiens
caccttgacagggcacacc

SEQ ID NO: 2852867 - DNA, 16 bp, Homo sapiens
caccttggactcctcc

SEQ ID NO: 2852868 - DNA, 18 bp, Homo sapiens
caccttggactcctccca

SEQ ID NO: 2852869 - DNA, 21 bp, Homo sapiens
caccttggactcctcccacaa

SEQ ID NO: 2852870 - DNA, 14 bp, Homo sapiens
caccttggctgcag

SEQ ID NO: 2852871 - DNA, 15 bp, Homo sapiens
caccttggctgcagg

SEQ ID NO: 2852872 - DNA, 16 bp, Homo sapiens
caccttggctgcaggg

SEQ ID NO: 2852873 - DNA, 20 bp, Homo sapiens
caccttgtcatgtaccatca

SEQ ID NO: 2852874 - DNA, 17 bp, Homo sapiens
caccttgtgtctgtaca

SEQ ID NO: 2852875 - DNA, 13 bp, Homo sapiens
cacctttctagtt

SEQ ID NO: 2852876 - DNA, 15 bp, Homo sapiens
cacctttgcaaagtt

SEQ ID NO: 2852877 - DNA, 13 bp, Homo sapiens
cacgaaatgttat

SEQ ID NO: 2852878 - DNA, 15 bp, Homo sapiens
cacgaaatgttattt

SEQ ID NO: 2852879 - DNA, 17 bp, Homo sapiens
cacgaaatgttattttt

SEQ ID NO: 2852880 - DNA, 16 bp, Homo sapiens
cacgaacccacctgct

SEQ ID NO: 2852881 - DNA, 22 bp, Homo sapiens
cacgaatttggtgtggctgtat

SEQ ID NO: 2852882 - DNA, 12 bp, Homo sapiens
cacgatgaaaaa

SEQ ID NO: 2852883 - DNA, 15 bp, Homo sapiens
cacgatgaaaaactt

SEQ ID NO: 2852884 - DNA, 14 bp, Homo sapiens
cacgatgtggccct

SEQ ID NO: 2852885 - DNA, 16 bp, Homo sapiens
cacgatgtggccctgg

SEQ ID NO: 2852886 - DNA, 19 bp, Homo sapiens
cagaactggacgcccagct

SEQ ID NO: 2852887 - DNA, 23 bp, Homo sapiens
cagaacttcgaccctttctctga

SEQ ID NO: 2852888 - DNA, 14 bp, Homo sapiens
cagaagaaacaagg

SEQ ID NO: 2852889 - DNA, 15 bp, Homo sapiens
cagaagaaggcagca

SEQ ID NO: 2852890 - DNA, 15 bp, Homo sapiens
cagaagaatattcag

SEQ ID NO: 2852891 - DNA, 13 bp, Homo sapiens
cagaagcctgggg

SEQ ID NO: 2852892 - DNA, 24 bp, Homo sapiens
cagaagcctgggggcctggctggc

SEQ ID NO: 2852893 - DNA, 16 bp, Homo sapiens
cagaagcttctgccca

SEQ ID NO: 2852894 - DNA, 19 bp, Homo sapiens
cagaaggaatctgtgcaga

SEQ ID NO: 2852895 - DNA, 14 bp, Homo sapiens
cagaaggagaagga

SEQ ID NO: 2852896 - DNA, 14 bp, Homo sapiens
cagaaggccaagaa

SEQ ID NO: 2852897 - DNA, 18 bp, Homo sapiens
cagaaggccaagaatcaa

SEQ ID NO: 2852898 - DNA, 21 bp, Homo sapiens
cagaaggggcacgcctgccca

SEQ ID NO: 2852899 - DNA, 15 bp, Homo sapiens
cagaaggtattcctt

SEQ ID NO: 2852900 - DNA, 23 bp, Homo sapiens
cagaaggttgctctagattgaga

SEQ ID NO: 2852901 - DNA, 17 bp, Homo sapiens
cagaagtcatgaagccc

SEQ ID NO: 2852902 - DNA, 19 bp, Homo sapiens
cagaagtttctcagctccc

SEQ ID NO: 2852903 - DNA, 22 bp, Homo sapiens
cagaataaagttctgagtgttt

SEQ ID NO: 2852904 - DNA, 13 bp, Homo sapiens
cagaataagtgct

SEQ ID NO: 2852905 - DNA, 17 bp, Homo sapiens
cagaataatctttgggt

SEQ ID NO: 2852906 - DNA, 23 bp, Homo sapiens
cagaatacagtaagctgctctat

SEQ ID NO: 2852907 - DNA, 15 bp, Homo sapiens
cagaataccttcttc

SEQ ID NO: 2852908 - DNA, 23 bp, Homo sapiens
cagaataccttcttcgctgctag

SEQ ID NO: 2852909 - DNA, 22 bp, Homo sapiens
cagaatatggacaaagaaggca

SEQ ID NO: 2852910 - DNA, 13 bp, Homo sapiens
cagaatccaaaga

SEQ ID NO: 2852911 - DNA, 15 bp, Homo sapiens
cagaatccaaagatc

SEQ ID NO: 2852912 - DNA, 18 bp, Homo sapiens
cagaatccaaagatcaca

SEQ ID NO: 2852913 - DNA, 13 bp, Homo sapiens
cagaatttttaat

SEQ ID NO: 2852914 - DNA, 16 bp, Homo sapiens
cagaatttttaatgac

SEQ ID NO: 2852915 - DNA, 17 bp, Homo sapiens
cagaatttttaatgact

SEQ ID NO: 2852916 - DNA, 19 bp, Homo sapiens
cagaatttttaatgacttt

SEQ ID NO: 2852917 - DNA, 15 bp, Homo sapiens
cagacacaggcccgg

SEQ ID NO: 2852918 - DNA, 21 bp, Homo sapiens
cagacacaggcccggctccag

SEQ ID NO: 2852919 - DNA, 13 bp, Homo sapiens
cagacacctgtgc

SEQ ID NO: 2852920 - DNA, 15 bp, Homo sapiens
cagacacctgtgcac

SEQ ID NO: 2852921 - DNA, 19 bp, Homo sapiens
cagacaccttgacagggca

SEQ ID NO: 2852922 - DNA, 18 bp, Homo sapiens
cagacactaagttatagt

SEQ ID NO: 2852923 - DNA, 22 bp, Homo sapiens
cagacacttcatggaccaagaa

SEQ ID NO: 2852924 - DNA, 13 bp, Homo sapiens
cagacagcagctc

SEQ ID NO: 2852925 - DNA, 15 bp, Homo sapiens
cagacagcagctcag

SEQ ID NO: 2852926 - DNA, 21 bp, Homo sapiens
cagacaggagaaatgcatcca

SEQ ID NO: 2852927 - DNA, 13 bp, Homo sapiens
cagacaggcaagc

SEQ ID NO: 2852928 - DNA, 18 bp, Homo sapiens
cagaccaactctctcctg

SEQ ID NO: 2852929 - DNA, 19 bp, Homo sapiens
cagaccacctccctgccct

SEQ ID NO: 2852930 - DNA, 12 bp, Homo sapiens
cagaccacctgc

SEQ ID NO: 2852931 - DNA, 16 bp, Homo sapiens
cagaccataatgttac

SEQ ID NO: 2852932 - DNA, 15 bp, Homo sapiens
cagaccccagcggct

SEQ ID NO: 2852933 - DNA, 14 bp, Homo sapiens
cagacccggctgcg

SEQ ID NO: 2852934 - DNA, 16 bp, Homo sapiens
cagaccctaccccacc

SEQ ID NO: 2852935 - DNA, 15 bp, Homo sapiens
cagaccctgcccttg

SEQ ID NO: 2852936 - DNA, 16 bp, Homo sapiens
cagacctctgatccct

SEQ ID NO: 2852937 - DNA, 15 bp, Homo sapiens
cagactacagccaga

SEQ ID NO: 2852938 - DNA, 16 bp, Homo sapiens
cagactcagtttgtca

SEQ ID NO: 2852939 - DNA, 19 bp, Homo sapiens
cagactctacagaggccat

SEQ ID NO: 2852940 - DNA, 20 bp, Homo sapiens
cagactctacagaggccatg

SEQ ID NO: 2852941 - DNA, 17 bp, Homo sapiens
cagactggaagcacagc

SEQ ID NO: 2852942 - DNA, 20 bp, Homo sapiens
cagactggaagcacagcttc

SEQ ID NO: 2852943 - DNA, 16 bp, Homo sapiens
cagactggctggctgc

SEQ ID NO: 2852944 - DNA, 22 bp, Homo sapiens
cagactgtggctgcagagacct

SEQ ID NO: 2852945 - DNA, 13 bp, Homo sapiens
cagacttctccag

SEQ ID NO: 2852946 - DNA, 16 bp, Homo sapiens
cagacttctctttctt

SEQ ID NO: 2852947 - DNA, 18 bp, Homo sapiens
cagagaaagaagagacag

SEQ ID NO: 2852948 - DNA, 22 bp, Homo sapiens
cagagaaagaagagacaggagg

SEQ ID NO: 2852949 - DNA, 19 bp, Homo sapiens
cagagaaagtacttctcca

SEQ ID NO: 2852950 - DNA, 23 bp, Homo sapiens
cagagaaagtacttctccaccct

SEQ ID NO: 2852951 - DNA, 14 bp, Homo sapiens
cagagaaggcagga

SEQ ID NO: 2852952 - DNA, 19 bp, Homo sapiens
cagagaaggcttcctccag

SEQ ID NO: 2852953 - DNA, 16 bp, Homo sapiens
cagagaagtcagttgg

SEQ ID NO: 2852954 - DNA, 21 bp, Homo sapiens
cagagaagtcagttggagaaa

SEQ ID NO: 2852955 - DNA, 18 bp, Homo sapiens
cagagaatctgaagctat

SEQ ID NO: 2852956 - DNA, 20 bp, Homo sapiens
cagagaatgaaagggcccag

SEQ ID NO: 2852957 - DNA, 21 bp, Homo sapiens
cagagaatgaaagggcccaga

SEQ ID NO: 2852958 - DNA, 23 bp, Homo sapiens
cagagaatttctaccatttcaga

SEQ ID NO: 2852959 - DNA, 17 bp, Homo sapiens
cagagacacctgcacct

SEQ ID NO: 2852960 - DNA, 20 bp, Homo sapiens
cagagacacctgcacctccc

SEQ ID NO: 2852961 - DNA, 14 bp, Homo sapiens
cagagacaggaaaa

SEQ ID NO: 2852962 - DNA, 15 bp, Homo sapiens
cagagacaggaaaat

SEQ ID NO: 2852963 - DNA, 14 bp, Homo sapiens
cagagacaggccca

SEQ ID NO: 2852964 - DNA, 19 bp, Homo sapiens
cagagacaggcccaagaga

SEQ ID NO: 2852965 - DNA, 15 bp, Homo sapiens
cagagacaggtggcc

SEQ ID NO: 2852966 - DNA, 18 bp, Homo sapiens
cagagacaggtggcctag

SEQ ID NO: 2852967 - DNA, 14 bp, Homo sapiens
cagagacccagatc

SEQ ID NO: 2852968 - DNA, 21 bp, Homo sapiens
cagagacccagatctcatgga

SEQ ID NO: 2852969 - DNA, 16 bp, Homo sapiens
cagagaccccttcctt

SEQ ID NO: 2852970 - DNA, 21 bp, Homo sapiens
cagagaccccttcctttcctc

SEQ ID NO: 2852971 - DNA, 22 bp, Homo sapiens
cagagaccccttcctttcctct

SEQ ID NO: 2852972 - DNA, 14 bp, Homo sapiens
cagagaccttgcga

SEQ ID NO: 2852973 - DNA, 23 bp, Homo sapiens
cagagaccttgcgaccatgtgta

SEQ ID NO: 2852974 - DNA, 20 bp, Homo sapiens
cagagactcagggccccagc

SEQ ID NO: 2852975 - DNA, 12 bp, Homo sapiens
cagagagaagcc

SEQ ID NO: 2852976 - DNA, 19 bp, Homo sapiens
cagcgagccctggtggcag

SEQ ID NO: 2852977 - DNA, 20 bp, Homo sapiens
cagcgagccctggtggcagt

SEQ ID NO: 2852978 - DNA, 23 bp, Homo sapiens
cagcgattccctctcccaggccc

SEQ ID NO: 2852979 - DNA, 12 bp, Homo sapiens
cagcgcctccct

SEQ ID NO: 2852980 - DNA, 16 bp, Homo sapiens
cagcgcctccctccac

SEQ ID NO: 2852981 - DNA, 20 bp, Homo sapiens
cagcgcctccctccacccca

SEQ ID NO: 2852982 - DNA, 16 bp, Homo sapiens
cagcggggacagctcc

SEQ ID NO: 2852983 - DNA, 13 bp, Homo sapiens
cagcgtggccttg

SEQ ID NO: 2852984 - DNA, 16 bp, Homo sapiens
cagctaatctgtaggg

SEQ ID NO: 2852985 - DNA, 21 bp, Homo sapiens
cagctaatctgtagggctgga

SEQ ID NO: 2852986 - DNA, 15 bp, Homo sapiens
cagctaatgggacac

SEQ ID NO: 2852987 - DNA, 18 bp, Homo sapiens
cagctacacctgaggctg

SEQ ID NO: 2852988 - DNA, 19 bp, Homo sapiens
cagctactcaagaggctga

SEQ ID NO: 2852989 - DNA, 23 bp, Homo sapiens
cagctactcaagaggctgaggca

SEQ ID NO: 2852990 - DNA, 21 bp, Homo sapiens
cagctactcagaagcctgagg

SEQ ID NO: 2852991 - DNA, 16 bp, Homo sapiens
cagctactcaggaggc

SEQ ID NO: 2852992 - DNA, 23 bp, Homo sapiens
cagctagaaataagcccaacaga

SEQ ID NO: 2852993 - DNA, 13 bp, Homo sapiens
cagctagggctgg

SEQ ID NO: 2852994 - DNA, 14 bp, Homo sapiens
cagctagggctgga

SEQ ID NO: 2852995 - DNA, 19 bp, Homo sapiens
cagctagtgacccacatgc

SEQ ID NO: 2852996 - DNA, 19 bp, Homo sapiens
cagctcaccagccccagtg

SEQ ID NO: 2852997 - DNA, 20 bp, Homo sapiens
cagctcaccagccccagtgc

SEQ ID NO: 2852998 - DNA, 14 bp, Homo sapiens
cagctcagaggccc

SEQ ID NO: 2852999 - DNA, 17 bp, Homo sapiens
cagctcagaggcccagg

SEQ ID NO: 2853000 - DNA, 12 bp, Homo sapiens
cagctcagcctc

SEQ ID NO: 2853001 - DNA, 16 bp, Homo sapiens
cagctcagcctccccc

SEQ ID NO: 2853002 - DNA, 12 bp, Homo sapiens
cagctcaggcac

SEQ ID NO: 2853003 - DNA, 12 bp, Homo sapiens
cagctcagtccc

SEQ ID NO: 2853004 - DNA, 19 bp, Homo sapiens
cagctcccaccccaccccc

SEQ ID NO: 2853005 - DNA, 20 bp, Homo sapiens
cagctccccaggactcaccc

SEQ ID NO: 2853006 - DNA, 21 bp, Homo sapiens
cagctccccaggactcaccct

SEQ ID NO: 2853007 - DNA, 18 bp, Homo sapiens
cagctcctctgtctcgag

SEQ ID NO: 2853008 - DNA, 19 bp, Homo sapiens
cagctcctctgtctcgagc

SEQ ID NO: 2853009 - DNA, 16 bp, Homo sapiens
cagctcctgggcagct

SEQ ID NO: 2853010 - DNA, 17 bp, Homo sapiens
cagctcctgggcagctt

SEQ ID NO: 2853011 - DNA, 23 bp, Homo sapiens
cagctccttctgtcctactctgt

SEQ ID NO: 2853012 - DNA, 14 bp, Homo sapiens
cagctctccctctg

SEQ ID NO: 2853013 - DNA, 18 bp, Homo sapiens
cagctctccctctggccc

SEQ ID NO: 2853014 - DNA, 21 bp, Homo sapiens
cagctctccctctggccctgc

SEQ ID NO: 2853015 - DNA, 23 bp, Homo sapiens
cagctctccctctggccctgcct

SEQ ID NO: 2853016 - DNA, 15 bp, Homo sapiens
cagctctctctaccc

SEQ ID NO: 2853017 - DNA, 16 bp, Homo sapiens
cagctctctctacccg

SEQ ID NO: 2853018 - DNA, 23 bp, Homo sapiens
cagctctctctacccggcccaga

SEQ ID NO: 2853019 - DNA, 16 bp, Homo sapiens
cagctctgtcctggga

SEQ ID NO: 2853020 - DNA, 15 bp, Homo sapiens
cagctcttctccagg

SEQ ID NO: 2853021 - DNA, 16 bp, Homo sapiens
cagctcttctccaggc

SEQ ID NO: 2853022 - DNA, 22 bp, Homo sapiens
cagctcttggcccctgtgtgag

SEQ ID NO: 2853023 - DNA, 15 bp, Homo sapiens
cagctgagcagggcc

SEQ ID NO: 2853024 - DNA, 20 bp, Homo sapiens
cagctgaggctgggggcggg

SEQ ID NO: 2853025 - DNA, 16 bp, Homo sapiens
cagctgcacctgccag

SEQ ID NO: 2853026 - DNA, 20 bp, Homo sapiens
cagctgcacctgccagcctg

SEQ ID NO: 2853027 - DNA, 19 bp, Homo sapiens
cagctgcagatgccacacc

SEQ ID NO: 2853028 - DNA, 22 bp, Homo sapiens
cagctgcagtcaacagttcaaa

SEQ ID NO: 2853029 - DNA, 17 bp, Homo sapiens
cagctgccgaccagagc

SEQ ID NO: 2853030 - DNA, 12 bp, Homo sapiens
cagctgcctgca

SEQ ID NO: 2853031 - DNA, 18 bp, Homo sapiens
cagctgcggtccacccag

SEQ ID NO: 2853032 - DNA, 19 bp, Homo sapiens
cagctgcggtccacccagg

SEQ ID NO: 2853033 - DNA, 22 bp, Homo sapiens
cagctgcggtccacccaggagc

SEQ ID NO: 2853034 - DNA, 16 bp, Homo sapiens
cagctgctcgcacaga

SEQ ID NO: 2853035 - DNA, 16 bp, Homo sapiens
cagctgtcattcagga

SEQ ID NO: 2853036 - DNA, 13 bp, Homo sapiens
cagctgtccctgt

SEQ ID NO: 2853037 - DNA, 15 bp, Homo sapiens
cagctgtccctgtca

SEQ ID NO: 2853038 - DNA, 22 bp, Homo sapiens
cagctgtccctgtcaccaagct

SEQ ID NO: 2853039 - DNA, 16 bp, Homo sapiens
cagctgtctgtggctt

SEQ ID NO: 2853040 - DNA, 19 bp, Homo sapiens
cagctgtgctctggacagg

SEQ ID NO: 2853041 - DNA, 24 bp, Homo sapiens
cagctgtgctctggacaggcatgt

SEQ ID NO: 2853042 - DNA, 15 bp, Homo sapiens
cagctgtttgtcata

SEQ ID NO: 2853043 - DNA, 23 bp, Homo sapiens
cagcttatggggtattttaagca

SEQ ID NO: 2853044 - DNA, 14 bp, Homo sapiens
cagcttcatcaatt

SEQ ID NO: 2853045 - DNA, 15 bp, Homo sapiens
cagcttcatcaattt

SEQ ID NO: 2853046 - DNA, 16 bp, Homo sapiens
cagcttcatcaatttt

SEQ ID NO: 2853047 - DNA, 23 bp, Homo sapiens
cagcttcatcaatttttatacat

SEQ ID NO: 2853048 - DNA, 18 bp, Homo sapiens
cagcttcatttcctgtgt

SEQ ID NO: 2853049 - DNA, 14 bp, Homo sapiens
cagcttgagagggc

SEQ ID NO: 2853050 - DNA, 21 bp, Homo sapiens
cagcttgagggttgggctggt

SEQ ID NO: 2853051 - DNA, 18 bp, Homo sapiens
cagcttgtaaatagctca

SEQ ID NO: 2853052 - DNA, 20 bp, Homo sapiens
cagcttgtaaatagctcagg

SEQ ID NO: 2853053 - DNA, 21 bp, Homo sapiens
cagcttgtaaatagctcaggt

SEQ ID NO: 2853054 - DNA, 15 bp, Homo sapiens
cagcttgtagccagc

SEQ ID NO: 2853055 - DNA, 16 bp, Homo sapiens
cagcttgtagccagcc

SEQ ID NO: 2853056 - DNA, 18 bp, Homo sapiens
cagcttgtagccagccgg

SEQ ID NO: 2853057 - DNA, 21 bp, Homo sapiens
cagcttgtggcaagtgaattt

SEQ ID NO: 2853058 - DNA, 17 bp, Homo sapiens
cagcttgttatttataa

SEQ ID NO: 2853059 - DNA, 14 bp, Homo sapiens
cagctttcctgtat

SEQ ID NO: 2853060 - DNA, 19 bp, Homo sapiens
cagctttttgtcttttctg

SEQ ID NO: 2853061 - DNA, 20 bp, Homo sapiens
caggaaaactgacagaggag

SEQ ID NO: 2853062 - DNA, 14 bp, Homo sapiens
caggaaaactgttt

SEQ ID NO: 2853063 - DNA, 15 bp, Homo sapiens
caggaaaactgtttt

SEQ ID NO: 2853064 - DNA, 19 bp, Homo sapiens
caggaaaagctgctgacag

SEQ ID NO: 2853065 - DNA, 20 bp, Homo sapiens
caggaaaagctgctgacagt

SEQ ID NO: 2853066 - DNA, 18 bp, Homo sapiens
cagtgctgttctggagct

SEQ ID NO: 2853067 - DNA, 16 bp, Homo sapiens
cagtgcttcagcctga

SEQ ID NO: 2853068 - DNA, 22 bp, Homo sapiens
cagtggacaccaggagtccctg

SEQ ID NO: 2853069 - DNA, 14 bp, Homo sapiens
cagtggagaaatat

SEQ ID NO: 2853070 - DNA, 18 bp, Homo sapiens
cagtggatcatgaaaagt

SEQ ID NO: 2853071 - DNA, 20 bp, Homo sapiens
cagtggatcatgaaaagtgc

SEQ ID NO: 2853072 - DNA, 15 bp, Homo sapiens
cagtggcagctgctt

SEQ ID NO: 2853073 - DNA, 15 bp, Homo sapiens
cagtgggaactggag

SEQ ID NO: 2853074 - DNA, 22 bp, Homo sapiens
cagtgggacaaaccagagcaga

SEQ ID NO: 2853075 - DNA, 11 bp, Homo sapiens
cagtgggagct

SEQ ID NO: 2853076 - DNA, 17 bp, Homo sapiens
cagtgggagctgcctgt

SEQ ID NO: 2853077 - DNA, 23 bp, Homo sapiens
cagtgggagctgcctgttcagct

SEQ ID NO: 2853078 - DNA, 15 bp, Homo sapiens
cagtggtaagctctg

SEQ ID NO: 2853079 - DNA, 17 bp, Homo sapiens
cagtggtaagctctggc

SEQ ID NO: 2853080 - DNA, 14 bp, Homo sapiens
cagtggtaccagct

SEQ ID NO: 2853081 - DNA, 15 bp, Homo sapiens
cagtggtaccagctc

SEQ ID NO: 2853082 - DNA, 11 bp, Homo sapiens
cagtgtaaaga

SEQ ID NO: 2853083 - DNA, 18 bp, Homo sapiens
cagtgtaaagaataaatg

SEQ ID NO: 2853084 - DNA, 19 bp, Homo sapiens
cagtgtaaagaataaatga

SEQ ID NO: 2853085 - DNA, 22 bp, Homo sapiens
cagtgtactgctttcaacttaa

SEQ ID NO: 2853086 - DNA, 20 bp, Homo sapiens
cagtgtcatttatgaaaaga

SEQ ID NO: 2853087 - DNA, 16 bp, Homo sapiens
cagtgtcttccataat

SEQ ID NO: 2853088 - DNA, 20 bp, Homo sapiens
cagtgtcttccataatgtat

SEQ ID NO: 2853089 - DNA, 22 bp, Homo sapiens
cagtgtcttccataatgtataa

SEQ ID NO: 2853090 - DNA, 18 bp, Homo sapiens
cagtgtgatcccaagtgc

SEQ ID NO: 2853091 - DNA, 19 bp, Homo sapiens
cagtgtgatcccaagtgcc

SEQ ID NO: 2853092 - DNA, 16 bp, Homo sapiens
cagtgtgcacccctcc

SEQ ID NO: 2853093 - DNA, 20 bp, Homo sapiens
cagtgtgcacccctccccat

SEQ ID NO: 2853094 - DNA, 16 bp, Homo sapiens
cagtgtgtcacactga

SEQ ID NO: 2853095 - DNA, 19 bp, Homo sapiens
cagtgttcctcaccaataa

SEQ ID NO: 2853096 - DNA, 18 bp, Homo sapiens
cagtgtttagaagagcct

SEQ ID NO: 2853097 - DNA, 20 bp, Homo sapiens
cagtgtttagaagagcctga

SEQ ID NO: 2853098 - DNA, 19 bp, Homo sapiens
cagttaactttaagactga

SEQ ID NO: 2853099 - DNA, 20 bp, Homo sapiens
cagttaactttcagaagaga

SEQ ID NO: 2853100 - DNA, 16 bp, Homo sapiens
cagttaatacttaaca

SEQ ID NO: 2853101 - DNA, 17 bp, Homo sapiens
cagttaatacttaacat

SEQ ID NO: 2853102 - DNA, 21 bp, Homo sapiens
cagttataagtagcaggccaa

SEQ ID NO: 2853103 - DNA, 16 bp, Homo sapiens
cagttatctaagttaa

SEQ ID NO: 2853104 - DNA, 17 bp, Homo sapiens
cagttcctcgccctggg

SEQ ID NO: 2853105 - DNA, 16 bp, Homo sapiens
cagttcgcagccaccc

SEQ ID NO: 2853106 - DNA, 19 bp, Homo sapiens
cagttcgcagccaccctga

SEQ ID NO: 2853107 - DNA, 22 bp, Homo sapiens
cagttcgcagccaccctgagga

SEQ ID NO: 2853108 - DNA, 16 bp, Homo sapiens
cagttctgctcctctc

SEQ ID NO: 2853109 - DNA, 18 bp, Homo sapiens
cagttctgctcctctcca

SEQ ID NO: 2853110 - DNA, 17 bp, Homo sapiens
cagttgacttactgttt

SEQ ID NO: 2853111 - DNA, 13 bp, Homo sapiens
cagttgcaataaa

SEQ ID NO: 2853112 - DNA, 16 bp, Homo sapiens
cagttgcaataaaata

SEQ ID NO: 2853113 - DNA, 17 bp, Homo sapiens
cagttgcaataaaatag

SEQ ID NO: 2853114 - DNA, 19 bp, Homo sapiens
cagttgcaataaaatagta

SEQ ID NO: 2853115 - DNA, 20 bp, Homo sapiens
cagttgccatgtagacccct

SEQ ID NO: 2853116 - DNA, 22 bp, Homo sapiens
cagttggcagaaaggatgtttt

SEQ ID NO: 2853117 - DNA, 18 bp, Homo sapiens
cagttgggagcactggag

SEQ ID NO: 2853118 - DNA, 21 bp, Homo sapiens
cagttgggagcactggagtgc

SEQ ID NO: 2853119 - DNA, 18 bp, Homo sapiens
cagttgggtggatgcctg

SEQ ID NO: 2853120 - DNA, 19 bp, Homo sapiens
cagtttatatttaactctc

SEQ ID NO: 2853121 - DNA, 18 bp, Homo sapiens
cagtttcaattcagtgct

SEQ ID NO: 2853122 - DNA, 20 bp, Homo sapiens
cagtttctcctttattgctc

SEQ ID NO: 2853123 - DNA, 22 bp, Homo sapiens
cagtttgcagaaaagcacctgc

SEQ ID NO: 2853124 - DNA, 16 bp, Homo sapiens
cagttttttatgctaa

SEQ ID NO: 2853125 - DNA, 21 bp, Homo sapiens
cagtttttttatggcattttt

SEQ ID NO: 2853126 - DNA, 19 bp, Homo sapiens
cataaaataaagtatatat

SEQ ID NO: 2853127 - DNA, 20 bp, Homo sapiens
cataaaataaagtatatata

SEQ ID NO: 2853128 - DNA, 14 bp, Homo sapiens
cataaactgtgtgc

SEQ ID NO: 2853129 - DNA, 18 bp, Homo sapiens
cataaccttaccagattt

SEQ ID NO: 2853130 - DNA, 12 bp, Homo sapiens
cataagaatgaa

SEQ ID NO: 2853131 - DNA, 21 bp, Homo sapiens
cataagaccataacagccaac

SEQ ID NO: 2853132 - DNA, 16 bp, Homo sapiens
cataagaccctaagcc

SEQ ID NO: 2853133 - DNA, 20 bp, Homo sapiens
cataagaccctaagcctcct

SEQ ID NO: 2853134 - DNA, 12 bp, Homo sapiens
cataagattaaa

SEQ ID NO: 2853135 - DNA, 21 bp, Homo sapiens
cataagattaaaggaaggaaa

SEQ ID NO: 2853136 - DNA, 19 bp, Homo sapiens
cataagttggaccagagga

SEQ ID NO: 2853137 - DNA, 19 bp, Homo sapiens
cataatctggactcctctg

SEQ ID NO: 2853138 - DNA, 15 bp, Homo sapiens
cataatgtataaaga

SEQ ID NO: 2853139 - DNA, 14 bp, Homo sapiens
cataattatgacag

SEQ ID NO: 2853140 - DNA, 15 bp, Homo sapiens
cataattatgacagt

SEQ ID NO: 2853141 - DNA, 17 bp, Homo sapiens
cataattatgacagtta

SEQ ID NO: 2853142 - DNA, 19 bp, Homo sapiens
cataattatgacagttata

SEQ ID NO: 2853143 - DNA, 17 bp, Homo sapiens
cataattcttgtatatt

SEQ ID NO: 2853144 - DNA, 22 bp, Homo sapiens
cataatttagtttcatataaag

SEQ ID NO: 2853145 - DNA, 12 bp, Homo sapiens
cataattttcaa

SEQ ID NO: 2853146 - DNA, 24 bp, Homo sapiens
catacacatccccagccagaagtt

SEQ ID NO: 2853147 - DNA, 17 bp, Homo sapiens
catacatttataatgtt

SEQ ID NO: 2853148 - DNA, 22 bp, Homo sapiens
catacatttataatgtttgcta

SEQ ID NO: 2853149 - DNA, 23 bp, Homo sapiens
catacatttataatgtttgctat

SEQ ID NO: 2853150 - DNA, 13 bp, Homo sapiens
cataccctccccc

SEQ ID NO: 2853151 - DNA, 14 bp, Homo sapiens
catacccttcttta

SEQ ID NO: 2853152 - DNA, 22 bp, Homo sapiens
catacctctctctatatataca

SEQ ID NO: 2853153 - DNA, 19 bp, Homo sapiens
catacctttattgtgatct

SEQ ID NO: 2853154 - DNA, 15 bp, Homo sapiens
catagacagaagaaa

SEQ ID NO: 2853155 - DNA, 19 bp, Homo sapiens
catagatagtgctttattt

SEQ ID NO: 2853156 - DNA, 19 bp, Homo sapiens
cattatagattttcatgtt

SEQ ID NO: 2853157 - DNA, 16 bp, Homo sapiens
cattatcgggagcagt

SEQ ID NO: 2853158 - DNA, 13 bp, Homo sapiens
cattattatcaac

SEQ ID NO: 2853159 - DNA, 18 bp, Homo sapiens
cattattggaatataatt

SEQ ID NO: 2853160 - DNA, 23 bp, Homo sapiens
cattatttcaaccgcttgccata

SEQ ID NO: 2853161 - DNA, 13 bp, Homo sapiens
cattatttgcatg

SEQ ID NO: 2853162 - DNA, 15 bp, Homo sapiens
cattcaagcctgtga

SEQ ID NO: 2853163 - DNA, 17 bp, Homo sapiens
cattcacatttgatgta

SEQ ID NO: 2853164 - DNA, 13 bp, Homo sapiens
cattcagaagaaa

SEQ ID NO: 2853165 - DNA, 15 bp, Homo sapiens
cattcagacacttca

SEQ ID NO: 2853166 - DNA, 23 bp, Homo sapiens
cattcaggaaaactgacagagga

SEQ ID NO: 2853167 - DNA, 11 bp, Homo sapiens
cattccatgat

SEQ ID NO: 2853168 - DNA, 22 bp, Homo sapiens
cattccccaattatcttattta

SEQ ID NO: 2853169 - DNA, 20 bp, Homo sapiens
cattcccctcgtgtgactct

SEQ ID NO: 2853170 - DNA, 15 bp, Homo sapiens
cattccctatcaaaa

SEQ ID NO: 2853171 - DNA, 23 bp, Homo sapiens
cattccctatcaaaacatatcaa

SEQ ID NO: 2853172 - DNA, 24 bp, Homo sapiens
cattccctatcaaaacatatcaat

SEQ ID NO: 2853173 - DNA, 20 bp, Homo sapiens
cattccctgagtcaccagga

SEQ ID NO: 2853174 - DNA, 13 bp, Homo sapiens
cattccctggcct

SEQ ID NO: 2853175 - DNA, 14 bp, Homo sapiens
cattccctggcctg

SEQ ID NO: 2853176 - DNA, 15 bp, Homo sapiens
cattccctggcctgg

SEQ ID NO: 2853177 - DNA, 18 bp, Homo sapiens
cattccctggcctggctc

SEQ ID NO: 2853178 - DNA, 23 bp, Homo sapiens
cattcccttggatgtagtctgag

SEQ ID NO: 2853179 - DNA, 23 bp, Homo sapiens
cattcctcagggacagagacacc

SEQ ID NO: 2853180 - DNA, 18 bp, Homo sapiens
cattctctctcctgtcca

SEQ ID NO: 2853181 - DNA, 17 bp, Homo sapiens
cattctgaccatttcag

SEQ ID NO: 2853182 - DNA, 17 bp, Homo sapiens
cattctgcctgcccagg

SEQ ID NO: 2853183 - DNA, 20 bp, Homo sapiens
cattctgcctgcccaggccc

SEQ ID NO: 2853184 - DNA, 13 bp, Homo sapiens
cattcttcctagt

SEQ ID NO: 2853185 - DNA, 18 bp, Homo sapiens
cattcttcctagttttct

SEQ ID NO: 2853186 - DNA, 14 bp, Homo sapiens
cattcttgtcctgg

SEQ ID NO: 2853187 - DNA, 22 bp, Homo sapiens
cattgaaagagaaccagtttca

SEQ ID NO: 2853188 - DNA, 23 bp, Homo sapiens
cattgaccaagatgatcacatgg

SEQ ID NO: 2853189 - DNA, 22 bp, Homo sapiens
cattgagggaaaacataatatc

SEQ ID NO: 2853190 - DNA, 23 bp, Homo sapiens
cattgagtttaagtctctgactc

SEQ ID NO: 2853191 - DNA, 17 bp, Homo sapiens
cattgcggacagccacg

SEQ ID NO: 2853192 - DNA, 16 bp, Homo sapiens
cattggcagtgtgtca

SEQ ID NO: 2853193 - DNA, 15 bp, Homo sapiens
cattgtagagcttct

SEQ ID NO: 2853194 - DNA, 16 bp, Homo sapiens
cattgtataaaaatag

SEQ ID NO: 2853195 - DNA, 19 bp, Homo sapiens
cattgtgtgagcttctaca

SEQ ID NO: 2853196 - DNA, 17 bp, Homo sapiens
cattgtttattaacaaa

SEQ ID NO: 2853197 - DNA, 15 bp, Homo sapiens
catttaaatattaat

SEQ ID NO: 2853198 - DNA, 18 bp, Homo sapiens
catttaagggaaaaatat

SEQ ID NO: 2853199 - DNA, 18 bp, Homo sapiens
catttacaataaatattc

SEQ ID NO: 2853200 - DNA, 20 bp, Homo sapiens
catttagttctttgttattt

SEQ ID NO: 2853201 - DNA, 17 bp, Homo sapiens
catttatatatatatgt

SEQ ID NO: 2853202 - DNA, 18 bp, Homo sapiens
catttatatatatatgta

SEQ ID NO: 2853203 - DNA, 17 bp, Homo sapiens
catttatgagctcttca

SEQ ID NO: 2853204 - DNA, 23 bp, Homo sapiens
catttatgagctcttcatgtttc

SEQ ID NO: 2853205 - DNA, 14 bp, Homo sapiens
catttattctgctc

SEQ ID NO: 2853206 - DNA, 14 bp, Homo sapiens
catttattttgaca

SEQ ID NO: 2853207 - DNA, 14 bp, Homo sapiens
catttcactttaaa

SEQ ID NO: 2853208 - DNA, 15 bp, Homo sapiens
catttcactttaaag

SEQ ID NO: 2853209 - DNA, 21 bp, Homo sapiens
catttcactttaaagtctttc

SEQ ID NO: 2853210 - DNA, 16 bp, Homo sapiens
catttcatctatttct

SEQ ID NO: 2853211 - DNA, 18 bp, Homo sapiens
catttcatctatttctga

SEQ ID NO: 2853212 - DNA, 20 bp, Homo sapiens
catttcatctatttctgaga

SEQ ID NO: 2853213 - DNA, 14 bp, Homo sapiens
catttcatctcatt

SEQ ID NO: 2853214 - DNA, 10 bp, Homo sapiens
catttccctc

SEQ ID NO: 2853215 - DNA, 15 bp, Homo sapiens
catttccctcccggg

SEQ ID NO: 2853216 - DNA, 12 bp, Homo sapiens
catttccctcct

SEQ ID NO: 2853217 - DNA, 14 bp, Homo sapiens
catttcctgggtgg

SEQ ID NO: 2853218 - DNA, 12 bp, Homo sapiens
catttcctgtgt

SEQ ID NO: 2853219 - DNA, 12 bp, Homo sapiens
catttccttgga

SEQ ID NO: 2853220 - DNA, 13 bp, Homo sapiens
catttccttggag

SEQ ID NO: 2853221 - DNA, 21 bp, Homo sapiens
catttcgcccctcatttatcc

SEQ ID NO: 2853222 - DNA, 18 bp, Homo sapiens
catttctactgtgactga

SEQ ID NO: 2853223 - DNA, 17 bp, Homo sapiens
catttcttaaaatgttt

SEQ ID NO: 2853224 - DNA, 14 bp, Homo sapiens
catttgagcagggc

SEQ ID NO: 2853225 - DNA, 17 bp, Homo sapiens
catttgagcagggctca

SEQ ID NO: 2853226 - DNA, 18 bp, Homo sapiens
catttgagcagggctcag

SEQ ID NO: 2853227 - DNA, 20 bp, Homo sapiens
catttgagcagggctcagcg

SEQ ID NO: 2853228 - DNA, 14 bp, Homo sapiens
catttgatgctaaa

SEQ ID NO: 2853229 - DNA, 15 bp, Homo sapiens
catttgatgctaaat

SEQ ID NO: 2853230 - DNA, 14 bp, Homo sapiens
catttgatgtacat

SEQ ID NO: 2853231 - DNA, 15 bp, Homo sapiens
catttgatgtacatg

SEQ ID NO: 2853232 - DNA, 15 bp, Homo sapiens
catttgcaccctccg

SEQ ID NO: 2853233 - DNA, 17 bp, Homo sapiens
catttgtaatgtatctt

SEQ ID NO: 2853234 - DNA, 23 bp, Homo sapiens
catttgtaatgtatcttatttat

SEQ ID NO: 2853235 - DNA, 17 bp, Homo sapiens
catttgtcacacacttt

SEQ ID NO: 2853236 - DNA, 17 bp, Homo sapiens
cattttactacttgtta

SEQ ID NO: 2853237 - DNA, 15 bp, Homo sapiens
cattttatttattag

SEQ ID NO: 2853238 - DNA, 16 bp, Homo sapiens
cattttcagagtgaca

SEQ ID NO: 2853239 - DNA, 21 bp, Homo sapiens
cattttcgctttcctctggtt

SEQ ID NO: 2853240 - DNA, 14 bp, Homo sapiens
cattttctctagct

SEQ ID NO: 2853241 - DNA, 18 bp, Homo sapiens
cattttctctttaaaaga

SEQ ID NO: 2853242 - DNA, 13 bp, Homo sapiens
cattttgcaaaat

SEQ ID NO: 2853243 - DNA, 17 bp, Homo sapiens
cattttgcaaaatttcc

SEQ ID NO: 2853244 - DNA, 20 bp, Homo sapiens
cattttggaagttttcagga

SEQ ID NO: 2853245 - DNA, 22 bp, Homo sapiens
cattttggggtacccactgctc

SEQ ID NO: 2853246 - DNA, 23 bp, Homo sapiens
cattttgtacaaagatatgctaa

SEQ ID NO: 2853247 - DNA, 15 bp, Homo sapiens
ccagagggcccaggc

SEQ ID NO: 2853248 - DNA, 18 bp, Homo sapiens
ccagagtgtgggaaggga

SEQ ID NO: 2853249 - DNA, 21 bp, Homo sapiens
ccagagtgtgggaagggagag

SEQ ID NO: 2853250 - DNA, 14 bp, Homo sapiens
ccagatctcatgga

SEQ ID NO: 2853251 - DNA, 14 bp, Homo sapiens
ccagatgagaagtt

SEQ ID NO: 2853252 - DNA, 15 bp, Homo sapiens
ccagatgagaagtta

SEQ ID NO: 2853253 - DNA, 23 bp, Homo sapiens
ccagatgcaccagcccttagcag

SEQ ID NO: 2853254 - DNA, 20 bp, Homo sapiens
ccagattgcaacaggctggg

SEQ ID NO: 2853255 - DNA, 22 bp, Homo sapiens
ccagattgcaacaggctgggct

SEQ ID NO: 2853256 - DNA, 23 bp, Homo sapiens
ccagattgcaacaggctgggctt

SEQ ID NO: 2853257 - DNA, 21 bp, Homo sapiens
ccagatttgctaatttatcct

SEQ ID NO: 2853258 - DNA, 24 bp, Homo sapiens
ccagattttttacagctgcctgca

SEQ ID NO: 2853259 - DNA, 16 bp, Homo sapiens
ccagcaagtgagagct

SEQ ID NO: 2853260 - DNA, 17 bp, Homo sapiens
ccagcactaaagcagtg

SEQ ID NO: 2853261 - DNA, 21 bp, Homo sapiens
ccagcactcctctgtctctgc

SEQ ID NO: 2853262 - DNA, 18 bp, Homo sapiens
ccagcactgtgaagaccc

SEQ ID NO: 2853263 - DNA, 21 bp, Homo sapiens
ccagcactttgggaggctgag

SEQ ID NO: 2853264 - DNA, 12 bp, Homo sapiens
ccagcagaaaag

SEQ ID NO: 2853265 - DNA, 14 bp, Homo sapiens
ccagcagaaaagtg

SEQ ID NO: 2853266 - DNA, 17 bp, Homo sapiens
ccagcagaaaagtgctt

SEQ ID NO: 2853267 - DNA, 22 bp, Homo sapiens
ccagcagaaaagtgcttagaaa

SEQ ID NO: 2853268 - DNA, 15 bp, Homo sapiens
ccagcagccagctct

SEQ ID NO: 2853269 - DNA, 19 bp, Homo sapiens
ccagcagccagctctcagc

SEQ ID NO: 2853270 - DNA, 12 bp, Homo sapiens
ccagcagcccta

SEQ ID NO: 2853271 - DNA, 19 bp, Homo sapiens
ccagcatgtcactcccaga

SEQ ID NO: 2853272 - DNA, 17 bp, Homo sapiens
ccagcattttactactt

SEQ ID NO: 2853273 - DNA, 12 bp, Homo sapiens
ccagccacctct

SEQ ID NO: 2853274 - DNA, 22 bp, Homo sapiens
ccagccactcgggaggctgaga

SEQ ID NO: 2853275 - DNA, 21 bp, Homo sapiens
ccagccagaagcctctgcctc

SEQ ID NO: 2853276 - DNA, 12 bp, Homo sapiens
ccagccagcgcc

SEQ ID NO: 2853277 - DNA, 20 bp, Homo sapiens
ccagccagcgcctccctcca

SEQ ID NO: 2853278 - DNA, 22 bp, Homo sapiens
ccagccagcgcctccctccacc

SEQ ID NO: 2853279 - DNA, 12 bp, Homo sapiens
ccagccagctcc

SEQ ID NO: 2853280 - DNA, 18 bp, Homo sapiens
ccagccatcaagagactg

SEQ ID NO: 2853281 - DNA, 16 bp, Homo sapiens
ccagcccacttctgcc

SEQ ID NO: 2853282 - DNA, 17 bp, Homo sapiens
ccagcccacttctgcca

SEQ ID NO: 2853283 - DNA, 12 bp, Homo sapiens
ccagcccagccc

SEQ ID NO: 2853284 - DNA, 18 bp, Homo sapiens
ccagcccagcccagctgg

SEQ ID NO: 2853285 - DNA, 19 bp, Homo sapiens
ccagcccattctctctcct

SEQ ID NO: 2853286 - DNA, 14 bp, Homo sapiens
ccagccccagcaag

SEQ ID NO: 2853287 - DNA, 22 bp, Homo sapiens
ccagccccagcaagagcacaag

SEQ ID NO: 2853288 - DNA, 15 bp, Homo sapiens
ccagccccagtgccc

SEQ ID NO: 2853289 - DNA, 16 bp, Homo sapiens
ccagccccagtgccca

SEQ ID NO: 2853290 - DNA, 15 bp, Homo sapiens
ccagccccgactcca

SEQ ID NO: 2853291 - DNA, 17 bp, Homo sapiens
ccagccccgactccagc

SEQ ID NO: 2853292 - DNA, 21 bp, Homo sapiens
ccagccccgactccagccagc

SEQ ID NO: 2853293 - DNA, 22 bp, Homo sapiens
ccagcccctcctccccttcctg

SEQ ID NO: 2853294 - DNA, 24 bp, Homo sapiens
ccagcccctcctccccttcctgca

SEQ ID NO: 2853295 - DNA, 13 bp, Homo sapiens
ccagcccggcctg

SEQ ID NO: 2853296 - DNA, 15 bp, Homo sapiens
ccagcccggcctgct

SEQ ID NO: 2853297 - DNA, 19 bp, Homo sapiens
ccagcccggcctgctccca

SEQ ID NO: 2853298 - DNA, 14 bp, Homo sapiens
ccagccctccctgt

SEQ ID NO: 2853299 - DNA, 16 bp, Homo sapiens
ccagccctccctgtcc

SEQ ID NO: 2853300 - DNA, 17 bp, Homo sapiens
ccagccctccctgtcct

SEQ ID NO: 2853301 - DNA, 18 bp, Homo sapiens
ccagccctccctgtcctc

SEQ ID NO: 2853302 - DNA, 21 bp, Homo sapiens
ccagccctccctgtcctcctc

SEQ ID NO: 2853303 - DNA, 13 bp, Homo sapiens
ccagccctgcctg

SEQ ID NO: 2853304 - DNA, 17 bp, Homo sapiens
ccagccctgcctggagg

SEQ ID NO: 2853305 - DNA, 16 bp, Homo sapiens
ccagcccttagcaggg

SEQ ID NO: 2853306 - DNA, 17 bp, Homo sapiens
ccagcccttagcaggga

SEQ ID NO: 2853307 - DNA, 17 bp, Homo sapiens
ccagcccttccctgctt

SEQ ID NO: 2853308 - DNA, 20 bp, Homo sapiens
ccagccggggcgagtggcac

SEQ ID NO: 2853309 - DNA, 19 bp, Homo sapiens
ccagccgggtacctcagtt

SEQ ID NO: 2853310 - DNA, 16 bp, Homo sapiens
ccagccggtgcctggc

SEQ ID NO: 2853311 - DNA, 21 bp, Homo sapiens
ccagccgtgatgctcaggctt

SEQ ID NO: 2853312 - DNA, 16 bp, Homo sapiens
ccagcctaagaagctc

SEQ ID NO: 2853313 - DNA, 15 bp, Homo sapiens
ccagcctccatgctg

SEQ ID NO: 2853314 - DNA, 16 bp, Homo sapiens
ccagcctccatgctgc

SEQ ID NO: 2853315 - DNA, 18 bp, Homo sapiens
ccagcctcgcatgccaga

SEQ ID NO: 2853316 - DNA, 13 bp, Homo sapiens
ccagcctctgtcc

SEQ ID NO: 2853317 - DNA, 13 bp, Homo sapiens
ccagcctggcctc

SEQ ID NO: 2853318 - DNA, 14 bp, Homo sapiens
ccagcctggcctcc

SEQ ID NO: 2853319 - DNA, 17 bp, Homo sapiens
ccagcctggcctcctgc

SEQ ID NO: 2853320 - DNA, 19 bp, Homo sapiens
ccagcctggcctcctgcct

SEQ ID NO: 2853321 - DNA, 18 bp, Homo sapiens
ccagcctggcttctggag

SEQ ID NO: 2853322 - DNA, 19 bp, Homo sapiens
ccagcctgggcaacagagc

SEQ ID NO: 2853323 - DNA, 17 bp, Homo sapiens
ccagcctgggcctatgg

SEQ ID NO: 2853324 - DNA, 19 bp, Homo sapiens
ccagcctgggcctatggag

SEQ ID NO: 2853325 - DNA, 20 bp, Homo sapiens
ccagcctgttggacccgctc

SEQ ID NO: 2853326 - DNA, 16 bp, Homo sapiens
ccagccttctctctct

SEQ ID NO: 2853327 - DNA, 21 bp, Homo sapiens
ccagcgagccctggtggcagt

SEQ ID NO: 2853328 - DNA, 18 bp, Homo sapiens
ccagcgcctccctccacc

SEQ ID NO: 2853329 - DNA, 21 bp, Homo sapiens
ccagcgcctccctccacccca

SEQ ID NO: 2853330 - DNA, 22 bp, Homo sapiens
ccagcgcctccctccaccccag

SEQ ID NO: 2853331 - DNA, 21 bp, Homo sapiens
ccagcgtcagaggccctggag

SEQ ID NO: 2853332 - DNA, 20 bp, Homo sapiens
ccagctaatctgtagggctg

SEQ ID NO: 2853333 - DNA, 17 bp, Homo sapiens
ccagctactcagaagcc

SEQ ID NO: 2853334 - DNA, 21 bp, Homo sapiens
ccagctactcagaagcctgag

SEQ ID NO: 2853335 - DNA, 19 bp, Homo sapiens
ccagctactcaggaggctg

SEQ ID NO: 2853336 - DNA, 20 bp, Homo sapiens
ccagctactcaggaggctga

SEQ ID NO: 2853337 - DNA, 16 bp, Homo sapiens
cccactctgctctgat

SEQ ID NO: 2853338 - DNA, 17 bp, Homo sapiens
cccactctgctctgatg

SEQ ID NO: 2853339 - DNA, 19 bp, Homo sapiens
cccactgcaggccccgctt

SEQ ID NO: 2853340 - DNA, 13 bp, Homo sapiens
cccactgctctgg

SEQ ID NO: 2853341 - DNA, 22 bp, Homo sapiens
cccactgtgcttacagtgactg

SEQ ID NO: 2853342 - DNA, 20 bp, Homo sapiens
cccacttctctactctggaa

SEQ ID NO: 2853343 - DNA, 14 bp, Homo sapiens
cccacttctctcca

SEQ ID NO: 2853344 - DNA, 18 bp, Homo sapiens
cccacttctctccaggct

SEQ ID NO: 2853345 - DNA, 18 bp, Homo sapiens
cccagaaaacctccagta

SEQ ID NO: 2853346 - DNA, 23 bp, Homo sapiens
cccagaaggcagggaaaggctct

SEQ ID NO: 2853347 - DNA, 17 bp, Homo sapiens
cccagaattcccagctg

SEQ ID NO: 2853348 - DNA, 17 bp, Homo sapiens
cccagaccacctccctg

SEQ ID NO: 2853349 - DNA, 14 bp, Homo sapiens
cccagactcagctc

SEQ ID NO: 2853350 - DNA, 16 bp, Homo sapiens
cccagactcagctcca

SEQ ID NO: 2853351 - DNA, 13 bp, Homo sapiens
cccagagacagga

SEQ ID NO: 2853352 - DNA, 15 bp, Homo sapiens
cccagagaggaatca

SEQ ID NO: 2853353 - DNA, 19 bp, Homo sapiens
cccagagaggaatcagact

SEQ ID NO: 2853354 - DNA, 23 bp, Homo sapiens
cccagagaggggacatttccctc

SEQ ID NO: 2853355 - DNA, 14 bp, Homo sapiens
cccagagatgcctc

SEQ ID NO: 2853356 - DNA, 16 bp, Homo sapiens
cccagagatgcctcca

SEQ ID NO: 2853357 - DNA, 17 bp, Homo sapiens
cccagagatgcctccac

SEQ ID NO: 2853358 - DNA, 18 bp, Homo sapiens
cccagagatgcctccacc

SEQ ID NO: 2853359 - DNA, 14 bp, Homo sapiens
cccagagccttctc

SEQ ID NO: 2853360 - DNA, 17 bp, Homo sapiens
cccagagccttctcctg

SEQ ID NO: 2853361 - DNA, 22 bp, Homo sapiens
cccagagggcccaggcaggcca

SEQ ID NO: 2853362 - DNA, 16 bp, Homo sapiens
cccagcaagtgagagc

SEQ ID NO: 2853363 - DNA, 19 bp, Homo sapiens
cccagcaagtgagagctgg

SEQ ID NO: 2853364 - DNA, 20 bp, Homo sapiens
cccagcaagtgagagctggg

SEQ ID NO: 2853365 - DNA, 22 bp, Homo sapiens
cccagcaagtgagagctgggtg

SEQ ID NO: 2853366 - DNA, 23 bp, Homo sapiens
cccagcaagtgagagctgggtgt

SEQ ID NO: 2853367 - DNA, 15 bp, Homo sapiens
cccagcactcctctg

SEQ ID NO: 2853368 - DNA, 19 bp, Homo sapiens
cccagcactcctctgtctc

SEQ ID NO: 2853369 - DNA, 12 bp, Homo sapiens
cccagcactgtg

SEQ ID NO: 2853370 - DNA, 15 bp, Homo sapiens
cccagcactttggga

SEQ ID NO: 2853371 - DNA, 23 bp, Homo sapiens
cccagcactttgggaggctgaag

SEQ ID NO: 2853372 - DNA, 22 bp, Homo sapiens
cccagcagccctaaggatctct

SEQ ID NO: 2853373 - DNA, 16 bp, Homo sapiens
cccagcaggaagccag

SEQ ID NO: 2853374 - DNA, 20 bp, Homo sapiens
cccagcaggaagccaggctg

SEQ ID NO: 2853375 - DNA, 16 bp, Homo sapiens
cccagcccaaagctgt

SEQ ID NO: 2853376 - DNA, 22 bp, Homo sapiens
cccagcccattctctctcctgt

SEQ ID NO: 2853377 - DNA, 12 bp, Homo sapiens
cccagcccccac

SEQ ID NO: 2853378 - DNA, 16 bp, Homo sapiens
cccagccccgactcca

SEQ ID NO: 2853379 - DNA, 19 bp, Homo sapiens
cccagccccgactccagcc

SEQ ID NO: 2853380 - DNA, 20 bp, Homo sapiens
cccagcctccaagctccatc

SEQ ID NO: 2853381 - DNA, 17 bp, Homo sapiens
cccagcctcgcatgcca

SEQ ID NO: 2853382 - DNA, 16 bp, Homo sapiens
cccagcctctgtccct

SEQ ID NO: 2853383 - DNA, 11 bp, Homo sapiens
cccagcctggg

SEQ ID NO: 2853384 - DNA, 12 bp, Homo sapiens
cccagcctgggc

SEQ ID NO: 2853385 - DNA, 13 bp, Homo sapiens
cccagcctgggcc

SEQ ID NO: 2853386 - DNA, 15 bp, Homo sapiens
cccagcctgggccta

SEQ ID NO: 2853387 - DNA, 18 bp, Homo sapiens
cccagcctgggcctatgg

SEQ ID NO: 2853388 - DNA, 20 bp, Homo sapiens
cccagctaatctgtagggct

SEQ ID NO: 2853389 - DNA, 22 bp, Homo sapiens
cccagctactcagaagcctgag

SEQ ID NO: 2853390 - DNA, 16 bp, Homo sapiens
cccagctagggctgga

SEQ ID NO: 2853391 - DNA, 17 bp, Homo sapiens
cccagctagggctggac

SEQ ID NO: 2853392 - DNA, 12 bp, Homo sapiens
cccagctcccca

SEQ ID NO: 2853393 - DNA, 14 bp, Homo sapiens
cccagctccccagg

SEQ ID NO: 2853394 - DNA, 18 bp, Homo sapiens
cccagctccccaggactc

SEQ ID NO: 2853395 - DNA, 15 bp, Homo sapiens
cccagctccctagga

SEQ ID NO: 2853396 - DNA, 14 bp, Homo sapiens
cccagctctccctc

SEQ ID NO: 2853397 - DNA, 21 bp, Homo sapiens
cccagctctccctctggccct

SEQ ID NO: 2853398 - DNA, 13 bp, Homo sapiens
cccagctgcacct

SEQ ID NO: 2853399 - DNA, 12 bp, Homo sapiens
cccagctgcaga

SEQ ID NO: 2853400 - DNA, 16 bp, Homo sapiens
cccagctgtctgtgtc

SEQ ID NO: 2853401 - DNA, 15 bp, Homo sapiens
cccaggaactgggcc

SEQ ID NO: 2853402 - DNA, 19 bp, Homo sapiens
cccaggacgccactcattt

SEQ ID NO: 2853403 - DNA, 14 bp, Homo sapiens
cccaggagagccag

SEQ ID NO: 2853404 - DNA, 19 bp, Homo sapiens
cccaggagagccagccctc

SEQ ID NO: 2853405 - DNA, 22 bp, Homo sapiens
cccaggagagccagccctccct

SEQ ID NO: 2853406 - DNA, 23 bp, Homo sapiens
cccaggaggtggaggttgcagtg

SEQ ID NO: 2853407 - DNA, 24 bp, Homo sapiens
cccaggagttcgaggctgcagtca

SEQ ID NO: 2853408 - DNA, 14 bp, Homo sapiens
cccaggcaggccac

SEQ ID NO: 2853409 - DNA, 13 bp, Homo sapiens
cccaggcaggtct

SEQ ID NO: 2853410 - DNA, 17 bp, Homo sapiens
cccaggcaggtcttgaa

SEQ ID NO: 2853411 - DNA, 21 bp, Homo sapiens
cccaggcccctgccaccctgg

SEQ ID NO: 2853412 - DNA, 21 bp, Homo sapiens
cccaggctggcgtgcagtggt

SEQ ID NO: 2853413 - DNA, 13 bp, Homo sapiens
cccagggcacagg

SEQ ID NO: 2853414 - DNA, 14 bp, Homo sapiens
cccagggcacagga

SEQ ID NO: 2853415 - DNA, 17 bp, Homo sapiens
cccagggcacaggagct

SEQ ID NO: 2853416 - DNA, 21 bp, Homo sapiens
cccagggcatcccatgggggt

SEQ ID NO: 2853417 - DNA, 20 bp, Homo sapiens
cccagggccagggccctgca

SEQ ID NO: 2853418 - DNA, 16 bp, Homo sapiens
cccagggcccccacag

SEQ ID NO: 2853419 - DNA, 20 bp, Homo sapiens
cccagggcccccacaggccc

SEQ ID NO: 2853420 - DNA, 17 bp, Homo sapiens
cccaggggaccacacct

SEQ ID NO: 2853421 - DNA, 13 bp, Homo sapiens
cccaggggagagg

SEQ ID NO: 2853422 - DNA, 23 bp, Homo sapiens
cccaggggagagggtctggagaa

SEQ ID NO: 2853423 - DNA, 24 bp, Homo sapiens
cccaggggagagggtctggagaag

SEQ ID NO: 2853424 - DNA, 18 bp, Homo sapiens
cccaggggctccacctgt

SEQ ID NO: 2853425 - DNA, 20 bp, Homo sapiens
cccaggtcctctgataccca

SEQ ID NO: 2853426 - DNA, 15 bp, Homo sapiens
cccaggtctctccac

SEQ ID NO: 2853427 - DNA, 18 bp, Homo sapiens
cccaggtctctccactgc

SEQ ID NO: 2853428 - DNA, 20 bp, Homo sapiens
ccctgccacactcagtcccc

SEQ ID NO: 2853429 - DNA, 12 bp, Homo sapiens
ccctgccaccct

SEQ ID NO: 2853430 - DNA, 17 bp, Homo sapiens
ccctgccaccctgggga

SEQ ID NO: 2853431 - DNA, 18 bp, Homo sapiens
ccctgccaccctggggag

SEQ ID NO: 2853432 - DNA, 12 bp, Homo sapiens
ccctgccagtgt

SEQ ID NO: 2853433 - DNA, 14 bp, Homo sapiens
ccctgcccggctgc

SEQ ID NO: 2853434 - DNA, 13 bp, Homo sapiens
ccctgccctgctg

SEQ ID NO: 2853435 - DNA, 14 bp, Homo sapiens
ccctgccgcctcaa

SEQ ID NO: 2853436 - DNA, 15 bp, Homo sapiens
ccctgcctggaggac

SEQ ID NO: 2853437 - DNA, 16 bp, Homo sapiens
ccctgcctggaggacc

SEQ ID NO: 2853438 - DNA, 19 bp, Homo sapiens
ccctgcctggaggacctga

SEQ ID NO: 2853439 - DNA, 21 bp, Homo sapiens
ccctgcctggaggacctgagc

SEQ ID NO: 2853440 - DNA, 21 bp, Homo sapiens
ccctgctctccgaccagacac

SEQ ID NO: 2853441 - DNA, 23 bp, Homo sapiens
ccctgctgccgcctcccagcctg

SEQ ID NO: 2853442 - DNA, 12 bp, Homo sapiens
ccctgcttctca

SEQ ID NO: 2853443 - DNA, 15 bp, Homo sapiens
ccctggaactgtctc

SEQ ID NO: 2853444 - DNA, 17 bp, Homo sapiens
ccctggaccaccagccc

SEQ ID NO: 2853445 - DNA, 19 bp, Homo sapiens
ccctggaccaccagcccca

SEQ ID NO: 2853446 - DNA, 21 bp, Homo sapiens
ccctggaccaccagccccagc

SEQ ID NO: 2853447 - DNA, 19 bp, Homo sapiens
ccctggatcagcgtggcct

SEQ ID NO: 2853448 - DNA, 21 bp, Homo sapiens
ccctggatcagcgtggccttg

SEQ ID NO: 2853449 - DNA, 20 bp, Homo sapiens
ccctggcaggatgaccctgc

SEQ ID NO: 2853450 - DNA, 13 bp, Homo sapiens
ccctggcctgctg

SEQ ID NO: 2853451 - DNA, 21 bp, Homo sapiens
ccctggcctgctgggctctcc

SEQ ID NO: 2853452 - DNA, 22 bp, Homo sapiens
ccctggcctgctgggctctcca

SEQ ID NO: 2853453 - DNA, 19 bp, Homo sapiens
ccctggcctggctctcctg

SEQ ID NO: 2853454 - DNA, 10 bp, Homo sapiens
ccctggctct

SEQ ID NO: 2853455 - DNA, 13 bp, Homo sapiens
ccctggctcttct

SEQ ID NO: 2853456 - DNA, 20 bp, Homo sapiens
ccctggcttgtaactccacc

SEQ ID NO: 2853457 - DNA, 14 bp, Homo sapiens
ccctgggcctgctg

SEQ ID NO: 2853458 - DNA, 19 bp, Homo sapiens
ccctgggcctgctgctgag

SEQ ID NO: 2853459 - DNA, 16 bp, Homo sapiens
ccctgggctctgcccc

SEQ ID NO: 2853460 - DNA, 13 bp, Homo sapiens
ccctggggcctgt

SEQ ID NO: 2853461 - DNA, 17 bp, Homo sapiens
ccctggggcctgtactg

SEQ ID NO: 2853462 - DNA, 18 bp, Homo sapiens
ccctggggcctgtactgc

SEQ ID NO: 2853463 - DNA, 21 bp, Homo sapiens
ccctggggcctgtactgcctg

SEQ ID NO: 2853464 - DNA, 18 bp, Homo sapiens
ccctgggggctagcagaa

SEQ ID NO: 2853465 - DNA, 17 bp, Homo sapiens
ccctggtggacagtcct

SEQ ID NO: 2853466 - DNA, 19 bp, Homo sapiens
ccctggtggacagtcctgg

SEQ ID NO: 2853467 - DNA, 13 bp, Homo sapiens
ccctggtggcagt

SEQ ID NO: 2853468 - DNA, 20 bp, Homo sapiens
ccctgtaaatagttttaaat

SEQ ID NO: 2853469 - DNA, 14 bp, Homo sapiens
ccctgtcctcctcg

SEQ ID NO: 2853470 - DNA, 15 bp, Homo sapiens
ccctgtcctcctcgg

SEQ ID NO: 2853471 - DNA, 16 bp, Homo sapiens
ccctgtcctcctcgga

SEQ ID NO: 2853472 - DNA, 15 bp, Homo sapiens
ccctgtcgagacact

SEQ ID NO: 2853473 - DNA, 20 bp, Homo sapiens
cccttactatgatctcagga

SEQ ID NO: 2853474 - DNA, 23 bp, Homo sapiens
cccttagcagggaaacagctaat

SEQ ID NO: 2853475 - DNA, 12 bp, Homo sapiens
cccttagctctc

SEQ ID NO: 2853476 - DNA, 14 bp, Homo sapiens
cccttagctctccc

SEQ ID NO: 2853477 - DNA, 12 bp, Homo sapiens
cccttatccagg

SEQ ID NO: 2853478 - DNA, 11 bp, Homo sapiens
cccttccagtg

SEQ ID NO: 2853479 - DNA, 20 bp, Homo sapiens
cccttccagtggtaccagct

SEQ ID NO: 2853480 - DNA, 22 bp, Homo sapiens
cccttccagtggtaccagctca

SEQ ID NO: 2853481 - DNA, 24 bp, Homo sapiens
cccttccagtggtaccagctcact

SEQ ID NO: 2853482 - DNA, 12 bp, Homo sapiens
cccttccctgct

SEQ ID NO: 2853483 - DNA, 15 bp, Homo sapiens
cccttccctgctttg

SEQ ID NO: 2853484 - DNA, 14 bp, Homo sapiens
cccttcgctcctgt

SEQ ID NO: 2853485 - DNA, 15 bp, Homo sapiens
cccttcgctcctgtg

SEQ ID NO: 2853486 - DNA, 16 bp, Homo sapiens
cccttcgctcctgtgt

SEQ ID NO: 2853487 - DNA, 18 bp, Homo sapiens
cccttcgctcctgtgtct

SEQ ID NO: 2853488 - DNA, 15 bp, Homo sapiens
cccttctttaaatca

SEQ ID NO: 2853489 - DNA, 18 bp, Homo sapiens
cccttctttaaatcaaaa

SEQ ID NO: 2853490 - DNA, 20 bp, Homo sapiens
cccttgaagaggggaggggc

SEQ ID NO: 2853491 - DNA, 23 bp, Homo sapiens
cccttgaagaggggaggggccta

SEQ ID NO: 2853492 - DNA, 14 bp, Homo sapiens
cccttgagaaacct

SEQ ID NO: 2853493 - DNA, 13 bp, Homo sapiens
cccttgagacctc

SEQ ID NO: 2853494 - DNA, 17 bp, Homo sapiens
cccttgagacctcagcc

SEQ ID NO: 2853495 - DNA, 23 bp, Homo sapiens
cccttgcacagcccacacatgaa

SEQ ID NO: 2853496 - DNA, 12 bp, Homo sapiens
cccttgcccagg

SEQ ID NO: 2853497 - DNA, 22 bp, Homo sapiens
cccttgcccagggctcagcctg

SEQ ID NO: 2853498 - DNA, 23 bp, Homo sapiens
cccttgcccagggctcagcctgg

SEQ ID NO: 2853499 - DNA, 15 bp, Homo sapiens
ccctttcctggggga

SEQ ID NO: 2853500 - DNA, 18 bp, Homo sapiens
ccctttccttccttccct

SEQ ID NO: 2853501 - DNA, 16 bp, Homo sapiens
ccctttgggaggctga

SEQ ID NO: 2853502 - DNA, 23 bp, Homo sapiens
cccttttcaagttgagaacaaaa

SEQ ID NO: 2853503 - DNA, 16 bp, Homo sapiens
cccttttctacagtta

SEQ ID NO: 2853504 - DNA, 23 bp, Homo sapiens
ccgaagctaacagggaaggcagg

SEQ ID NO: 2853505 - DNA, 17 bp, Homo sapiens
ccgaatagctgggacta

SEQ ID NO: 2853506 - DNA, 20 bp, Homo sapiens
ccgaatagctgggactacag

SEQ ID NO: 2853507 - DNA, 20 bp, Homo sapiens
ccgacaggcatgcaccagtg

SEQ ID NO: 2853508 - DNA, 18 bp, Homo sapiens
ccgaccagacaccttgac

SEQ ID NO: 2853509 - DNA, 12 bp, Homo sapiens
ccgacctcagcc

SEQ ID NO: 2853510 - DNA, 13 bp, Homo sapiens
ccgacctcagcct

SEQ ID NO: 2853511 - DNA, 19 bp, Homo sapiens
ccgacctcgtcctccccct

SEQ ID NO: 2853512 - DNA, 11 bp, Homo sapiens
ccgactccagc

SEQ ID NO: 2853513 - DNA, 15 bp, Homo sapiens
ccgagcagctgagca

SEQ ID NO: 2853514 - DNA, 20 bp, Homo sapiens
ccgagcagctgagcagggcc

SEQ ID NO: 2853515 - DNA, 16 bp, Homo sapiens
ccgagccgggcctggg

SEQ ID NO: 2853516 - DNA, 14 bp, Homo sapiens
ccgagtagctggga

SEQ ID NO: 2853517 - DNA, 16 bp, Homo sapiens
ccgagtagctgggact

SEQ ID NO: 2853518 - DNA, 15 bp, Homo sapiens
ccgcagagctccctt

SEQ ID NO: 2853519 - DNA, 12 bp, Homo sapiens
cctctcctgcct

SEQ ID NO: 2853520 - DNA, 15 bp, Homo sapiens
cctctcctgcctact

SEQ ID NO: 2853521 - DNA, 17 bp, Homo sapiens
cctctcctgcctactca

SEQ ID NO: 2853522 - DNA, 13 bp, Homo sapiens
cctctctgaatgt

SEQ ID NO: 2853523 - DNA, 13 bp, Homo sapiens
cctctcttgcctt

SEQ ID NO: 2853524 - DNA, 13 bp, Homo sapiens
cctctgacacaca

SEQ ID NO: 2853525 - DNA, 21 bp, Homo sapiens
cctctgacacacagctctgtc

SEQ ID NO: 2853526 - DNA, 19 bp, Homo sapiens
cctctgacctgcaggccaa

SEQ ID NO: 2853527 - DNA, 15 bp, Homo sapiens
cctctgaggccagcc

SEQ ID NO: 2853528 - DNA, 17 bp, Homo sapiens
cctctgaggccagcctg

SEQ ID NO: 2853529 - DNA, 18 bp, Homo sapiens
cctctgaggccagcctgg

SEQ ID NO: 2853530 - DNA, 21 bp, Homo sapiens
cctctgaggccagcctggcct

SEQ ID NO: 2853531 - DNA, 14 bp, Homo sapiens
cctctgatacctca

SEQ ID NO: 2853532 - DNA, 12 bp, Homo sapiens
cctctgatccct

SEQ ID NO: 2853533 - DNA, 11 bp, Homo sapiens
cctctgccacc

SEQ ID NO: 2853534 - DNA, 12 bp, Homo sapiens
cctctgccacct

SEQ ID NO: 2853535 - DNA, 16 bp, Homo sapiens
cctctgccacctcccc

SEQ ID NO: 2853536 - DNA, 21 bp, Homo sapiens
cctctgcctctgacacacagc

SEQ ID NO: 2853537 - DNA, 21 bp, Homo sapiens
cctctgcctgaagtcacacag

SEQ ID NO: 2853538 - DNA, 22 bp, Homo sapiens
cctctgcctgaagtcacacagt

SEQ ID NO: 2853539 - DNA, 15 bp, Homo sapiens
cctctgcctgtctcc

SEQ ID NO: 2853540 - DNA, 19 bp, Homo sapiens
cctctgcctgtctccccca

SEQ ID NO: 2853541 - DNA, 20 bp, Homo sapiens
cctctgctctgaggcttcca

SEQ ID NO: 2853542 - DNA, 22 bp, Homo sapiens
cctctgctctgaggcttccaga

SEQ ID NO: 2853543 - DNA, 21 bp, Homo sapiens
cctctggattctctgggtcta

SEQ ID NO: 2853544 - DNA, 18 bp, Homo sapiens
cctctgtccagggccctg

SEQ ID NO: 2853545 - DNA, 21 bp, Homo sapiens
cctctgtccagggccctgagc

SEQ ID NO: 2853546 - DNA, 23 bp, Homo sapiens
cctctgtccagggccctgagctc

SEQ ID NO: 2853547 - DNA, 14 bp, Homo sapiens
cctctgtctctgct

SEQ ID NO: 2853548 - DNA, 15 bp, Homo sapiens
cctctgtctctgctc

SEQ ID NO: 2853549 - DNA, 19 bp, Homo sapiens
cctctgtgtgctcctcctt

SEQ ID NO: 2853550 - DNA, 21 bp, Homo sapiens
cctcttaatgtatgattacat

SEQ ID NO: 2853551 - DNA, 12 bp, Homo sapiens
cctcttccccac

SEQ ID NO: 2853552 - DNA, 15 bp, Homo sapiens
cctcttccccttgcc

SEQ ID NO: 2853553 - DNA, 17 bp, Homo sapiens
cctcttccccttgccct

SEQ ID NO: 2853554 - DNA, 13 bp, Homo sapiens
cctcttcctgcca

SEQ ID NO: 2853555 - DNA, 13 bp, Homo sapiens
cctcttccttccc

SEQ ID NO: 2853556 - DNA, 18 bp, Homo sapiens
cctctttgcctgtgtgag

SEQ ID NO: 2853557 - DNA, 23 bp, Homo sapiens
cctgaaagtgacagagacccaga

SEQ ID NO: 2853558 - DNA, 15 bp, Homo sapiens
cctgaaatttcagat

SEQ ID NO: 2853559 - DNA, 16 bp, Homo sapiens
cctgaacaagaattgg

SEQ ID NO: 2853560 - DNA, 23 bp, Homo sapiens
cctgaatgtattgaacttggaaa

SEQ ID NO: 2853561 - DNA, 20 bp, Homo sapiens
cctgacaagcactgctaggc

SEQ ID NO: 2853562 - DNA, 19 bp, Homo sapiens
cctgaccaacatggagaaa

SEQ ID NO: 2853563 - DNA, 20 bp, Homo sapiens
cctgacctcctcctgccctc

SEQ ID NO: 2853564 - DNA, 13 bp, Homo sapiens
cctgactcctcta

SEQ ID NO: 2853565 - DNA, 13 bp, Homo sapiens
cctgactctctgt

SEQ ID NO: 2853566 - DNA, 16 bp, Homo sapiens
cctgactctctgtgac

SEQ ID NO: 2853567 - DNA, 17 bp, Homo sapiens
cctgactctctgtgacc

SEQ ID NO: 2853568 - DNA, 21 bp, Homo sapiens
cctgactggtgctataggctg

SEQ ID NO: 2853569 - DNA, 11 bp, Homo sapiens
cctgactgtgt

SEQ ID NO: 2853570 - DNA, 14 bp, Homo sapiens
cctgactgtgttca

SEQ ID NO: 2853571 - DNA, 24 bp, Homo sapiens
cctgactgtgttcagtgccttgga

SEQ ID NO: 2853572 - DNA, 23 bp, Homo sapiens
cctgacttggggagatggagttc

SEQ ID NO: 2853573 - DNA, 22 bp, Homo sapiens
cctgagaagtgtctaaaaacac

SEQ ID NO: 2853574 - DNA, 21 bp, Homo sapiens
cctgagaccagttgggagcac

SEQ ID NO: 2853575 - DNA, 18 bp, Homo sapiens
cctgagcactgccaggag

SEQ ID NO: 2853576 - DNA, 13 bp, Homo sapiens
cctgagcccaggg

SEQ ID NO: 2853577 - DNA, 15 bp, Homo sapiens
cctgagcccagggag

SEQ ID NO: 2853578 - DNA, 13 bp, Homo sapiens
cctgagcctgccg

SEQ ID NO: 2853579 - DNA, 21 bp, Homo sapiens
cctgagcctgccgagcaaccg

SEQ ID NO: 2853580 - DNA, 15 bp, Homo sapiens
cctgagctcggtgga

SEQ ID NO: 2853581 - DNA, 18 bp, Homo sapiens
cctgagctcggtggaccc

SEQ ID NO: 2853582 - DNA, 21 bp, Homo sapiens
cctgagctcggtggacccagg

SEQ ID NO: 2853583 - DNA, 13 bp, Homo sapiens
cctgaggagtctg

SEQ ID NO: 2853584 - DNA, 16 bp, Homo sapiens
cctgaggagtctgagg

SEQ ID NO: 2853585 - DNA, 17 bp, Homo sapiens
cctgaggagtctgaggt

SEQ ID NO: 2853586 - DNA, 18 bp, Homo sapiens
cctgaggagtctgaggtc

SEQ ID NO: 2853587 - DNA, 19 bp, Homo sapiens
cctgaggagtctgaggtcc

SEQ ID NO: 2853588 - DNA, 21 bp, Homo sapiens
cctgaggagtctgaggtcctg

SEQ ID NO: 2853589 - DNA, 22 bp, Homo sapiens
cctgaggagtctgaggtcctga

SEQ ID NO: 2853590 - DNA, 13 bp, Homo sapiens
cctgagggtggag

SEQ ID NO: 2853591 - DNA, 15 bp, Homo sapiens
cctgagtcacccatg

SEQ ID NO: 2853592 - DNA, 23 bp, Homo sapiens
cctgagtcaccctacctgtgcct

SEQ ID NO: 2853593 - DNA, 16 bp, Homo sapiens
cctgagtctcctgtgc

SEQ ID NO: 2853594 - DNA, 14 bp, Homo sapiens
cctgagtggatctc

SEQ ID NO: 2853595 - DNA, 18 bp, Homo sapiens
cctgagtggatctccaag

SEQ ID NO: 2853596 - DNA, 19 bp, Homo sapiens
cctgagtggatctccaagg

SEQ ID NO: 2853597 - DNA, 23 bp, Homo sapiens
cctgataaacattaaacactgta

SEQ ID NO: 2853598 - DNA, 20 bp, Homo sapiens
cctgatcaagtcaccggagc

SEQ ID NO: 2853599 - DNA, 14 bp, Homo sapiens
cctgcaaaatttta

SEQ ID NO: 2853600 - DNA, 20 bp, Homo sapiens
cctgcacaaagcccttccat

SEQ ID NO: 2853601 - DNA, 23 bp, Homo sapiens
cctgcacaaagcccttccatgtc

SEQ ID NO: 2853602 - DNA, 15 bp, Homo sapiens
cctgcacccttcctc

SEQ ID NO: 2853603 - DNA, 22 bp, Homo sapiens
cctgcacctccccccactgcag

SEQ ID NO: 2853604 - DNA, 15 bp, Homo sapiens
cctgcacgcactgcg

SEQ ID NO: 2853605 - DNA, 16 bp, Homo sapiens
cctgcacttgcagact

SEQ ID NO: 2853606 - DNA, 13 bp, Homo sapiens
cctgcagaccctg

SEQ ID NO: 2853607 - DNA, 15 bp, Homo sapiens
cctgcagactcactg

SEQ ID NO: 2853608 - DNA, 16 bp, Homo sapiens
cctgcagagcacacag

SEQ ID NO: 2853609 - DNA, 20 bp, Homo sapiens
cctgcagccaaacagagcct

SEQ ID NO: 2853610 - DNA, 17 bp, Homo sapiens
cgactccagccagcgcc

SEQ ID NO: 2853611 - DNA, 18 bp, Homo sapiens
cgactccagccagcgcct

SEQ ID NO: 2853612 - DNA, 20 bp, Homo sapiens
cgactccagccagcgcctcc

SEQ ID NO: 2853613 - DNA, 21 bp, Homo sapiens
cgactccagccagcgcctccc

SEQ ID NO: 2853614 - DNA, 22 bp, Homo sapiens
cgacttttctaaagctctgaac

SEQ ID NO: 2853615 - DNA, 16 bp, Homo sapiens
cgagaccagcctggcc

SEQ ID NO: 2853616 - DNA, 19 bp, Homo sapiens
cgagacccttgcattagaa

SEQ ID NO: 2853617 - DNA, 15 bp, Homo sapiens
cgagagcctgctccc

SEQ ID NO: 2853618 - DNA, 19 bp, Homo sapiens
cgagagtagccgagagcct

SEQ ID NO: 2853619 - DNA, 18 bp, Homo sapiens
cgagatcgctggcagaga

SEQ ID NO: 2853620 - DNA, 22 bp, Homo sapiens
cgagcaaccgtggcccttcctg

SEQ ID NO: 2853621 - DNA, 23 bp, Homo sapiens
cgagcaaccgtggcccttcctgg

SEQ ID NO: 2853622 - DNA, 12 bp, Homo sapiens
cgagcagctgag

SEQ ID NO: 2853623 - DNA, 13 bp, Homo sapiens
cgagcagctgagc

SEQ ID NO: 2853624 - DNA, 15 bp, Homo sapiens
cgagccctggtggca

SEQ ID NO: 2853625 - DNA, 15 bp, Homo sapiens
cgagccgggcctggg

SEQ ID NO: 2853626 - DNA, 13 bp, Homo sapiens
cgagcgccctgca

SEQ ID NO: 2853627 - DNA, 21 bp, Homo sapiens
cgagcgccctgcagaccctgc

SEQ ID NO: 2853628 - DNA, 12 bp, Homo sapiens
cgaggacaggga

SEQ ID NO: 2853629 - DNA, 23 bp, Homo sapiens
cgaggagcttccagtgcatgttg

SEQ ID NO: 2853630 - DNA, 22 bp, Homo sapiens
cgaggctgcccactatggtcat

SEQ ID NO: 2853631 - DNA, 16 bp, Homo sapiens
cgaggtcaacagagaa

SEQ ID NO: 2853632 - DNA, 21 bp, Homo sapiens
cgaggtcaacagagaaggcag

SEQ ID NO: 2853633 - DNA, 18 bp, Homo sapiens
cgaggtgcggccaccacc

SEQ ID NO: 2853634 - DNA, 20 bp, Homo sapiens
cgaggtggatcacagaggct

SEQ ID NO: 2853635 - DNA, 15 bp, Homo sapiens
cgagtagctgggact

SEQ ID NO: 2853636 - DNA, 16 bp, Homo sapiens
cgagtagctgggacta

SEQ ID NO: 2853637 - DNA, 14 bp, Homo sapiens
cgagtgccaggact

SEQ ID NO: 2853638 - DNA, 19 bp, Homo sapiens
cgatctgggttcactgcaa

SEQ ID NO: 2853639 - DNA, 15 bp, Homo sapiens
cgatctgtactgtaa

SEQ ID NO: 2853640 - DNA, 21 bp, Homo sapiens
cgatgaatttggagactctgt

SEQ ID NO: 2853641 - DNA, 13 bp, Homo sapiens
cgatgtggccctg

SEQ ID NO: 2853642 - DNA, 16 bp, Homo sapiens
cgatgtggccctggcc

SEQ ID NO: 2853643 - DNA, 18 bp, Homo sapiens
cgatgtggccctggcctg

SEQ ID NO: 2853644 - DNA, 13 bp, Homo sapiens
cgattcttctgct

SEQ ID NO: 2853645 - DNA, 21 bp, Homo sapiens
cgattcttctgcttcagcctc

SEQ ID NO: 2853646 - DNA, 19 bp, Homo sapiens
cgcaaagggctgaaagcca

SEQ ID NO: 2853647 - DNA, 19 bp, Homo sapiens
cgcaacccgtgccaagtcc

SEQ ID NO: 2853648 - DNA, 20 bp, Homo sapiens
cgcaagcctgtaatcccagc

SEQ ID NO: 2853649 - DNA, 14 bp, Homo sapiens
cgcaagggcctgat

SEQ ID NO: 2853650 - DNA, 15 bp, Homo sapiens
cgcaagtctgcagcc

SEQ ID NO: 2853651 - DNA, 21 bp, Homo sapiens
cgcacagattacttcagggct

SEQ ID NO: 2853652 - DNA, 16 bp, Homo sapiens
cgcaccaggccgggct

SEQ ID NO: 2853653 - DNA, 14 bp, Homo sapiens
cgcaccccagagtg

SEQ ID NO: 2853654 - DNA, 17 bp, Homo sapiens
cgcaccccccaagctgt

SEQ ID NO: 2853655 - DNA, 16 bp, Homo sapiens
cgcacctgccccctgg

SEQ ID NO: 2853656 - DNA, 11 bp, Homo sapiens
cgcagccaccc

SEQ ID NO: 2853657 - DNA, 17 bp, Homo sapiens
cgcagccaccctgagga

SEQ ID NO: 2853658 - DNA, 22 bp, Homo sapiens
cgcagccaccctgaggagtctg

SEQ ID NO: 2853659 - DNA, 16 bp, Homo sapiens
cgcagcctccctctga

SEQ ID NO: 2853660 - DNA, 15 bp, Homo sapiens
cgcatcttctccatc

SEQ ID NO: 2853661 - DNA, 14 bp, Homo sapiens
cgcatgccagagcc

SEQ ID NO: 2853662 - DNA, 15 bp, Homo sapiens
cgcatgccctcaatc

SEQ ID NO: 2853663 - DNA, 12 bp, Homo sapiens
cgcattccctga

SEQ ID NO: 2853664 - DNA, 13 bp, Homo sapiens
cgcattttctcta

SEQ ID NO: 2853665 - DNA, 12 bp, Homo sapiens
cgccactcattt

SEQ ID NO: 2853666 - DNA, 14 bp, Homo sapiens
cgccactcatttca

SEQ ID NO: 2853667 - DNA, 19 bp, Homo sapiens
cgccactcatttcatctca

SEQ ID NO: 2853668 - DNA, 22 bp, Homo sapiens
cgccactgcactccagcctggg

SEQ ID NO: 2853669 - DNA, 15 bp, Homo sapiens
cgcccagctgcacct

SEQ ID NO: 2853670 - DNA, 23 bp, Homo sapiens
cgcccagctgcacctgccagcct

SEQ ID NO: 2853671 - DNA, 19 bp, Homo sapiens
cgcccagtctggaatgcag

SEQ ID NO: 2853672 - DNA, 21 bp, Homo sapiens
cgcccagtctggaatgcagtg

SEQ ID NO: 2853673 - DNA, 22 bp, Homo sapiens
cgcccagttgggtggatgcctg

SEQ ID NO: 2853674 - DNA, 23 bp, Homo sapiens
cgcccagttgggtggatgcctgg

SEQ ID NO: 2853675 - DNA, 13 bp, Homo sapiens
cgccccagacaca

SEQ ID NO: 2853676 - DNA, 20 bp, Homo sapiens
cgcccccacaccccatctct

SEQ ID NO: 2853677 - DNA, 15 bp, Homo sapiens
cgccctgcagaccct

SEQ ID NO: 2853678 - DNA, 14 bp, Homo sapiens
cgcccttcccacag

SEQ ID NO: 2853679 - DNA, 16 bp, Homo sapiens
cgcctatgatcccagc

SEQ ID NO: 2853680 - DNA, 11 bp, Homo sapiens
cgcctcccagc

SEQ ID NO: 2853681 - DNA, 15 bp, Homo sapiens
cgcctccctccaccc

SEQ ID NO: 2853682 - DNA, 13 bp, Homo sapiens
cgcctctgcattc

SEQ ID NO: 2853683 - DNA, 11 bp, Homo sapiens
cgcctgagccc

SEQ ID NO: 2853684 - DNA, 18 bp, Homo sapiens
cgcctgagcccagggagg

SEQ ID NO: 2853685 - DNA, 19 bp, Homo sapiens
cgcctgcccccagcactcc

SEQ ID NO: 2853686 - DNA, 15 bp, Homo sapiens
cgcctgtagtcccag

SEQ ID NO: 2853687 - DNA, 11 bp, Homo sapiens
cgcctgtgccc

SEQ ID NO: 2853688 - DNA, 22 bp, Homo sapiens
cgccttcactccggtgtgcctg

SEQ ID NO: 2853689 - DNA, 18 bp, Homo sapiens
cgcgcatgtaatcccagc

SEQ ID NO: 2853690 - DNA, 22 bp, Homo sapiens
cgcgccactacactccagcctg

SEQ ID NO: 2853691 - DNA, 23 bp, Homo sapiens
cgcgccactacactccagcctga

SEQ ID NO: 2853692 - DNA, 16 bp, Homo sapiens
cgcgtctaccctggga

SEQ ID NO: 2853693 - DNA, 20 bp, Homo sapiens
cgctacaccactctggcagc

SEQ ID NO: 2853694 - DNA, 16 bp, Homo sapiens
cgctctgccctccctg

SEQ ID NO: 2853695 - DNA, 18 bp, Homo sapiens
cgctgccgcaccccagag

SEQ ID NO: 2853696 - DNA, 20 bp, Homo sapiens
cgctgcctaagtggctgctg

SEQ ID NO: 2853697 - DNA, 15 bp, Homo sapiens
cgctggacaacccag

SEQ ID NO: 2853698 - DNA, 22 bp, Homo sapiens
cgctggacaacccagaactgga

SEQ ID NO: 2853699 - DNA, 21 bp, Homo sapiens
cgctgggaggaacctgaacct

SEQ ID NO: 2853700 - DNA, 13 bp, Homo sapiens
cgctggtggacca

SEQ ID NO: 2853701 - DNA, 14 bp, Homo sapiens
ctcaagctgcgttt

SEQ ID NO: 2853702 - DNA, 18 bp, Homo sapiens
ctcaagtgattctcctgc

SEQ ID NO: 2853703 - DNA, 19 bp, Homo sapiens
ctcaagtgattctcctgcc

SEQ ID NO: 2853704 - DNA, 17 bp, Homo sapiens
ctcaatattcaataaag

SEQ ID NO: 2853705 - DNA, 18 bp, Homo sapiens
ctcaatattcaataaagc

SEQ ID NO: 2853706 - DNA, 18 bp, Homo sapiens
ctcaatattttccatgaa

SEQ ID NO: 2853707 - DNA, 22 bp, Homo sapiens
ctcaatattttccatgaaaatg

SEQ ID NO: 2853708 - DNA, 14 bp, Homo sapiens
ctcaatcctctaag

SEQ ID NO: 2853709 - DNA, 21 bp, Homo sapiens
ctcaatgtgaatcagacccta

SEQ ID NO: 2853710 - DNA, 15 bp, Homo sapiens
ctcaatgtgaccagg

SEQ ID NO: 2853711 - DNA, 22 bp, Homo sapiens
ctcacaaaccatgcaaatgcta

SEQ ID NO: 2853712 - DNA, 19 bp, Homo sapiens
ctcacaactgtttttgaag

SEQ ID NO: 2853713 - DNA, 20 bp, Homo sapiens
ctcacaactgtttttgaaga

SEQ ID NO: 2853714 - DNA, 19 bp, Homo sapiens
ctcacaagaagaccagact

SEQ ID NO: 2853715 - DNA, 21 bp, Homo sapiens
ctcacacaggcatttcctggg

SEQ ID NO: 2853716 - DNA, 20 bp, Homo sapiens
ctcacagttcctcgccctgg

SEQ ID NO: 2853717 - DNA, 12 bp, Homo sapiens
ctcacatttatg

SEQ ID NO: 2853718 - DNA, 13 bp, Homo sapiens
ctcaccaataact

SEQ ID NO: 2853719 - DNA, 14 bp, Homo sapiens
ctcaccatgtaaaa

SEQ ID NO: 2853720 - DNA, 15 bp, Homo sapiens
ctcaccccctcccac

SEQ ID NO: 2853721 - DNA, 23 bp, Homo sapiens
ctcaccccctcccacccccagcc

SEQ ID NO: 2853722 - DNA, 16 bp, Homo sapiens
ctcaccccgtctgggg

SEQ ID NO: 2853723 - DNA, 20 bp, Homo sapiens
ctcacctttgcaaagttaca

SEQ ID NO: 2853724 - DNA, 22 bp, Homo sapiens
ctcacgcctgtaatcccagcat

SEQ ID NO: 2853725 - DNA, 17 bp, Homo sapiens
ctcactatgttgcccag

SEQ ID NO: 2853726 - DNA, 23 bp, Homo sapiens
ctcactatgttgcccaggcaggt

SEQ ID NO: 2853727 - DNA, 14 bp, Homo sapiens
ctcactccaccacc

SEQ ID NO: 2853728 - DNA, 16 bp, Homo sapiens
ctcactccaccaccca

SEQ ID NO: 2853729 - DNA, 16 bp, Homo sapiens
ctcactgcagcctcaa

SEQ ID NO: 2853730 - DNA, 13 bp, Homo sapiens
ctcactgccccac

SEQ ID NO: 2853731 - DNA, 19 bp, Homo sapiens
ctcactgccttccaggagc

SEQ ID NO: 2853732 - DNA, 20 bp, Homo sapiens
ctcactggggtcctggggcc

SEQ ID NO: 2853733 - DNA, 22 bp, Homo sapiens
ctcactggggtcctggggcctc

SEQ ID NO: 2853734 - DNA, 14 bp, Homo sapiens
ctcactgttgccca

SEQ ID NO: 2853735 - DNA, 16 bp, Homo sapiens
ctcactgttgcccagg

SEQ ID NO: 2853736 - DNA, 17 bp, Homo sapiens
ctcactgttgcccaggc

SEQ ID NO: 2853737 - DNA, 19 bp, Homo sapiens
ctcactgttgcccaggctg

SEQ ID NO: 2853738 - DNA, 15 bp, Homo sapiens
ctcacttcaatgaac

SEQ ID NO: 2853739 - DNA, 21 bp, Homo sapiens
ctcacttttaatgaacaaatg

SEQ ID NO: 2853740 - DNA, 13 bp, Homo sapiens
ctcagaagacact

SEQ ID NO: 2853741 - DNA, 15 bp, Homo sapiens
ctcagaagacactga

SEQ ID NO: 2853742 - DNA, 23 bp, Homo sapiens
ctcagaagacactgatgggcaac

SEQ ID NO: 2853743 - DNA, 13 bp, Homo sapiens
ctcagaagcctga

SEQ ID NO: 2853744 - DNA, 15 bp, Homo sapiens
ctcagaagcctgagg

SEQ ID NO: 2853745 - DNA, 16 bp, Homo sapiens
ctcagaagcctgaggc

SEQ ID NO: 2853746 - DNA, 17 bp, Homo sapiens
ctcagaagcctgaggct

SEQ ID NO: 2853747 - DNA, 16 bp, Homo sapiens
ctcagaaggtattcct

SEQ ID NO: 2853748 - DNA, 18 bp, Homo sapiens
ctcagaatccaaagatca

SEQ ID NO: 2853749 - DNA, 13 bp, Homo sapiens
ctcagaccaactc

SEQ ID NO: 2853750 - DNA, 13 bp, Homo sapiens
ctcagacccccac

SEQ ID NO: 2853751 - DNA, 14 bp, Homo sapiens
ctcagacccccact

SEQ ID NO: 2853752 - DNA, 16 bp, Homo sapiens
ctcagacccccactct

SEQ ID NO: 2853753 - DNA, 13 bp, Homo sapiens
ctcagactgctca

SEQ ID NO: 2853754 - DNA, 22 bp, Homo sapiens
ctcagagacaggtggcctagca

SEQ ID NO: 2853755 - DNA, 16 bp, Homo sapiens
ctcagaggcccaggaa

SEQ ID NO: 2853756 - DNA, 15 bp, Homo sapiens
ctcagaggggccccg

SEQ ID NO: 2853757 - DNA, 18 bp, Homo sapiens
ctcagatagaatgacagt

SEQ ID NO: 2853758 - DNA, 14 bp, Homo sapiens
ctcagatggagaca

SEQ ID NO: 2853759 - DNA, 21 bp, Homo sapiens
ctcagatggagacattggatg

SEQ ID NO: 2853760 - DNA, 14 bp, Homo sapiens
ctcagcagccctcc

SEQ ID NO: 2853761 - DNA, 21 bp, Homo sapiens
ctcagcagccctcctcacccc

SEQ ID NO: 2853762 - DNA, 12 bp, Homo sapiens
ctcagcatacct

SEQ ID NO: 2853763 - DNA, 16 bp, Homo sapiens
ctcagcatcctggcac

SEQ ID NO: 2853764 - DNA, 17 bp, Homo sapiens
ctcagcatcctggcacc

SEQ ID NO: 2853765 - DNA, 18 bp, Homo sapiens
ctcagcatcctggcaccc

SEQ ID NO: 2853766 - DNA, 17 bp, Homo sapiens
ctcagccccgggcctgc

SEQ ID NO: 2853767 - DNA, 11 bp, Homo sapiens
ctcagccctgg

SEQ ID NO: 2853768 - DNA, 21 bp, Homo sapiens
ctcagccctgggccccaccac

SEQ ID NO: 2853769 - DNA, 13 bp, Homo sapiens
ctcagcctcccaa

SEQ ID NO: 2853770 - DNA, 16 bp, Homo sapiens
ctcagcctcccaaagt

SEQ ID NO: 2853771 - DNA, 13 bp, Homo sapiens
ctcagcctccccc

SEQ ID NO: 2853772 - DNA, 14 bp, Homo sapiens
ctcagcctcccccc

SEQ ID NO: 2853773 - DNA, 19 bp, Homo sapiens
ctcagcctcccgaatagct

SEQ ID NO: 2853774 - DNA, 22 bp, Homo sapiens
ctcagcctcccgaatagctggg

SEQ ID NO: 2853775 - DNA, 12 bp, Homo sapiens
ctcagcctggtg

SEQ ID NO: 2853776 - DNA, 20 bp, Homo sapiens
ctcagcctggtgggcctcct

SEQ ID NO: 2853777 - DNA, 18 bp, Homo sapiens
ctcagcctgtgctgcccg

SEQ ID NO: 2853778 - DNA, 22 bp, Homo sapiens
ctcagccttccccttgcccagg

SEQ ID NO: 2853779 - DNA, 21 bp, Homo sapiens
ctcagccttgaaaaacaagtc

SEQ ID NO: 2853780 - DNA, 15 bp, Homo sapiens
ctcagccttggataa

SEQ ID NO: 2853781 - DNA, 14 bp, Homo sapiens
ctcagcgaatgaat

SEQ ID NO: 2853782 - DNA, 13 bp, Homo sapiens
ctcagcggggaca

SEQ ID NO: 2853783 - DNA, 14 bp, Homo sapiens
ctcagcggggacag

SEQ ID NO: 2853784 - DNA, 15 bp, Homo sapiens
ctcagcggggacagc

SEQ ID NO: 2853785 - DNA, 21 bp, Homo sapiens
ctcagcggggacagctccttc

SEQ ID NO: 2853786 - DNA, 23 bp, Homo sapiens
ctcagcggggacagctccttctg

SEQ ID NO: 2853787 - DNA, 23 bp, Homo sapiens
ctcagctgacacataatttgaat

SEQ ID NO: 2853788 - DNA, 16 bp, Homo sapiens
ctcagctgctcgcaca

SEQ ID NO: 2853789 - DNA, 18 bp, Homo sapiens
ctcagctgctcgcacaga

SEQ ID NO: 2853790 - DNA, 18 bp, Homo sapiens
ctcagctgtctgtggctt

SEQ ID NO: 2853791 - DNA, 15 bp, Homo sapiens
ctcagcttcatttcc

SEQ ID NO: 2853792 - DNA, 20 bp, Homo sapiens
ctctgcctctgacacacagc

SEQ ID NO: 2853793 - DNA, 20 bp, Homo sapiens
ctctgctcctctccccagca

SEQ ID NO: 2853794 - DNA, 14 bp, Homo sapiens
ctctgctctgatgc

SEQ ID NO: 2853795 - DNA, 14 bp, Homo sapiens
ctctgctgacagac

SEQ ID NO: 2853796 - DNA, 16 bp, Homo sapiens
ctctgctgacagacac

SEQ ID NO: 2853797 - DNA, 17 bp, Homo sapiens
ctctgctgacagacaca

SEQ ID NO: 2853798 - DNA, 15 bp, Homo sapiens
ctctgctgccatggc

SEQ ID NO: 2853799 - DNA, 15 bp, Homo sapiens
ctctgctggcctggc

SEQ ID NO: 2853800 - DNA, 16 bp, Homo sapiens
ctctgctggcctggcc

SEQ ID NO: 2853801 - DNA, 21 bp, Homo sapiens
ctctggaagagaggaatgcct

SEQ ID NO: 2853802 - DNA, 14 bp, Homo sapiens
ctctggaccagcct

SEQ ID NO: 2853803 - DNA, 13 bp, Homo sapiens
ctctggatggcac

SEQ ID NO: 2853804 - DNA, 19 bp, Homo sapiens
ctctggatggcaccagagg

SEQ ID NO: 2853805 - DNA, 20 bp, Homo sapiens
ctctggatggcaccagaggc

SEQ ID NO: 2853806 - DNA, 17 bp, Homo sapiens
ctctggcagccacactt

SEQ ID NO: 2853807 - DNA, 22 bp, Homo sapiens
ctctggcagccacacttctcag

SEQ ID NO: 2853808 - DNA, 22 bp, Homo sapiens
ctctggctccgaaaaactttgt

SEQ ID NO: 2853809 - DNA, 12 bp, Homo sapiens
ctctggcttcca

SEQ ID NO: 2853810 - DNA, 14 bp, Homo sapiens
ctctggcttccagg

SEQ ID NO: 2853811 - DNA, 17 bp, Homo sapiens
ctctggcttccaggtat

SEQ ID NO: 2853812 - DNA, 18 bp, Homo sapiens
ctctggcttccaggtatc

SEQ ID NO: 2853813 - DNA, 17 bp, Homo sapiens
ctctggtggaacctgca

SEQ ID NO: 2853814 - DNA, 17 bp, Homo sapiens
ctctgtccctcactgcc

SEQ ID NO: 2853815 - DNA, 18 bp, Homo sapiens
ctctgtccctcactgcct

SEQ ID NO: 2853816 - DNA, 21 bp, Homo sapiens
ctctgtccctcactgccttcc

SEQ ID NO: 2853817 - DNA, 18 bp, Homo sapiens
ctctgtccctctttgcct

SEQ ID NO: 2853818 - DNA, 20 bp, Homo sapiens
ctctgtccctctttgcctgt

SEQ ID NO: 2853819 - DNA, 22 bp, Homo sapiens
ctctgtcctgggagtgagctgg

SEQ ID NO: 2853820 - DNA, 17 bp, Homo sapiens
ctctgtcgcccagtctg

SEQ ID NO: 2853821 - DNA, 18 bp, Homo sapiens
ctctgtcgcccagtctgg

SEQ ID NO: 2853822 - DNA, 10 bp, Homo sapiens
ctctgtctct

SEQ ID NO: 2853823 - DNA, 12 bp, Homo sapiens
ctctgtctctgc

SEQ ID NO: 2853824 - DNA, 13 bp, Homo sapiens
ctctgtctctgct

SEQ ID NO: 2853825 - DNA, 16 bp, Homo sapiens
ctctgtctctgctctt

SEQ ID NO: 2853826 - DNA, 17 bp, Homo sapiens
ctctgtctctgctcttg

SEQ ID NO: 2853827 - DNA, 15 bp, Homo sapiens
ctctgtgccagagcc

SEQ ID NO: 2853828 - DNA, 17 bp, Homo sapiens
ctctgtgccagagcctg

SEQ ID NO: 2853829 - DNA, 19 bp, Homo sapiens
ctctgtgccagagcctggg

SEQ ID NO: 2853830 - DNA, 22 bp, Homo sapiens
ctctgtgcttttaaatgcataa

SEQ ID NO: 2853831 - DNA, 22 bp, Homo sapiens
ctctgtgtcaggtggggcagct

SEQ ID NO: 2853832 - DNA, 16 bp, Homo sapiens
ctcttaaaaaataaaa

SEQ ID NO: 2853833 - DNA, 20 bp, Homo sapiens
ctcttaaagctgcctgtagt

SEQ ID NO: 2853834 - DNA, 16 bp, Homo sapiens
ctcttcaactgaccag

SEQ ID NO: 2853835 - DNA, 17 bp, Homo sapiens
ctcttcaactgaccagc

SEQ ID NO: 2853836 - DNA, 11 bp, Homo sapiens
ctcttcagaaa

SEQ ID NO: 2853837 - DNA, 18 bp, Homo sapiens
ctcttccccttgcccttg

SEQ ID NO: 2853838 - DNA, 19 bp, Homo sapiens
ctcttccccttgcccttgc

SEQ ID NO: 2853839 - DNA, 15 bp, Homo sapiens
ctcttcccctttcct

SEQ ID NO: 2853840 - DNA, 15 bp, Homo sapiens
ctcttcctacccaac

SEQ ID NO: 2853841 - DNA, 22 bp, Homo sapiens
ctcttcctacccaaccactcaa

SEQ ID NO: 2853842 - DNA, 13 bp, Homo sapiens
ctcttccttcccc

SEQ ID NO: 2853843 - DNA, 16 bp, Homo sapiens
ctcttctatttaaaaa

SEQ ID NO: 2853844 - DNA, 17 bp, Homo sapiens
ctcttctattttgtaaa

SEQ ID NO: 2853845 - DNA, 19 bp, Homo sapiens
ctcttctgttctcaaatgc

SEQ ID NO: 2853846 - DNA, 15 bp, Homo sapiens
ctcttgacctcaggt

SEQ ID NO: 2853847 - DNA, 20 bp, Homo sapiens
ctcttgccactgcctcttcc

SEQ ID NO: 2853848 - DNA, 20 bp, Homo sapiens
ctcttgcctgcacccttcct

SEQ ID NO: 2853849 - DNA, 18 bp, Homo sapiens
ctcttgcctttccacctg

SEQ ID NO: 2853850 - DNA, 15 bp, Homo sapiens
ctcttgcctttctta

SEQ ID NO: 2853851 - DNA, 12 bp, Homo sapiens
ctcttgctcaaa

SEQ ID NO: 2853852 - DNA, 19 bp, Homo sapiens
ctcttgctcaaaaatctgt

SEQ ID NO: 2853853 - DNA, 22 bp, Homo sapiens
ctcttgggcatgctcagccctt

SEQ ID NO: 2853854 - DNA, 21 bp, Homo sapiens
ctctttaagagttagtttctt

SEQ ID NO: 2853855 - DNA, 21 bp, Homo sapiens
ctctttaatgtcacaggcagg

SEQ ID NO: 2853856 - DNA, 22 bp, Homo sapiens
ctctttaatgtcacaggcaggt

SEQ ID NO: 2853857 - DNA, 21 bp, Homo sapiens
ctctttcttattttgtaataa

SEQ ID NO: 2853858 - DNA, 14 bp, Homo sapiens
ctctttgcctgtgt

SEQ ID NO: 2853859 - DNA, 16 bp, Homo sapiens
ctctttgcctgtgtga

SEQ ID NO: 2853860 - DNA, 19 bp, Homo sapiens
ctctttggggtcagccagg

SEQ ID NO: 2853861 - DNA, 20 bp, Homo sapiens
ctctttggggtcagccaggg

SEQ ID NO: 2853862 - DNA, 12 bp, Homo sapiens
ctctttgtaaga

SEQ ID NO: 2853863 - DNA, 20 bp, Homo sapiens
ctctttgttcagttgactta

SEQ ID NO: 2853864 - DNA, 14 bp, Homo sapiens
ctcttttcaaaaca

SEQ ID NO: 2853865 - DNA, 23 bp, Homo sapiens
ctcttttgttcctggctttgaca

SEQ ID NO: 2853866 - DNA, 19 bp, Homo sapiens
ctgaaaactggaataagaa

SEQ ID NO: 2853867 - DNA, 22 bp, Homo sapiens
ctgaaaactggaataagaagca

SEQ ID NO: 2853868 - DNA, 14 bp, Homo sapiens
ctgaaaactgttta

SEQ ID NO: 2853869 - DNA, 18 bp, Homo sapiens
ctgaaaagactcagtgtt

SEQ ID NO: 2853870 - DNA, 12 bp, Homo sapiens
ctgaaaatcact

SEQ ID NO: 2853871 - DNA, 13 bp, Homo sapiens
ctgaaaatcacta

SEQ ID NO: 2853872 - DNA, 16 bp, Homo sapiens
ctgaaaattaacactg

SEQ ID NO: 2853873 - DNA, 18 bp, Homo sapiens
ctgaaacacctcccaggg

SEQ ID NO: 2853874 - DNA, 14 bp, Homo sapiens
ctgaaagaaacagt

SEQ ID NO: 2853875 - DNA, 16 bp, Homo sapiens
ctgaaagaaacagtta

SEQ ID NO: 2853876 - DNA, 20 bp, Homo sapiens
ctgaaagaaacagttaactt

SEQ ID NO: 2853877 - DNA, 11 bp, Homo sapiens
ctgaaagccac

SEQ ID NO: 2853878 - DNA, 21 bp, Homo sapiens
ctgaaagccacgttccttact

SEQ ID NO: 2853879 - DNA, 14 bp, Homo sapiens
ctgaaagccagctg

SEQ ID NO: 2853880 - DNA, 16 bp, Homo sapiens
ctgaaagtgacagaga

SEQ ID NO: 2853881 - DNA, 17 bp, Homo sapiens
ctgaaagtgacagagac

SEQ ID NO: 2853882 - DNA, 18 bp, Homo sapiens
ctgaaagtgacagagacc

SEQ ID NO: 2853883 - DNA, 20 bp, Homo sapiens
ctgccctgccacctgtctgt

SEQ ID NO: 2853884 - DNA, 11 bp, Homo sapiens
ctgccctgctg

SEQ ID NO: 2853885 - DNA, 13 bp, Homo sapiens
ctgccctgtaccc

SEQ ID NO: 2853886 - DNA, 21 bp, Homo sapiens
ctgccctgtaccccagcactt

SEQ ID NO: 2853887 - DNA, 20 bp, Homo sapiens
ctgcccttgtttggggcagg

SEQ ID NO: 2853888 - DNA, 22 bp, Homo sapiens
ctgcccttgtttggggcaggag

SEQ ID NO: 2853889 - DNA, 13 bp, Homo sapiens
ctgccgaccagag

SEQ ID NO: 2853890 - DNA, 15 bp, Homo sapiens
ctgccgacctcgtcc

SEQ ID NO: 2853891 - DNA, 15 bp, Homo sapiens
ctgccgcaccccaga

SEQ ID NO: 2853892 - DNA, 17 bp, Homo sapiens
ctgccgcaccccagagt

SEQ ID NO: 2853893 - DNA, 20 bp, Homo sapiens
ctgcctacattccctggcct

SEQ ID NO: 2853894 - DNA, 21 bp, Homo sapiens
ctgcctacattccctggcctg

SEQ ID NO: 2853895 - DNA, 12 bp, Homo sapiens
ctgcctagaaaa

SEQ ID NO: 2853896 - DNA, 19 bp, Homo sapiens
ctgcctaggaattcccagc

SEQ ID NO: 2853897 - DNA, 15 bp, Homo sapiens
ctgcctatccatcct

SEQ ID NO: 2853898 - DNA, 16 bp, Homo sapiens
ctgcctatccatcctg

SEQ ID NO: 2853899 - DNA, 17 bp, Homo sapiens
ctgcctatccatcctgc

SEQ ID NO: 2853900 - DNA, 18 bp, Homo sapiens
ctgcctccattctgacca

SEQ ID NO: 2853901 - DNA, 15 bp, Homo sapiens
ctgcctcctcttcaa

SEQ ID NO: 2853902 - DNA, 18 bp, Homo sapiens
ctgcctcgaactggctgc

SEQ ID NO: 2853903 - DNA, 15 bp, Homo sapiens
ctgcctctgacacac

SEQ ID NO: 2853904 - DNA, 17 bp, Homo sapiens
ctgcctctgacacacag

SEQ ID NO: 2853905 - DNA, 19 bp, Homo sapiens
ctgcctgaacctggggtca

SEQ ID NO: 2853906 - DNA, 18 bp, Homo sapiens
ctgcctgaagtcacacag

SEQ ID NO: 2853907 - DNA, 23 bp, Homo sapiens
ctgcctgaagtcacacagtgagt

SEQ ID NO: 2853908 - DNA, 16 bp, Homo sapiens
ctgcctgcatctattc

SEQ ID NO: 2853909 - DNA, 16 bp, Homo sapiens
ctgcctgcccaggccc

SEQ ID NO: 2853910 - DNA, 12 bp, Homo sapiens
ctgcctgccctc

SEQ ID NO: 2853911 - DNA, 12 bp, Homo sapiens
ctgcctgcttgg

SEQ ID NO: 2853912 - DNA, 10 bp, Homo sapiens
ctgcctggag

SEQ ID NO: 2853913 - DNA, 18 bp, Homo sapiens
ctgcctggaggacctgag

SEQ ID NO: 2853914 - DNA, 21 bp, Homo sapiens
ctgcctggaggacctgagcct

SEQ ID NO: 2853915 - DNA, 15 bp, Homo sapiens
ctgcctgtagttagg

SEQ ID NO: 2853916 - DNA, 16 bp, Homo sapiens
ctgcctgtagttagga

SEQ ID NO: 2853917 - DNA, 19 bp, Homo sapiens
ctgcctgtagttaggaaat

SEQ ID NO: 2853918 - DNA, 14 bp, Homo sapiens
ctgcctgttcagct

SEQ ID NO: 2853919 - DNA, 17 bp, Homo sapiens
ctgcctgttcagctcca

SEQ ID NO: 2853920 - DNA, 19 bp, Homo sapiens
ctgcctgttcccattcttg

SEQ ID NO: 2853921 - DNA, 13 bp, Homo sapiens
ctgccttccagga

SEQ ID NO: 2853922 - DNA, 20 bp, Homo sapiens
ctgccttgaagccactgaag

SEQ ID NO: 2853923 - DNA, 17 bp, Homo sapiens
ctgcctttggaagaaac

SEQ ID NO: 2853924 - DNA, 17 bp, Homo sapiens
ctgcgagcatttccctc

SEQ ID NO: 2853925 - DNA, 19 bp, Homo sapiens
ctgcgagcatttccctccc

SEQ ID NO: 2853926 - DNA, 20 bp, Homo sapiens
ctgcggaatgaaccacatct

SEQ ID NO: 2853927 - DNA, 15 bp, Homo sapiens
ctgcggagccggcac

SEQ ID NO: 2853928 - DNA, 17 bp, Homo sapiens
ctgcggagccggcacct

SEQ ID NO: 2853929 - DNA, 15 bp, Homo sapiens
ctgcggtccacccag

SEQ ID NO: 2853930 - DNA, 16 bp, Homo sapiens
ctgcggtccacccagg

SEQ ID NO: 2853931 - DNA, 18 bp, Homo sapiens
ctgcggtccacccaggag

SEQ ID NO: 2853932 - DNA, 20 bp, Homo sapiens
ctgcgttttggaagctctga

SEQ ID NO: 2853933 - DNA, 16 bp, Homo sapiens
ctgctaattccccaga

SEQ ID NO: 2853934 - DNA, 15 bp, Homo sapiens
ctgctacaccttagc

SEQ ID NO: 2853935 - DNA, 21 bp, Homo sapiens
ctgctacaccttagcagctct

SEQ ID NO: 2853936 - DNA, 18 bp, Homo sapiens
ctgctacctcactggggt

SEQ ID NO: 2853937 - DNA, 22 bp, Homo sapiens
ctgctactcataagttggacca

SEQ ID NO: 2853938 - DNA, 22 bp, Homo sapiens
ctgctagcacttggagccaagg

SEQ ID NO: 2853939 - DNA, 20 bp, Homo sapiens
ctgctaggcgagtgccagga

SEQ ID NO: 2853940 - DNA, 22 bp, Homo sapiens
ctgctaggcgagtgccaggact

SEQ ID NO: 2853941 - DNA, 22 bp, Homo sapiens
ctgctcaacctctctccttctg

SEQ ID NO: 2853942 - DNA, 23 bp, Homo sapiens
ctgctcaagaagacatggagact

SEQ ID NO: 2853943 - DNA, 14 bp, Homo sapiens
ctgctcagaggggc

SEQ ID NO: 2853944 - DNA, 14 bp, Homo sapiens
ctgctccaagtggt

SEQ ID NO: 2853945 - DNA, 15 bp, Homo sapiens
ctgctcccagcagcc

SEQ ID NO: 2853946 - DNA, 21 bp, Homo sapiens
ctgctcccagcagccctaagg

SEQ ID NO: 2853947 - DNA, 12 bp, Homo sapiens
ctgctcccccac

SEQ ID NO: 2853948 - DNA, 23 bp, Homo sapiens
ctgctcccccaccccctccccag

SEQ ID NO: 2853949 - DNA, 14 bp, Homo sapiens
ctgctcctccaggg

SEQ ID NO: 2853950 - DNA, 16 bp, Homo sapiens
ctgctcctccagggcc

SEQ ID NO: 2853951 - DNA, 22 bp, Homo sapiens
ctgctcctccagggccacgtgc

SEQ ID NO: 2853952 - DNA, 13 bp, Homo sapiens
ctgctcctcccat

SEQ ID NO: 2853953 - DNA, 13 bp, Homo sapiens
ctgctcctctcca

SEQ ID NO: 2853954 - DNA, 17 bp, Homo sapiens
ctgctcctctccaggca

SEQ ID NO: 2853955 - DNA, 13 bp, Homo sapiens
ctgctcgcacaga

SEQ ID NO: 2853956 - DNA, 13 bp, Homo sapiens
ctgctcggggtgc

SEQ ID NO: 2853957 - DNA, 19 bp, Homo sapiens
ctgctcggggtgcacagga

SEQ ID NO: 2853958 - DNA, 18 bp, Homo sapiens
ctgctcgtccccaagtga

SEQ ID NO: 2853959 - DNA, 15 bp, Homo sapiens
ctgctcgtctatcac

SEQ ID NO: 2853960 - DNA, 15 bp, Homo sapiens
ctgctctcagcctcc

SEQ ID NO: 2853961 - DNA, 18 bp, Homo sapiens
ctgctctcagcctcccaa

SEQ ID NO: 2853962 - DNA, 19 bp, Homo sapiens
ctgctctgaggcttccaga

SEQ ID NO: 2853963 - DNA, 12 bp, Homo sapiens
ctgctctgatgc

SEQ ID NO: 2853964 - DNA, 18 bp, Homo sapiens
ctgctctgatgcatcaga

SEQ ID NO: 2853965 - DNA, 15 bp, Homo sapiens
ctgctcttgcctgca

SEQ ID NO: 2853966 - DNA, 19 bp, Homo sapiens
ctgctgaaacacctcccag

SEQ ID NO: 2853967 - DNA, 19 bp, Homo sapiens
ctgctgacagacacaggcc

SEQ ID NO: 2853968 - DNA, 23 bp, Homo sapiens
ctgctgacagacacaggcccggc

SEQ ID NO: 2853969 - DNA, 11 bp, Homo sapiens
ctgctgacagt

SEQ ID NO: 2853970 - DNA, 13 bp, Homo sapiens
ctgctgacagtgt

SEQ ID NO: 2853971 - DNA, 12 bp, Homo sapiens
ctgctgagaacc

SEQ ID NO: 2853972 - DNA, 13 bp, Homo sapiens
ctgctgagaacct

SEQ ID NO: 2853973 - DNA, 14 bp, Homo sapiens
ctgctgagaacctg

SEQ ID NO: 2853974 - DNA, 17 bp, Homo sapiens
ctgtacccaatttaatt

SEQ ID NO: 2853975 - DNA, 14 bp, Homo sapiens
ctgtacgtctgaca

SEQ ID NO: 2853976 - DNA, 17 bp, Homo sapiens
ctgtactgcctgcttgg

SEQ ID NO: 2853977 - DNA, 19 bp, Homo sapiens
ctgtactgcctgcttgggg

SEQ ID NO: 2853978 - DNA, 13 bp, Homo sapiens
ctgtacttaataa

SEQ ID NO: 2853979 - DNA, 16 bp, Homo sapiens
ctgtacttaataaatt

SEQ ID NO: 2853980 - DNA, 18 bp, Homo sapiens
ctgtacttaataaattca

SEQ ID NO: 2853981 - DNA, 16 bp, Homo sapiens
ctgtacttattttcca

SEQ ID NO: 2853982 - DNA, 15 bp, Homo sapiens
ctgtacttcaagtta

SEQ ID NO: 2853983 - DNA, 16 bp, Homo sapiens
ctgtagcatcttctgg

SEQ ID NO: 2853984 - DNA, 17 bp, Homo sapiens
ctgtagcatcttctgga

SEQ ID NO: 2853985 - DNA, 18 bp, Homo sapiens
ctgtagcatcttctggag

SEQ ID NO: 2853986 - DNA, 17 bp, Homo sapiens
ctgtagcattacagtgg

SEQ ID NO: 2853987 - DNA, 17 bp, Homo sapiens
ctgtagccccagtgaca

SEQ ID NO: 2853988 - DNA, 18 bp, Homo sapiens
ctgtagccccagtgacag

SEQ ID NO: 2853989 - DNA, 20 bp, Homo sapiens
ctgtagccccagtgacagct

SEQ ID NO: 2853990 - DNA, 14 bp, Homo sapiens
ctgtagggctggac

SEQ ID NO: 2853991 - DNA, 16 bp, Homo sapiens
ctgtagggctggacct

SEQ ID NO: 2853992 - DNA, 14 bp, Homo sapiens
ctgtaggttgctta

SEQ ID NO: 2853993 - DNA, 15 bp, Homo sapiens
ctgtagtcccagcca

SEQ ID NO: 2853994 - DNA, 20 bp, Homo sapiens
ctgtagtcctagccactcag

SEQ ID NO: 2853995 - DNA, 13 bp, Homo sapiens
ctgtagtgagaaa

SEQ ID NO: 2853996 - DNA, 21 bp, Homo sapiens
ctgtagttaggaaataaaacc

SEQ ID NO: 2853997 - DNA, 20 bp, Homo sapiens
ctgtagttgcgtggactctg

SEQ ID NO: 2853998 - DNA, 19 bp, Homo sapiens
ctgtatatacaataacata

SEQ ID NO: 2853999 - DNA, 23 bp, Homo sapiens
ctgtatatacaataacataattt

SEQ ID NO: 2854000 - DNA, 20 bp, Homo sapiens
ctgtatattatggtgtaatg

SEQ ID NO: 2854001 - DNA, 22 bp, Homo sapiens
ctgtatattatggtgtaatgca

SEQ ID NO: 2854002 - DNA, 14 bp, Homo sapiens
ctgtatcccatgag

SEQ ID NO: 2854003 - DNA, 22 bp, Homo sapiens
ctgtatcccatgagcctcagca

SEQ ID NO: 2854004 - DNA, 17 bp, Homo sapiens
ctgtatcggagacagtg

SEQ ID NO: 2854005 - DNA, 18 bp, Homo sapiens
ctgtatcggagacagtga

SEQ ID NO: 2854006 - DNA, 21 bp, Homo sapiens
ctgtatctactaaaaatacaa

SEQ ID NO: 2854007 - DNA, 13 bp, Homo sapiens
ctgtattcagatc

SEQ ID NO: 2854008 - DNA, 17 bp, Homo sapiens
ctgtattcagatcgtat

SEQ ID NO: 2854009 - DNA, 17 bp, Homo sapiens
ctgtatttgttcccaag

SEQ ID NO: 2854010 - DNA, 19 bp, Homo sapiens
ctgtatttgttcccaagag

SEQ ID NO: 2854011 - DNA, 10 bp, Homo sapiens
ctgtattttc

SEQ ID NO: 2854012 - DNA, 15 bp, Homo sapiens
ctgtatttttagaga

SEQ ID NO: 2854013 - DNA, 18 bp, Homo sapiens
ctgtcaatttccctgact

SEQ ID NO: 2854014 - DNA, 14 bp, Homo sapiens
ctgtcatagaaatt

SEQ ID NO: 2854015 - DNA, 16 bp, Homo sapiens
ctgtcatccagaaaat

SEQ ID NO: 2854016 - DNA, 23 bp, Homo sapiens
ctgtcattgtccatgcctacaga

SEQ ID NO: 2854017 - DNA, 14 bp, Homo sapiens
ctgtcatttgagca

SEQ ID NO: 2854018 - DNA, 16 bp, Homo sapiens
ctgtcatttgagcagg

SEQ ID NO: 2854019 - DNA, 20 bp, Homo sapiens
ctgtcatttgagcagggctc

SEQ ID NO: 2854020 - DNA, 21 bp, Homo sapiens
ctgtcatttgagcagggctca

SEQ ID NO: 2854021 - DNA, 17 bp, Homo sapiens
ctgtccaggcactgctg

SEQ ID NO: 2854022 - DNA, 22 bp, Homo sapiens
ctgtccaggcactgctgcccag

SEQ ID NO: 2854023 - DNA, 19 bp, Homo sapiens
ctgtccagggccctgagct

SEQ ID NO: 2854024 - DNA, 14 bp, Homo sapiens
ctgtccagtttcca

SEQ ID NO: 2854025 - DNA, 21 bp, Homo sapiens
ctgtccatgtattcacacacc

SEQ ID NO: 2854026 - DNA, 13 bp, Homo sapiens
ctgtcccacctct

SEQ ID NO: 2854027 - DNA, 22 bp, Homo sapiens
ctgtcccctggggtctctgctg

SEQ ID NO: 2854028 - DNA, 16 bp, Homo sapiens
ctgtccctctttgcct

SEQ ID NO: 2854029 - DNA, 18 bp, Homo sapiens
ctgtccctctttgcctgt

SEQ ID NO: 2854030 - DNA, 16 bp, Homo sapiens
ctgtcctactctgtgt

SEQ ID NO: 2854031 - DNA, 18 bp, Homo sapiens
ctgtcctactctgtgtca

SEQ ID NO: 2854032 - DNA, 21 bp, Homo sapiens
ctgtcctactctgtgtcaggt

SEQ ID NO: 2854033 - DNA, 19 bp, Homo sapiens
ctgtcgattagactggaca

SEQ ID NO: 2854034 - DNA, 15 bp, Homo sapiens
ctgtcgcccagtctg

SEQ ID NO: 2854035 - DNA, 14 bp, Homo sapiens
ctgtcgtgtttaca

SEQ ID NO: 2854036 - DNA, 20 bp, Homo sapiens
ctgtctcgagcgccctgcag

SEQ ID NO: 2854037 - DNA, 21 bp, Homo sapiens
ctgtctcgagcgccctgcaga

SEQ ID NO: 2854038 - DNA, 14 bp, Homo sapiens
ctgtctctgctctt

SEQ ID NO: 2854039 - DNA, 19 bp, Homo sapiens
ctgtctctgctcttgcctg

SEQ ID NO: 2854040 - DNA, 11 bp, Homo sapiens
ctgtctctgtc

SEQ ID NO: 2854041 - DNA, 17 bp, Homo sapiens
ctgtctgccagccagca

SEQ ID NO: 2854042 - DNA, 16 bp, Homo sapiens
ctgtctggctgtacgt

SEQ ID NO: 2854043 - DNA, 17 bp, Homo sapiens
ctgtctgtctgtcccaa

SEQ ID NO: 2854044 - DNA, 17 bp, Homo sapiens
ctgtctttcagcattca

SEQ ID NO: 2854045 - DNA, 20 bp, Homo sapiens
ctgtgaaatcagaagtgcaa

SEQ ID NO: 2854046 - DNA, 15 bp, Homo sapiens
ctgtgaacccaggac

SEQ ID NO: 2854047 - DNA, 14 bp, Homo sapiens
ctgtgaacctggag

SEQ ID NO: 2854048 - DNA, 19 bp, Homo sapiens
ctgtgaagaatgaagtgga

SEQ ID NO: 2854049 - DNA, 18 bp, Homo sapiens
ctgtgaagacccagcagg

SEQ ID NO: 2854050 - DNA, 22 bp, Homo sapiens
ctgtgaagacccagcaggaagc

SEQ ID NO: 2854051 - DNA, 22 bp, Homo sapiens
ctgtgacctgccccgcccagct

SEQ ID NO: 2854052 - DNA, 15 bp, Homo sapiens
ctgtgacctgctgag

SEQ ID NO: 2854053 - DNA, 16 bp, Homo sapiens
ctgtgacctgctgagc

SEQ ID NO: 2854054 - DNA, 18 bp, Homo sapiens
ctgtgacctgctgagctc

SEQ ID NO: 2854055 - DNA, 17 bp, Homo sapiens
ctgtgactcgcttagct

SEQ ID NO: 2854056 - DNA, 15 bp, Homo sapiens
ctgtgagcaagaagt

SEQ ID NO: 2854057 - DNA, 13 bp, Homo sapiens
ctgtgaggcaggg

SEQ ID NO: 2854058 - DNA, 14 bp, Homo sapiens
ctgtgaggcagggg

SEQ ID NO: 2854059 - DNA, 16 bp, Homo sapiens
ctgtgaggtgctgatg

SEQ ID NO: 2854060 - DNA, 20 bp, Homo sapiens
ctgtgatggggtgggcaggg

SEQ ID NO: 2854061 - DNA, 21 bp, Homo sapiens
ctgtgatggggtgggcagggc

SEQ ID NO: 2854062 - DNA, 22 bp, Homo sapiens
ctgtgatggggtgggcagggct

SEQ ID NO: 2854063 - DNA, 21 bp, Homo sapiens
ctgtgcacggccagctgcatc

SEQ ID NO: 2854064 - DNA, 15 bp, Homo sapiens
ctgtgcagatgagca

SEQ ID NO: 2854065 - DNA, 14 bp, Homo sapiens
cttctctctctggt

SEQ ID NO: 2854066 - DNA, 22 bp, Homo sapiens
cttctctgtgaacgatttagaa

SEQ ID NO: 2854067 - DNA, 21 bp, Homo sapiens
cttctcttacgctctctgtct

SEQ ID NO: 2854068 - DNA, 21 bp, Homo sapiens
cttctctttcttattttgtaa

SEQ ID NO: 2854069 - DNA, 19 bp, Homo sapiens
cttctctttgtccccaaat

SEQ ID NO: 2854070 - DNA, 17 bp, Homo sapiens
cttctgaaacttcataa

SEQ ID NO: 2854071 - DNA, 15 bp, Homo sapiens
cttctgaaatgaaac

SEQ ID NO: 2854072 - DNA, 13 bp, Homo sapiens
cttctgactgctg

SEQ ID NO: 2854073 - DNA, 19 bp, Homo sapiens
cttctgcaattgcttagga

SEQ ID NO: 2854074 - DNA, 17 bp, Homo sapiens
cttctgccatattctgt

SEQ ID NO: 2854075 - DNA, 11 bp, Homo sapiens
cttctggagcc

SEQ ID NO: 2854076 - DNA, 20 bp, Homo sapiens
cttctggagtctccagtggt

SEQ ID NO: 2854077 - DNA, 16 bp, Homo sapiens
cttctgtcctactctg

SEQ ID NO: 2854078 - DNA, 17 bp, Homo sapiens
cttctgtcctactctgt

SEQ ID NO: 2854079 - DNA, 12 bp, Homo sapiens
cttctgttctca

SEQ ID NO: 2854080 - DNA, 13 bp, Homo sapiens
cttcttaaagagt

SEQ ID NO: 2854081 - DNA, 16 bp, Homo sapiens
cttcttcacccagcta

SEQ ID NO: 2854082 - DNA, 18 bp, Homo sapiens
cttcttcacccagctaat

SEQ ID NO: 2854083 - DNA, 20 bp, Homo sapiens
cttcttcagaagacactgca

SEQ ID NO: 2854084 - DNA, 20 bp, Homo sapiens
cttcttcggggaactcctgg

SEQ ID NO: 2854085 - DNA, 20 bp, Homo sapiens
cttcttgccccttgggcctc

SEQ ID NO: 2854086 - DNA, 22 bp, Homo sapiens
cttcttgccccttgggcctccc

SEQ ID NO: 2854087 - DNA, 14 bp, Homo sapiens
cttctttaaatcaa

SEQ ID NO: 2854088 - DNA, 18 bp, Homo sapiens
cttctttaaatcaaaagc

SEQ ID NO: 2854089 - DNA, 14 bp, Homo sapiens
cttctttcctcttc

SEQ ID NO: 2854090 - DNA, 15 bp, Homo sapiens
cttctttcctcttcc

SEQ ID NO: 2854091 - DNA, 20 bp, Homo sapiens
cttctttttattttcttttg

SEQ ID NO: 2854092 - DNA, 14 bp, Homo sapiens
cttgaaaaagtaga

SEQ ID NO: 2854093 - DNA, 22 bp, Homo sapiens
cttgaaaacctcatttaccata

SEQ ID NO: 2854094 - DNA, 13 bp, Homo sapiens
cttgaaagctgtg

SEQ ID NO: 2854095 - DNA, 17 bp, Homo sapiens
cttgaaattatatctgt

SEQ ID NO: 2854096 - DNA, 21 bp, Homo sapiens
cttgaaattatatctgtggtc

SEQ ID NO: 2854097 - DNA, 24 bp, Homo sapiens
cttgaaattatatctgtggtcttc

SEQ ID NO: 2854098 - DNA, 13 bp, Homo sapiens
cttgaacactggg

SEQ ID NO: 2854099 - DNA, 18 bp, Homo sapiens
cttgaactcctggcctca

SEQ ID NO: 2854100 - DNA, 19 bp, Homo sapiens
cttgaactcctggcctcaa

SEQ ID NO: 2854101 - DNA, 14 bp, Homo sapiens
cttgaactgattca

SEQ ID NO: 2854102 - DNA, 22 bp, Homo sapiens
cttgaactgttctggcctcaga

SEQ ID NO: 2854103 - DNA, 13 bp, Homo sapiens
cttgaagaatatt

SEQ ID NO: 2854104 - DNA, 13 bp, Homo sapiens
cttgaagatcgtt

SEQ ID NO: 2854105 - DNA, 21 bp, Homo sapiens
cttgaagccactgaagctggg

SEQ ID NO: 2854106 - DNA, 14 bp, Homo sapiens
cttgaaggaacagt

SEQ ID NO: 2854107 - DNA, 16 bp, Homo sapiens
cttgaagggtaaagaa

SEQ ID NO: 2854108 - DNA, 19 bp, Homo sapiens
cttgactatcacatacaat

SEQ ID NO: 2854109 - DNA, 21 bp, Homo sapiens
cttgactatcacatacaattt

SEQ ID NO: 2854110 - DNA, 23 bp, Homo sapiens
cttgactatcacatacaatttgc

SEQ ID NO: 2854111 - DNA, 16 bp, Homo sapiens
cttgagacctcagcca

SEQ ID NO: 2854112 - DNA, 13 bp, Homo sapiens
cttgagccagtaa

SEQ ID NO: 2854113 - DNA, 16 bp, Homo sapiens
cttgagccagtaattg

SEQ ID NO: 2854114 - DNA, 14 bp, Homo sapiens
cttgagcccaggag

SEQ ID NO: 2854115 - DNA, 12 bp, Homo sapiens
cttgagcttggc

SEQ ID NO: 2854116 - DNA, 13 bp, Homo sapiens
cttgaggacacat

SEQ ID NO: 2854117 - DNA, 16 bp, Homo sapiens
cttgaggacacatgtc

SEQ ID NO: 2854118 - DNA, 14 bp, Homo sapiens
cttgaggccaggag

SEQ ID NO: 2854119 - DNA, 17 bp, Homo sapiens
cttgagggttgggctgg

SEQ ID NO: 2854120 - DNA, 17 bp, Homo sapiens
cttgatatagaaagctg

SEQ ID NO: 2854121 - DNA, 19 bp, Homo sapiens
cttgattttagccttctct

SEQ ID NO: 2854122 - DNA, 15 bp, Homo sapiens
cttgcaatggcagcc

SEQ ID NO: 2854123 - DNA, 16 bp, Homo sapiens
cttgcaatggcagcct

SEQ ID NO: 2854124 - DNA, 23 bp, Homo sapiens
cttgcacaagcttgtatatacat

SEQ ID NO: 2854125 - DNA, 12 bp, Homo sapiens
cttgcacctgca

SEQ ID NO: 2854126 - DNA, 11 bp, Homo sapiens
cttgcattaga

SEQ ID NO: 2854127 - DNA, 13 bp, Homo sapiens
cttgcccagggct

SEQ ID NO: 2854128 - DNA, 18 bp, Homo sapiens
cttgcccagggctcagcc

SEQ ID NO: 2854129 - DNA, 16 bp, Homo sapiens
cttgccccttgggcct

SEQ ID NO: 2854130 - DNA, 20 bp, Homo sapiens
cttgcccggattctgggagg

SEQ ID NO: 2854131 - DNA, 15 bp, Homo sapiens
cttgcccttgccctg

SEQ ID NO: 2854132 - DNA, 16 bp, Homo sapiens
cttgcctttccacctg

SEQ ID NO: 2854133 - DNA, 20 bp, Homo sapiens
cttgcctttccacctgcttt

SEQ ID NO: 2854134 - DNA, 21 bp, Homo sapiens
cttgcctttcttatttgcaat

SEQ ID NO: 2854135 - DNA, 18 bp, Homo sapiens
cttgccttttaaaagaaa

SEQ ID NO: 2854136 - DNA, 12 bp, Homo sapiens
cttgctctgctg

SEQ ID NO: 2854137 - DNA, 16 bp, Homo sapiens
cttgctctgctgacag

SEQ ID NO: 2854138 - DNA, 22 bp, Homo sapiens
cttgctctgctgacagacacag

SEQ ID NO: 2854139 - DNA, 15 bp, Homo sapiens
cttgctgtcctaggc

SEQ ID NO: 2854140 - DNA, 16 bp, Homo sapiens
cttgctgtcctaggcc

SEQ ID NO: 2854141 - DNA, 17 bp, Homo sapiens
cttgctgtcctaggcca

SEQ ID NO: 2854142 - DNA, 20 bp, Homo sapiens
cttgctgtcctaggccacac

SEQ ID NO: 2854143 - DNA, 20 bp, Homo sapiens
cttggaaaaatccagaaaga

SEQ ID NO: 2854144 - DNA, 21 bp, Homo sapiens
cttggaaagcatcacctcagg

SEQ ID NO: 2854145 - DNA, 12 bp, Homo sapiens
cttggacctctg

SEQ ID NO: 2854146 - DNA, 16 bp, Homo sapiens
cttggacctctgctct

SEQ ID NO: 2854147 - DNA, 17 bp, Homo sapiens
cttggacctctgctctg

SEQ ID NO: 2854148 - DNA, 15 bp, Homo sapiens
cttggactcctccca

SEQ ID NO: 2854149 - DNA, 18 bp, Homo sapiens
cttggactcctcccacaa

SEQ ID NO: 2854150 - DNA, 22 bp, Homo sapiens
cttggagagggacgaagaaagg

SEQ ID NO: 2854151 - DNA, 16 bp, Homo sapiens
cttggaggacagtggg

SEQ ID NO: 2854152 - DNA, 18 bp, Homo sapiens
cttggataatgctgttgc

SEQ ID NO: 2854153 - DNA, 22 bp, Homo sapiens
cttggataatgctgttgcctca

SEQ ID NO: 2854154 - DNA, 23 bp, Homo sapiens
cttggataatgctgttgcctcat

SEQ ID NO: 2854155 - DNA, 18 bp, Homo sapiens
cttggcatcacagggcag

SEQ ID NO: 2854156 - DNA, 18 bp, Homo sapiens
gaaatacacaagtaaaca

SEQ ID NO: 2854157 - DNA, 18 bp, Homo sapiens
gaaatagacagtatattt

SEQ ID NO: 2854158 - DNA, 15 bp, Homo sapiens
gaaatagtgttcttt

SEQ ID NO: 2854159 - DNA, 16 bp, Homo sapiens
gaaatatagttctgat

SEQ ID NO: 2854160 - DNA, 20 bp, Homo sapiens
gaaatatcagttactcagcc

SEQ ID NO: 2854161 - DNA, 23 bp, Homo sapiens
gaaatatcagttactcagccctg

SEQ ID NO: 2854162 - DNA, 18 bp, Homo sapiens
gaaatatgcacaatagca

SEQ ID NO: 2854163 - DNA, 22 bp, Homo sapiens
gaaatatttaagtatatagtat

SEQ ID NO: 2854164 - DNA, 21 bp, Homo sapiens
gaaatatttgcttatttatat

SEQ ID NO: 2854165 - DNA, 14 bp, Homo sapiens
gaaatgacattttg

SEQ ID NO: 2854166 - DNA, 14 bp, Homo sapiens
gaaatgataaagat

SEQ ID NO: 2854167 - DNA, 18 bp, Homo sapiens
gaaatggagaagctctgt

SEQ ID NO: 2854168 - DNA, 14 bp, Homo sapiens
gaaatgtttcacta

SEQ ID NO: 2854169 - DNA, 19 bp, Homo sapiens
gaaattactacaaaatttg

SEQ ID NO: 2854170 - DNA, 19 bp, Homo sapiens
gaaattagctgtgtgaaat

SEQ ID NO: 2854171 - DNA, 13 bp, Homo sapiens
gaaattcacactg

SEQ ID NO: 2854172 - DNA, 17 bp, Homo sapiens
gaaattgcctgacgaac

SEQ ID NO: 2854173 - DNA, 15 bp, Homo sapiens
gaaattgttcctgat

SEQ ID NO: 2854174 - DNA, 20 bp, Homo sapiens
gaaatttaaactataagcaa

SEQ ID NO: 2854175 - DNA, 21 bp, Homo sapiens
gaaatttcagattcccagagc

SEQ ID NO: 2854176 - DNA, 19 bp, Homo sapiens
gaacaaagaaaaaaatata

SEQ ID NO: 2854177 - DNA, 22 bp, Homo sapiens
gaacaaagaacggcatgtgaat

SEQ ID NO: 2854178 - DNA, 19 bp, Homo sapiens
gaacaatagctattgcatg

SEQ ID NO: 2854179 - DNA, 17 bp, Homo sapiens
gaacacaggcaaaatcc

SEQ ID NO: 2854180 - DNA, 17 bp, Homo sapiens
gaacaccaacttttatt

SEQ ID NO: 2854181 - DNA, 20 bp, Homo sapiens
gaacaccactttgtctctga

SEQ ID NO: 2854182 - DNA, 21 bp, Homo sapiens
gaacacccgactcctcaaaag

SEQ ID NO: 2854183 - DNA, 20 bp, Homo sapiens
gaacactgggggaggggaca

SEQ ID NO: 2854184 - DNA, 23 bp, Homo sapiens
gaacagaacatagacagaagaaa

SEQ ID NO: 2854185 - DNA, 18 bp, Homo sapiens
gaacagacaacagaagtc

SEQ ID NO: 2854186 - DNA, 17 bp, Homo sapiens
gaacagacaggagaaat

SEQ ID NO: 2854187 - DNA, 20 bp, Homo sapiens
gaacagactggaagcacagc

SEQ ID NO: 2854188 - DNA, 22 bp, Homo sapiens
gaacagactggaagcacagctt

SEQ ID NO: 2854189 - DNA, 21 bp, Homo sapiens
gaacagagtatatatgtacag

SEQ ID NO: 2854190 - DNA, 20 bp, Homo sapiens
gaacagcagactcagctctg

SEQ ID NO: 2854191 - DNA, 21 bp, Homo sapiens
gaacagcagactcagctctga

SEQ ID NO: 2854192 - DNA, 14 bp, Homo sapiens
gaacagtgtttccc

SEQ ID NO: 2854193 - DNA, 20 bp, Homo sapiens
gaacatccaaggagaaacag

SEQ ID NO: 2854194 - DNA, 21 bp, Homo sapiens
gaacatgagtttatgggaatg

SEQ ID NO: 2854195 - DNA, 16 bp, Homo sapiens
gaacatgcacatttat

SEQ ID NO: 2854196 - DNA, 18 bp, Homo sapiens
gaacatgcacatttatat

SEQ ID NO: 2854197 - DNA, 15 bp, Homo sapiens
gaacatgcctgattt

SEQ ID NO: 2854198 - DNA, 19 bp, Homo sapiens
gaacatgcctgattttaaa

SEQ ID NO: 2854199 - DNA, 14 bp, Homo sapiens
gaacatttctagaa

SEQ ID NO: 2854200 - DNA, 20 bp, Homo sapiens
gaaccaaagagactggagca

SEQ ID NO: 2854201 - DNA, 18 bp, Homo sapiens
gaaccacatcttgctctg

SEQ ID NO: 2854202 - DNA, 21 bp, Homo sapiens
gaaccacatcttgctctgctg

SEQ ID NO: 2854203 - DNA, 16 bp, Homo sapiens
gaaccaccacacccag

SEQ ID NO: 2854204 - DNA, 17 bp, Homo sapiens
gaaccaccacacccagc

SEQ ID NO: 2854205 - DNA, 11 bp, Homo sapiens
gaacccaggac

SEQ ID NO: 2854206 - DNA, 13 bp, Homo sapiens
gaacccctgtgtc

SEQ ID NO: 2854207 - DNA, 19 bp, Homo sapiens
gaacctaattcaattcaaa

SEQ ID NO: 2854208 - DNA, 11 bp, Homo sapiens
gaacctcacct

SEQ ID NO: 2854209 - DNA, 11 bp, Homo sapiens
gaacctcaggc

SEQ ID NO: 2854210 - DNA, 15 bp, Homo sapiens
gaactcaactttgac

SEQ ID NO: 2854211 - DNA, 20 bp, Homo sapiens
gaactcagctgtctgtggct

SEQ ID NO: 2854212 - DNA, 19 bp, Homo sapiens
gaactcccagcaacacaag

SEQ ID NO: 2854213 - DNA, 20 bp, Homo sapiens
gaactcctggaaatatcagt

SEQ ID NO: 2854214 - DNA, 20 bp, Homo sapiens
gaactctggcttccaggtat

SEQ ID NO: 2854215 - DNA, 20 bp, Homo sapiens
gaactcttaatcaaatagca

SEQ ID NO: 2854216 - DNA, 19 bp, Homo sapiens
gaactgaagggggcggcct

SEQ ID NO: 2854217 - DNA, 20 bp, Homo sapiens
gaactggagggtgagaggaa

SEQ ID NO: 2854218 - DNA, 16 bp, Homo sapiens
gaactggccaagctga

SEQ ID NO: 2854219 - DNA, 12 bp, Homo sapiens
gaactggctgca

SEQ ID NO: 2854220 - DNA, 12 bp, Homo sapiens
gaactgtgacag

SEQ ID NO: 2854221 - DNA, 16 bp, Homo sapiens
gaactgtgacaggaag

SEQ ID NO: 2854222 - DNA, 18 bp, Homo sapiens
gaactgtgacaggaagcc

SEQ ID NO: 2854223 - DNA, 22 bp, Homo sapiens
gaactgtgatggggtgggcagg

SEQ ID NO: 2854224 - DNA, 21 bp, Homo sapiens
gaacttcgaccctttctctga

SEQ ID NO: 2854225 - DNA, 16 bp, Homo sapiens
gaacttgaactgattc

SEQ ID NO: 2854226 - DNA, 22 bp, Homo sapiens
gaacttgctgctgagtgcacca

SEQ ID NO: 2854227 - DNA, 19 bp, Homo sapiens
gaacttggaaagaaatgcc

SEQ ID NO: 2854228 - DNA, 18 bp, Homo sapiens
gaagaaaaaatacatttt

SEQ ID NO: 2854229 - DNA, 14 bp, Homo sapiens
gaagaaaaagaagc

SEQ ID NO: 2854230 - DNA, 22 bp, Homo sapiens
gaagaaaactcctttagcaggt

SEQ ID NO: 2854231 - DNA, 15 bp, Homo sapiens
gaagaaaaggtacat

SEQ ID NO: 2854232 - DNA, 20 bp, Homo sapiens
gaagaaacaggggatcaaag

SEQ ID NO: 2854233 - DNA, 23 bp, Homo sapiens
gaagaaacaggggatcaaagttc

SEQ ID NO: 2854234 - DNA, 17 bp, Homo sapiens
gaagaaatgacattttg

SEQ ID NO: 2854235 - DNA, 14 bp, Homo sapiens
gaagaaattcctgt

SEQ ID NO: 2854236 - DNA, 18 bp, Homo sapiens
gaagaaattcctgtagca

SEQ ID NO: 2854237 - DNA, 22 bp, Homo sapiens
gaagaaattcctgtagcatctt

SEQ ID NO: 2854238 - DNA, 14 bp, Homo sapiens
gaagaagggaaatt

SEQ ID NO: 2854239 - DNA, 17 bp, Homo sapiens
gaagaatattcaggact

SEQ ID NO: 2854240 - DNA, 21 bp, Homo sapiens
gaagaatctcatctcagtgaa

SEQ ID NO: 2854241 - DNA, 20 bp, Homo sapiens
gaagaattgaacccaggagg

SEQ ID NO: 2854242 - DNA, 15 bp, Homo sapiens
gaagaattttcagac

SEQ ID NO: 2854243 - DNA, 16 bp, Homo sapiens
gaagacactgatgggc

SEQ ID NO: 2854244 - DNA, 21 bp, Homo sapiens
gaagacactgatgggcaaccc

SEQ ID NO: 2854245 - DNA, 15 bp, Homo sapiens
gaagacaggacagtg

SEQ ID NO: 2854246 - DNA, 22 bp, Homo sapiens
gacctggttggccgtggtccag

SEQ ID NO: 2854247 - DNA, 12 bp, Homo sapiens
gacctgtaatca

SEQ ID NO: 2854248 - DNA, 18 bp, Homo sapiens
gaccttctccaaatgaga

SEQ ID NO: 2854249 - DNA, 14 bp, Homo sapiens
gaccttgaactggg

SEQ ID NO: 2854250 - DNA, 14 bp, Homo sapiens
gacctttctgagtg

SEQ ID NO: 2854251 - DNA, 21 bp, Homo sapiens
gacctttgtcatctttcttct

SEQ ID NO: 2854252 - DNA, 18 bp, Homo sapiens
gacgagggatgggatttc

SEQ ID NO: 2854253 - DNA, 22 bp, Homo sapiens
gacgcatgccctcaatcccagc

SEQ ID NO: 2854254 - DNA, 17 bp, Homo sapiens
gacgccactcatttcat

SEQ ID NO: 2854255 - DNA, 19 bp, Homo sapiens
gacgccactcatttcatct

SEQ ID NO: 2854256 - DNA, 21 bp, Homo sapiens
gacgccactcatttcatctca

SEQ ID NO: 2854257 - DNA, 23 bp, Homo sapiens
gacgccactcatttcatctcatt

SEQ ID NO: 2854258 - DNA, 18 bp, Homo sapiens
gacggaggttgcagtgag

SEQ ID NO: 2854259 - DNA, 14 bp, Homo sapiens
gacggagtcccacc

SEQ ID NO: 2854260 - DNA, 18 bp, Homo sapiens
gacggagtcccaccttgg

SEQ ID NO: 2854261 - DNA, 19 bp, Homo sapiens
gacggccccgtcagccaca

SEQ ID NO: 2854262 - DNA, 17 bp, Homo sapiens
gacggggtttcaccatg

SEQ ID NO: 2854263 - DNA, 16 bp, Homo sapiens
gacggtcccacactgg

SEQ ID NO: 2854264 - DNA, 18 bp, Homo sapiens
gacgtcaagtctccttcc

SEQ ID NO: 2854265 - DNA, 22 bp, Homo sapiens
gacgtcagtagtttgagaccag

SEQ ID NO: 2854266 - DNA, 11 bp, Homo sapiens
gacgtcctgga

SEQ ID NO: 2854267 - DNA, 18 bp, Homo sapiens
gactaaaaatattataac

SEQ ID NO: 2854268 - DNA, 19 bp, Homo sapiens
gactaacactcagaagcct

SEQ ID NO: 2854269 - DNA, 23 bp, Homo sapiens
gactaacactcagaagcctgggg

SEQ ID NO: 2854270 - DNA, 15 bp, Homo sapiens
gactacaggcaccca

SEQ ID NO: 2854271 - DNA, 22 bp, Homo sapiens
gactagaggcagggaggggact

SEQ ID NO: 2854272 - DNA, 14 bp, Homo sapiens
gactataaacatta

SEQ ID NO: 2854273 - DNA, 18 bp, Homo sapiens
gactatcaaactgaagcc

SEQ ID NO: 2854274 - DNA, 16 bp, Homo sapiens
gactatcacatacaat

SEQ ID NO: 2854275 - DNA, 19 bp, Homo sapiens
gactatcttactatttcac

SEQ ID NO: 2854276 - DNA, 15 bp, Homo sapiens
gactatgaaaagcta

SEQ ID NO: 2854277 - DNA, 20 bp, Homo sapiens
gactcaagtttttacaaaat

SEQ ID NO: 2854278 - DNA, 15 bp, Homo sapiens
gactcacaagaagac

SEQ ID NO: 2854279 - DNA, 17 bp, Homo sapiens
gactcacaagaagacca

SEQ ID NO: 2854280 - DNA, 22 bp, Homo sapiens
gactcacaagaagaccagactg

SEQ ID NO: 2854281 - DNA, 17 bp, Homo sapiens
gactcacctgttacttg

SEQ ID NO: 2854282 - DNA, 15 bp, Homo sapiens
gactcagctccagaa

SEQ ID NO: 2854283 - DNA, 22 bp, Homo sapiens
gactcagctctgacattctgat

SEQ ID NO: 2854284 - DNA, 17 bp, Homo sapiens
gactcaggatccagtcc

SEQ ID NO: 2854285 - DNA, 23 bp, Homo sapiens
gactcaggcccccacctggctca

SEQ ID NO: 2854286 - DNA, 14 bp, Homo sapiens
gactcagggcccca

SEQ ID NO: 2854287 - DNA, 17 bp, Homo sapiens
gactcagggccccagca

SEQ ID NO: 2854288 - DNA, 12 bp, Homo sapiens
gactcagtgttc

SEQ ID NO: 2854289 - DNA, 12 bp, Homo sapiens
gactccagccag

SEQ ID NO: 2854290 - DNA, 18 bp, Homo sapiens
gactccccaggccaggcc

SEQ ID NO: 2854291 - DNA, 14 bp, Homo sapiens
gactcctcccacaa

SEQ ID NO: 2854292 - DNA, 13 bp, Homo sapiens
gactcctgccctg

SEQ ID NO: 2854293 - DNA, 19 bp, Homo sapiens
gactcgcttagctgaaacc

SEQ ID NO: 2854294 - DNA, 15 bp, Homo sapiens
gactctctgtgacct

SEQ ID NO: 2854295 - DNA, 14 bp, Homo sapiens
gactctgcacatga

SEQ ID NO: 2854296 - DNA, 15 bp, Homo sapiens
gactctgcacatgtc

SEQ ID NO: 2854297 - DNA, 14 bp, Homo sapiens
gactcttgttttca

SEQ ID NO: 2854298 - DNA, 17 bp, Homo sapiens
gactgaagaaggacatt

SEQ ID NO: 2854299 - DNA, 18 bp, Homo sapiens
gactgccccaactcctgg

SEQ ID NO: 2854300 - DNA, 12 bp, Homo sapiens
gactgctgggac

SEQ ID NO: 2854301 - DNA, 14 bp, Homo sapiens
gactgctgggactg

SEQ ID NO: 2854302 - DNA, 19 bp, Homo sapiens
gactgctgggactggccag

SEQ ID NO: 2854303 - DNA, 17 bp, Homo sapiens
gactggctggctgcagt

SEQ ID NO: 2854304 - DNA, 20 bp, Homo sapiens
gactggtgctataggctgga

SEQ ID NO: 2854305 - DNA, 18 bp, Homo sapiens
gactgtacttattttcca

SEQ ID NO: 2854306 - DNA, 17 bp, Homo sapiens
gactgtcgtgtttacaa

SEQ ID NO: 2854307 - DNA, 18 bp, Homo sapiens
gactgtcgtgtttacaaa

SEQ ID NO: 2854308 - DNA, 12 bp, Homo sapiens
gactgtggctgc

SEQ ID NO: 2854309 - DNA, 14 bp, Homo sapiens
gactgtggctgcta

SEQ ID NO: 2854310 - DNA, 19 bp, Homo sapiens
gacttaaaatattcctgca

SEQ ID NO: 2854311 - DNA, 13 bp, Homo sapiens
gacttaaagcaga

SEQ ID NO: 2854312 - DNA, 14 bp, Homo sapiens
gacttacatgattc

SEQ ID NO: 2854313 - DNA, 15 bp, Homo sapiens
gacttacatgattca

SEQ ID NO: 2854314 - DNA, 21 bp, Homo sapiens
gacttcaagcatggctatttt

SEQ ID NO: 2854315 - DNA, 12 bp, Homo sapiens
gacttcacaaaa

SEQ ID NO: 2854316 - DNA, 17 bp, Homo sapiens
gacttcacaaaatgcaa

SEQ ID NO: 2854317 - DNA, 18 bp, Homo sapiens
gacttcacaaaatgcaag

SEQ ID NO: 2854318 - DNA, 18 bp, Homo sapiens
gacttcagtcctggtctg

SEQ ID NO: 2854319 - DNA, 19 bp, Homo sapiens
gacttcctcgcctctccca

SEQ ID NO: 2854320 - DNA, 17 bp, Homo sapiens
gacttctctttcttatt

SEQ ID NO: 2854321 - DNA, 19 bp, Homo sapiens
gacttcttgcttgtacata

SEQ ID NO: 2854322 - DNA, 20 bp, Homo sapiens
gacttgagcctccatttctg

SEQ ID NO: 2854323 - DNA, 19 bp, Homo sapiens
gacttgggcacccccagcc

SEQ ID NO: 2854324 - DNA, 21 bp, Homo sapiens
gacttgggcacccccagcctg

SEQ ID NO: 2854325 - DNA, 22 bp, Homo sapiens
gacttgggcacccccagcctgg

SEQ ID NO: 2854326 - DNA, 14 bp, Homo sapiens
gacttggtctgatt

SEQ ID NO: 2854327 - DNA, 19 bp, Homo sapiens
gacttgtagggatgccttt

SEQ ID NO: 2854328 - DNA, 16 bp, Homo sapiens
gacttgtgtctctgtg

SEQ ID NO: 2854329 - DNA, 13 bp, Homo sapiens
gagaaacagagac

SEQ ID NO: 2854330 - DNA, 19 bp, Homo sapiens
gagaaacagagacaggccc

SEQ ID NO: 2854331 - DNA, 17 bp, Homo sapiens
gagaaacccaccagcct

SEQ ID NO: 2854332 - DNA, 24 bp, Homo sapiens
gagaaacctccggtgtgagatata

SEQ ID NO: 2854333 - DNA, 21 bp, Homo sapiens
gagaaaccttattgtacctct

SEQ ID NO: 2854334 - DNA, 18 bp, Homo sapiens
gagaaagaagtaggcatg

SEQ ID NO: 2854335 - DNA, 16 bp, Homo sapiens
gagaaaggttgaagca

SEQ ID NO: 2854336 - DNA, 13 bp, Homo sapiens
gagaaatatttat

SEQ ID NO: 2854337 - DNA, 21 bp, Homo sapiens
gaggtgaccccagggcacagg

SEQ ID NO: 2854338 - DNA, 22 bp, Homo sapiens
gaggtgaccccagggcacagga

SEQ ID NO: 2854339 - DNA, 14 bp, Homo sapiens
gaggtgcccaggag

SEQ ID NO: 2854340 - DNA, 16 bp, Homo sapiens
gaggtgcccaggagaa

SEQ ID NO: 2854341 - DNA, 20 bp, Homo sapiens
gaggtgcggccaccacccta

SEQ ID NO: 2854342 - DNA, 13 bp, Homo sapiens
gaggtggagaact

SEQ ID NO: 2854343 - DNA, 23 bp, Homo sapiens
gaggttgagaagactcctgggct

SEQ ID NO: 2854344 - DNA, 15 bp, Homo sapiens
gaggttgcagtgagc

SEQ ID NO: 2854345 - DNA, 16 bp, Homo sapiens
gagtaatttattgttt

SEQ ID NO: 2854346 - DNA, 22 bp, Homo sapiens
gagtagcaagttctagagaaga

SEQ ID NO: 2854347 - DNA, 13 bp, Homo sapiens
gagtatactaaaa

SEQ ID NO: 2854348 - DNA, 12 bp, Homo sapiens
gagtatatatgt

SEQ ID NO: 2854349 - DNA, 15 bp, Homo sapiens
gagtatatatgtaca

SEQ ID NO: 2854350 - DNA, 19 bp, Homo sapiens
gagtcaatcccctcattca

SEQ ID NO: 2854351 - DNA, 15 bp, Homo sapiens
gagtcaccaagccca

SEQ ID NO: 2854352 - DNA, 17 bp, Homo sapiens
gagtcaccaagcccagt

SEQ ID NO: 2854353 - DNA, 20 bp, Homo sapiens
gagtcatgatctccctgccg

SEQ ID NO: 2854354 - DNA, 12 bp, Homo sapiens
gagtccagggcg

SEQ ID NO: 2854355 - DNA, 18 bp, Homo sapiens
gagtcccaaggaaagccc

SEQ ID NO: 2854356 - DNA, 18 bp, Homo sapiens
gagtctacctcttcagta

SEQ ID NO: 2854357 - DNA, 20 bp, Homo sapiens
gagtctcactgttgcccagg

SEQ ID NO: 2854358 - DNA, 17 bp, Homo sapiens
gagtctcctctctgaga

SEQ ID NO: 2854359 - DNA, 16 bp, Homo sapiens
gagtctgaggtcctga

SEQ ID NO: 2854360 - DNA, 23 bp, Homo sapiens
gagtctgaggtcctgagcactgc

SEQ ID NO: 2854361 - DNA, 20 bp, Homo sapiens
gagtgacacccaagagggct

SEQ ID NO: 2854362 - DNA, 21 bp, Homo sapiens
gagtgacacccaagagggctg

SEQ ID NO: 2854363 - DNA, 14 bp, Homo sapiens
gagtgacagaggca

SEQ ID NO: 2854364 - DNA, 11 bp, Homo sapiens
gagtgacatgg

SEQ ID NO: 2854365 - DNA, 20 bp, Homo sapiens
gagtgacggtcccacactgg

SEQ ID NO: 2854366 - DNA, 18 bp, Homo sapiens
gagtgactcgagggttgg

SEQ ID NO: 2854367 - DNA, 21 bp, Homo sapiens
gagtgagaataattgtgtaca

SEQ ID NO: 2854368 - DNA, 24 bp, Homo sapiens
gagtgagcactaaggtgtgctctg

SEQ ID NO: 2854369 - DNA, 21 bp, Homo sapiens
gagtgagccacagaccacctg

SEQ ID NO: 2854370 - DNA, 12 bp, Homo sapiens
gagtgagctggt

SEQ ID NO: 2854371 - DNA, 15 bp, Homo sapiens
gagtgattcaggggc

SEQ ID NO: 2854372 - DNA, 13 bp, Homo sapiens
gagtgccaggact

SEQ ID NO: 2854373 - DNA, 22 bp, Homo sapiens
gagtgcccttaaaataatgatt

SEQ ID NO: 2854374 - DNA, 17 bp, Homo sapiens
gagtggccggggaagct

SEQ ID NO: 2854375 - DNA, 18 bp, Homo sapiens
gagtgtagcaactacagt

SEQ ID NO: 2854376 - DNA, 12 bp, Homo sapiens
gagtgtgaccaa

SEQ ID NO: 2854377 - DNA, 12 bp, Homo sapiens
gagttcctgcat

SEQ ID NO: 2854378 - DNA, 20 bp, Homo sapiens
gagttcgagaccagcctggc

SEQ ID NO: 2854379 - DNA, 21 bp, Homo sapiens
gagttcttaaggattgtgata

SEQ ID NO: 2854380 - DNA, 15 bp, Homo sapiens
gagttcttgtgccat

SEQ ID NO: 2854381 - DNA, 23 bp, Homo sapiens
gagttgtgagcactctactgcaa

SEQ ID NO: 2854382 - DNA, 15 bp, Homo sapiens
gagtttgtgtgtctt

SEQ ID NO: 2854383 - DNA, 21 bp, Homo sapiens
gataaacacagaggttttaaa

SEQ ID NO: 2854384 - DNA, 18 bp, Homo sapiens
gataaacattaaacactg

SEQ ID NO: 2854385 - DNA, 15 bp, Homo sapiens
gataaactaaaagca

SEQ ID NO: 2854386 - DNA, 21 bp, Homo sapiens
gataaagatgtcaaatatctc

SEQ ID NO: 2854387 - DNA, 17 bp, Homo sapiens
gataaagattttttaat

SEQ ID NO: 2854388 - DNA, 15 bp, Homo sapiens
gataacaaaatcaca

SEQ ID NO: 2854389 - DNA, 20 bp, Homo sapiens
gataacaaaatcacaagcaa

SEQ ID NO: 2854390 - DNA, 13 bp, Homo sapiens
gataacagaattg

SEQ ID NO: 2854391 - DNA, 11 bp, Homo sapiens
gataactctcc

SEQ ID NO: 2854392 - DNA, 16 bp, Homo sapiens
gataatatctgtgagg

SEQ ID NO: 2854393 - DNA, 20 bp, Homo sapiens
gatacactgaagttaacaga

SEQ ID NO: 2854394 - DNA, 12 bp, Homo sapiens
gatacagaatga

SEQ ID NO: 2854395 - DNA, 18 bp, Homo sapiens
gatacaggaaaagctgct

SEQ ID NO: 2854396 - DNA, 21 bp, Homo sapiens
gatacaggaaaagctgctgac

SEQ ID NO: 2854397 - DNA, 23 bp, Homo sapiens
gatacaggaaaagctgctgacag

SEQ ID NO: 2854398 - DNA, 22 bp, Homo sapiens
gatacattccctatcaaaacat

SEQ ID NO: 2854399 - DNA, 17 bp, Homo sapiens
gataccaggttgaaaga

SEQ ID NO: 2854400 - DNA, 17 bp, Homo sapiens
gatactctgtcagatgg

SEQ ID NO: 2854401 - DNA, 16 bp, Homo sapiens
gatactggaagttttg

SEQ ID NO: 2854402 - DNA, 13 bp, Homo sapiens
gatactgggtaca

SEQ ID NO: 2854403 - DNA, 16 bp, Homo sapiens
gatagtattgtgcata

SEQ ID NO: 2854404 - DNA, 22 bp, Homo sapiens
gatatatatttactaaaagaat

SEQ ID NO: 2854405 - DNA, 12 bp, Homo sapiens
gatatatctgaa

SEQ ID NO: 2854406 - DNA, 15 bp, Homo sapiens
gatatctgaacacat

SEQ ID NO: 2854407 - DNA, 23 bp, Homo sapiens
gatatctgaacacatactagaaa

SEQ ID NO: 2854408 - DNA, 21 bp, Homo sapiens
gatatgagttgttttcagact

SEQ ID NO: 2854409 - DNA, 17 bp, Homo sapiens
gatatgtaaaacattta

SEQ ID NO: 2854410 - DNA, 18 bp, Homo sapiens
gatatgtaaaacatttat

SEQ ID NO: 2854411 - DNA, 19 bp, Homo sapiens
gatatgtaaacataattct

SEQ ID NO: 2854412 - DNA, 12 bp, Homo sapiens
gatcaaagttcc

SEQ ID NO: 2854413 - DNA, 22 bp, Homo sapiens
gatcaaccccttcgctcctgtg

SEQ ID NO: 2854414 - DNA, 13 bp, Homo sapiens
gatcacagaggct

SEQ ID NO: 2854415 - DNA, 14 bp, Homo sapiens
gatcaccagcccgg

SEQ ID NO: 2854416 - DNA, 14 bp, Homo sapiens
gatcacctgaggtt

SEQ ID NO: 2854417 - DNA, 18 bp, Homo sapiens
gatcacgccactgcacta

SEQ ID NO: 2854418 - DNA, 12 bp, Homo sapiens
gatcactggagc

SEQ ID NO: 2854419 - DNA, 17 bp, Homo sapiens
gatcagcgtggccttgt

SEQ ID NO: 2854420 - DNA, 21 bp, Homo sapiens
gatcatccactgtgccatgtg

SEQ ID NO: 2854421 - DNA, 23 bp, Homo sapiens
gatcatcccatctaagctgcagc

SEQ ID NO: 2854422 - DNA, 17 bp, Homo sapiens
gatccaagctggtccca

SEQ ID NO: 2854423 - DNA, 21 bp, Homo sapiens
gatccaagctggtcccactca

SEQ ID NO: 2854424 - DNA, 15 bp, Homo sapiens
gatccacacacagag

SEQ ID NO: 2854425 - DNA, 18 bp, Homo sapiens
gatccacacacagaggaa

SEQ ID NO: 2854426 - DNA, 19 bp, Homo sapiens
gatccacacacagaggaag

SEQ ID NO: 2854427 - DNA, 16 bp, Homo sapiens
gatccatgtagcagga

SEQ ID NO: 2854428 - DNA, 15 bp, Homo sapiens
gcagctgagcagggc

SEQ ID NO: 2854429 - DNA, 18 bp, Homo sapiens
gcagctgagcagggccgg

SEQ ID NO: 2854430 - DNA, 19 bp, Homo sapiens
gcagctgagcagggccggg

SEQ ID NO: 2854431 - DNA, 21 bp, Homo sapiens
gcagctgagcagggccgggga

SEQ ID NO: 2854432 - DNA, 17 bp, Homo sapiens
gcagctgcggtccaccc

SEQ ID NO: 2854433 - DNA, 23 bp, Homo sapiens
gcagctgcggtccacccaggagc

SEQ ID NO: 2854434 - DNA, 20 bp, Homo sapiens
gcagctgcttttgtctatgg

SEQ ID NO: 2854435 - DNA, 20 bp, Homo sapiens
gcagctggtctttattcctc

SEQ ID NO: 2854436 - DNA, 17 bp, Homo sapiens
gcagcttgtagccagcc

SEQ ID NO: 2854437 - DNA, 18 bp, Homo sapiens
gcagcttgtagccagccg

SEQ ID NO: 2854438 - DNA, 21 bp, Homo sapiens
gcagcttgtagccagccgggg

SEQ ID NO: 2854439 - DNA, 22 bp, Homo sapiens
gcagcttgtagccagccggggc

SEQ ID NO: 2854440 - DNA, 14 bp, Homo sapiens
gcaggaactcccag

SEQ ID NO: 2854441 - DNA, 13 bp, Homo sapiens
gcaggaagccagg

SEQ ID NO: 2854442 - DNA, 17 bp, Homo sapiens
gcaggaatgtgtggcag

SEQ ID NO: 2854443 - DNA, 14 bp, Homo sapiens
gcaggaccaggact

SEQ ID NO: 2854444 - DNA, 15 bp, Homo sapiens
gcaggaccaggacta

SEQ ID NO: 2854445 - DNA, 21 bp, Homo sapiens
gcaggagtagctgagctcaca

SEQ ID NO: 2854446 - DNA, 23 bp, Homo sapiens
gcaggcaaagtgagactgacacc

SEQ ID NO: 2854447 - DNA, 15 bp, Homo sapiens
gcaggcacatggagg

SEQ ID NO: 2854448 - DNA, 22 bp, Homo sapiens
gcaggcagggctctcctggctt

SEQ ID NO: 2854449 - DNA, 22 bp, Homo sapiens
gcagggaaaggctctgaaagcc

SEQ ID NO: 2854450 - DNA, 13 bp, Homo sapiens
gcagggaggggac

SEQ ID NO: 2854451 - DNA, 15 bp, Homo sapiens
gcagggaggggacta

SEQ ID NO: 2854452 - DNA, 22 bp, Homo sapiens
gcagggatgtcacgtcttgaaa

SEQ ID NO: 2854453 - DNA, 22 bp, Homo sapiens
gcagggctcagcggggacagct

SEQ ID NO: 2854454 - DNA, 12 bp, Homo sapiens
gcagggctctcc

SEQ ID NO: 2854455 - DNA, 11 bp, Homo sapiens
gcagggctggg

SEQ ID NO: 2854456 - DNA, 17 bp, Homo sapiens
gcagggtctcactctgt

SEQ ID NO: 2854457 - DNA, 20 bp, Homo sapiens
gcagtcacactgttactcca

SEQ ID NO: 2854458 - DNA, 15 bp, Homo sapiens
gcagtccagaataag

SEQ ID NO: 2854459 - DNA, 14 bp, Homo sapiens
gcagtccagccagc

SEQ ID NO: 2854460 - DNA, 13 bp, Homo sapiens
gcagtgagccgag

SEQ ID NO: 2854461 - DNA, 21 bp, Homo sapiens
gcagtgatggttgccaggacg

SEQ ID NO: 2854462 - DNA, 12 bp, Homo sapiens
gcagtgggagct

SEQ ID NO: 2854463 - DNA, 13 bp, Homo sapiens
gcagtgggagctg

SEQ ID NO: 2854464 - DNA, 14 bp, Homo sapiens
gcagtgggagctgc

SEQ ID NO: 2854465 - DNA, 15 bp, Homo sapiens
gcagtgggagctgcc

SEQ ID NO: 2854466 - DNA, 16 bp, Homo sapiens
gcagtgggagctgcct

SEQ ID NO: 2854467 - DNA, 18 bp, Homo sapiens
gcagtgggagctgcctgt

SEQ ID NO: 2854468 - DNA, 18 bp, Homo sapiens
gcagtggtgcgatctggg

SEQ ID NO: 2854469 - DNA, 19 bp, Homo sapiens
gcagtggtgcgatctgggt

SEQ ID NO: 2854470 - DNA, 15 bp, Homo sapiens
gcagtgtcttccata

SEQ ID NO: 2854471 - DNA, 21 bp, Homo sapiens
gcagtgtgtcacactgagctg

SEQ ID NO: 2854472 - DNA, 22 bp, Homo sapiens
gcagtgttcctcaccaataact

SEQ ID NO: 2854473 - DNA, 23 bp, Homo sapiens
gcagtgttcctcaccaataactt

SEQ ID NO: 2854474 - DNA, 17 bp, Homo sapiens
gcagttattaacactaa

SEQ ID NO: 2854475 - DNA, 17 bp, Homo sapiens
gcagttcgcagccaccc

SEQ ID NO: 2854476 - DNA, 15 bp, Homo sapiens
gcagttgacagcagg

SEQ ID NO: 2854477 - DNA, 16 bp, Homo sapiens
gcagttggcagaaagg

SEQ ID NO: 2854478 - DNA, 16 bp, Homo sapiens
gcataagattaaagga

SEQ ID NO: 2854479 - DNA, 18 bp, Homo sapiens
gcataagattaaaggaag

SEQ ID NO: 2854480 - DNA, 17 bp, Homo sapiens
gcatacatttataatgt

SEQ ID NO: 2854481 - DNA, 13 bp, Homo sapiens
gcatattaaaggc

SEQ ID NO: 2854482 - DNA, 21 bp, Homo sapiens
gcatcacagggcagagccggg

SEQ ID NO: 2854483 - DNA, 15 bp, Homo sapiens
gcatcacctcaggcc

SEQ ID NO: 2854484 - DNA, 19 bp, Homo sapiens
gcatcagaaagggagggct

SEQ ID NO: 2854485 - DNA, 13 bp, Homo sapiens
gcatcatgcctct

SEQ ID NO: 2854486 - DNA, 16 bp, Homo sapiens
gcatcatgcctctgag

SEQ ID NO: 2854487 - DNA, 20 bp, Homo sapiens
gcatcatgcctctgaggcca

SEQ ID NO: 2854488 - DNA, 16 bp, Homo sapiens
gcatcccaggggacca

SEQ ID NO: 2854489 - DNA, 21 bp, Homo sapiens
gcatcccaggggaccacacct

SEQ ID NO: 2854490 - DNA, 21 bp, Homo sapiens
gcatcccatgggggtgctgca

SEQ ID NO: 2854491 - DNA, 18 bp, Homo sapiens
gcatcctccacaatagca

SEQ ID NO: 2854492 - DNA, 14 bp, Homo sapiens
gcatcctggcaccc

SEQ ID NO: 2854493 - DNA, 15 bp, Homo sapiens
gcatctacacagcct

SEQ ID NO: 2854494 - DNA, 16 bp, Homo sapiens
gcatctacacagcctg

SEQ ID NO: 2854495 - DNA, 21 bp, Homo sapiens
gcatctcttgaggccaggagt

SEQ ID NO: 2854496 - DNA, 17 bp, Homo sapiens
gcatctgactcacaaga

SEQ ID NO: 2854497 - DNA, 18 bp, Homo sapiens
gcatctgctaataaaacc

SEQ ID NO: 2854498 - DNA, 20 bp, Homo sapiens
gcatgagggatcacagggcc

SEQ ID NO: 2854499 - DNA, 21 bp, Homo sapiens
gcatgatcttgttaatgcatt

SEQ ID NO: 2854500 - DNA, 14 bp, Homo sapiens
gcatgattttatac

SEQ ID NO: 2854501 - DNA, 16 bp, Homo sapiens
gcatgattttatacat

SEQ ID NO: 2854502 - DNA, 14 bp, Homo sapiens
gcatgctcagccct

SEQ ID NO: 2854503 - DNA, 17 bp, Homo sapiens
gcatgctcagcccttcc

SEQ ID NO: 2854504 - DNA, 13 bp, Homo sapiens
gcatgctctctgc

SEQ ID NO: 2854505 - DNA, 17 bp, Homo sapiens
gcatgctctctgcagcc

SEQ ID NO: 2854506 - DNA, 21 bp, Homo sapiens
gcatgctctctgcagccagcc

SEQ ID NO: 2854507 - DNA, 22 bp, Homo sapiens
gcatgctctctgcagccagccc

SEQ ID NO: 2854508 - DNA, 23 bp, Homo sapiens
gcatgctctctgcagccagccca

SEQ ID NO: 2854509 - DNA, 24 bp, Homo sapiens
gcatgctggcctcccaataaagct

SEQ ID NO: 2854510 - DNA, 16 bp, Homo sapiens
gcatgctggggcaagt

SEQ ID NO: 2854511 - DNA, 15 bp, Homo sapiens
gcatggctattttat

SEQ ID NO: 2854512 - DNA, 20 bp, Homo sapiens
gcatggtcacaagcacaaag

SEQ ID NO: 2854513 - DNA, 23 bp, Homo sapiens
gcatgtaaaatgcagtccagaat

SEQ ID NO: 2854514 - DNA, 17 bp, Homo sapiens
gcatgtaatcccagcta

SEQ ID NO: 2854515 - DNA, 14 bp, Homo sapiens
gcatgttctctgag

SEQ ID NO: 2854516 - DNA, 19 bp, Homo sapiens
gcattaaattttaaggtag

SEQ ID NO: 2854517 - DNA, 13 bp, Homo sapiens
gcattaacttaaa

SEQ ID NO: 2854518 - DNA, 17 bp, Homo sapiens
gccctgacccctgcacc

SEQ ID NO: 2854519 - DNA, 16 bp, Homo sapiens
gccctgacctcccagc

SEQ ID NO: 2854520 - DNA, 16 bp, Homo sapiens
gccctgagctcggtgg

SEQ ID NO: 2854521 - DNA, 22 bp, Homo sapiens
gccctgagtggatctccaagga

SEQ ID NO: 2854522 - DNA, 23 bp, Homo sapiens
gccctgagtggatctccaaggac

SEQ ID NO: 2854523 - DNA, 13 bp, Homo sapiens
gccctgcagaccc

SEQ ID NO: 2854524 - DNA, 19 bp, Homo sapiens
gccctgcagaccctgccct

SEQ ID NO: 2854525 - DNA, 20 bp, Homo sapiens
gccctgcagaccctgccctt

SEQ ID NO: 2854526 - DNA, 15 bp, Homo sapiens
gccctgccacctgtc

SEQ ID NO: 2854527 - DNA, 18 bp, Homo sapiens
gccctgccacctgtctgt

SEQ ID NO: 2854528 - DNA, 20 bp, Homo sapiens
gccctgccacctgtctgtct

SEQ ID NO: 2854529 - DNA, 11 bp, Homo sapiens
gccctgcctgg

SEQ ID NO: 2854530 - DNA, 20 bp, Homo sapiens
gccctgcctggaggacctga

SEQ ID NO: 2854531 - DNA, 14 bp, Homo sapiens
gccctgccttcagc

SEQ ID NO: 2854532 - DNA, 23 bp, Homo sapiens
gccctgctgccgcctcccagcct

SEQ ID NO: 2854533 - DNA, 21 bp, Homo sapiens
gccctggatcagcgtggcctt

SEQ ID NO: 2854534 - DNA, 22 bp, Homo sapiens
gccctggatcagcgtggccttg

SEQ ID NO: 2854535 - DNA, 17 bp, Homo sapiens
gccctggatgtgcccac

SEQ ID NO: 2854536 - DNA, 18 bp, Homo sapiens
gccctggatgtgcccaca

SEQ ID NO: 2854537 - DNA, 20 bp, Homo sapiens
gccctggatgtgcccacagg

SEQ ID NO: 2854538 - DNA, 19 bp, Homo sapiens
gccctggcccagagctgga

SEQ ID NO: 2854539 - DNA, 12 bp, Homo sapiens
gccctggcctgc

SEQ ID NO: 2854540 - DNA, 20 bp, Homo sapiens
gccctgggaccgctacacca

SEQ ID NO: 2854541 - DNA, 15 bp, Homo sapiens
gccctggggcctgta

SEQ ID NO: 2854542 - DNA, 18 bp, Homo sapiens
gccctggggcctgtactg

SEQ ID NO: 2854543 - DNA, 21 bp, Homo sapiens
gccctggggcctgtactgcct

SEQ ID NO: 2854544 - DNA, 19 bp, Homo sapiens
gccctggtggcagtgggag

SEQ ID NO: 2854545 - DNA, 16 bp, Homo sapiens
gccctgtcgagacact

SEQ ID NO: 2854546 - DNA, 16 bp, Homo sapiens
gcccttcacagtgttt

SEQ ID NO: 2854547 - DNA, 12 bp, Homo sapiens
gcccttccagtg

SEQ ID NO: 2854548 - DNA, 16 bp, Homo sapiens
gcccttccagtggtac

SEQ ID NO: 2854549 - DNA, 12 bp, Homo sapiens
gcccttcccact

SEQ ID NO: 2854550 - DNA, 16 bp, Homo sapiens
gcccttccctgctttg

SEQ ID NO: 2854551 - DNA, 13 bp, Homo sapiens
gcccttcctggac

SEQ ID NO: 2854552 - DNA, 14 bp, Homo sapiens
gcccttcctggaca

SEQ ID NO: 2854553 - DNA, 16 bp, Homo sapiens
gcccttcctggacagc

SEQ ID NO: 2854554 - DNA, 13 bp, Homo sapiens
gcccttctttcta

SEQ ID NO: 2854555 - DNA, 15 bp, Homo sapiens
gcccttgccctgacc

SEQ ID NO: 2854556 - DNA, 17 bp, Homo sapiens
gcccttgtttggggcag

SEQ ID NO: 2854557 - DNA, 18 bp, Homo sapiens
gcccttgtttggggcagg

SEQ ID NO: 2854558 - DNA, 17 bp, Homo sapiens
gccctttgggaggctga

SEQ ID NO: 2854559 - DNA, 21 bp, Homo sapiens
gccctttgggaggctgaggcg

SEQ ID NO: 2854560 - DNA, 19 bp, Homo sapiens
gccgaagctaacagggaag

SEQ ID NO: 2854561 - DNA, 14 bp, Homo sapiens
gccgaccagagccc

SEQ ID NO: 2854562 - DNA, 17 bp, Homo sapiens
gccgaccagagccccac

SEQ ID NO: 2854563 - DNA, 11 bp, Homo sapiens
gccgacctcag

SEQ ID NO: 2854564 - DNA, 12 bp, Homo sapiens
gccgacctcagc

SEQ ID NO: 2854565 - DNA, 20 bp, Homo sapiens
gccgacctcgtcctccccct

SEQ ID NO: 2854566 - DNA, 21 bp, Homo sapiens
gccgacctcgtcctccccctg

SEQ ID NO: 2854567 - DNA, 13 bp, Homo sapiens
gccgactcaggga

SEQ ID NO: 2854568 - DNA, 15 bp, Homo sapiens
gccgactcagggacc

SEQ ID NO: 2854569 - DNA, 19 bp, Homo sapiens
gccgagagcctgctccccc

SEQ ID NO: 2854570 - DNA, 22 bp, Homo sapiens
gccgagagcctgctcccccacc

SEQ ID NO: 2854571 - DNA, 21 bp, Homo sapiens
gccgagatcacgccactgcac

SEQ ID NO: 2854572 - DNA, 19 bp, Homo sapiens
gccgagccgggcctggggc

SEQ ID NO: 2854573 - DNA, 13 bp, Homo sapiens
gccgagggaaatg

SEQ ID NO: 2854574 - DNA, 19 bp, Homo sapiens
gccgagggaaatgctgttg

SEQ ID NO: 2854575 - DNA, 23 bp, Homo sapiens
gccgagtttgggccactgcactc

SEQ ID NO: 2854576 - DNA, 17 bp, Homo sapiens
gccgcaagtctgcagcc

SEQ ID NO: 2854577 - DNA, 13 bp, Homo sapiens
gccgcaccccaga

SEQ ID NO: 2854578 - DNA, 16 bp, Homo sapiens
gccgcaccccagagtg

SEQ ID NO: 2854579 - DNA, 20 bp, Homo sapiens
gccgcagggacagaactgaa

SEQ ID NO: 2854580 - DNA, 14 bp, Homo sapiens
gccgcctcccagcc

SEQ ID NO: 2854581 - DNA, 21 bp, Homo sapiens
gccgctcctgtctgccagcca

SEQ ID NO: 2854582 - DNA, 23 bp, Homo sapiens
gccgctcctgtctgccagccagc

SEQ ID NO: 2854583 - DNA, 18 bp, Homo sapiens
gccgctcttctgtcatcc

SEQ ID NO: 2854584 - DNA, 20 bp, Homo sapiens
gccgctcttctgtcatcccg

SEQ ID NO: 2854585 - DNA, 16 bp, Homo sapiens
gccgctgccccagccc

SEQ ID NO: 2854586 - DNA, 16 bp, Homo sapiens
gccgctgttcacccac

SEQ ID NO: 2854587 - DNA, 18 bp, Homo sapiens
gccggatgtcccatctgc

SEQ ID NO: 2854588 - DNA, 20 bp, Homo sapiens
gccgggaacagacaacagaa

SEQ ID NO: 2854589 - DNA, 18 bp, Homo sapiens
gccgggcttgggccctgc

SEQ ID NO: 2854590 - DNA, 19 bp, Homo sapiens
gccgggcttgggccctgca

SEQ ID NO: 2854591 - DNA, 20 bp, Homo sapiens
gccggggaactggccaagct

SEQ ID NO: 2854592 - DNA, 20 bp, Homo sapiens
gccgggtacctcagtttctc

SEQ ID NO: 2854593 - DNA, 13 bp, Homo sapiens
gccggtgcctggc

SEQ ID NO: 2854594 - DNA, 18 bp, Homo sapiens
gccgtggtccagctcttg

SEQ ID NO: 2854595 - DNA, 15 bp, Homo sapiens
gcctaaaagtaaaca

SEQ ID NO: 2854596 - DNA, 16 bp, Homo sapiens
gcctaaaagtaaacat

SEQ ID NO: 2854597 - DNA, 16 bp, Homo sapiens
gcctaaatccaaagaa

SEQ ID NO: 2854598 - DNA, 13 bp, Homo sapiens
gcctaaatctaat

SEQ ID NO: 2854599 - DNA, 16 bp, Homo sapiens
gcctacaggagtgagc

SEQ ID NO: 2854600 - DNA, 17 bp, Homo sapiens
gcctacaggagtgagca

SEQ ID NO: 2854601 - DNA, 20 bp, Homo sapiens
gcctacattccctggcctgg

SEQ ID NO: 2854602 - DNA, 17 bp, Homo sapiens
gcctagaaaatgcaaaa

SEQ ID NO: 2854603 - DNA, 20 bp, Homo sapiens
gcctagatccacacacagag

SEQ ID NO: 2854604 - DNA, 18 bp, Homo sapiens
gcctagcaggcacaggac

SEQ ID NO: 2854605 - DNA, 15 bp, Homo sapiens
gcctagccgacctca

SEQ ID NO: 2854606 - DNA, 16 bp, Homo sapiens
gcctagccgacctcag

SEQ ID NO: 2854607 - DNA, 18 bp, Homo sapiens
gcctagccgacctcagcc

SEQ ID NO: 2854608 - DNA, 20 bp, Homo sapiens
gcctagccgacctcagcctt

SEQ ID NO: 2854609 - DNA, 19 bp, Homo sapiens
gctcctgtctgccagccag

SEQ ID NO: 2854610 - DNA, 20 bp, Homo sapiens
gctcctgtctgccagccagc

SEQ ID NO: 2854611 - DNA, 13 bp, Homo sapiens
gctccttctgtcc

SEQ ID NO: 2854612 - DNA, 21 bp, Homo sapiens
gctccttctgtcctactctgt

SEQ ID NO: 2854613 - DNA, 20 bp, Homo sapiens
gctcctttctccagccagca

SEQ ID NO: 2854614 - DNA, 19 bp, Homo sapiens
gctcggggtgcacaggagg

SEQ ID NO: 2854615 - DNA, 17 bp, Homo sapiens
gctctaacgcctgagcc

SEQ ID NO: 2854616 - DNA, 20 bp, Homo sapiens
gctctaacgcctgagcccag

SEQ ID NO: 2854617 - DNA, 23 bp, Homo sapiens
gctctaacgcctgagcccaggga

SEQ ID NO: 2854618 - DNA, 21 bp, Homo sapiens
gctctagcctgggcaacaaca

SEQ ID NO: 2854619 - DNA, 14 bp, Homo sapiens
gctctaggctgccc

SEQ ID NO: 2854620 - DNA, 14 bp, Homo sapiens
gctctagtgggaag

SEQ ID NO: 2854621 - DNA, 11 bp, Homo sapiens
gctctcagcca

SEQ ID NO: 2854622 - DNA, 17 bp, Homo sapiens
gctctcagcctcccaac

SEQ ID NO: 2854623 - DNA, 16 bp, Homo sapiens
gctctccacctcagcc

SEQ ID NO: 2854624 - DNA, 19 bp, Homo sapiens
gctctccacctcagccttg

SEQ ID NO: 2854625 - DNA, 20 bp, Homo sapiens
gctctccacctcagccttgg

SEQ ID NO: 2854626 - DNA, 21 bp, Homo sapiens
gctctccacctcagccttgga

SEQ ID NO: 2854627 - DNA, 11 bp, Homo sapiens
gctctccctct

SEQ ID NO: 2854628 - DNA, 14 bp, Homo sapiens
gctctccctctggc

SEQ ID NO: 2854629 - DNA, 17 bp, Homo sapiens
gctctccctctggccct

SEQ ID NO: 2854630 - DNA, 21 bp, Homo sapiens
gctctccctctggccctgcct

SEQ ID NO: 2854631 - DNA, 17 bp, Homo sapiens
gctctccgaccagacac

SEQ ID NO: 2854632 - DNA, 19 bp, Homo sapiens
gctctccgaccagacacct

SEQ ID NO: 2854633 - DNA, 22 bp, Homo sapiens
gctctcctcttgccactgcctc

SEQ ID NO: 2854634 - DNA, 20 bp, Homo sapiens
gctctcctgagaggtgctgc

SEQ ID NO: 2854635 - DNA, 14 bp, Homo sapiens
gctctcctggcttc

SEQ ID NO: 2854636 - DNA, 16 bp, Homo sapiens
gctctcctttctttct

SEQ ID NO: 2854637 - DNA, 13 bp, Homo sapiens
gctctctgcagcc

SEQ ID NO: 2854638 - DNA, 14 bp, Homo sapiens
gctctctgcagcca

SEQ ID NO: 2854639 - DNA, 17 bp, Homo sapiens
gctctctgcagccagcc

SEQ ID NO: 2854640 - DNA, 16 bp, Homo sapiens
gctctgagaggccctg

SEQ ID NO: 2854641 - DNA, 17 bp, Homo sapiens
gctctgagaggccctgg

SEQ ID NO: 2854642 - DNA, 18 bp, Homo sapiens
gctctgagaggccctgga

SEQ ID NO: 2854643 - DNA, 20 bp, Homo sapiens
gctctgagcaaatgtggctc

SEQ ID NO: 2854644 - DNA, 10 bp, Homo sapiens
gctctgaggc

SEQ ID NO: 2854645 - DNA, 20 bp, Homo sapiens
gctctgaggcgccccaaccc

SEQ ID NO: 2854646 - DNA, 19 bp, Homo sapiens
gctctgaggcttccagaga

SEQ ID NO: 2854647 - DNA, 16 bp, Homo sapiens
gctctgatgcatcaga

SEQ ID NO: 2854648 - DNA, 19 bp, Homo sapiens
gctctgatgcatcagaaag

SEQ ID NO: 2854649 - DNA, 15 bp, Homo sapiens
gctctgccccagctc

SEQ ID NO: 2854650 - DNA, 15 bp, Homo sapiens
gctctgccctccctg

SEQ ID NO: 2854651 - DNA, 18 bp, Homo sapiens
gctctgccctccctggcc

SEQ ID NO: 2854652 - DNA, 19 bp, Homo sapiens
gctctgccctccctggcct

SEQ ID NO: 2854653 - DNA, 22 bp, Homo sapiens
gctctgccctccctggcctcac

SEQ ID NO: 2854654 - DNA, 18 bp, Homo sapiens
gctctgctgacagacaca

SEQ ID NO: 2854655 - DNA, 19 bp, Homo sapiens
gctctgctgacagacacag

SEQ ID NO: 2854656 - DNA, 23 bp, Homo sapiens
gctctgctgacagacacaggccc

SEQ ID NO: 2854657 - DNA, 13 bp, Homo sapiens
gctctgctggcct

SEQ ID NO: 2854658 - DNA, 15 bp, Homo sapiens
gctctggacaggcat

SEQ ID NO: 2854659 - DNA, 22 bp, Homo sapiens
gctctggacaggcatgttctct

SEQ ID NO: 2854660 - DNA, 11 bp, Homo sapiens
gctctggacca

SEQ ID NO: 2854661 - DNA, 17 bp, Homo sapiens
gctctggaccagcctgt

SEQ ID NO: 2854662 - DNA, 15 bp, Homo sapiens
gctctggccccaggc

SEQ ID NO: 2854663 - DNA, 19 bp, Homo sapiens
gctctggccccaggcttgt

SEQ ID NO: 2854664 - DNA, 21 bp, Homo sapiens
gctctgggatagctgacccag

SEQ ID NO: 2854665 - DNA, 15 bp, Homo sapiens
gctctgtccactctg

SEQ ID NO: 2854666 - DNA, 14 bp, Homo sapiens
gctctgtgcaggga

SEQ ID NO: 2854667 - DNA, 17 bp, Homo sapiens
gctcttccaaagctcct

SEQ ID NO: 2854668 - DNA, 15 bp, Homo sapiens
gctcttctatttaaa

SEQ ID NO: 2854669 - DNA, 19 bp, Homo sapiens
gctcttctatttaaaaaat

SEQ ID NO: 2854670 - DNA, 21 bp, Homo sapiens
gctcttctatttaaaaaataa

SEQ ID NO: 2854671 - DNA, 12 bp, Homo sapiens
gctcttctccag

SEQ ID NO: 2854672 - DNA, 22 bp, Homo sapiens
gctcttctccttggaggacagt

SEQ ID NO: 2854673 - DNA, 15 bp, Homo sapiens
gctcttctgtcatcc

SEQ ID NO: 2854674 - DNA, 11 bp, Homo sapiens
gctcttgcctg

SEQ ID NO: 2854675 - DNA, 12 bp, Homo sapiens
gctcttgcctgc

SEQ ID NO: 2854676 - DNA, 14 bp, Homo sapiens
gctcttggcccctg

SEQ ID NO: 2854677 - DNA, 12 bp, Homo sapiens
gctctttcaggg

SEQ ID NO: 2854678 - DNA, 13 bp, Homo sapiens
gctctttctgggc

SEQ ID NO: 2854679 - DNA, 13 bp, Homo sapiens
gctctttggtaga

SEQ ID NO: 2854680 - DNA, 18 bp, Homo sapiens
gctctttggtagaaaagg

SEQ ID NO: 2854681 - DNA, 14 bp, Homo sapiens
gctgaaaatcacta

SEQ ID NO: 2854682 - DNA, 13 bp, Homo sapiens
gctgaaagccatt

SEQ ID NO: 2854683 - DNA, 16 bp, Homo sapiens
gctgaacaatgaatgc

SEQ ID NO: 2854684 - DNA, 22 bp, Homo sapiens
gctgaacccattttgagtgact

SEQ ID NO: 2854685 - DNA, 20 bp, Homo sapiens
gctgaagggaccttgaaggg

SEQ ID NO: 2854686 - DNA, 13 bp, Homo sapiens
gctgaattatttt

SEQ ID NO: 2854687 - DNA, 23 bp, Homo sapiens
gctgaattattttgttgtgattt

SEQ ID NO: 2854688 - DNA, 15 bp, Homo sapiens
gctgacagacacagg

SEQ ID NO: 2854689 - DNA, 16 bp, Homo sapiens
gctgacagacacaggc

SEQ ID NO: 2854690 - DNA, 14 bp, Homo sapiens
gctgaccaagagag

SEQ ID NO: 2854691 - DNA, 19 bp, Homo sapiens
gctgacccagtccctgggg

SEQ ID NO: 2854692 - DNA, 18 bp, Homo sapiens
gctgactgatgttgaggg

SEQ ID NO: 2854693 - DNA, 16 bp, Homo sapiens
gctgagaacctggcct

SEQ ID NO: 2854694 - DNA, 17 bp, Homo sapiens
gctgagaacctggcctt

SEQ ID NO: 2854695 - DNA, 16 bp, Homo sapiens
gctgagaaggacacct

SEQ ID NO: 2854696 - DNA, 15 bp, Homo sapiens
gctgagacaggagaa

SEQ ID NO: 2854697 - DNA, 14 bp, Homo sapiens
gctgagactgcggg

SEQ ID NO: 2854698 - DNA, 14 bp, Homo sapiens
gctgagagacccaa

SEQ ID NO: 2854699 - DNA, 22 bp, Homo sapiens
gctgagagacccaaggaggaaa

SEQ ID NO: 2854700 - DNA, 16 bp, Homo sapiens
ggaaggcaggcagggc

SEQ ID NO: 2854701 - DNA, 18 bp, Homo sapiens
ggaaggcaggcagggctc

SEQ ID NO: 2854702 - DNA, 22 bp, Homo sapiens
ggaaggcaggcagggctctcct

SEQ ID NO: 2854703 - DNA, 20 bp, Homo sapiens
ggaaggctacttcggggctg

SEQ ID NO: 2854704 - DNA, 22 bp, Homo sapiens
ggaaggctacttcggggctggg

SEQ ID NO: 2854705 - DNA, 17 bp, Homo sapiens
ggaaggctgctgtgtag

SEQ ID NO: 2854706 - DNA, 17 bp, Homo sapiens
ggaaggctggctgggca

SEQ ID NO: 2854707 - DNA, 18 bp, Homo sapiens
ggaagggaaagccagaag

SEQ ID NO: 2854708 - DNA, 11 bp, Homo sapiens
ggaagggccag

SEQ ID NO: 2854709 - DNA, 17 bp, Homo sapiens
ggaaggtagcccagcac

SEQ ID NO: 2854710 - DNA, 23 bp, Homo sapiens
ggaaggtagcccagcactgtgaa

SEQ ID NO: 2854711 - DNA, 21 bp, Homo sapiens
ggaagtcgtccttactcctgt

SEQ ID NO: 2854712 - DNA, 22 bp, Homo sapiens
ggaagtcgtccttactcctgtg

SEQ ID NO: 2854713 - DNA, 17 bp, Homo sapiens
ggaagtctaggagctgg

SEQ ID NO: 2854714 - DNA, 15 bp, Homo sapiens
ggaagtgagaaacca

SEQ ID NO: 2854715 - DNA, 16 bp, Homo sapiens
ggaatatgactgtttt

SEQ ID NO: 2854716 - DNA, 18 bp, Homo sapiens
ggaatatgactgttttta

SEQ ID NO: 2854717 - DNA, 21 bp, Homo sapiens
ggaatcagacttcacactgca

SEQ ID NO: 2854718 - DNA, 18 bp, Homo sapiens
ggaatcgatctgtactgt

SEQ ID NO: 2854719 - DNA, 20 bp, Homo sapiens
ggaatcgatctgtactgtaa

SEQ ID NO: 2854720 - DNA, 13 bp, Homo sapiens
ggaatgaagcatg

SEQ ID NO: 2854721 - DNA, 15 bp, Homo sapiens
ggaatgaagcatgta

SEQ ID NO: 2854722 - DNA, 17 bp, Homo sapiens
ggaatgaagcatgtagc

SEQ ID NO: 2854723 - DNA, 12 bp, Homo sapiens
ggaatgcagtgg

SEQ ID NO: 2854724 - DNA, 22 bp, Homo sapiens
ggaatgcggccgcattccctga

SEQ ID NO: 2854725 - DNA, 15 bp, Homo sapiens
ggaatggcacagccc

SEQ ID NO: 2854726 - DNA, 19 bp, Homo sapiens
ggaatgtttgcctctgcct

SEQ ID NO: 2854727 - DNA, 15 bp, Homo sapiens
ggaattttcaaaaat

SEQ ID NO: 2854728 - DNA, 15 bp, Homo sapiens
ggacaaaggagcctg

SEQ ID NO: 2854729 - DNA, 13 bp, Homo sapiens
ggacaagaagctg

SEQ ID NO: 2854730 - DNA, 14 bp, Homo sapiens
ggacaagaagctgc

SEQ ID NO: 2854731 - DNA, 16 bp, Homo sapiens
ggacaagcaggtaaga

SEQ ID NO: 2854732 - DNA, 13 bp, Homo sapiens
ggacaagcatggt

SEQ ID NO: 2854733 - DNA, 21 bp, Homo sapiens
ggacaagccaacttgtaaata

SEQ ID NO: 2854734 - DNA, 13 bp, Homo sapiens
ggacacacaaggt

SEQ ID NO: 2854735 - DNA, 21 bp, Homo sapiens
ggacacacaaggtgcaaatca

SEQ ID NO: 2854736 - DNA, 12 bp, Homo sapiens
ggacacagctct

SEQ ID NO: 2854737 - DNA, 13 bp, Homo sapiens
ggacacaggcctg

SEQ ID NO: 2854738 - DNA, 20 bp, Homo sapiens
ggacacagtttctattgtaa

SEQ ID NO: 2854739 - DNA, 12 bp, Homo sapiens
ggacacatgtcc

SEQ ID NO: 2854740 - DNA, 13 bp, Homo sapiens
ggacacatgtcca

SEQ ID NO: 2854741 - DNA, 19 bp, Homo sapiens
ggacacatgtccagtggga

SEQ ID NO: 2854742 - DNA, 13 bp, Homo sapiens
ggacaccaggagt

SEQ ID NO: 2854743 - DNA, 20 bp, Homo sapiens
ggacaccccttatccaggac

SEQ ID NO: 2854744 - DNA, 21 bp, Homo sapiens
ggacacctcaaatacatacct

SEQ ID NO: 2854745 - DNA, 11 bp, Homo sapiens
ggacacctgcc

SEQ ID NO: 2854746 - DNA, 12 bp, Homo sapiens
ggacacctgccc

SEQ ID NO: 2854747 - DNA, 14 bp, Homo sapiens
ggacacctgccctg

SEQ ID NO: 2854748 - DNA, 16 bp, Homo sapiens
ggacacctgccctgcc

SEQ ID NO: 2854749 - DNA, 17 bp, Homo sapiens
ggacacctgccctgccc

SEQ ID NO: 2854750 - DNA, 13 bp, Homo sapiens
ggacacctggccg

SEQ ID NO: 2854751 - DNA, 23 bp, Homo sapiens
ggacacctggccgcctccaggag

SEQ ID NO: 2854752 - DNA, 22 bp, Homo sapiens
ggacacggggcagtggcaacct

SEQ ID NO: 2854753 - DNA, 23 bp, Homo sapiens
ggacagaactgaacgtcctgcag

SEQ ID NO: 2854754 - DNA, 15 bp, Homo sapiens
ggacagacctggaca

SEQ ID NO: 2854755 - DNA, 17 bp, Homo sapiens
ggacagagacacctgca

SEQ ID NO: 2854756 - DNA, 19 bp, Homo sapiens
ggacagagacacctgcacc

SEQ ID NO: 2854757 - DNA, 15 bp, Homo sapiens
ggacagccacggcca

SEQ ID NO: 2854758 - DNA, 19 bp, Homo sapiens
ggacagccacggccaggcc

SEQ ID NO: 2854759 - DNA, 22 bp, Homo sapiens
ggacagccacggccaggccaga

SEQ ID NO: 2854760 - DNA, 17 bp, Homo sapiens
ggacagctccttctgtc

SEQ ID NO: 2854761 - DNA, 20 bp, Homo sapiens
ggacagctgtgcctcgctcc

SEQ ID NO: 2854762 - DNA, 19 bp, Homo sapiens
ggacaggactaacactcag

SEQ ID NO: 2854763 - DNA, 11 bp, Homo sapiens
ggacaggcccg

SEQ ID NO: 2854764 - DNA, 17 bp, Homo sapiens
ggacagggaggtgaccc

SEQ ID NO: 2854765 - DNA, 17 bp, Homo sapiens
ggacagtattctcagtg

SEQ ID NO: 2854766 - DNA, 17 bp, Homo sapiens
ggacagtgcttcagcct

SEQ ID NO: 2854767 - DNA, 23 bp, Homo sapiens
ggacagtgcttcagcctgaggct

SEQ ID NO: 2854768 - DNA, 16 bp, Homo sapiens
ggacatgcagctctga

SEQ ID NO: 2854769 - DNA, 22 bp, Homo sapiens
ggaccacaaaaatgaaagcatg

SEQ ID NO: 2854770 - DNA, 22 bp, Homo sapiens
ggaccacaggcatctacacagc

SEQ ID NO: 2854771 - DNA, 12 bp, Homo sapiens
ggaccagggcat

SEQ ID NO: 2854772 - DNA, 14 bp, Homo sapiens
ggacccagggatga

SEQ ID NO: 2854773 - DNA, 15 bp, Homo sapiens
ggacccgctctggac

SEQ ID NO: 2854774 - DNA, 12 bp, Homo sapiens
ggaccctttcct

SEQ ID NO: 2854775 - DNA, 16 bp, Homo sapiens
ggaccctttccttcct

SEQ ID NO: 2854776 - DNA, 17 bp, Homo sapiens
ggaccctttccttcctt

SEQ ID NO: 2854777 - DNA, 22 bp, Homo sapiens
ggaccctttccttccttccctg

SEQ ID NO: 2854778 - DNA, 22 bp, Homo sapiens
ggaccgctacaccactctggca

SEQ ID NO: 2854779 - DNA, 12 bp, Homo sapiens
ggacctctgctc

SEQ ID NO: 2854780 - DNA, 14 bp, Homo sapiens
ggacctctgctctg

SEQ ID NO: 2854781 - DNA, 14 bp, Homo sapiens
ggacctgagcctgc

SEQ ID NO: 2854782 - DNA, 19 bp, Homo sapiens
ggacctgagcctgccgagc

SEQ ID NO: 2854783 - DNA, 13 bp, Homo sapiens
ggaccttcctgcc

SEQ ID NO: 2854784 - DNA, 15 bp, Homo sapiens
ggaccttgaactggg

SEQ ID NO: 2854785 - DNA, 20 bp, Homo sapiens
ggactaacactcagaagcct

SEQ ID NO: 2854786 - DNA, 21 bp, Homo sapiens
ggactaacactcagaagcctg

SEQ ID NO: 2854787 - DNA, 21 bp, Homo sapiens
ggactacgttaagggaaggaa

SEQ ID NO: 2854788 - DNA, 18 bp, Homo sapiens
ggactcaatgcactgaca

SEQ ID NO: 2854789 - DNA, 23 bp, Homo sapiens
ggactcaccctcataccatctgc

SEQ ID NO: 2854790 - DNA, 16 bp, Homo sapiens
ggactccccaggccag

SEQ ID NO: 2854791 - DNA, 22 bp, Homo sapiens
ggctgaaataaaagcctctggt

SEQ ID NO: 2854792 - DNA, 19 bp, Homo sapiens
ggctgacccagtccctggg

SEQ ID NO: 2854793 - DNA, 13 bp, Homo sapiens
ggctgaggcagaa

SEQ ID NO: 2854794 - DNA, 14 bp, Homo sapiens
ggctgaggcagaag

SEQ ID NO: 2854795 - DNA, 17 bp, Homo sapiens
ggctgaggcagaagaat

SEQ ID NO: 2854796 - DNA, 22 bp, Homo sapiens
ggctgagtcatgatctccctgc

SEQ ID NO: 2854797 - DNA, 18 bp, Homo sapiens
ggctgcccactatggtca

SEQ ID NO: 2854798 - DNA, 21 bp, Homo sapiens
ggctgccccgggtccccagct

SEQ ID NO: 2854799 - DNA, 23 bp, Homo sapiens
ggctgcgagcatttccctcccgg

SEQ ID NO: 2854800 - DNA, 13 bp, Homo sapiens
ggctgctcctcca

SEQ ID NO: 2854801 - DNA, 15 bp, Homo sapiens
ggctgctcctccagg

SEQ ID NO: 2854802 - DNA, 19 bp, Homo sapiens
ggctgctcctccagggcca

SEQ ID NO: 2854803 - DNA, 21 bp, Homo sapiens
ggctgctcggggtgcacagga

SEQ ID NO: 2854804 - DNA, 22 bp, Homo sapiens
ggctgctcggggtgcacaggag

SEQ ID NO: 2854805 - DNA, 17 bp, Homo sapiens
ggctggaggcagggcct

SEQ ID NO: 2854806 - DNA, 15 bp, Homo sapiens
ggctggatgtggtgg

SEQ ID NO: 2854807 - DNA, 18 bp, Homo sapiens
ggctggatgtggtggcat

SEQ ID NO: 2854808 - DNA, 14 bp, Homo sapiens
ggctggcgtgcagt

SEQ ID NO: 2854809 - DNA, 17 bp, Homo sapiens
ggctggctaactggaag

SEQ ID NO: 2854810 - DNA, 10 bp, Homo sapiens
ggctggctga

SEQ ID NO: 2854811 - DNA, 19 bp, Homo sapiens
ggctggctgaaaatcacta

SEQ ID NO: 2854812 - DNA, 15 bp, Homo sapiens
ggctgggagctctgc

SEQ ID NO: 2854813 - DNA, 11 bp, Homo sapiens
ggctgggcttc

SEQ ID NO: 2854814 - DNA, 21 bp, Homo sapiens
ggctgggcttcagtggcagct

SEQ ID NO: 2854815 - DNA, 21 bp, Homo sapiens
ggctgggggcgggggagccaa

SEQ ID NO: 2854816 - DNA, 22 bp, Homo sapiens
ggctggtctccctccagctgga

SEQ ID NO: 2854817 - DNA, 16 bp, Homo sapiens
ggctggtgtcacctga

SEQ ID NO: 2854818 - DNA, 22 bp, Homo sapiens
ggctgtggtggctgtctctgtc

SEQ ID NO: 2854819 - DNA, 20 bp, Homo sapiens
ggcttcagcatatttatagc

SEQ ID NO: 2854820 - DNA, 15 bp, Homo sapiens
ggcttcagtggcagc

SEQ ID NO: 2854821 - DNA, 18 bp, Homo sapiens
ggcttcagtggcagctgc

SEQ ID NO: 2854822 - DNA, 19 bp, Homo sapiens
ggcttcagtggcagctgct

SEQ ID NO: 2854823 - DNA, 13 bp, Homo sapiens
ggcttccagagag

SEQ ID NO: 2854824 - DNA, 12 bp, Homo sapiens
ggcttccaggta

SEQ ID NO: 2854825 - DNA, 18 bp, Homo sapiens
ggcttcccatccccagcg

SEQ ID NO: 2854826 - DNA, 21 bp, Homo sapiens
ggcttcctcagttcctgccct

SEQ ID NO: 2854827 - DNA, 14 bp, Homo sapiens
ggcttcctccgtct

SEQ ID NO: 2854828 - DNA, 12 bp, Homo sapiens
ggcttctcctga

SEQ ID NO: 2854829 - DNA, 15 bp, Homo sapiens
ggcttctcctgaccc

SEQ ID NO: 2854830 - DNA, 16 bp, Homo sapiens
ggcttctcctgaccca

SEQ ID NO: 2854831 - DNA, 18 bp, Homo sapiens
ggcttctggagcccttgg

SEQ ID NO: 2854832 - DNA, 20 bp, Homo sapiens
ggcttctggagcccttgggt

SEQ ID NO: 2854833 - DNA, 14 bp, Homo sapiens
ggcttgcatgccaa

SEQ ID NO: 2854834 - DNA, 17 bp, Homo sapiens
ggcttgggccctgcaca

SEQ ID NO: 2854835 - DNA, 15 bp, Homo sapiens
ggcttggggcttcct

SEQ ID NO: 2854836 - DNA, 21 bp, Homo sapiens
ggcttgtcactagcagctgca

SEQ ID NO: 2854837 - DNA, 14 bp, Homo sapiens
ggctttaacaaaac

SEQ ID NO: 2854838 - DNA, 15 bp, Homo sapiens
gggaaaggatatttt

SEQ ID NO: 2854839 - DNA, 12 bp, Homo sapiens
gggaaccctgct

SEQ ID NO: 2854840 - DNA, 18 bp, Homo sapiens
gggaacgtgactgcccca

SEQ ID NO: 2854841 - DNA, 19 bp, Homo sapiens
gggaactggccaagctgag

SEQ ID NO: 2854842 - DNA, 23 bp, Homo sapiens
gggaagcggaggttgcagggagc

SEQ ID NO: 2854843 - DNA, 18 bp, Homo sapiens
gggaagctgggggaaggg

SEQ ID NO: 2854844 - DNA, 22 bp, Homo sapiens
gggaaggctacttcggggctgg

SEQ ID NO: 2854845 - DNA, 15 bp, Homo sapiens
gggaaggctgctgtg

SEQ ID NO: 2854846 - DNA, 12 bp, Homo sapiens
gggaagggccag

SEQ ID NO: 2854847 - DNA, 13 bp, Homo sapiens
gggaagggccagt

SEQ ID NO: 2854848 - DNA, 16 bp, Homo sapiens
gggaataagccatgac

SEQ ID NO: 2854849 - DNA, 22 bp, Homo sapiens
gggaatggcacagcccaaagaa

SEQ ID NO: 2854850 - DNA, 21 bp, Homo sapiens
gggaatgtttgcctctgcctc

SEQ ID NO: 2854851 - DNA, 15 bp, Homo sapiens
gggacaaaggagcct

SEQ ID NO: 2854852 - DNA, 15 bp, Homo sapiens
gggacagctccttct

SEQ ID NO: 2854853 - DNA, 16 bp, Homo sapiens
gggaccctttccttcc

SEQ ID NO: 2854854 - DNA, 21 bp, Homo sapiens
gggaccgctacaccactctgg

SEQ ID NO: 2854855 - DNA, 15 bp, Homo sapiens
gggactgtcgctgct

SEQ ID NO: 2854856 - DNA, 17 bp, Homo sapiens
gggactgtcgctgcttc

SEQ ID NO: 2854857 - DNA, 17 bp, Homo sapiens
gggacttggaagctccg

SEQ ID NO: 2854858 - DNA, 23 bp, Homo sapiens
gggacttggaagctccgctttct

SEQ ID NO: 2854859 - DNA, 15 bp, Homo sapiens
gggagaacctcaggc

SEQ ID NO: 2854860 - DNA, 13 bp, Homo sapiens
gggagagaccctt

SEQ ID NO: 2854861 - DNA, 16 bp, Homo sapiens
gggagcactggagtgc

SEQ ID NO: 2854862 - DNA, 19 bp, Homo sapiens
gggagcagtgtcttccata

SEQ ID NO: 2854863 - DNA, 14 bp, Homo sapiens
gggagccaacagca

SEQ ID NO: 2854864 - DNA, 13 bp, Homo sapiens
gggagctgcctgt

SEQ ID NO: 2854865 - DNA, 22 bp, Homo sapiens
gggagctgcctgttcagctcca

SEQ ID NO: 2854866 - DNA, 22 bp, Homo sapiens
gggaggatcactggagcccagg

SEQ ID NO: 2854867 - DNA, 23 bp, Homo sapiens
gggaggatcactggagcccagga

SEQ ID NO: 2854868 - DNA, 16 bp, Homo sapiens
gggagggctctgaggc

SEQ ID NO: 2854869 - DNA, 17 bp, Homo sapiens
gggagtgacagaggcag

SEQ ID NO: 2854870 - DNA, 15 bp, Homo sapiens
gggattacaggtgtg

SEQ ID NO: 2854871 - DNA, 20 bp, Homo sapiens
gggcaacccccagcctgcta

SEQ ID NO: 2854872 - DNA, 15 bp, Homo sapiens
gggcacaggagctac

SEQ ID NO: 2854873 - DNA, 17 bp, Homo sapiens
gggcacaggagctacct

SEQ ID NO: 2854874 - DNA, 21 bp, Homo sapiens
gggcaccgagaactcgaagcc

SEQ ID NO: 2854875 - DNA, 18 bp, Homo sapiens
gggcacgcctgcccagcc

SEQ ID NO: 2854876 - DNA, 20 bp, Homo sapiens
gggcactcagaagacactga

SEQ ID NO: 2854877 - DNA, 14 bp, Homo sapiens
gggcagaagggaga

SEQ ID NO: 2854878 - DNA, 16 bp, Homo sapiens
gggcagaagggagaag

SEQ ID NO: 2854879 - DNA, 21 bp, Homo sapiens
gggcagaggctggaggcaggg

SEQ ID NO: 2854880 - DNA, 15 bp, Homo sapiens
gggcagagggcagag

SEQ ID NO: 2854881 - DNA, 12 bp, Homo sapiens
gggcagcagcca

SEQ ID NO: 2854882 - DNA, 13 bp, Homo sapiens
gtacctttgtcac

SEQ ID NO: 2854883 - DNA, 23 bp, Homo sapiens
gtacgaacccctcccctcccccc

SEQ ID NO: 2854884 - DNA, 15 bp, Homo sapiens
gtacgtctgacaggc

SEQ ID NO: 2854885 - DNA, 12 bp, Homo sapiens
gtactacaattt

SEQ ID NO: 2854886 - DNA, 15 bp, Homo sapiens
gtactactagatgtc

SEQ ID NO: 2854887 - DNA, 15 bp, Homo sapiens
gtactcctgcaaaat

SEQ ID NO: 2854888 - DNA, 18 bp, Homo sapiens
gtactcttgctttttcaa

SEQ ID NO: 2854889 - DNA, 19 bp, Homo sapiens
gtactgaccccatcaccta

SEQ ID NO: 2854890 - DNA, 11 bp, Homo sapiens
gtactgcctgc

SEQ ID NO: 2854891 - DNA, 17 bp, Homo sapiens
gtactgctttcaactta

SEQ ID NO: 2854892 - DNA, 14 bp, Homo sapiens
gtactggcatggta

SEQ ID NO: 2854893 - DNA, 16 bp, Homo sapiens
gtactggcatggtacg

SEQ ID NO: 2854894 - DNA, 20 bp, Homo sapiens
gtacttattttccaataaaa

SEQ ID NO: 2854895 - DNA, 20 bp, Homo sapiens
gtacttctccaccctgctct

SEQ ID NO: 2854896 - DNA, 16 bp, Homo sapiens
gtacttgtggacacag

SEQ ID NO: 2854897 - DNA, 20 bp, Homo sapiens
gtacttgtggacacagctct

SEQ ID NO: 2854898 - DNA, 22 bp, Homo sapiens
gtagaacaagcaacataaaaca

SEQ ID NO: 2854899 - DNA, 22 bp, Homo sapiens
gtagaacacaaggtcatttgct

SEQ ID NO: 2854900 - DNA, 19 bp, Homo sapiens
gtagaagggttatatttta

SEQ ID NO: 2854901 - DNA, 16 bp, Homo sapiens
gtagaattatatctaa

SEQ ID NO: 2854902 - DNA, 19 bp, Homo sapiens
gtagaattatatctaattt

SEQ ID NO: 2854903 - DNA, 18 bp, Homo sapiens
gtagacacgctcttctat

SEQ ID NO: 2854904 - DNA, 10 bp, Homo sapiens
gtagagccag

SEQ ID NO: 2854905 - DNA, 18 bp, Homo sapiens
gtagagccagggtctcac

SEQ ID NO: 2854906 - DNA, 17 bp, Homo sapiens
gtagattgtgtaaattc

SEQ ID NO: 2854907 - DNA, 17 bp, Homo sapiens
gtagcaggtaccactga

SEQ ID NO: 2854908 - DNA, 18 bp, Homo sapiens
gtagcaggtaccactgat

SEQ ID NO: 2854909 - DNA, 20 bp, Homo sapiens
gtagcatttcttatttgttt

SEQ ID NO: 2854910 - DNA, 16 bp, Homo sapiens
gtagccccagtgacag

SEQ ID NO: 2854911 - DNA, 19 bp, Homo sapiens
gtagccccagtgacagcta

SEQ ID NO: 2854912 - DNA, 12 bp, Homo sapiens
gtagcctgtgca

SEQ ID NO: 2854913 - DNA, 13 bp, Homo sapiens
gtagctgagctca

SEQ ID NO: 2854914 - DNA, 19 bp, Homo sapiens
gtagctgggactacaggca

SEQ ID NO: 2854915 - DNA, 16 bp, Homo sapiens
gtagctgtgacctgct

SEQ ID NO: 2854916 - DNA, 17 bp, Homo sapiens
gtagctgtgacctgctg

SEQ ID NO: 2854917 - DNA, 18 bp, Homo sapiens
gtagctgtgacctgctga

SEQ ID NO: 2854918 - DNA, 19 bp, Homo sapiens
gtagctgtgacctgctgag

SEQ ID NO: 2854919 - DNA, 13 bp, Homo sapiens
gtagcttaaataa

SEQ ID NO: 2854920 - DNA, 12 bp, Homo sapiens
gtagctttgctc

SEQ ID NO: 2854921 - DNA, 22 bp, Homo sapiens
gtaggaaagcaccgcagcatgt

SEQ ID NO: 2854922 - DNA, 16 bp, Homo sapiens
gtaggaccaatgttgt

SEQ ID NO: 2854923 - DNA, 21 bp, Homo sapiens
gtaggagggactgtcgctgct

SEQ ID NO: 2854924 - DNA, 14 bp, Homo sapiens
gtaggcagagcctt

SEQ ID NO: 2854925 - DNA, 15 bp, Homo sapiens
gtaggcagagccttt

SEQ ID NO: 2854926 - DNA, 21 bp, Homo sapiens
gtaggcccctggtctgccctg

SEQ ID NO: 2854927 - DNA, 16 bp, Homo sapiens
gtagtataaagaaaag

SEQ ID NO: 2854928 - DNA, 17 bp, Homo sapiens
gtagtcgtcaagttgca

SEQ ID NO: 2854929 - DNA, 13 bp, Homo sapiens
gtagttaggaaat

SEQ ID NO: 2854930 - DNA, 14 bp, Homo sapiens
gtagttaggaaata

SEQ ID NO: 2854931 - DNA, 20 bp, Homo sapiens
gtagttaggaaataaaacct

SEQ ID NO: 2854932 - DNA, 11 bp, Homo sapiens
gtagtttttca

SEQ ID NO: 2854933 - DNA, 13 bp, Homo sapiens
gtataaagaaaag

SEQ ID NO: 2854934 - DNA, 15 bp, Homo sapiens
gtataaatatgaaat

SEQ ID NO: 2854935 - DNA, 17 bp, Homo sapiens
gtataaatggttgtctg

SEQ ID NO: 2854936 - DNA, 19 bp, Homo sapiens
gtataatggttgactgggt

SEQ ID NO: 2854937 - DNA, 23 bp, Homo sapiens
gtatatacatattataaataaat

SEQ ID NO: 2854938 - DNA, 21 bp, Homo sapiens
gtatatagtatatttatactc

SEQ ID NO: 2854939 - DNA, 18 bp, Homo sapiens
gtatatatatatatatgt

SEQ ID NO: 2854940 - DNA, 13 bp, Homo sapiens
gtatatatgtaca

SEQ ID NO: 2854941 - DNA, 15 bp, Homo sapiens
gtatatatgtacagt

SEQ ID NO: 2854942 - DNA, 16 bp, Homo sapiens
gtatatctatatctct

SEQ ID NO: 2854943 - DNA, 15 bp, Homo sapiens
gtatatgtatatcta

SEQ ID NO: 2854944 - DNA, 16 bp, Homo sapiens
gtatatgtatatctat

SEQ ID NO: 2854945 - DNA, 21 bp, Homo sapiens
gtatatgtctcaggtccctgc

SEQ ID NO: 2854946 - DNA, 18 bp, Homo sapiens
gtatattatggtgtaatg

SEQ ID NO: 2854947 - DNA, 16 bp, Homo sapiens
gtatattatgtattta

SEQ ID NO: 2854948 - DNA, 15 bp, Homo sapiens
gtatcatagaaatgt

SEQ ID NO: 2854949 - DNA, 15 bp, Homo sapiens
gtatccaattatgtg

SEQ ID NO: 2854950 - DNA, 20 bp, Homo sapiens
gtatccaattatgtgacaac

SEQ ID NO: 2854951 - DNA, 19 bp, Homo sapiens
gtatcccatgagcctcagc

SEQ ID NO: 2854952 - DNA, 12 bp, Homo sapiens
gtatctgaagac

SEQ ID NO: 2854953 - DNA, 14 bp, Homo sapiens
gtatcttatttata

SEQ ID NO: 2854954 - DNA, 22 bp, Homo sapiens
gtatgaaagatggctgtgcctc

SEQ ID NO: 2854955 - DNA, 15 bp, Homo sapiens
gtatgaacttgagga

SEQ ID NO: 2854956 - DNA, 13 bp, Homo sapiens
gtatgaatgatgt

SEQ ID NO: 2854957 - DNA, 20 bp, Homo sapiens
gtatgcaagaagaatataaa

SEQ ID NO: 2854958 - DNA, 17 bp, Homo sapiens
gtatgctgttttaataa

SEQ ID NO: 2854959 - DNA, 15 bp, Homo sapiens
gtatggtggctgggt

SEQ ID NO: 2854960 - DNA, 20 bp, Homo sapiens
gtatgtgatatctgaacaca

SEQ ID NO: 2854961 - DNA, 14 bp, Homo sapiens
gtatgtgtgtatgg

SEQ ID NO: 2854962 - DNA, 19 bp, Homo sapiens
gtatgtttttgtgtatttg

SEQ ID NO: 2854963 - DNA, 15 bp, Homo sapiens
gtattaattatctga

SEQ ID NO: 2854964 - DNA, 13 bp, Homo sapiens
gtattacttctgc

SEQ ID NO: 2854965 - DNA, 15 bp, Homo sapiens
gtattacttctgcta

SEQ ID NO: 2854966 - DNA, 22 bp, Homo sapiens
gtattcagatcgtattaattat

SEQ ID NO: 2854967 - DNA, 20 bp, Homo sapiens
gtattccttttgtgtacagt

SEQ ID NO: 2854968 - DNA, 15 bp, Homo sapiens
gtattgtaatgaata

SEQ ID NO: 2854969 - DNA, 20 bp, Homo sapiens
gtattgtaatgaatatctgc

SEQ ID NO: 2854970 - DNA, 21 bp, Homo sapiens
gtattgtccatatcagacctc

SEQ ID NO: 2854971 - DNA, 14 bp, Homo sapiens
gtatttatatttgg

SEQ ID NO: 2854972 - DNA, 20 bp, Homo sapiens
gtatttatatttggaaagag

SEQ ID NO: 2854973 - DNA, 23 bp, Homo sapiens
gtgcctgggtggggctgctcctc

SEQ ID NO: 2854974 - DNA, 17 bp, Homo sapiens
gtgcctgtgaggcaggg

SEQ ID NO: 2854975 - DNA, 15 bp, Homo sapiens
gtgccttacctcctg

SEQ ID NO: 2854976 - DNA, 17 bp, Homo sapiens
gtgccttacctcctgcc

SEQ ID NO: 2854977 - DNA, 21 bp, Homo sapiens
gtgccttacctcctgcccagg

SEQ ID NO: 2854978 - DNA, 14 bp, Homo sapiens
gtgccttcatttgg

SEQ ID NO: 2854979 - DNA, 12 bp, Homo sapiens
gtgccttccata

SEQ ID NO: 2854980 - DNA, 15 bp, Homo sapiens
gtgccttccataatt

SEQ ID NO: 2854981 - DNA, 15 bp, Homo sapiens
gtgcgacttcacaaa

SEQ ID NO: 2854982 - DNA, 22 bp, Homo sapiens
gtgcgacttcacaaaatgcaag

SEQ ID NO: 2854983 - DNA, 14 bp, Homo sapiens
gtgcgttttagagt

SEQ ID NO: 2854984 - DNA, 19 bp, Homo sapiens
gtgctacctctctcttccc

SEQ ID NO: 2854985 - DNA, 14 bp, Homo sapiens
gtgctctaggctgc

SEQ ID NO: 2854986 - DNA, 16 bp, Homo sapiens
gtgctctaggctgccc

SEQ ID NO: 2854987 - DNA, 18 bp, Homo sapiens
gtgctctggacaggcatg

SEQ ID NO: 2854988 - DNA, 17 bp, Homo sapiens
gtgctcttctgttctca

SEQ ID NO: 2854989 - DNA, 13 bp, Homo sapiens
gtgctgcagccag

SEQ ID NO: 2854990 - DNA, 15 bp, Homo sapiens
gtgctgccatccagg

SEQ ID NO: 2854991 - DNA, 19 bp, Homo sapiens
gtgctgccatccaggttca

SEQ ID NO: 2854992 - DNA, 18 bp, Homo sapiens
gtgctgcccgtcttcagc

SEQ ID NO: 2854993 - DNA, 19 bp, Homo sapiens
gtgctgcccgtcttcagcc

SEQ ID NO: 2854994 - DNA, 21 bp, Homo sapiens
gtgctgcccgtcttcagccta

SEQ ID NO: 2854995 - DNA, 20 bp, Homo sapiens
gtgctgggattacaggtgtg

SEQ ID NO: 2854996 - DNA, 11 bp, Homo sapiens
gtgctgtggcc

SEQ ID NO: 2854997 - DNA, 17 bp, Homo sapiens
gtgctgtggccagggtg

SEQ ID NO: 2854998 - DNA, 17 bp, Homo sapiens
gtgctgtggcctgggca

SEQ ID NO: 2854999 - DNA, 18 bp, Homo sapiens
gtgctgtttgagatgtga

SEQ ID NO: 2855000 - DNA, 21 bp, Homo sapiens
gtgcttatcccatagccagga

SEQ ID NO: 2855001 - DNA, 19 bp, Homo sapiens
gtgcttctctttgtcccca

SEQ ID NO: 2855002 - DNA, 12 bp, Homo sapiens
gtggaaaaatat

SEQ ID NO: 2855003 - DNA, 13 bp, Homo sapiens
gtggaaaaatatt

SEQ ID NO: 2855004 - DNA, 14 bp, Homo sapiens
gtggaaagcctctg

SEQ ID NO: 2855005 - DNA, 23 bp, Homo sapiens
gtggaactacattagtacacagc

SEQ ID NO: 2855006 - DNA, 13 bp, Homo sapiens
gtggaagccctcc

SEQ ID NO: 2855007 - DNA, 18 bp, Homo sapiens
gtggaagccctccttcca

SEQ ID NO: 2855008 - DNA, 14 bp, Homo sapiens
gtggacacagctct

SEQ ID NO: 2855009 - DNA, 17 bp, Homo sapiens
gtggacacagctcttct

SEQ ID NO: 2855010 - DNA, 23 bp, Homo sapiens
gtggacacagctcttctccaggc

SEQ ID NO: 2855011 - DNA, 21 bp, Homo sapiens
gtggacaccaggagtccctgg

SEQ ID NO: 2855012 - DNA, 22 bp, Homo sapiens
gtggacaccaggagtccctggt

SEQ ID NO: 2855013 - DNA, 16 bp, Homo sapiens
gtggacacctgccctg

SEQ ID NO: 2855014 - DNA, 18 bp, Homo sapiens
gtggacacctgccctgcc

SEQ ID NO: 2855015 - DNA, 13 bp, Homo sapiens
gtggaccttcctg

SEQ ID NO: 2855016 - DNA, 22 bp, Homo sapiens
gtggagaaataaaaatacctct

SEQ ID NO: 2855017 - DNA, 13 bp, Homo sapiens
gtggaggctgctc

SEQ ID NO: 2855018 - DNA, 14 bp, Homo sapiens
gtggaggctgctcg

SEQ ID NO: 2855019 - DNA, 13 bp, Homo sapiens
gtggatcacagag

SEQ ID NO: 2855020 - DNA, 23 bp, Homo sapiens
gtggatctccaaggaccaggtta

SEQ ID NO: 2855021 - DNA, 17 bp, Homo sapiens
gtggatgtgtaaatgga

SEQ ID NO: 2855022 - DNA, 19 bp, Homo sapiens
gtggcaagtgaatttgcct

SEQ ID NO: 2855023 - DNA, 20 bp, Homo sapiens
gtggcagataatcagcctct

SEQ ID NO: 2855024 - DNA, 23 bp, Homo sapiens
gtggcagataatcagcctcttaa

SEQ ID NO: 2855025 - DNA, 12 bp, Homo sapiens
gtggcagccctg

SEQ ID NO: 2855026 - DNA, 19 bp, Homo sapiens
gtggcagctgcggtccacc

SEQ ID NO: 2855027 - DNA, 15 bp, Homo sapiens
gtggcagtgggagct

SEQ ID NO: 2855028 - DNA, 19 bp, Homo sapiens
gtggcagtgggagctgcct

SEQ ID NO: 2855029 - DNA, 22 bp, Homo sapiens
gtggcatgttcatcgtataaca

SEQ ID NO: 2855030 - DNA, 13 bp, Homo sapiens
gtggccagggtga

SEQ ID NO: 2855031 - DNA, 17 bp, Homo sapiens
gtggccatgcttcttgc

SEQ ID NO: 2855032 - DNA, 22 bp, Homo sapiens
gtggccatgtcgcctgccccca

SEQ ID NO: 2855033 - DNA, 13 bp, Homo sapiens
gtggccctggcct

SEQ ID NO: 2855034 - DNA, 16 bp, Homo sapiens
gtggccctggcctgct

SEQ ID NO: 2855035 - DNA, 17 bp, Homo sapiens
gtggccctggcctgctg

SEQ ID NO: 2855036 - DNA, 18 bp, Homo sapiens
gtggccctggcctgctgg

SEQ ID NO: 2855037 - DNA, 21 bp, Homo sapiens
gtggcccttcctggacagctg

SEQ ID NO: 2855038 - DNA, 14 bp, Homo sapiens
gtggcctgggcaag

SEQ ID NO: 2855039 - DNA, 21 bp, Homo sapiens
gtggcgttctgctgcccctgc

SEQ ID NO: 2855040 - DNA, 15 bp, Homo sapiens
gtggctactctgtgc

SEQ ID NO: 2855041 - DNA, 17 bp, Homo sapiens
gtggctagtcagagaga

SEQ ID NO: 2855042 - DNA, 19 bp, Homo sapiens
gtggctagtcagagagagt

SEQ ID NO: 2855043 - DNA, 22 bp, Homo sapiens
gtggctcacgcctgtaatccca

SEQ ID NO: 2855044 - DNA, 17 bp, Homo sapiens
gtggctgacccagtccc

SEQ ID NO: 2855045 - DNA, 19 bp, Homo sapiens
gtggctgctagcacttgga

SEQ ID NO: 2855046 - DNA, 19 bp, Homo sapiens
gtggctgggttggagggtg

SEQ ID NO: 2855047 - DNA, 18 bp, Homo sapiens
gtggcttcccatgtcttt

SEQ ID NO: 2855048 - DNA, 17 bp, Homo sapiens
gtggcttcctccgtctg

SEQ ID NO: 2855049 - DNA, 19 bp, Homo sapiens
gtggctttaggagcagtgg

SEQ ID NO: 2855050 - DNA, 20 bp, Homo sapiens
gtgggacaaaccagagcaga

SEQ ID NO: 2855051 - DNA, 14 bp, Homo sapiens
gtgggagctgcctg

SEQ ID NO: 2855052 - DNA, 15 bp, Homo sapiens
gtgggagctgcctgt

SEQ ID NO: 2855053 - DNA, 15 bp, Homo sapiens
gtgggagggtaccag

SEQ ID NO: 2855054 - DNA, 16 bp, Homo sapiens
gtgggagggtaccagc

SEQ ID NO: 2855055 - DNA, 14 bp, Homo sapiens
gtgggatggaggag

SEQ ID NO: 2855056 - DNA, 15 bp, Homo sapiens
gtgggcagcagctca

SEQ ID NO: 2855057 - DNA, 13 bp, Homo sapiens
gtgggcagggctg

SEQ ID NO: 2855058 - DNA, 14 bp, Homo sapiens
gtgggcagggctgg

SEQ ID NO: 2855059 - DNA, 14 bp, Homo sapiens
gtgggccaggacag

SEQ ID NO: 2855060 - DNA, 18 bp, Homo sapiens
gtgggccaggacaggccc

SEQ ID NO: 2855061 - DNA, 15 bp, Homo sapiens
gtgggcctcctctgt

SEQ ID NO: 2855062 - DNA, 15 bp, Homo sapiens
gtgggctagttgggc

SEQ ID NO: 2855063 - DNA, 14 bp, Homo sapiens
gtgggctgagccct

SEQ ID NO: 2855064 - DNA, 19 bp, Homo sapiens
taaagcttgcaacaaaatt

SEQ ID NO: 2855065 - DNA, 15 bp, Homo sapiens
taaaggattgatcac

SEQ ID NO: 2855066 - DNA, 21 bp, Homo sapiens
taaaggattgatcactttgtt

SEQ ID NO: 2855067 - DNA, 21 bp, Homo sapiens
taaagggaaaggattcatgtg

SEQ ID NO: 2855068 - DNA, 23 bp, Homo sapiens
taaaggtggtatgtgtgtgtatg

SEQ ID NO: 2855069 - DNA, 16 bp, Homo sapiens
taaagtacctgtagtg

SEQ ID NO: 2855070 - DNA, 21 bp, Homo sapiens
taaagtacctgtagtgagaaa

SEQ ID NO: 2855071 - DNA, 17 bp, Homo sapiens
taaagtatatatttatt

SEQ ID NO: 2855072 - DNA, 13 bp, Homo sapiens
taaagtgaccagg

SEQ ID NO: 2855073 - DNA, 21 bp, Homo sapiens
taaagttagtgtgttgtctgt

SEQ ID NO: 2855074 - DNA, 15 bp, Homo sapiens
taaagttcaacatgt

SEQ ID NO: 2855075 - DNA, 16 bp, Homo sapiens
taaagttgataaagat

SEQ ID NO: 2855076 - DNA, 20 bp, Homo sapiens
taaagttgataaagattttt

SEQ ID NO: 2855077 - DNA, 18 bp, Homo sapiens
taaagtttaaaaaataca

SEQ ID NO: 2855078 - DNA, 15 bp, Homo sapiens
taaataaaagcagca

SEQ ID NO: 2855079 - DNA, 16 bp, Homo sapiens
taaataaatcattaat

SEQ ID NO: 2855080 - DNA, 22 bp, Homo sapiens
taaataaatgtatcttattcac

SEQ ID NO: 2855081 - DNA, 18 bp, Homo sapiens
taaataaatgtcattaaa

SEQ ID NO: 2855082 - DNA, 12 bp, Homo sapiens
taaataaattca

SEQ ID NO: 2855083 - DNA, 18 bp, Homo sapiens
taaatacacaacacacac

SEQ ID NO: 2855084 - DNA, 17 bp, Homo sapiens
taaatacagacactaag

SEQ ID NO: 2855085 - DNA, 13 bp, Homo sapiens
taaatagcatctg

SEQ ID NO: 2855086 - DNA, 18 bp, Homo sapiens
taaatagtaggaccaatg

SEQ ID NO: 2855087 - DNA, 24 bp, Homo sapiens
taaatagttttaaatatgaacaaa

SEQ ID NO: 2855088 - DNA, 11 bp, Homo sapiens
taaatatatat

SEQ ID NO: 2855089 - DNA, 21 bp, Homo sapiens
taaatatatatttttcaacca

SEQ ID NO: 2855090 - DNA, 14 bp, Homo sapiens
taaatatgaacaaa

SEQ ID NO: 2855091 - DNA, 21 bp, Homo sapiens
taaatatgttagcaaagagtt

SEQ ID NO: 2855092 - DNA, 14 bp, Homo sapiens
taaatattctgcat

SEQ ID NO: 2855093 - DNA, 14 bp, Homo sapiens
taaatattttaaag

SEQ ID NO: 2855094 - DNA, 15 bp, Homo sapiens
taaatattttaaaga

SEQ ID NO: 2855095 - DNA, 14 bp, Homo sapiens
taaatcaatgtcac

SEQ ID NO: 2855096 - DNA, 23 bp, Homo sapiens
taaatcaatgtcacttaaaggct

SEQ ID NO: 2855097 - DNA, 18 bp, Homo sapiens
taaatcacgctttttgaa

SEQ ID NO: 2855098 - DNA, 22 bp, Homo sapiens
taaatcacgctttttgaaaaag

SEQ ID NO: 2855099 - DNA, 12 bp, Homo sapiens
taaatccaaaga

SEQ ID NO: 2855100 - DNA, 13 bp, Homo sapiens
taaatccaaagaa

SEQ ID NO: 2855101 - DNA, 23 bp, Homo sapiens
taaatcccattcataactttcat

SEQ ID NO: 2855102 - DNA, 17 bp, Homo sapiens
taaatcctttactgtta

SEQ ID NO: 2855103 - DNA, 20 bp, Homo sapiens
taaatctgagcctaaatcta

SEQ ID NO: 2855104 - DNA, 12 bp, Homo sapiens
taaatcttcctt

SEQ ID NO: 2855105 - DNA, 14 bp, Homo sapiens
taaatcttccttgt

SEQ ID NO: 2855106 - DNA, 18 bp, Homo sapiens
taaatcttccttgtgagg

SEQ ID NO: 2855107 - DNA, 19 bp, Homo sapiens
taaatcttccttgtgagga

SEQ ID NO: 2855108 - DNA, 19 bp, Homo sapiens
taaatcttttataggattt

SEQ ID NO: 2855109 - DNA, 15 bp, Homo sapiens
taaatgagctcctgc

SEQ ID NO: 2855110 - DNA, 15 bp, Homo sapiens
taaatgcaatatgta

SEQ ID NO: 2855111 - DNA, 16 bp, Homo sapiens
taaatgcatgatttta

SEQ ID NO: 2855112 - DNA, 20 bp, Homo sapiens
taaatgcatgattttataca

SEQ ID NO: 2855113 - DNA, 19 bp, Homo sapiens
taaatgccaacataccctt

SEQ ID NO: 2855114 - DNA, 16 bp, Homo sapiens
taaatgccctctctga

SEQ ID NO: 2855115 - DNA, 20 bp, Homo sapiens
taaatggagcttgtacatat

SEQ ID NO: 2855116 - DNA, 14 bp, Homo sapiens
taaatgtgtaaatg

SEQ ID NO: 2855117 - DNA, 22 bp, Homo sapiens
taaatgtgtggtgctaactgta

SEQ ID NO: 2855118 - DNA, 19 bp, Homo sapiens
taaattacaattgtcattt

SEQ ID NO: 2855119 - DNA, 18 bp, Homo sapiens
taaattagtatttattta

SEQ ID NO: 2855120 - DNA, 22 bp, Homo sapiens
taaattataacttaaaatattt

SEQ ID NO: 2855121 - DNA, 16 bp, Homo sapiens
taaattcaaaccattt

SEQ ID NO: 2855122 - DNA, 18 bp, Homo sapiens
taaattcagatatatttt

SEQ ID NO: 2855123 - DNA, 20 bp, Homo sapiens
taaattcagatatatttttc

SEQ ID NO: 2855124 - DNA, 16 bp, Homo sapiens
taaattccactggact

SEQ ID NO: 2855125 - DNA, 16 bp, Homo sapiens
taaattgatgttgctg

SEQ ID NO: 2855126 - DNA, 17 bp, Homo sapiens
taacaaaacaagaaaga

SEQ ID NO: 2855127 - DNA, 17 bp, Homo sapiens
taacaactaatcaagag

SEQ ID NO: 2855128 - DNA, 16 bp, Homo sapiens
taacaagatctttcag

SEQ ID NO: 2855129 - DNA, 15 bp, Homo sapiens
taacaagccagattt

SEQ ID NO: 2855130 - DNA, 16 bp, Homo sapiens
taacaatgtatgtgaa

SEQ ID NO: 2855131 - DNA, 14 bp, Homo sapiens
taacacatgtcctt

SEQ ID NO: 2855132 - DNA, 11 bp, Homo sapiens
taacacattat

SEQ ID NO: 2855133 - DNA, 18 bp, Homo sapiens
taacactcagaagcctgg

SEQ ID NO: 2855134 - DNA, 20 bp, Homo sapiens
taacactcagaagcctgggg

SEQ ID NO: 2855135 - DNA, 15 bp, Homo sapiens
taacactgcaagaag

SEQ ID NO: 2855136 - DNA, 19 bp, Homo sapiens
taacaggcagatacaggaa

SEQ ID NO: 2855137 - DNA, 23 bp, Homo sapiens
taacaggctcaatattcctgaat

SEQ ID NO: 2855138 - DNA, 16 bp, Homo sapiens
taacataatttgtaca

SEQ ID NO: 2855139 - DNA, 19 bp, Homo sapiens
taacataatttgtacatat

SEQ ID NO: 2855140 - DNA, 18 bp, Homo sapiens
taacattaattctactaa

SEQ ID NO: 2855141 - DNA, 22 bp, Homo sapiens
taacattctgtaaaatgtctgt

SEQ ID NO: 2855142 - DNA, 20 bp, Homo sapiens
taacatttatctaaaagaat

SEQ ID NO: 2855143 - DNA, 18 bp, Homo sapiens
taaccacaaccaggaaga

SEQ ID NO: 2855144 - DNA, 20 bp, Homo sapiens
taaccagacacatactcatt

SEQ ID NO: 2855145 - DNA, 22 bp, Homo sapiens
taaccagacacatactcatttt

SEQ ID NO: 2855146 - DNA, 18 bp, Homo sapiens
taaccagcacatttctcc

SEQ ID NO: 2855147 - DNA, 18 bp, Homo sapiens
taacccccagtgccacag

SEQ ID NO: 2855148 - DNA, 12 bp, Homo sapiens
taacccctttcc

SEQ ID NO: 2855149 - DNA, 13 bp, Homo sapiens
taacccctttcct

SEQ ID NO: 2855150 - DNA, 19 bp, Homo sapiens
taaccctctcttccctatt

SEQ ID NO: 2855151 - DNA, 19 bp, Homo sapiens
taacctcagtgtcatttat

SEQ ID NO: 2855152 - DNA, 20 bp, Homo sapiens
taacctcagtgtcatttatg

SEQ ID NO: 2855153 - DNA, 19 bp, Homo sapiens
taacctccacagtagcatt

SEQ ID NO: 2855154 - DNA, 21 bp, Homo sapiens
tcaccaataacttcagagaag

SEQ ID NO: 2855155 - DNA, 15 bp, Homo sapiens
tcaccaatgtaccca

SEQ ID NO: 2855156 - DNA, 13 bp, Homo sapiens
tcaccacctctcc

SEQ ID NO: 2855157 - DNA, 14 bp, Homo sapiens
tcaccaccttccca

SEQ ID NO: 2855158 - DNA, 13 bp, Homo sapiens
tcaccagagccca

SEQ ID NO: 2855159 - DNA, 19 bp, Homo sapiens
tcaccagagcccatgctca

SEQ ID NO: 2855160 - DNA, 20 bp, Homo sapiens
tcaccagagcccatgctcaa

SEQ ID NO: 2855161 - DNA, 22 bp, Homo sapiens
tcaccagccccagtgcccacag

SEQ ID NO: 2855162 - DNA, 22 bp, Homo sapiens
tcaccaggaatgttaaagtcag

SEQ ID NO: 2855163 - DNA, 14 bp, Homo sapiens
tcacccacagggct

SEQ ID NO: 2855164 - DNA, 12 bp, Homo sapiens
tcacccatgtgc

SEQ ID NO: 2855165 - DNA, 17 bp, Homo sapiens
tcaccccctcccacccc

SEQ ID NO: 2855166 - DNA, 15 bp, Homo sapiens
tcaccctacctgtgc

SEQ ID NO: 2855167 - DNA, 19 bp, Homo sapiens
tcaccctcataccatctgc

SEQ ID NO: 2855168 - DNA, 23 bp, Homo sapiens
tcaccggagctttcaaagaagga

SEQ ID NO: 2855169 - DNA, 16 bp, Homo sapiens
tcacctgaagactcat

SEQ ID NO: 2855170 - DNA, 23 bp, Homo sapiens
tcacctgaagactcattcttctg

SEQ ID NO: 2855171 - DNA, 19 bp, Homo sapiens
tcacctgagtcaccctacc

SEQ ID NO: 2855172 - DNA, 16 bp, Homo sapiens
tcacctgcctgccctc

SEQ ID NO: 2855173 - DNA, 13 bp, Homo sapiens
tcacctggaagca

SEQ ID NO: 2855174 - DNA, 15 bp, Homo sapiens
tcacgcaacttgaaa

SEQ ID NO: 2855175 - DNA, 16 bp, Homo sapiens
tcacgcaacttgaaat

SEQ ID NO: 2855176 - DNA, 13 bp, Homo sapiens
tcacgcccagcct

SEQ ID NO: 2855177 - DNA, 15 bp, Homo sapiens
tcacgcccagcctcc

SEQ ID NO: 2855178 - DNA, 17 bp, Homo sapiens
tcacgcccagcctcctc

SEQ ID NO: 2855179 - DNA, 19 bp, Homo sapiens
tcacgcctatgatcccagc

SEQ ID NO: 2855180 - DNA, 23 bp, Homo sapiens
tcacgcctgtaatcccagcactt

SEQ ID NO: 2855181 - DNA, 13 bp, Homo sapiens
tcacggctcactg

SEQ ID NO: 2855182 - DNA, 14 bp, Homo sapiens
tcacgtgaaatatt

SEQ ID NO: 2855183 - DNA, 12 bp, Homo sapiens
tcactaaatctt

SEQ ID NO: 2855184 - DNA, 19 bp, Homo sapiens
tcactactcacagtctctt

SEQ ID NO: 2855185 - DNA, 12 bp, Homo sapiens
tcactagcagct

SEQ ID NO: 2855186 - DNA, 14 bp, Homo sapiens
tcactagcagctgc

SEQ ID NO: 2855187 - DNA, 19 bp, Homo sapiens
tcactataaccatcagtta

SEQ ID NO: 2855188 - DNA, 21 bp, Homo sapiens
tcactataaccatcagttact

SEQ ID NO: 2855189 - DNA, 22 bp, Homo sapiens
tcactataaccatcagttactg

SEQ ID NO: 2855190 - DNA, 14 bp, Homo sapiens
tcactatgacactg

SEQ ID NO: 2855191 - DNA, 13 bp, Homo sapiens
tcactatgatttt

SEQ ID NO: 2855192 - DNA, 16 bp, Homo sapiens
tcactatgattttcta

SEQ ID NO: 2855193 - DNA, 19 bp, Homo sapiens
tcactatgttgcccaggca

SEQ ID NO: 2855194 - DNA, 21 bp, Homo sapiens
tcactatgttgcccaggcagg

SEQ ID NO: 2855195 - DNA, 13 bp, Homo sapiens
tcactccaccacc

SEQ ID NO: 2855196 - DNA, 15 bp, Homo sapiens
tcactccaccaccca

SEQ ID NO: 2855197 - DNA, 18 bp, Homo sapiens
tcactcccagaccacctc

SEQ ID NO: 2855198 - DNA, 24 bp, Homo sapiens
tcactccctccctggctctgccag

SEQ ID NO: 2855199 - DNA, 21 bp, Homo sapiens
tcactccggtgtgcctgcagc

SEQ ID NO: 2855200 - DNA, 22 bp, Homo sapiens
tcactccggtgtgcctgcagcc

SEQ ID NO: 2855201 - DNA, 14 bp, Homo sapiens
tcactcttatgaaa

SEQ ID NO: 2855202 - DNA, 17 bp, Homo sapiens
tcactcttattgcccac

SEQ ID NO: 2855203 - DNA, 21 bp, Homo sapiens
tcactcttattgcccacgctg

SEQ ID NO: 2855204 - DNA, 15 bp, Homo sapiens
tcactgcacaagata

SEQ ID NO: 2855205 - DNA, 12 bp, Homo sapiens
tcactgcagcct

SEQ ID NO: 2855206 - DNA, 14 bp, Homo sapiens
tcactgcagcctca

SEQ ID NO: 2855207 - DNA, 15 bp, Homo sapiens
tcactgcagcctcaa

SEQ ID NO: 2855208 - DNA, 12 bp, Homo sapiens
tcactggagccc

SEQ ID NO: 2855209 - DNA, 13 bp, Homo sapiens
tcactggagccca

SEQ ID NO: 2855210 - DNA, 20 bp, Homo sapiens
tcactggagtagttgctact

SEQ ID NO: 2855211 - DNA, 16 bp, Homo sapiens
tcactggggtcctggg

SEQ ID NO: 2855212 - DNA, 17 bp, Homo sapiens
tcactggggtcctgggg

SEQ ID NO: 2855213 - DNA, 18 bp, Homo sapiens
tcactggtagaccaaaat

SEQ ID NO: 2855214 - DNA, 20 bp, Homo sapiens
tcactggtagaccaaaataa

SEQ ID NO: 2855215 - DNA, 17 bp, Homo sapiens
tcactgttgcccaggct

SEQ ID NO: 2855216 - DNA, 19 bp, Homo sapiens
tcactgttgcccaggctgg

SEQ ID NO: 2855217 - DNA, 16 bp, Homo sapiens
tcacttgaactcggga

SEQ ID NO: 2855218 - DNA, 13 bp, Homo sapiens
tcacttgaatgtg

SEQ ID NO: 2855219 - DNA, 22 bp, Homo sapiens
tcacttgaggtcaggagttcct

SEQ ID NO: 2855220 - DNA, 17 bp, Homo sapiens
tcacttgtgcagtgttg

SEQ ID NO: 2855221 - DNA, 20 bp, Homo sapiens
tcactttaattctcatgtga

SEQ ID NO: 2855222 - DNA, 22 bp, Homo sapiens
tcactttaattctcatgtgatc

SEQ ID NO: 2855223 - DNA, 21 bp, Homo sapiens
tcactttaccttcagcagtta

SEQ ID NO: 2855224 - DNA, 15 bp, Homo sapiens
tcagaaaagaaaacc

SEQ ID NO: 2855225 - DNA, 18 bp, Homo sapiens
tcagaaaagaaaaccatt

SEQ ID NO: 2855226 - DNA, 10 bp, Homo sapiens
tcagaaaagt

SEQ ID NO: 2855227 - DNA, 21 bp, Homo sapiens
tcagaaaagtagaattatatc

SEQ ID NO: 2855228 - DNA, 23 bp, Homo sapiens
tcagaaaagtagaattatatcta

SEQ ID NO: 2855229 - DNA, 18 bp, Homo sapiens
tcagaaagggagggctct

SEQ ID NO: 2855230 - DNA, 20 bp, Homo sapiens
tcagaaagggagggctctga

SEQ ID NO: 2855231 - DNA, 21 bp, Homo sapiens
tcagaaagggagggctctgag

SEQ ID NO: 2855232 - DNA, 12 bp, Homo sapiens
tcagaagaaaga

SEQ ID NO: 2855233 - DNA, 13 bp, Homo sapiens
tcagaagcctgag

SEQ ID NO: 2855234 - DNA, 15 bp, Homo sapiens
tcagaagcctgaggc

SEQ ID NO: 2855235 - DNA, 13 bp, Homo sapiens
tcagaagcctggg

SEQ ID NO: 2855236 - DNA, 14 bp, Homo sapiens
tcagaagcctgggg

SEQ ID NO: 2855237 - DNA, 19 bp, Homo sapiens
tcagaagcctgggggcctg

SEQ ID NO: 2855238 - DNA, 22 bp, Homo sapiens
tcagaagcctgggggcctggct

SEQ ID NO: 2855239 - DNA, 13 bp, Homo sapiens
tcagaaggagaag

SEQ ID NO: 2855240 - DNA, 18 bp, Homo sapiens
tcagaaggagaaggaagg

SEQ ID NO: 2855241 - DNA, 23 bp, Homo sapiens
tcagaaggagaaggaaggagact

SEQ ID NO: 2855242 - DNA, 14 bp, Homo sapiens
tcagaatccaaaga

SEQ ID NO: 2855243 - DNA, 14 bp, Homo sapiens
tcagaatgtcattt

SEQ ID NO: 2855244 - DNA, 23 bp, Homo sapiens
tcagaatttctttgtcattcaag

SEQ ID NO: 2855245 - DNA, 20 bp, Homo sapiens
tcccaaaatgttgaaatatg

SEQ ID NO: 2855246 - DNA, 16 bp, Homo sapiens
tcccaaagtgctggga

SEQ ID NO: 2855247 - DNA, 13 bp, Homo sapiens
tcccaaccccagg

SEQ ID NO: 2855248 - DNA, 23 bp, Homo sapiens
tcccaaccccagggcccccacag

SEQ ID NO: 2855249 - DNA, 17 bp, Homo sapiens
tcccaagctctgctcct

SEQ ID NO: 2855250 - DNA, 13 bp, Homo sapiens
tcccaataaaagt

SEQ ID NO: 2855251 - DNA, 17 bp, Homo sapiens
tcccaataaaagtgact

SEQ ID NO: 2855252 - DNA, 14 bp, Homo sapiens
tcccaataaagctg

SEQ ID NO: 2855253 - DNA, 18 bp, Homo sapiens
tcccacactcccccagac

SEQ ID NO: 2855254 - DNA, 18 bp, Homo sapiens
tcccacaggttcaggcga

SEQ ID NO: 2855255 - DNA, 14 bp, Homo sapiens
tcccacatccctgg

SEQ ID NO: 2855256 - DNA, 18 bp, Homo sapiens
tcccacatccctgggcct

SEQ ID NO: 2855257 - DNA, 22 bp, Homo sapiens
tcccacatccctgggcctgctg

SEQ ID NO: 2855258 - DNA, 20 bp, Homo sapiens
tcccaccaccttggactcct

SEQ ID NO: 2855259 - DNA, 23 bp, Homo sapiens
tcccaccagcatgtcactcccag

SEQ ID NO: 2855260 - DNA, 15 bp, Homo sapiens
tcccacccacatgtg

SEQ ID NO: 2855261 - DNA, 16 bp, Homo sapiens
tcccacccacatgtga

SEQ ID NO: 2855262 - DNA, 22 bp, Homo sapiens
tcccacccacatgtgacacata

SEQ ID NO: 2855263 - DNA, 16 bp, Homo sapiens
tcccaccccaccccct

SEQ ID NO: 2855264 - DNA, 22 bp, Homo sapiens
tcccaccccacccccttcagtg

SEQ ID NO: 2855265 - DNA, 23 bp, Homo sapiens
tcccacccccagccccgactcca

SEQ ID NO: 2855266 - DNA, 13 bp, Homo sapiens
tcccacctcagcc

SEQ ID NO: 2855267 - DNA, 16 bp, Homo sapiens
tcccaccttggctgca

SEQ ID NO: 2855268 - DNA, 19 bp, Homo sapiens
tcccaccttggctgcaggg

SEQ ID NO: 2855269 - DNA, 16 bp, Homo sapiens
tcccagagacaggaaa

SEQ ID NO: 2855270 - DNA, 16 bp, Homo sapiens
tcccagagcaaaataa

SEQ ID NO: 2855271 - DNA, 13 bp, Homo sapiens
tcccagcactttg

SEQ ID NO: 2855272 - DNA, 16 bp, Homo sapiens
tcccagcactttggga

SEQ ID NO: 2855273 - DNA, 15 bp, Homo sapiens
tcccagcccaaagct

SEQ ID NO: 2855274 - DNA, 16 bp, Homo sapiens
tcccagctacacctga

SEQ ID NO: 2855275 - DNA, 14 bp, Homo sapiens
tcccagctactcag

SEQ ID NO: 2855276 - DNA, 16 bp, Homo sapiens
tcccagctactcagaa

SEQ ID NO: 2855277 - DNA, 22 bp, Homo sapiens
tcccagctctccctctggccct

SEQ ID NO: 2855278 - DNA, 23 bp, Homo sapiens
tcccagctctccctctggccctg

SEQ ID NO: 2855279 - DNA, 14 bp, Homo sapiens
tcccagctgtctgt

SEQ ID NO: 2855280 - DNA, 16 bp, Homo sapiens
tcccaggaactgggcc

SEQ ID NO: 2855281 - DNA, 11 bp, Homo sapiens
tcccaggcccc

SEQ ID NO: 2855282 - DNA, 17 bp, Homo sapiens
tcccagggccagggccc

SEQ ID NO: 2855283 - DNA, 21 bp, Homo sapiens
tcccagggccagggccctgca

SEQ ID NO: 2855284 - DNA, 12 bp, Homo sapiens
tcccaggggacc

SEQ ID NO: 2855285 - DNA, 14 bp, Homo sapiens
tcccaggttggcct

SEQ ID NO: 2855286 - DNA, 15 bp, Homo sapiens
tcccagttcaggagt

SEQ ID NO: 2855287 - DNA, 23 bp, Homo sapiens
tcccagttcaggagtcccaagga

SEQ ID NO: 2855288 - DNA, 18 bp, Homo sapiens
tcccatccatcagctccc

SEQ ID NO: 2855289 - DNA, 14 bp, Homo sapiens
tcccatccccagcg

SEQ ID NO: 2855290 - DNA, 18 bp, Homo sapiens
tcccatctaagctgcagc

SEQ ID NO: 2855291 - DNA, 22 bp, Homo sapiens
tcccatctaagctgcagcttcc

SEQ ID NO: 2855292 - DNA, 23 bp, Homo sapiens
tcccatctaagctgcagcttcct

SEQ ID NO: 2855293 - DNA, 14 bp, Homo sapiens
tcccatctcttcct

SEQ ID NO: 2855294 - DNA, 15 bp, Homo sapiens
tcccatctgctcctc

SEQ ID NO: 2855295 - DNA, 16 bp, Homo sapiens
tcccatgagcctcagc

SEQ ID NO: 2855296 - DNA, 17 bp, Homo sapiens
tcccatgagcctcagca

SEQ ID NO: 2855297 - DNA, 15 bp, Homo sapiens
tcccatgctgaatta

SEQ ID NO: 2855298 - DNA, 18 bp, Homo sapiens
tcccatgggggtgctgca

SEQ ID NO: 2855299 - DNA, 21 bp, Homo sapiens
tcccatgggggtgctgcagcc

SEQ ID NO: 2855300 - DNA, 15 bp, Homo sapiens
tcccatttccttgga

SEQ ID NO: 2855301 - DNA, 13 bp, Homo sapiens
tccccacagaact

SEQ ID NO: 2855302 - DNA, 17 bp, Homo sapiens
tccccacagaactgctt

SEQ ID NO: 2855303 - DNA, 23 bp, Homo sapiens
tccccaccttcaattcctgggcc

SEQ ID NO: 2855304 - DNA, 15 bp, Homo sapiens
tccccaccttcccca

SEQ ID NO: 2855305 - DNA, 16 bp, Homo sapiens
tccccaccttccccag

SEQ ID NO: 2855306 - DNA, 20 bp, Homo sapiens
tccccaccttcttcagccac

SEQ ID NO: 2855307 - DNA, 16 bp, Homo sapiens
tccccagactcagctc

SEQ ID NO: 2855308 - DNA, 21 bp, Homo sapiens
tccccagactcagctccagaa

SEQ ID NO: 2855309 - DNA, 20 bp, Homo sapiens
tccccagacttctctttctt

SEQ ID NO: 2855310 - DNA, 20 bp, Homo sapiens
tccccagcaagtgagagctg

SEQ ID NO: 2855311 - DNA, 11 bp, Homo sapiens
tccccagctcc

SEQ ID NO: 2855312 - DNA, 15 bp, Homo sapiens
tccccagctccccag

SEQ ID NO: 2855313 - DNA, 16 bp, Homo sapiens
tccccagctccccagg

SEQ ID NO: 2855314 - DNA, 23 bp, Homo sapiens
tccccaggactcaccctcatacc

SEQ ID NO: 2855315 - DNA, 12 bp, Homo sapiens
tccccaggccag

SEQ ID NO: 2855316 - DNA, 23 bp, Homo sapiens
tccccaggggagagggtctggag

SEQ ID NO: 2855317 - DNA, 17 bp, Homo sapiens
tccccaggtctctccac

SEQ ID NO: 2855318 - DNA, 15 bp, Homo sapiens
tccccaggtggctga

SEQ ID NO: 2855319 - DNA, 19 bp, Homo sapiens
tccccaggtggctgaccca

SEQ ID NO: 2855320 - DNA, 14 bp, Homo sapiens
tccccagtgtggcc

SEQ ID NO: 2855321 - DNA, 16 bp, Homo sapiens
tccccatcatcccagc

SEQ ID NO: 2855322 - DNA, 17 bp, Homo sapiens
tccccatcatcccagct

SEQ ID NO: 2855323 - DNA, 15 bp, Homo sapiens
tccccattagtatcc

SEQ ID NO: 2855324 - DNA, 17 bp, Homo sapiens
tccccattcacagagcc

SEQ ID NO: 2855325 - DNA, 22 bp, Homo sapiens
tccccattcttcctagttttct

SEQ ID NO: 2855326 - DNA, 18 bp, Homo sapiens
tcccccatcccccactgc

SEQ ID NO: 2855327 - DNA, 20 bp, Homo sapiens
tcccccatcccctttcctcc

SEQ ID NO: 2855328 - DNA, 12 bp, Homo sapiens
tccccccactgc

SEQ ID NO: 2855329 - DNA, 18 bp, Homo sapiens
tccccccactgcaggccc

SEQ ID NO: 2855330 - DNA, 23 bp, Homo sapiens
tccccccactgcaggccccgctt

SEQ ID NO: 2855331 - DNA, 15 bp, Homo sapiens
tccccccagcccctc

SEQ ID NO: 2855332 - DNA, 17 bp, Homo sapiens
tcccccgctggcagcca

SEQ ID NO: 2855333 - DNA, 13 bp, Homo sapiens
tccccctatgctc

SEQ ID NO: 2855334 - DNA, 19 bp, Homo sapiens
tccccctcccagggccagg

SEQ ID NO: 2855335 - DNA, 10 bp, Homo sapiens
tccccctggg

SEQ ID NO: 2855336 - DNA, 16 bp, Homo sapiens
tcggaagcagtgcctt

SEQ ID NO: 2855337 - DNA, 19 bp, Homo sapiens
tcggaaggctggctgggca

SEQ ID NO: 2855338 - DNA, 16 bp, Homo sapiens
tcggaagggaaaacag

SEQ ID NO: 2855339 - DNA, 21 bp, Homo sapiens
tcggagacagtgatctccata

SEQ ID NO: 2855340 - DNA, 23 bp, Homo sapiens
tcggagacagtgatctccatatg

SEQ ID NO: 2855341 - DNA, 23 bp, Homo sapiens
tcggagcctcatccgaggcaggg

SEQ ID NO: 2855342 - DNA, 19 bp, Homo sapiens
tcggagcgaagcagagagg

SEQ ID NO: 2855343 - DNA, 22 bp, Homo sapiens
tcggagtagaaattgttcctga

SEQ ID NO: 2855344 - DNA, 16 bp, Homo sapiens
tcggcccacagctccc

SEQ ID NO: 2855345 - DNA, 13 bp, Homo sapiens
tcgggagcagtgt

SEQ ID NO: 2855346 - DNA, 16 bp, Homo sapiens
tcggggcgacccctca

SEQ ID NO: 2855347 - DNA, 14 bp, Homo sapiens
tcggggtgcacagg

SEQ ID NO: 2855348 - DNA, 15 bp, Homo sapiens
tcggtggccatgctt

SEQ ID NO: 2855349 - DNA, 23 bp, Homo sapiens
tcggttccacgtccccctggggc

SEQ ID NO: 2855350 - DNA, 21 bp, Homo sapiens
tcgtataacacaatatgaata

SEQ ID NO: 2855351 - DNA, 14 bp, Homo sapiens
tcgtccccaagtga

SEQ ID NO: 2855352 - DNA, 14 bp, Homo sapiens
tcgtcctccccctg

SEQ ID NO: 2855353 - DNA, 17 bp, Homo sapiens
tcgtcctccccctgcca

SEQ ID NO: 2855354 - DNA, 15 bp, Homo sapiens
tcgtccttactcctg

SEQ ID NO: 2855355 - DNA, 16 bp, Homo sapiens
tcgtccttactcctgt

SEQ ID NO: 2855356 - DNA, 13 bp, Homo sapiens
tcgtgacaacact

SEQ ID NO: 2855357 - DNA, 13 bp, Homo sapiens
tcgtgcatttgtg

SEQ ID NO: 2855358 - DNA, 16 bp, Homo sapiens
tcgtgcctataaatag

SEQ ID NO: 2855359 - DNA, 17 bp, Homo sapiens
tcgtgcctataaatagt

SEQ ID NO: 2855360 - DNA, 12 bp, Homo sapiens
tcgtggagagct

SEQ ID NO: 2855361 - DNA, 16 bp, Homo sapiens
tcgtggagagctagga

SEQ ID NO: 2855362 - DNA, 24 bp, Homo sapiens
tcgtggagagctaggagcaaagcc

SEQ ID NO: 2855363 - DNA, 21 bp, Homo sapiens
tcgtggcagataatcagcctc

SEQ ID NO: 2855364 - DNA, 22 bp, Homo sapiens
tcgtgggtgtgtgtagccaagg

SEQ ID NO: 2855365 - DNA, 19 bp, Homo sapiens
tcgtttattgcttaatccc

SEQ ID NO: 2855366 - DNA, 19 bp, Homo sapiens
tctaaaactatggttccca

SEQ ID NO: 2855367 - DNA, 23 bp, Homo sapiens
tctaaaactatggttcccaataa

SEQ ID NO: 2855368 - DNA, 21 bp, Homo sapiens
tctaaagctggtttaatgttt

SEQ ID NO: 2855369 - DNA, 16 bp, Homo sapiens
tctaaatcttccttgt

SEQ ID NO: 2855370 - DNA, 18 bp, Homo sapiens
tctaaatcttccttgtga

SEQ ID NO: 2855371 - DNA, 21 bp, Homo sapiens
tctaacccccagtgccacaga

SEQ ID NO: 2855372 - DNA, 17 bp, Homo sapiens
tctaagctgcagcttcc

SEQ ID NO: 2855373 - DNA, 23 bp, Homo sapiens
tctaaggaaatggagaagctctg

SEQ ID NO: 2855374 - DNA, 16 bp, Homo sapiens
tctaagttctattgaa

SEQ ID NO: 2855375 - DNA, 14 bp, Homo sapiens
tctaatacctctgt

SEQ ID NO: 2855376 - DNA, 20 bp, Homo sapiens
tctaatcaggttgttaatgt

SEQ ID NO: 2855377 - DNA, 22 bp, Homo sapiens
tctaatgtaagaaaatttgaag

SEQ ID NO: 2855378 - DNA, 14 bp, Homo sapiens
tctaatgtgtgaat

SEQ ID NO: 2855379 - DNA, 18 bp, Homo sapiens
tctaattcccattttgca

SEQ ID NO: 2855380 - DNA, 19 bp, Homo sapiens
tctaatttatacaaaataa

SEQ ID NO: 2855381 - DNA, 21 bp, Homo sapiens
tctaatttatacaaaataatt

SEQ ID NO: 2855382 - DNA, 13 bp, Homo sapiens
tctacaaccagag

SEQ ID NO: 2855383 - DNA, 15 bp, Homo sapiens
tctacaaccagagcc

SEQ ID NO: 2855384 - DNA, 17 bp, Homo sapiens
tctacaaccagagcccc

SEQ ID NO: 2855385 - DNA, 23 bp, Homo sapiens
tctacaaccagagccccccacaa

SEQ ID NO: 2855386 - DNA, 11 bp, Homo sapiens
tctacacagcc

SEQ ID NO: 2855387 - DNA, 19 bp, Homo sapiens
tctacacatatatgtatat

SEQ ID NO: 2855388 - DNA, 15 bp, Homo sapiens
tctacagaacaaaga

SEQ ID NO: 2855389 - DNA, 16 bp, Homo sapiens
tctacagacttctcca

SEQ ID NO: 2855390 - DNA, 17 bp, Homo sapiens
tctacagacttctccag

SEQ ID NO: 2855391 - DNA, 18 bp, Homo sapiens
tctacagacttctccaga

SEQ ID NO: 2855392 - DNA, 16 bp, Homo sapiens
tctacagaggccatgg

SEQ ID NO: 2855393 - DNA, 18 bp, Homo sapiens
tctaccatttcagagagg

SEQ ID NO: 2855394 - DNA, 23 bp, Homo sapiens
tctacccagagccttctcctgcc

SEQ ID NO: 2855395 - DNA, 20 bp, Homo sapiens
tctacccagcgagccctggt

SEQ ID NO: 2855396 - DNA, 16 bp, Homo sapiens
tctacccggcccagag

SEQ ID NO: 2855397 - DNA, 12 bp, Homo sapiens
tctaccctggga

SEQ ID NO: 2855398 - DNA, 23 bp, Homo sapiens
tctaccgacctgtctccctgggg

SEQ ID NO: 2855399 - DNA, 21 bp, Homo sapiens
tctacctggtctctccttgtt

SEQ ID NO: 2855400 - DNA, 15 bp, Homo sapiens
tctacgctctccttt

SEQ ID NO: 2855401 - DNA, 16 bp, Homo sapiens
tctacgctctcctttc

SEQ ID NO: 2855402 - DNA, 17 bp, Homo sapiens
tctacgctctcctttct

SEQ ID NO: 2855403 - DNA, 20 bp, Homo sapiens
tctacgtataaatatgaaat

SEQ ID NO: 2855404 - DNA, 18 bp, Homo sapiens
tctactcatatatatcta

SEQ ID NO: 2855405 - DNA, 17 bp, Homo sapiens
tctactcctacctcagc

SEQ ID NO: 2855406 - DNA, 19 bp, Homo sapiens
tctactgggaaggctactt

SEQ ID NO: 2855407 - DNA, 16 bp, Homo sapiens
tctagaacacaggcaa

SEQ ID NO: 2855408 - DNA, 17 bp, Homo sapiens
tctagaacatgcacatt

SEQ ID NO: 2855409 - DNA, 20 bp, Homo sapiens
tctagaatgtgttttctgaa

SEQ ID NO: 2855410 - DNA, 13 bp, Homo sapiens
tctagagaagagg

SEQ ID NO: 2855411 - DNA, 20 bp, Homo sapiens
tctagagatagtacataaag

SEQ ID NO: 2855412 - DNA, 13 bp, Homo sapiens
tctaggctgcccc

SEQ ID NO: 2855413 - DNA, 18 bp, Homo sapiens
tctagttagcaggaaata

SEQ ID NO: 2855414 - DNA, 18 bp, Homo sapiens
tctagttagctgctttaa

SEQ ID NO: 2855415 - DNA, 19 bp, Homo sapiens
tctagttgaaaataaagtg

SEQ ID NO: 2855416 - DNA, 17 bp, Homo sapiens
tctatagccaaaaatag

SEQ ID NO: 2855417 - DNA, 15 bp, Homo sapiens
tctatagtagtcaat

SEQ ID NO: 2855418 - DNA, 18 bp, Homo sapiens
tctatatatacatgtata

SEQ ID NO: 2855419 - DNA, 21 bp, Homo sapiens
tctatatatacatgtatagtg

SEQ ID NO: 2855420 - DNA, 22 bp, Homo sapiens
tctatatatacatgtatagtga

SEQ ID NO: 2855421 - DNA, 20 bp, Homo sapiens
tctatctgcctttacctaca

SEQ ID NO: 2855422 - DNA, 13 bp, Homo sapiens
tctatgcaatttt

SEQ ID NO: 2855423 - DNA, 14 bp, Homo sapiens
tctatgcaattttt

SEQ ID NO: 2855424 - DNA, 14 bp, Homo sapiens
tctatggcagtcca

SEQ ID NO: 2855425 - DNA, 12 bp, Homo sapiens
tctatgggactc

SEQ ID NO: 2855426 - DNA, 15 bp, Homo sapiens
tctgtcttgccagcc

SEQ ID NO: 2855427 - DNA, 21 bp, Homo sapiens
tctgtcttgccagccagaagc

SEQ ID NO: 2855428 - DNA, 18 bp, Homo sapiens
tctgtgactcgcttagct

SEQ ID NO: 2855429 - DNA, 18 bp, Homo sapiens
tctgtgaggtgctgatga

SEQ ID NO: 2855430 - DNA, 22 bp, Homo sapiens
tctgtgctttgactcacctgtt

SEQ ID NO: 2855431 - DNA, 21 bp, Homo sapiens
tctgtggagagtgagaataat

SEQ ID NO: 2855432 - DNA, 23 bp, Homo sapiens
tctgtgtgtgtccccctatgctc

SEQ ID NO: 2855433 - DNA, 19 bp, Homo sapiens
tctgttcacttttcctccc

SEQ ID NO: 2855434 - DNA, 18 bp, Homo sapiens
tctgttcatttcctcaaa

SEQ ID NO: 2855435 - DNA, 12 bp, Homo sapiens
tctgttggccag

SEQ ID NO: 2855436 - DNA, 18 bp, Homo sapiens
tctgttggccagtgtgac

SEQ ID NO: 2855437 - DNA, 20 bp, Homo sapiens
tctgttggccagtgtgacaa

SEQ ID NO: 2855438 - DNA, 18 bp, Homo sapiens
tctgtttataaaaacaaa

SEQ ID NO: 2855439 - DNA, 22 bp, Homo sapiens
tctgtttctattctctcctcag

SEQ ID NO: 2855440 - DNA, 15 bp, Homo sapiens
tcttaaaataactta

SEQ ID NO: 2855441 - DNA, 19 bp, Homo sapiens
tcttaaaatatatttcaga

SEQ ID NO: 2855442 - DNA, 13 bp, Homo sapiens
tcttaaaatgttt

SEQ ID NO: 2855443 - DNA, 23 bp, Homo sapiens
tcttaaagctgcctgtagttagg

SEQ ID NO: 2855444 - DNA, 19 bp, Homo sapiens
tcttaaataagaaactttt

SEQ ID NO: 2855445 - DNA, 14 bp, Homo sapiens
tcttacaaacatgt

SEQ ID NO: 2855446 - DNA, 18 bp, Homo sapiens
tcttacccatatatctta

SEQ ID NO: 2855447 - DNA, 24 bp, Homo sapiens
tcttactaaacattttgttattgg

SEQ ID NO: 2855448 - DNA, 19 bp, Homo sapiens
tcttagaagtggaccagga

SEQ ID NO: 2855449 - DNA, 17 bp, Homo sapiens
tcttaggggagagcttt

SEQ ID NO: 2855450 - DNA, 19 bp, Homo sapiens
tcttaggggagagctttct

SEQ ID NO: 2855451 - DNA, 19 bp, Homo sapiens
tcttatagaatatttatta

SEQ ID NO: 2855452 - DNA, 20 bp, Homo sapiens
tcttatgaaatgggctttaa

SEQ ID NO: 2855453 - DNA, 14 bp, Homo sapiens
tcttatgcaatttc

SEQ ID NO: 2855454 - DNA, 17 bp, Homo sapiens
tcttattcagtaaaaaa

SEQ ID NO: 2855455 - DNA, 18 bp, Homo sapiens
tcttattcagtaaaaaac

SEQ ID NO: 2855456 - DNA, 16 bp, Homo sapiens
tcttatttatatatga

SEQ ID NO: 2855457 - DNA, 13 bp, Homo sapiens
tcttatttgcaat

SEQ ID NO: 2855458 - DNA, 23 bp, Homo sapiens
tcttatttgtttggtcactgcta

SEQ ID NO: 2855459 - DNA, 19 bp, Homo sapiens
tcttcaactgaccagcctc

SEQ ID NO: 2855460 - DNA, 16 bp, Homo sapiens
tcttcagccacctctc

SEQ ID NO: 2855461 - DNA, 21 bp, Homo sapiens
tcttcagcctagccgacctca

SEQ ID NO: 2855462 - DNA, 15 bp, Homo sapiens
tcttcagcgagaccc

SEQ ID NO: 2855463 - DNA, 14 bp, Homo sapiens
tcttcaggttctta

SEQ ID NO: 2855464 - DNA, 13 bp, Homo sapiens
tcttccaaagctc

SEQ ID NO: 2855465 - DNA, 15 bp, Homo sapiens
tcttccaaaggcata

SEQ ID NO: 2855466 - DNA, 18 bp, Homo sapiens
tcttccaagcaaaggtga

SEQ ID NO: 2855467 - DNA, 22 bp, Homo sapiens
tcttccagtttgctttgccctt

SEQ ID NO: 2855468 - DNA, 16 bp, Homo sapiens
tcttccataatgtata

SEQ ID NO: 2855469 - DNA, 17 bp, Homo sapiens
tcttcccatcactggag

SEQ ID NO: 2855470 - DNA, 15 bp, Homo sapiens
tcttcccatttgtaa

SEQ ID NO: 2855471 - DNA, 16 bp, Homo sapiens
tcttccccttgccctt

SEQ ID NO: 2855472 - DNA, 13 bp, Homo sapiens
tcttcccctttcc

SEQ ID NO: 2855473 - DNA, 14 bp, Homo sapiens
tcttcccctttcct

SEQ ID NO: 2855474 - DNA, 19 bp, Homo sapiens
tcttcctagttttctcctc

SEQ ID NO: 2855475 - DNA, 11 bp, Homo sapiens
tcttcctctgc

SEQ ID NO: 2855476 - DNA, 12 bp, Homo sapiens
tcttcctctgct

SEQ ID NO: 2855477 - DNA, 22 bp, Homo sapiens
tcttcctgtaacacaagccaca

SEQ ID NO: 2855478 - DNA, 12 bp, Homo sapiens
tcttccttcccc

SEQ ID NO: 2855479 - DNA, 14 bp, Homo sapiens
tcttccttccccca

SEQ ID NO: 2855480 - DNA, 15 bp, Homo sapiens
tcttccttcccccat

SEQ ID NO: 2855481 - DNA, 15 bp, Homo sapiens
tcttccttgtgagga

SEQ ID NO: 2855482 - DNA, 18 bp, Homo sapiens
tcttctaaaatgctttta

SEQ ID NO: 2855483 - DNA, 22 bp, Homo sapiens
tcttctaaaattgaagagattt

SEQ ID NO: 2855484 - DNA, 18 bp, Homo sapiens
tcttctacaaccagagcc

SEQ ID NO: 2855485 - DNA, 19 bp, Homo sapiens
tcttctacaaccagagccc

SEQ ID NO: 2855486 - DNA, 20 bp, Homo sapiens
tcttctacaaccagagcccc

SEQ ID NO: 2855487 - DNA, 16 bp, Homo sapiens
tcttctactttcatct

SEQ ID NO: 2855488 - DNA, 14 bp, Homo sapiens
tcttctatttaaaa

SEQ ID NO: 2855489 - DNA, 15 bp, Homo sapiens
tcttctatttaaaaa

SEQ ID NO: 2855490 - DNA, 18 bp, Homo sapiens
tcttctatttaaaaaata

SEQ ID NO: 2855491 - DNA, 13 bp, Homo sapiens
tcttctattttgt

SEQ ID NO: 2855492 - DNA, 13 bp, Homo sapiens
tcttctccaggct

SEQ ID NO: 2855493 - DNA, 13 bp, Homo sapiens
tcttctgaaatga

SEQ ID NO: 2855494 - DNA, 19 bp, Homo sapiens
tcttctgcttcagcctccc

SEQ ID NO: 2855495 - DNA, 22 bp, Homo sapiens
tcttctgcttcagcctcccgag

SEQ ID NO: 2855496 - DNA, 17 bp, Homo sapiens
tcttctggagtctccag

SEQ ID NO: 2855497 - DNA, 19 bp, Homo sapiens
tcttctggagtctccagtg

SEQ ID NO: 2855498 - DNA, 15 bp, Homo sapiens
tcttctgtacgtctg

SEQ ID NO: 2855499 - DNA, 19 bp, Homo sapiens
tcttctgtatactgtggag

SEQ ID NO: 2855500 - DNA, 15 bp, Homo sapiens
tcttctgtcatcccg

SEQ ID NO: 2855501 - DNA, 22 bp, Homo sapiens
tcttctgtcatcccgctcctgc

SEQ ID NO: 2855502 - DNA, 14 bp, Homo sapiens
tcttctgttctcaa

SEQ ID NO: 2855503 - DNA, 15 bp, Homo sapiens
tcttcttcttcagaa

SEQ ID NO: 2855504 - DNA, 22 bp, Homo sapiens
tcttcttttaaaccattttctt

SEQ ID NO: 2855505 - DNA, 17 bp, Homo sapiens
tcttgaactcctggcct

SEQ ID NO: 2855506 - DNA, 13 bp, Homo sapiens
tcttgaagaatat

SEQ ID NO: 2855507 - DNA, 14 bp, Homo sapiens
tcttgaagaatatt

SEQ ID NO: 2855508 - DNA, 16 bp, Homo sapiens
tcttgaggccaggagt

SEQ ID NO: 2855509 - DNA, 18 bp, Homo sapiens
tcttgagtactagaattt

SEQ ID NO: 2855510 - DNA, 13 bp, Homo sapiens
tcttgcaatggca

SEQ ID NO: 2855511 - DNA, 16 bp, Homo sapiens
tcttgcaatggcagcc

SEQ ID NO: 2855512 - DNA, 18 bp, Homo sapiens
tcttgcctgaatccatca

SEQ ID NO: 2855513 - DNA, 15 bp, Homo sapiens
tcttgcttgtacata

SEQ ID NO: 2855514 - DNA, 21 bp, Homo sapiens
tcttggacctctgctctgagg

SEQ ID NO: 2855515 - DNA, 18 bp, Homo sapiens
tcttggcccctgtgtgag

SEQ ID NO: 2855516 - DNA, 14 bp, Homo sapiens
tcttgtacatgtgt

SEQ ID NO: 2855517 - DNA, 18 bp, Homo sapiens
tgagaaacccaccagcct

SEQ ID NO: 2855518 - DNA, 23 bp, Homo sapiens
tgagaaaccttattgtacctctc

SEQ ID NO: 2855519 - DNA, 12 bp, Homo sapiens
tgagaaatgtga

SEQ ID NO: 2855520 - DNA, 14 bp, Homo sapiens
tgagaaatgtgaac

SEQ ID NO: 2855521 - DNA, 17 bp, Homo sapiens
tgagaaatttaaactat

SEQ ID NO: 2855522 - DNA, 18 bp, Homo sapiens
tgagaaatttaaactata

SEQ ID NO: 2855523 - DNA, 14 bp, Homo sapiens
tgagaacctggcct

SEQ ID NO: 2855524 - DNA, 18 bp, Homo sapiens
tgagaagtgtatatagtt

SEQ ID NO: 2855525 - DNA, 16 bp, Homo sapiens
tgagaagttaagcagc

SEQ ID NO: 2855526 - DNA, 12 bp, Homo sapiens
tgagaataattg

SEQ ID NO: 2855527 - DNA, 18 bp, Homo sapiens
tgagaatctatatttaac

SEQ ID NO: 2855528 - DNA, 15 bp, Homo sapiens
tgagaattccaagga

SEQ ID NO: 2855529 - DNA, 13 bp, Homo sapiens
tgagaattttaaa

SEQ ID NO: 2855530 - DNA, 21 bp, Homo sapiens
tgagacagagttttcactctt

SEQ ID NO: 2855531 - DNA, 15 bp, Homo sapiens
tgagacaggagaatc

SEQ ID NO: 2855532 - DNA, 13 bp, Homo sapiens
tgagaccacagag

SEQ ID NO: 2855533 - DNA, 15 bp, Homo sapiens
tgagaccacctctca

SEQ ID NO: 2855534 - DNA, 14 bp, Homo sapiens
tgagaccactgtta

SEQ ID NO: 2855535 - DNA, 19 bp, Homo sapiens
tgagaccagcctggccaac

SEQ ID NO: 2855536 - DNA, 12 bp, Homo sapiens
tgagaccagttg

SEQ ID NO: 2855537 - DNA, 21 bp, Homo sapiens
tgagacccattcctatttctt

SEQ ID NO: 2855538 - DNA, 19 bp, Homo sapiens
tgagacctcagccatgagg

SEQ ID NO: 2855539 - DNA, 23 bp, Homo sapiens
tgagactgcgggatggtcctggg

SEQ ID NO: 2855540 - DNA, 12 bp, Homo sapiens
tgagacttccaa

SEQ ID NO: 2855541 - DNA, 19 bp, Homo sapiens
tgagagacattaactcatt

SEQ ID NO: 2855542 - DNA, 21 bp, Homo sapiens
tgagagacccaaggaggaaaa

SEQ ID NO: 2855543 - DNA, 23 bp, Homo sapiens
tgagagagtgctgagaaggacac

SEQ ID NO: 2855544 - DNA, 16 bp, Homo sapiens
tgagagctgctctgga

SEQ ID NO: 2855545 - DNA, 12 bp, Homo sapiens
tgagaggccctg

SEQ ID NO: 2855546 - DNA, 23 bp, Homo sapiens
tgagaggccctggatcagcgtgg

SEQ ID NO: 2855547 - DNA, 14 bp, Homo sapiens
tgagaggggaacag

SEQ ID NO: 2855548 - DNA, 18 bp, Homo sapiens
tgagaggggaacagactg

SEQ ID NO: 2855549 - DNA, 19 bp, Homo sapiens
tgagagtatattatgtatt

SEQ ID NO: 2855550 - DNA, 14 bp, Homo sapiens
tgagagtgtgacca

SEQ ID NO: 2855551 - DNA, 14 bp, Homo sapiens
tgagagttccagat

SEQ ID NO: 2855552 - DNA, 14 bp, Homo sapiens
tgagatatacaaat

SEQ ID NO: 2855553 - DNA, 16 bp, Homo sapiens
tgagatctaagccttt

SEQ ID NO: 2855554 - DNA, 15 bp, Homo sapiens
tgagatgtgatgctg

SEQ ID NO: 2855555 - DNA, 19 bp, Homo sapiens
tgagcaagatcttgtctcc

SEQ ID NO: 2855556 - DNA, 12 bp, Homo sapiens
tgagcaattcat

SEQ ID NO: 2855557 - DNA, 17 bp, Homo sapiens
tgagcactgccaggagg

SEQ ID NO: 2855558 - DNA, 14 bp, Homo sapiens
tgagcagggccggg

SEQ ID NO: 2855559 - DNA, 16 bp, Homo sapiens
tgagcagggccgggga

SEQ ID NO: 2855560 - DNA, 15 bp, Homo sapiens
tgagcagggctcagc

SEQ ID NO: 2855561 - DNA, 16 bp, Homo sapiens
tgagcagggctcagcg

SEQ ID NO: 2855562 - DNA, 23 bp, Homo sapiens
tgagcagggctcagcggggacag

SEQ ID NO: 2855563 - DNA, 12 bp, Homo sapiens
tgagcatctctg

SEQ ID NO: 2855564 - DNA, 16 bp, Homo sapiens
tgagcatctctgtgta

SEQ ID NO: 2855565 - DNA, 15 bp, Homo sapiens
tgagccaaagagaaa

SEQ ID NO: 2855566 - DNA, 21 bp, Homo sapiens
tgagccactgcaccgggccac

SEQ ID NO: 2855567 - DNA, 12 bp, Homo sapiens
tgagcccaggga

SEQ ID NO: 2855568 - DNA, 23 bp, Homo sapiens
tgagccgagatcacgccactgca

SEQ ID NO: 2855569 - DNA, 17 bp, Homo sapiens
tgagcctcagcatcctg

SEQ ID NO: 2855570 - DNA, 21 bp, Homo sapiens
tgagcctcagcatcctggcac

SEQ ID NO: 2855571 - DNA, 20 bp, Homo sapiens
tgagcctccatttctggctt

SEQ ID NO: 2855572 - DNA, 13 bp, Homo sapiens
tgagcctgccgag

SEQ ID NO: 2855573 - DNA, 19 bp, Homo sapiens
tgagcctgtaatcctcagc

SEQ ID NO: 2855574 - DNA, 13 bp, Homo sapiens
tgagccttcagtc

SEQ ID NO: 2855575 - DNA, 14 bp, Homo sapiens
tgagccttcagtct

SEQ ID NO: 2855576 - DNA, 19 bp, Homo sapiens
tgagcgcagagtaaaataa

SEQ ID NO: 2855577 - DNA, 13 bp, Homo sapiens
tgagctaggcatg

SEQ ID NO: 2855578 - DNA, 18 bp, Homo sapiens
tgagctcacaaggcagca

SEQ ID NO: 2855579 - DNA, 19 bp, Homo sapiens
tgagctcacaaggcagcaa

SEQ ID NO: 2855580 - DNA, 18 bp, Homo sapiens
tgagctcagacccccact

SEQ ID NO: 2855581 - DNA, 15 bp, Homo sapiens
tgagctctgagaggc

SEQ ID NO: 2855582 - DNA, 19 bp, Homo sapiens
tgagctctgagaggccctg

SEQ ID NO: 2855583 - DNA, 21 bp, Homo sapiens
tgagctgggcaccacaggctg

SEQ ID NO: 2855584 - DNA, 16 bp, Homo sapiens
tgagcttctctgtgaa

SEQ ID NO: 2855585 - DNA, 12 bp, Homo sapiens
tgaggacacatg

SEQ ID NO: 2855586 - DNA, 21 bp, Homo sapiens
tgaggacactaaccacgctgg

SEQ ID NO: 2855587 - DNA, 16 bp, Homo sapiens
tgaggagtctgaggtc

SEQ ID NO: 2855588 - DNA, 16 bp, Homo sapiens
tgaggagtgtgagaat

SEQ ID NO: 2855589 - DNA, 13 bp, Homo sapiens
tgaggattcctga

SEQ ID NO: 2855590 - DNA, 16 bp, Homo sapiens
tgaggatttcaagcct

SEQ ID NO: 2855591 - DNA, 21 bp, Homo sapiens
tgaggcaaaggccagcagcag

SEQ ID NO: 2855592 - DNA, 13 bp, Homo sapiens
tgaggcagaagaa

SEQ ID NO: 2855593 - DNA, 17 bp, Homo sapiens
tgaggcagacagcagct

SEQ ID NO: 2855594 - DNA, 20 bp, Homo sapiens
tgaggcagacagcagctcag

SEQ ID NO: 2855595 - DNA, 22 bp, Homo sapiens
tgaggccaaacgttttgaacta

SEQ ID NO: 2855596 - DNA, 14 bp, Homo sapiens
tgaggccagcctgg

SEQ ID NO: 2855597 - DNA, 18 bp, Homo sapiens
tgaggccagcctggcctc

SEQ ID NO: 2855598 - DNA, 19 bp, Homo sapiens
tgaggcctaaaagtaaaca

SEQ ID NO: 2855599 - DNA, 15 bp, Homo sapiens
tgaggcctcttggac

SEQ ID NO: 2855600 - DNA, 23 bp, Homo sapiens
tgaggcctcttggacctctgctc

SEQ ID NO: 2855601 - DNA, 21 bp, Homo sapiens
tgaggcctgccctcagggatc

SEQ ID NO: 2855602 - DNA, 17 bp, Homo sapiens
tgaggcctggccaggca

SEQ ID NO: 2855603 - DNA, 17 bp, Homo sapiens
tgaggcctttccccagt

SEQ ID NO: 2855604 - DNA, 23 bp, Homo sapiens
tgaggcctttccccagtgtggcc

SEQ ID NO: 2855605 - DNA, 23 bp, Homo sapiens
tgaggcgggtggatcacctgagg

SEQ ID NO: 2855606 - DNA, 13 bp, Homo sapiens
tgaggctgagact

SEQ ID NO: 2855607 - DNA, 18 bp, Homo sapiens
tgaggctgagactgcggg

SEQ ID NO: 2855608 - DNA, 15 bp, Homo sapiens
tgccaaaatattgct

SEQ ID NO: 2855609 - DNA, 22 bp, Homo sapiens
tgccaaagcaaaagaagtaaaa

SEQ ID NO: 2855610 - DNA, 18 bp, Homo sapiens
tgccaaattgtagttctt

SEQ ID NO: 2855611 - DNA, 23 bp, Homo sapiens
tgccaaattttggccaaagtgtt

SEQ ID NO: 2855612 - DNA, 22 bp, Homo sapiens
tgccaacatacccttctttaaa

SEQ ID NO: 2855613 - DNA, 17 bp, Homo sapiens
tgccaagaaaaggcatg

SEQ ID NO: 2855614 - DNA, 13 bp, Homo sapiens
tgccaagtccagg

SEQ ID NO: 2855615 - DNA, 21 bp, Homo sapiens
tgccaatgaggtctgaaatgg

SEQ ID NO: 2855616 - DNA, 18 bp, Homo sapiens
tgccacaccctccccatt

SEQ ID NO: 2855617 - DNA, 17 bp, Homo sapiens
tgccacactcagtcccc

SEQ ID NO: 2855618 - DNA, 11 bp, Homo sapiens
tgccacagaga

SEQ ID NO: 2855619 - DNA, 21 bp, Homo sapiens
tgccaccaccagatgagaagt

SEQ ID NO: 2855620 - DNA, 20 bp, Homo sapiens
tgccaccctggggagaaagt

SEQ ID NO: 2855621 - DNA, 18 bp, Homo sapiens
tgccacctcccctatcca

SEQ ID NO: 2855622 - DNA, 22 bp, Homo sapiens
tgccacctcccctatccaccca

SEQ ID NO: 2855623 - DNA, 11 bp, Homo sapiens
tgccacctgtc

SEQ ID NO: 2855624 - DNA, 23 bp, Homo sapiens
tgccacctgttaaaatgtacact

SEQ ID NO: 2855625 - DNA, 13 bp, Homo sapiens
tgccactgcctct

SEQ ID NO: 2855626 - DNA, 20 bp, Homo sapiens
tgccactgcctcttcctccc

SEQ ID NO: 2855627 - DNA, 20 bp, Homo sapiens
tgccagaacagtttgtacag

SEQ ID NO: 2855628 - DNA, 12 bp, Homo sapiens
tgccagacatgt

SEQ ID NO: 2855629 - DNA, 13 bp, Homo sapiens
tgccagagcctgg

SEQ ID NO: 2855630 - DNA, 14 bp, Homo sapiens
tgccagagcctggg

SEQ ID NO: 2855631 - DNA, 20 bp, Homo sapiens
tgccagagcctggggctcta

SEQ ID NO: 2855632 - DNA, 21 bp, Homo sapiens
tgccagatgcctttatggctg

SEQ ID NO: 2855633 - DNA, 11 bp, Homo sapiens
tgccagccaca

SEQ ID NO: 2855634 - DNA, 11 bp, Homo sapiens
tgccagccagc

SEQ ID NO: 2855635 - DNA, 23 bp, Homo sapiens
tgccagccagcagccagctctca

SEQ ID NO: 2855636 - DNA, 20 bp, Homo sapiens
tgccagccgtgatgctcagg

SEQ ID NO: 2855637 - DNA, 15 bp, Homo sapiens
tgccagcctggcttc

SEQ ID NO: 2855638 - DNA, 23 bp, Homo sapiens
tgccagcctggcttctggagccc

SEQ ID NO: 2855639 - DNA, 16 bp, Homo sapiens
tgccaggactccccag

SEQ ID NO: 2855640 - DNA, 23 bp, Homo sapiens
tgccaggactccccaggccaggc

SEQ ID NO: 2855641 - DNA, 22 bp, Homo sapiens
tgccaggagggacaaaggagcc

SEQ ID NO: 2855642 - DNA, 23 bp, Homo sapiens
tgccaggagggacaaaggagcct

SEQ ID NO: 2855643 - DNA, 24 bp, Homo sapiens
tgccaggagggacaaaggagcctg

SEQ ID NO: 2855644 - DNA, 18 bp, Homo sapiens
tgccagggcccctgttcc

SEQ ID NO: 2855645 - DNA, 18 bp, Homo sapiens
tgccaggtttttggtctg

SEQ ID NO: 2855646 - DNA, 24 bp, Homo sapiens
tgccaggtttttggtctgacccac

SEQ ID NO: 2855647 - DNA, 17 bp, Homo sapiens
tgccagtccccctgccc

SEQ ID NO: 2855648 - DNA, 20 bp, Homo sapiens
tgccagtgtttagaagagcc

SEQ ID NO: 2855649 - DNA, 21 bp, Homo sapiens
tgccagtgtttagaagagcct

SEQ ID NO: 2855650 - DNA, 23 bp, Homo sapiens
tgccagtgtttagaagagcctga

SEQ ID NO: 2855651 - DNA, 17 bp, Homo sapiens
tgccatattctgttggc

SEQ ID NO: 2855652 - DNA, 20 bp, Homo sapiens
tgccatattctgttggccag

SEQ ID NO: 2855653 - DNA, 15 bp, Homo sapiens
tgccatccaggttca

SEQ ID NO: 2855654 - DNA, 20 bp, Homo sapiens
tgccatccaggttcagcttg

SEQ ID NO: 2855655 - DNA, 23 bp, Homo sapiens
tgccatggacagaagaaggcagc

SEQ ID NO: 2855656 - DNA, 17 bp, Homo sapiens
tgccatggcgtgtccct

SEQ ID NO: 2855657 - DNA, 17 bp, Homo sapiens
tgccatgtcaaacaaat

SEQ ID NO: 2855658 - DNA, 19 bp, Homo sapiens
tgccattttaataaaatga

SEQ ID NO: 2855659 - DNA, 24 bp, Homo sapiens
tgcccaacctgctctcctcttgcc

SEQ ID NO: 2855660 - DNA, 14 bp, Homo sapiens
tgcccacaggatca

SEQ ID NO: 2855661 - DNA, 12 bp, Homo sapiens
tgcccacaggga

SEQ ID NO: 2855662 - DNA, 23 bp, Homo sapiens
tgcccacatcccaggcttcaccc

SEQ ID NO: 2855663 - DNA, 23 bp, Homo sapiens
tgcccagaattcccagctgtctg

SEQ ID NO: 2855664 - DNA, 19 bp, Homo sapiens
tgcccagagatgcctccac

SEQ ID NO: 2855665 - DNA, 20 bp, Homo sapiens
tgcccagagatgcctccacc

SEQ ID NO: 2855666 - DNA, 23 bp, Homo sapiens
tgcccagagggcccaggcaggcc

SEQ ID NO: 2855667 - DNA, 11 bp, Homo sapiens
tgcccaggaga

SEQ ID NO: 2855668 - DNA, 20 bp, Homo sapiens
tgcccaggagagccagccct

SEQ ID NO: 2855669 - DNA, 21 bp, Homo sapiens
tgcccaggagagccagccctc

SEQ ID NO: 2855670 - DNA, 14 bp, Homo sapiens
tgcccaggcaggtc

SEQ ID NO: 2855671 - DNA, 17 bp, Homo sapiens
tgcccaggcccctgcca

SEQ ID NO: 2855672 - DNA, 20 bp, Homo sapiens
tgcccaggcccctgccaccc

SEQ ID NO: 2855673 - DNA, 15 bp, Homo sapiens
tgcccaggcctgcct

SEQ ID NO: 2855674 - DNA, 17 bp, Homo sapiens
tgcccaggcctgcctgt

SEQ ID NO: 2855675 - DNA, 19 bp, Homo sapiens
tgcccaggctggcgtgcag

SEQ ID NO: 2855676 - DNA, 20 bp, Homo sapiens
tgcccaggctggtcttgaac

SEQ ID NO: 2855677 - DNA, 16 bp, Homo sapiens
tgcccagggctcagcc

SEQ ID NO: 2855678 - DNA, 18 bp, Homo sapiens
tgcccagggctcagcctg

SEQ ID NO: 2855679 - DNA, 19 bp, Homo sapiens
tgcccagggctcagcctgg

SEQ ID NO: 2855680 - DNA, 23 bp, Homo sapiens
tgcccagggctcagcctggtggg

SEQ ID NO: 2855681 - DNA, 16 bp, Homo sapiens
tgcccatgggagctgg

SEQ ID NO: 2855682 - DNA, 16 bp, Homo sapiens
tgccccaactcctgga

SEQ ID NO: 2855683 - DNA, 16 bp, Homo sapiens
tgccccaactccttcc

SEQ ID NO: 2855684 - DNA, 14 bp, Homo sapiens
tgccccaccagcca

SEQ ID NO: 2855685 - DNA, 17 bp, Homo sapiens
tgccccaccagccacct

SEQ ID NO: 2855686 - DNA, 14 bp, Homo sapiens
tgccccagctctgg

SEQ ID NO: 2855687 - DNA, 15 bp, Homo sapiens
tgccccagggctccc

SEQ ID NO: 2855688 - DNA, 15 bp, Homo sapiens
tgcccccagcactcc

SEQ ID NO: 2855689 - DNA, 17 bp, Homo sapiens
tgcccccagcactcctc

SEQ ID NO: 2855690 - DNA, 18 bp, Homo sapiens
tgcccccgtcttctctcc

SEQ ID NO: 2855691 - DNA, 17 bp, Homo sapiens
tgccccgggtccccagc

SEQ ID NO: 2855692 - DNA, 17 bp, Homo sapiens
tgcccctcttcccggga

SEQ ID NO: 2855693 - DNA, 19 bp, Homo sapiens
tgccccttcccatctcttc

SEQ ID NO: 2855694 - DNA, 17 bp, Homo sapiens
tgcccggattctgggag

SEQ ID NO: 2855695 - DNA, 18 bp, Homo sapiens
tgcccggattctgggagg

SEQ ID NO: 2855696 - DNA, 17 bp, Homo sapiens
tgccctgacctcccagc

SEQ ID NO: 2855697 - DNA, 20 bp, Homo sapiens
tgccctgacctcccagccct

SEQ ID NO: 2855698 - DNA, 11 bp, Homo sapiens
tgctgctgaga

SEQ ID NO: 2855699 - DNA, 13 bp, Homo sapiens
tgctgctgagaac

SEQ ID NO: 2855700 - DNA, 15 bp, Homo sapiens
tgctgctgagaacct

SEQ ID NO: 2855701 - DNA, 16 bp, Homo sapiens
tgctgctgagaacctg

SEQ ID NO: 2855702 - DNA, 21 bp, Homo sapiens
tgctgctgagaacctggcctt

SEQ ID NO: 2855703 - DNA, 14 bp, Homo sapiens
tgctgctgtgtttt

SEQ ID NO: 2855704 - DNA, 15 bp, Homo sapiens
tgctggataaaatga

SEQ ID NO: 2855705 - DNA, 18 bp, Homo sapiens
tgctggctgttggctggg

SEQ ID NO: 2855706 - DNA, 14 bp, Homo sapiens
tgctgggctctcca

SEQ ID NO: 2855707 - DNA, 16 bp, Homo sapiens
tgctgggctctccacc

SEQ ID NO: 2855708 - DNA, 23 bp, Homo sapiens
tgctgggctctccacctcagcct

SEQ ID NO: 2855709 - DNA, 18 bp, Homo sapiens
tgctggtaccactggaat

SEQ ID NO: 2855710 - DNA, 15 bp, Homo sapiens
tgctggttttcctaa

SEQ ID NO: 2855711 - DNA, 20 bp, Homo sapiens
tgctgtaaataaatgcttta

SEQ ID NO: 2855712 - DNA, 23 bp, Homo sapiens
tgctgtggccagggtgagagctg

SEQ ID NO: 2855713 - DNA, 16 bp, Homo sapiens
tgctgtggcctgggca

SEQ ID NO: 2855714 - DNA, 19 bp, Homo sapiens
tgctgtgtagctctgtcca

SEQ ID NO: 2855715 - DNA, 15 bp, Homo sapiens
tgctgttctggagct

SEQ ID NO: 2855716 - DNA, 11 bp, Homo sapiens
tgctgtttcct

SEQ ID NO: 2855717 - DNA, 17 bp, Homo sapiens
tgctgtttgagatgtga

SEQ ID NO: 2855718 - DNA, 15 bp, Homo sapiens
tgcttaaaattttac

SEQ ID NO: 2855719 - DNA, 16 bp, Homo sapiens
tgcttacagtgactgt

SEQ ID NO: 2855720 - DNA, 12 bp, Homo sapiens
tgcttagaaagt

SEQ ID NO: 2855721 - DNA, 15 bp, Homo sapiens
tgcttagaaagttat

SEQ ID NO: 2855722 - DNA, 13 bp, Homo sapiens
tgcttatttatat

SEQ ID NO: 2855723 - DNA, 20 bp, Homo sapiens
tgcttatttatattcagaga

SEQ ID NO: 2855724 - DNA, 15 bp, Homo sapiens
tgcttattttaaaat

SEQ ID NO: 2855725 - DNA, 17 bp, Homo sapiens
tgcttcaaatccatcca

SEQ ID NO: 2855726 - DNA, 12 bp, Homo sapiens
tgcttcacataa

SEQ ID NO: 2855727 - DNA, 14 bp, Homo sapiens
tgcttcagcctgag

SEQ ID NO: 2855728 - DNA, 14 bp, Homo sapiens
tgcttctcagcccc

SEQ ID NO: 2855729 - DNA, 14 bp, Homo sapiens
tgcttctgaactca

SEQ ID NO: 2855730 - DNA, 13 bp, Homo sapiens
tgcttcttgcccc

SEQ ID NO: 2855731 - DNA, 17 bp, Homo sapiens
tgcttgactatcacata

SEQ ID NO: 2855732 - DNA, 14 bp, Homo sapiens
tgcttgagcccagg

SEQ ID NO: 2855733 - DNA, 17 bp, Homo sapiens
tgcttgtccctgcccag

SEQ ID NO: 2855734 - DNA, 15 bp, Homo sapiens
tgcttgttgtcaagt

SEQ ID NO: 2855735 - DNA, 17 bp, Homo sapiens
tgctttaaagtacctgt

SEQ ID NO: 2855736 - DNA, 21 bp, Homo sapiens
tgctttaatatagctatcatt

SEQ ID NO: 2855737 - DNA, 18 bp, Homo sapiens
tgctttacctttattaat

SEQ ID NO: 2855738 - DNA, 15 bp, Homo sapiens
tgctttcaacttaaa

SEQ ID NO: 2855739 - DNA, 17 bp, Homo sapiens
tgctttcaacttaaatc

SEQ ID NO: 2855740 - DNA, 20 bp, Homo sapiens
tgctttcaacttaaatcact

SEQ ID NO: 2855741 - DNA, 19 bp, Homo sapiens
tgctttcccaccagcatgt

SEQ ID NO: 2855742 - DNA, 15 bp, Homo sapiens
tgctttcctccctgg

SEQ ID NO: 2855743 - DNA, 13 bp, Homo sapiens
tgctttgatattt

SEQ ID NO: 2855744 - DNA, 13 bp, Homo sapiens
tgctttgcttttt

SEQ ID NO: 2855745 - DNA, 17 bp, Homo sapiens
tgctttgtgtgattgaa

SEQ ID NO: 2855746 - DNA, 15 bp, Homo sapiens
tgctttgttttctaa

SEQ ID NO: 2855747 - DNA, 20 bp, Homo sapiens
tgcttttgtctatgggactc

SEQ ID NO: 2855748 - DNA, 18 bp, Homo sapiens
tggaaaaatccagaaaga

SEQ ID NO: 2855749 - DNA, 14 bp, Homo sapiens
tggaaaagaataca

SEQ ID NO: 2855750 - DNA, 18 bp, Homo sapiens
tggaaaagaatccctgca

SEQ ID NO: 2855751 - DNA, 22 bp, Homo sapiens
tggaaaagtcacacagacacac

SEQ ID NO: 2855752 - DNA, 13 bp, Homo sapiens
tggaaactggcca

SEQ ID NO: 2855753 - DNA, 20 bp, Homo sapiens
tggaaagactgattgtttta

SEQ ID NO: 2855754 - DNA, 20 bp, Homo sapiens
tggaaagcatcacctcaggc

SEQ ID NO: 2855755 - DNA, 12 bp, Homo sapiens
tggaaagcctct

SEQ ID NO: 2855756 - DNA, 18 bp, Homo sapiens
tggaaagcctctgctgcc

SEQ ID NO: 2855757 - DNA, 13 bp, Homo sapiens
tggaaaggctcag

SEQ ID NO: 2855758 - DNA, 23 bp, Homo sapiens
tggaaaggctcagtctcaggagc

SEQ ID NO: 2855759 - DNA, 19 bp, Homo sapiens
tggaaaggtcattgtggct

SEQ ID NO: 2855760 - DNA, 15 bp, Homo sapiens
tggaaataaatgtat

SEQ ID NO: 2855761 - DNA, 22 bp, Homo sapiens
tggaacacctaccaaaaaataa

SEQ ID NO: 2855762 - DNA, 21 bp, Homo sapiens
tggaacatgtcggagtagaaa

SEQ ID NO: 2855763 - DNA, 20 bp, Homo sapiens
tggaactgaagggggcggcc

SEQ ID NO: 2855764 - DNA, 20 bp, Homo sapiens
tggaactggaatcctttcag

SEQ ID NO: 2855765 - DNA, 14 bp, Homo sapiens
tggaagattttaaa

SEQ ID NO: 2855766 - DNA, 17 bp, Homo sapiens
tggaagcatgtaggaga

SEQ ID NO: 2855767 - DNA, 19 bp, Homo sapiens
tggaagcatgtaggagaat

SEQ ID NO: 2855768 - DNA, 13 bp, Homo sapiens
tggaagccctcct

SEQ ID NO: 2855769 - DNA, 19 bp, Homo sapiens
tggaagccctccttccacg

SEQ ID NO: 2855770 - DNA, 18 bp, Homo sapiens
tggaagctgccctgccca

SEQ ID NO: 2855771 - DNA, 16 bp, Homo sapiens
tggaagctgtgtcctt

SEQ ID NO: 2855772 - DNA, 21 bp, Homo sapiens
tggaaggtttgtatattgtca

SEQ ID NO: 2855773 - DNA, 21 bp, Homo sapiens
tggaagtgttccctgagaaac

SEQ ID NO: 2855774 - DNA, 13 bp, Homo sapiens
tggaagttttcag

SEQ ID NO: 2855775 - DNA, 22 bp, Homo sapiens
tggaatacagtgttattttctt

SEQ ID NO: 2855776 - DNA, 20 bp, Homo sapiens
tggaatactaaaaatcatga

SEQ ID NO: 2855777 - DNA, 14 bp, Homo sapiens
tggaatgaagcatg

SEQ ID NO: 2855778 - DNA, 18 bp, Homo sapiens
tggaatgaattaaataaa

SEQ ID NO: 2855779 - DNA, 19 bp, Homo sapiens
tggaatgactataaacatt

SEQ ID NO: 2855780 - DNA, 23 bp, Homo sapiens
tggaatgtaactatatcatcctt

SEQ ID NO: 2855781 - DNA, 16 bp, Homo sapiens
tggaattgctgctctc

SEQ ID NO: 2855782 - DNA, 13 bp, Homo sapiens
tggaattttctta

SEQ ID NO: 2855783 - DNA, 11 bp, Homo sapiens
tggacaaccca

SEQ ID NO: 2855784 - DNA, 13 bp, Homo sapiens
tggacaacccaga

SEQ ID NO: 2855785 - DNA, 15 bp, Homo sapiens
tggacacagctcttc

SEQ ID NO: 2855786 - DNA, 18 bp, Homo sapiens
tggacacagctcttctcc

SEQ ID NO: 2855787 - DNA, 22 bp, Homo sapiens
tggacacagctcttctccaggc

SEQ ID NO: 2855788 - DNA, 23 bp, Homo sapiens
tggacacagctcttctccaggct

SEQ ID NO: 2855789 - DNA, 23 bp, Homo sapiens
tgggaaatggtatgagctgaggg

SEQ ID NO: 2855790 - DNA, 17 bp, Homo sapiens
tgggaaccatgaagctg

SEQ ID NO: 2855791 - DNA, 19 bp, Homo sapiens
tgggaacccgactgtgaaa

SEQ ID NO: 2855792 - DNA, 13 bp, Homo sapiens
tgggaagacatga

SEQ ID NO: 2855793 - DNA, 23 bp, Homo sapiens
tgggaaggctacttcggggctgg

SEQ ID NO: 2855794 - DNA, 20 bp, Homo sapiens
tgggaatgttacattgtttg

SEQ ID NO: 2855795 - DNA, 16 bp, Homo sapiens
tgggacagcaacctgt

SEQ ID NO: 2855796 - DNA, 21 bp, Homo sapiens
tgggacccatagatcttctga

SEQ ID NO: 2855797 - DNA, 17 bp, Homo sapiens
tgggaccctttccttcc

SEQ ID NO: 2855798 - DNA, 16 bp, Homo sapiens
tgggactacaggcacc

SEQ ID NO: 2855799 - DNA, 16 bp, Homo sapiens
tgggactacaggtgtg

SEQ ID NO: 2855800 - DNA, 22 bp, Homo sapiens
tgggagaagccgcagggacaga

SEQ ID NO: 2855801 - DNA, 16 bp, Homo sapiens
tgggagagccagctct

SEQ ID NO: 2855802 - DNA, 12 bp, Homo sapiens
tgggagcactgg

SEQ ID NO: 2855803 - DNA, 23 bp, Homo sapiens
tgggagcactggagtgcagggag

SEQ ID NO: 2855804 - DNA, 19 bp, Homo sapiens
tgggagcctgaggcatgag

SEQ ID NO: 2855805 - DNA, 21 bp, Homo sapiens
tgggagctgcctgttcagctc

SEQ ID NO: 2855806 - DNA, 22 bp, Homo sapiens
tgggagctgcctgttcagctcc

SEQ ID NO: 2855807 - DNA, 20 bp, Homo sapiens
tgggaggaaaagaaaagagg

SEQ ID NO: 2855808 - DNA, 13 bp, Homo sapiens
tgggaggaagcag

SEQ ID NO: 2855809 - DNA, 22 bp, Homo sapiens
tgggaggcggagagtacagtga

SEQ ID NO: 2855810 - DNA, 14 bp, Homo sapiens
tgggaggctgaagt

SEQ ID NO: 2855811 - DNA, 17 bp, Homo sapiens
tgggaggctgaagtggg

SEQ ID NO: 2855812 - DNA, 15 bp, Homo sapiens
tgggaggctgaggcg

SEQ ID NO: 2855813 - DNA, 22 bp, Homo sapiens
tgggatctgtaaggaactggaa

SEQ ID NO: 2855814 - DNA, 21 bp, Homo sapiens
tgggattcaggaaaaggcctg

SEQ ID NO: 2855815 - DNA, 20 bp, Homo sapiens
tgggattcccaccaaggtct

SEQ ID NO: 2855816 - DNA, 19 bp, Homo sapiens
tgggatttatatctatagt

SEQ ID NO: 2855817 - DNA, 15 bp, Homo sapiens
tgggcacccccagcc

SEQ ID NO: 2855818 - DNA, 23 bp, Homo sapiens
tgggcacccccagcctgggccta

SEQ ID NO: 2855819 - DNA, 18 bp, Homo sapiens
tgggcagaagggagaagg

SEQ ID NO: 2855820 - DNA, 14 bp, Homo sapiens
tgggcagcagctca

SEQ ID NO: 2855821 - DNA, 18 bp, Homo sapiens
tgggcagcatagcaagac

SEQ ID NO: 2855822 - DNA, 14 bp, Homo sapiens
tgggcagggctggg

SEQ ID NO: 2855823 - DNA, 15 bp, Homo sapiens
tgggcagggctggga

SEQ ID NO: 2855824 - DNA, 17 bp, Homo sapiens
tgggcatgctcagccct

SEQ ID NO: 2855825 - DNA, 16 bp, Homo sapiens
tgggccaattaaaata

SEQ ID NO: 2855826 - DNA, 22 bp, Homo sapiens
tgggccaattaaaatatatata

SEQ ID NO: 2855827 - DNA, 18 bp, Homo sapiens
tgggccactctcccctcc

SEQ ID NO: 2855828 - DNA, 18 bp, Homo sapiens
tgggccccaccacctagg

SEQ ID NO: 2855829 - DNA, 19 bp, Homo sapiens
tgggcccgctttgcctgct

SEQ ID NO: 2855830 - DNA, 21 bp, Homo sapiens
tgggccgctgctttgcgctgg

SEQ ID NO: 2855831 - DNA, 19 bp, Homo sapiens
tgggcctatggagagccct

SEQ ID NO: 2855832 - DNA, 16 bp, Homo sapiens
tgggcctcctgtgtgt

SEQ ID NO: 2855833 - DNA, 16 bp, Homo sapiens
tgggcctgctgctgag

SEQ ID NO: 2855834 - DNA, 23 bp, Homo sapiens
tgggcctgctgctgagaacctgg

SEQ ID NO: 2855835 - DNA, 23 bp, Homo sapiens
tgggcgaatctacagaacaaaga

SEQ ID NO: 2855836 - DNA, 19 bp, Homo sapiens
tgggctcctggaaccaatc

SEQ ID NO: 2855837 - DNA, 16 bp, Homo sapiens
tgggctctccacctca

SEQ ID NO: 2855838 - DNA, 18 bp, Homo sapiens
tgggctctccacctcagc

SEQ ID NO: 2855839 - DNA, 19 bp, Homo sapiens
tgggctctgccccagctct

SEQ ID NO: 2855840 - DNA, 16 bp, Homo sapiens
tgggctgagccctggc

SEQ ID NO: 2855841 - DNA, 17 bp, Homo sapiens
tgggctgctacccagaa

SEQ ID NO: 2855842 - DNA, 17 bp, Homo sapiens
tgggcttcagtggcagc

SEQ ID NO: 2855843 - DNA, 24 bp, Homo sapiens
tggggaagactgtggctgctagca

SEQ ID NO: 2855844 - DNA, 21 bp, Homo sapiens
tggggaagcaagacgtcctgg

SEQ ID NO: 2855845 - DNA, 17 bp, Homo sapiens
tggggaccctgtagagt

SEQ ID NO: 2855846 - DNA, 20 bp, Homo sapiens
tggggagacctggttggccg

SEQ ID NO: 2855847 - DNA, 16 bp, Homo sapiens
tggggagttataaaaa

SEQ ID NO: 2855848 - DNA, 17 bp, Homo sapiens
tggggataaaggagaag

SEQ ID NO: 2855849 - DNA, 13 bp, Homo sapiens
tggggcagcttga

SEQ ID NO: 2855850 - DNA, 14 bp, Homo sapiens
tggggcaggagtag

SEQ ID NO: 2855851 - DNA, 19 bp, Homo sapiens
tggggcaggagtagctgag

SEQ ID NO: 2855852 - DNA, 18 bp, Homo sapiens
tggggcctgtactgcctg

SEQ ID NO: 2855853 - DNA, 18 bp, Homo sapiens
tggggcggtgagagggga

SEQ ID NO: 2855854 - DNA, 11 bp, Homo sapiens
tggggctcctt

SEQ ID NO: 2855855 - DNA, 18 bp, Homo sapiens
tggggctctaacgcctga

SEQ ID NO: 2855856 - DNA, 19 bp, Homo sapiens
tggggctctaacgcctgag

SEQ ID NO: 2855857 - DNA, 20 bp, Homo sapiens
tggggctctaacgcctgagc

SEQ ID NO: 2855858 - DNA, 21 bp, Homo sapiens
tggggctctaacgcctgagcc

SEQ ID NO: 2855859 - DNA, 24 bp, Homo sapiens
tggggctctaacgcctgagcccag

SEQ ID NO: 2855860 - DNA, 15 bp, Homo sapiens
tggggctctgtgcag

SEQ ID NO: 2855861 - DNA, 19 bp, Homo sapiens
tggggctgctcctccaggg

SEQ ID NO: 2855862 - DNA, 15 bp, Homo sapiens
tggggcttctcctga

SEQ ID NO: 2855863 - DNA, 13 bp, Homo sapiens
tgggggcagaggg

SEQ ID NO: 2855864 - DNA, 15 bp, Homo sapiens
tgggggcctggctgg

SEQ ID NO: 2855865 - DNA, 19 bp, Homo sapiens
tgggggcgggggagccaac

SEQ ID NO: 2855866 - DNA, 19 bp, Homo sapiens
tgggggttctttcttcctc

SEQ ID NO: 2855867 - DNA, 18 bp, Homo sapiens
tggggtacccactgctct

SEQ ID NO: 2855868 - DNA, 19 bp, Homo sapiens
tggggtacccactgctctg

SEQ ID NO: 2855869 - DNA, 20 bp, Homo sapiens
tggggtacccactgctctgg

SEQ ID NO: 2855870 - DNA, 19 bp, Homo sapiens
tggggtatggattctaaaa

SEQ ID NO: 2855871 - DNA, 20 bp, Homo sapiens
tggggtatggattctaaaat

SEQ ID NO: 2855872 - DNA, 18 bp, Homo sapiens
tggggtcagccagggcca

SEQ ID NO: 2855873 - DNA, 21 bp, Homo sapiens
tggggtctccctctcctgcct

SEQ ID NO: 2855874 - DNA, 22 bp, Homo sapiens
tggggtgacccggcaccccctg

SEQ ID NO: 2855875 - DNA, 23 bp, Homo sapiens
tggggtgacccggcaccccctgc

SEQ ID NO: 2855876 - DNA, 15 bp, Homo sapiens
tggggttcagcccct

SEQ ID NO: 2855877 - DNA, 21 bp, Homo sapiens
tggggttcagcccctcctctg

SEQ ID NO: 2855878 - DNA, 22 bp, Homo sapiens
tggggttcagcccctcctctgc

SEQ ID NO: 2855879 - DNA, 12 bp, Homo sapiens
tgtccctacacc

SEQ ID NO: 2855880 - DNA, 20 bp, Homo sapiens
tgtccctcactgccttccag

SEQ ID NO: 2855881 - DNA, 15 bp, Homo sapiens
tgtccctctttgcct

SEQ ID NO: 2855882 - DNA, 21 bp, Homo sapiens
tgtccctgtcaccaagctcac

SEQ ID NO: 2855883 - DNA, 22 bp, Homo sapiens
tgtccgaagaccgaattttatt

SEQ ID NO: 2855884 - DNA, 16 bp, Homo sapiens
tgtcctaaggacacac

SEQ ID NO: 2855885 - DNA, 21 bp, Homo sapiens
tgtcctaggggccgagggaaa

SEQ ID NO: 2855886 - DNA, 14 bp, Homo sapiens
tgtcctatgtcaat

SEQ ID NO: 2855887 - DNA, 21 bp, Homo sapiens
tgtcctatgtcaatttgtata

SEQ ID NO: 2855888 - DNA, 21 bp, Homo sapiens
tgtcctccaacaataaagagc

SEQ ID NO: 2855889 - DNA, 22 bp, Homo sapiens
tgtcctccaacaataaagagct

SEQ ID NO: 2855890 - DNA, 10 bp, Homo sapiens
tgtcctcctc

SEQ ID NO: 2855891 - DNA, 15 bp, Homo sapiens
tgtcctcttgctcaa

SEQ ID NO: 2855892 - DNA, 23 bp, Homo sapiens
tgtcctcttgctcaaaaatctgt

SEQ ID NO: 2855893 - DNA, 11 bp, Homo sapiens
tgtcctgctgt

SEQ ID NO: 2855894 - DNA, 15 bp, Homo sapiens
tgtccttgcacctgc

SEQ ID NO: 2855895 - DNA, 14 bp, Homo sapiens
tgtcctttgagaaa

SEQ ID NO: 2855896 - DNA, 20 bp, Homo sapiens
tgtcctttgagaaagaaata

SEQ ID NO: 2855897 - DNA, 14 bp, Homo sapiens
tgtcgcccagtctg

SEQ ID NO: 2855898 - DNA, 12 bp, Homo sapiens
tgtcgcctgccc

SEQ ID NO: 2855899 - DNA, 15 bp, Homo sapiens
tgtcgtgtttacaaa

SEQ ID NO: 2855900 - DNA, 16 bp, Homo sapiens
tgtcgtgtttacaaaa

SEQ ID NO: 2855901 - DNA, 21 bp, Homo sapiens
tgtctataatggaaacattta

SEQ ID NO: 2855902 - DNA, 14 bp, Homo sapiens
tgtctatgggactc

SEQ ID NO: 2855903 - DNA, 15 bp, Homo sapiens
tgtctatgggactca

SEQ ID NO: 2855904 - DNA, 14 bp, Homo sapiens
tgtctccctggggt

SEQ ID NO: 2855905 - DNA, 17 bp, Homo sapiens
tgtctcgagcgccctgc

SEQ ID NO: 2855906 - DNA, 23 bp, Homo sapiens
tgtctctgggcttggggcttcct

SEQ ID NO: 2855907 - DNA, 23 bp, Homo sapiens
tgtctctgtccctcactgccttc

SEQ ID NO: 2855908 - DNA, 22 bp, Homo sapiens
tgtctctttaatgtcacaggca

SEQ ID NO: 2855909 - DNA, 19 bp, Homo sapiens
tgtctgattggctcaccca

SEQ ID NO: 2855910 - DNA, 19 bp, Homo sapiens
tgtctgccagccagcagcc

SEQ ID NO: 2855911 - DNA, 18 bp, Homo sapiens
tgtctgcccccgtcttct

SEQ ID NO: 2855912 - DNA, 22 bp, Homo sapiens
tgtctgcccccgtcttctctcc

SEQ ID NO: 2855913 - DNA, 23 bp, Homo sapiens
tgtctgcttagtatctcatcaac

SEQ ID NO: 2855914 - DNA, 17 bp, Homo sapiens
tgtctggaaaagcactt

SEQ ID NO: 2855915 - DNA, 13 bp, Homo sapiens
tgtctgtacacgt

SEQ ID NO: 2855916 - DNA, 15 bp, Homo sapiens
tgtctgtacacgtgt

SEQ ID NO: 2855917 - DNA, 20 bp, Homo sapiens
tgtctgtacacgtgtcctgt

SEQ ID NO: 2855918 - DNA, 14 bp, Homo sapiens
tgtctgtctgtccc

SEQ ID NO: 2855919 - DNA, 15 bp, Homo sapiens
tgtctgtctgtctgt

SEQ ID NO: 2855920 - DNA, 15 bp, Homo sapiens
tgtctgtgtcagcct

SEQ ID NO: 2855921 - DNA, 14 bp, Homo sapiens
tgtcttccataatg

SEQ ID NO: 2855922 - DNA, 22 bp, Homo sapiens
tgtcttcctagtatattagttt

SEQ ID NO: 2855923 - DNA, 15 bp, Homo sapiens
tgtcttgcaatggca

SEQ ID NO: 2855924 - DNA, 17 bp, Homo sapiens
tgtcttgcaatggcagc

SEQ ID NO: 2855925 - DNA, 18 bp, Homo sapiens
tgtcttgcaatggcagcc

SEQ ID NO: 2855926 - DNA, 13 bp, Homo sapiens
tgtcttggacact

SEQ ID NO: 2855927 - DNA, 15 bp, Homo sapiens
tgtcttggacactgt

SEQ ID NO: 2855928 - DNA, 19 bp, Homo sapiens
tgtcttggacactgtacaa

SEQ ID NO: 2855929 - DNA, 13 bp, Homo sapiens
tgtcttgtacatg

SEQ ID NO: 2855930 - DNA, 20 bp, Homo sapiens
tgtcttgtacatgtgtagcc

SEQ ID NO: 2855931 - DNA, 14 bp, Homo sapiens
tgtctttaaggaaa

SEQ ID NO: 2855932 - DNA, 19 bp, Homo sapiens
tgtctttaggcagcagctt

SEQ ID NO: 2855933 - DNA, 16 bp, Homo sapiens
tgtcttttttcactac

SEQ ID NO: 2855934 - DNA, 21 bp, Homo sapiens
tgtgaaagtcagatgcccaga

SEQ ID NO: 2855935 - DNA, 22 bp, Homo sapiens
tgtgaaagtcagatgcccagag

SEQ ID NO: 2855936 - DNA, 14 bp, Homo sapiens
tgtgaacccaggac

SEQ ID NO: 2855937 - DNA, 13 bp, Homo sapiens
tgtgaagaaatgg

SEQ ID NO: 2855938 - DNA, 13 bp, Homo sapiens
tgtgaagacccag

SEQ ID NO: 2855939 - DNA, 18 bp, Homo sapiens
tgtgaagacccagcagga

SEQ ID NO: 2855940 - DNA, 20 bp, Homo sapiens
tgtgaatatggactcagttt

SEQ ID NO: 2855941 - DNA, 15 bp, Homo sapiens
tgtgaattcccaggt

SEQ ID NO: 2855942 - DNA, 14 bp, Homo sapiens
tgtgaattctgtga

SEQ ID NO: 2855943 - DNA, 16 bp, Homo sapiens
tgtgaattctgtgaag

SEQ ID NO: 2855944 - DNA, 17 bp, Homo sapiens
tgtgacaacctttgtgt

SEQ ID NO: 2855945 - DNA, 21 bp, Homo sapiens
tgtgacaacctttgtgtaata

SEQ ID NO: 2855946 - DNA, 23 bp, Homo sapiens
tgtgacaacctttgtgtaataaa

SEQ ID NO: 2855947 - DNA, 21 bp, Homo sapiens
tgtgacaaggattgctactgt

SEQ ID NO: 2855948 - DNA, 22 bp, Homo sapiens
tgtgacacatatgcaccttgtg

SEQ ID NO: 2855949 - DNA, 16 bp, Homo sapiens
tgtgacccagggtgca

SEQ ID NO: 2855950 - DNA, 15 bp, Homo sapiens
tgtgacctgctgagc

SEQ ID NO: 2855951 - DNA, 16 bp, Homo sapiens
tgtgacctgctgagct

SEQ ID NO: 2855952 - DNA, 18 bp, Homo sapiens
tgtgacctgctgagctct

SEQ ID NO: 2855953 - DNA, 23 bp, Homo sapiens
tgtgactcgcttagctgaaacct

SEQ ID NO: 2855954 - DNA, 14 bp, Homo sapiens
tgtgagcagtgagt

SEQ ID NO: 2855955 - DNA, 16 bp, Homo sapiens
tgtgagcatctctgtg

SEQ ID NO: 2855956 - DNA, 19 bp, Homo sapiens
tgtgagccaaagagaaaag

SEQ ID NO: 2855957 - DNA, 12 bp, Homo sapiens
tgtgaggcaggg

SEQ ID NO: 2855958 - DNA, 18 bp, Homo sapiens
tgtgaggcaggggcggag

SEQ ID NO: 2855959 - DNA, 15 bp, Homo sapiens
tgtgagtcaccaagc

SEQ ID NO: 2855960 - DNA, 17 bp, Homo sapiens
tgtgagtcaccaagccc

SEQ ID NO: 2855961 - DNA, 19 bp, Homo sapiens
tgtgagtcaccaagcccag

SEQ ID NO: 2855962 - DNA, 17 bp, Homo sapiens
tgtgatatctgaacaca

SEQ ID NO: 2855963 - DNA, 15 bp, Homo sapiens
tgtgatcagaccata

SEQ ID NO: 2855964 - DNA, 18 bp, Homo sapiens
tgtgatcccaagtgccag

SEQ ID NO: 2855965 - DNA, 22 bp, Homo sapiens
tgtgatgatgaaatgaggtcag

SEQ ID NO: 2855966 - DNA, 23 bp, Homo sapiens
tgtgatgctggtaccactggaat

SEQ ID NO: 2855967 - DNA, 18 bp, Homo sapiens
tgtgatgggatctgtaag

SEQ ID NO: 2855968 - DNA, 22 bp, Homo sapiens
tgtgatggggtgggcagggctg

SEQ ID NO: 2855969 - DNA, 15 bp, Homo sapiens
tgtgattgaatctga

SEQ ID NO: 2855970 - DNA, 20 bp, Homo sapiens
ttaaaaaataaaaaaataca

SEQ ID NO: 2855971 - DNA, 22 bp, Homo sapiens
ttaaaaaataaaaaaatacagt

SEQ ID NO: 2855972 - DNA, 23 bp, Homo sapiens
ttaaaaaataaaaaaatacagta

SEQ ID NO: 2855973 - DNA, 15 bp, Homo sapiens
ttaaaaaataaatat

SEQ ID NO: 2855974 - DNA, 16 bp, Homo sapiens
ttaaaaaataaatata

SEQ ID NO: 2855975 - DNA, 18 bp, Homo sapiens
ttaaaaaataaatataat

SEQ ID NO: 2855976 - DNA, 12 bp, Homo sapiens
ttaaaaaatgtc

SEQ ID NO: 2855977 - DNA, 17 bp, Homo sapiens
ttaaaaacatgagaaat

SEQ ID NO: 2855978 - DNA, 19 bp, Homo sapiens
ttaaaaacatgagaaatgt

SEQ ID NO: 2855979 - DNA, 20 bp, Homo sapiens
ttaaaaacatgagaaatgtg

SEQ ID NO: 2855980 - DNA, 21 bp, Homo sapiens
ttaaaaacatgagaaatgtga

SEQ ID NO: 2855981 - DNA, 16 bp, Homo sapiens
ttaaaaagcagtcctc

SEQ ID NO: 2855982 - DNA, 16 bp, Homo sapiens
ttaaaaagtactcttt

SEQ ID NO: 2855983 - DNA, 19 bp, Homo sapiens
ttaaaaagttgcacattag

SEQ ID NO: 2855984 - DNA, 16 bp, Homo sapiens
ttaaaagaagactgga

SEQ ID NO: 2855985 - DNA, 17 bp, Homo sapiens
ttaaaagaagactggaa

SEQ ID NO: 2855986 - DNA, 14 bp, Homo sapiens
ttaaaagtgtattt

SEQ ID NO: 2855987 - DNA, 23 bp, Homo sapiens
ttaaaagtgttgattacataatc

SEQ ID NO: 2855988 - DNA, 22 bp, Homo sapiens
ttaaaagttgggaaaagtgtta

SEQ ID NO: 2855989 - DNA, 23 bp, Homo sapiens
ttaaaatagcaaaagaagaagtt

SEQ ID NO: 2855990 - DNA, 22 bp, Homo sapiens
ttaaaatagcaacactctatat

SEQ ID NO: 2855991 - DNA, 15 bp, Homo sapiens
ttaaaatcattcaat

SEQ ID NO: 2855992 - DNA, 17 bp, Homo sapiens
ttaaaattagtgagatt

SEQ ID NO: 2855993 - DNA, 15 bp, Homo sapiens
ttaaaatttattgct

SEQ ID NO: 2855994 - DNA, 19 bp, Homo sapiens
ttaaaattttacttttgtt

SEQ ID NO: 2855995 - DNA, 14 bp, Homo sapiens
ttaaacaaaggttg

SEQ ID NO: 2855996 - DNA, 14 bp, Homo sapiens
ttaaacacctgaca

SEQ ID NO: 2855997 - DNA, 16 bp, Homo sapiens
ttaaacacctgacaca

SEQ ID NO: 2855998 - DNA, 16 bp, Homo sapiens
ttaaacacgtgtctat

SEQ ID NO: 2855999 - DNA, 14 bp, Homo sapiens
ttaaacactgtaat

SEQ ID NO: 2856000 - DNA, 17 bp, Homo sapiens
ttaaacactgtaatctt

SEQ ID NO: 2856001 - DNA, 17 bp, Homo sapiens
ttaaacagactttagct

SEQ ID NO: 2856002 - DNA, 13 bp, Homo sapiens
ttaaaccagcaga

SEQ ID NO: 2856003 - DNA, 16 bp, Homo sapiens
ttaaaccagcagaaaa

SEQ ID NO: 2856004 - DNA, 16 bp, Homo sapiens
ttaaaccgctaaaaga

SEQ ID NO: 2856005 - DNA, 16 bp, Homo sapiens
ttaaagagcatggaaa

SEQ ID NO: 2856006 - DNA, 20 bp, Homo sapiens
ttaaagaggcgtcttgtatt

SEQ ID NO: 2856007 - DNA, 21 bp, Homo sapiens
ttaaagaggcgtcttgtattt

SEQ ID NO: 2856008 - DNA, 23 bp, Homo sapiens
ttaaagaggcgtcttgtattttc

SEQ ID NO: 2856009 - DNA, 14 bp, Homo sapiens
ttaaagcaaaggag

SEQ ID NO: 2856010 - DNA, 17 bp, Homo sapiens
ttaaagcatttactttg

SEQ ID NO: 2856011 - DNA, 15 bp, Homo sapiens
ttaaagctgcctgta

SEQ ID NO: 2856012 - DNA, 12 bp, Homo sapiens
ttaaaggagtta

SEQ ID NO: 2856013 - DNA, 15 bp, Homo sapiens
ttaaagtacctgtag

SEQ ID NO: 2856014 - DNA, 22 bp, Homo sapiens
ttaaagtacctgtagtgagaaa

SEQ ID NO: 2856015 - DNA, 16 bp, Homo sapiens
ttaaagtatatattta

SEQ ID NO: 2856016 - DNA, 15 bp, Homo sapiens
ttaaataaattcaaa

SEQ ID NO: 2856017 - DNA, 17 bp, Homo sapiens
ttaaatacagacactaa

SEQ ID NO: 2856018 - DNA, 15 bp, Homo sapiens
ttaaatagcatctgc

SEQ ID NO: 2856019 - DNA, 23 bp, Homo sapiens
ttaaatagcatctgctcttctct

SEQ ID NO: 2856020 - DNA, 14 bp, Homo sapiens
ttaaatatgaacaa

SEQ ID NO: 2856021 - DNA, 14 bp, Homo sapiens
ttaaatatttacat

SEQ ID NO: 2856022 - DNA, 17 bp, Homo sapiens
ttaaatatttacatatg

SEQ ID NO: 2856023 - DNA, 19 bp, Homo sapiens
ttaaatcaaaagctgcttg

SEQ ID NO: 2856024 - DNA, 23 bp, Homo sapiens
ttaaatcaaaagctgcttgacta

SEQ ID NO: 2856025 - DNA, 12 bp, Homo sapiens
ttaaatcactga

SEQ ID NO: 2856026 - DNA, 22 bp, Homo sapiens
ttaaatcactgaggcattttta

SEQ ID NO: 2856027 - DNA, 13 bp, Homo sapiens
ttaaatcgttaga

SEQ ID NO: 2856028 - DNA, 15 bp, Homo sapiens
ttaaatgacattttt

SEQ ID NO: 2856029 - DNA, 15 bp, Homo sapiens
ttaaattctttttca

SEQ ID NO: 2856030 - DNA, 16 bp, Homo sapiens
ttaaattctttttcaa

SEQ ID NO: 2856031 - DNA, 18 bp, Homo sapiens
ttaacaaaacaagaaaga

SEQ ID NO: 2856032 - DNA, 19 bp, Homo sapiens
ttaacactgcttgtgtttt

SEQ ID NO: 2856033 - DNA, 22 bp, Homo sapiens
ttaacatcatcaggcttggaat

SEQ ID NO: 2856034 - DNA, 17 bp, Homo sapiens
ttaaccagcacatttct

SEQ ID NO: 2856035 - DNA, 22 bp, Homo sapiens
ttaaccgtttttcaagaaaact

SEQ ID NO: 2856036 - DNA, 18 bp, Homo sapiens
ttaacctgaattattcca

SEQ ID NO: 2856037 - DNA, 17 bp, Homo sapiens
ttaacggctccaggatt

SEQ ID NO: 2856038 - DNA, 12 bp, Homo sapiens
ttaactcaatat

SEQ ID NO: 2856039 - DNA, 15 bp, Homo sapiens
ttaactcattagact

SEQ ID NO: 2856040 - DNA, 16 bp, Homo sapiens
ttaactcattagactg

SEQ ID NO: 2856041 - DNA, 17 bp, Homo sapiens
ttaactcattagactgg

SEQ ID NO: 2856042 - DNA, 17 bp, Homo sapiens
ttaactctctttatgtc

SEQ ID NO: 2856043 - DNA, 22 bp, Homo sapiens
ttaactgtgtgaagaaatggaa

SEQ ID NO: 2856044 - DNA, 15 bp, Homo sapiens
ttaacttaaatagta

SEQ ID NO: 2856045 - DNA, 11 bp, Homo sapiens
ttaacttgtat

SEQ ID NO: 2856046 - DNA, 23 bp, Homo sapiens
ttaactttatcacattatttgca

SEQ ID NO: 2856047 - DNA, 15 bp, Homo sapiens
ttaagaggcagggtc

SEQ ID NO: 2856048 - DNA, 16 bp, Homo sapiens
ttaagaggcagggtct

SEQ ID NO: 2856049 - DNA, 20 bp, Homo sapiens
ttaagagtagcaagttctag

SEQ ID NO: 2856050 - DNA, 19 bp, Homo sapiens
ttaagagtgaaataattaa

SEQ ID NO: 2856051 - DNA, 16 bp, Homo sapiens
ttaagataattataat

SEQ ID NO: 2856052 - DNA, 20 bp, Homo sapiens
ttaagcattgggtgggtaaa

SEQ ID NO: 2856053 - DNA, 14 bp, Homo sapiens
ttaagctgtttcca

SEQ ID NO: 2856054 - DNA, 13 bp, Homo sapiens
ttaagggaaaaat

SEQ ID NO: 2856055 - DNA, 15 bp, Homo sapiens
ttaagtaaaccaaaa

SEQ ID NO: 2856056 - DNA, 14 bp, Homo sapiens
ttaagtatatagta

SEQ ID NO: 2856057 - DNA, 19 bp, Homo sapiens
ttaagtatatagtatattt

SEQ ID NO: 2856058 - DNA, 21 bp, Homo sapiens
ttaagtatatagtatatttat

SEQ ID NO: 2856059 - DNA, 19 bp, Homo sapiens
ttaagtatttatatattta

SEQ ID NO: 2856060 - DNA, 12 bp, Homo sapiens
ttaagtcatcca

SEQ ID NO: 2856061 - DNA, 23 bp, Homo sapiens
ttatgacatcacttgtacaaaat

SEQ ID NO: 2856062 - DNA, 20 bp, Homo sapiens
ttatgatgtgggtcaaggaa

SEQ ID NO: 2856063 - DNA, 21 bp, Homo sapiens
ttatgatgtgggtcaaggaat

SEQ ID NO: 2856064 - DNA, 15 bp, Homo sapiens
ttatgccttttattt

SEQ ID NO: 2856065 - DNA, 14 bp, Homo sapiens
ttatgctgagtatg

SEQ ID NO: 2856066 - DNA, 19 bp, Homo sapiens
ttatggaagattttaaatt

SEQ ID NO: 2856067 - DNA, 17 bp, Homo sapiens
ttatggagtgtcaccag

SEQ ID NO: 2856068 - DNA, 15 bp, Homo sapiens
ttatgggtcctgcaa

SEQ ID NO: 2856069 - DNA, 17 bp, Homo sapiens
ttatgggtcctgcaatt

SEQ ID NO: 2856070 - DNA, 14 bp, Homo sapiens
ttatggtgtaatgc

SEQ ID NO: 2856071 - DNA, 19 bp, Homo sapiens
ttatgtctcaaaataagtt

SEQ ID NO: 2856072 - DNA, 23 bp, Homo sapiens
ttatgtgacaacctttgtgtaat

SEQ ID NO: 2856073 - DNA, 22 bp, Homo sapiens
ttatgtgtgtatatgtatgtgt

SEQ ID NO: 2856074 - DNA, 12 bp, Homo sapiens
ttattacctctg

SEQ ID NO: 2856075 - DNA, 13 bp, Homo sapiens
ttattacctctga

SEQ ID NO: 2856076 - DNA, 21 bp, Homo sapiens
ttattagattctccaaatgat

SEQ ID NO: 2856077 - DNA, 12 bp, Homo sapiens
ttattagctgta

SEQ ID NO: 2856078 - DNA, 14 bp, Homo sapiens
ttattatcctgcat

SEQ ID NO: 2856079 - DNA, 16 bp, Homo sapiens
ttattattagattctc

SEQ ID NO: 2856080 - DNA, 17 bp, Homo sapiens
ttattcaagacaccaaa

SEQ ID NO: 2856081 - DNA, 18 bp, Homo sapiens
ttattcaattcctctggg

SEQ ID NO: 2856082 - DNA, 19 bp, Homo sapiens
ttattcaattcctctggga

SEQ ID NO: 2856083 - DNA, 20 bp, Homo sapiens
ttattcctatatagtttatt

SEQ ID NO: 2856084 - DNA, 13 bp, Homo sapiens
ttattctaatttt

SEQ ID NO: 2856085 - DNA, 13 bp, Homo sapiens
ttattctagatta

SEQ ID NO: 2856086 - DNA, 14 bp, Homo sapiens
ttattgctcctgta

SEQ ID NO: 2856087 - DNA, 12 bp, Homo sapiens
ttattgctgttg

SEQ ID NO: 2856088 - DNA, 17 bp, Homo sapiens
ttattgtacctctctta

SEQ ID NO: 2856089 - DNA, 23 bp, Homo sapiens
ttattgtgttgccttagcacttc

SEQ ID NO: 2856090 - DNA, 16 bp, Homo sapiens
ttatttaaaatagcaa

SEQ ID NO: 2856091 - DNA, 23 bp, Homo sapiens
ttatttaaaccgctaaaagaaac

SEQ ID NO: 2856092 - DNA, 21 bp, Homo sapiens
ttatttactgagcttctctgt

SEQ ID NO: 2856093 - DNA, 22 bp, Homo sapiens
ttatttactgagcttctctgtg

SEQ ID NO: 2856094 - DNA, 16 bp, Homo sapiens
ttatttatatatgaag

SEQ ID NO: 2856095 - DNA, 18 bp, Homo sapiens
ttatttatcagtgacaga

SEQ ID NO: 2856096 - DNA, 15 bp, Homo sapiens
ttatttatttatgga

SEQ ID NO: 2856097 - DNA, 12 bp, Homo sapiens
ttatttgtaata

SEQ ID NO: 2856098 - DNA, 17 bp, Homo sapiens
ttatttgtaatagatgt

SEQ ID NO: 2856099 - DNA, 18 bp, Homo sapiens
ttattttcaagaaactga

SEQ ID NO: 2856100 - DNA, 14 bp, Homo sapiens
ttattttcacctgt

SEQ ID NO: 2856101 - DNA, 13 bp, Homo sapiens
ttattttccaata

SEQ ID NO: 2856102 - DNA, 15 bp, Homo sapiens
ttattttccaataaa

SEQ ID NO: 2856103 - DNA, 16 bp, Homo sapiens
ttattttctatagctc

SEQ ID NO: 2856104 - DNA, 13 bp, Homo sapiens
ttattttgtaata

SEQ ID NO: 2856105 - DNA, 16 bp, Homo sapiens
ttattttgtaataaac

SEQ ID NO: 2856106 - DNA, 17 bp, Homo sapiens
ttattttgtaataaact

SEQ ID NO: 2856107 - DNA, 20 bp, Homo sapiens
ttattttgttgtgattttgt

SEQ ID NO: 2856108 - DNA, 23 bp, Homo sapiens
ttatttttgacagtgttgaaaat

SEQ ID NO: 2856109 - DNA, 20 bp, Homo sapiens
ttattttttctacacagtaa

SEQ ID NO: 2856110 - DNA, 18 bp, Homo sapiens
ttcaaaaaaacactagtt

SEQ ID NO: 2856111 - DNA, 20 bp, Homo sapiens
ttcaaaaattgtgtttagat

SEQ ID NO: 2856112 - DNA, 23 bp, Homo sapiens
ttcaaaaattgtgtttagatttt

SEQ ID NO: 2856113 - DNA, 11 bp, Homo sapiens
ttcaaaataaa

SEQ ID NO: 2856114 - DNA, 16 bp, Homo sapiens
ttcaaaccatttaatt

SEQ ID NO: 2856115 - DNA, 21 bp, Homo sapiens
ttcaaaccatttaattcataa

SEQ ID NO: 2856116 - DNA, 19 bp, Homo sapiens
ttcaaagtttaataaattt

SEQ ID NO: 2856117 - DNA, 16 bp, Homo sapiens
ttcaaattgtcttttg

SEQ ID NO: 2856118 - DNA, 13 bp, Homo sapiens
ttcaaatttcaca

SEQ ID NO: 2856119 - DNA, 19 bp, Homo sapiens
ttcaaccactgtaaaatga

SEQ ID NO: 2856120 - DNA, 14 bp, Homo sapiens
ttcaaccagcattt

SEQ ID NO: 2856121 - DNA, 20 bp, Homo sapiens
ttcaaccagcattttactac

SEQ ID NO: 2856122 - DNA, 16 bp, Homo sapiens
ttcaacctgtgtctta

SEQ ID NO: 2856123 - DNA, 14 bp, Homo sapiens
ttcaacttaaatca

SEQ ID NO: 2856124 - DNA, 12 bp, Homo sapiens
ttcaacttttcc

SEQ ID NO: 2856125 - DNA, 15 bp, Homo sapiens
ttcaagaaaactgga

SEQ ID NO: 2856126 - DNA, 20 bp, Homo sapiens
ttcaagaaactgaggaattt

SEQ ID NO: 2856127 - DNA, 14 bp, Homo sapiens
ttcaagagaagaaa

SEQ ID NO: 2856128 - DNA, 19 bp, Homo sapiens
ttcaaggagatataaaatc

SEQ ID NO: 2856129 - DNA, 13 bp, Homo sapiens
ttcaagttaaagt

SEQ ID NO: 2856130 - DNA, 16 bp, Homo sapiens
ttcaagttagctcagg

SEQ ID NO: 2856131 - DNA, 12 bp, Homo sapiens
ttcaataaagta

SEQ ID NO: 2856132 - DNA, 14 bp, Homo sapiens
ttcaataaagtatc

SEQ ID NO: 2856133 - DNA, 22 bp, Homo sapiens
ttcaatggtttgcaaggaagcc

SEQ ID NO: 2856134 - DNA, 19 bp, Homo sapiens
ttcaattcagtgctgtact

SEQ ID NO: 2856135 - DNA, 14 bp, Homo sapiens
ttcaattcctgggc

SEQ ID NO: 2856136 - DNA, 16 bp, Homo sapiens
ttcacaaccagccaca

SEQ ID NO: 2856137 - DNA, 20 bp, Homo sapiens
ttcacaatgaaatgctctcc

SEQ ID NO: 2856138 - DNA, 13 bp, Homo sapiens
ttcacacacccct

SEQ ID NO: 2856139 - DNA, 12 bp, Homo sapiens
ttcacagtgttt

SEQ ID NO: 2856140 - DNA, 15 bp, Homo sapiens
ttcacataccctccc

SEQ ID NO: 2856141 - DNA, 15 bp, Homo sapiens
ttcacatttgatgta

SEQ ID NO: 2856142 - DNA, 15 bp, Homo sapiens
ttcaccagagcccat

SEQ ID NO: 2856143 - DNA, 13 bp, Homo sapiens
ttcaccatttccg

SEQ ID NO: 2856144 - DNA, 19 bp, Homo sapiens
ttcacctgtttttaagctg

SEQ ID NO: 2856145 - DNA, 21 bp, Homo sapiens
ttcacctgtttttaagctgtt

SEQ ID NO: 2856146 - DNA, 14 bp, Homo sapiens
ttcacgcaacttga

SEQ ID NO: 2856147 - DNA, 18 bp, Homo sapiens
ttcactataaatggtgtt

SEQ ID NO: 2856148 - DNA, 21 bp, Homo sapiens
ttcactggcgaggtgcggcca

SEQ ID NO: 2856149 - DNA, 15 bp, Homo sapiens
ttcactgtagaatga

SEQ ID NO: 2856150 - DNA, 23 bp, Homo sapiens
ttcacttcgatgactggatacag

SEQ ID NO: 2856151 - DNA, 19 bp, Homo sapiens
ttcagaaagcattacattt

SEQ ID NO: 2856152 - DNA, 16 bp, Homo sapiens
ttgaactcctggcctc

SEQ ID NO: 2856153 - DNA, 13 bp, Homo sapiens
ttgaactgattca

SEQ ID NO: 2856154 - DNA, 18 bp, Homo sapiens
ttgaactgggtacttgtg

SEQ ID NO: 2856155 - DNA, 21 bp, Homo sapiens
ttgaactgttctggcctcaga

SEQ ID NO: 2856156 - DNA, 20 bp, Homo sapiens
ttgaagaagagtttgcaaat

SEQ ID NO: 2856157 - DNA, 18 bp, Homo sapiens
ttgaagaagggaaattca

SEQ ID NO: 2856158 - DNA, 18 bp, Homo sapiens
ttgaagaatattgttaaa

SEQ ID NO: 2856159 - DNA, 15 bp, Homo sapiens
ttgaagaatgttaag

SEQ ID NO: 2856160 - DNA, 19 bp, Homo sapiens
ttgaagaatgttaagactt

SEQ ID NO: 2856161 - DNA, 23 bp, Homo sapiens
ttgaagaatgttaagacttgaca

SEQ ID NO: 2856162 - DNA, 20 bp, Homo sapiens
ttgaagagatttcaacatat

SEQ ID NO: 2856163 - DNA, 17 bp, Homo sapiens
ttgaagaggggaggggc

SEQ ID NO: 2856164 - DNA, 20 bp, Homo sapiens
ttgaagcaaatcgaatgaaa

SEQ ID NO: 2856165 - DNA, 13 bp, Homo sapiens
ttgaagccactga

SEQ ID NO: 2856166 - DNA, 14 bp, Homo sapiens
ttgaagctaagatt

SEQ ID NO: 2856167 - DNA, 20 bp, Homo sapiens
ttgaaggaacagtgctgttc

SEQ ID NO: 2856168 - DNA, 19 bp, Homo sapiens
ttgaagggtaaagaagttt

SEQ ID NO: 2856169 - DNA, 23 bp, Homo sapiens
ttgaagttagctttaacttaaat

SEQ ID NO: 2856170 - DNA, 19 bp, Homo sapiens
ttgaataaaaaacatttgt

SEQ ID NO: 2856171 - DNA, 13 bp, Homo sapiens
ttgaataaagtct

SEQ ID NO: 2856172 - DNA, 14 bp, Homo sapiens
ttgaataaagtctg

SEQ ID NO: 2856173 - DNA, 19 bp, Homo sapiens
ttgaataaagtctgagtgg

SEQ ID NO: 2856174 - DNA, 12 bp, Homo sapiens
ttgaataaataa

SEQ ID NO: 2856175 - DNA, 16 bp, Homo sapiens
ttgaataagtattctt

SEQ ID NO: 2856176 - DNA, 14 bp, Homo sapiens
ttgaatatcattaa

SEQ ID NO: 2856177 - DNA, 15 bp, Homo sapiens
ttgaatgcaaaccat

SEQ ID NO: 2856178 - DNA, 16 bp, Homo sapiens
ttgaatgcaaaccata

SEQ ID NO: 2856179 - DNA, 20 bp, Homo sapiens
ttgaatggctatgtttttaa

SEQ ID NO: 2856180 - DNA, 15 bp, Homo sapiens
ttgaatggtgcagaa

SEQ ID NO: 2856181 - DNA, 16 bp, Homo sapiens
ttgaatggtgcagaaa

SEQ ID NO: 2856182 - DNA, 12 bp, Homo sapiens
ttgaattctgga

SEQ ID NO: 2856183 - DNA, 23 bp, Homo sapiens
ttgaattctggaggaagaagaca

SEQ ID NO: 2856184 - DNA, 15 bp, Homo sapiens
ttgacaaaataacat

SEQ ID NO: 2856185 - DNA, 22 bp, Homo sapiens
ttgacaagtcattttaacttta

SEQ ID NO: 2856186 - DNA, 13 bp, Homo sapiens
ttgacacacagca

SEQ ID NO: 2856187 - DNA, 16 bp, Homo sapiens
ttgacacacagcactc

SEQ ID NO: 2856188 - DNA, 16 bp, Homo sapiens
ttgacagaacactgtc

SEQ ID NO: 2856189 - DNA, 17 bp, Homo sapiens
ttgacagaacactgtct

SEQ ID NO: 2856190 - DNA, 19 bp, Homo sapiens
ttgacagtgttgaaaatgt

SEQ ID NO: 2856191 - DNA, 22 bp, Homo sapiens
ttgaccaagatgatcacatgga

SEQ ID NO: 2856192 - DNA, 13 bp, Homo sapiens
ttgactatcacat

SEQ ID NO: 2856193 - DNA, 14 bp, Homo sapiens
ttgactatcacata

SEQ ID NO: 2856194 - DNA, 20 bp, Homo sapiens
ttgactcaagtttttacaaa

SEQ ID NO: 2856195 - DNA, 21 bp, Homo sapiens
ttgactcaagtttttacaaaa

SEQ ID NO: 2856196 - DNA, 14 bp, Homo sapiens
ttgactcacctgtt

SEQ ID NO: 2856197 - DNA, 21 bp, Homo sapiens
ttgactcttttgccattaaac

SEQ ID NO: 2856198 - DNA, 17 bp, Homo sapiens
ttgactgggtttctctg

SEQ ID NO: 2856199 - DNA, 15 bp, Homo sapiens
ttgacttactgtttc

SEQ ID NO: 2856200 - DNA, 20 bp, Homo sapiens
ttgacttactgtttcttacc

SEQ ID NO: 2856201 - DNA, 13 bp, Homo sapiens
ttgactttcaggt

SEQ ID NO: 2856202 - DNA, 21 bp, Homo sapiens
ttgactttcaggtactaaata

SEQ ID NO: 2856203 - DNA, 10 bp, Homo sapiens
ttgagaaacc

SEQ ID NO: 2856204 - DNA, 12 bp, Homo sapiens
ttgagaaagaaa

SEQ ID NO: 2856205 - DNA, 14 bp, Homo sapiens
ttgagaaagaaata

SEQ ID NO: 2856206 - DNA, 11 bp, Homo sapiens
ttgagacagag

SEQ ID NO: 2856207 - DNA, 12 bp, Homo sapiens
ttgagacagagt

SEQ ID NO: 2856208 - DNA, 15 bp, Homo sapiens
ttgagaccagcctgg

SEQ ID NO: 2856209 - DNA, 21 bp, Homo sapiens
ttgagaccagcctggccaaca

SEQ ID NO: 2856210 - DNA, 15 bp, Homo sapiens
ttgagacctcagcca

SEQ ID NO: 2856211 - DNA, 13 bp, Homo sapiens
ttgagagtgtgac

SEQ ID NO: 2856212 - DNA, 19 bp, Homo sapiens
ttgagataatatctgtgag

SEQ ID NO: 2856213 - DNA, 14 bp, Homo sapiens
ttgagataatgtca

SEQ ID NO: 2856214 - DNA, 13 bp, Homo sapiens
ttgagcaattcat

SEQ ID NO: 2856215 - DNA, 15 bp, Homo sapiens
ttgagcaattcattt

SEQ ID NO: 2856216 - DNA, 20 bp, Homo sapiens
ttgagcaattcatttcactt

SEQ ID NO: 2856217 - DNA, 16 bp, Homo sapiens
ttgagcagggctcagc

SEQ ID NO: 2856218 - DNA, 22 bp, Homo sapiens
ttgagccaagcttcaaccctca

SEQ ID NO: 2856219 - DNA, 12 bp, Homo sapiens
ttgagctgtttt

SEQ ID NO: 2856220 - DNA, 11 bp, Homo sapiens
ttgaggacaca

SEQ ID NO: 2856221 - DNA, 15 bp, Homo sapiens
ttgaggacacatgtc

SEQ ID NO: 2856222 - DNA, 19 bp, Homo sapiens
ttgaggcctgccctcaggg

SEQ ID NO: 2856223 - DNA, 14 bp, Homo sapiens
ttgaggctgcagcg

SEQ ID NO: 2856224 - DNA, 16 bp, Homo sapiens
ttgaggggctcctgga

SEQ ID NO: 2856225 - DNA, 19 bp, Homo sapiens
ttgaggtggaagccctcct

SEQ ID NO: 2856226 - DNA, 20 bp, Homo sapiens
ttgagtgactcgagggttgg

SEQ ID NO: 2856227 - DNA, 23 bp, Homo sapiens
ttgagtttaagtctctgactctt

SEQ ID NO: 2856228 - DNA, 17 bp, Homo sapiens
ttgataaagatttttta

SEQ ID NO: 2856229 - DNA, 20 bp, Homo sapiens
ttgataaagattttttaata

SEQ ID NO: 2856230 - DNA, 15 bp, Homo sapiens
ttgatactaagcatt

SEQ ID NO: 2856231 - DNA, 13 bp, Homo sapiens
ttgatatgaaaaa

SEQ ID NO: 2856232 - DNA, 19 bp, Homo sapiens
ttgatgaccaatctctgtg

SEQ ID NO: 2856233 - DNA, 17 bp, Homo sapiens
ttgatgacccccaacca

SEQ ID NO: 2856234 - DNA, 14 bp, Homo sapiens
ttgatgccaaaaaa

SEQ ID NO: 2856235 - DNA, 21 bp, Homo sapiens
ttgatgggaagaaaaggtaca

SEQ ID NO: 2856236 - DNA, 14 bp, Homo sapiens
ttgatgtttccaga

SEQ ID NO: 2856237 - DNA, 20 bp, Homo sapiens
ttgattacataatcaaagct

SEQ ID NO: 2856238 - DNA, 20 bp, Homo sapiens
ttgattttagccttctctgt

SEQ ID NO: 2856239 - DNA, 15 bp, Homo sapiens
ttgcaaaatttccag

SEQ ID NO: 2856240 - DNA, 14 bp, Homo sapiens
ttgcaacaggctgg

SEQ ID NO: 2856241 - DNA, 18 bp, Homo sapiens
ttgcaagatttaacacta

SEQ ID NO: 2856242 - DNA, 23 bp, Homo sapiens
ttgcaaggccgctgttcacccac

SEQ ID NO: 2856243 - DNA, 14 bp, Homo sapiens
tttagaaaacttta

SEQ ID NO: 2856244 - DNA, 21 bp, Homo sapiens
tttagagatgaattaaattta

SEQ ID NO: 2856245 - DNA, 18 bp, Homo sapiens
tttagagattaatttgtg

SEQ ID NO: 2856246 - DNA, 22 bp, Homo sapiens
tttagagattaatttgtgtaga

SEQ ID NO: 2856247 - DNA, 18 bp, Homo sapiens
tttagcacaatttatatt

SEQ ID NO: 2856248 - DNA, 23 bp, Homo sapiens
tttagcagtccaaagaacaagaa

SEQ ID NO: 2856249 - DNA, 18 bp, Homo sapiens
tttagctctgatcagcat

SEQ ID NO: 2856250 - DNA, 22 bp, Homo sapiens
tttagtcttttactcctttgca

SEQ ID NO: 2856251 - DNA, 19 bp, Homo sapiens
tttagttgcagaaacattt

SEQ ID NO: 2856252 - DNA, 17 bp, Homo sapiens
tttagttgtatctcttt

SEQ ID NO: 2856253 - DNA, 21 bp, Homo sapiens
tttataatgtggatttcctat

SEQ ID NO: 2856254 - DNA, 13 bp, Homo sapiens
tttatacaaaata

SEQ ID NO: 2856255 - DNA, 15 bp, Homo sapiens
tttatacaaaataat

SEQ ID NO: 2856256 - DNA, 16 bp, Homo sapiens
tttatacaaaataatt

SEQ ID NO: 2856257 - DNA, 11 bp, Homo sapiens
tttatacatag

SEQ ID NO: 2856258 - DNA, 12 bp, Homo sapiens
tttatacatatc

SEQ ID NO: 2856259 - DNA, 15 bp, Homo sapiens
tttatacatatcaga

SEQ ID NO: 2856260 - DNA, 16 bp, Homo sapiens
tttatacatatcagaa

SEQ ID NO: 2856261 - DNA, 18 bp, Homo sapiens
tttatacatatcagaaaa

SEQ ID NO: 2856262 - DNA, 19 bp, Homo sapiens
tttatacatatcagaaaag

SEQ ID NO: 2856263 - DNA, 19 bp, Homo sapiens
tttatactccatacataac

SEQ ID NO: 2856264 - DNA, 13 bp, Homo sapiens
tttatatatatat

SEQ ID NO: 2856265 - DNA, 15 bp, Homo sapiens
tttatatatatatgt

SEQ ID NO: 2856266 - DNA, 19 bp, Homo sapiens
tttatatatatatgtatat

SEQ ID NO: 2856267 - DNA, 23 bp, Homo sapiens
tttatatattggtaacatccttt

SEQ ID NO: 2856268 - DNA, 12 bp, Homo sapiens
tttatatattta

SEQ ID NO: 2856269 - DNA, 15 bp, Homo sapiens
tttatatccacatct

SEQ ID NO: 2856270 - DNA, 16 bp, Homo sapiens
tttatatgaaatgttt

SEQ ID NO: 2856271 - DNA, 20 bp, Homo sapiens
tttatatgaaatgtttcact

SEQ ID NO: 2856272 - DNA, 16 bp, Homo sapiens
tttatattacactaca

SEQ ID NO: 2856273 - DNA, 22 bp, Homo sapiens
tttatattcagagatgtaccat

SEQ ID NO: 2856274 - DNA, 23 bp, Homo sapiens
tttatattcagagatgtaccatg

SEQ ID NO: 2856275 - DNA, 13 bp, Homo sapiens
tttatatttggaa

SEQ ID NO: 2856276 - DNA, 13 bp, Homo sapiens
tttatattttccc

SEQ ID NO: 2856277 - DNA, 14 bp, Homo sapiens
tttatattttccct

SEQ ID NO: 2856278 - DNA, 13 bp, Homo sapiens
tttatcagtgaca

SEQ ID NO: 2856279 - DNA, 21 bp, Homo sapiens
tttatccattcaactgaaaat

SEQ ID NO: 2856280 - DNA, 16 bp, Homo sapiens
tttatcgcagaccttt

SEQ ID NO: 2856281 - DNA, 14 bp, Homo sapiens
tttatctaaaagaa

SEQ ID NO: 2856282 - DNA, 20 bp, Homo sapiens
tttatctaatacctctgtgt

SEQ ID NO: 2856283 - DNA, 22 bp, Homo sapiens
tttatctgtgttgtctctctaa

SEQ ID NO: 2856284 - DNA, 12 bp, Homo sapiens
tttatgaagaaa

SEQ ID NO: 2856285 - DNA, 22 bp, Homo sapiens
tttatgaagaaaaaatacattt

SEQ ID NO: 2856286 - DNA, 23 bp, Homo sapiens
tttatggaggatggagagagggg

SEQ ID NO: 2856287 - DNA, 19 bp, Homo sapiens
tttatggtgtgttcctaac

SEQ ID NO: 2856288 - DNA, 16 bp, Homo sapiens
tttatggtttctccag

SEQ ID NO: 2856289 - DNA, 22 bp, Homo sapiens
tttatgtaaactgcattagaaa

SEQ ID NO: 2856290 - DNA, 19 bp, Homo sapiens
tttatgtctgtggattttt

SEQ ID NO: 2856291 - DNA, 15 bp, Homo sapiens
tttattaatgaactg

SEQ ID NO: 2856292 - DNA, 21 bp, Homo sapiens
tttattaatgcctctcccgca

SEQ ID NO: 2856293 - DNA, 15 bp, Homo sapiens
tttattcactgtaag

SEQ ID NO: 2856294 - DNA, 16 bp, Homo sapiens
tttattcactgtaagt

SEQ ID NO: 2856295 - DNA, 17 bp, Homo sapiens
tttattgcttgatactt

SEQ ID NO: 2856296 - DNA, 21 bp, Homo sapiens
tttattgtcattactgccttt

SEQ ID NO: 2856297 - DNA, 13 bp, Homo sapiens
tttattgtgatct

SEQ ID NO: 2856298 - DNA, 14 bp, Homo sapiens
tttatttattcact

SEQ ID NO: 2856299 - DNA, 13 bp, Homo sapiens
tttatttgttgag

SEQ ID NO: 2856300 - DNA, 21 bp, Homo sapiens
tttattttaaaacagaagaat

SEQ ID NO: 2856301 - DNA, 23 bp, Homo sapiens
tttattttgtatttttgaataaa

SEQ ID NO: 2856302 - DNA, 15 bp, Homo sapiens
tttattttttaatca

SEQ ID NO: 2856303 - DNA, 17 bp, Homo sapiens
tttcaaaaattacacta

SEQ ID NO: 2856304 - DNA, 23 bp, Homo sapiens
tttcaaaagtggattttcctgaa

SEQ ID NO: 2856305 - DNA, 17 bp, Homo sapiens
tttcaaaataaactggg

SEQ ID NO: 2856306 - DNA, 12 bp, Homo sapiens
tttcaaccagca

SEQ ID NO: 2856307 - DNA, 14 bp, Homo sapiens
tttcaaccagcatt

SEQ ID NO: 2856308 - DNA, 20 bp, Homo sapiens
tttcaaccagcattttacta

SEQ ID NO: 2856309 - DNA, 23 bp, Homo sapiens
tttcaacttaaatcactgaggca

SEQ ID NO: 2856310 - DNA, 14 bp, Homo sapiens
tttcaagaaaactg

SEQ ID NO: 2856311 - DNA, 22 bp, Homo sapiens
tttcaagagaagaaaaaattaa

SEQ ID NO: 2856312 - DNA, 21 bp, Homo sapiens
tttcaagtgaatctaaaagct

SEQ ID NO: 2856313 - DNA, 13 bp, Homo sapiens
tttcacagttttt

SEQ ID NO: 2856314 - DNA, 15 bp, Homo sapiens
tttcacattaatatt

SEQ ID NO: 2856315 - DNA, 22 bp, Homo sapiens
tttcacctggaagcatttgttt

SEQ ID NO: 2856316 - DNA, 24 bp, Homo sapiens
tttcactcttattgcccacgctgg

SEQ ID NO: 2856317 - DNA, 10 bp, Homo sapiens
tttcagaccc

SEQ ID NO: 2856318 - DNA, 23 bp, Homo sapiens
tttcagagtgacacccaagaggg

SEQ ID NO: 2856319 - DNA, 20 bp, Homo sapiens
tttcagattcccagagcaaa

SEQ ID NO: 2856320 - DNA, 16 bp, Homo sapiens
tttcagcactcagaaa

SEQ ID NO: 2856321 - DNA, 23 bp, Homo sapiens
tttcagctattagcaactgtgct

SEQ ID NO: 2856322 - DNA, 16 bp, Homo sapiens
tttcaggatactctgt

SEQ ID NO: 2856323 - DNA, 21 bp, Homo sapiens
tttcaggatactctgtcagat

SEQ ID NO: 2856324 - DNA, 18 bp, Homo sapiens
tttcaggtgtttagttgc

SEQ ID NO: 2856325 - DNA, 21 bp, Homo sapiens
tttcagttgatcactggcaat

SEQ ID NO: 2856326 - DNA, 22 bp, Homo sapiens
tttcatctcatttaagggaaaa

SEQ ID NO: 2856327 - DNA, 23 bp, Homo sapiens
tttcatctcatttaagggaaaaa

SEQ ID NO: 2856328 - DNA, 13 bp, Homo sapiens
tttcattaaagca

SEQ ID NO: 2856329 - DNA, 23 bp, Homo sapiens
tttcattgagggaaaacataata

SEQ ID NO: 2856330 - DNA, 22 bp, Homo sapiens
tttcattgatatgaaaaatatg

SEQ ID NO: 2856331 - DNA, 14 bp, Homo sapiens
tttcatttcaactg

SEQ ID NO: 2856332 - DNA, 13 bp, Homo sapiens
tttccaagagctg

SEQ ID NO: 2856333 - DNA, 10 bp, Homo sapiens
aaaaaacatt

SEQ ID NO: 2856334 - DNA, 16 bp, Homo sapiens
aaaaaatgtatatgca

SEQ ID NO: 2856335 - DNA, 14 bp, Homo sapiens
aaaaacaattaact

SEQ ID NO: 2856336 - DNA, 20 bp, Homo sapiens
aaaaatgagagctgtaactg

SEQ ID NO: 2856337 - DNA, 12 bp, Homo sapiens
aaaaattaaaat

SEQ ID NO: 2856338 - DNA, 16 bp, Homo sapiens
aaaaattatgcaattc

SEQ ID NO: 2856339 - DNA, 13 bp, Homo sapiens
aaaacatttatga

SEQ ID NO: 2856340 - DNA, 21 bp, Homo sapiens
aaaaccatttttgaaccttaa

SEQ ID NO: 2856341 - DNA, 18 bp, Homo sapiens
aaaactcttaagtcctaa

SEQ ID NO: 2856342 - DNA, 14 bp, Homo sapiens
aaaagaaatatatt

SEQ ID NO: 2856343 - DNA, 16 bp, Homo sapiens
aaaagaaatatatttt

SEQ ID NO: 2856344 - DNA, 14 bp, Homo sapiens
aaaataaaatgttt

SEQ ID NO: 2856345 - DNA, 18 bp, Homo sapiens
aaaatagaataattcttt

SEQ ID NO: 2856346 - DNA, 22 bp, Homo sapiens
aaaatccccttcgctgaaattg

SEQ ID NO: 2856347 - DNA, 20 bp, Homo sapiens
aaaatctgtcacgtagaact

SEQ ID NO: 2856348 - DNA, 17 bp, Homo sapiens
aaaatgggagccaggag

SEQ ID NO: 2856349 - DNA, 24 bp, Homo sapiens
aaaatggtcctatttttgtgaaga

SEQ ID NO: 2856350 - DNA, 17 bp, Homo sapiens
aaaatgtatatgcactt

SEQ ID NO: 2856351 - DNA, 21 bp, Homo sapiens
aaaatgtatccaaggaaacat

SEQ ID NO: 2856352 - DNA, 15 bp, Homo sapiens
aaaatgtttcattat

SEQ ID NO: 2856353 - DNA, 23 bp, Homo sapiens
aaaattatgcaattcagtgttcc

SEQ ID NO: 2856354 - DNA, 19 bp, Homo sapiens
aaaattatgttactgtatt

SEQ ID NO: 2856355 - DNA, 13 bp, Homo sapiens
aaaattatttgca

SEQ ID NO: 2856356 - DNA, 20 bp, Homo sapiens
aaaatttgccaatctttcct

SEQ ID NO: 2856357 - DNA, 16 bp, Homo sapiens
aaacaaagtactcttt

SEQ ID NO: 2856358 - DNA, 22 bp, Homo sapiens
aaacaaataatttgaactttgg

SEQ ID NO: 2856359 - DNA, 13 bp, Homo sapiens
aaacactgtgcac

SEQ ID NO: 2856360 - DNA, 15 bp, Homo sapiens
aaacagttgctgtga

SEQ ID NO: 2856361 - DNA, 16 bp, Homo sapiens
aaacagttgctgtgaa

SEQ ID NO: 2856362 - DNA, 14 bp, Homo sapiens
aaacatttatgaca

SEQ ID NO: 2856363 - DNA, 16 bp, Homo sapiens
aaacatttatgacaag

SEQ ID NO: 2856364 - DNA, 16 bp, Homo sapiens
aaacattttatcatta

SEQ ID NO: 2856365 - DNA, 22 bp, Homo sapiens
aaacattttatcattaaaaatt

SEQ ID NO: 2856366 - DNA, 18 bp, Homo sapiens
aaaccagttaagaatgga

SEQ ID NO: 2856367 - DNA, 21 bp, Homo sapiens
aaaccagttaagaatggaaga

SEQ ID NO: 2856368 - DNA, 19 bp, Homo sapiens
aaacccattaggcatgcct

SEQ ID NO: 2856369 - DNA, 22 bp, Homo sapiens
aaacctgtattactgaataata

SEQ ID NO: 2856370 - DNA, 16 bp, Homo sapiens
aaaccttattgtacct

SEQ ID NO: 2856371 - DNA, 13 bp, Homo sapiens
aaaccttttgaaa

SEQ ID NO: 2856372 - DNA, 18 bp, Homo sapiens
aaacgaaaacctgactag

SEQ ID NO: 2856373 - DNA, 18 bp, Homo sapiens
aaactagggccaagccca

SEQ ID NO: 2856374 - DNA, 17 bp, Homo sapiens
aaactatgttcctaaca

SEQ ID NO: 2856375 - DNA, 12 bp, Homo sapiens
aaactgtgcacc

SEQ ID NO: 2856376 - DNA, 19 bp, Homo sapiens
aaagaatccctgcagcctg

SEQ ID NO: 2856377 - DNA, 13 bp, Homo sapiens
aaagactgcagaa

SEQ ID NO: 2856378 - DNA, 15 bp, Homo sapiens
aaagactgcagaacc

SEQ ID NO: 2856379 - DNA, 20 bp, Homo sapiens
aaagcacaatttaaaacaat

SEQ ID NO: 2856380 - DNA, 14 bp, Homo sapiens
aaagcctaaaattg

SEQ ID NO: 2856381 - DNA, 15 bp, Homo sapiens
aaagccttctggatc

SEQ ID NO: 2856382 - DNA, 16 bp, Homo sapiens
aaagccttctggatcc

SEQ ID NO: 2856383 - DNA, 15 bp, Homo sapiens
aaagctaaagtttgg

SEQ ID NO: 2856384 - DNA, 22 bp, Homo sapiens
aaaggcaagcttgaggccaaga

SEQ ID NO: 2856385 - DNA, 22 bp, Homo sapiens
aaaggcagctaagatagaaagc

SEQ ID NO: 2856386 - DNA, 14 bp, Homo sapiens
aaaggcttggctgg

SEQ ID NO: 2856387 - DNA, 15 bp, Homo sapiens
aaagtacaaatgaag

SEQ ID NO: 2856388 - DNA, 19 bp, Homo sapiens
aaagtactaatagaacttg

SEQ ID NO: 2856389 - DNA, 13 bp, Homo sapiens
aaagtactcttta

SEQ ID NO: 2856390 - DNA, 21 bp, Homo sapiens
aaagtacttgactacctactg

SEQ ID NO: 2856391 - DNA, 18 bp, Homo sapiens
aaagtagtgttgtccagg

SEQ ID NO: 2856392 - DNA, 16 bp, Homo sapiens
aaagtcaaaaaattat

SEQ ID NO: 2856393 - DNA, 21 bp, Homo sapiens
aaagttctgtactcaaatgta

SEQ ID NO: 2856394 - DNA, 17 bp, Homo sapiens
aaataaattatattaat

SEQ ID NO: 2856395 - DNA, 19 bp, Homo sapiens
aaataaatttggttctaat

SEQ ID NO: 2856396 - DNA, 22 bp, Homo sapiens
aaataactgtgtggcagttaat

SEQ ID NO: 2856397 - DNA, 14 bp, Homo sapiens
aaatacatttgtaa

SEQ ID NO: 2856398 - DNA, 15 bp, Homo sapiens
aaataccattcacta

SEQ ID NO: 2856399 - DNA, 18 bp, Homo sapiens
aaatagaataattctttt

SEQ ID NO: 2856400 - DNA, 23 bp, Homo sapiens
aaatagtgtcatataaactcatt

SEQ ID NO: 2856401 - DNA, 22 bp, Homo sapiens
aaatataatgttgataatatat

SEQ ID NO: 2856402 - DNA, 16 bp, Homo sapiens
aaatatacattttcta

SEQ ID NO: 2856403 - DNA, 20 bp, Homo sapiens
aaatatacattttctaaata

SEQ ID NO: 2856404 - DNA, 15 bp, Homo sapiens
aaatatcataaagca

SEQ ID NO: 2856405 - DNA, 19 bp, Homo sapiens
aaatattccctagaaactt

SEQ ID NO: 2856406 - DNA, 13 bp, Homo sapiens
aaatcaaactgct

SEQ ID NO: 2856407 - DNA, 16 bp, Homo sapiens
aaatccagtttcccac

SEQ ID NO: 2856408 - DNA, 12 bp, Homo sapiens
aaatgaactttg

SEQ ID NO: 2856409 - DNA, 12 bp, Homo sapiens
aaatgatgttat

SEQ ID NO: 2856410 - DNA, 13 bp, Homo sapiens
aaatgccagagcc

SEQ ID NO: 2856411 - DNA, 20 bp, Homo sapiens
aaatgtacgtcatttgtgca

SEQ ID NO: 2856412 - DNA, 12 bp, Homo sapiens
aaatgtcttgtg

SEQ ID NO: 2856413 - DNA, 21 bp, Homo sapiens
aaatgtgatgaatactgtatt

SEQ ID NO: 2856414 - DNA, 14 bp, Homo sapiens
aaatgtggtctgcc

SEQ ID NO: 2856415 - DNA, 22 bp, Homo sapiens
aaatgtggtctgccaatctgta

SEQ ID NO: 2856416 - DNA, 16 bp, Homo sapiens
aaatgtgtaataatgt

SEQ ID NO: 2856417 - DNA, 19 bp, Homo sapiens
aaattaaaacaaatataca

SEQ ID NO: 2856418 - DNA, 20 bp, Homo sapiens
aaattacctttaattttaat

SEQ ID NO: 2856419 - DNA, 21 bp, Homo sapiens
aaattacctttaattttaatg

SEQ ID NO: 2856420 - DNA, 20 bp, Homo sapiens
aaatttgccaatctttccta

SEQ ID NO: 2856421 - DNA, 13 bp, Homo sapiens
aacaaaaattgtc

SEQ ID NO: 2856422 - DNA, 15 bp, Homo sapiens
aacaaacaaaactct

SEQ ID NO: 2856423 - DNA, 18 bp, Homo sapiens
aacaaataatttgaactt

SEQ ID NO: 2856424 - DNA, 20 bp, Homo sapiens
aacaaataatttgaactttg

SEQ ID NO: 2856425 - DNA, 15 bp, Homo sapiens
aagatggctgctgcc

SEQ ID NO: 2856426 - DNA, 23 bp, Homo sapiens
aagcaatgtgagtcccagagccc

SEQ ID NO: 2856427 - DNA, 17 bp, Homo sapiens
aagcaggaaggatggca

SEQ ID NO: 2856428 - DNA, 14 bp, Homo sapiens
aagcattgcctgga

SEQ ID NO: 2856429 - DNA, 19 bp, Homo sapiens
aagcattgcctggactgac

SEQ ID NO: 2856430 - DNA, 20 bp, Homo sapiens
aagcattgcctggactgacc

SEQ ID NO: 2856431 - DNA, 22 bp, Homo sapiens
aagcattgcctggactgaccac

SEQ ID NO: 2856432 - DNA, 14 bp, Homo sapiens
aagccaaaggcagc

SEQ ID NO: 2856433 - DNA, 18 bp, Homo sapiens
aagccacttaaaatgttc

SEQ ID NO: 2856434 - DNA, 14 bp, Homo sapiens
aagccagcgtcctc

SEQ ID NO: 2856435 - DNA, 20 bp, Homo sapiens
aagcccagcactgcttgagg

SEQ ID NO: 2856436 - DNA, 16 bp, Homo sapiens
aagccgactctggccc

SEQ ID NO: 2856437 - DNA, 17 bp, Homo sapiens
aagccgactctggccct

SEQ ID NO: 2856438 - DNA, 22 bp, Homo sapiens
aagcctagtgaaggcttctctc

SEQ ID NO: 2856439 - DNA, 16 bp, Homo sapiens
aagcctccgctgggct

SEQ ID NO: 2856440 - DNA, 17 bp, Homo sapiens
aagcctccgctgggctt

SEQ ID NO: 2856441 - DNA, 19 bp, Homo sapiens
aagccttctggatccatgg

SEQ ID NO: 2856442 - DNA, 20 bp, Homo sapiens
aagctgggcatgaacgcact

SEQ ID NO: 2856443 - DNA, 19 bp, Homo sapiens
aagctgggggaagggtggt

SEQ ID NO: 2856444 - DNA, 18 bp, Homo sapiens
aagctgtatcactgcctt

SEQ ID NO: 2856445 - DNA, 21 bp, Homo sapiens
aagctgttattcttgttatac

SEQ ID NO: 2856446 - DNA, 23 bp, Homo sapiens
aagctgtttccatagggtgacac

SEQ ID NO: 2856447 - DNA, 14 bp, Homo sapiens
aagcttgagcctcc

SEQ ID NO: 2856448 - DNA, 13 bp, Homo sapiens
aagcttgaggcca

SEQ ID NO: 2856449 - DNA, 19 bp, Homo sapiens
aagcttgaggccaagatgg

SEQ ID NO: 2856450 - DNA, 21 bp, Homo sapiens
aagcttgaggccaagatggct

SEQ ID NO: 2856451 - DNA, 19 bp, Homo sapiens
aaggagccccattcctggg

SEQ ID NO: 2856452 - DNA, 23 bp, Homo sapiens
aaggatccagagacttggggacc

SEQ ID NO: 2856453 - DNA, 15 bp, Homo sapiens
aaggatggcaagcac

SEQ ID NO: 2856454 - DNA, 22 bp, Homo sapiens
aaggattgttgggcttggggga

SEQ ID NO: 2856455 - DNA, 20 bp, Homo sapiens
aaggcaaacccatcaacaaa

SEQ ID NO: 2856456 - DNA, 19 bp, Homo sapiens
aaggctgtgtttagattgt

SEQ ID NO: 2856457 - DNA, 20 bp, Homo sapiens
aaggctgtgtttagattgta

SEQ ID NO: 2856458 - DNA, 20 bp, Homo sapiens
aagggaagaaggaggaatgc

SEQ ID NO: 2856459 - DNA, 12 bp, Homo sapiens
aagggaagtggg

SEQ ID NO: 2856460 - DNA, 15 bp, Homo sapiens
aagggattctgggaa

SEQ ID NO: 2856461 - DNA, 11 bp, Homo sapiens
aagggggtggg

SEQ ID NO: 2856462 - DNA, 16 bp, Homo sapiens
aagggggtggggggag

SEQ ID NO: 2856463 - DNA, 17 bp, Homo sapiens
aagggggtggggggagt

SEQ ID NO: 2856464 - DNA, 12 bp, Homo sapiens
aaggtgaacttt

SEQ ID NO: 2856465 - DNA, 13 bp, Homo sapiens
aagtaaaacagtc

SEQ ID NO: 2856466 - DNA, 17 bp, Homo sapiens
aagtaaaacagtcatct

SEQ ID NO: 2856467 - DNA, 19 bp, Homo sapiens
aagtaacaatctatggctt

SEQ ID NO: 2856468 - DNA, 17 bp, Homo sapiens
aagtacaaatgaagaaa

SEQ ID NO: 2856469 - DNA, 20 bp, Homo sapiens
ataaagctgttattcttgtt

SEQ ID NO: 2856470 - DNA, 23 bp, Homo sapiens
ataaagctgttattcttgttata

SEQ ID NO: 2856471 - DNA, 13 bp, Homo sapiens
ataaagtacaaat

SEQ ID NO: 2856472 - DNA, 23 bp, Homo sapiens
ataaagtacaaatgaagaaagtc

SEQ ID NO: 2856473 - DNA, 14 bp, Homo sapiens
ataaatgccagagc

SEQ ID NO: 2856474 - DNA, 15 bp, Homo sapiens
ataacaattcctcta

SEQ ID NO: 2856475 - DNA, 22 bp, Homo sapiens
ataactctaaccaaggctgtgt

SEQ ID NO: 2856476 - DNA, 18 bp, Homo sapiens
ataagaaagcctaaaatt

SEQ ID NO: 2856477 - DNA, 16 bp, Homo sapiens
ataataaagtacttga

SEQ ID NO: 2856478 - DNA, 18 bp, Homo sapiens
ataataaagtacttgact

SEQ ID NO: 2856479 - DNA, 15 bp, Homo sapiens
ataataggccacaga

SEQ ID NO: 2856480 - DNA, 17 bp, Homo sapiens
ataatatcaaataaaat

SEQ ID NO: 2856481 - DNA, 19 bp, Homo sapiens
ataatatcaaataaaatat

SEQ ID NO: 2856482 - DNA, 13 bp, Homo sapiens
ataatcagtaaat

SEQ ID NO: 2856483 - DNA, 14 bp, Homo sapiens
ataatcagtaaata

SEQ ID NO: 2856484 - DNA, 18 bp, Homo sapiens
ataatgggattagaaaca

SEQ ID NO: 2856485 - DNA, 19 bp, Homo sapiens
ataatgggattagaaacaa

SEQ ID NO: 2856486 - DNA, 16 bp, Homo sapiens
aatgggattagaaaca

SEQ ID NO: 2856487 - DNA, 17 bp, Homo sapiens
aatggtgtggtgaatgt

SEQ ID NO: 2856488 - DNA, 23 bp, Homo sapiens
aatgtatccaaggaaacatttta

SEQ ID NO: 2856489 - DNA, 17 bp, Homo sapiens
aatgtatcttattcaca

SEQ ID NO: 2856490 - DNA, 18 bp, Homo sapiens
aatgtatcttattcacat

SEQ ID NO: 2856491 - DNA, 17 bp, Homo sapiens
aatgtatgtcagtgcta

SEQ ID NO: 2856492 - DNA, 16 bp, Homo sapiens
aatgtccaaaatttat

SEQ ID NO: 2856493 - DNA, 18 bp, Homo sapiens
aatgtccaaaatttatat

SEQ ID NO: 2856494 - DNA, 22 bp, Homo sapiens
aatgtgaaaatggtccaggaga

SEQ ID NO: 2856495 - DNA, 16 bp, Homo sapiens
aatgtgagtcccagag

SEQ ID NO: 2856496 - DNA, 16 bp, Homo sapiens
aatgtgatgaatactg

SEQ ID NO: 2856497 - DNA, 18 bp, Homo sapiens
aatgtgtgagaaaaacta

SEQ ID NO: 2856498 - DNA, 18 bp, Homo sapiens
aattagtggtcataaaat

SEQ ID NO: 2856499 - DNA, 20 bp, Homo sapiens
aattagtgtgacagtttcca

SEQ ID NO: 2856500 - DNA, 21 bp, Homo sapiens
aattagtgtgacagtttccaa

SEQ ID NO: 2856501 - DNA, 22 bp, Homo sapiens
aattagtgtgacagtttccaaa

SEQ ID NO: 2856502 - DNA, 19 bp, Homo sapiens
aattatgcaattcagtgtt

SEQ ID NO: 2856503 - DNA, 23 bp, Homo sapiens
aattattatgactcaataaaaga

SEQ ID NO: 2856504 - DNA, 12 bp, Homo sapiens
aattcacacctt

SEQ ID NO: 2856505 - DNA, 21 bp, Homo sapiens
aattcacatctaacctcatct

SEQ ID NO: 2856506 - DNA, 15 bp, Homo sapiens
aattccagatttgtt

SEQ ID NO: 2856507 - DNA, 17 bp, Homo sapiens
aattccaggctgagcca

SEQ ID NO: 2856508 - DNA, 18 bp, Homo sapiens
aattccaggctgagccat

SEQ ID NO: 2856509 - DNA, 21 bp, Homo sapiens
aattccaggctgagccatgag

SEQ ID NO: 2856510 - DNA, 17 bp, Homo sapiens
aattgccctatgctgtg

SEQ ID NO: 2856511 - DNA, 21 bp, Homo sapiens
aattgctgataccatatgaat

SEQ ID NO: 2856512 - DNA, 14 bp, Homo sapiens
aattgtaactgttc

SEQ ID NO: 2856513 - DNA, 19 bp, Homo sapiens
aattgtaagtgaaattaag

SEQ ID NO: 2856514 - DNA, 16 bp, Homo sapiens
aattgtcccttaaaca

SEQ ID NO: 2856515 - DNA, 16 bp, Homo sapiens
aatttaactttccagt

SEQ ID NO: 2856516 - DNA, 22 bp, Homo sapiens
aatttagttgagcatagagaac

SEQ ID NO: 2856517 - DNA, 12 bp, Homo sapiens
aatttattcaat

SEQ ID NO: 2856518 - DNA, 21 bp, Homo sapiens
aatttattcaattcctctggg

SEQ ID NO: 2856519 - DNA, 21 bp, Homo sapiens
aatttcaaaatacatttgtaa

SEQ ID NO: 2856520 - DNA, 17 bp, Homo sapiens
aatttctactttgaagt

SEQ ID NO: 2856521 - DNA, 13 bp, Homo sapiens
aatttgagtgctc

SEQ ID NO: 2856522 - DNA, 22 bp, Homo sapiens
aatttggttctaatagaactca

SEQ ID NO: 2856523 - DNA, 16 bp, Homo sapiens
aattttaatgaagaaa

SEQ ID NO: 2856524 - DNA, 16 bp, Homo sapiens
aattttaatgctgttt

SEQ ID NO: 2856525 - DNA, 21 bp, Homo sapiens
aattttgaataaataaatgta

SEQ ID NO: 2856526 - DNA, 14 bp, Homo sapiens
aatttttaactgta

SEQ ID NO: 2856527 - DNA, 19 bp, Homo sapiens
aatttttttcaatatttat

SEQ ID NO: 2856528 - DNA, 22 bp, Homo sapiens
acaaaataaccaatcctggaca

SEQ ID NO: 2856529 - DNA, 22 bp, Homo sapiens
acaaactcatcctcttttaatg

SEQ ID NO: 2856530 - DNA, 20 bp, Homo sapiens
acaaagtaaaagtagtgttg

SEQ ID NO: 2856531 - DNA, 23 bp, Homo sapiens
acaaagtactctttaacatacaa

SEQ ID NO: 2856532 - DNA, 17 bp, Homo sapiens
acaaatactcttaggaa

SEQ ID NO: 2856533 - DNA, 23 bp, Homo sapiens
acaaatactcttaggaagagaaa

SEQ ID NO: 2856534 - DNA, 20 bp, Homo sapiens
acaaatgctcccacctgaat

SEQ ID NO: 2856535 - DNA, 22 bp, Homo sapiens
acaaattcaagagctagaaaaa

SEQ ID NO: 2856536 - DNA, 12 bp, Homo sapiens
acaagaaaatgt

SEQ ID NO: 2856537 - DNA, 17 bp, Homo sapiens
acaagctgtatcactgc

SEQ ID NO: 2856538 - DNA, 16 bp, Homo sapiens
acaagggattctggga

SEQ ID NO: 2856539 - DNA, 18 bp, Homo sapiens
acaagggattctgggaag

SEQ ID NO: 2856540 - DNA, 18 bp, Homo sapiens
acaatcagctccttcctg

SEQ ID NO: 2856541 - DNA, 20 bp, Homo sapiens
acaatctatggcttatttct

SEQ ID NO: 2856542 - DNA, 16 bp, Homo sapiens
acaatctgggactttc

SEQ ID NO: 2856543 - DNA, 19 bp, Homo sapiens
acaatgccttgggagagat

SEQ ID NO: 2856544 - DNA, 12 bp, Homo sapiens
acaattaactgc

SEQ ID NO: 2856545 - DNA, 13 bp, Homo sapiens
acaattaactgcc

SEQ ID NO: 2856546 - DNA, 22 bp, Homo sapiens
acaatttaaaacaatccttact

SEQ ID NO: 2856547 - DNA, 16 bp, Homo sapiens
acacaatttatactgc

SEQ ID NO: 2856548 - DNA, 22 bp, Homo sapiens
acacagttgaattttttctaaa

SEQ ID NO: 2856549 - DNA, 15 bp, Homo sapiens
acaccaaccaggcct

SEQ ID NO: 2856550 - DNA, 17 bp, Homo sapiens
acactatggtatttgag

SEQ ID NO: 2856551 - DNA, 13 bp, Homo sapiens
acactatttgtga

SEQ ID NO: 2856552 - DNA, 16 bp, Homo sapiens
acactccacattcttc

SEQ ID NO: 2856553 - DNA, 16 bp, Homo sapiens
acactgcggaagccaa

SEQ ID NO: 2856554 - DNA, 16 bp, Homo sapiens
acactgtcaaacaggt

SEQ ID NO: 2856555 - DNA, 16 bp, Homo sapiens
acactgtccttccctg

SEQ ID NO: 2856556 - DNA, 17 bp, Homo sapiens
acactgtccttccctgc

SEQ ID NO: 2856557 - DNA, 18 bp, Homo sapiens
acactgtccttccctgcc

SEQ ID NO: 2856558 - DNA, 21 bp, Homo sapiens
acactgtccttccctgccact

SEQ ID NO: 2856559 - DNA, 19 bp, Homo sapiens
acactttgccatattttca

SEQ ID NO: 2856560 - DNA, 12 bp, Homo sapiens
acagaaagcctc

SEQ ID NO: 2856561 - DNA, 13 bp, Homo sapiens
acagaaagcctcc

SEQ ID NO: 2856562 - DNA, 21 bp, Homo sapiens
acagaaagcctccgctgggct

SEQ ID NO: 2856563 - DNA, 22 bp, Homo sapiens
acagaaagcctccgctgggctt

SEQ ID NO: 2856564 - DNA, 20 bp, Homo sapiens
acagaactctttcaaaacct

SEQ ID NO: 2856565 - DNA, 16 bp, Homo sapiens
acagaaggtgaacttt

SEQ ID NO: 2856566 - DNA, 14 bp, Homo sapiens
acagacacaattta

SEQ ID NO: 2856567 - DNA, 15 bp, Homo sapiens
acagacccacacatg

SEQ ID NO: 2856568 - DNA, 14 bp, Homo sapiens
acagacctggctct

SEQ ID NO: 2856569 - DNA, 17 bp, Homo sapiens
acagagagtcctttggg

SEQ ID NO: 2856570 - DNA, 14 bp, Homo sapiens
acagagcttccctg

SEQ ID NO: 2856571 - DNA, 15 bp, Homo sapiens
acagagcttccctga

SEQ ID NO: 2856572 - DNA, 14 bp, Homo sapiens
acagccagcaagag

SEQ ID NO: 2856573 - DNA, 13 bp, Homo sapiens
acagcccagagcc

SEQ ID NO: 2856574 - DNA, 18 bp, Homo sapiens
acagcctcccctgccagg

SEQ ID NO: 2856575 - DNA, 19 bp, Homo sapiens
acagcctcccctgccaggg

SEQ ID NO: 2856576 - DNA, 18 bp, Homo sapiens
acagctcaagcattctgt

SEQ ID NO: 2856577 - DNA, 21 bp, Homo sapiens
acagctcaagcattctgttta

SEQ ID NO: 2856578 - DNA, 20 bp, Homo sapiens
acaggagccccacccccatg

SEQ ID NO: 2856579 - DNA, 22 bp, Homo sapiens
acaggagccccacccccatgca

SEQ ID NO: 2856580 - DNA, 20 bp, Homo sapiens
acaggcacattaactgttgc

SEQ ID NO: 2856581 - DNA, 21 bp, Homo sapiens
acagggacttgtttagagagc

SEQ ID NO: 2856582 - DNA, 21 bp, Homo sapiens
acaggtttttagtttgttctt

SEQ ID NO: 2856583 - DNA, 22 bp, Homo sapiens
acagtaggagcccagctctgaa

SEQ ID NO: 2856584 - DNA, 12 bp, Homo sapiens
acagtcactgga

SEQ ID NO: 2856585 - DNA, 21 bp, Homo sapiens
acagtcatctagaattcactg

SEQ ID NO: 2856586 - DNA, 14 bp, Homo sapiens
acagtttccaaatt

SEQ ID NO: 2856587 - DNA, 16 bp, Homo sapiens
acagtttttgacattt

SEQ ID NO: 2856588 - DNA, 20 bp, Homo sapiens
acagtttttgacatttatat

SEQ ID NO: 2856589 - DNA, 19 bp, Homo sapiens
acatatgctgatcttttaa

SEQ ID NO: 2856590 - DNA, 23 bp, Homo sapiens
acatatgctgatcttttaaaatc

SEQ ID NO: 2856591 - DNA, 19 bp, Homo sapiens
acatatttgtatgtttttc

SEQ ID NO: 2856592 - DNA, 16 bp, Homo sapiens
acatctaacctcatct

SEQ ID NO: 2856593 - DNA, 17 bp, Homo sapiens
acatgaagattctttcc

SEQ ID NO: 2856594 - DNA, 18 bp, Homo sapiens
acatgaagattctttccc

SEQ ID NO: 2856595 - DNA, 22 bp, Homo sapiens
acatgaagattctttcccaatt

SEQ ID NO: 2856596 - DNA, 19 bp, Homo sapiens
atctcccagataatgtgaa

SEQ ID NO: 2856597 - DNA, 16 bp, Homo sapiens
atctcctgccttcctc

SEQ ID NO: 2856598 - DNA, 17 bp, Homo sapiens
atctcctgccttcctcc

SEQ ID NO: 2856599 - DNA, 20 bp, Homo sapiens
atctcctgccttcctcctgg

SEQ ID NO: 2856600 - DNA, 17 bp, Homo sapiens
atctgaccatctgtgac

SEQ ID NO: 2856601 - DNA, 12 bp, Homo sapiens
atctgcaggctg

SEQ ID NO: 2856602 - DNA, 13 bp, Homo sapiens
atctgcaggctgc

SEQ ID NO: 2856603 - DNA, 19 bp, Homo sapiens
atctggctttttctgccac

SEQ ID NO: 2856604 - DNA, 20 bp, Homo sapiens
atctggctttttctgccact

SEQ ID NO: 2856605 - DNA, 16 bp, Homo sapiens
atctggggctctggga

SEQ ID NO: 2856606 - DNA, 22 bp, Homo sapiens
atctggttagataatgaatgat

SEQ ID NO: 2856607 - DNA, 18 bp, Homo sapiens
atctgtgactataaagct

SEQ ID NO: 2856608 - DNA, 13 bp, Homo sapiens
atcttattcacat

SEQ ID NO: 2856609 - DNA, 19 bp, Homo sapiens
atcttggggctgatgaaga

SEQ ID NO: 2856610 - DNA, 20 bp, Homo sapiens
atcttggggctgatgaagaa

SEQ ID NO: 2856611 - DNA, 15 bp, Homo sapiens
atcttgtctctgggc

SEQ ID NO: 2856612 - DNA, 19 bp, Homo sapiens
atctttatatttcaataaa

SEQ ID NO: 2856613 - DNA, 20 bp, Homo sapiens
atctttatatttcaataaat

SEQ ID NO: 2856614 - DNA, 17 bp, Homo sapiens
atcttttaaaatcatga

SEQ ID NO: 2856615 - DNA, 15 bp, Homo sapiens
atcttttttagtgtt

SEQ ID NO: 2856616 - DNA, 21 bp, Homo sapiens
atcttttttagtgttaaagag

SEQ ID NO: 2856617 - DNA, 16 bp, Homo sapiens
atgaaaaaatgtatat

SEQ ID NO: 2856618 - DNA, 13 bp, Homo sapiens
atgaaaaaccatt

SEQ ID NO: 2856619 - DNA, 13 bp, Homo sapiens
atgaaaaatataa

SEQ ID NO: 2856620 - DNA, 21 bp, Homo sapiens
atgaaacatgggctgtgatta

SEQ ID NO: 2856621 - DNA, 18 bp, Homo sapiens
atgaagaaagtcaaaaaa

SEQ ID NO: 2856622 - DNA, 21 bp, Homo sapiens
atgaagaaagtcaaaaaatta

SEQ ID NO: 2856623 - DNA, 18 bp, Homo sapiens
atgaagtctgagggaaac

SEQ ID NO: 2856624 - DNA, 20 bp, Homo sapiens
atgaagtctgagggaaacca

SEQ ID NO: 2856625 - DNA, 22 bp, Homo sapiens
atgaagtctgagggaaaccaga

SEQ ID NO: 2856626 - DNA, 21 bp, Homo sapiens
atgaatactgtattttgtatt

SEQ ID NO: 2856627 - DNA, 14 bp, Homo sapiens
atgacaagctgtat

SEQ ID NO: 2856628 - DNA, 16 bp, Homo sapiens
atgacaagctgtatca

SEQ ID NO: 2856629 - DNA, 20 bp, Homo sapiens
atgacaagctgtatcactgc

SEQ ID NO: 2856630 - DNA, 18 bp, Homo sapiens
atgacatttatttttcat

SEQ ID NO: 2856631 - DNA, 14 bp, Homo sapiens
atgaggagcgtgga

SEQ ID NO: 2856632 - DNA, 12 bp, Homo sapiens
atgatgacaatc

SEQ ID NO: 2856633 - DNA, 23 bp, Homo sapiens
atgatttccctccagagaaagca

SEQ ID NO: 2856634 - DNA, 17 bp, Homo sapiens
atgcaagtgagaagctg

SEQ ID NO: 2856635 - DNA, 23 bp, Homo sapiens
atgcaatgcttcattattcaaga

SEQ ID NO: 2856636 - DNA, 19 bp, Homo sapiens
atgcaattcagtgttccaa

SEQ ID NO: 2856637 - DNA, 15 bp, Homo sapiens
atgcacttttagaaa

SEQ ID NO: 2856638 - DNA, 20 bp, Homo sapiens
atgcacttttagaaatgcat

SEQ ID NO: 2856639 - DNA, 17 bp, Homo sapiens
atgcatgcactgttccc

SEQ ID NO: 2856640 - DNA, 21 bp, Homo sapiens
atgccagagccaacctggact

SEQ ID NO: 2856641 - DNA, 23 bp, Homo sapiens
atgccagagccaacctggacttc

SEQ ID NO: 2856642 - DNA, 18 bp, Homo sapiens
atgcctcaagaacacctt

SEQ ID NO: 2856643 - DNA, 21 bp, Homo sapiens
atgcctcagtagcatctcagt

SEQ ID NO: 2856644 - DNA, 13 bp, Homo sapiens
atgctaaatgtgt

SEQ ID NO: 2856645 - DNA, 16 bp, Homo sapiens
atgctaaatgtgtaat

SEQ ID NO: 2856646 - DNA, 17 bp, Homo sapiens
atgctaaatgtgtaata

SEQ ID NO: 2856647 - DNA, 13 bp, Homo sapiens
atgctacttccca

SEQ ID NO: 2856648 - DNA, 15 bp, Homo sapiens
atgctgatcttttaa

SEQ ID NO: 2856649 - DNA, 22 bp, Homo sapiens
atgctggactggaggcccctgg

SEQ ID NO: 2856650 - DNA, 18 bp, Homo sapiens
atgctgtgctccatattt

SEQ ID NO: 2856651 - DNA, 13 bp, Homo sapiens
atgctgtttctaa

SEQ ID NO: 2856652 - DNA, 15 bp, Homo sapiens
atgctgtttctaaga

SEQ ID NO: 2856653 - DNA, 24 bp, Homo sapiens
atgctgtttctaagaaaatgtagt

SEQ ID NO: 2856654 - DNA, 19 bp, Homo sapiens
atggagtgggagatcagcc

SEQ ID NO: 2856655 - DNA, 20 bp, Homo sapiens
atggagtgggagatcagcca

SEQ ID NO: 2856656 - DNA, 13 bp, Homo sapiens
atggcagaaggca

SEQ ID NO: 2856657 - DNA, 16 bp, Homo sapiens
atggcatcttcaatat

SEQ ID NO: 2856658 - DNA, 13 bp, Homo sapiens
atggcatttctct

SEQ ID NO: 2856659 - DNA, 21 bp, Homo sapiens
atggcttatttctatgacaaa

SEQ ID NO: 2856660 - DNA, 22 bp, Homo sapiens
atggcttatttctatgacaaat

SEQ ID NO: 2856661 - DNA, 14 bp, Homo sapiens
atggtaatagcttt

SEQ ID NO: 2856662 - DNA, 18 bp, Homo sapiens
atggtcagccctagggtg

SEQ ID NO: 2856663 - DNA, 23 bp, Homo sapiens
atggtcctatttttgtgaagagg

SEQ ID NO: 2856664 - DNA, 15 bp, Homo sapiens
atgtaaataactcta

SEQ ID NO: 2856665 - DNA, 19 bp, Homo sapiens
atgtaatcttgaattgtaa

SEQ ID NO: 2856666 - DNA, 16 bp, Homo sapiens
atgtaatttcaaaata

SEQ ID NO: 2856667 - DNA, 14 bp, Homo sapiens
atgtagaaaatttg

SEQ ID NO: 2856668 - DNA, 21 bp, Homo sapiens
atgtatttctatatagacttg

SEQ ID NO: 2856669 - DNA, 20 bp, Homo sapiens
atgtcagctgctgttgaact

SEQ ID NO: 2856670 - DNA, 21 bp, Homo sapiens
atgtcagctgctgttgaactt

SEQ ID NO: 2856671 - DNA, 17 bp, Homo sapiens
atgtccttaaaatgtgg

SEQ ID NO: 2856672 - DNA, 14 bp, Homo sapiens
atgtgacccaccag

SEQ ID NO: 2856673 - DNA, 16 bp, Homo sapiens
atgtgacccaccagtg

SEQ ID NO: 2856674 - DNA, 19 bp, Homo sapiens
atgtgacccaccagtgcct

SEQ ID NO: 2856675 - DNA, 15 bp, Homo sapiens
atgtggtctgccaat

SEQ ID NO: 2856676 - DNA, 14 bp, Homo sapiens
atgttcacttttga

SEQ ID NO: 2856677 - DNA, 18 bp, Homo sapiens
atgttcacttttgacaaa

SEQ ID NO: 2856678 - DNA, 16 bp, Homo sapiens
atgttcctaacaaaat

SEQ ID NO: 2856679 - DNA, 17 bp, Homo sapiens
atgttcctaacaaaatg

SEQ ID NO: 2856680 - DNA, 19 bp, Homo sapiens
atgttctaagtctttccat

SEQ ID NO: 2856681 - DNA, 16 bp, Homo sapiens
atgtttaaaagaaata

SEQ ID NO: 2856682 - DNA, 14 bp, Homo sapiens
attaaaaaacaatt

SEQ ID NO: 2856683 - DNA, 22 bp, Homo sapiens
attaaaaacgaaaacctgacta

SEQ ID NO: 2856684 - DNA, 13 bp, Homo sapiens
attaacctctcac

SEQ ID NO: 2856685 - DNA, 22 bp, Homo sapiens
attaactatcttctttggactt

SEQ ID NO: 2856686 - DNA, 19 bp, Homo sapiens
attaactgtgaaatgtacg

SEQ ID NO: 2856687 - DNA, 13 bp, Homo sapiens
attaactgttgca

SEQ ID NO: 2856688 - DNA, 21 bp, Homo sapiens
attaagcattttgaaacaaag

SEQ ID NO: 2856689 - DNA, 13 bp, Homo sapiens
attacccaatgga

SEQ ID NO: 2856690 - DNA, 15 bp, Homo sapiens
attacctttaatttt

SEQ ID NO: 2856691 - DNA, 19 bp, Homo sapiens
attacctttaattttaatg

SEQ ID NO: 2856692 - DNA, 16 bp, Homo sapiens
attactgaataatatc

SEQ ID NO: 2856693 - DNA, 16 bp, Homo sapiens
attactgcaatcactg

SEQ ID NO: 2856694 - DNA, 17 bp, Homo sapiens
attactgcaatcactgt

SEQ ID NO: 2856695 - DNA, 18 bp, Homo sapiens
attagaaacaaacaaaac

SEQ ID NO: 2856696 - DNA, 13 bp, Homo sapiens
attagataatatt

SEQ ID NO: 2856697 - DNA, 15 bp, Homo sapiens
attagataatatttt

SEQ ID NO: 2856698 - DNA, 16 bp, Homo sapiens
attagtaacatgtgtt

SEQ ID NO: 2856699 - DNA, 20 bp, Homo sapiens
attagtggtcataaaataga

SEQ ID NO: 2856700 - DNA, 21 bp, Homo sapiens
attagtgtgacagtttccaaa

SEQ ID NO: 2856701 - DNA, 23 bp, Homo sapiens
attagtgtgacagtttccaaatt

SEQ ID NO: 2856702 - DNA, 22 bp, Homo sapiens
attataatttttttcaatattt

SEQ ID NO: 2856703 - DNA, 16 bp, Homo sapiens
attatagcaactaatg

SEQ ID NO: 2856704 - DNA, 15 bp, Homo sapiens
attatgtaaataact

SEQ ID NO: 2856705 - DNA, 17 bp, Homo sapiens
attatgtaaataactct

SEQ ID NO: 2856706 - DNA, 14 bp, Homo sapiens
attatgttactgta

SEQ ID NO: 2856707 - DNA, 19 bp, Homo sapiens
caagagggacgcctggggg

SEQ ID NO: 2856708 - DNA, 21 bp, Homo sapiens
caagatattttaaaatctgtc

SEQ ID NO: 2856709 - DNA, 23 bp, Homo sapiens
caagcaggaaatgaaaatgtctt

SEQ ID NO: 2856710 - DNA, 17 bp, Homo sapiens
caagcattctgtttatc

SEQ ID NO: 2856711 - DNA, 14 bp, Homo sapiens
caagccagagtttt

SEQ ID NO: 2856712 - DNA, 13 bp, Homo sapiens
cacttcaaccccc

SEQ ID NO: 2856713 - DNA, 22 bp, Homo sapiens
cacttgaggtcaggagttccta

SEQ ID NO: 2856714 - DNA, 15 bp, Homo sapiens
cactttaaccctctc

SEQ ID NO: 2856715 - DNA, 18 bp, Homo sapiens
cactttaaccctctcttc

SEQ ID NO: 2856716 - DNA, 17 bp, Homo sapiens
cactttcctacaaaatg

SEQ ID NO: 2856717 - DNA, 18 bp, Homo sapiens
cactttcctacaaaatgg

SEQ ID NO: 2856718 - DNA, 11 bp, Homo sapiens
cagaaagcctc

SEQ ID NO: 2856719 - DNA, 21 bp, Homo sapiens
cagaaagcctccgctgggctt

SEQ ID NO: 2856720 - DNA, 15 bp, Homo sapiens
cagaaagggccaccc

SEQ ID NO: 2856721 - DNA, 16 bp, Homo sapiens
cagaaatcaaactgct

SEQ ID NO: 2856722 - DNA, 22 bp, Homo sapiens
cagaacccccaggtggcctgcg

SEQ ID NO: 2856723 - DNA, 16 bp, Homo sapiens
cagaactctttcaaaa

SEQ ID NO: 2856724 - DNA, 15 bp, Homo sapiens
cagaagcattgcctg

SEQ ID NO: 2856725 - DNA, 15 bp, Homo sapiens
cagaataccttcttc

SEQ ID NO: 2856726 - DNA, 23 bp, Homo sapiens
cagaataccttcttcgctgctag

SEQ ID NO: 2856727 - DNA, 17 bp, Homo sapiens
cagaatttttaactgta

SEQ ID NO: 2856728 - DNA, 22 bp, Homo sapiens
cagacattcacctgtatatttc

SEQ ID NO: 2856729 - DNA, 16 bp, Homo sapiens
cagacccacacatgtt

SEQ ID NO: 2856730 - DNA, 16 bp, Homo sapiens
cagacctggctctcag

SEQ ID NO: 2856731 - DNA, 20 bp, Homo sapiens
cagacctggctctcagagga

SEQ ID NO: 2856732 - DNA, 15 bp, Homo sapiens
cagactcagctccag

SEQ ID NO: 2856733 - DNA, 17 bp, Homo sapiens
cagactcagctccagaa

SEQ ID NO: 2856734 - DNA, 15 bp, Homo sapiens
cagagaaagcacaat

SEQ ID NO: 2856735 - DNA, 21 bp, Homo sapiens
cagagaccccttcctttcctc

SEQ ID NO: 2856736 - DNA, 18 bp, Homo sapiens
cagagacttggggaccag

SEQ ID NO: 2856737 - DNA, 17 bp, Homo sapiens
cagagcaattccaggct

SEQ ID NO: 2856738 - DNA, 19 bp, Homo sapiens
cagagcaattccaggctga

SEQ ID NO: 2856739 - DNA, 21 bp, Homo sapiens
cagagcaattccaggctgagc

SEQ ID NO: 2856740 - DNA, 11 bp, Homo sapiens
cagagccaacc

SEQ ID NO: 2856741 - DNA, 15 bp, Homo sapiens
cagagccaacctgga

SEQ ID NO: 2856742 - DNA, 19 bp, Homo sapiens
cagagccaacctggacttc

SEQ ID NO: 2856743 - DNA, 18 bp, Homo sapiens
cagagcccctcctccagc

SEQ ID NO: 2856744 - DNA, 17 bp, Homo sapiens
cagagcctggctgccca

SEQ ID NO: 2856745 - DNA, 23 bp, Homo sapiens
cagaggaaaaatgggagccagga

SEQ ID NO: 2856746 - DNA, 16 bp, Homo sapiens
cagaggaaggggccag

SEQ ID NO: 2856747 - DNA, 19 bp, Homo sapiens
cagaggaaggggccagagg

SEQ ID NO: 2856748 - DNA, 19 bp, Homo sapiens
cagaggactcccaaccctg

SEQ ID NO: 2856749 - DNA, 21 bp, Homo sapiens
cagaggactcccaaccctggc

SEQ ID NO: 2856750 - DNA, 19 bp, Homo sapiens
cagagtttttaaagccttc

SEQ ID NO: 2856751 - DNA, 15 bp, Homo sapiens
cagataacttcttta

SEQ ID NO: 2856752 - DNA, 13 bp, Homo sapiens
cagataatgtgaa

SEQ ID NO: 2856753 - DNA, 22 bp, Homo sapiens
cagattgatagggagttttaaa

SEQ ID NO: 2856754 - DNA, 16 bp, Homo sapiens
cagattggccaattaa

SEQ ID NO: 2856755 - DNA, 14 bp, Homo sapiens
cagcaaattccaga

SEQ ID NO: 2856756 - DNA, 16 bp, Homo sapiens
cagcacctccaggcct

SEQ ID NO: 2856757 - DNA, 19 bp, Homo sapiens
cagcactttaaccctctct

SEQ ID NO: 2856758 - DNA, 17 bp, Homo sapiens
cagcagctcaacctacc

SEQ ID NO: 2856759 - DNA, 19 bp, Homo sapiens
cagcagctcaacctaccct

SEQ ID NO: 2856760 - DNA, 17 bp, Homo sapiens
cagcagggaagctcttt

SEQ ID NO: 2856761 - DNA, 19 bp, Homo sapiens
cagcagggctaccctgagc

SEQ ID NO: 2856762 - DNA, 17 bp, Homo sapiens
cagcagtgtgaggccag

SEQ ID NO: 2856763 - DNA, 14 bp, Homo sapiens
cagcatctgaccat

SEQ ID NO: 2856764 - DNA, 19 bp, Homo sapiens
cagcatctgaccatctgtg

SEQ ID NO: 2856765 - DNA, 17 bp, Homo sapiens
cagcattgtaattatgt

SEQ ID NO: 2856766 - DNA, 14 bp, Homo sapiens
cagcccagagcctg

SEQ ID NO: 2856767 - DNA, 11 bp, Homo sapiens
cagccccaccc

SEQ ID NO: 2856768 - DNA, 22 bp, Homo sapiens
cagccccacccctaagtgccca

SEQ ID NO: 2856769 - DNA, 22 bp, Homo sapiens
cagcccccactttcctacaaaa

SEQ ID NO: 2856770 - DNA, 13 bp, Homo sapiens
cagcccctgtccc

SEQ ID NO: 2856771 - DNA, 14 bp, Homo sapiens
cagcccggggagga

SEQ ID NO: 2856772 - DNA, 14 bp, Homo sapiens
cagccctcatcccg

SEQ ID NO: 2856773 - DNA, 17 bp, Homo sapiens
cagccctcatcccgagc

SEQ ID NO: 2856774 - DNA, 16 bp, Homo sapiens
cagcctcccctgccag

SEQ ID NO: 2856775 - DNA, 17 bp, Homo sapiens
cagcctcccctgccagg

SEQ ID NO: 2856776 - DNA, 18 bp, Homo sapiens
cagcctcccctgccaggg

SEQ ID NO: 2856777 - DNA, 22 bp, Homo sapiens
cagccttattttgttggtgctt

SEQ ID NO: 2856778 - DNA, 13 bp, Homo sapiens
cagccttttcctt

SEQ ID NO: 2856779 - DNA, 16 bp, Homo sapiens
cagcgaggaggctcca

SEQ ID NO: 2856780 - DNA, 17 bp, Homo sapiens
cagcgaggaggctccag

SEQ ID NO: 2856781 - DNA, 22 bp, Homo sapiens
cagcggcagagcaattccaggc

SEQ ID NO: 2856782 - DNA, 15 bp, Homo sapiens
cagcgtcctcctctg

SEQ ID NO: 2856783 - DNA, 16 bp, Homo sapiens
cagcgtcctcctctgt

SEQ ID NO: 2856784 - DNA, 22 bp, Homo sapiens
cagctaagatagaaagctggac

SEQ ID NO: 2856785 - DNA, 14 bp, Homo sapiens
cagctaataaacca

SEQ ID NO: 2856786 - DNA, 15 bp, Homo sapiens
cagctaataaaccag

SEQ ID NO: 2856787 - DNA, 15 bp, Homo sapiens
cagctcttctcttcc

SEQ ID NO: 2856788 - DNA, 18 bp, Homo sapiens
cagctcttctcttcctag

SEQ ID NO: 2856789 - DNA, 18 bp, Homo sapiens
cagctctttccaaattaa

SEQ ID NO: 2856790 - DNA, 23 bp, Homo sapiens
cagctggatgagaatttgagtgc

SEQ ID NO: 2856791 - DNA, 14 bp, Homo sapiens
cagctgggcctcct

SEQ ID NO: 2856792 - DNA, 19 bp, Homo sapiens
cagctgggcctcctgcctc

SEQ ID NO: 2856793 - DNA, 21 bp, Homo sapiens
caggaaaggcttggctggtgt

SEQ ID NO: 2856794 - DNA, 13 bp, Homo sapiens
caggacccagagg

SEQ ID NO: 2856795 - DNA, 16 bp, Homo sapiens
caggacccagaggaag

SEQ ID NO: 2856796 - DNA, 23 bp, Homo sapiens
caggcaaggtttacactgcggaa

SEQ ID NO: 2856797 - DNA, 22 bp, Homo sapiens
caggcactgagataccagcgag

SEQ ID NO: 2856798 - DNA, 13 bp, Homo sapiens
caggcctgttgct

SEQ ID NO: 2856799 - DNA, 10 bp, Homo sapiens
caggccttca

SEQ ID NO: 2856800 - DNA, 20 bp, Homo sapiens
caggctgagccatgaggagc

SEQ ID NO: 2856801 - DNA, 20 bp, Homo sapiens
caggctgcacctctggctag

SEQ ID NO: 2856802 - DNA, 13 bp, Homo sapiens
cagggcagagtga

SEQ ID NO: 2856803 - DNA, 13 bp, Homo sapiens
cagggcagggccc

SEQ ID NO: 2856804 - DNA, 24 bp, Homo sapiens
cagggctaccctgagctgaggcag

SEQ ID NO: 2856805 - DNA, 13 bp, Homo sapiens
cagggctcctggg

SEQ ID NO: 2856806 - DNA, 20 bp, Homo sapiens
cagggggcccgaacagggac

SEQ ID NO: 2856807 - DNA, 21 bp, Homo sapiens
cagggggcccgaacagggact

SEQ ID NO: 2856808 - DNA, 21 bp, Homo sapiens
caggggtgggagagccagctc

SEQ ID NO: 2856809 - DNA, 22 bp, Homo sapiens
caggggtgggagagccagctct

SEQ ID NO: 2856810 - DNA, 23 bp, Homo sapiens
caggggtgggagagccagctctc

SEQ ID NO: 2856811 - DNA, 15 bp, Homo sapiens
cagggtgggccactc

SEQ ID NO: 2856812 - DNA, 18 bp, Homo sapiens
cagggtgggccactctcc

SEQ ID NO: 2856813 - DNA, 20 bp, Homo sapiens
cagggtgggccactctcccc

SEQ ID NO: 2856814 - DNA, 15 bp, Homo sapiens
caggtctagactttc

SEQ ID NO: 2856815 - DNA, 20 bp, Homo sapiens
caggtggggagactgggctg

SEQ ID NO: 2856816 - DNA, 17 bp, Homo sapiens
caggttagtgacattta

SEQ ID NO: 2856817 - DNA, 23 bp, Homo sapiens
cagtaaatagtgtcatataaact

SEQ ID NO: 2856818 - DNA, 20 bp, Homo sapiens
cagtaatgctaaatgtgtaa

SEQ ID NO: 2856819 - DNA, 16 bp, Homo sapiens
cagtagcatctcagtg

SEQ ID NO: 2856820 - DNA, 12 bp, Homo sapiens
cagtaggagccc

SEQ ID NO: 2856821 - DNA, 13 bp, Homo sapiens
ccccaacactgtc

SEQ ID NO: 2856822 - DNA, 23 bp, Homo sapiens
ccccacccctaagtgcccaaagt

SEQ ID NO: 2856823 - DNA, 15 bp, Homo sapiens
ccccaccctccactc

SEQ ID NO: 2856824 - DNA, 17 bp, Homo sapiens
ccccaccctccactcag

SEQ ID NO: 2856825 - DNA, 14 bp, Homo sapiens
ccccactactgcag

SEQ ID NO: 2856826 - DNA, 17 bp, Homo sapiens
ccccagctcttctcttc

SEQ ID NO: 2856827 - DNA, 14 bp, Homo sapiens
ccccatcagtgctc

SEQ ID NO: 2856828 - DNA, 15 bp, Homo sapiens
ccccatcccctttcc

SEQ ID NO: 2856829 - DNA, 13 bp, Homo sapiens
ccccatttctatt

SEQ ID NO: 2856830 - DNA, 22 bp, Homo sapiens
cccccaaagcaatgtgagtccc

SEQ ID NO: 2856831 - DNA, 18 bp, Homo sapiens
cccccagctaataaacca

SEQ ID NO: 2856832 - DNA, 11 bp, Homo sapiens
ccccctcattc

SEQ ID NO: 2856833 - DNA, 14 bp, Homo sapiens
cccctaagtgccca

SEQ ID NO: 2856834 - DNA, 21 bp, Homo sapiens
cccctccgcagcagggaagct

SEQ ID NO: 2856835 - DNA, 17 bp, Homo sapiens
cccctcctccagcccct

SEQ ID NO: 2856836 - DNA, 17 bp, Homo sapiens
cccctcgtgtgactctc

SEQ ID NO: 2856837 - DNA, 23 bp, Homo sapiens
cccctcgtgtgactctcttggat

SEQ ID NO: 2856838 - DNA, 12 bp, Homo sapiens
cccctctgtcca

SEQ ID NO: 2856839 - DNA, 22 bp, Homo sapiens
cccctctgtccaggcactgaga

SEQ ID NO: 2856840 - DNA, 15 bp, Homo sapiens
cccctgccagggcag

SEQ ID NO: 2856841 - DNA, 14 bp, Homo sapiens
cccctgtactccag

SEQ ID NO: 2856842 - DNA, 20 bp, Homo sapiens
cccctgtgcagccgctgagc

SEQ ID NO: 2856843 - DNA, 14 bp, Homo sapiens
ccccttcctttcct

SEQ ID NO: 2856844 - DNA, 21 bp, Homo sapiens
ccccttcctttcctctgcagc

SEQ ID NO: 2856845 - DNA, 22 bp, Homo sapiens
cccgagatgtgacccaccagtg

SEQ ID NO: 2856846 - DNA, 14 bp, Homo sapiens
cccggcccagagac

SEQ ID NO: 2856847 - DNA, 13 bp, Homo sapiens
ccctaagtgccca

SEQ ID NO: 2856848 - DNA, 15 bp, Homo sapiens
ccctaagtgcccaaa

SEQ ID NO: 2856849 - DNA, 18 bp, Homo sapiens
ccctatcagttgattttt

SEQ ID NO: 2856850 - DNA, 13 bp, Homo sapiens
ccctatgctgtgc

SEQ ID NO: 2856851 - DNA, 17 bp, Homo sapiens
ccctcatcccgagcacc

SEQ ID NO: 2856852 - DNA, 14 bp, Homo sapiens
ccctcatctgtccc

SEQ ID NO: 2856853 - DNA, 13 bp, Homo sapiens
ccctcattcccct

SEQ ID NO: 2856854 - DNA, 15 bp, Homo sapiens
ccctcattcccctcg

SEQ ID NO: 2856855 - DNA, 17 bp, Homo sapiens
ccctccactcagctgtc

SEQ ID NO: 2856856 - DNA, 14 bp, Homo sapiens
ccctccagagaaag

SEQ ID NO: 2856857 - DNA, 23 bp, Homo sapiens
ccctcggaggtccagctgggcct

SEQ ID NO: 2856858 - DNA, 21 bp, Homo sapiens
ccctctacagagcttccctga

SEQ ID NO: 2856859 - DNA, 14 bp, Homo sapiens
ccctctcttcccta

SEQ ID NO: 2856860 - DNA, 18 bp, Homo sapiens
ccctgcaaaaggactctc

SEQ ID NO: 2856861 - DNA, 13 bp, Homo sapiens
ccctggagccaga

SEQ ID NO: 2856862 - DNA, 14 bp, Homo sapiens
cccttacagtagga

SEQ ID NO: 2856863 - DNA, 13 bp, Homo sapiens
cccttccactgag

SEQ ID NO: 2856864 - DNA, 13 bp, Homo sapiens
cccttcccagacc

SEQ ID NO: 2856865 - DNA, 16 bp, Homo sapiens
cccttcccagaccagg

SEQ ID NO: 2856866 - DNA, 17 bp, Homo sapiens
cccttcccagaccagga

SEQ ID NO: 2856867 - DNA, 13 bp, Homo sapiens
cccttcctttcct

SEQ ID NO: 2856868 - DNA, 22 bp, Homo sapiens
ccgagatgtgacccaccagtgc

SEQ ID NO: 2856869 - DNA, 12 bp, Homo sapiens
ccgctgggcttc

SEQ ID NO: 2856870 - DNA, 15 bp, Homo sapiens
ccgcttggagcagag

SEQ ID NO: 2856871 - DNA, 14 bp, Homo sapiens
ccggactggcagaa

SEQ ID NO: 2856872 - DNA, 16 bp, Homo sapiens
ccggcccagagacccc

SEQ ID NO: 2856873 - DNA, 11 bp, Homo sapiens
ccggggaggaa

SEQ ID NO: 2856874 - DNA, 14 bp, Homo sapiens
ccgggtctgcctct

SEQ ID NO: 2856875 - DNA, 22 bp, Homo sapiens
ccgggttctgcagcggcagagc

SEQ ID NO: 2856876 - DNA, 14 bp, Homo sapiens
ccgtgggctccctg

SEQ ID NO: 2856877 - DNA, 12 bp, Homo sapiens
cctaagtgccca

SEQ ID NO: 2856878 - DNA, 14 bp, Homo sapiens
cctaagtgcccaaa

SEQ ID NO: 2856879 - DNA, 16 bp, Homo sapiens
cctaagtgcccaaagt

SEQ ID NO: 2856880 - DNA, 21 bp, Homo sapiens
cctaatatttaggcaagagaa

SEQ ID NO: 2856881 - DNA, 15 bp, Homo sapiens
cctacagacctggct

SEQ ID NO: 2856882 - DNA, 17 bp, Homo sapiens
cctacagacctggctct

SEQ ID NO: 2856883 - DNA, 21 bp, Homo sapiens
cctactggtgtaatctcaatg

SEQ ID NO: 2856884 - DNA, 13 bp, Homo sapiens
cctactttctatt

SEQ ID NO: 2856885 - DNA, 14 bp, Homo sapiens
cctagatctgcagg

SEQ ID NO: 2856886 - DNA, 15 bp, Homo sapiens
cctagatctgcaggc

SEQ ID NO: 2856887 - DNA, 22 bp, Homo sapiens
cctagtgaaggcttctctctgt

SEQ ID NO: 2856888 - DNA, 12 bp, Homo sapiens
cctatgctgtgc

SEQ ID NO: 2856889 - DNA, 22 bp, Homo sapiens
cctatgtttttgttcaaagcca

SEQ ID NO: 2856890 - DNA, 14 bp, Homo sapiens
cctatttttgtgaa

SEQ ID NO: 2856891 - DNA, 15 bp, Homo sapiens
cctcaagaacacctt

SEQ ID NO: 2856892 - DNA, 13 bp, Homo sapiens
cctcaatccagct

SEQ ID NO: 2856893 - DNA, 22 bp, Homo sapiens
cctcagttctcaaatgtgtgtg

SEQ ID NO: 2856894 - DNA, 14 bp, Homo sapiens
cctcatcccgagca

SEQ ID NO: 2856895 - DNA, 17 bp, Homo sapiens
cctcatctgtccctccg

SEQ ID NO: 2856896 - DNA, 18 bp, Homo sapiens
cctcatcttcttcaccat

SEQ ID NO: 2856897 - DNA, 14 bp, Homo sapiens
cctcattcccctcg

SEQ ID NO: 2856898 - DNA, 13 bp, Homo sapiens
cctccaccttcca

SEQ ID NO: 2856899 - DNA, 14 bp, Homo sapiens
cctccaccttccat

SEQ ID NO: 2856900 - DNA, 17 bp, Homo sapiens
cctccacgttctgctca

SEQ ID NO: 2856901 - DNA, 13 bp, Homo sapiens
cctccagagaaag

SEQ ID NO: 2856902 - DNA, 17 bp, Homo sapiens
cctccaggcctgttgct

SEQ ID NO: 2856903 - DNA, 22 bp, Homo sapiens
cctcccacaatctgggactttc

SEQ ID NO: 2856904 - DNA, 15 bp, Homo sapiens
cctccccagctcttc

SEQ ID NO: 2856905 - DNA, 13 bp, Homo sapiens
cctcccctgccag

SEQ ID NO: 2856906 - DNA, 12 bp, Homo sapiens
cctccctcttcc

SEQ ID NO: 2856907 - DNA, 14 bp, Homo sapiens
cctccgctgggctt

SEQ ID NO: 2856908 - DNA, 22 bp, Homo sapiens
cctcctctgtgaccaatgtctt

SEQ ID NO: 2856909 - DNA, 18 bp, Homo sapiens
cctcgctggactctcagt

SEQ ID NO: 2856910 - DNA, 21 bp, Homo sapiens
cctcggaggtccagctgggcc

SEQ ID NO: 2856911 - DNA, 18 bp, Homo sapiens
cctctacagagcttccct

SEQ ID NO: 2856912 - DNA, 20 bp, Homo sapiens
cctctacagagcttccctga

SEQ ID NO: 2856913 - DNA, 21 bp, Homo sapiens
cctctacagagcttccctgac

SEQ ID NO: 2856914 - DNA, 19 bp, Homo sapiens
cctctccagtttgcacctg

SEQ ID NO: 2856915 - DNA, 23 bp, Homo sapiens
cctctccagtttgcacctgtccc

SEQ ID NO: 2856916 - DNA, 20 bp, Homo sapiens
cctctcttatagaatattta

SEQ ID NO: 2856917 - DNA, 16 bp, Homo sapiens
cctctgactcagggct

SEQ ID NO: 2856918 - DNA, 14 bp, Homo sapiens
cctctgcagcactt

SEQ ID NO: 2856919 - DNA, 17 bp, Homo sapiens
cctctggctagagccga

SEQ ID NO: 2856920 - DNA, 13 bp, Homo sapiens
cctcttcagaggc

SEQ ID NO: 2856921 - DNA, 17 bp, Homo sapiens
cctcttctgggagggca

SEQ ID NO: 2856922 - DNA, 16 bp, Homo sapiens
cctcttgaaacctgat

SEQ ID NO: 2856923 - DNA, 23 bp, Homo sapiens
cctctttcttgtttgtcagcatc

SEQ ID NO: 2856924 - DNA, 15 bp, Homo sapiens
cctgaatttgtatat

SEQ ID NO: 2856925 - DNA, 16 bp, Homo sapiens
cctgacaactcatttt

SEQ ID NO: 2856926 - DNA, 20 bp, Homo sapiens
cctgaccacgctttctagct

SEQ ID NO: 2856927 - DNA, 12 bp, Homo sapiens
cctgaccagggg

SEQ ID NO: 2856928 - DNA, 14 bp, Homo sapiens
cctgagaaacacta

SEQ ID NO: 2856929 - DNA, 18 bp, Homo sapiens
cctgctctagtgggacag

SEQ ID NO: 2856930 - DNA, 19 bp, Homo sapiens
cctgctctagtgggacagc

SEQ ID NO: 2856931 - DNA, 22 bp, Homo sapiens
cctgctctagtgggacagccca

SEQ ID NO: 2856932 - DNA, 23 bp, Homo sapiens
cctggacatgaagattctttccc

SEQ ID NO: 2856933 - DNA, 18 bp, Homo sapiens
cctggactgaccacacca

SEQ ID NO: 2856934 - DNA, 15 bp, Homo sapiens
cctggacttcctgtc

SEQ ID NO: 2856935 - DNA, 18 bp, Homo sapiens
cctggatgccaaggagcc

SEQ ID NO: 2856936 - DNA, 15 bp, Homo sapiens
cctggctctcagagg

SEQ ID NO: 2856937 - DNA, 15 bp, Homo sapiens
cctggctgcccatca

SEQ ID NO: 2856938 - DNA, 11 bp, Homo sapiens
cctgggccctc

SEQ ID NO: 2856939 - DNA, 14 bp, Homo sapiens
cctgggccctctct

SEQ ID NO: 2856940 - DNA, 15 bp, Homo sapiens
cctgggggtgccagg

SEQ ID NO: 2856941 - DNA, 20 bp, Homo sapiens
cctgggttttgtattctctg

SEQ ID NO: 2856942 - DNA, 18 bp, Homo sapiens
cctggtagaattgggaag

SEQ ID NO: 2856943 - DNA, 20 bp, Homo sapiens
cctggtccagtcgggaggag

SEQ ID NO: 2856944 - DNA, 23 bp, Homo sapiens
cctgtaatcccagcactttggga

SEQ ID NO: 2856945 - DNA, 22 bp, Homo sapiens
cctgtatgtcaataaacaacag

SEQ ID NO: 2856946 - DNA, 14 bp, Homo sapiens
cctgtcaccagagc

SEQ ID NO: 2856947 - DNA, 21 bp, Homo sapiens
cctgtcaccagagcttctctg

SEQ ID NO: 2856948 - DNA, 19 bp, Homo sapiens
cctgtccccaccctccact

SEQ ID NO: 2856949 - DNA, 17 bp, Homo sapiens
cctgtgctgaacataac

SEQ ID NO: 2856950 - DNA, 18 bp, Homo sapiens
cctgtgtgtactctgtcc

SEQ ID NO: 2856951 - DNA, 14 bp, Homo sapiens
cctgttcatgtttt

SEQ ID NO: 2856952 - DNA, 19 bp, Homo sapiens
cctgttgctatagagccta

SEQ ID NO: 2856953 - DNA, 19 bp, Homo sapiens
ccttaccccaaagagaaag

SEQ ID NO: 2856954 - DNA, 16 bp, Homo sapiens
ccttattgtacctctc

SEQ ID NO: 2856955 - DNA, 19 bp, Homo sapiens
ccttccattttcccccact

SEQ ID NO: 2856956 - DNA, 12 bp, Homo sapiens
ccttccccagac

SEQ ID NO: 2856957 - DNA, 23 bp, Homo sapiens
ccttcccccatcccctttcctcc

SEQ ID NO: 2856958 - DNA, 19 bp, Homo sapiens
ccttgagaaaccttattgt

SEQ ID NO: 2856959 - DNA, 20 bp, Homo sapiens
ccttgagattctgaagtatg

SEQ ID NO: 2856960 - DNA, 11 bp, Homo sapiens
ccttgggagag

SEQ ID NO: 2856961 - DNA, 23 bp, Homo sapiens
ccttgtgttcagctctttccaaa

SEQ ID NO: 2856962 - DNA, 19 bp, Homo sapiens
cctttcccaggtgctacac

SEQ ID NO: 2856963 - DNA, 16 bp, Homo sapiens
cctttcctccccacct

SEQ ID NO: 2856964 - DNA, 14 bp, Homo sapiens
cctttcctctgcag

SEQ ID NO: 2856965 - DNA, 19 bp, Homo sapiens
cctttgttttgcactgaca

SEQ ID NO: 2856966 - DNA, 14 bp, Homo sapiens
cgaaaacctgacta

SEQ ID NO: 2856967 - DNA, 21 bp, Homo sapiens
cgaaaccagttaagaatggaa

SEQ ID NO: 2856968 - DNA, 14 bp, Homo sapiens
cgaacagggacttg

SEQ ID NO: 2856969 - DNA, 15 bp, Homo sapiens
cgaacagggacttgt

SEQ ID NO: 2856970 - DNA, 16 bp, Homo sapiens
cgaagactgagccaga

SEQ ID NO: 2856971 - DNA, 19 bp, Homo sapiens
cgaatacttttgccctttg

SEQ ID NO: 2856972 - DNA, 17 bp, Homo sapiens
cgaatgcccctgttcat

SEQ ID NO: 2856973 - DNA, 20 bp, Homo sapiens
cgactctatagactctagga

SEQ ID NO: 2856974 - DNA, 18 bp, Homo sapiens
cgactctggccctggccc

SEQ ID NO: 2856975 - DNA, 11 bp, Homo sapiens
cgactgtctcc

SEQ ID NO: 2856976 - DNA, 21 bp, Homo sapiens
cgagatgtgacccaccagtgc

SEQ ID NO: 2856977 - DNA, 13 bp, Homo sapiens
cgagcacctccac

SEQ ID NO: 2856978 - DNA, 19 bp, Homo sapiens
cgcacacatggacacagac

SEQ ID NO: 2856979 - DNA, 16 bp, Homo sapiens
cgcagcagggaagctc

SEQ ID NO: 2856980 - DNA, 21 bp, Homo sapiens
cgccctccctctcccaggccc

SEQ ID NO: 2856981 - DNA, 15 bp, Homo sapiens
cgctgctagagaagg

SEQ ID NO: 2856982 - DNA, 18 bp, Homo sapiens
cgctgggcttcattccgg

SEQ ID NO: 2856983 - DNA, 14 bp, Homo sapiens
cgcttggagcagag

SEQ ID NO: 2856984 - DNA, 19 bp, Homo sapiens
cgcttgtagaactcactct

SEQ ID NO: 2856985 - DNA, 23 bp, Homo sapiens
cgcttgtagaactcactctgggc

SEQ ID NO: 2856986 - DNA, 21 bp, Homo sapiens
cggaattctcgggaaattatt

SEQ ID NO: 2856987 - DNA, 13 bp, Homo sapiens
cggagccactcct

SEQ ID NO: 2856988 - DNA, 19 bp, Homo sapiens
cggcagagcaattccaggc

SEQ ID NO: 2856989 - DNA, 20 bp, Homo sapiens
cggcagagcaattccaggct

SEQ ID NO: 2856990 - DNA, 15 bp, Homo sapiens
cgggacagagaggag

SEQ ID NO: 2856991 - DNA, 13 bp, Homo sapiens
cgggacctggtgc

SEQ ID NO: 2856992 - DNA, 22 bp, Homo sapiens
cgggttctgcagcggcagagca

SEQ ID NO: 2856993 - DNA, 13 bp, Homo sapiens
cgtgggctccctg

SEQ ID NO: 2856994 - DNA, 17 bp, Homo sapiens
cgtgggctccctgactg

SEQ ID NO: 2856995 - DNA, 15 bp, Homo sapiens
ctaaataaaaatatg

SEQ ID NO: 2856996 - DNA, 18 bp, Homo sapiens
ctaaataaaaatatgtaa

SEQ ID NO: 2856997 - DNA, 15 bp, Homo sapiens
ctaaatgtgtaataa

SEQ ID NO: 2856998 - DNA, 21 bp, Homo sapiens
ctaaccaaggctgtgtttaga

SEQ ID NO: 2856999 - DNA, 23 bp, Homo sapiens
ctaagaaacacatcaaataaact

SEQ ID NO: 2857000 - DNA, 15 bp, Homo sapiens
ctaagatagaaagct

SEQ ID NO: 2857001 - DNA, 16 bp, Homo sapiens
ctaagatagaaagctg

SEQ ID NO: 2857002 - DNA, 20 bp, Homo sapiens
ctaagatagaaagctggact

SEQ ID NO: 2857003 - DNA, 23 bp, Homo sapiens
ctaagatagaaagctggactgac

SEQ ID NO: 2857004 - DNA, 14 bp, Homo sapiens
ctaagtgcccaaag

SEQ ID NO: 2857005 - DNA, 15 bp, Homo sapiens
ctaagtgcccaaagt

SEQ ID NO: 2857006 - DNA, 21 bp, Homo sapiens
ctaagtgcccaaagtggggag

SEQ ID NO: 2857007 - DNA, 13 bp, Homo sapiens
ctaatagaactca

SEQ ID NO: 2857008 - DNA, 13 bp, Homo sapiens
ctaatagaacttg

SEQ ID NO: 2857009 - DNA, 18 bp, Homo sapiens
ctaattgtaagtgaaatt

SEQ ID NO: 2857010 - DNA, 15 bp, Homo sapiens
ctacaaggacaatgc

SEQ ID NO: 2857011 - DNA, 16 bp, Homo sapiens
ctacacccttttccag

SEQ ID NO: 2857012 - DNA, 21 bp, Homo sapiens
ctacagtcaggaaaggaatca

SEQ ID NO: 2857013 - DNA, 18 bp, Homo sapiens
ctacatatgctgatcttt

SEQ ID NO: 2857014 - DNA, 20 bp, Homo sapiens
ctacatatttgtatgttttt

SEQ ID NO: 2857015 - DNA, 22 bp, Homo sapiens
ctacatatttgtatgtttttct

SEQ ID NO: 2857016 - DNA, 14 bp, Homo sapiens
ctacccggcccaga

SEQ ID NO: 2857017 - DNA, 12 bp, Homo sapiens
ctaccctgagct

SEQ ID NO: 2857018 - DNA, 21 bp, Homo sapiens
ctaccttggttcccccactga

SEQ ID NO: 2857019 - DNA, 19 bp, Homo sapiens
ctactgcagcacctccagg

SEQ ID NO: 2857020 - DNA, 20 bp, Homo sapiens
ctactgttatcagtaatgct

SEQ ID NO: 2857021 - DNA, 14 bp, Homo sapiens
ctagaaaaataaaa

SEQ ID NO: 2857022 - DNA, 13 bp, Homo sapiens
ctagaatcacagc

SEQ ID NO: 2857023 - DNA, 15 bp, Homo sapiens
ctagaatttattcaa

SEQ ID NO: 2857024 - DNA, 19 bp, Homo sapiens
ctcttcctagatctgcagg

SEQ ID NO: 2857025 - DNA, 14 bp, Homo sapiens
ctcttgaaacctga

SEQ ID NO: 2857026 - DNA, 21 bp, Homo sapiens
ctcttgtaatccgaatctctt

SEQ ID NO: 2857027 - DNA, 16 bp, Homo sapiens
ctcttttctcctgcag

SEQ ID NO: 2857028 - DNA, 14 bp, Homo sapiens
ctgaaaccagtgtt

SEQ ID NO: 2857029 - DNA, 14 bp, Homo sapiens
ctgaaataatggga

SEQ ID NO: 2857030 - DNA, 19 bp, Homo sapiens
ctgaacataacttctcatg

SEQ ID NO: 2857031 - DNA, 20 bp, Homo sapiens
ctgaagagaccactcaatcc

SEQ ID NO: 2857032 - DNA, 13 bp, Homo sapiens
ctgaagtatgaag

SEQ ID NO: 2857033 - DNA, 14 bp, Homo sapiens
ctgaagtatgaagt

SEQ ID NO: 2857034 - DNA, 15 bp, Homo sapiens
ctgaatagcagaagg

SEQ ID NO: 2857035 - DNA, 20 bp, Homo sapiens
ctgaatgtatgtcagtgcta

SEQ ID NO: 2857036 - DNA, 17 bp, Homo sapiens
ctgaattttataaataa

SEQ ID NO: 2857037 - DNA, 20 bp, Homo sapiens
ctgacactcaataaacagtc

SEQ ID NO: 2857038 - DNA, 18 bp, Homo sapiens
ctgacatttggagtgttc

SEQ ID NO: 2857039 - DNA, 16 bp, Homo sapiens
ctgaccaaagactgca

SEQ ID NO: 2857040 - DNA, 20 bp, Homo sapiens
ctgaccaaagactgcagaac

SEQ ID NO: 2857041 - DNA, 13 bp, Homo sapiens
ctgaccatctgtg

SEQ ID NO: 2857042 - DNA, 16 bp, Homo sapiens
ctgaccatctgtgact

SEQ ID NO: 2857043 - DNA, 18 bp, Homo sapiens
ctgaccatctgtgactat

SEQ ID NO: 2857044 - DNA, 21 bp, Homo sapiens
ctgacgacactgaagaatcaa

SEQ ID NO: 2857045 - DNA, 12 bp, Homo sapiens
ctgactgggagt

SEQ ID NO: 2857046 - DNA, 14 bp, Homo sapiens
ctgacttaggtttc

SEQ ID NO: 2857047 - DNA, 18 bp, Homo sapiens
ctgagataccagcgagga

SEQ ID NO: 2857048 - DNA, 15 bp, Homo sapiens
ctgagccatgaggag

SEQ ID NO: 2857049 - DNA, 15 bp, Homo sapiens
ctgagctgaggcagc

SEQ ID NO: 2857050 - DNA, 13 bp, Homo sapiens
ctgagctgtgcag

SEQ ID NO: 2857051 - DNA, 15 bp, Homo sapiens
ctgaggagacagaaa

SEQ ID NO: 2857052 - DNA, 18 bp, Homo sapiens
ctgaggagacagaaagcc

SEQ ID NO: 2857053 - DNA, 19 bp, Homo sapiens
ctgaggagacagaaagcct

SEQ ID NO: 2857054 - DNA, 16 bp, Homo sapiens
ctgaggcaagagaatt

SEQ ID NO: 2857055 - DNA, 17 bp, Homo sapiens
ctgaggcagcagtgtga

SEQ ID NO: 2857056 - DNA, 17 bp, Homo sapiens
ctgaggctgagaaagct

SEQ ID NO: 2857057 - DNA, 17 bp, Homo sapiens
ctgagggagcctggccc

SEQ ID NO: 2857058 - DNA, 15 bp, Homo sapiens
ctgagggatctttac

SEQ ID NO: 2857059 - DNA, 19 bp, Homo sapiens
ctgagttttgtttcacttt

SEQ ID NO: 2857060 - DNA, 19 bp, Homo sapiens
ctgataaaaccatgtagaa

SEQ ID NO: 2857061 - DNA, 17 bp, Homo sapiens
ctgataccatatgaatg

SEQ ID NO: 2857062 - DNA, 14 bp, Homo sapiens
ctgatcagagccgt

SEQ ID NO: 2857063 - DNA, 12 bp, Homo sapiens
ctgatccctcta

SEQ ID NO: 2857064 - DNA, 16 bp, Homo sapiens
ctgatgaaagctttgg

SEQ ID NO: 2857065 - DNA, 23 bp, Homo sapiens
ctgatgtcagctgctgttgaact

SEQ ID NO: 2857066 - DNA, 17 bp, Homo sapiens
ctgcaccatcacacatg

SEQ ID NO: 2857067 - DNA, 17 bp, Homo sapiens
ctgcacctctggctaga

SEQ ID NO: 2857068 - DNA, 20 bp, Homo sapiens
ctgcacctctggctagagcc

SEQ ID NO: 2857069 - DNA, 22 bp, Homo sapiens
ctgcacctctggctagagccga

SEQ ID NO: 2857070 - DNA, 19 bp, Homo sapiens
ctgcagaacccccaggtgg

SEQ ID NO: 2857071 - DNA, 17 bp, Homo sapiens
ctgcagcaaacactcca

SEQ ID NO: 2857072 - DNA, 17 bp, Homo sapiens
ctgcagcacctccaggc

SEQ ID NO: 2857073 - DNA, 20 bp, Homo sapiens
ctgcagcacctccaggcctg

SEQ ID NO: 2857074 - DNA, 20 bp, Homo sapiens
ctgcagcctggtagaattgg

SEQ ID NO: 2857075 - DNA, 19 bp, Homo sapiens
ctgcagctgcaccatcaca

SEQ ID NO: 2857076 - DNA, 23 bp, Homo sapiens
ctgcaggctgcacctctggctag

SEQ ID NO: 2857077 - DNA, 22 bp, Homo sapiens
ctgcagggaaaattatttgcat

SEQ ID NO: 2857078 - DNA, 19 bp, Homo sapiens
ctgcatcccacgttctgtt

SEQ ID NO: 2857079 - DNA, 22 bp, Homo sapiens
ctgccacagcctcccctgccag

SEQ ID NO: 2857080 - DNA, 13 bp, Homo sapiens
ctgccactgagga

SEQ ID NO: 2857081 - DNA, 14 bp, Homo sapiens
ctgccactgaggag

SEQ ID NO: 2857082 - DNA, 15 bp, Homo sapiens
ctgccactgaggaga

SEQ ID NO: 2857083 - DNA, 12 bp, Homo sapiens
ctgccagggcag

SEQ ID NO: 2857084 - DNA, 21 bp, Homo sapiens
ctgccatgcctcaagaacacc

SEQ ID NO: 2857085 - DNA, 16 bp, Homo sapiens
ctgcctcttctgggag

SEQ ID NO: 2857086 - DNA, 20 bp, Homo sapiens
ctgcctgacatttggagtgt

SEQ ID NO: 2857087 - DNA, 13 bp, Homo sapiens
ctgcctgcctccc

SEQ ID NO: 2857088 - DNA, 22 bp, Homo sapiens
ctgcctgcctcccctccgcagc

SEQ ID NO: 2857089 - DNA, 16 bp, Homo sapiens
ctgcctgctcatggcc

SEQ ID NO: 2857090 - DNA, 19 bp, Homo sapiens
ctgcctgctcatggccctc

SEQ ID NO: 2857091 - DNA, 13 bp, Homo sapiens
ctgccttcctcct

SEQ ID NO: 2857092 - DNA, 14 bp, Homo sapiens
ctgccttcctcctg

SEQ ID NO: 2857093 - DNA, 21 bp, Homo sapiens
ctgccttcctcctgggccctc

SEQ ID NO: 2857094 - DNA, 18 bp, Homo sapiens
ctgccttcgtttatattt

SEQ ID NO: 2857095 - DNA, 18 bp, Homo sapiens
ctgccttgtccctctcac

SEQ ID NO: 2857096 - DNA, 20 bp, Homo sapiens
ctgcggaagccaaaggcagc

SEQ ID NO: 2857097 - DNA, 18 bp, Homo sapiens
ctgctagactcctcagga

SEQ ID NO: 2857098 - DNA, 15 bp, Homo sapiens
ctgctagagaagggg

SEQ ID NO: 2857099 - DNA, 16 bp, Homo sapiens
ctgctcatcattctct

SEQ ID NO: 2857100 - DNA, 17 bp, Homo sapiens
ctgctctagtgggacag

SEQ ID NO: 2857101 - DNA, 21 bp, Homo sapiens
ctgctctagtgggacagccca

SEQ ID NO: 2857102 - DNA, 17 bp, Homo sapiens
ctgctgttgaacttttt

SEQ ID NO: 2857103 - DNA, 16 bp, Homo sapiens
ctgcttaattgctgat

SEQ ID NO: 2857104 - DNA, 14 bp, Homo sapiens
ctgcttatgaaaag

SEQ ID NO: 2857105 - DNA, 14 bp, Homo sapiens
ctggactctcagtc

SEQ ID NO: 2857106 - DNA, 21 bp, Homo sapiens
ctggactctcagtctctgagc

SEQ ID NO: 2857107 - DNA, 15 bp, Homo sapiens
ctggactgaccaaag

SEQ ID NO: 2857108 - DNA, 15 bp, Homo sapiens
ctggacttcctgtca

SEQ ID NO: 2857109 - DNA, 16 bp, Homo sapiens
ctggacttcctgtcat

SEQ ID NO: 2857110 - DNA, 17 bp, Homo sapiens
ctggaggcccctggagc

SEQ ID NO: 2857111 - DNA, 19 bp, Homo sapiens
ctggaggcccctggagcca

SEQ ID NO: 2857112 - DNA, 16 bp, Homo sapiens
cttctggatccatggg

SEQ ID NO: 2857113 - DNA, 22 bp, Homo sapiens
cttctgggagggcagcagggct

SEQ ID NO: 2857114 - DNA, 17 bp, Homo sapiens
cttctttggacttctga

SEQ ID NO: 2857115 - DNA, 13 bp, Homo sapiens
cttgaaagctgtg

SEQ ID NO: 2857116 - DNA, 23 bp, Homo sapiens
cttgaaatacgtttgtgtttcta

SEQ ID NO: 2857117 - DNA, 15 bp, Homo sapiens
cttgaacccaggaga

SEQ ID NO: 2857118 - DNA, 11 bp, Homo sapiens
cttgagaaacc

SEQ ID NO: 2857119 - DNA, 23 bp, Homo sapiens
cttgagattctgaagtatgaagt

SEQ ID NO: 2857120 - DNA, 12 bp, Homo sapiens
cttgagcctccc

SEQ ID NO: 2857121 - DNA, 15 bp, Homo sapiens
cttgagcctccccca

SEQ ID NO: 2857122 - DNA, 13 bp, Homo sapiens
cttgaggccaaga

SEQ ID NO: 2857123 - DNA, 19 bp, Homo sapiens
cttgaggccaagatggctg

SEQ ID NO: 2857124 - DNA, 20 bp, Homo sapiens
cttgccttattagagtgtct

SEQ ID NO: 2857125 - DNA, 17 bp, Homo sapiens
cttggagaatactgcca

SEQ ID NO: 2857126 - DNA, 18 bp, Homo sapiens
cttggatgtacctgcccc

SEQ ID NO: 2857127 - DNA, 16 bp, Homo sapiens
cttgggccctttgagt

SEQ ID NO: 2857128 - DNA, 17 bp, Homo sapiens
cttgggccctttgagtg

SEQ ID NO: 2857129 - DNA, 13 bp, Homo sapiens
cttgggctccctg

SEQ ID NO: 2857130 - DNA, 19 bp, Homo sapiens
cttggttcccccactgatc

SEQ ID NO: 2857131 - DNA, 17 bp, Homo sapiens
cttgtagaactcactct

SEQ ID NO: 2857132 - DNA, 19 bp, Homo sapiens
cttgtagaactcactctgg

SEQ ID NO: 2857133 - DNA, 23 bp, Homo sapiens
cttgtagaactcactctgggctg

SEQ ID NO: 2857134 - DNA, 20 bp, Homo sapiens
cttgtccctctcactcccca

SEQ ID NO: 2857135 - DNA, 23 bp, Homo sapiens
cttgtgttcagctctttccaaat

SEQ ID NO: 2857136 - DNA, 21 bp, Homo sapiens
cttgtttagagagcctgtcac

SEQ ID NO: 2857137 - DNA, 19 bp, Homo sapiens
gttatattgaaaaaataga

SEQ ID NO: 2857138 - DNA, 20 bp, Homo sapiens
gttatcaccgtgggctccct

SEQ ID NO: 2857139 - DNA, 18 bp, Homo sapiens
gttatcagtaatgctaaa

SEQ ID NO: 2857140 - DNA, 22 bp, Homo sapiens
gttattagagattacctcctga

SEQ ID NO: 2857141 - DNA, 17 bp, Homo sapiens
gttattggactccaggc

SEQ ID NO: 2857142 - DNA, 19 bp, Homo sapiens
gttattggactccaggcct

SEQ ID NO: 2857143 - DNA, 12 bp, Homo sapiens
gttcaaagccag

SEQ ID NO: 2857144 - DNA, 21 bp, Homo sapiens
gttcagctctttccaaattaa

SEQ ID NO: 2857145 - DNA, 21 bp, Homo sapiens
gttccattgaagccgactctg

SEQ ID NO: 2857146 - DNA, 18 bp, Homo sapiens
gttctaaatatgaatgaa

SEQ ID NO: 2857147 - DNA, 16 bp, Homo sapiens
gttctaagtctttcca

SEQ ID NO: 2857148 - DNA, 19 bp, Homo sapiens
gttctgcagcggcagagca

SEQ ID NO: 2857149 - DNA, 18 bp, Homo sapiens
gttctgctcatcattctc

SEQ ID NO: 2857150 - DNA, 18 bp, Homo sapiens
gttctgtagagccaatta

SEQ ID NO: 2857151 - DNA, 19 bp, Homo sapiens
gttgcacttttgaatgtcc

SEQ ID NO: 2857152 - DNA, 12 bp, Homo sapiens
gttgctgctgtt

SEQ ID NO: 2857153 - DNA, 13 bp, Homo sapiens
gttggtctgtgta

SEQ ID NO: 2857154 - DNA, 14 bp, Homo sapiens
gttgtccaggaagt

SEQ ID NO: 2857155 - DNA, 16 bp, Homo sapiens
gttgtcttatgtgaaa

SEQ ID NO: 2857156 - DNA, 15 bp, Homo sapiens
gttgttgttgctgct

SEQ ID NO: 2857157 - DNA, 13 bp, Homo sapiens
gtttacagaactg

SEQ ID NO: 2857158 - DNA, 22 bp, Homo sapiens
gtttataatactactactgtta

SEQ ID NO: 2857159 - DNA, 11 bp, Homo sapiens
gtttatatttt

SEQ ID NO: 2857160 - DNA, 17 bp, Homo sapiens
gtttcaattgcatctcc

SEQ ID NO: 2857161 - DNA, 22 bp, Homo sapiens
gtttcaattgcatctcccagat

SEQ ID NO: 2857162 - DNA, 12 bp, Homo sapiens
gtttcaggaagt

SEQ ID NO: 2857163 - DNA, 18 bp, Homo sapiens
gtttctaagaaaatgtag

SEQ ID NO: 2857164 - DNA, 11 bp, Homo sapiens
gtttgcagcct

SEQ ID NO: 2857165 - DNA, 19 bp, Homo sapiens
gtttgggttgttggtctgt

SEQ ID NO: 2857166 - DNA, 12 bp, Homo sapiens
gtttgtcagcat

SEQ ID NO: 2857167 - DNA, 23 bp, Homo sapiens
gtttgtcagcatctgaccatctg

SEQ ID NO: 2857168 - DNA, 19 bp, Homo sapiens
gttttaactagaatttatt

SEQ ID NO: 2857169 - DNA, 18 bp, Homo sapiens
gttttccaaaagtaaaga

SEQ ID NO: 2857170 - DNA, 14 bp, Homo sapiens
gttttgcactgaca

SEQ ID NO: 2857171 - DNA, 15 bp, Homo sapiens
gttttgtattctctg

SEQ ID NO: 2857172 - DNA, 16 bp, Homo sapiens
gtttttaaagccttct

SEQ ID NO: 2857173 - DNA, 19 bp, Homo sapiens
gtttttaagctgtttccat

SEQ ID NO: 2857174 - DNA, 14 bp, Homo sapiens
gtttttgacattta

SEQ ID NO: 2857175 - DNA, 18 bp, Homo sapiens
gtttttgacatttatatt

SEQ ID NO: 2857176 - DNA, 15 bp, Homo sapiens
gtttttgttcaaagc

SEQ ID NO: 2857177 - DNA, 11 bp, Homo sapiens
taaaaaatgtc

SEQ ID NO: 2857178 - DNA, 13 bp, Homo sapiens
taaaaaatgtctc

SEQ ID NO: 2857179 - DNA, 18 bp, Homo sapiens
taaaaagaaaaagagata

SEQ ID NO: 2857180 - DNA, 20 bp, Homo sapiens
taaaaattacctttaatttt

SEQ ID NO: 2857181 - DNA, 22 bp, Homo sapiens
taaaaattacctttaattttaa

SEQ ID NO: 2857182 - DNA, 15 bp, Homo sapiens
taaaacaatccttac

SEQ ID NO: 2857183 - DNA, 12 bp, Homo sapiens
taaaacagtcat

SEQ ID NO: 2857184 - DNA, 22 bp, Homo sapiens
taaaacagtcatctagaattca

SEQ ID NO: 2857185 - DNA, 18 bp, Homo sapiens
taaaagaaatatattttt

SEQ ID NO: 2857186 - DNA, 20 bp, Homo sapiens
taaaagtagtgttgtccagg

SEQ ID NO: 2857187 - DNA, 22 bp, Homo sapiens
taaaatagaataattcttttct

SEQ ID NO: 2857188 - DNA, 15 bp, Homo sapiens
taaaatatcataaag

SEQ ID NO: 2857189 - DNA, 19 bp, Homo sapiens
taaaatatcataaagcatt

SEQ ID NO: 2857190 - DNA, 17 bp, Homo sapiens
taaaatgtttcattatg

SEQ ID NO: 2857191 - DNA, 15 bp, Homo sapiens
taaacaacagctgaa

SEQ ID NO: 2857192 - DNA, 21 bp, Homo sapiens
tgttaaagagataaagaataa

SEQ ID NO: 2857193 - DNA, 17 bp, Homo sapiens
tgttaacctttctaacc

SEQ ID NO: 2857194 - DNA, 23 bp, Homo sapiens
tgttacctgaaaacactgtgcac

SEQ ID NO: 2857195 - DNA, 20 bp, Homo sapiens
tgttatacatcaatatgtat

SEQ ID NO: 2857196 - DNA, 21 bp, Homo sapiens
tgttatacatcaatatgtata

SEQ ID NO: 2857197 - DNA, 18 bp, Homo sapiens
tgttatcagtaatgctaa

SEQ ID NO: 2857198 - DNA, 13 bp, Homo sapiens
tgttattcttgtt

SEQ ID NO: 2857199 - DNA, 21 bp, Homo sapiens
tgttcaaagccagcgtcctcc

SEQ ID NO: 2857200 - DNA, 19 bp, Homo sapiens
tgttcagctctttccaaat

SEQ ID NO: 2857201 - DNA, 14 bp, Homo sapiens
tgttccaagtctct

SEQ ID NO: 2857202 - DNA, 19 bp, Homo sapiens
tgttccaagtctctgtgta

SEQ ID NO: 2857203 - DNA, 21 bp, Homo sapiens
tgttccccttccactgagggc

SEQ ID NO: 2857204 - DNA, 17 bp, Homo sapiens
tgttctaagtctttcca

SEQ ID NO: 2857205 - DNA, 18 bp, Homo sapiens
tgttctgatcggccagtt

SEQ ID NO: 2857206 - DNA, 13 bp, Homo sapiens
tgttcttgaattt

SEQ ID NO: 2857207 - DNA, 22 bp, Homo sapiens
tgttgacaaatgacagatcttt

SEQ ID NO: 2857208 - DNA, 14 bp, Homo sapiens
ttcataatcagtaa

SEQ ID NO: 2857209 - DNA, 23 bp, Homo sapiens
ttcatagtaagtgcgaagactga

SEQ ID NO: 2857210 - DNA, 23 bp, Homo sapiens
ttcatattgtaatctatgtttat

SEQ ID NO: 2857211 - DNA, 16 bp, Homo sapiens
ttcatcctcctcccca

SEQ ID NO: 2857212 - DNA, 19 bp, Homo sapiens
ttcatgtaaactgtgcacc

SEQ ID NO: 2857213 - DNA, 23 bp, Homo sapiens
ttcattatgcacttttagaaatg

SEQ ID NO: 2857214 - DNA, 14 bp, Homo sapiens
ttcattattcaaga

SEQ ID NO: 2857215 - DNA, 23 bp, Homo sapiens
ttcattattcaagaatgaaaaat

SEQ ID NO: 2857216 - DNA, 20 bp, Homo sapiens
ttcattccggactggcagaa

SEQ ID NO: 2857217 - DNA, 19 bp, Homo sapiens
ttcattggcattctttgca

SEQ ID NO: 2857218 - DNA, 19 bp, Homo sapiens
ttccaaattaaaacaaata

SEQ ID NO: 2857219 - DNA, 15 bp, Homo sapiens
ttccactgagggcag

SEQ ID NO: 2857220 - DNA, 18 bp, Homo sapiens
ttccagctggatgagaat

SEQ ID NO: 2857221 - DNA, 12 bp, Homo sapiens
ttccaggctgag

SEQ ID NO: 2857222 - DNA, 16 bp, Homo sapiens
ttccattggatctcat

SEQ ID NO: 2857223 - DNA, 17 bp, Homo sapiens
ttccattggatctcatt

SEQ ID NO: 2857224 - DNA, 18 bp, Homo sapiens
ttccattttcccccacta

SEQ ID NO: 2857225 - DNA, 12 bp, Homo sapiens
ttcccaggtgct

SEQ ID NO: 2857226 - DNA, 13 bp, Homo sapiens
ttcccccagccca

SEQ ID NO: 2857227 - DNA, 19 bp, Homo sapiens
ttcccctaacctcattccc

SEQ ID NO: 2857228 - DNA, 18 bp, Homo sapiens
ttcccttcccagaccagg

SEQ ID NO: 2857229 - DNA, 16 bp, Homo sapiens
ttccctttttcataat

SEQ ID NO: 2857230 - DNA, 16 bp, Homo sapiens
ttcctaataaagttct

SEQ ID NO: 2857231 - DNA, 19 bp, Homo sapiens
ttcctaataaagttctgta

SEQ ID NO: 2857232 - DNA, 13 bp, Homo sapiens
ttcctacaaaatg

SEQ ID NO: 2857233 - DNA, 15 bp, Homo sapiens
ttcctacaaaatgga

SEQ ID NO: 2857234 - DNA, 19 bp, Homo sapiens
ttcctccccaccttcccca

SEQ ID NO: 2857235 - DNA, 23 bp, Homo sapiens
ttcctccccaccttccccagact

SEQ ID NO: 2857236 - DNA, 23 bp, Homo sapiens
ttcctcctgggccctctctgctc

SEQ ID NO: 2857237 - DNA, 21 bp, Homo sapiens
ttcctgggaaatattccctag

SEQ ID NO: 2857238 - DNA, 19 bp, Homo sapiens
ttcgctgctagagaagggg

SEQ ID NO: 2857239 - DNA, 13 bp, Homo sapiens
ttcggaaacactg

SEQ ID NO: 2857240 - DNA, 18 bp, Homo sapiens
ttctaaataaaaatatgt

SEQ ID NO: 2857241 - DNA, 16 bp, Homo sapiens
ttctaagaaaatgtag

SEQ ID NO: 2857242 - DNA, 12 bp, Homo sapiens
ttctaatagaac

SEQ ID NO: 2857243 - DNA, 22 bp, Homo sapiens
ttctaggaaacccaaggaacaa

SEQ ID NO: 2857244 - DNA, 18 bp, Homo sapiens
ttctatgacaaattcaag

SEQ ID NO: 2857245 - DNA, 15 bp, Homo sapiens
ttctatttatttact

SEQ ID NO: 2857246 - DNA, 19 bp, Homo sapiens
ttctatttctcctccatgg

SEQ ID NO: 2857247 - DNA, 13 bp, Homo sapiens
ttctcaaatgtgt

SEQ ID NO: 2857248 - DNA, 15 bp, Homo sapiens
ttctcaaatgtgtgt

SEQ ID NO: 2857249 - DNA, 21 bp, Homo sapiens
ttctcagtccagcagtttcca

SEQ ID NO: 2857250 - DNA, 13 bp, Homo sapiens
ttctcgggaaatt

SEQ ID NO: 2857251 - DNA, 19 bp, Homo sapiens
ttctctaagagaacaatgt

SEQ ID NO: 2857252 - DNA, 18 bp, Homo sapiens
ttctctattttcataatc

SEQ ID NO: 2857253 - DNA, 17 bp, Homo sapiens
ttctctgagctgtgcag

SEQ ID NO: 2857254 - DNA, 18 bp, Homo sapiens
ttctctgagctgtgcagg

SEQ ID NO: 2857255 - DNA, 12 bp, Homo sapiens
ttctctgtctca

SEQ ID NO: 2857256 - DNA, 12 bp, Homo sapiens
ttctctgtgaac

SEQ ID NO: 2857257 - DNA, 16 bp, Homo sapiens
ttctcttcccttccca

SEQ ID NO: 2857258 - DNA, 19 bp, Homo sapiens
ttctgccactgaggagaca

SEQ ID NO: 2857259 - DNA, 19 bp, Homo sapiens
ttctgctcatcattctctg

SEQ ID NO: 2857260 - DNA, 21 bp, Homo sapiens
ttctgctcatcattctctgtc

SEQ ID NO: 2857261 - DNA, 19 bp, Homo sapiens
ttctgggaagcttgagcct

SEQ ID NO: 2857262 - DNA, 14 bp, Homo sapiens
ttctggttctaact

SEQ ID NO: 2857263 - DNA, 15 bp, Homo sapiens
ttcttgaaagctgtg

SEQ ID NO: 2857264 - DNA, 21 bp, Homo sapiens
ttcttgaatttaataatctgt

SEQ ID NO: 2857265 - DNA, 22 bp, Homo sapiens
ttcttggttgaggaaacaaaca

SEQ ID NO: 2857266 - DNA, 13 bp, Homo sapiens
ttcttgtttgtca

SEQ ID NO: 2857267 - DNA, 15 bp, Homo sapiens
ttcttgtttgtcagc

SEQ ID NO: 2857268 - DNA, 16 bp, Homo sapiens
ttcttgtttgtcagca

SEQ ID NO: 2857269 - DNA, 19 bp, Homo sapiens
ttcttgtttgtcagcatct

SEQ ID NO: 2857270 - DNA, 21 bp, Homo sapiens
ttcttgtttgtcagcatctga

SEQ ID NO: 2857271 - DNA, 18 bp, Homo sapiens
ttctttggacttctgaag

SEQ ID NO: 2857272 - DNA, 14 bp, Homo sapiens
ttgaaatgaacttt

SEQ ID NO: 2857273 - DNA, 16 bp, Homo sapiens
ttgaaatgaactttgt

SEQ ID NO: 2857274 - DNA, 18 bp, Homo sapiens
ttgaaatgaactttgtca

SEQ ID NO: 2857275 - DNA, 14 bp, Homo sapiens
ttgaactttggaac

SEQ ID NO: 2857276 - DNA, 13 bp, Homo sapiens
ttgaactttttaa

SEQ ID NO: 2857277 - DNA, 17 bp, Homo sapiens
ttgaagccgactctggc

SEQ ID NO: 2857278 - DNA, 15 bp, Homo sapiens
ttgaagtgttccctt

SEQ ID NO: 2857279 - DNA, 21 bp, Homo sapiens
ttgaatctatgaacctgaaaa

SEQ ID NO: 2857280 - DNA, 22 bp, Homo sapiens
ttgaatgtccaaaatttatatt

SEQ ID NO: 2857281 - DNA, 21 bp, Homo sapiens
ttgaattcttggttgaggaaa

SEQ ID NO: 2857282 - DNA, 18 bp, Homo sapiens
ttgaattgtaactgttct

SEQ ID NO: 2857283 - DNA, 22 bp, Homo sapiens
ttgacaaatgacagatcttttt

SEQ ID NO: 2857284 - DNA, 20 bp, Homo sapiens
ttgacaggttttccaaaagt

SEQ ID NO: 2857285 - DNA, 19 bp, Homo sapiens
ttgacagtttttgacattt

SEQ ID NO: 2857286 - DNA, 15 bp, Homo sapiens
ttgacatttatatta

SEQ ID NO: 2857287 - DNA, 12 bp, Homo sapiens
ttgagattctga

SEQ ID NO: 2857288 - DNA, 18 bp, Homo sapiens
ttgagcctcccccaaagc

SEQ ID NO: 2857289 - DNA, 21 bp, Homo sapiens
ttgaggccaagatggctgctg

SEQ ID NO: 2857290 - DNA, 22 bp, Homo sapiens
ttgaggccaagatggctgctgc

SEQ ID NO: 2857291 - DNA, 14 bp, Homo sapiens
ttgagtctgtgcca

SEQ ID NO: 2857292 - DNA, 14 bp, Homo sapiens
ttgagttttcagtg

SEQ ID NO: 2857293 - DNA, 17 bp, Homo sapiens
ttgataatatatattaa

SEQ ID NO: 2857294 - DNA, 21 bp, Homo sapiens
ttgataatatatattaagtgt

SEQ ID NO: 2857295 - DNA, 19 bp, Homo sapiens
ttgatagggtctaccaata

SEQ ID NO: 2857296 - DNA, 22 bp, Homo sapiens
ttgatagggtctaccaatacaa

SEQ ID NO: 2857297 - DNA, 23 bp, Homo sapiens
ttgatagggtctaccaatacaaa

SEQ ID NO: 2857298 - DNA, 17 bp, Homo sapiens
ttgattattcagtgtca

SEQ ID NO: 2857299 - DNA, 14 bp, Homo sapiens
ttgcaacctcgctg

SEQ ID NO: 2857300 - DNA, 13 bp, Homo sapiens
ttgcaatgcagag

SEQ ID NO: 2857301 - DNA, 20 bp, Homo sapiens
ttgcaatgcagaggttgaga

SEQ ID NO: 2857302 - DNA, 14 bp, Homo sapiens
ttgcacttttgaat

SEQ ID NO: 2857303 - DNA, 16 bp, Homo sapiens
ttgcacttttgaatgt

SEQ ID NO: 2857304 - DNA, 15 bp, Homo sapiens
ttgcagcctgctcta

SEQ ID NO: 2857305 - DNA, 19 bp, Homo sapiens
ttgcataacaattcctcta

SEQ ID NO: 2857306 - DNA, 20 bp, Homo sapiens
ttgcatctcccagataatgt

SEQ ID NO: 2857307 - DNA, 14 bp, Homo sapiens
ttttagtttgttct

SEQ ID NO: 2857308 - DNA, 23 bp, Homo sapiens
ttttcacctgtttttaagctgtt

SEQ ID NO: 2857309 - DNA, 16 bp, Homo sapiens
ttttccaaaagtaaag

SEQ ID NO: 2857310 - DNA, 12 bp, Homo sapiens
tccacaaaataa

SEQ ID NO: 2857311 - DNA, 15 bp, Homo sapiens
tccacattcttcagt

SEQ ID NO: 2857312 - DNA, 20 bp, Homo sapiens
tccacggagccactcctctg

SEQ ID NO: 2857313 - DNA, 13 bp, Homo sapiens
tccactcccagca

SEQ ID NO: 2857314 - DNA, 17 bp, Homo sapiens
tccactcccagcagctc

SEQ ID NO: 2857315 - DNA, 16 bp, Homo sapiens
tccacttcattttgta

SEQ ID NO: 2857316 - DNA, 17 bp, Homo sapiens
tccacttcattttgtat

SEQ ID NO: 2857317 - DNA, 20 bp, Homo sapiens
tccagagaaagcacaattta

SEQ ID NO: 2857318 - DNA, 17 bp, Homo sapiens
tccagagggcactctgc

SEQ ID NO: 2857319 - DNA, 13 bp, Homo sapiens
tccagcccctgtc

SEQ ID NO: 2857320 - DNA, 15 bp, Homo sapiens
tccagctgggcctcc

SEQ ID NO: 2857321 - DNA, 20 bp, Homo sapiens
tccaggccccacctcctcct

SEQ ID NO: 2857322 - DNA, 11 bp, Homo sapiens
tccaggctgag

SEQ ID NO: 2857323 - DNA, 13 bp, Homo sapiens
tccaggctgagcc

SEQ ID NO: 2857324 - DNA, 14 bp, Homo sapiens
tccaggctgagcca

SEQ ID NO: 2857325 - DNA, 18 bp, Homo sapiens
tccaggctgagccatgag

SEQ ID NO: 2857326 - DNA, 19 bp, Homo sapiens
tccagttaaaaaaaatttt

SEQ ID NO: 2857327 - DNA, 21 bp, Homo sapiens
tccagttaaaaaaaattttaa

SEQ ID NO: 2857328 - DNA, 13 bp, Homo sapiens
tccagtttcccac

SEQ ID NO: 2857329 - DNA, 17 bp, Homo sapiens
tccagtttgcacctgtc

SEQ ID NO: 2857330 - DNA, 16 bp, Homo sapiens
tccataaagtacaaat

SEQ ID NO: 2857331 - DNA, 18 bp, Homo sapiens
tccataaagtacaaatga

SEQ ID NO: 2857332 - DNA, 15 bp, Homo sapiens
tccatgggcagagcc

SEQ ID NO: 2857333 - DNA, 15 bp, Homo sapiens
tccatggggggagaa

SEQ ID NO: 2857334 - DNA, 22 bp, Homo sapiens
tccattgaagccgactctggcc

SEQ ID NO: 2857335 - DNA, 14 bp, Homo sapiens
tccattttccccca

SEQ ID NO: 2857336 - DNA, 12 bp, Homo sapiens
tcccaaaacaat

SEQ ID NO: 2857337 - DNA, 17 bp, Homo sapiens
tcccacaggacatttct

SEQ ID NO: 2857338 - DNA, 19 bp, Homo sapiens
tcccacccacagccataga

SEQ ID NO: 2857339 - DNA, 18 bp, Homo sapiens
tcccacctgaatttgtat

SEQ ID NO: 2857340 - DNA, 15 bp, Homo sapiens
tcccacgttctgtta

SEQ ID NO: 2857341 - DNA, 11 bp, Homo sapiens
tcccagagccc

SEQ ID NO: 2857342 - DNA, 17 bp, Homo sapiens
tcccagctacttgggag

SEQ ID NO: 2857343 - DNA, 18 bp, Homo sapiens
tcccatctggctttttct

SEQ ID NO: 2857344 - DNA, 22 bp, Homo sapiens
tcccatctggctttttctgcca

SEQ ID NO: 2857345 - DNA, 14 bp, Homo sapiens
tccccaccctccac

SEQ ID NO: 2857346 - DNA, 16 bp, Homo sapiens
tccccaccctccactc

SEQ ID NO: 2857347 - DNA, 15 bp, Homo sapiens
tccccaccttcccca

SEQ ID NO: 2857348 - DNA, 16 bp, Homo sapiens
tccccaccttccccag

SEQ ID NO: 2857349 - DNA, 15 bp, Homo sapiens
tccccagctcttctc

SEQ ID NO: 2857350 - DNA, 20 bp, Homo sapiens
tccccagctcttctcttcct

SEQ ID NO: 2857351 - DNA, 12 bp, Homo sapiens
tccccctctgtc

SEQ ID NO: 2857352 - DNA, 19 bp, Homo sapiens
tcccctcccacccacagcc

SEQ ID NO: 2857353 - DNA, 22 bp, Homo sapiens
tcccctccgcagcagggaagct

SEQ ID NO: 2857354 - DNA, 23 bp, Homo sapiens
tcccctccgcagcagggaagctc

SEQ ID NO: 2857355 - DNA, 19 bp, Homo sapiens
tcccctcgtgtgactctct

SEQ ID NO: 2857356 - DNA, 12 bp, Homo sapiens
tcccctgccagg

SEQ ID NO: 2857357 - DNA, 18 bp, Homo sapiens
tgacatttatttttcatt

SEQ ID NO: 2857358 - DNA, 16 bp, Homo sapiens
tgaccaaagactgcag

SEQ ID NO: 2857359 - DNA, 18 bp, Homo sapiens
tgaccaaagactgcagaa

SEQ ID NO: 2857360 - DNA, 15 bp, Homo sapiens
tgaccacaccaacca

SEQ ID NO: 2857361 - DNA, 19 bp, Homo sapiens
tgaccacaccaaccaggcc

SEQ ID NO: 2857362 - DNA, 20 bp, Homo sapiens
tgaccacaccaaccaggcct

SEQ ID NO: 2857363 - DNA, 23 bp, Homo sapiens
tgaccatctgtgactataaagct

SEQ ID NO: 2857364 - DNA, 12 bp, Homo sapiens
tgacccaccagt

SEQ ID NO: 2857365 - DNA, 13 bp, Homo sapiens
tgacccaccagtg

SEQ ID NO: 2857366 - DNA, 16 bp, Homo sapiens
tgacccaccagtgcct

SEQ ID NO: 2857367 - DNA, 13 bp, Homo sapiens
tgaccccagagga

SEQ ID NO: 2857368 - DNA, 17 bp, Homo sapiens
tgaccttccaaagacta

SEQ ID NO: 2857369 - DNA, 13 bp, Homo sapiens
tgactacctactg

SEQ ID NO: 2857370 - DNA, 18 bp, Homo sapiens
tgactaggttctgtagag

SEQ ID NO: 2857371 - DNA, 14 bp, Homo sapiens
tgactcagggctcc

SEQ ID NO: 2857372 - DNA, 18 bp, Homo sapiens
tgactcagggctcctggg

SEQ ID NO: 2857373 - DNA, 20 bp, Homo sapiens
tgactcattctgaaggagcc

SEQ ID NO: 2857374 - DNA, 17 bp, Homo sapiens
tgacttaggtttcagga

SEQ ID NO: 2857375 - DNA, 13 bp, Homo sapiens
tgagaaaaactaa

SEQ ID NO: 2857376 - DNA, 23 bp, Homo sapiens
tgagaaacactatttgtgacttt

SEQ ID NO: 2857377 - DNA, 18 bp, Homo sapiens
tgagaaagctaaagtttg

SEQ ID NO: 2857378 - DNA, 20 bp, Homo sapiens
tgagaatttgagtgctctga

SEQ ID NO: 2857379 - DNA, 20 bp, Homo sapiens
tgagacccagccctcatccc

SEQ ID NO: 2857380 - DNA, 14 bp, Homo sapiens
tgagattctgaagt

SEQ ID NO: 2857381 - DNA, 17 bp, Homo sapiens
tgagattctgaagtatg

SEQ ID NO: 2857382 - DNA, 13 bp, Homo sapiens
tgagcaccccctc

SEQ ID NO: 2857383 - DNA, 23 bp, Homo sapiens
tgagcaccccctcattcccctcg

SEQ ID NO: 2857384 - DNA, 23 bp, Homo sapiens
tgagccatgaggagcgtggactc

SEQ ID NO: 2857385 - DNA, 14 bp, Homo sapiens
tgagctgaggcagc

SEQ ID NO: 2857386 - DNA, 15 bp, Homo sapiens
tgagcttctctgtga

SEQ ID NO: 2857387 - DNA, 17 bp, Homo sapiens
tgaggagacagaaagcc

SEQ ID NO: 2857388 - DNA, 18 bp, Homo sapiens
tgaggagacagaaagcct

SEQ ID NO: 2857389 - DNA, 16 bp, Homo sapiens
tgaggagcgtggactc

SEQ ID NO: 2857390 - DNA, 24 bp, Homo sapiens
tgaggagcgtggactctgctagac

SEQ ID NO: 2857391 - DNA, 14 bp, Homo sapiens
tgaggcaagagaat

SEQ ID NO: 2857392 - DNA, 18 bp, Homo sapiens
tgaggccaagatggctgc

SEQ ID NO: 2857393 - DNA, 22 bp, Homo sapiens
tgagggggtggttattggactc

SEQ ID NO: 2857394 - DNA, 20 bp, Homo sapiens
tgagtcaatagcttgtcttc

SEQ ID NO: 2857395 - DNA, 19 bp, Homo sapiens
tgagtttgtagaactttat

SEQ ID NO: 2857396 - DNA, 18 bp, Homo sapiens
tgagttttgtttcacttt

SEQ ID NO: 2857397 - DNA, 16 bp, Homo sapiens
tgataagcaggaagga

SEQ ID NO: 2857398 - DNA, 19 bp, Homo sapiens
tgataccatatgaatgaaa

SEQ ID NO: 2857399 - DNA, 15 bp, Homo sapiens
tgatattgctgtgag

SEQ ID NO: 2857400 - DNA, 23 bp, Homo sapiens
tgatcagagccgtggtcctttgg

SEQ ID NO: 2857401 - DNA, 13 bp, Homo sapiens
tgatcttttaaaa

SEQ ID NO: 2857402 - DNA, 19 bp, Homo sapiens
tgatcttttaaaatcatga

SEQ ID NO: 2857403 - DNA, 18 bp, Homo sapiens
tgatgaaagctttggcga

SEQ ID NO: 2857404 - DNA, 12 bp, Homo sapiens
tgatgaagaagg

SEQ ID NO: 2857405 - DNA, 18 bp, Homo sapiens
tgatgagtttgacagttt

SEQ ID NO: 2857406 - DNA, 13 bp, Homo sapiens
tgatgctttggaa

SEQ ID NO: 2857407 - DNA, 14 bp, Homo sapiens
tgatgctttggaag

SEQ ID NO: 2857408 - DNA, 22 bp, Homo sapiens
tgatgctttggaagatgcagaa

SEQ ID NO: 2857409 - DNA, 11 bp, Homo sapiens
tgatgtttaaa

SEQ ID NO: 2857410 - DNA, 21 bp, Homo sapiens
tgattaattcaccttccagtg

SEQ ID NO: 2857411 - DNA, 17 bp, Homo sapiens
tgattactgcaatcact

SEQ ID NO: 2857412 - DNA, 21 bp, Homo sapiens
tgattcagtgttaaatgtgat

SEQ ID NO: 2857413 - DNA, 20 bp, Homo sapiens
tgatttccctccagagaaag

SEQ ID NO: 2857414 - DNA, 21 bp, Homo sapiens
tgatttccctccagagaaagc

SEQ ID NO: 2857415 - DNA, 11 bp, Homo sapiens
tgatttctaat

SEQ ID NO: 2857416 - DNA, 21 bp, Homo sapiens
tgcaaagcaatcttttataca

SEQ ID NO: 2857417 - DNA, 20 bp, Homo sapiens
tgcaacctcgctggactctc

SEQ ID NO: 2857418 - DNA, 11 bp, Homo sapiens
tgcaagggaaa

SEQ ID NO: 2857419 - DNA, 18 bp, Homo sapiens
tgcacatctgtgtcttgt

SEQ ID NO: 2857420 - DNA, 13 bp, Homo sapiens
tgcacctgtcccc

SEQ ID NO: 2857421 - DNA, 14 bp, Homo sapiens
tgcactgttccccc

SEQ ID NO: 2857422 - DNA, 19 bp, Homo sapiens
tgcactgttccccctgtgc

SEQ ID NO: 2857423 - DNA, 20 bp, Homo sapiens
tgcacttttgaatgtccaaa

SEQ ID NO: 2857424 - DNA, 21 bp, Homo sapiens
tataaataaaatcatgtagtt

SEQ ID NO: 2857425 - DNA, 13 bp, Homo sapiens
tataaatgccaga

SEQ ID NO: 2857426 - DNA, 14 bp, Homo sapiens
tataaatgccagag

SEQ ID NO: 2857427 - DNA, 19 bp, Homo sapiens
tataaatgccagagccaac

SEQ ID NO: 2857428 - DNA, 21 bp, Homo sapiens
tataagtagtaaatcagaaag

SEQ ID NO: 2857429 - DNA, 16 bp, Homo sapiens
tataatactactactg

SEQ ID NO: 2857430 - DNA, 23 bp, Homo sapiens
tataatgatcagcaaaaagactg

SEQ ID NO: 2857431 - DNA, 15 bp, Homo sapiens
tatacattttctaaa

SEQ ID NO: 2857432 - DNA, 17 bp, Homo sapiens
tatacattttctaaata

SEQ ID NO: 2857433 - DNA, 22 bp, Homo sapiens
tatacattttctaaataaaaat

SEQ ID NO: 2857434 - DNA, 16 bp, Homo sapiens
tatactctcccagatt

SEQ ID NO: 2857435 - DNA, 15 bp, Homo sapiens
tatagaatatttatt

SEQ ID NO: 2857436 - DNA, 11 bp, Homo sapiens
tatagactcta

SEQ ID NO: 2857437 - DNA, 21 bp, Homo sapiens
tatagacttggagaatactgc

SEQ ID NO: 2857438 - DNA, 17 bp, Homo sapiens
tatagcaactaatgttt

SEQ ID NO: 2857439 - DNA, 13 bp, Homo sapiens
tatagtgatgtaa

SEQ ID NO: 2857440 - DNA, 16 bp, Homo sapiens
tatatgtattttttga

SEQ ID NO: 2857441 - DNA, 16 bp, Homo sapiens
tatcaaataaaatatc

SEQ ID NO: 2857442 - DNA, 19 bp, Homo sapiens
tatcactgccttcgtttat

SEQ ID NO: 2857443 - DNA, 20 bp, Homo sapiens
tatcaggacccagaggaagg

SEQ ID NO: 2857444 - DNA, 17 bp, Homo sapiens
tatcagttgatttttct

SEQ ID NO: 2857445 - DNA, 17 bp, Homo sapiens
tatccaactttttcata

SEQ ID NO: 2857446 - DNA, 17 bp, Homo sapiens
tatcttgtctctgggct

SEQ ID NO: 2857447 - DNA, 17 bp, Homo sapiens
tatgacaagctgtatca

SEQ ID NO: 2857448 - DNA, 21 bp, Homo sapiens
tatgacaagctgtatcactgc

SEQ ID NO: 2857449 - DNA, 10 bp, Homo sapiens
tatgatgaca

SEQ ID NO: 2857450 - DNA, 22 bp, Homo sapiens
tatgcacttataattttcctaa

SEQ ID NO: 2857451 - DNA, 12 bp, Homo sapiens
tatgcactttta

SEQ ID NO: 2857452 - DNA, 14 bp, Homo sapiens
tatggcttatttct

SEQ ID NO: 2857453 - DNA, 22 bp, Homo sapiens
tatggcttatttctatgacaaa

SEQ ID NO: 2857454 - DNA, 22 bp, Homo sapiens
tatggtaatagctttagtgaat

SEQ ID NO: 2857455 - DNA, 14 bp, Homo sapiens
tatggtatttgagt

SEQ ID NO: 2857456 - DNA, 15 bp, Homo sapiens
tatggtgaagggaag

SEQ ID NO: 2857457 - DNA, 11 bp, Homo sapiens
tatgtaacatg

SEQ ID NO: 2857458 - DNA, 12 bp, Homo sapiens
tatgtaacatgt

SEQ ID NO: 2857459 - DNA, 16 bp, Homo sapiens
tatgtaatttcaaaat

SEQ ID NO: 2857460 - DNA, 17 bp, Homo sapiens
tatgtaatttcaaaata

SEQ ID NO: 2857461 - DNA, 16 bp, Homo sapiens
tatgtattttttgaat

SEQ ID NO: 2857462 - DNA, 15 bp, Homo sapiens
tatgtgaaaaattaa

SEQ ID NO: 2857463 - DNA, 21 bp, Homo sapiens
tatgttactgtatttttcaga

SEQ ID NO: 2857464 - DNA, 21 bp, Homo sapiens
tatgttcctaacaaaatgaga

SEQ ID NO: 2857465 - DNA, 13 bp, Homo sapiens
tatgtttttctgt

SEQ ID NO: 2857466 - DNA, 14 bp, Homo sapiens
tatgtttttctgta

SEQ ID NO: 2857467 - DNA, 23 bp, Homo sapiens
tatgtttttctgtataacagcct

SEQ ID NO: 2857468 - DNA, 18 bp, Homo sapiens
tattaactatcttctttg

SEQ ID NO: 2857469 - DNA, 17 bp, Homo sapiens
tattaagtgtgccaaat

SEQ ID NO: 2857470 - DNA, 14 bp, Homo sapiens
tattacctctgata

SEQ ID NO: 2857471 - DNA, 19 bp, Homo sapiens
tattataatttttttcaat

SEQ ID NO: 2857472 - DNA, 15 bp, Homo sapiens
tattattttcacctg

SEQ ID NO: 2857473 - DNA, 16 bp, Homo sapiens
tattattttcacctgt

SEQ ID NO: 2857474 - DNA, 18 bp, Homo sapiens
tattcaagaatgaaaaat

SEQ ID NO: 2857475 - DNA, 16 bp, Homo sapiens
tattcaattcctctgg

SEQ ID NO: 2857476 - DNA, 19 bp, Homo sapiens
tattctctgagctgtgcag

SEQ ID NO: 2857477 - DNA, 15 bp, Homo sapiens
tattgtccattgtcc

SEQ ID NO: 2857478 - DNA, 18 bp, Homo sapiens
tattgtttcaattgcatc

SEQ ID NO: 2857479 - DNA, 14 bp, Homo sapiens
tatttactaactaa

SEQ ID NO: 2857480 - DNA, 19 bp, Homo sapiens
tatttactaactaaatacc

SEQ ID NO: 2857481 - DNA, 16 bp, Homo sapiens
tatttactgagcttct

SEQ ID NO: 2857482 - DNA, 21 bp, Homo sapiens
tatttactgagcttctctgtg

SEQ ID NO: 2857483 - DNA, 19 bp, Homo sapiens
tatttataacaacctaaat

SEQ ID NO: 2857484 - DNA, 20 bp, Homo sapiens
tatttataacaacctaaatt

SEQ ID NO: 2857485 - DNA, 13 bp, Homo sapiens
tatttattacctc

SEQ ID NO: 2857486 - DNA, 16 bp, Homo sapiens
tatttattacctctga

SEQ ID NO: 2857487 - DNA, 13 bp, Homo sapiens
tatttatttactg

SEQ ID NO: 2857488 - DNA, 14 bp, Homo sapiens
tatttctatgacaa

SEQ ID NO: 2857489 - DNA, 19 bp, Homo sapiens
tatttctatgacaaattca

SEQ ID NO: 2857490 - DNA, 13 bp, Homo sapiens
tatttgatttcta

SEQ ID NO: 2857491 - DNA, 18 bp, Homo sapiens
tatttgatttctaattgt

SEQ ID NO: 2857492 - DNA, 21 bp, Homo sapiens
tatttgcataacaattcctct

SEQ ID NO: 2857493 - DNA, 22 bp, Homo sapiens
tatttgcataacaattcctcta

SEQ ID NO: 2857494 - DNA, 13 bp, Homo sapiens
tattttgaaatga

SEQ ID NO: 2857495 - DNA, 14 bp, Homo sapiens
tattttgaaatgaa

SEQ ID NO: 2857496 - DNA, 18 bp, Homo sapiens
tattttgaaatgaacttt

SEQ ID NO: 2857497 - DNA, 11 bp, Homo sapiens
tcaaaaaatta

SEQ ID NO: 2857498 - DNA, 18 bp, Homo sapiens
tcaaaatacatttgtaag

SEQ ID NO: 2857499 - DNA, 22 bp, Homo sapiens
tcaaagccggcctgagaaacac

SEQ ID NO: 2857500 - DNA, 14 bp, Homo sapiens
tcaaagtatgcaat

SEQ ID NO: 2857501 - DNA, 20 bp, Homo sapiens
tcaaataaaatatcataaag

SEQ ID NO: 2857502 - DNA, 18 bp, Homo sapiens
tcaacccccatttctatt

SEQ ID NO: 2857503 - DNA, 13 bp, Homo sapiens
tcaacctgcctga

SEQ ID NO: 2857504 - DNA, 23 bp, Homo sapiens
tcaacgcctcactgaaacatggc

SEQ ID NO: 2857505 - DNA, 16 bp, Homo sapiens
tcaagaaacagccagc

SEQ ID NO: 2857506 - DNA, 17 bp, Homo sapiens
tcaagaaacagccagca

SEQ ID NO: 2857507 - DNA, 18 bp, Homo sapiens
tcaagaaacagccagcaa

SEQ ID NO: 2857508 - DNA, 21 bp, Homo sapiens
tcaagaatgaaaaatataatg

SEQ ID NO: 2857509 - DNA, 22 bp, Homo sapiens
tcaagagctagaaaaataaaat

SEQ ID NO: 2857510 - DNA, 16 bp, Homo sapiens
tcaaggacattggtga

SEQ ID NO: 2857511 - DNA, 22 bp, Homo sapiens
tcaagggaaaggcaagcttgag

SEQ ID NO: 2857512 - DNA, 16 bp, Homo sapiens
tcaataaacagtcact

SEQ ID NO: 2857513 - DNA, 14 bp, Homo sapiens
tcaatatgaatcta

SEQ ID NO: 2857514 - DNA, 15 bp, Homo sapiens
tcaatatgaatctat

SEQ ID NO: 2857515 - DNA, 20 bp, Homo sapiens
tcaatatttattattttcac

SEQ ID NO: 2857516 - DNA, 15 bp, Homo sapiens
tcaatccagctatgt

SEQ ID NO: 2857517 - DNA, 20 bp, Homo sapiens
tcaatgaccattcaattagt

SEQ ID NO: 2857518 - DNA, 20 bp, Homo sapiens
tcacaatcttggggctgatg

SEQ ID NO: 2857519 - DNA, 15 bp, Homo sapiens
tcacacatgcatcat

SEQ ID NO: 2857520 - DNA, 20 bp, Homo sapiens
tcacatctatccacactgtc

SEQ ID NO: 2857521 - DNA, 12 bp, Homo sapiens
tcaccagagctt

SEQ ID NO: 2857522 - DNA, 21 bp, Homo sapiens
tcaccagagcttctctgggct

SEQ ID NO: 2857523 - DNA, 16 bp, Homo sapiens
tcaccgtgggctccct

SEQ ID NO: 2857524 - DNA, 20 bp, Homo sapiens
tcacctgtttttaagctgtt

SEQ ID NO: 2857525 - DNA, 21 bp, Homo sapiens
tcacctgtttttaagctgttt

SEQ ID NO: 2857526 - DNA, 11 bp, Homo sapiens
tcactccccag

SEQ ID NO: 2857527 - DNA, 12 bp, Homo sapiens
tcactctgggct

SEQ ID NO: 2857528 - DNA, 14 bp, Homo sapiens
tcactgaaacatgg

SEQ ID NO: 2857529 - DNA, 17 bp, Homo sapiens
tcactgccatgcctcaa

SEQ ID NO: 2857530 - DNA, 20 bp, Homo sapiens
tcactggcgacacgtagcag

SEQ ID NO: 2857531 - DNA, 22 bp, Homo sapiens
tcacttgaggtcaggagttcct

SEQ ID NO: 2857532 - DNA, 15 bp, Homo sapiens
tcactttgacatttg

SEQ ID NO: 2857533 - DNA, 18 bp, Homo sapiens
tcagaaagtaacaatcta

SEQ ID NO: 2857534 - DNA, 19 bp, Homo sapiens
ctatcttttttagtgttaa

SEQ ID NO: 2857535 - DNA, 14 bp, Homo sapiens
ctatttgtgacttt

SEQ ID NO: 2857536 - DNA, 16 bp, Homo sapiens
ctatttttatgatgac

SEQ ID NO: 2857537 - DNA, 17 bp, Homo sapiens
ctatttttatgatgaca

SEQ ID NO: 2857538 - DNA, 19 bp, Homo sapiens
ctatttttatgatgacaat

SEQ ID NO: 2857539 - DNA, 23 bp, Homo sapiens
ctatttttatgatgacaatcaaa

SEQ ID NO: 2857540 - DNA, 20 bp, Homo sapiens
ctcaagaaatatactctccc

SEQ ID NO: 2857541 - DNA, 17 bp, Homo sapiens
ctcaagcattctgttta

SEQ ID NO: 2857542 - DNA, 14 bp, Homo sapiens
ctcaagggaaaggc

SEQ ID NO: 2857543 - DNA, 14 bp, Homo sapiens
ctcaataaacagtc

SEQ ID NO: 2857544 - DNA, 21 bp, Homo sapiens
ctcaatgcaagccccaacttt

SEQ ID NO: 2857545 - DNA, 16 bp, Homo sapiens
ctcacccccttctcca

SEQ ID NO: 2857546 - DNA, 12 bp, Homo sapiens
ctcactctgggc

SEQ ID NO: 2857547 - DNA, 13 bp, Homo sapiens
ctcactctgggct

SEQ ID NO: 2857548 - DNA, 15 bp, Homo sapiens
ctcactctgggctgt

SEQ ID NO: 2857549 - DNA, 23 bp, Homo sapiens
ctcagaggaaaaatgggagccag

SEQ ID NO: 2857550 - DNA, 23 bp, Homo sapiens
ctcagctccagaataccttcttc

SEQ ID NO: 2857551 - DNA, 18 bp, Homo sapiens
ctcagtagcatctcagtg

SEQ ID NO: 2857552 - DNA, 13 bp, Homo sapiens
ctcagtctctgag

SEQ ID NO: 2857553 - DNA, 20 bp, Homo sapiens
ctcagtctctgagcagtgaa

SEQ ID NO: 2857554 - DNA, 20 bp, Homo sapiens
ctcatcattctctgtctcat

SEQ ID NO: 2857555 - DNA, 22 bp, Homo sapiens
ctcatcattctctgtctcatcc

SEQ ID NO: 2857556 - DNA, 23 bp, Homo sapiens
ctcatcattctctgtctcatcca

SEQ ID NO: 2857557 - DNA, 16 bp, Homo sapiens
ctcatccatcatcatg

SEQ ID NO: 2857558 - DNA, 13 bp, Homo sapiens
ctcatctgtccct

SEQ ID NO: 2857559 - DNA, 18 bp, Homo sapiens
ctcattggacccttccat

SEQ ID NO: 2857560 - DNA, 14 bp, Homo sapiens
ctccacatcctcca

SEQ ID NO: 2857561 - DNA, 12 bp, Homo sapiens
ctccaccttcca

SEQ ID NO: 2857562 - DNA, 20 bp, Homo sapiens
ctccacgttctgctcatcat

SEQ ID NO: 2857563 - DNA, 13 bp, Homo sapiens
ctccactcccagc

SEQ ID NO: 2857564 - DNA, 17 bp, Homo sapiens
ctccactcccagcagct

SEQ ID NO: 2857565 - DNA, 18 bp, Homo sapiens
ctccagaataccttcttc

SEQ ID NO: 2857566 - DNA, 21 bp, Homo sapiens
ctccagaataccttcttcgct

SEQ ID NO: 2857567 - DNA, 14 bp, Homo sapiens
ctccagagaaagca

SEQ ID NO: 2857568 - DNA, 13 bp, Homo sapiens
ctccagagggcac

SEQ ID NO: 2857569 - DNA, 18 bp, Homo sapiens
ctccaggcctgaccaggg

SEQ ID NO: 2857570 - DNA, 18 bp, Homo sapiens
ctccagtttgcacctgtc

SEQ ID NO: 2857571 - DNA, 20 bp, Homo sapiens
ctccagtttgcacctgtccc

SEQ ID NO: 2857572 - DNA, 21 bp, Homo sapiens
ctccagtttgcacctgtcccc

SEQ ID NO: 2857573 - DNA, 20 bp, Homo sapiens
ctccataaagtacaaatgaa

SEQ ID NO: 2857574 - DNA, 19 bp, Homo sapiens
ctccatatttgatttctaa

SEQ ID NO: 2857575 - DNA, 22 bp, Homo sapiens
ctccatgtgaccgaacactgca

SEQ ID NO: 2857576 - DNA, 14 bp, Homo sapiens
ctcccaaccctggc

SEQ ID NO: 2857577 - DNA, 23 bp, Homo sapiens
ctcccacaatctgggactttcac

SEQ ID NO: 2857578 - DNA, 16 bp, Homo sapiens
ctcccagatttttact

SEQ ID NO: 2857579 - DNA, 14 bp, Homo sapiens
ctccccagctcttc

SEQ ID NO: 2857580 - DNA, 20 bp, Homo sapiens
ctccccagctcttctcttcc

SEQ ID NO: 2857581 - DNA, 22 bp, Homo sapiens
ctccccagctcttctcttccta

SEQ ID NO: 2857582 - DNA, 14 bp, Homo sapiens
ctcccctccctctt

SEQ ID NO: 2857583 - DNA, 19 bp, Homo sapiens
ctcccctccgcagcaggga

SEQ ID NO: 2857584 - DNA, 21 bp, Homo sapiens
ctcccctgccagggcagggcc

SEQ ID NO: 2857585 - DNA, 17 bp, Homo sapiens
ctccctcttccttcccc

SEQ ID NO: 2857586 - DNA, 19 bp, Homo sapiens
ctccctcttccttccccca

SEQ ID NO: 2857587 - DNA, 13 bp, Homo sapiens
ctcccttgggctc

SEQ ID NO: 2857588 - DNA, 13 bp, Homo sapiens
ctccgctgggctt

SEQ ID NO: 2857589 - DNA, 18 bp, Homo sapiens
ctccgctgggcttcattc

SEQ ID NO: 2857590 - DNA, 15 bp, Homo sapiens
ctcctcaggagagac

SEQ ID NO: 2857591 - DNA, 17 bp, Homo sapiens
ctcctccagcccctgtc

SEQ ID NO: 2857592 - DNA, 18 bp, Homo sapiens
ctcctccagcccctgtcc

SEQ ID NO: 2857593 - DNA, 20 bp, Homo sapiens
ctcctccagcccctgtccca

SEQ ID NO: 2857594 - DNA, 15 bp, Homo sapiens
ctcctccatgggaga

SEQ ID NO: 2857595 - DNA, 13 bp, Homo sapiens
ctcctcccacaat

SEQ ID NO: 2857596 - DNA, 14 bp, Homo sapiens
ctcctcccacaatc

SEQ ID NO: 2857597 - DNA, 13 bp, Homo sapiens
ctcctctgactca

SEQ ID NO: 2857598 - DNA, 20 bp, Homo sapiens
ctcctctgactcagggctcc

SEQ ID NO: 2857599 - DNA, 19 bp, Homo sapiens
ctcctgcctccgggcaggc

SEQ ID NO: 2857600 - DNA, 18 bp, Homo sapiens
ctcctgccttcctcctgg

SEQ ID NO: 2857601 - DNA, 20 bp, Homo sapiens
ctcctgccttcctcctgggc

SEQ ID NO: 2857602 - DNA, 12 bp, Homo sapiens
ctcctgggccct

SEQ ID NO: 2857603 - DNA, 14 bp, Homo sapiens
ctcctgggccctct

SEQ ID NO: 2857604 - DNA, 21 bp, Homo sapiens
ctcctgggttttgtattctct

SEQ ID NO: 2857605 - DNA, 17 bp, Homo sapiens
ctccttgggccctttga

SEQ ID NO: 2857606 - DNA, 19 bp, Homo sapiens
ctccttgggccctttgagt

SEQ ID NO: 2857607 - DNA, 16 bp, Homo sapiens
ctcgccccaacactgt

SEQ ID NO: 2857608 - DNA, 12 bp, Homo sapiens
ctcgctgccagc

SEQ ID NO: 2857609 - DNA, 23 bp, Homo sapiens
ctcgttgactggctgtgtgttgg

SEQ ID NO: 2857610 - DNA, 20 bp, Homo sapiens
ctctacagagcttccctgac

SEQ ID NO: 2857611 - DNA, 18 bp, Homo sapiens
ctctacccggcccagaga

SEQ ID NO: 2857612 - DNA, 17 bp, Homo sapiens
ctctagctctctaggcc

SEQ ID NO: 2857613 - DNA, 17 bp, Homo sapiens
ctctaggcctctccagt

SEQ ID NO: 2857614 - DNA, 13 bp, Homo sapiens
ctctagtgggaca

SEQ ID NO: 2857615 - DNA, 16 bp, Homo sapiens
ctctagtgggacagcc

SEQ ID NO: 2857616 - DNA, 23 bp, Homo sapiens
ctctagtgggacagcccagagcc

SEQ ID NO: 2857617 - DNA, 13 bp, Homo sapiens
ctctcactcccca

SEQ ID NO: 2857618 - DNA, 14 bp, Homo sapiens
ctctcactccccag

SEQ ID NO: 2857619 - DNA, 16 bp, Homo sapiens
ctctcagtctctgagc

SEQ ID NO: 2857620 - DNA, 18 bp, Homo sapiens
ctctcagtctctgagcag

SEQ ID NO: 2857621 - DNA, 19 bp, Homo sapiens
ctctccagtttgcacctgt

SEQ ID NO: 2857622 - DNA, 22 bp, Homo sapiens
ctctccagtttgcacctgtccc

SEQ ID NO: 2857623 - DNA, 16 bp, Homo sapiens
ctctcccctccctctt

SEQ ID NO: 2857624 - DNA, 22 bp, Homo sapiens
ctctcccctccctcttccttcc

SEQ ID NO: 2857625 - DNA, 14 bp, Homo sapiens
ctctctaggcctct

SEQ ID NO: 2857626 - DNA, 15 bp, Homo sapiens
gaatatttattacct

SEQ ID NO: 2857627 - DNA, 12 bp, Homo sapiens
gaatccctgcag

SEQ ID NO: 2857628 - DNA, 19 bp, Homo sapiens
gaatctataagtagtaaat

SEQ ID NO: 2857629 - DNA, 21 bp, Homo sapiens
gaatctataagtagtaaatca

SEQ ID NO: 2857630 - DNA, 21 bp, Homo sapiens
gaatgaatgggatattttgaa

SEQ ID NO: 2857631 - DNA, 16 bp, Homo sapiens
gaatgggatattttga

SEQ ID NO: 2857632 - DNA, 15 bp, Homo sapiens
gaatgtccaaaattt

SEQ ID NO: 2857633 - DNA, 13 bp, Homo sapiens
gaattcactgagt

SEQ ID NO: 2857634 - DNA, 19 bp, Homo sapiens
gaattcactgagttttgtt

SEQ ID NO: 2857635 - DNA, 19 bp, Homo sapiens
gaattcttggttgaggaaa

SEQ ID NO: 2857636 - DNA, 16 bp, Homo sapiens
gaattgtcacatctat

SEQ ID NO: 2857637 - DNA, 13 bp, Homo sapiens
gaatttattcaat

SEQ ID NO: 2857638 - DNA, 23 bp, Homo sapiens
gaatttattcaattcctctggga

SEQ ID NO: 2857639 - DNA, 16 bp, Homo sapiens
gacaaaccagagcaga

SEQ ID NO: 2857640 - DNA, 16 bp, Homo sapiens
gacaagggattctggg

SEQ ID NO: 2857641 - DNA, 17 bp, Homo sapiens
gacaagggattctggga

SEQ ID NO: 2857642 - DNA, 15 bp, Homo sapiens
gacaagtgggatttg

SEQ ID NO: 2857643 - DNA, 18 bp, Homo sapiens
gacaatgccttgggagag

SEQ ID NO: 2857644 - DNA, 20 bp, Homo sapiens
gacacagacccacacatgtt

SEQ ID NO: 2857645 - DNA, 17 bp, Homo sapiens
gacactcaataaacagt

SEQ ID NO: 2857646 - DNA, 22 bp, Homo sapiens
gacagaaagcctccgctgggct

SEQ ID NO: 2857647 - DNA, 23 bp, Homo sapiens
gacagaacttcagcattgtaatt

SEQ ID NO: 2857648 - DNA, 15 bp, Homo sapiens
gacagcccagagcct

SEQ ID NO: 2857649 - DNA, 18 bp, Homo sapiens
gacagcgatataatttta

SEQ ID NO: 2857650 - DNA, 15 bp, Homo sapiens
gacaggtctagactt

SEQ ID NO: 2857651 - DNA, 23 bp, Homo sapiens
gacagtaaacactccacattctt

SEQ ID NO: 2857652 - DNA, 14 bp, Homo sapiens
gacatttatattaa

SEQ ID NO: 2857653 - DNA, 17 bp, Homo sapiens
gaccaaagactgcagaa

SEQ ID NO: 2857654 - DNA, 21 bp, Homo sapiens
gaccaaaggatccagagactt

SEQ ID NO: 2857655 - DNA, 18 bp, Homo sapiens
aaaaagaaaaagagataa

SEQ ID NO: 2857656 - DNA, 13 bp, Homo sapiens
aaaaataaaatgt

SEQ ID NO: 2857657 - DNA, 12 bp, Homo sapiens
aaaaatataatg

SEQ ID NO: 2857658 - DNA, 15 bp, Homo sapiens
aaaaatgggagccag

SEQ ID NO: 2857659 - DNA, 13 bp, Homo sapiens
atgtgaaaaatta

SEQ ID NO: 2857660 - DNA, 20 bp, Homo sapiens
atgtgaaaaattaacttttt

SEQ ID NO: 2857661 - DNA, 21 bp, Homo sapiens
atgtgaaaatggtccaggaga

SEQ ID NO: 2857662 - DNA, 18 bp, Homo sapiens
atgtgacccaccagtgcc

SEQ ID NO: 2857663 - DNA, 21 bp, Homo sapiens
atgtgagtcccagagcccgct

SEQ ID NO: 2857664 - DNA, 17 bp, Homo sapiens
atgtgatgaatactgta

SEQ ID NO: 2857665 - DNA, 14 bp, Homo sapiens
atgtggccccaccc

SEQ ID NO: 2857666 - DNA, 21 bp, Homo sapiens
atgtggtctgccaatctgtac

SEQ ID NO: 2857667 - DNA, 18 bp, Homo sapiens
atgtgtaataatgtaaca

SEQ ID NO: 2857668 - DNA, 22 bp, Homo sapiens
atgtgtaataatgtaacatgat

SEQ ID NO: 2857669 - DNA, 21 bp, Homo sapiens
atgttactgtatttttcagaa

SEQ ID NO: 2857670 - DNA, 21 bp, Homo sapiens
atgttatacatcaatatgtat

SEQ ID NO: 2857671 - DNA, 23 bp, Homo sapiens
atgttatacatcaatatgtatat

SEQ ID NO: 2857672 - DNA, 22 bp, Homo sapiens
atgttcacttttgacaaaggca

SEQ ID NO: 2857673 - DNA, 16 bp, Homo sapiens
atgttcccaaaacaat

SEQ ID NO: 2857674 - DNA, 18 bp, Homo sapiens
atgttctaagtctttcca

SEQ ID NO: 2857675 - DNA, 15 bp, Homo sapiens
atgtttaaaagaaat

SEQ ID NO: 2857676 - DNA, 15 bp, Homo sapiens
atgtttaaagagaag

SEQ ID NO: 2857677 - DNA, 15 bp, Homo sapiens
atgtttacagaactg

SEQ ID NO: 2857678 - DNA, 13 bp, Homo sapiens
atgtttcattatg

SEQ ID NO: 2857679 - DNA, 12 bp, Homo sapiens
attaaaaaacaa

SEQ ID NO: 2857680 - DNA, 13 bp, Homo sapiens
attaaaaaacaat

SEQ ID NO: 2857681 - DNA, 18 bp, Homo sapiens
attaaaaaacaattaact

SEQ ID NO: 2857682 - DNA, 19 bp, Homo sapiens
attaaaaaacaattaactg

SEQ ID NO: 2857683 - DNA, 21 bp, Homo sapiens
attaaaaacgaaaacctgact

SEQ ID NO: 2857684 - DNA, 22 bp, Homo sapiens
attaaaaattacctttaatttt

SEQ ID NO: 2857685 - DNA, 19 bp, Homo sapiens
attaaaacaaatatacatt

SEQ ID NO: 2857686 - DNA, 15 bp, Homo sapiens
attaaagactccagt

SEQ ID NO: 2857687 - DNA, 14 bp, Homo sapiens
attaactatcttct

SEQ ID NO: 2857688 - DNA, 22 bp, Homo sapiens
attaactgccctctgaaataat

SEQ ID NO: 2857689 - DNA, 16 bp, Homo sapiens
attaactgtgaaatgt

SEQ ID NO: 2857690 - DNA, 20 bp, Homo sapiens
attaagcattttgaaacaaa

SEQ ID NO: 2857691 - DNA, 20 bp, Homo sapiens
attaagccacttaaaatgtt

SEQ ID NO: 2857692 - DNA, 17 bp, Homo sapiens
attacctcctgagaaaa

SEQ ID NO: 2857693 - DNA, 16 bp, Homo sapiens
attacctttaatttta

SEQ ID NO: 2857694 - DNA, 22 bp, Homo sapiens
attacgaatgcccctgttcatg

SEQ ID NO: 2857695 - DNA, 13 bp, Homo sapiens
attactgcaatca

SEQ ID NO: 2857696 - DNA, 16 bp, Homo sapiens
attagaaacaaacaaa

SEQ ID NO: 2857697 - DNA, 19 bp, Homo sapiens
attagaaacaaacaaaact

SEQ ID NO: 2857698 - DNA, 12 bp, Homo sapiens
attagacttgaa

SEQ ID NO: 2857699 - DNA, 19 bp, Homo sapiens
attagagggatgagacaga

SEQ ID NO: 2857700 - DNA, 17 bp, Homo sapiens
attagagtgtctttcca

SEQ ID NO: 2857701 - DNA, 18 bp, Homo sapiens
attaggccagcaacgctt

SEQ ID NO: 2857702 - DNA, 23 bp, Homo sapiens
attagtgatgtccttaaaatgtg

SEQ ID NO: 2857703 - DNA, 17 bp, Homo sapiens
attagtggtcataaaat

SEQ ID NO: 2857704 - DNA, 20 bp, Homo sapiens
attagtgtgacagtttccaa

SEQ ID NO: 2857705 - DNA, 23 bp, Homo sapiens
attataatttttttcaatattta

SEQ ID NO: 2857706 - DNA, 19 bp, Homo sapiens
attatagcaactaatgttt

SEQ ID NO: 2857707 - DNA, 17 bp, Homo sapiens
attatccaggtaatcca

SEQ ID NO: 2857708 - DNA, 15 bp, Homo sapiens
attatctttgctgtt

SEQ ID NO: 2857709 - DNA, 21 bp, Homo sapiens
attattcaagaatgaaaaata

SEQ ID NO: 2857710 - DNA, 14 bp, Homo sapiens
attattcagtgtca

SEQ ID NO: 2857711 - DNA, 12 bp, Homo sapiens
attatttgctat

SEQ ID NO: 2857712 - DNA, 16 bp, Homo sapiens
attatttgctatggca

SEQ ID NO: 2857713 - DNA, 15 bp, Homo sapiens
attcaagaaacagaa

SEQ ID NO: 2857714 - DNA, 17 bp, Homo sapiens
attcaagaaacagaagt

SEQ ID NO: 2857715 - DNA, 21 bp, Homo sapiens
attcaagaatgaaaaatataa

SEQ ID NO: 2857716 - DNA, 21 bp, Homo sapiens
attcaattagtggtcataaaa

SEQ ID NO: 2857717 - DNA, 24 bp, Homo sapiens
attcaattagtggtcataaaatag

SEQ ID NO: 2857718 - DNA, 18 bp, Homo sapiens
attcaattcctctgggaa

SEQ ID NO: 2857719 - DNA, 14 bp, Homo sapiens
attccagatttgtt

SEQ ID NO: 2857720 - DNA, 20 bp, Homo sapiens
attccctagaaacttccaaa

SEQ ID NO: 2857721 - DNA, 20 bp, Homo sapiens
attcctctactaacaatcag

SEQ ID NO: 2857722 - DNA, 20 bp, Homo sapiens
attctcataagtagcattca

SEQ ID NO: 2857723 - DNA, 17 bp, Homo sapiens
attctctgagctgtgca

SEQ ID NO: 2857724 - DNA, 12 bp, Homo sapiens
attctctgtctc

SEQ ID NO: 2857725 - DNA, 13 bp, Homo sapiens
attctctgtctca

SEQ ID NO: 2857726 - DNA, 16 bp, Homo sapiens
attctgaaggagcccc

SEQ ID NO: 2857727 - DNA, 14 bp, Homo sapiens
attctgaagtatga

SEQ ID NO: 2857728 - DNA, 22 bp, Homo sapiens
attctgggaagcttgagcctcc

SEQ ID NO: 2857729 - DNA, 17 bp, Homo sapiens
attcttcagtttttcac

SEQ ID NO: 2857730 - DNA, 18 bp, Homo sapiens
attcttggttgaggaaac

SEQ ID NO: 2857731 - DNA, 23 bp, Homo sapiens
attgaattcttggttgaggaaac

SEQ ID NO: 2857732 - DNA, 15 bp, Homo sapiens
attgagttttcagtg

SEQ ID NO: 2857733 - DNA, 16 bp, Homo sapiens
attgagttttcagtgg

SEQ ID NO: 2857734 - DNA, 22 bp, Homo sapiens
attgcatctcccagataatgtg

SEQ ID NO: 2857735 - DNA, 15 bp, Homo sapiens
attgcctggactgac

SEQ ID NO: 2857736 - DNA, 16 bp, Homo sapiens
attgcctggactgacc

SEQ ID NO: 2857737 - DNA, 18 bp, Homo sapiens
attgcctggactgaccac

SEQ ID NO: 2857738 - DNA, 19 bp, Homo sapiens
attgcctggactgaccaca

SEQ ID NO: 2857739 - DNA, 20 bp, Homo sapiens
attgctgataccatatgaat

SEQ ID NO: 2857740 - DNA, 21 bp, Homo sapiens
attgctgccccatcagtgctc

SEQ ID NO: 2857741 - DNA, 16 bp, Homo sapiens
attggactccaggcct

SEQ ID NO: 2857742 - DNA, 21 bp, Homo sapiens
attggactccaggcctgacca

SEQ ID NO: 2857743 - DNA, 13 bp, Homo sapiens
attggagggaaga

SEQ ID NO: 2857744 - DNA, 18 bp, Homo sapiens
attggcattctttgcaat

SEQ ID NO: 2857745 - DNA, 23 bp, Homo sapiens
attggcattctttgcaatactgc

SEQ ID NO: 2857746 - DNA, 18 bp, Homo sapiens
attgggaagctgggggaa

SEQ ID NO: 2857747 - DNA, 20 bp, Homo sapiens
attgtaagtgaaattaagca

SEQ ID NO: 2857748 - DNA, 23 bp, Homo sapiens
attgtaagtgaaattaagcattt

SEQ ID NO: 2857749 - DNA, 18 bp, Homo sapiens
attgtaattatgtaaata

SEQ ID NO: 2857750 - DNA, 19 bp, Homo sapiens
attgtacctctcttataga

SEQ ID NO: 2857751 - DNA, 14 bp, Homo sapiens
attgtcacatctat

SEQ ID NO: 2857752 - DNA, 18 bp, Homo sapiens
attgtccaatcctatgtt

SEQ ID NO: 2857753 - DNA, 21 bp, Homo sapiens
atttaaatacagtcttccatt

SEQ ID NO: 2857754 - DNA, 15 bp, Homo sapiens
atttaactttccagt

SEQ ID NO: 2857755 - DNA, 22 bp, Homo sapiens
atttaactttccagtcttagct

SEQ ID NO: 2857756 - DNA, 19 bp, Homo sapiens
atttacagataacttcttt

SEQ ID NO: 2857757 - DNA, 19 bp, Homo sapiens
atttagaagcctgacaact

SEQ ID NO: 2857758 - DNA, 17 bp, Homo sapiens
atttaggcaagagaaaa

SEQ ID NO: 2857759 - DNA, 13 bp, Homo sapiens
atttatattaaat

SEQ ID NO: 2857760 - DNA, 15 bp, Homo sapiens
atttattacctctga

SEQ ID NO: 2857761 - DNA, 14 bp, Homo sapiens
atttattattttca

SEQ ID NO: 2857762 - DNA, 21 bp, Homo sapiens
atttattattttcacctgttt

SEQ ID NO: 2857763 - DNA, 24 bp, Homo sapiens
atttatttactgagcttctctgtg

SEQ ID NO: 2857764 - DNA, 19 bp, Homo sapiens
atttcaaaatacatttgta

SEQ ID NO: 2857765 - DNA, 14 bp, Homo sapiens
atttccgggtggaa

SEQ ID NO: 2857766 - DNA, 13 bp, Homo sapiens
atttctaattgta

SEQ ID NO: 2857767 - DNA, 16 bp, Homo sapiens
atttctaattgtaagt

SEQ ID NO: 2857768 - DNA, 16 bp, Homo sapiens
catccaagccagagtt

SEQ ID NO: 2857769 - DNA, 17 bp, Homo sapiens
catccatgtacttccct

SEQ ID NO: 2857770 - DNA, 22 bp, Homo sapiens
catccatgtacttccctcttga

SEQ ID NO: 2857771 - DNA, 13 bp, Homo sapiens
catccattaggcc

SEQ ID NO: 2857772 - DNA, 17 bp, Homo sapiens
catcccacgttctgtta

SEQ ID NO: 2857773 - DNA, 12 bp, Homo sapiens
catcccctttcc

SEQ ID NO: 2857774 - DNA, 14 bp, Homo sapiens
catcccctttcctc

SEQ ID NO: 2857775 - DNA, 15 bp, Homo sapiens
catcccctttcctcc

SEQ ID NO: 2857776 - DNA, 21 bp, Homo sapiens
catcccctttcctccccacct

SEQ ID NO: 2857777 - DNA, 17 bp, Homo sapiens
catcccgagcacctcca

SEQ ID NO: 2857778 - DNA, 20 bp, Homo sapiens
catcctccacgttctgctca

SEQ ID NO: 2857779 - DNA, 12 bp, Homo sapiens
catcctcctccc

SEQ ID NO: 2857780 - DNA, 15 bp, Homo sapiens
catcctcctccccag

SEQ ID NO: 2857781 - DNA, 14 bp, Homo sapiens
catcctcttttaat

SEQ ID NO: 2857782 - DNA, 15 bp, Homo sapiens
catctaacctcatct

SEQ ID NO: 2857783 - DNA, 18 bp, Homo sapiens
catctaacctcatcttct

SEQ ID NO: 2857784 - DNA, 19 bp, Homo sapiens
catctaacctcatcttctt

SEQ ID NO: 2857785 - DNA, 16 bp, Homo sapiens
catctatccacactgt

SEQ ID NO: 2857786 - DNA, 12 bp, Homo sapiens
catctgaccatc

SEQ ID NO: 2857787 - DNA, 13 bp, Homo sapiens
catctgaccatct

SEQ ID NO: 2857788 - DNA, 16 bp, Homo sapiens
catctgtccctccggg

SEQ ID NO: 2857789 - DNA, 16 bp, Homo sapiens
catctgtgactataaa

SEQ ID NO: 2857790 - DNA, 23 bp, Homo sapiens
catctgtgactataaagctgtta

SEQ ID NO: 2857791 - DNA, 14 bp, Homo sapiens
catctgtgtcttgt

SEQ ID NO: 2857792 - DNA, 14 bp, Homo sapiens
catcttcttcacca

SEQ ID NO: 2857793 - DNA, 22 bp, Homo sapiens
catgatttccctccagagaaag

SEQ ID NO: 2857794 - DNA, 13 bp, Homo sapiens
catgggagccggg

SEQ ID NO: 2857795 - DNA, 19 bp, Homo sapiens
catggtcagccctagggtg

SEQ ID NO: 2857796 - DNA, 19 bp, Homo sapiens
catgtacttccctcttgaa

SEQ ID NO: 2857797 - DNA, 21 bp, Homo sapiens
catgtgtgtccacgactgtct

SEQ ID NO: 2857798 - DNA, 20 bp, Homo sapiens
catgtttttgttttaaaacg

SEQ ID NO: 2857799 - DNA, 22 bp, Homo sapiens
cattaactgttgcacttttgaa

SEQ ID NO: 2857800 - DNA, 16 bp, Homo sapiens
cattaggccagcaacg

SEQ ID NO: 2857801 - DNA, 22 bp, Homo sapiens
cattatgcacttttagaaatgc

SEQ ID NO: 2857802 - DNA, 21 bp, Homo sapiens
cattcaattagtggtcataaa

SEQ ID NO: 2857803 - DNA, 22 bp, Homo sapiens
cattcaattagtggtcataaaa

SEQ ID NO: 2857804 - DNA, 14 bp, Homo sapiens
cattccaagcctga

SEQ ID NO: 2857805 - DNA, 11 bp, Homo sapiens
cattcccctcg

SEQ ID NO: 2857806 - DNA, 20 bp, Homo sapiens
cattccggactggcagaagc

SEQ ID NO: 2857807 - DNA, 21 bp, Homo sapiens
cattcctgggaaatattccct

SEQ ID NO: 2857808 - DNA, 19 bp, Homo sapiens
cattctctgtctcatccat

SEQ ID NO: 2857809 - DNA, 23 bp, Homo sapiens
cattctctgtctcatccatcatc

SEQ ID NO: 2857810 - DNA, 16 bp, Homo sapiens
cattctgaaggagccc

SEQ ID NO: 2857811 - DNA, 17 bp, Homo sapiens
cattcttgaaagctgtg

SEQ ID NO: 2857812 - DNA, 22 bp, Homo sapiens
cattgaattcttggttgaggaa

SEQ ID NO: 2857813 - DNA, 15 bp, Homo sapiens
cattgcctggactga

SEQ ID NO: 2857814 - DNA, 17 bp, Homo sapiens
cattggacccttccatg

SEQ ID NO: 2857815 - DNA, 14 bp, Homo sapiens
cattgtaattatgt

SEQ ID NO: 2857816 - DNA, 18 bp, Homo sapiens
cattgtttgtctgtcttc

SEQ ID NO: 2857817 - DNA, 18 bp, Homo sapiens
catttaaatacagtcttc

SEQ ID NO: 2857818 - DNA, 15 bp, Homo sapiens
catttagaagcctga

SEQ ID NO: 2857819 - DNA, 23 bp, Homo sapiens
catttctatttatttactgagct

SEQ ID NO: 2857820 - DNA, 15 bp, Homo sapiens
catttctctaagaga

SEQ ID NO: 2857821 - DNA, 13 bp, Homo sapiens
catttctctttaa

SEQ ID NO: 2857822 - DNA, 22 bp, Homo sapiens
catttgcaagggaaaagtctct

SEQ ID NO: 2857823 - DNA, 16 bp, Homo sapiens
catttggacaaaatgg

SEQ ID NO: 2857824 - DNA, 17 bp, Homo sapiens
catttggacaaaatgga

SEQ ID NO: 2857825 - DNA, 22 bp, Homo sapiens
catttgtaagtgtaaaaaatgt

SEQ ID NO: 2857826 - DNA, 20 bp, Homo sapiens
cattttatcattaaaaatta

SEQ ID NO: 2857827 - DNA, 23 bp, Homo sapiens
cattttctaaataaaaatatgta

SEQ ID NO: 2857828 - DNA, 20 bp, Homo sapiens
cattttgtataatcacagtt

SEQ ID NO: 2857829 - DNA, 18 bp, Homo sapiens
ccaaaagtaaagatgcta

SEQ ID NO: 2857830 - DNA, 18 bp, Homo sapiens
ccaaagactgcagaaccc

SEQ ID NO: 2857831 - DNA, 11 bp, Homo sapiens
ccaaagagaaa

SEQ ID NO: 2857832 - DNA, 22 bp, Homo sapiens
ccaaaggcagctaagatagaaa

SEQ ID NO: 2857833 - DNA, 14 bp, Homo sapiens
ccaaattaaaacaa

SEQ ID NO: 2857834 - DNA, 20 bp, Homo sapiens
ccaacactgtccttccctgc

SEQ ID NO: 2857835 - DNA, 23 bp, Homo sapiens
ccaacactgtccttccctgccac

SEQ ID NO: 2857836 - DNA, 17 bp, Homo sapiens
ccaacagacacaattta

SEQ ID NO: 2857837 - DNA, 17 bp, Homo sapiens
ccaaccctggcttgggg

SEQ ID NO: 2857838 - DNA, 12 bp, Homo sapiens
ccaacctggact

SEQ ID NO: 2857839 - DNA, 13 bp, Homo sapiens
ccaacctggactt

SEQ ID NO: 2857840 - DNA, 16 bp, Homo sapiens
ccaacctggacttcct

SEQ ID NO: 2857841 - DNA, 21 bp, Homo sapiens
ccaacctggacttcctgtcat

SEQ ID NO: 2857842 - DNA, 23 bp, Homo sapiens
ccaaccttagatgttctaagtct

SEQ ID NO: 2857843 - DNA, 13 bp, Homo sapiens
ccaaccttgttta

SEQ ID NO: 2857844 - DNA, 22 bp, Homo sapiens
ccaagatggctgctgcctgctc

SEQ ID NO: 2857845 - DNA, 13 bp, Homo sapiens
ccaagcctgacca

SEQ ID NO: 2857846 - DNA, 21 bp, Homo sapiens
ccaagggctttgttttgcaca

SEQ ID NO: 2857847 - DNA, 22 bp, Homo sapiens
ccaataaaagctcttctttttt

SEQ ID NO: 2857848 - DNA, 19 bp, Homo sapiens
ccaatccatcgtattaaaa

SEQ ID NO: 2857849 - DNA, 20 bp, Homo sapiens
ccaatccatcgtattaaaaa

SEQ ID NO: 2857850 - DNA, 13 bp, Homo sapiens
ccaatcctatgtt

SEQ ID NO: 2857851 - DNA, 15 bp, Homo sapiens
ccaatgaaaaaatgt

SEQ ID NO: 2857852 - DNA, 23 bp, Homo sapiens
ccaatgaaaaaatgtatatgcac

SEQ ID NO: 2857853 - DNA, 12 bp, Homo sapiens
ccaatgtcttga

SEQ ID NO: 2857854 - DNA, 18 bp, Homo sapiens
ccaattaaaaacgaaaac

SEQ ID NO: 2857855 - DNA, 21 bp, Homo sapiens
ccaattaaaaacgaaaacctg

SEQ ID NO: 2857856 - DNA, 14 bp, Homo sapiens
ccacaccaaccagg

SEQ ID NO: 2857857 - DNA, 18 bp, Homo sapiens
ccacagaaggtgaacttt

SEQ ID NO: 2857858 - DNA, 19 bp, Homo sapiens
ccacagaaggtgaactttg

SEQ ID NO: 2857859 - DNA, 16 bp, Homo sapiens
ccacagccatagacct

SEQ ID NO: 2857860 - DNA, 16 bp, Homo sapiens
ccacagcctcccctgc

SEQ ID NO: 2857861 - DNA, 20 bp, Homo sapiens
ccacagcctcccctgccagg

SEQ ID NO: 2857862 - DNA, 16 bp, Homo sapiens
ccacatgggaggctca

SEQ ID NO: 2857863 - DNA, 14 bp, Homo sapiens
ccacattcttcagt

SEQ ID NO: 2857864 - DNA, 16 bp, Homo sapiens
ccacattcttcagttt

SEQ ID NO: 2857865 - DNA, 19 bp, Homo sapiens
ccacccctaagtgcccaaa

SEQ ID NO: 2857866 - DNA, 17 bp, Homo sapiens
ccaccctccaccttcca

SEQ ID NO: 2857867 - DNA, 11 bp, Homo sapiens
ccaccttcccc

SEQ ID NO: 2857868 - DNA, 20 bp, Homo sapiens
ccaccttccccagactcagc

SEQ ID NO: 2857869 - DNA, 22 bp, Homo sapiens
ccaccttccccagactcagctc

SEQ ID NO: 2857870 - DNA, 18 bp, Homo sapiens
ccaccttggactcctccc

SEQ ID NO: 2857871 - DNA, 19 bp, Homo sapiens
ccacgccctccctctccca

SEQ ID NO: 2857872 - DNA, 12 bp, Homo sapiens
ccacggagccac

SEQ ID NO: 2857873 - DNA, 21 bp, Homo sapiens
ccacggagccactcctctgac

SEQ ID NO: 2857874 - DNA, 15 bp, Homo sapiens
ccactctcccctccc

SEQ ID NO: 2857875 - DNA, 16 bp, Homo sapiens
ccactctcccctccct

SEQ ID NO: 2857876 - DNA, 18 bp, Homo sapiens
ccactctcccctccctct

SEQ ID NO: 2857877 - DNA, 17 bp, Homo sapiens
ccactcttttgctgtgc

SEQ ID NO: 2857878 - DNA, 14 bp, Homo sapiens
ctatttatttactg

SEQ ID NO: 2857879 - DNA, 18 bp, Homo sapiens
ctattttcataatcagta

SEQ ID NO: 2857880 - DNA, 22 bp, Homo sapiens
ctcaatgcaagccccaactttc

SEQ ID NO: 2857881 - DNA, 22 bp, Homo sapiens
ctcacatgtcagtaccttcaaa

SEQ ID NO: 2857882 - DNA, 17 bp, Homo sapiens
ctcacccccttctccat

SEQ ID NO: 2857883 - DNA, 20 bp, Homo sapiens
ctcacccccttctccatcca

SEQ ID NO: 2857884 - DNA, 17 bp, Homo sapiens
ctcactataccagtata

SEQ ID NO: 2857885 - DNA, 13 bp, Homo sapiens
ctcactccccagc

SEQ ID NO: 2857886 - DNA, 20 bp, Homo sapiens
ctcactccccagccccaccc

SEQ ID NO: 2857887 - DNA, 11 bp, Homo sapiens
ctcactctggg

SEQ ID NO: 2857888 - DNA, 20 bp, Homo sapiens
ctcagaggaaaaatgggagc

SEQ ID NO: 2857889 - DNA, 13 bp, Homo sapiens
ctcagctccagaa

SEQ ID NO: 2857890 - DNA, 22 bp, Homo sapiens
ctcagctccagaataccttctt

SEQ ID NO: 2857891 - DNA, 17 bp, Homo sapiens
ctcagctgtcctgcagc

SEQ ID NO: 2857892 - DNA, 19 bp, Homo sapiens
ctcagctgtcctgcagcaa

SEQ ID NO: 2857893 - DNA, 20 bp, Homo sapiens
ctcaggaccaaagctttcat

SEQ ID NO: 2857894 - DNA, 21 bp, Homo sapiens
ctcaggaccaaagctttcatg

SEQ ID NO: 2857895 - DNA, 22 bp, Homo sapiens
ctcaggaccaaagctttcatgt

SEQ ID NO: 2857896 - DNA, 12 bp, Homo sapiens
ctcaggagagac

SEQ ID NO: 2857897 - DNA, 15 bp, Homo sapiens
ctcagggctcctggg

SEQ ID NO: 2857898 - DNA, 17 bp, Homo sapiens
ctcagggctcctgggtt

SEQ ID NO: 2857899 - DNA, 20 bp, Homo sapiens
ctcagtgggacaaaccagag

SEQ ID NO: 2857900 - DNA, 18 bp, Homo sapiens
ctcagtggtgtgtgaagt

SEQ ID NO: 2857901 - DNA, 21 bp, Homo sapiens
ctcagtgttttggtggaaaaa

SEQ ID NO: 2857902 - DNA, 18 bp, Homo sapiens
ctcagttctcaaatgtgt

SEQ ID NO: 2857903 - DNA, 13 bp, Homo sapiens
ctcatcattctct

SEQ ID NO: 2857904 - DNA, 19 bp, Homo sapiens
ctcatcattctctgtctca

SEQ ID NO: 2857905 - DNA, 19 bp, Homo sapiens
ctcatccatcatcatgtgt

SEQ ID NO: 2857906 - DNA, 23 bp, Homo sapiens
ctcatgtatattacccaatggaa

SEQ ID NO: 2857907 - DNA, 12 bp, Homo sapiens
ctcattcccctc

SEQ ID NO: 2857908 - DNA, 14 bp, Homo sapiens
ctcattcccctcgt

SEQ ID NO: 2857909 - DNA, 17 bp, Homo sapiens
ctcattctgaaggagcc

SEQ ID NO: 2857910 - DNA, 15 bp, Homo sapiens
ctccacattcttcag

SEQ ID NO: 2857911 - DNA, 18 bp, Homo sapiens
ctccacattcttcagttt

SEQ ID NO: 2857912 - DNA, 22 bp, Homo sapiens
ctccacattcttcagtttttca

SEQ ID NO: 2857913 - DNA, 16 bp, Homo sapiens
ctccaccctccacctt

SEQ ID NO: 2857914 - DNA, 15 bp, Homo sapiens
ctccacgttctgctc

SEQ ID NO: 2857915 - DNA, 17 bp, Homo sapiens
ctccacgttctgctcat

SEQ ID NO: 2857916 - DNA, 15 bp, Homo sapiens
ctccactcagctgtc

SEQ ID NO: 2857917 - DNA, 18 bp, Homo sapiens
ctccactcagctgtcctg

SEQ ID NO: 2857918 - DNA, 21 bp, Homo sapiens
ctccactcagctgtcctgcag

SEQ ID NO: 2857919 - DNA, 19 bp, Homo sapiens
ctccactcccagcagctca

SEQ ID NO: 2857920 - DNA, 22 bp, Homo sapiens
ctccagagaaagcacaatttaa

SEQ ID NO: 2857921 - DNA, 21 bp, Homo sapiens
ctccagagggcactctgcttg

SEQ ID NO: 2857922 - DNA, 12 bp, Homo sapiens
ctccagcccctg

SEQ ID NO: 2857923 - DNA, 14 bp, Homo sapiens
ctccagcccctgtc

SEQ ID NO: 2857924 - DNA, 13 bp, Homo sapiens
ctccaggcctgac

SEQ ID NO: 2857925 - DNA, 15 bp, Homo sapiens
ctccaggcctgacca

SEQ ID NO: 2857926 - DNA, 13 bp, Homo sapiens
ctccaggcctgtt

SEQ ID NO: 2857927 - DNA, 15 bp, Homo sapiens
ctcccacccacagcc

SEQ ID NO: 2857928 - DNA, 16 bp, Homo sapiens
ctcccacccacagcca

SEQ ID NO: 2857929 - DNA, 15 bp, Homo sapiens
ctccccaccttcccc

SEQ ID NO: 2857930 - DNA, 12 bp, Homo sapiens
ctcccccaaagc

SEQ ID NO: 2857931 - DNA, 19 bp, Homo sapiens
ctcccctccctcttccttc

SEQ ID NO: 2857932 - DNA, 15 bp, Homo sapiens
ctcccctgccagggc

SEQ ID NO: 2857933 - DNA, 18 bp, Homo sapiens
ctcccttgggctccctgt

SEQ ID NO: 2857934 - DNA, 14 bp, Homo sapiens
ctccgctgggcttc

SEQ ID NO: 2857935 - DNA, 16 bp, Homo sapiens
ctccgggcaggcaagg

SEQ ID NO: 2857936 - DNA, 21 bp, Homo sapiens
ctcctcaggagagacccctcc

SEQ ID NO: 2857937 - DNA, 17 bp, Homo sapiens
ctcctccccagctcttc

SEQ ID NO: 2857938 - DNA, 13 bp, Homo sapiens
ctcctctgtgacc

SEQ ID NO: 2857939 - DNA, 20 bp, Homo sapiens
ctcctgagaaaaaaggttcc

SEQ ID NO: 2857940 - DNA, 16 bp, Homo sapiens
ctcctgcctccgggca

SEQ ID NO: 2857941 - DNA, 16 bp, Homo sapiens
ctcctgccttcctcct

SEQ ID NO: 2857942 - DNA, 15 bp, Homo sapiens
ctcctgggccctctc

SEQ ID NO: 2857943 - DNA, 13 bp, Homo sapiens
ctccttcctggag

SEQ ID NO: 2857944 - DNA, 18 bp, Homo sapiens
ctccttgggccctttgag

SEQ ID NO: 2857945 - DNA, 22 bp, Homo sapiens
ctcgagaccataaagatattct

SEQ ID NO: 2857946 - DNA, 13 bp, Homo sapiens
ctcgctgccagct

SEQ ID NO: 2857947 - DNA, 16 bp, Homo sapiens
ctcgctggactctcag

SEQ ID NO: 2857948 - DNA, 23 bp, Homo sapiens
ctcggaggtccagctgggcctcc

SEQ ID NO: 2857949 - DNA, 21 bp, Homo sapiens
ctctaaccaaggctgtgttta

SEQ ID NO: 2857950 - DNA, 19 bp, Homo sapiens
ctctacccggcccagagac

SEQ ID NO: 2857951 - DNA, 12 bp, Homo sapiens
ctctacctgaca

SEQ ID NO: 2857952 - DNA, 22 bp, Homo sapiens
ctctactaaaaatacaaaaatt

SEQ ID NO: 2857953 - DNA, 21 bp, Homo sapiens
ctctactaacaatcagctcct

SEQ ID NO: 2857954 - DNA, 20 bp, Homo sapiens
ctctagtgggacagcccaga

SEQ ID NO: 2857955 - DNA, 22 bp, Homo sapiens
ctctagtgggacagcccagagc

SEQ ID NO: 2857956 - DNA, 20 bp, Homo sapiens
ctctattttcataatcagta

SEQ ID NO: 2857957 - DNA, 14 bp, Homo sapiens
ctctcagtctctga

SEQ ID NO: 2857958 - DNA, 17 bp, Homo sapiens
ctctccagtttgcacct

SEQ ID NO: 2857959 - DNA, 23 bp, Homo sapiens
ctctccagtttgcacctgtcccc

SEQ ID NO: 2857960 - DNA, 14 bp, Homo sapiens
ctctcccaggcccg

SEQ ID NO: 2857961 - DNA, 15 bp, Homo sapiens
ctctcccctccctct

SEQ ID NO: 2857962 - DNA, 21 bp, Homo sapiens
ctctctacccggcccagagac

SEQ ID NO: 2857963 - DNA, 22 bp, Homo sapiens
ctctctctacccggcccagaga

SEQ ID NO: 2857964 - DNA, 17 bp, Homo sapiens
ctctgaaaccagtgtta

SEQ ID NO: 2857965 - DNA, 20 bp, Homo sapiens
ctctgactcagggctcctgg

SEQ ID NO: 2857966 - DNA, 12 bp, Homo sapiens
ctctgatccctc

SEQ ID NO: 2857967 - DNA, 22 bp, Homo sapiens
ctctgatccctctacagagctt

SEQ ID NO: 2857968 - DNA, 13 bp, Homo sapiens
ctctgctagactc

SEQ ID NO: 2857969 - DNA, 20 bp, Homo sapiens
ctctgctagactcctcagga

SEQ ID NO: 2857970 - DNA, 21 bp, Homo sapiens
ctctgctagactcctcaggag

SEQ ID NO: 2857971 - DNA, 16 bp, Homo sapiens
ctctggccctggccct

SEQ ID NO: 2857972 - DNA, 14 bp, Homo sapiens
ctctggctagagcc

SEQ ID NO: 2857973 - DNA, 16 bp, Homo sapiens
ctctggctagagccga

SEQ ID NO: 2857974 - DNA, 21 bp, Homo sapiens
ctctgtgaacgatttagaaag

SEQ ID NO: 2857975 - DNA, 23 bp, Homo sapiens
ctctgtgaacgatttagaaagaa

SEQ ID NO: 2857976 - DNA, 14 bp, Homo sapiens
ctctgtgaccaatg

SEQ ID NO: 2857977 - DNA, 17 bp, Homo sapiens
ctctgtgaccaatgtct

SEQ ID NO: 2857978 - DNA, 20 bp, Homo sapiens
ctcttatagaatatttatta

SEQ ID NO: 2857979 - DNA, 19 bp, Homo sapiens
ctcttcatggcatcttcaa

SEQ ID NO: 2857980 - DNA, 13 bp, Homo sapiens
ctcttccttcccc

SEQ ID NO: 2857981 - DNA, 22 bp, Homo sapiens
ctcttccttcccccatcccctt

SEQ ID NO: 2857982 - DNA, 21 bp, Homo sapiens
ctcttctgggagggcagcagg

SEQ ID NO: 2857983 - DNA, 16 bp, Homo sapiens
ctcttgaaacctgatg

SEQ ID NO: 2857984 - DNA, 20 bp, Homo sapiens
ctctttaaactatgttccta

SEQ ID NO: 2857985 - DNA, 13 bp, Homo sapiens
ctctttcttgttt

SEQ ID NO: 2857986 - DNA, 18 bp, Homo sapiens
ctctttcttgtttgtcag

SEQ ID NO: 2857987 - DNA, 22 bp, Homo sapiens
ctctttcttgtttgtcagcatc

SEQ ID NO: 2857988 - DNA, 21 bp, Homo sapiens
ctttcctccccaccttcccca

SEQ ID NO: 2857989 - DNA, 16 bp, Homo sapiens
ctttcctctgcagcac

SEQ ID NO: 2857990 - DNA, 21 bp, Homo sapiens
ctttcctgtgtgtactctgtc

SEQ ID NO: 2857991 - DNA, 23 bp, Homo sapiens
ctttctatttttatgatgacaat

SEQ ID NO: 2857992 - DNA, 20 bp, Homo sapiens
ctttcttgtttgtcagcatc

SEQ ID NO: 2857993 - DNA, 21 bp, Homo sapiens
ctttcttgtttgtcagcatct

SEQ ID NO: 2857994 - DNA, 21 bp, Homo sapiens
ctttgagtgcagtcctgatca

SEQ ID NO: 2857995 - DNA, 22 bp, Homo sapiens
ctttgcaatactgcttaattgc

SEQ ID NO: 2857996 - DNA, 16 bp, Homo sapiens
ctttgcattttgatat

SEQ ID NO: 2857997 - DNA, 19 bp, Homo sapiens
ctttgcattttgatattgc

SEQ ID NO: 2857998 - DNA, 19 bp, Homo sapiens
ctttggaagatgcagaagc

SEQ ID NO: 2857999 - DNA, 23 bp, Homo sapiens
ctttgtcagtgttgcctcttgca

SEQ ID NO: 2858000 - DNA, 23 bp, Homo sapiens
ctttgttttgcacactttgccat

SEQ ID NO: 2858001 - DNA, 17 bp, Homo sapiens
cttttagaaatgcatat

SEQ ID NO: 2858002 - DNA, 15 bp, Homo sapiens
cttttctcctgcaga

SEQ ID NO: 2858003 - DNA, 17 bp, Homo sapiens
cttttgacaaaggcaag

SEQ ID NO: 2858004 - DNA, 13 bp, Homo sapiens
cttttgctgtgca

SEQ ID NO: 2858005 - DNA, 22 bp, Homo sapiens
cttttggcctcctgcaaagtct

SEQ ID NO: 2858006 - DNA, 12 bp, Homo sapiens
ctttttcataat

SEQ ID NO: 2858007 - DNA, 13 bp, Homo sapiens
ctttttcataatt

SEQ ID NO: 2858008 - DNA, 14 bp, Homo sapiens
ctttttcatagtaa

SEQ ID NO: 2858009 - DNA, 17 bp, Homo sapiens
ctttttctgccactgag

SEQ ID NO: 2858010 - DNA, 13 bp, Homo sapiens
ctttttgctttcg

SEQ ID NO: 2858011 - DNA, 15 bp, Homo sapiens
cttttttctcttccc

SEQ ID NO: 2858012 - DNA, 15 bp, Homo sapiens
gaaaaataaaatgtt

SEQ ID NO: 2858013 - DNA, 21 bp, Homo sapiens
gaaaaatataatgttgataat

SEQ ID NO: 2858014 - DNA, 17 bp, Homo sapiens
gaaaaatgggagccagg

SEQ ID NO: 2858015 - DNA, 21 bp, Homo sapiens
gaaaagaatccctgcagcctg

SEQ ID NO: 2858016 - DNA, 21 bp, Homo sapiens
gaaaagaggtggattcctggg

SEQ ID NO: 2858017 - DNA, 15 bp, Homo sapiens
gaaaatgtatccaag

SEQ ID NO: 2858018 - DNA, 17 bp, Homo sapiens
gaaaatttgttattttg

SEQ ID NO: 2858019 - DNA, 20 bp, Homo sapiens
gaaacaaacaaaactcttaa

SEQ ID NO: 2858020 - DNA, 18 bp, Homo sapiens
gaaacaaataatttgaac

SEQ ID NO: 2858021 - DNA, 21 bp, Homo sapiens
gaaacaaataatttgaacttt

SEQ ID NO: 2858022 - DNA, 17 bp, Homo sapiens
gaaacaactctttgaga

SEQ ID NO: 2858023 - DNA, 20 bp, Homo sapiens
gaaacactatttgtgacttt

SEQ ID NO: 2858024 - DNA, 15 bp, Homo sapiens
gaaacagccagcaag

SEQ ID NO: 2858025 - DNA, 18 bp, Homo sapiens
gaaaccagagtctgtatt

SEQ ID NO: 2858026 - DNA, 14 bp, Homo sapiens
gaaacccaaggaac

SEQ ID NO: 2858027 - DNA, 15 bp, Homo sapiens
gaaacccaaggaaca

SEQ ID NO: 2858028 - DNA, 15 bp, Homo sapiens
gaaacctgatgtcag

SEQ ID NO: 2858029 - DNA, 19 bp, Homo sapiens
gaaagcctccgctgggctt

SEQ ID NO: 2858030 - DNA, 15 bp, Homo sapiens
gaaaggcttggctgg

SEQ ID NO: 2858031 - DNA, 19 bp, Homo sapiens
gaaaggcttggctggtgta

SEQ ID NO: 2858032 - DNA, 21 bp, Homo sapiens
gaaataatgggattagaaaca

SEQ ID NO: 2858033 - DNA, 20 bp, Homo sapiens
gaaatacgtttgtgtttcta

SEQ ID NO: 2858034 - DNA, 15 bp, Homo sapiens
gaaatattccctaga

SEQ ID NO: 2858035 - DNA, 22 bp, Homo sapiens
gaaattaagcattttgaaacaa

SEQ ID NO: 2858036 - DNA, 22 bp, Homo sapiens
gaacacctttgttttgcactga

SEQ ID NO: 2858037 - DNA, 22 bp, Homo sapiens
gaacagggacttgtttagagag

SEQ ID NO: 2858038 - DNA, 16 bp, Homo sapiens
gaacataacttctcat

SEQ ID NO: 2858039 - DNA, 19 bp, Homo sapiens
gaacccatattttaaattc

SEQ ID NO: 2858040 - DNA, 22 bp, Homo sapiens
gaacctaaagtagcaggactcg

SEQ ID NO: 2858041 - DNA, 20 bp, Homo sapiens
gaactaccttggttccccca

SEQ ID NO: 2858042 - DNA, 15 bp, Homo sapiens
gaactcactctgggc

SEQ ID NO: 2858043 - DNA, 17 bp, Homo sapiens
gaactcactctgggctg

SEQ ID NO: 2858044 - DNA, 18 bp, Homo sapiens
gaactgggtgactggagg

SEQ ID NO: 2858045 - DNA, 19 bp, Homo sapiens
gaacttcagcattgtaatt

SEQ ID NO: 2858046 - DNA, 17 bp, Homo sapiens
gaagaaagtcaaaaaat

SEQ ID NO: 2858047 - DNA, 19 bp, Homo sapiens
gaagcaataataaagtact

SEQ ID NO: 2858048 - DNA, 18 bp, Homo sapiens
gaagcattgcctggactg

SEQ ID NO: 2858049 - DNA, 13 bp, Homo sapiens
gaagccgactctg

SEQ ID NO: 2858050 - DNA, 15 bp, Homo sapiens
gaagccgactctggc

SEQ ID NO: 2858051 - DNA, 22 bp, Homo sapiens
gaagctcttttctcctgcagaa

SEQ ID NO: 2858052 - DNA, 17 bp, Homo sapiens
gaagcttgagcctcccc

SEQ ID NO: 2858053 - DNA, 16 bp, Homo sapiens
gaaggcttctctctgt

SEQ ID NO: 2858054 - DNA, 16 bp, Homo sapiens
gaaggggccagaggct

SEQ ID NO: 2858055 - DNA, 22 bp, Homo sapiens
gaagggggattggagggaagac

SEQ ID NO: 2858056 - DNA, 16 bp, Homo sapiens
gaagggggtgggggga

SEQ ID NO: 2858057 - DNA, 22 bp, Homo sapiens
gaagggtggtctgagcaccccc

SEQ ID NO: 2858058 - DNA, 22 bp, Homo sapiens
gaagtcagaatttttaactgta

SEQ ID NO: 2858059 - DNA, 18 bp, Homo sapiens
gaagtgaacccatatttt

SEQ ID NO: 2858060 - DNA, 19 bp, Homo sapiens
gaagtgaacccatatttta

SEQ ID NO: 2858061 - DNA, 17 bp, Homo sapiens
gaagtgatatggtgaag

SEQ ID NO: 2858062 - DNA, 22 bp, Homo sapiens
gaataaataaatgtatcttatt

SEQ ID NO: 2858063 - DNA, 20 bp, Homo sapiens
gaataatatcaaataaaata

SEQ ID NO: 2858064 - DNA, 21 bp, Homo sapiens
gaatactgccaaaacatttat

SEQ ID NO: 2858065 - DNA, 19 bp, Homo sapiens
gaatacttttgccctttga

SEQ ID NO: 2858066 - DNA, 13 bp, Homo sapiens
gaatattgtccat

SEQ ID NO: 2858067 - DNA, 10 bp, Homo sapiens
gaatatttat

SEQ ID NO: 2858068 - DNA, 17 bp, Homo sapiens
gaatatttattacctct

SEQ ID NO: 2858069 - DNA, 18 bp, Homo sapiens
gaatatttattacctctg

SEQ ID NO: 2858070 - DNA, 19 bp, Homo sapiens
gaatatttattacctctga

SEQ ID NO: 2858071 - DNA, 23 bp, Homo sapiens
gaatcaagagggcagcccccact

SEQ ID NO: 2858072 - DNA, 22 bp, Homo sapiens
gaatcatttctatttctcctcc

SEQ ID NO: 2858073 - DNA, 18 bp, Homo sapiens
gaatccctgcagcctggt

SEQ ID NO: 2858074 - DNA, 16 bp, Homo sapiens
gaatctatgaacctga

SEQ ID NO: 2858075 - DNA, 18 bp, Homo sapiens
gaatctctttttgctttc

SEQ ID NO: 2858076 - DNA, 22 bp, Homo sapiens
gaatgaatgggatattttgaaa

SEQ ID NO: 2858077 - DNA, 15 bp, Homo sapiens
gaatgattcagtgtt

SEQ ID NO: 2858078 - DNA, 17 bp, Homo sapiens
gaatgttacattgtttg

SEQ ID NO: 2858079 - DNA, 17 bp, Homo sapiens
gaattcggtgtgcacca

SEQ ID NO: 2858080 - DNA, 20 bp, Homo sapiens
gaattcttggttgaggaaac

SEQ ID NO: 2858081 - DNA, 13 bp, Homo sapiens
gaattgggaagct

SEQ ID NO: 2858082 - DNA, 16 bp, Homo sapiens
gaatttaataatctgt

SEQ ID NO: 2858083 - DNA, 17 bp, Homo sapiens
gaatttattcaattcct

SEQ ID NO: 2858084 - DNA, 17 bp, Homo sapiens
gaatttgagtgctctga

SEQ ID NO: 2858085 - DNA, 21 bp, Homo sapiens
gacaactcattttcatattgt

SEQ ID NO: 2858086 - DNA, 23 bp, Homo sapiens
gacaactcattttcatattgtaa

SEQ ID NO: 2858087 - DNA, 16 bp, Homo sapiens
gacacagacccacaca

SEQ ID NO: 2858088 - DNA, 21 bp, Homo sapiens
gacactcccttgggctccctg

SEQ ID NO: 2858089 - DNA, 13 bp, Homo sapiens
gacagcccagagc

SEQ ID NO: 2858090 - DNA, 14 bp, Homo sapiens
gacagtttccaaat

SEQ ID NO: 2858091 - DNA, 18 bp, Homo sapiens
gacatttatattaaataa

SEQ ID NO: 2858092 - DNA, 16 bp, Homo sapiens
gacatttctctaagag

SEQ ID NO: 2858093 - DNA, 18 bp, Homo sapiens
gaccaaagactgcagaac

SEQ ID NO: 2858094 - DNA, 20 bp, Homo sapiens
gaccaaagactgcagaaccc

SEQ ID NO: 2858095 - DNA, 17 bp, Homo sapiens
gaccacaccaaccaggc

SEQ ID NO: 2858096 - DNA, 21 bp, Homo sapiens
gaccacgctttctagctgttg

SEQ ID NO: 2858097 - DNA, 19 bp, Homo sapiens
gatgggatggtggagggcc

SEQ ID NO: 2858098 - DNA, 14 bp, Homo sapiens
gatggtggagggcc

SEQ ID NO: 2858099 - DNA, 15 bp, Homo sapiens
gatggtggagggcca

SEQ ID NO: 2858100 - DNA, 19 bp, Homo sapiens
gatgtccttaaaatgtggt

SEQ ID NO: 2858101 - DNA, 19 bp, Homo sapiens
gatgtgacccaccagtgcc

SEQ ID NO: 2858102 - DNA, 22 bp, Homo sapiens
gatgttatacatcaatatgtat

SEQ ID NO: 2858103 - DNA, 13 bp, Homo sapiens
gattacctcctga

SEQ ID NO: 2858104 - DNA, 20 bp, Homo sapiens
gattagaaacaaacaaaact

SEQ ID NO: 2858105 - DNA, 15 bp, Homo sapiens
gattagtgatgtcct

SEQ ID NO: 2858106 - DNA, 19 bp, Homo sapiens
gattatgtagcaaaataca

SEQ ID NO: 2858107 - DNA, 15 bp, Homo sapiens
gattattcagtgtca

SEQ ID NO: 2858108 - DNA, 16 bp, Homo sapiens
gattcctgggcaagaa

SEQ ID NO: 2858109 - DNA, 11 bp, Homo sapiens
gattctgggaa

SEQ ID NO: 2858110 - DNA, 23 bp, Homo sapiens
gattctgggaagcttgagcctcc

SEQ ID NO: 2858111 - DNA, 16 bp, Homo sapiens
gattgagtctgtgcca

SEQ ID NO: 2858112 - DNA, 16 bp, Homo sapiens
gattgctgccccatca

SEQ ID NO: 2858113 - DNA, 21 bp, Homo sapiens
gatttccctccagagaaagca

SEQ ID NO: 2858114 - DNA, 10 bp, Homo sapiens
gatttctaat

SEQ ID NO: 2858115 - DNA, 15 bp, Homo sapiens
gattttaattttgaa

SEQ ID NO: 2858116 - DNA, 15 bp, Homo sapiens
gcaaacactccaccc

SEQ ID NO: 2858117 - DNA, 17 bp, Homo sapiens
gcaaacactccaccctc

SEQ ID NO: 2858118 - DNA, 17 bp, Homo sapiens
gcaaattccagatttgt

SEQ ID NO: 2858119 - DNA, 15 bp, Homo sapiens
gcaataataaagtac

SEQ ID NO: 2858120 - DNA, 16 bp, Homo sapiens
gcaataataaagtact

SEQ ID NO: 2858121 - DNA, 13 bp, Homo sapiens
gcaattcagtgtt

SEQ ID NO: 2858122 - DNA, 24 bp, Homo sapiens
gcaattccaggctgagccatgagg

SEQ ID NO: 2858123 - DNA, 21 bp, Homo sapiens
gcaattgcgaccttaatttaa

SEQ ID NO: 2858124 - DNA, 17 bp, Homo sapiens
gcacacatggacacaga

SEQ ID NO: 2858125 - DNA, 13 bp, Homo sapiens
gcacactttgcca

SEQ ID NO: 2858126 - DNA, 20 bp, Homo sapiens
gcacagggtgtggtatgagg

SEQ ID NO: 2858127 - DNA, 18 bp, Homo sapiens
gcacatctgtgtcttgtt

SEQ ID NO: 2858128 - DNA, 15 bp, Homo sapiens
gcaccaagcaggaaa

SEQ ID NO: 2858129 - DNA, 16 bp, Homo sapiens
gcaccatcacacatgc

SEQ ID NO: 2858130 - DNA, 18 bp, Homo sapiens
gcacctctggctagagcc

SEQ ID NO: 2858131 - DNA, 21 bp, Homo sapiens
gcacctctggctagagccgag

SEQ ID NO: 2858132 - DNA, 20 bp, Homo sapiens
gcacctgtccccaccctcca

SEQ ID NO: 2858133 - DNA, 23 bp, Homo sapiens
gcacctgtccccaccctccactc

SEQ ID NO: 2858134 - DNA, 21 bp, Homo sapiens
gcactgagataccagcgagga

SEQ ID NO: 2858135 - DNA, 12 bp, Homo sapiens
gcactgggctgt

SEQ ID NO: 2858136 - DNA, 19 bp, Homo sapiens
gcactggtaggttgggaca

SEQ ID NO: 2858137 - DNA, 18 bp, Homo sapiens
gcactttaaccctctctt

SEQ ID NO: 2858138 - DNA, 21 bp, Homo sapiens
gcactttaaccctctcttccc

SEQ ID NO: 2858139 - DNA, 15 bp, Homo sapiens
gcactttataaaagc

SEQ ID NO: 2858140 - DNA, 17 bp, Homo sapiens
gcactttataaaagcaa

SEQ ID NO: 2858141 - DNA, 13 bp, Homo sapiens
gcacttttgaatg

SEQ ID NO: 2858142 - DNA, 15 bp, Homo sapiens
gcagaagcaataata

SEQ ID NO: 2858143 - DNA, 18 bp, Homo sapiens
gcagaagcattgcctgga

SEQ ID NO: 2858144 - DNA, 20 bp, Homo sapiens
gcagaagcattgcctggact

SEQ ID NO: 2858145 - DNA, 22 bp, Homo sapiens
gcagagcaattccaggctgagc

SEQ ID NO: 2858146 - DNA, 16 bp, Homo sapiens
gcagagcccaagggaa

SEQ ID NO: 2858147 - DNA, 18 bp, Homo sapiens
gcagcacctccaggcctg

SEQ ID NO: 2858148 - DNA, 18 bp, Homo sapiens
gcagcactttaaccctct

SEQ ID NO: 2858149 - DNA, 21 bp, Homo sapiens
gcagcactttaaccctctctt

SEQ ID NO: 2858150 - DNA, 17 bp, Homo sapiens
gcagcagggaagctctt

SEQ ID NO: 2858151 - DNA, 19 bp, Homo sapiens
gcagcagggctaccctgag

SEQ ID NO: 2858152 - DNA, 19 bp, Homo sapiens
gcagcagtgtgaggccagg

SEQ ID NO: 2858153 - DNA, 23 bp, Homo sapiens
gcagcagtgtgaggccagggcag

SEQ ID NO: 2858154 - DNA, 15 bp, Homo sapiens
gcagcccccactttc

SEQ ID NO: 2858155 - DNA, 17 bp, Homo sapiens
gcagccgctgagcgagg

SEQ ID NO: 2858156 - DNA, 16 bp, Homo sapiens
gcagcctgctctagtg

SEQ ID NO: 2858157 - DNA, 21 bp, Homo sapiens
gcagcctgctctagtgggaca

SEQ ID NO: 2858158 - DNA, 18 bp, Homo sapiens
gcagctaagatagaaagc

SEQ ID NO: 2858159 - DNA, 22 bp, Homo sapiens
gcagctaagatagaaagctgga

SEQ ID NO: 2858160 - DNA, 21 bp, Homo sapiens
gcagggctaccctgagctgag

SEQ ID NO: 2858161 - DNA, 18 bp, Homo sapiens
gcaggggtgggagagcca

SEQ ID NO: 2858162 - DNA, 14 bp, Homo sapiens
gcaggttctctttg

SEQ ID NO: 2858163 - DNA, 20 bp, Homo sapiens
gcagtgaatgattcagtgtt

SEQ ID NO: 2858164 - DNA, 19 bp, Homo sapiens
gcagtgtgaggccagggca

SEQ ID NO: 2858165 - DNA, 17 bp, Homo sapiens
gcatcccacgttctgtt

SEQ ID NO: 2858166 - DNA, 18 bp, Homo sapiens
gcatcccacgttctgtta

SEQ ID NO: 2858167 - DNA, 20 bp, Homo sapiens
gcatctcagtggtgtgtgaa

SEQ ID NO: 2858168 - DNA, 20 bp, Homo sapiens
gcatgaaaaaccatttttga

SEQ ID NO: 2858169 - DNA, 22 bp, Homo sapiens
gcatgcactgttccccctgtgc

SEQ ID NO: 2858170 - DNA, 13 bp, Homo sapiens
gcattctgtttat

SEQ ID NO: 2858171 - DNA, 20 bp, Homo sapiens
gcattctttgcaatactgct

SEQ ID NO: 2858172 - DNA, 16 bp, Homo sapiens
gcattgccaagggctt

SEQ ID NO: 2858173 - DNA, 14 bp, Homo sapiens
gcattgcctggact

SEQ ID NO: 2858174 - DNA, 16 bp, Homo sapiens
gcatttctctttaaac

SEQ ID NO: 2858175 - DNA, 13 bp, Homo sapiens
gcattttgaaaca

SEQ ID NO: 2858176 - DNA, 21 bp, Homo sapiens
gccaacctggacttcctgtca

SEQ ID NO: 2858177 - DNA, 17 bp, Homo sapiens
gccaagatggctgctgc

SEQ ID NO: 2858178 - DNA, 15 bp, Homo sapiens
gccacagaaggtgaa

SEQ ID NO: 2858179 - DNA, 15 bp, Homo sapiens
gccacatgggaggct

SEQ ID NO: 2858180 - DNA, 23 bp, Homo sapiens
gccacgtgtttgtgctgtggtgt

SEQ ID NO: 2858181 - DNA, 15 bp, Homo sapiens
gccactcctctgact

SEQ ID NO: 2858182 - DNA, 17 bp, Homo sapiens
gccactcctctgactca

SEQ ID NO: 2858183 - DNA, 17 bp, Homo sapiens
gccactctcccctccct

SEQ ID NO: 2858184 - DNA, 22 bp, Homo sapiens
gccactctcccctccctcttcc

SEQ ID NO: 2858185 - DNA, 16 bp, Homo sapiens
gccactgaggagacag

SEQ ID NO: 2858186 - DNA, 18 bp, Homo sapiens
gccacttaaaatgttcac

SEQ ID NO: 2858187 - DNA, 18 bp, Homo sapiens
gccagagccaacctggac

SEQ ID NO: 2858188 - DNA, 19 bp, Homo sapiens
gccagagccaacctggact

SEQ ID NO: 2858189 - DNA, 16 bp, Homo sapiens
gccagattggccaatt

SEQ ID NO: 2858190 - DNA, 17 bp, Homo sapiens
gccagattggccaatta

SEQ ID NO: 2858191 - DNA, 12 bp, Homo sapiens
gccagcaacgct

SEQ ID NO: 2858192 - DNA, 19 bp, Homo sapiens
gccagcaagagttaggggc

SEQ ID NO: 2858193 - DNA, 17 bp, Homo sapiens
gccagctctctctaccc

SEQ ID NO: 2858194 - DNA, 15 bp, Homo sapiens
gccagctctgtatca

SEQ ID NO: 2858195 - DNA, 14 bp, Homo sapiens
gccaggcaggggtg

SEQ ID NO: 2858196 - DNA, 20 bp, Homo sapiens
gccaggcaggggtgggagag

SEQ ID NO: 2858197 - DNA, 16 bp, Homo sapiens
gccagggcagagtgag

SEQ ID NO: 2858198 - DNA, 20 bp, Homo sapiens
gccagttttcggaaacactg

SEQ ID NO: 2858199 - DNA, 16 bp, Homo sapiens
gccatagacctacaga

SEQ ID NO: 2858200 - DNA, 13 bp, Homo sapiens
gccatcagggtgg

SEQ ID NO: 2858201 - DNA, 15 bp, Homo sapiens
gcccaaagtggggag

SEQ ID NO: 2858202 - DNA, 12 bp, Homo sapiens
gcccaatattat

SEQ ID NO: 2858203 - DNA, 13 bp, Homo sapiens
gcccagctctgaa

SEQ ID NO: 2858204 - DNA, 20 bp, Homo sapiens
gcccatccattaggccagca

SEQ ID NO: 2858205 - DNA, 20 bp, Homo sapiens
gccccacccctaagtgccca

SEQ ID NO: 2858206 - DNA, 21 bp, Homo sapiens
gcccccactttcctacaaaat

SEQ ID NO: 2858207 - DNA, 23 bp, Homo sapiens
gtcttttttctcttcccttccca

SEQ ID NO: 2858208 - DNA, 17 bp, Homo sapiens
gtgaaggcttctctctg

SEQ ID NO: 2858209 - DNA, 22 bp, Homo sapiens
gtgaaggcttctctctgtggga

SEQ ID NO: 2858210 - DNA, 18 bp, Homo sapiens
gtgaagggaagtggggag

SEQ ID NO: 2858211 - DNA, 18 bp, Homo sapiens
gtgaatgtgtgagaaaaa

SEQ ID NO: 2858212 - DNA, 21 bp, Homo sapiens
gtgaatgtgtgagaaaaacta

SEQ ID NO: 2858213 - DNA, 13 bp, Homo sapiens
gtgacagtttcca

SEQ ID NO: 2858214 - DNA, 15 bp, Homo sapiens
gtgaccaatgtcttg

SEQ ID NO: 2858215 - DNA, 16 bp, Homo sapiens
gtgactataaagctgt

SEQ ID NO: 2858216 - DNA, 23 bp, Homo sapiens
gtgagccttgcatgacatcatga

SEQ ID NO: 2858217 - DNA, 15 bp, Homo sapiens
gtgaggccagggcag

SEQ ID NO: 2858218 - DNA, 19 bp, Homo sapiens
gtgatatggtgaagggaag

SEQ ID NO: 2858219 - DNA, 16 bp, Homo sapiens
gtgattactgcaatca

SEQ ID NO: 2858220 - DNA, 18 bp, Homo sapiens
gtgcacatctgtgtcttg

SEQ ID NO: 2858221 - DNA, 13 bp, Homo sapiens
gtgccaggaccag

SEQ ID NO: 2858222 - DNA, 16 bp, Homo sapiens
gtgccaggaccagtca

SEQ ID NO: 2858223 - DNA, 11 bp, Homo sapiens
gtgcccaaagt

SEQ ID NO: 2858224 - DNA, 21 bp, Homo sapiens
gtgctacacccttttccagct

SEQ ID NO: 2858225 - DNA, 16 bp, Homo sapiens
gtgctataaatgccag

SEQ ID NO: 2858226 - DNA, 21 bp, Homo sapiens
gtgctataaatgccagagcca

SEQ ID NO: 2858227 - DNA, 12 bp, Homo sapiens
gtgctgcctcta

SEQ ID NO: 2858228 - DNA, 14 bp, Homo sapiens
gtgcttcgggccct

SEQ ID NO: 2858229 - DNA, 16 bp, Homo sapiens
gtggccatcagggtgg

SEQ ID NO: 2858230 - DNA, 21 bp, Homo sapiens
gtgggacagcccagagcctgg

SEQ ID NO: 2858231 - DNA, 18 bp, Homo sapiens
gtggggagggacaaggga

SEQ ID NO: 2858232 - DNA, 22 bp, Homo sapiens
gtggggagggacaagggattct

SEQ ID NO: 2858233 - DNA, 20 bp, Homo sapiens
gtgggtccatgggcagagcc

SEQ ID NO: 2858234 - DNA, 14 bp, Homo sapiens
gtggtcataaaata

SEQ ID NO: 2858235 - DNA, 13 bp, Homo sapiens
gtggtctgccaat

SEQ ID NO: 2858236 - DNA, 21 bp, Homo sapiens
gtggtctgccaatctgtacaa

SEQ ID NO: 2858237 - DNA, 22 bp, Homo sapiens
gtggttattggactccaggcct

SEQ ID NO: 2858238 - DNA, 19 bp, Homo sapiens
gtgtaataatgtaacatga

SEQ ID NO: 2858239 - DNA, 21 bp, Homo sapiens
gtgtcatataaactcatttat

SEQ ID NO: 2858240 - DNA, 18 bp, Homo sapiens
gtgtccacgactgtctcc

SEQ ID NO: 2858241 - DNA, 23 bp, Homo sapiens
gtgtgactctcttggattattta

SEQ ID NO: 2858242 - DNA, 14 bp, Homo sapiens
gtgtgatcgtctga

SEQ ID NO: 2858243 - DNA, 15 bp, Homo sapiens
gtgtgtactctgtcc

SEQ ID NO: 2858244 - DNA, 21 bp, Homo sapiens
gtgttaaatgtgatgaatact

SEQ ID NO: 2858245 - DNA, 23 bp, Homo sapiens
gtgttagggaagggcctgccaca

SEQ ID NO: 2858246 - DNA, 18 bp, Homo sapiens
gtgttcagctctttccaa

SEQ ID NO: 2858247 - DNA, 20 bp, Homo sapiens
gtgttcagctctttccaaat

SEQ ID NO: 2858248 - DNA, 18 bp, Homo sapiens
gtgttccccttccactga

SEQ ID NO: 2858249 - DNA, 22 bp, Homo sapiens
gtgttccccttccactgagggc

SEQ ID NO: 2858250 - DNA, 15 bp, Homo sapiens
gtgttgcctcttgca

SEQ ID NO: 2858251 - DNA, 19 bp, Homo sapiens
gtgttgttgttgctgctgt

SEQ ID NO: 2858252 - DNA, 15 bp, Homo sapiens
gtgtttctagaatca

SEQ ID NO: 2858253 - DNA, 20 bp, Homo sapiens
gtgtttgcagcctgctctag

SEQ ID NO: 2858254 - DNA, 22 bp, Homo sapiens
gttacctgaaaacactgtgcac

SEQ ID NO: 2858255 - DNA, 18 bp, Homo sapiens
gttactgtatttttcaga

SEQ ID NO: 2858256 - DNA, 14 bp, Homo sapiens
gttataaagataca

SEQ ID NO: 2858257 - DNA, 22 bp, Homo sapiens
gttatcaccgtgggctccctga

SEQ ID NO: 2858258 - DNA, 16 bp, Homo sapiens
gttattcttgttatac

SEQ ID NO: 2858259 - DNA, 14 bp, Homo sapiens
gttattggactcca

SEQ ID NO: 2858260 - DNA, 13 bp, Homo sapiens
gttattttgcaac

SEQ ID NO: 2858261 - DNA, 18 bp, Homo sapiens
gttcaagaagtaatcagt

SEQ ID NO: 2858262 - DNA, 20 bp, Homo sapiens
gttcacttttgacaaaggca

SEQ ID NO: 2858263 - DNA, 16 bp, Homo sapiens
gttcagaaaaccactt

SEQ ID NO: 2858264 - DNA, 18 bp, Homo sapiens
gttcagctctttccaaat

SEQ ID NO: 2858265 - DNA, 18 bp, Homo sapiens
gttcatgtttttgtttta

SEQ ID NO: 2858266 - DNA, 21 bp, Homo sapiens
gttcattggcattctttgcaa

SEQ ID NO: 2858267 - DNA, 19 bp, Homo sapiens
gttcccaaaacaatggtgt

SEQ ID NO: 2858268 - DNA, 13 bp, Homo sapiens
gttccccttccac

SEQ ID NO: 2858269 - DNA, 14 bp, Homo sapiens
gttctcaaatgtgt

SEQ ID NO: 2858270 - DNA, 10 bp, Homo sapiens
gttctgcagc

SEQ ID NO: 2858271 - DNA, 13 bp, Homo sapiens
gttcttccccaca

SEQ ID NO: 2858272 - DNA, 22 bp, Homo sapiens
gttgagcatagagaacaaagta

SEQ ID NO: 2858273 - DNA, 16 bp, Homo sapiens
gttgcacttttgaatg

SEQ ID NO: 2858274 - DNA, 18 bp, Homo sapiens
gttgcacttttgaatgtc

SEQ ID NO: 2858275 - DNA, 20 bp, Homo sapiens
gttgcacttttgaatgtcca

SEQ ID NO: 2858276 - DNA, 11 bp, Homo sapiens
gttgctgctgt

SEQ ID NO: 2858277 - DNA, 14 bp, Homo sapiens
gttggtctgtgtaa

SEQ ID NO: 2858278 - DNA, 23 bp, Homo sapiens
gttgtcttatgtgaaaaattaac

SEQ ID NO: 2858279 - DNA, 13 bp, Homo sapiens
gttgttgctgctg

SEQ ID NO: 2858280 - DNA, 14 bp, Homo sapiens
gttgttgctgctgt

SEQ ID NO: 2858281 - DNA, 15 bp, Homo sapiens
gttgttgctgctgtt

SEQ ID NO: 2858282 - DNA, 14 bp, Homo sapiens
gtttaatagatttg

SEQ ID NO: 2858283 - DNA, 21 bp, Homo sapiens
gtttacactgcggaagccaaa

SEQ ID NO: 2858284 - DNA, 15 bp, Homo sapiens
gtttagagagcctgt

SEQ ID NO: 2858285 - DNA, 20 bp, Homo sapiens
gtttagattgtattaactat

SEQ ID NO: 2858286 - DNA, 20 bp, Homo sapiens
gtttatatttttttaactgt

SEQ ID NO: 2858287 - DNA, 16 bp, Homo sapiens
gtttcaattgcatctc

SEQ ID NO: 2858288 - DNA, 19 bp, Homo sapiens
gtttgacagtttttgacat

SEQ ID NO: 2858289 - DNA, 14 bp, Homo sapiens
gtttgtcagcatct

SEQ ID NO: 2858290 - DNA, 15 bp, Homo sapiens
gtttgtcagcatctg

SEQ ID NO: 2858291 - DNA, 19 bp, Homo sapiens
gtttgtcagcatctgacca

SEQ ID NO: 2858292 - DNA, 18 bp, Homo sapiens
gtttgtctgtcttcatag

SEQ ID NO: 2858293 - DNA, 14 bp, Homo sapiens
gtttgttcttcaga

SEQ ID NO: 2858294 - DNA, 19 bp, Homo sapiens
gttttaaaacgtgtaaatg

SEQ ID NO: 2858295 - DNA, 21 bp, Homo sapiens
gttttaaaacgtgtaaatgaa

SEQ ID NO: 2858296 - DNA, 15 bp, Homo sapiens
gttttaaagaaattt

SEQ ID NO: 2858297 - DNA, 19 bp, Homo sapiens
gttttgacaggttttccaa

SEQ ID NO: 2858298 - DNA, 12 bp, Homo sapiens
gttttgtattct

SEQ ID NO: 2858299 - DNA, 13 bp, Homo sapiens
gttttgtttcact

SEQ ID NO: 2858300 - DNA, 14 bp, Homo sapiens
gttttgtttcactt

SEQ ID NO: 2858301 - DNA, 16 bp, Homo sapiens
gttttgtttcactttg

SEQ ID NO: 2858302 - DNA, 14 bp, Homo sapiens
gtttttaaagcctt

SEQ ID NO: 2858303 - DNA, 13 bp, Homo sapiens
gtttttaagctgt

SEQ ID NO: 2858304 - DNA, 15 bp, Homo sapiens
gtttttgacatttat

SEQ ID NO: 2858305 - DNA, 17 bp, Homo sapiens
gtttttgacatttatat

SEQ ID NO: 2858306 - DNA, 17 bp, Homo sapiens
taaaaaacaattaactg

SEQ ID NO: 2858307 - DNA, 18 bp, Homo sapiens
taaaaacgaaaacctgac

SEQ ID NO: 2858308 - DNA, 16 bp, Homo sapiens
taaaaatatgtaattt

SEQ ID NO: 2858309 - DNA, 22 bp, Homo sapiens
taaaacaaatatacattttcta

SEQ ID NO: 2858310 - DNA, 17 bp, Homo sapiens
taaaacaatccttacta

SEQ ID NO: 2858311 - DNA, 21 bp, Homo sapiens
taaaaccatgtagaaaatttg

SEQ ID NO: 2858312 - DNA, 16 bp, Homo sapiens
taaaacgtgtaaatga

SEQ ID NO: 2858313 - DNA, 15 bp, Homo sapiens
taaaagttctcaatg

SEQ ID NO: 2858314 - DNA, 17 bp, Homo sapiens
taaaagttctcaatgta

SEQ ID NO: 2858315 - DNA, 14 bp, Homo sapiens
taaaatagaataat

SEQ ID NO: 2858316 - DNA, 18 bp, Homo sapiens
taaaatagaataattctt

SEQ ID NO: 2858317 - DNA, 13 bp, Homo sapiens
tcgggaggagcag

SEQ ID NO: 2858318 - DNA, 22 bp, Homo sapiens
tcgggaggagcagcccggggag

SEQ ID NO: 2858319 - DNA, 17 bp, Homo sapiens
tcgtattaaaaaacaat

SEQ ID NO: 2858320 - DNA, 22 bp, Homo sapiens
tcgtttatatttttttaactgt

SEQ ID NO: 2858321 - DNA, 23 bp, Homo sapiens
tcgtttatatttttttaactgtg

SEQ ID NO: 2858322 - DNA, 13 bp, Homo sapiens
tctaaaaagaaaa

SEQ ID NO: 2858323 - DNA, 23 bp, Homo sapiens
tctaaactccctggctgttctga

SEQ ID NO: 2858324 - DNA, 21 bp, Homo sapiens
tctaaataaaaatatgtaatt

SEQ ID NO: 2858325 - DNA, 23 bp, Homo sapiens
tctaaatatgaatgaatgggata

SEQ ID NO: 2858326 - DNA, 18 bp, Homo sapiens
tctaaccaaggctgtgtt

SEQ ID NO: 2858327 - DNA, 20 bp, Homo sapiens
tctaacctcatcttcttcac

SEQ ID NO: 2858328 - DNA, 16 bp, Homo sapiens
tctaactacaaggaca

SEQ ID NO: 2858329 - DNA, 21 bp, Homo sapiens
tctaattgtaagtgaaattaa

SEQ ID NO: 2858330 - DNA, 22 bp, Homo sapiens
tctaattgtaagtgaaattaag

SEQ ID NO: 2858331 - DNA, 22 bp, Homo sapiens
tctaatttatcttgtctctggg

SEQ ID NO: 2858332 - DNA, 23 bp, Homo sapiens
tctaatttatcttgtctctgggc

SEQ ID NO: 2858333 - DNA, 16 bp, Homo sapiens
tctacccggcccagag

SEQ ID NO: 2858334 - DNA, 16 bp, Homo sapiens
tctacctacatatttg

SEQ ID NO: 2858335 - DNA, 12 bp, Homo sapiens
tctactttgaag

SEQ ID NO: 2858336 - DNA, 22 bp, Homo sapiens
tctagaatcacagctcaagcat

SEQ ID NO: 2858337 - DNA, 15 bp, Homo sapiens
tctagctctctaggc

SEQ ID NO: 2858338 - DNA, 16 bp, Homo sapiens
tctagctctctaggcc

SEQ ID NO: 2858339 - DNA, 13 bp, Homo sapiens
tctagtgggacag

SEQ ID NO: 2858340 - DNA, 20 bp, Homo sapiens
tctatatagacttggagaat

SEQ ID NO: 2858341 - DNA, 13 bp, Homo sapiens
tctatgaacctga

SEQ ID NO: 2858342 - DNA, 17 bp, Homo sapiens
tctatggcttatttcta

SEQ ID NO: 2858343 - DNA, 19 bp, Homo sapiens
tctatggcttatttctatg

SEQ ID NO: 2858344 - DNA, 21 bp, Homo sapiens
tctatggcttatttctatgac

SEQ ID NO: 2858345 - DNA, 22 bp, Homo sapiens
tctatttatttactgagcttct

SEQ ID NO: 2858346 - DNA, 16 bp, Homo sapiens
tctattttcataatca

SEQ ID NO: 2858347 - DNA, 12 bp, Homo sapiens
tctatttttatg

SEQ ID NO: 2858348 - DNA, 19 bp, Homo sapiens
tctatttttatgatgacaa

SEQ ID NO: 2858349 - DNA, 22 bp, Homo sapiens
tctcaaatgtgtgtggcagcca

SEQ ID NO: 2858350 - DNA, 16 bp, Homo sapiens
tctcactataccagta

SEQ ID NO: 2858351 - DNA, 13 bp, Homo sapiens
tctcactccccag

SEQ ID NO: 2858352 - DNA, 18 bp, Homo sapiens
tctcagtctctgagcagt

SEQ ID NO: 2858353 - DNA, 15 bp, Homo sapiens
tctccagaagaaaat

SEQ ID NO: 2858354 - DNA, 18 bp, Homo sapiens
tctcccagataatgtgaa

SEQ ID NO: 2858355 - DNA, 23 bp, Homo sapiens
tctcccagataatgtgaaaatgg

SEQ ID NO: 2858356 - DNA, 13 bp, Homo sapiens
tctcccctccctc

SEQ ID NO: 2858357 - DNA, 17 bp, Homo sapiens
tctcccctccctcttcc

SEQ ID NO: 2858358 - DNA, 22 bp, Homo sapiens
tctcccctccctcttccttccc

SEQ ID NO: 2858359 - DNA, 16 bp, Homo sapiens
tctcctccatgggaga

SEQ ID NO: 2858360 - DNA, 15 bp, Homo sapiens
tctcgggaaattatt

SEQ ID NO: 2858361 - DNA, 19 bp, Homo sapiens
tctctacccggcccagaga

SEQ ID NO: 2858362 - DNA, 11 bp, Homo sapiens
tctctctgtgg

SEQ ID NO: 2858363 - DNA, 21 bp, Homo sapiens
tctctgctctgcgtgtcacct

SEQ ID NO: 2858364 - DNA, 21 bp, Homo sapiens
tctctgggcttggggcttcct

SEQ ID NO: 2858365 - DNA, 21 bp, Homo sapiens
tctctgtctcatccatcatca

SEQ ID NO: 2858366 - DNA, 22 bp, Homo sapiens
tctctgtgaacgatttagaaag

SEQ ID NO: 2858367 - DNA, 17 bp, Homo sapiens
tctcttatagaatattt

SEQ ID NO: 2858368 - DNA, 20 bp, Homo sapiens
tctcttatagaatatttatt

SEQ ID NO: 2858369 - DNA, 17 bp, Homo sapiens
tctcttcccttcccaga

SEQ ID NO: 2858370 - DNA, 14 bp, Homo sapiens
tctctttaaactat

SEQ ID NO: 2858371 - DNA, 13 bp, Homo sapiens
tctgaagagacca

SEQ ID NO: 2858372 - DNA, 13 bp, Homo sapiens
tctgaccatctgt

SEQ ID NO: 2858373 - DNA, 22 bp, Homo sapiens
tctgaccatctgtgactataaa

SEQ ID NO: 2858374 - DNA, 15 bp, Homo sapiens
tctgagcaccccctc

SEQ ID NO: 2858375 - DNA, 23 bp, Homo sapiens
tctgaggatagtagttaaataac

SEQ ID NO: 2858376 - DNA, 19 bp, Homo sapiens
tctgcagcggcagagcaat

SEQ ID NO: 2858377 - DNA, 13 bp, Homo sapiens
tctgccacagaga

SEQ ID NO: 2858378 - DNA, 14 bp, Homo sapiens
tctgccacagagag

SEQ ID NO: 2858379 - DNA, 16 bp, Homo sapiens
tctgccactgaggaga

SEQ ID NO: 2858380 - DNA, 19 bp, Homo sapiens
tctgccactgaggagacag

SEQ ID NO: 2858381 - DNA, 17 bp, Homo sapiens
tctgcctcttctgggag

SEQ ID NO: 2858382 - DNA, 15 bp, Homo sapiens
tctgcgtgtcacctg

SEQ ID NO: 2858383 - DNA, 19 bp, Homo sapiens
tctgcgtgtcacctgtgct

SEQ ID NO: 2858384 - DNA, 13 bp, Homo sapiens
tctggccctggcc

SEQ ID NO: 2858385 - DNA, 14 bp, Homo sapiens
tctggccctggccc

SEQ ID NO: 2858386 - DNA, 13 bp, Homo sapiens
tctggctttttct

SEQ ID NO: 2858387 - DNA, 17 bp, Homo sapiens
tctggctttttctgcca

SEQ ID NO: 2858388 - DNA, 18 bp, Homo sapiens
tctggctttttctgccac

SEQ ID NO: 2858389 - DNA, 24 bp, Homo sapiens
tctggctttttctgccactgagga

SEQ ID NO: 2858390 - DNA, 19 bp, Homo sapiens
tctgggaagcttgagcctc

SEQ ID NO: 2858391 - DNA, 21 bp, Homo sapiens
tctgggctgtaacgtggcact

SEQ ID NO: 2858392 - DNA, 16 bp, Homo sapiens
tctggggctctgggat

SEQ ID NO: 2858393 - DNA, 15 bp, Homo sapiens
tctgtatttttctaa

SEQ ID NO: 2858394 - DNA, 21 bp, Homo sapiens
tctgtgaacgatttagaaaga

SEQ ID NO: 2858395 - DNA, 14 bp, Homo sapiens
tctgtgactataaa

SEQ ID NO: 2858396 - DNA, 17 bp, Homo sapiens
tctgtgactataaagct

SEQ ID NO: 2858397 - DNA, 18 bp, Homo sapiens
tctgtgactataaagctg

SEQ ID NO: 2858398 - DNA, 20 bp, Homo sapiens
tctgtgactataaagctgtt

SEQ ID NO: 2858399 - DNA, 23 bp, Homo sapiens
tctgtgggatgggatggtggagg

SEQ ID NO: 2858400 - DNA, 21 bp, Homo sapiens
tctgtgtaacatccaagccag

SEQ ID NO: 2858401 - DNA, 22 bp, Homo sapiens
tctgtgtaaccagctcagtgtt

SEQ ID NO: 2858402 - DNA, 12 bp, Homo sapiens
tctgtgtcttgt

SEQ ID NO: 2858403 - DNA, 23 bp, Homo sapiens
tcttagctgaggctgagaaagct

SEQ ID NO: 2858404 - DNA, 23 bp, Homo sapiens
tcttatttacagataacttcttt

SEQ ID NO: 2858405 - DNA, 17 bp, Homo sapiens
tcttcaccatttggcaa

SEQ ID NO: 2858406 - DNA, 19 bp, Homo sapiens
tcttcactgccatgcctca

SEQ ID NO: 2858407 - DNA, 14 bp, Homo sapiens
tcttcagaggccct

SEQ ID NO: 2858408 - DNA, 15 bp, Homo sapiens
tcttcagaggccctc

SEQ ID NO: 2858409 - DNA, 18 bp, Homo sapiens
tcttcagtttttcacttc

SEQ ID NO: 2858410 - DNA, 18 bp, Homo sapiens
tcttcatgcctgatgaaa

SEQ ID NO: 2858411 - DNA, 21 bp, Homo sapiens
tcttcatggcatcttcaatat

SEQ ID NO: 2858412 - DNA, 13 bp, Homo sapiens
tcttcccttccca

SEQ ID NO: 2858413 - DNA, 21 bp, Homo sapiens
tcttcccttcccagaccagga

SEQ ID NO: 2858414 - DNA, 20 bp, Homo sapiens
tcttcctagatctgcaggct

SEQ ID NO: 2858415 - DNA, 11 bp, Homo sapiens
tcttccttccc

SEQ ID NO: 2858416 - DNA, 13 bp, Homo sapiens
tcttccttccccc

SEQ ID NO: 2858417 - DNA, 13 bp, Homo sapiens
tcttctgcctccc

SEQ ID NO: 2858418 - DNA, 20 bp, Homo sapiens
tcttctgggagggcagcagg

SEQ ID NO: 2858419 - DNA, 22 bp, Homo sapiens
tcttctgggagggcagcagggc

SEQ ID NO: 2858420 - DNA, 14 bp, Homo sapiens
tcttcttcaccatt

SEQ ID NO: 2858421 - DNA, 13 bp, Homo sapiens
tcttgaatttaat

SEQ ID NO: 2858422 - DNA, 16 bp, Homo sapiens
tcttgactacagtcag

SEQ ID NO: 2858423 - DNA, 16 bp, Homo sapiens
tcttggggctgatgaa

SEQ ID NO: 2858424 - DNA, 20 bp, Homo sapiens
tcttggggctgatgaagaag

SEQ ID NO: 2858425 - DNA, 20 bp, Homo sapiens
tctttcaaaaccttttgaaa

SEQ ID NO: 2858426 - DNA, 20 bp, Homo sapiens
tgtgtaataatgtaacatga

SEQ ID NO: 2858427 - DNA, 18 bp, Homo sapiens
tgtgtccacgactgtctc

SEQ ID NO: 2858428 - DNA, 18 bp, Homo sapiens
tgtgtccccctctgtcca

SEQ ID NO: 2858429 - DNA, 21 bp, Homo sapiens
tgtgtccccctctgtccaggc

SEQ ID NO: 2858430 - DNA, 23 bp, Homo sapiens
tgtgttacctgaaaacactgtgc

SEQ ID NO: 2858431 - DNA, 20 bp, Homo sapiens
tgtgttcagctctttccaaa

SEQ ID NO: 2858432 - DNA, 21 bp, Homo sapiens
tgtgttcagctctttccaaat

SEQ ID NO: 2858433 - DNA, 22 bp, Homo sapiens
tgtgttgggattgagtctgtgc

SEQ ID NO: 2858434 - DNA, 16 bp, Homo sapiens
tgtgtttgcagcctgc

SEQ ID NO: 2858435 - DNA, 16 bp, Homo sapiens
tgttaaaattaatata

SEQ ID NO: 2858436 - DNA, 14 bp, Homo sapiens
tgttaaagagataa

SEQ ID NO: 2858437 - DNA, 15 bp, Homo sapiens
tgttaagtattttca

SEQ ID NO: 2858438 - DNA, 17 bp, Homo sapiens
tgttaagtattttcata

SEQ ID NO: 2858439 - DNA, 23 bp, Homo sapiens
tgttattagagattacctcctga

SEQ ID NO: 2858440 - DNA, 16 bp, Homo sapiens
tgttattattagataa

SEQ ID NO: 2858441 - DNA, 14 bp, Homo sapiens
tgttattttgcaac

SEQ ID NO: 2858442 - DNA, 17 bp, Homo sapiens
tgttcacttttgacaaa

SEQ ID NO: 2858443 - DNA, 17 bp, Homo sapiens
tgttcagctctttccaa

SEQ ID NO: 2858444 - DNA, 20 bp, Homo sapiens
tgttccaagtctctgtgtaa

SEQ ID NO: 2858445 - DNA, 21 bp, Homo sapiens
tgttccattgaagccgactct

SEQ ID NO: 2858446 - DNA, 15 bp, Homo sapiens
tgttccccctgtgca

SEQ ID NO: 2858447 - DNA, 16 bp, Homo sapiens
tgttccccctgtgcag

SEQ ID NO: 2858448 - DNA, 17 bp, Homo sapiens
tgttccccttccactga

SEQ ID NO: 2858449 - DNA, 17 bp, Homo sapiens
tgttcctaacaaaatga

SEQ ID NO: 2858450 - DNA, 14 bp, Homo sapiens
tgttcttccccaca

SEQ ID NO: 2858451 - DNA, 13 bp, Homo sapiens
tgttgctgctgtt

SEQ ID NO: 2858452 - DNA, 22 bp, Homo sapiens
tgttgggcttgggggaaaagag

SEQ ID NO: 2858453 - DNA, 13 bp, Homo sapiens
tgttgttgctgct

SEQ ID NO: 2858454 - DNA, 16 bp, Homo sapiens
tgttgttgctgctgtt

SEQ ID NO: 2858455 - DNA, 16 bp, Homo sapiens
tgttgttgttgctgct

SEQ ID NO: 2858456 - DNA, 15 bp, Homo sapiens
tgtttagagagcctg

SEQ ID NO: 2858457 - DNA, 17 bp, Homo sapiens
tgtttagagagcctgtc

SEQ ID NO: 2858458 - DNA, 14 bp, Homo sapiens
tgtttctaagaaaa

SEQ ID NO: 2858459 - DNA, 17 bp, Homo sapiens
tgtttgcagcctgctct

SEQ ID NO: 2858460 - DNA, 18 bp, Homo sapiens
tgtttggaatattgtcca

SEQ ID NO: 2858461 - DNA, 11 bp, Homo sapiens
tgtttgtcagc

SEQ ID NO: 2858462 - DNA, 15 bp, Homo sapiens
tgtttgtcagcatct

SEQ ID NO: 2858463 - DNA, 17 bp, Homo sapiens
tgtttgtcagcatctga

SEQ ID NO: 2858464 - DNA, 12 bp, Homo sapiens
tgttttccctga

SEQ ID NO: 2858465 - DNA, 13 bp, Homo sapiens
tgttttgcactga

SEQ ID NO: 2858466 - DNA, 15 bp, Homo sapiens
tgttttgcactgaca

SEQ ID NO: 2858467 - DNA, 14 bp, Homo sapiens
tgtttttaagctgt

SEQ ID NO: 2858468 - DNA, 22 bp, Homo sapiens
tgtttttaagctgtttccatag

SEQ ID NO: 2858469 - DNA, 21 bp, Homo sapiens
ttaaaaacgaaaacctgacta

SEQ ID NO: 2858470 - DNA, 18 bp, Homo sapiens
ttaaaacgtgtaaatgaa

SEQ ID NO: 2858471 - DNA, 12 bp, Homo sapiens
ttaaaagaaata

SEQ ID NO: 2858472 - DNA, 16 bp, Homo sapiens
ttaaaatcatgatcct

SEQ ID NO: 2858473 - DNA, 14 bp, Homo sapiens
ttaaagaaatttta

SEQ ID NO: 2858474 - DNA, 13 bp, Homo sapiens
ttaaataacatgt

SEQ ID NO: 2858475 - DNA, 17 bp, Homo sapiens
ttaaccctctcttccct

SEQ ID NO: 2858476 - DNA, 12 bp, Homo sapiens
ttaactagaatt

SEQ ID NO: 2858477 - DNA, 21 bp, Homo sapiens
ttaactgttgcacttttgaat

SEQ ID NO: 2858478 - DNA, 21 bp, Homo sapiens
ttaagccacttaaaatgttca

SEQ ID NO: 2858479 - DNA, 18 bp, Homo sapiens
ttaataagatatttagta

SEQ ID NO: 2858480 - DNA, 23 bp, Homo sapiens
ttaatagtcaccttcatgattat

SEQ ID NO: 2858481 - DNA, 18 bp, Homo sapiens
ttaatatatcattatctt

SEQ ID NO: 2858482 - DNA, 23 bp, Homo sapiens
ttaatgaagaaagtggaaaacaa

SEQ ID NO: 2858483 - DNA, 15 bp, Homo sapiens
ttaatgctgtttcta

SEQ ID NO: 2858484 - DNA, 16 bp, Homo sapiens
ttaatgctgtttctaa

SEQ ID NO: 2858485 - DNA, 21 bp, Homo sapiens
ttaatggcatttctctttaaa

SEQ ID NO: 2858486 - DNA, 22 bp, Homo sapiens
ttacactgcggaagccaaaggc

SEQ ID NO: 2858487 - DNA, 11 bp, Homo sapiens
ttacagaactg

SEQ ID NO: 2858488 - DNA, 16 bp, Homo sapiens
ttactgaataatatca

SEQ ID NO: 2858489 - DNA, 18 bp, Homo sapiens
ttactgagcttctctgtg

SEQ ID NO: 2858490 - DNA, 22 bp, Homo sapiens
ttactgtatttttcagaaatca

SEQ ID NO: 2858491 - DNA, 13 bp, Homo sapiens
ttacttgcttctc

SEQ ID NO: 2858492 - DNA, 14 bp, Homo sapiens
ttacttgcttctct

SEQ ID NO: 2858493 - DNA, 14 bp, Homo sapiens
ttagaaataataaa

SEQ ID NO: 2858494 - DNA, 16 bp, Homo sapiens
ttagaagcctgacaac

SEQ ID NO: 2858495 - DNA, 18 bp, Homo sapiens
ttagactaaggccattat

SEQ ID NO: 2858496 - DNA, 20 bp, Homo sapiens
ttagagagcctgtcaccaga

SEQ ID NO: 2858497 - DNA, 23 bp, Homo sapiens
ttagagagcctgtcaccagagct

SEQ ID NO: 2858498 - DNA, 20 bp, Homo sapiens
ttagatgttctaagtctttc

SEQ ID NO: 2858499 - DNA, 18 bp, Homo sapiens
ttagattgtattaactat

SEQ ID NO: 2858500 - DNA, 24 bp, Homo sapiens
ttaggggaagtaaaacagtcatct

SEQ ID NO: 2858501 - DNA, 23 bp, Homo sapiens
ttagtaacatgtgttaagtattt

SEQ ID NO: 2858502 - DNA, 22 bp, Homo sapiens
ttagtagttactaaaattatgt

SEQ ID NO: 2858503 - DNA, 15 bp, Homo sapiens
ttagtgacatttaat

SEQ ID NO: 2858504 - DNA, 14 bp, Homo sapiens
ttagtttgttcttc

SEQ ID NO: 2858505 - DNA, 14 bp, Homo sapiens
ttataattttccta

SEQ ID NO: 2858506 - DNA, 14 bp, Homo sapiens
ttatacatcaatat

SEQ ID NO: 2858507 - DNA, 19 bp, Homo sapiens
ttatagcaactaatgtttg

SEQ ID NO: 2858508 - DNA, 21 bp, Homo sapiens
ttatagtgatgtaatcttgaa

SEQ ID NO: 2858509 - DNA, 13 bp, Homo sapiens
ttatatttcaata

SEQ ID NO: 2858510 - DNA, 19 bp, Homo sapiens
ttatatttcaataaatgat

SEQ ID NO: 2858511 - DNA, 16 bp, Homo sapiens
ttatattttagaaata

SEQ ID NO: 2858512 - DNA, 19 bp, Homo sapiens
ttatatttttttaactgtg

SEQ ID NO: 2858513 - DNA, 16 bp, Homo sapiens
ttatcattaaaaatta

SEQ ID NO: 2858514 - DNA, 18 bp, Homo sapiens
ttatcattaaaaattacc

SEQ ID NO: 2858515 - DNA, 16 bp, Homo sapiens
ttatcttgtctctggg

SEQ ID NO: 2858516 - DNA, 21 bp, Homo sapiens
ttatgaaaagtactaatagaa

SEQ ID NO: 2858517 - DNA, 22 bp, Homo sapiens
ttatgcacttttagaaatgcat

SEQ ID NO: 2858518 - DNA, 17 bp, Homo sapiens
ttatgtttaaaagaaat

SEQ ID NO: 2858519 - DNA, 18 bp, Homo sapiens
ttatgtttaaaagaaata

SEQ ID NO: 2858520 - DNA, 15 bp, Homo sapiens
ttattacctctgata

SEQ ID NO: 2858521 - DNA, 21 bp, Homo sapiens
ttattagagattacctcctga

SEQ ID NO: 2858522 - DNA, 17 bp, Homo sapiens
ttattagagtgtctttc

SEQ ID NO: 2858523 - DNA, 12 bp, Homo sapiens
ttattagataat

SEQ ID NO: 2858524 - DNA, 13 bp, Homo sapiens
ttattcttgttat

SEQ ID NO: 2858525 - DNA, 20 bp, Homo sapiens
ttattggactccaggcctga

SEQ ID NO: 2858526 - DNA, 12 bp, Homo sapiens
ttattgtacctc

SEQ ID NO: 2858527 - DNA, 22 bp, Homo sapiens
ttatttactgagcttctctgtg

SEQ ID NO: 2858528 - DNA, 11 bp, Homo sapiens
ttatttgcata

SEQ ID NO: 2858529 - DNA, 15 bp, Homo sapiens
ttcaagaagtaatca

SEQ ID NO: 2858530 - DNA, 16 bp, Homo sapiens
ttcaagaatgaaaaat

SEQ ID NO: 2858531 - DNA, 17 bp, Homo sapiens
ttcaagaatgaaaaata

SEQ ID NO: 2858532 - DNA, 20 bp, Homo sapiens
ttcaagaatgaaaaatataa

SEQ ID NO: 2858533 - DNA, 18 bp, Homo sapiens
ttcaagagctagaaaaat

SEQ ID NO: 2858534 - DNA, 16 bp, Homo sapiens
ttcaattcctctggga

SEQ ID NO: 2858535 - DNA, 19 bp, Homo sapiens
ttcaattgcatctcccaga

SEQ ID NO: 2858536 - DNA, 22 bp, Homo sapiens
aaactgcatcccacgttctgtt

SEQ ID NO: 2858537 - DNA, 20 bp, Homo sapiens
aaagaagcccaatattataa

SEQ ID NO: 2858538 - DNA, 15 bp, Homo sapiens
aaagaatccctgcag

SEQ ID NO: 2858539 - DNA, 12 bp, Homo sapiens
aaagactgcaga

SEQ ID NO: 2858540 - DNA, 14 bp, Homo sapiens
aaagcaaggaaact

SEQ ID NO: 2858541 - DNA, 15 bp, Homo sapiens
aaagctggactgacc

SEQ ID NO: 2858542 - DNA, 22 bp, Homo sapiens
aaagctggactgaccaaagact

SEQ ID NO: 2858543 - DNA, 17 bp, Homo sapiens
aaagctgttattcttgt

SEQ ID NO: 2858544 - DNA, 18 bp, Homo sapiens
aaagctgttattcttgtt

SEQ ID NO: 2858545 - DNA, 19 bp, Homo sapiens
aaagctgttattcttgtta

SEQ ID NO: 2858546 - DNA, 20 bp, Homo sapiens
aaaggcaagcttgaggccaa

SEQ ID NO: 2858547 - DNA, 23 bp, Homo sapiens
aaaggcagctaagatagaaagct

SEQ ID NO: 2858548 - DNA, 13 bp, Homo sapiens
aaaggcttggctg

SEQ ID NO: 2858549 - DNA, 21 bp, Homo sapiens
aaagtactctttaacatacaa

SEQ ID NO: 2858550 - DNA, 13 bp, Homo sapiens
aaagtagcaggac

SEQ ID NO: 2858551 - DNA, 20 bp, Homo sapiens
aaagtggaaaacaaggaagt

SEQ ID NO: 2858552 - DNA, 16 bp, Homo sapiens
aaataaaatgtttcat

SEQ ID NO: 2858553 - DNA, 19 bp, Homo sapiens
aaataaccaatcctggaca

SEQ ID NO: 2858554 - DNA, 24 bp, Homo sapiens
aaataagaaacaactctttgagaa

SEQ ID NO: 2858555 - DNA, 19 bp, Homo sapiens
aaataatttgaactttgga

SEQ ID NO: 2858556 - DNA, 22 bp, Homo sapiens
aaatacagtcttccatttgcaa

SEQ ID NO: 2858557 - DNA, 23 bp, Homo sapiens
aaatacagtcttccatttgcaag

SEQ ID NO: 2858558 - DNA, 19 bp, Homo sapiens
aaatatacattttctaaat

SEQ ID NO: 2858559 - DNA, 17 bp, Homo sapiens
aaatatactctcccaga

SEQ ID NO: 2858560 - DNA, 13 bp, Homo sapiens
aaatatcataaag

SEQ ID NO: 2858561 - DNA, 17 bp, Homo sapiens
aaatatcataaagcatt

SEQ ID NO: 2858562 - DNA, 13 bp, Homo sapiens
aaatatgaatgaa

SEQ ID NO: 2858563 - DNA, 18 bp, Homo sapiens
aaatattccctagaaact

SEQ ID NO: 2858564 - DNA, 13 bp, Homo sapiens
aaatcagaaagta

SEQ ID NO: 2858565 - DNA, 17 bp, Homo sapiens
aaatcagaaagtaacaa

SEQ ID NO: 2858566 - DNA, 14 bp, Homo sapiens
aaatctaactacaa

SEQ ID NO: 2858567 - DNA, 13 bp, Homo sapiens
aaatgaactttgt

SEQ ID NO: 2858568 - DNA, 13 bp, Homo sapiens
aaatgaagaaagt

SEQ ID NO: 2858569 - DNA, 14 bp, Homo sapiens
aaatgaagaaagtc

SEQ ID NO: 2858570 - DNA, 16 bp, Homo sapiens
aaatgaagaaagtcaa

SEQ ID NO: 2858571 - DNA, 17 bp, Homo sapiens
aaatgaagatctttata

SEQ ID NO: 2858572 - DNA, 18 bp, Homo sapiens
aaatgaagatctttatat

SEQ ID NO: 2858573 - DNA, 19 bp, Homo sapiens
aaatgaagatctttatatt

SEQ ID NO: 2858574 - DNA, 12 bp, Homo sapiens
aaatgccagagc

SEQ ID NO: 2858575 - DNA, 15 bp, Homo sapiens
aaatgccagagccaa

SEQ ID NO: 2858576 - DNA, 21 bp, Homo sapiens
aaatgccagagccaacctgga

SEQ ID NO: 2858577 - DNA, 22 bp, Homo sapiens
aaatgccagagccaacctggac

SEQ ID NO: 2858578 - DNA, 14 bp, Homo sapiens
aaatggtccaggag

SEQ ID NO: 2858579 - DNA, 20 bp, Homo sapiens
aaatggtcctatttttgtga

SEQ ID NO: 2858580 - DNA, 14 bp, Homo sapiens
aaatgtatatgcac

SEQ ID NO: 2858581 - DNA, 15 bp, Homo sapiens
aaatgtatatgcact

SEQ ID NO: 2858582 - DNA, 12 bp, Homo sapiens
aaatgtttcatt

SEQ ID NO: 2858583 - DNA, 22 bp, Homo sapiens
aaattaaaacaaatatacattt

SEQ ID NO: 2858584 - DNA, 12 bp, Homo sapiens
aaattaagcatt

SEQ ID NO: 2858585 - DNA, 18 bp, Homo sapiens
aaattaatatatcattat

SEQ ID NO: 2858586 - DNA, 17 bp, Homo sapiens
aaattattatgactcaa

SEQ ID NO: 2858587 - DNA, 13 bp, Homo sapiens
aaattatttgcat

SEQ ID NO: 2858588 - DNA, 13 bp, Homo sapiens
aaattatttgcta

SEQ ID NO: 2858589 - DNA, 22 bp, Homo sapiens
aaattcaagagctagaaaaata

SEQ ID NO: 2858590 - DNA, 19 bp, Homo sapiens
aaattgccctatgctgtgc

SEQ ID NO: 2858591 - DNA, 15 bp, Homo sapiens
aaatttggttctaat

SEQ ID NO: 2858592 - DNA, 15 bp, Homo sapiens
aacaactctttgaga

SEQ ID NO: 2858593 - DNA, 14 bp, Homo sapiens
aacaaggaagtcaa

SEQ ID NO: 2858594 - DNA, 18 bp, Homo sapiens
aacaatggtgtggtgaat

SEQ ID NO: 2858595 - DNA, 21 bp, Homo sapiens
aacaattaactgccctctgaa

SEQ ID NO: 2858596 - DNA, 17 bp, Homo sapiens
aacacatcaaataaact

SEQ ID NO: 2858597 - DNA, 21 bp, Homo sapiens
aacacctttgttttgcactga

SEQ ID NO: 2858598 - DNA, 22 bp, Homo sapiens
aacacctttgttttgcactgac

SEQ ID NO: 2858599 - DNA, 18 bp, Homo sapiens
aacactatttgtgacttt

SEQ ID NO: 2858600 - DNA, 16 bp, Homo sapiens
aacactgtccttccct

SEQ ID NO: 2858601 - DNA, 20 bp, Homo sapiens
aacactgtccttccctgcca

SEQ ID NO: 2858602 - DNA, 17 bp, Homo sapiens
aacatacaagaaaatgt

SEQ ID NO: 2858603 - DNA, 20 bp, Homo sapiens
aacatgggctgtgattactg

SEQ ID NO: 2858604 - DNA, 17 bp, Homo sapiens
aacattttaagttttac

SEQ ID NO: 2858605 - DNA, 22 bp, Homo sapiens
aaccacgcaggaagcctactat

SEQ ID NO: 2858606 - DNA, 20 bp, Homo sapiens
aacccatcaacaaaaattgt

SEQ ID NO: 2858607 - DNA, 22 bp, Homo sapiens
aacctaaatttggttctaggcc

SEQ ID NO: 2858608 - DNA, 14 bp, Homo sapiens
aacctaccctggtc

SEQ ID NO: 2858609 - DNA, 14 bp, Homo sapiens
aacctcattcccca

SEQ ID NO: 2858610 - DNA, 16 bp, Homo sapiens
aacctgtattactgaa

SEQ ID NO: 2858611 - DNA, 17 bp, Homo sapiens
aaccttaaaaggtactg

SEQ ID NO: 2858612 - DNA, 15 bp, Homo sapiens
aaccttattgtacct

SEQ ID NO: 2858613 - DNA, 16 bp, Homo sapiens
aaccttattgtacctc

SEQ ID NO: 2858614 - DNA, 18 bp, Homo sapiens
aaccttattgtacctctc

SEQ ID NO: 2858615 - DNA, 22 bp, Homo sapiens
aaccttgtttaatagatttggg

SEQ ID NO: 2858616 - DNA, 17 bp, Homo sapiens
aacgaaaacctgactag

SEQ ID NO: 2858617 - DNA, 20 bp, Homo sapiens
aactaatgtttgaacaaagc

SEQ ID NO: 2858618 - DNA, 17 bp, Homo sapiens
aactagaatttattcaa

SEQ ID NO: 2858619 - DNA, 23 bp, Homo sapiens
aactatcttctttggacttctga

SEQ ID NO: 2858620 - DNA, 21 bp, Homo sapiens
aactatgttcctaacaaaatg

SEQ ID NO: 2858621 - DNA, 21 bp, Homo sapiens
aactctaaccaaggctgtgtt

SEQ ID NO: 2858622 - DNA, 14 bp, Homo sapiens
aactgcagggaaaa

SEQ ID NO: 2858623 - DNA, 13 bp, Homo sapiens
aactgtgaaatgt

SEQ ID NO: 2858624 - DNA, 23 bp, Homo sapiens
aactgtgataatccccacaggca

SEQ ID NO: 2858625 - DNA, 19 bp, Homo sapiens
aactgttgcacttttgaat

SEQ ID NO: 2858626 - DNA, 16 bp, Homo sapiens
aacttaaaaaactgca

SEQ ID NO: 2858627 - DNA, 16 bp, Homo sapiens
aacttcagcattgtaa

SEQ ID NO: 2858628 - DNA, 19 bp, Homo sapiens
aacttcagcattgtaatta

SEQ ID NO: 2858629 - DNA, 21 bp, Homo sapiens
aacttgatagggtctaccaat

SEQ ID NO: 2858630 - DNA, 18 bp, Homo sapiens
aactttccagtcttagct

SEQ ID NO: 2858631 - DNA, 16 bp, Homo sapiens
aacttttttgtggcaa

SEQ ID NO: 2858632 - DNA, 21 bp, Homo sapiens
aacttttttgtggcaattagt

SEQ ID NO: 2858633 - DNA, 17 bp, Homo sapiens
aagaaagcctaaaattg

SEQ ID NO: 2858634 - DNA, 11 bp, Homo sapiens
aagaaatttta

SEQ ID NO: 2858635 - DNA, 13 bp, Homo sapiens
aagaatgaaaaat

SEQ ID NO: 2858636 - DNA, 14 bp, Homo sapiens
aagaatgaaaaata

SEQ ID NO: 2858637 - DNA, 15 bp, Homo sapiens
aagaatgaaaaatat

SEQ ID NO: 2858638 - DNA, 21 bp, Homo sapiens
aagactgagccagattggcca

SEQ ID NO: 2858639 - DNA, 18 bp, Homo sapiens
aagagaaagagtttgaaa

SEQ ID NO: 2858640 - DNA, 22 bp, Homo sapiens
aagagctagaaaaataaaatgt

SEQ ID NO: 2858641 - DNA, 17 bp, Homo sapiens
aagagggacgcctgggg

SEQ ID NO: 2858642 - DNA, 13 bp, Homo sapiens
aagagtagaaact

SEQ ID NO: 2858643 - DNA, 20 bp, Homo sapiens
aagagtagaaactgcaggga

SEQ ID NO: 2858644 - DNA, 18 bp, Homo sapiens
aagataaaatgatgttat

SEQ ID NO: 2858645 - DNA, 22 bp, Homo sapiens
aagatacagaactctttcaaaa

SEQ ID NO: 2858646 - DNA, 22 bp, Homo sapiens
actctgctagactcctcaggag

SEQ ID NO: 2858647 - DNA, 13 bp, Homo sapiens
actctgcttgtta

SEQ ID NO: 2858648 - DNA, 19 bp, Homo sapiens
actcttaagtcctaaaagt

SEQ ID NO: 2858649 - DNA, 11 bp, Homo sapiens
actctttcaaa

SEQ ID NO: 2858650 - DNA, 13 bp, Homo sapiens
actctttgagaaa

SEQ ID NO: 2858651 - DNA, 15 bp, Homo sapiens
actcttttgctgtgc

SEQ ID NO: 2858652 - DNA, 12 bp, Homo sapiens
actgacaagatg

SEQ ID NO: 2858653 - DNA, 22 bp, Homo sapiens
actgacaagatggaaaataaat

SEQ ID NO: 2858654 - DNA, 18 bp, Homo sapiens
actgactttttcccccca

SEQ ID NO: 2858655 - DNA, 13 bp, Homo sapiens
actgagccagatt

SEQ ID NO: 2858656 - DNA, 18 bp, Homo sapiens
actgagcttctctgtgaa

SEQ ID NO: 2858657 - DNA, 20 bp, Homo sapiens
actgaggagacagaaagcct

SEQ ID NO: 2858658 - DNA, 21 bp, Homo sapiens
actgaggagacagaaagcctc

SEQ ID NO: 2858659 - DNA, 18 bp, Homo sapiens
actgcaatcactgtgcta

SEQ ID NO: 2858660 - DNA, 19 bp, Homo sapiens
actgcagaacccccaggtg

SEQ ID NO: 2858661 - DNA, 12 bp, Homo sapiens
actgcagcacct

SEQ ID NO: 2858662 - DNA, 14 bp, Homo sapiens
actgcagcacctcc

SEQ ID NO: 2858663 - DNA, 10 bp, Homo sapiens
actgcaggga

SEQ ID NO: 2858664 - DNA, 23 bp, Homo sapiens
actgcagggaaaattatttgcat

SEQ ID NO: 2858665 - DNA, 20 bp, Homo sapiens
actgcatcccacgttctgtt

SEQ ID NO: 2858666 - DNA, 13 bp, Homo sapiens
actgcatttgtgt

SEQ ID NO: 2858667 - DNA, 15 bp, Homo sapiens
actgccaaaacattt

SEQ ID NO: 2858668 - DNA, 13 bp, Homo sapiens
actgccctctgaa

SEQ ID NO: 2858669 - DNA, 18 bp, Homo sapiens
actgcttgaggaaaacaa

SEQ ID NO: 2858670 - DNA, 22 bp, Homo sapiens
actggcagaagcattgcctgga

SEQ ID NO: 2858671 - DNA, 14 bp, Homo sapiens
actgggctgaggga

SEQ ID NO: 2858672 - DNA, 17 bp, Homo sapiens
actggtgtaatctcaat

SEQ ID NO: 2858673 - DNA, 18 bp, Homo sapiens
actgtccttccctgccac

SEQ ID NO: 2858674 - DNA, 22 bp, Homo sapiens
actgtctccatggccctgcaaa

SEQ ID NO: 2858675 - DNA, 19 bp, Homo sapiens
actgtgcacatctgtgtct

SEQ ID NO: 2858676 - DNA, 20 bp, Homo sapiens
actgtgcacatctgtgtctt

SEQ ID NO: 2858677 - DNA, 18 bp, Homo sapiens
actgttccccctgtgcag

SEQ ID NO: 2858678 - DNA, 20 bp, Homo sapiens
actgttgcacttttgaatgt

SEQ ID NO: 2858679 - DNA, 16 bp, Homo sapiens
acttcaacccccagct

SEQ ID NO: 2858680 - DNA, 22 bp, Homo sapiens
acttcattttgtataatcacag

SEQ ID NO: 2858681 - DNA, 22 bp, Homo sapiens
acttctacctacatatttgtat

SEQ ID NO: 2858682 - DNA, 20 bp, Homo sapiens
acttctgaagagaccactca

SEQ ID NO: 2858683 - DNA, 21 bp, Homo sapiens
acttctggggccacctctgga

SEQ ID NO: 2858684 - DNA, 15 bp, Homo sapiens
acttgtttagagagc

SEQ ID NO: 2858685 - DNA, 17 bp, Homo sapiens
acttgtttagagagcct

SEQ ID NO: 2858686 - DNA, 21 bp, Homo sapiens
acttgtttagagagcctgtca

SEQ ID NO: 2858687 - DNA, 23 bp, Homo sapiens
acttgtttagagagcctgtcacc

SEQ ID NO: 2858688 - DNA, 19 bp, Homo sapiens
actttaaccctctcttccc

SEQ ID NO: 2858689 - DNA, 15 bp, Homo sapiens
actttattgcaatgc

SEQ ID NO: 2858690 - DNA, 22 bp, Homo sapiens
actttctatttttatgatgaca

SEQ ID NO: 2858691 - DNA, 17 bp, Homo sapiens
acttttagaaatgcata

SEQ ID NO: 2858692 - DNA, 18 bp, Homo sapiens
acttttagaaatgcatat

SEQ ID NO: 2858693 - DNA, 15 bp, Homo sapiens
acttttgccctttga

SEQ ID NO: 2858694 - DNA, 12 bp, Homo sapiens
actttttccccc

SEQ ID NO: 2858695 - DNA, 13 bp, Homo sapiens
agaaaaactaact

SEQ ID NO: 2858696 - DNA, 20 bp, Homo sapiens
agaaacaactctttgagaaa

SEQ ID NO: 2858697 - DNA, 20 bp, Homo sapiens
agaaacacatcaaataaact

SEQ ID NO: 2858698 - DNA, 15 bp, Homo sapiens
agaaacagccagcaa

SEQ ID NO: 2858699 - DNA, 20 bp, Homo sapiens
agaaaccttattgtacctct

SEQ ID NO: 2858700 - DNA, 20 bp, Homo sapiens
agaaagtggaaaacaaggaa

SEQ ID NO: 2858701 - DNA, 20 bp, Homo sapiens
agaacaaagtaaaagtagtg

SEQ ID NO: 2858702 - DNA, 21 bp, Homo sapiens
agaacacctttgttttgcact

SEQ ID NO: 2858703 - DNA, 15 bp, Homo sapiens
agaactcactctggg

SEQ ID NO: 2858704 - DNA, 19 bp, Homo sapiens
agaactcactctgggctgt

SEQ ID NO: 2858705 - DNA, 14 bp, Homo sapiens
agaactctttcaaa

SEQ ID NO: 2858706 - DNA, 13 bp, Homo sapiens
agaagaaaatttg

SEQ ID NO: 2858707 - DNA, 15 bp, Homo sapiens
agaagcattgcctgg

SEQ ID NO: 2858708 - DNA, 17 bp, Homo sapiens
agaagcattgcctggac

SEQ ID NO: 2858709 - DNA, 18 bp, Homo sapiens
agaagcattgcctggact

SEQ ID NO: 2858710 - DNA, 20 bp, Homo sapiens
agaagcattgcctggactga

SEQ ID NO: 2858711 - DNA, 21 bp, Homo sapiens
agaagcattgcctggactgac

SEQ ID NO: 2858712 - DNA, 19 bp, Homo sapiens
agaagcctgacaactcatt

SEQ ID NO: 2858713 - DNA, 16 bp, Homo sapiens
agaagggggtgggggg

SEQ ID NO: 2858714 - DNA, 14 bp, Homo sapiens
agaaggtgaacttt

SEQ ID NO: 2858715 - DNA, 17 bp, Homo sapiens
agaagtgatatggtgaa

SEQ ID NO: 2858716 - DNA, 19 bp, Homo sapiens
agaataattcttttctgag

SEQ ID NO: 2858717 - DNA, 11 bp, Homo sapiens
agaatatttat

SEQ ID NO: 2858718 - DNA, 16 bp, Homo sapiens
agaatatttattacct

SEQ ID NO: 2858719 - DNA, 19 bp, Homo sapiens
agaatatttattacctctg

SEQ ID NO: 2858720 - DNA, 17 bp, Homo sapiens
agaatccctgcagcctg

SEQ ID NO: 2858721 - DNA, 23 bp, Homo sapiens
agaattcactgagttttgtttca

SEQ ID NO: 2858722 - DNA, 13 bp, Homo sapiens
agaattgggaagc

SEQ ID NO: 2858723 - DNA, 21 bp, Homo sapiens
agaatttattcaattcctctg

SEQ ID NO: 2858724 - DNA, 23 bp, Homo sapiens
agacatcagcctccttctttcac

SEQ ID NO: 2858725 - DNA, 19 bp, Homo sapiens
agaccataaagatattctt

SEQ ID NO: 2858726 - DNA, 13 bp, Homo sapiens
agacccacacatg

SEQ ID NO: 2858727 - DNA, 19 bp, Homo sapiens
agacccagccctcatcccg

SEQ ID NO: 2858728 - DNA, 18 bp, Homo sapiens
agaccctctttcttgttt

SEQ ID NO: 2858729 - DNA, 22 bp, Homo sapiens
agaccctctttcttgtttgtca

SEQ ID NO: 2858730 - DNA, 23 bp, Homo sapiens
agaccctctttcttgtttgtcag

SEQ ID NO: 2858731 - DNA, 14 bp, Homo sapiens
agacctacagacct

SEQ ID NO: 2858732 - DNA, 19 bp, Homo sapiens
agacctacagacctggctc

SEQ ID NO: 2858733 - DNA, 15 bp, Homo sapiens
agacgcctgaggaac

SEQ ID NO: 2858734 - DNA, 11 bp, Homo sapiens
agactcagctc

SEQ ID NO: 2858735 - DNA, 16 bp, Homo sapiens
agactcctcaggagag

SEQ ID NO: 2858736 - DNA, 18 bp, Homo sapiens
agacttggagaatactgc

SEQ ID NO: 2858737 - DNA, 22 bp, Homo sapiens
agacttggagaatactgccaaa

SEQ ID NO: 2858738 - DNA, 18 bp, Homo sapiens
agacttggggaccagagg

SEQ ID NO: 2858739 - DNA, 17 bp, Homo sapiens
agagaaaataaaccaag

SEQ ID NO: 2858740 - DNA, 20 bp, Homo sapiens
agagattacctcctgagaaa

SEQ ID NO: 2858741 - DNA, 14 bp, Homo sapiens
agagcaattccagg

SEQ ID NO: 2858742 - DNA, 16 bp, Homo sapiens
agagcaattccaggct

SEQ ID NO: 2858743 - DNA, 13 bp, Homo sapiens
agagcagagagca

SEQ ID NO: 2858744 - DNA, 13 bp, Homo sapiens
agagccaacctgg

SEQ ID NO: 2858745 - DNA, 14 bp, Homo sapiens
agagccaacctgga

SEQ ID NO: 2858746 - DNA, 15 bp, Homo sapiens
agagccaacctggac

SEQ ID NO: 2858747 - DNA, 17 bp, Homo sapiens
agagccaacctggactt

SEQ ID NO: 2858748 - DNA, 21 bp, Homo sapiens
agagccaacctggacttcctg

SEQ ID NO: 2858749 - DNA, 22 bp, Homo sapiens
agagccaacctggacttcctgt

SEQ ID NO: 2858750 - DNA, 19 bp, Homo sapiens
agagccaccaagagggacg

SEQ ID NO: 2858751 - DNA, 18 bp, Homo sapiens
agagccagctctctctac

SEQ ID NO: 2858752 - DNA, 19 bp, Homo sapiens
agagcccctcctccagccc

SEQ ID NO: 2858753 - DNA, 22 bp, Homo sapiens
agagcccctcctccagcccctg

SEQ ID NO: 2858754 - DNA, 16 bp, Homo sapiens
agagcccgcttttgtt

SEQ ID NO: 2858755 - DNA, 11 bp, Homo sapiens
agagcctgagg

SEQ ID NO: 2858756 - DNA, 21 bp, Homo sapiens
aggtggggagactgggctgag

SEQ ID NO: 2858757 - DNA, 15 bp, Homo sapiens
aggttagtgacattt

SEQ ID NO: 2858758 - DNA, 19 bp, Homo sapiens
aggtttcaggaagttgcca

SEQ ID NO: 2858759 - DNA, 12 bp, Homo sapiens
agtaaaacagtc

SEQ ID NO: 2858760 - DNA, 17 bp, Homo sapiens
agtaaatcagaaagtaa

SEQ ID NO: 2858761 - DNA, 17 bp, Homo sapiens
agtaagtgcgaagactg

SEQ ID NO: 2858762 - DNA, 16 bp, Homo sapiens
agtaatgctaaatgtg

SEQ ID NO: 2858763 - DNA, 19 bp, Homo sapiens
agtaatgctaaatgtgtaa

SEQ ID NO: 2858764 - DNA, 15 bp, Homo sapiens
agtactctttaacat

SEQ ID NO: 2858765 - DNA, 22 bp, Homo sapiens
agtactctttaacatacaagaa

SEQ ID NO: 2858766 - DNA, 13 bp, Homo sapiens
agtaggagcccag

SEQ ID NO: 2858767 - DNA, 18 bp, Homo sapiens
agtagtaaatcagaaagt

SEQ ID NO: 2858768 - DNA, 19 bp, Homo sapiens
agtagttactaaaattatg

SEQ ID NO: 2858769 - DNA, 20 bp, Homo sapiens
agtcaaaaaattatttgcta

SEQ ID NO: 2858770 - DNA, 15 bp, Homo sapiens
agtcaacctgggcaa

SEQ ID NO: 2858771 - DNA, 18 bp, Homo sapiens
agtcagaatttttaactg

SEQ ID NO: 2858772 - DNA, 19 bp, Homo sapiens
agtcagaatttttaactgt

SEQ ID NO: 2858773 - DNA, 22 bp, Homo sapiens
agtcagaatttttaactgtact

SEQ ID NO: 2858774 - DNA, 14 bp, Homo sapiens
agtccacaaaataa

SEQ ID NO: 2858775 - DNA, 16 bp, Homo sapiens
agtccagcagtttcca

SEQ ID NO: 2858776 - DNA, 22 bp, Homo sapiens
agtcctaaaagttctcaatgta

SEQ ID NO: 2858777 - DNA, 20 bp, Homo sapiens
agtcctgatcagagccgtgg

SEQ ID NO: 2858778 - DNA, 22 bp, Homo sapiens
agtcgaaccatggtgaactcca

SEQ ID NO: 2858779 - DNA, 19 bp, Homo sapiens
agtcgatagagctgtatta

SEQ ID NO: 2858780 - DNA, 16 bp, Homo sapiens
agtctccagaagaaaa

SEQ ID NO: 2858781 - DNA, 17 bp, Homo sapiens
agtctccagaagaaaat

SEQ ID NO: 2858782 - DNA, 20 bp, Homo sapiens
agtctccagaagaaaatttg

SEQ ID NO: 2858783 - DNA, 21 bp, Homo sapiens
agtctccagaagaaaatttgc

SEQ ID NO: 2858784 - DNA, 13 bp, Homo sapiens
agtctctgagcag

SEQ ID NO: 2858785 - DNA, 16 bp, Homo sapiens
agtctctgtgtaacca

SEQ ID NO: 2858786 - DNA, 16 bp, Homo sapiens
agtcttacgaatactt

SEQ ID NO: 2858787 - DNA, 17 bp, Homo sapiens
agtcttccatttgcaag

SEQ ID NO: 2858788 - DNA, 20 bp, Homo sapiens
agtgaaattaagcattttga

SEQ ID NO: 2858789 - DNA, 21 bp, Homo sapiens
agtgaaggcttctctctgtgg

SEQ ID NO: 2858790 - DNA, 17 bp, Homo sapiens
agtgaatgattcagtgt

SEQ ID NO: 2858791 - DNA, 19 bp, Homo sapiens
agtgaatgattcagtgtta

SEQ ID NO: 2858792 - DNA, 18 bp, Homo sapiens
agtgatatggtgaaggga

SEQ ID NO: 2858793 - DNA, 21 bp, Homo sapiens
agtgatatggtgaagggaagt

SEQ ID NO: 2858794 - DNA, 13 bp, Homo sapiens
agtgatgtgctga

SEQ ID NO: 2858795 - DNA, 17 bp, Homo sapiens
agtgcccaaagtgggga

SEQ ID NO: 2858796 - DNA, 18 bp, Homo sapiens
agtgcccaaagtggggag

SEQ ID NO: 2858797 - DNA, 18 bp, Homo sapiens
agtgctataaatgccaga

SEQ ID NO: 2858798 - DNA, 22 bp, Homo sapiens
agtgctataaatgccagagcca

SEQ ID NO: 2858799 - DNA, 15 bp, Homo sapiens
agtgggacaaaccag

SEQ ID NO: 2858800 - DNA, 22 bp, Homo sapiens
agtgggatttggggcctcaaga

SEQ ID NO: 2858801 - DNA, 14 bp, Homo sapiens
agtggggagggaca

SEQ ID NO: 2858802 - DNA, 17 bp, Homo sapiens
agtggtgtgtgaagttt

SEQ ID NO: 2858803 - DNA, 14 bp, Homo sapiens
agtgtaaaaaatgt

SEQ ID NO: 2858804 - DNA, 20 bp, Homo sapiens
agtgtcatataaactcattt

SEQ ID NO: 2858805 - DNA, 23 bp, Homo sapiens
agtgtctttccacggagccactc

SEQ ID NO: 2858806 - DNA, 18 bp, Homo sapiens
agtgtgacagtttccaaa

SEQ ID NO: 2858807 - DNA, 15 bp, Homo sapiens
agtgtgaggccaggg

SEQ ID NO: 2858808 - DNA, 19 bp, Homo sapiens
agtgttagggaagggcctg

SEQ ID NO: 2858809 - DNA, 23 bp, Homo sapiens
agtgttagggaagggcctgccac

SEQ ID NO: 2858810 - DNA, 21 bp, Homo sapiens
agtgttccccttccactgagg

SEQ ID NO: 2858811 - DNA, 21 bp, Homo sapiens
agtgttgcctcttgcaatgcc

SEQ ID NO: 2858812 - DNA, 11 bp, Homo sapiens
agtgttgtcca

SEQ ID NO: 2858813 - DNA, 20 bp, Homo sapiens
agtgttttaagataaattat

SEQ ID NO: 2858814 - DNA, 22 bp, Homo sapiens
agtgttttggtggaaaaaacat

SEQ ID NO: 2858815 - DNA, 14 bp, Homo sapiens
agttaggggcctta

SEQ ID NO: 2858816 - DNA, 17 bp, Homo sapiens
agttctcaaatgtgtgt

SEQ ID NO: 2858817 - DNA, 20 bp, Homo sapiens
agttgccatgggaaacaaat

SEQ ID NO: 2858818 - DNA, 22 bp, Homo sapiens
agttgtcttatgtgaaaaatta

SEQ ID NO: 2858819 - DNA, 23 bp, Homo sapiens
agttgtcttatgtgaaaaattaa

SEQ ID NO: 2858820 - DNA, 16 bp, Homo sapiens
agtttggttttgacag

SEQ ID NO: 2858821 - DNA, 18 bp, Homo sapiens
agtttgtagaactttatt

SEQ ID NO: 2858822 - DNA, 23 bp, Homo sapiens
agtttgtgttgttgttgctgctg

SEQ ID NO: 2858823 - DNA, 18 bp, Homo sapiens
agtttttaaagccttctg

SEQ ID NO: 2858824 - DNA, 14 bp, Homo sapiens
agtttttgacattt

SEQ ID NO: 2858825 - DNA, 13 bp, Homo sapiens
ataaaaataaatt

SEQ ID NO: 2858826 - DNA, 22 bp, Homo sapiens
ataaaaataaatttggttctaa

SEQ ID NO: 2858827 - DNA, 14 bp, Homo sapiens
ataaaatatcataa

SEQ ID NO: 2858828 - DNA, 16 bp, Homo sapiens
ataaaatatcataaag

SEQ ID NO: 2858829 - DNA, 18 bp, Homo sapiens
ataaaatgatgttataca

SEQ ID NO: 2858830 - DNA, 18 bp, Homo sapiens
ataaaatgtttcattatg

SEQ ID NO: 2858831 - DNA, 16 bp, Homo sapiens
ataaacaacagctgaa

SEQ ID NO: 2858832 - DNA, 12 bp, Homo sapiens
ataaagctgtta

SEQ ID NO: 2858833 - DNA, 14 bp, Homo sapiens
ataaagctgttatt

SEQ ID NO: 2858834 - DNA, 17 bp, Homo sapiens
ataaagtacaaatgaag

SEQ ID NO: 2858835 - DNA, 20 bp, Homo sapiens
ataaagtacaaatgaagaaa

SEQ ID NO: 2858836 - DNA, 15 bp, Homo sapiens
ataaagtacttgact

SEQ ID NO: 2858837 - DNA, 12 bp, Homo sapiens
ataaataaatgt

SEQ ID NO: 2858838 - DNA, 15 bp, Homo sapiens
ataaatgccagagcc

SEQ ID NO: 2858839 - DNA, 17 bp, Homo sapiens
ataaatgccagagccaa

SEQ ID NO: 2858840 - DNA, 21 bp, Homo sapiens
ataaatgccagagccaacctg

SEQ ID NO: 2858841 - DNA, 20 bp, Homo sapiens
ataaatttggttctaataga

SEQ ID NO: 2858842 - DNA, 19 bp, Homo sapiens
ataacagccttttccttct

SEQ ID NO: 2858843 - DNA, 15 bp, Homo sapiens
ataacttctcatgta

SEQ ID NO: 2858844 - DNA, 20 bp, Homo sapiens
ataagaaagcctaaaattga

SEQ ID NO: 2858845 - DNA, 16 bp, Homo sapiens
ataagagtagaaactg

SEQ ID NO: 2858846 - DNA, 17 bp, Homo sapiens
ataagtagcattcatgt

SEQ ID NO: 2858847 - DNA, 21 bp, Homo sapiens
ataagtagtaaatcagaaagt

SEQ ID NO: 2858848 - DNA, 19 bp, Homo sapiens
ataatatttttgtatttct

SEQ ID NO: 2858849 - DNA, 20 bp, Homo sapiens
ataatatttttgtatttctc

SEQ ID NO: 2858850 - DNA, 22 bp, Homo sapiens
ataatgatcagcaaaaagactg

SEQ ID NO: 2858851 - DNA, 14 bp, Homo sapiens
ataatgtaacatga

SEQ ID NO: 2858852 - DNA, 13 bp, Homo sapiens
ataattcttttct

SEQ ID NO: 2858853 - DNA, 22 bp, Homo sapiens
ataatttttttcaatatttatt

SEQ ID NO: 2858854 - DNA, 11 bp, Homo sapiens
atacaaaatgt

SEQ ID NO: 2858855 - DNA, 14 bp, Homo sapiens
atacaagaaaatgt

SEQ ID NO: 2858856 - DNA, 20 bp, Homo sapiens
atacagaactctttcaaaac

SEQ ID NO: 2858857 - DNA, 17 bp, Homo sapiens
atacattttctaaataa

SEQ ID NO: 2858858 - DNA, 21 bp, Homo sapiens
ataccatatgaatgaaacatg

SEQ ID NO: 2858859 - DNA, 14 bp, Homo sapiens
atactactactgtt

SEQ ID NO: 2858860 - DNA, 17 bp, Homo sapiens
atactccactcccagca

SEQ ID NO: 2858861 - DNA, 21 bp, Homo sapiens
atactcttaggaagagaaacc

SEQ ID NO: 2858862 - DNA, 22 bp, Homo sapiens
atactcttaggaagagaaacca

SEQ ID NO: 2858863 - DNA, 22 bp, Homo sapiens
atactgccaaaacatttatgac

SEQ ID NO: 2858864 - DNA, 18 bp, Homo sapiens
atactgcttaattgctga

SEQ ID NO: 2858865 - DNA, 17 bp, Homo sapiens
attagtaacatgtgtta

SEQ ID NO: 2858866 - DNA, 22 bp, Homo sapiens
attagtgtgacagtttccaaat

SEQ ID NO: 2858867 - DNA, 18 bp, Homo sapiens
attatgcaattcagtgtt

SEQ ID NO: 2858868 - DNA, 23 bp, Homo sapiens
attatgcacttttagaaatgcat

SEQ ID NO: 2858869 - DNA, 15 bp, Homo sapiens
attattcagtgtcac

SEQ ID NO: 2858870 - DNA, 12 bp, Homo sapiens
attcaattagtg

SEQ ID NO: 2858871 - DNA, 17 bp, Homo sapiens
attcaattcctctggga

SEQ ID NO: 2858872 - DNA, 12 bp, Homo sapiens
attcacacctta

SEQ ID NO: 2858873 - DNA, 23 bp, Homo sapiens
attcaccttccagtgtctcggag

SEQ ID NO: 2858874 - DNA, 14 bp, Homo sapiens
attcagtgtcactg

SEQ ID NO: 2858875 - DNA, 19 bp, Homo sapiens
attcagtgttaaatgtgat

SEQ ID NO: 2858876 - DNA, 12 bp, Homo sapiens
attccaggctga

SEQ ID NO: 2858877 - DNA, 16 bp, Homo sapiens
attccaggctgagcca

SEQ ID NO: 2858878 - DNA, 19 bp, Homo sapiens
attccaggctgagccatga

SEQ ID NO: 2858879 - DNA, 15 bp, Homo sapiens
attccggactggcag

SEQ ID NO: 2858880 - DNA, 17 bp, Homo sapiens
attccggactggcagaa

SEQ ID NO: 2858881 - DNA, 20 bp, Homo sapiens
attccggactggcagaagca

SEQ ID NO: 2858882 - DNA, 21 bp, Homo sapiens
attcctatacgcagcgtgctt

SEQ ID NO: 2858883 - DNA, 12 bp, Homo sapiens
attcctctggga

SEQ ID NO: 2858884 - DNA, 22 bp, Homo sapiens
attcctctgggaatgttacatt

SEQ ID NO: 2858885 - DNA, 17 bp, Homo sapiens
attcctgggaaatattc

SEQ ID NO: 2858886 - DNA, 22 bp, Homo sapiens
attcctgggaaatattccctag

SEQ ID NO: 2858887 - DNA, 15 bp, Homo sapiens
attcctgggcaagaa

SEQ ID NO: 2858888 - DNA, 17 bp, Homo sapiens
attctcgggaaattatt

SEQ ID NO: 2858889 - DNA, 14 bp, Homo sapiens
attctctgtctcat

SEQ ID NO: 2858890 - DNA, 17 bp, Homo sapiens
attctctgtctcatcca

SEQ ID NO: 2858891 - DNA, 10 bp, Homo sapiens
attctgggaa

SEQ ID NO: 2858892 - DNA, 21 bp, Homo sapiens
attctgggaagcttgagcctc

SEQ ID NO: 2858893 - DNA, 16 bp, Homo sapiens
attcttgaaagctgtg

SEQ ID NO: 2858894 - DNA, 14 bp, Homo sapiens
attgaaaaaataga

SEQ ID NO: 2858895 - DNA, 18 bp, Homo sapiens
attgaaaaaatagagcct

SEQ ID NO: 2858896 - DNA, 20 bp, Homo sapiens
attgaattcttggttgagga

SEQ ID NO: 2858897 - DNA, 22 bp, Homo sapiens
attgatagggagttttaaagaa

SEQ ID NO: 2858898 - DNA, 22 bp, Homo sapiens
attgctgataccatatgaatga

SEQ ID NO: 2858899 - DNA, 17 bp, Homo sapiens
attgctgtgagccttgc

SEQ ID NO: 2858900 - DNA, 14 bp, Homo sapiens
attggacccttcca

SEQ ID NO: 2858901 - DNA, 15 bp, Homo sapiens
attggacccttccat

SEQ ID NO: 2858902 - DNA, 15 bp, Homo sapiens
attggactccaggcc

SEQ ID NO: 2858903 - DNA, 23 bp, Homo sapiens
attggactccaggcctgaccagg

SEQ ID NO: 2858904 - DNA, 15 bp, Homo sapiens
attggccaattaaaa

SEQ ID NO: 2858905 - DNA, 17 bp, Homo sapiens
attgggaagctggggga

SEQ ID NO: 2858906 - DNA, 13 bp, Homo sapiens
attgtaactgttc

SEQ ID NO: 2858907 - DNA, 19 bp, Homo sapiens
attgtaactgttcttgaat

SEQ ID NO: 2858908 - DNA, 15 bp, Homo sapiens
attgtaatctatgtt

SEQ ID NO: 2858909 - DNA, 16 bp, Homo sapiens
attgtaattatgtaaa

SEQ ID NO: 2858910 - DNA, 22 bp, Homo sapiens
attgtttcaattgcatctccca

SEQ ID NO: 2858911 - DNA, 20 bp, Homo sapiens
atttaaaacaatccttacta

SEQ ID NO: 2858912 - DNA, 21 bp, Homo sapiens
atttaaaacaatccttactaa

SEQ ID NO: 2858913 - DNA, 13 bp, Homo sapiens
atttactgagctt

SEQ ID NO: 2858914 - DNA, 23 bp, Homo sapiens
atttatctcctcttcatggcatc

SEQ ID NO: 2858915 - DNA, 21 bp, Homo sapiens
atttcaaaatacatttgtaag

SEQ ID NO: 2858916 - DNA, 22 bp, Homo sapiens
atttcaaaatacatttgtaagt

SEQ ID NO: 2858917 - DNA, 18 bp, Homo sapiens
atttccctccagagaaag

SEQ ID NO: 2858918 - DNA, 22 bp, Homo sapiens
atttctatatagacttggagaa

SEQ ID NO: 2858919 - DNA, 16 bp, Homo sapiens
atttctatgacaaatt

SEQ ID NO: 2858920 - DNA, 17 bp, Homo sapiens
atttctatgacaaattc

SEQ ID NO: 2858921 - DNA, 15 bp, Homo sapiens
atttctatttctcct

SEQ ID NO: 2858922 - DNA, 18 bp, Homo sapiens
atttctatttctcctcca

SEQ ID NO: 2858923 - DNA, 16 bp, Homo sapiens
atttgagtgctctgat

SEQ ID NO: 2858924 - DNA, 20 bp, Homo sapiens
atttgcaagggaaaagtctc

SEQ ID NO: 2858925 - DNA, 14 bp, Homo sapiens
atttgccaatcttt

SEQ ID NO: 2858926 - DNA, 21 bp, Homo sapiens
atttggagtgttccccttcca

SEQ ID NO: 2858927 - DNA, 21 bp, Homo sapiens
atttgtaagtgtaaaaaatgt

SEQ ID NO: 2858928 - DNA, 21 bp, Homo sapiens
atttgtatatgactgcatttg

SEQ ID NO: 2858929 - DNA, 13 bp, Homo sapiens
atttgtgactttt

SEQ ID NO: 2858930 - DNA, 15 bp, Homo sapiens
atttgtgacttttta

SEQ ID NO: 2858931 - DNA, 23 bp, Homo sapiens
attttaatgaagaaagtggaaaa

SEQ ID NO: 2858932 - DNA, 21 bp, Homo sapiens
attttagaaataataaaaaga

SEQ ID NO: 2858933 - DNA, 19 bp, Homo sapiens
attttatcattaaaaatta

SEQ ID NO: 2858934 - DNA, 20 bp, Homo sapiens
attttatcattaaaaattac

SEQ ID NO: 2858935 - DNA, 21 bp, Homo sapiens
attttcacctgtttttaagct

SEQ ID NO: 2858936 - DNA, 20 bp, Homo sapiens
attttcataagtatttcaaa

SEQ ID NO: 2858937 - DNA, 21 bp, Homo sapiens
attttcctaataaagttctgt

SEQ ID NO: 2858938 - DNA, 20 bp, Homo sapiens
attttctaaataaaaatatg

SEQ ID NO: 2858939 - DNA, 15 bp, Homo sapiens
attttgaaacaaagt

SEQ ID NO: 2858940 - DNA, 20 bp, Homo sapiens
attttgaataaataaatgta

SEQ ID NO: 2858941 - DNA, 14 bp, Homo sapiens
attttgtataatca

SEQ ID NO: 2858942 - DNA, 12 bp, Homo sapiens
atttttaactgt

SEQ ID NO: 2858943 - DNA, 13 bp, Homo sapiens
atttttaactgta

SEQ ID NO: 2858944 - DNA, 16 bp, Homo sapiens
attttttgaatctatg

SEQ ID NO: 2858945 - DNA, 14 bp, Homo sapiens
atttttttaactgt

SEQ ID NO: 2858946 - DNA, 11 bp, Homo sapiens
caaaaaattat

SEQ ID NO: 2858947 - DNA, 16 bp, Homo sapiens
caaaacctgtattact

SEQ ID NO: 2858948 - DNA, 23 bp, Homo sapiens
caaaacctgtattactgaataat

SEQ ID NO: 2858949 - DNA, 12 bp, Homo sapiens
caaaatggaagg

SEQ ID NO: 2858950 - DNA, 19 bp, Homo sapiens
caaaatggtcctatttttg

SEQ ID NO: 2858951 - DNA, 18 bp, Homo sapiens
caaacactccaccctcca

SEQ ID NO: 2858952 - DNA, 21 bp, Homo sapiens
caaacatgaccctaaatcttg

SEQ ID NO: 2858953 - DNA, 13 bp, Homo sapiens
caaactagggcca

SEQ ID NO: 2858954 - DNA, 13 bp, Homo sapiens
caaagactgcaga

SEQ ID NO: 2858955 - DNA, 14 bp, Homo sapiens
caaagctcaaagta

SEQ ID NO: 2858956 - DNA, 11 bp, Homo sapiens
caaaggcagct

SEQ ID NO: 2858957 - DNA, 19 bp, Homo sapiens
caaaggcagctaagataga

SEQ ID NO: 2858958 - DNA, 13 bp, Homo sapiens
caaagtctccaga

SEQ ID NO: 2858959 - DNA, 19 bp, Homo sapiens
caaagtctccagaagaaaa

SEQ ID NO: 2858960 - DNA, 20 bp, Homo sapiens
caaagtctccagaagaaaat

SEQ ID NO: 2858961 - DNA, 15 bp, Homo sapiens
caaagtggggaggga

SEQ ID NO: 2858962 - DNA, 20 bp, Homo sapiens
caaagtggggagggacaagg

SEQ ID NO: 2858963 - DNA, 18 bp, Homo sapiens
caaataatttgaactttg

SEQ ID NO: 2858964 - DNA, 21 bp, Homo sapiens
caaataatttgaactttggaa

SEQ ID NO: 2858965 - DNA, 22 bp, Homo sapiens
caaataatttgaactttggaac

SEQ ID NO: 2858966 - DNA, 23 bp, Homo sapiens
caaatatacattttctaaataaa

SEQ ID NO: 2858967 - DNA, 18 bp, Homo sapiens
caaatcagtttgactact

SEQ ID NO: 2858968 - DNA, 14 bp, Homo sapiens
caaatgaagaaagt

SEQ ID NO: 2858969 - DNA, 16 bp, Homo sapiens
caaatgaagaaagtca

SEQ ID NO: 2858970 - DNA, 19 bp, Homo sapiens
caaattaaaacaaatatac

SEQ ID NO: 2858971 - DNA, 22 bp, Homo sapiens
caaattcaagagctagaaaaat

SEQ ID NO: 2858972 - DNA, 13 bp, Homo sapiens
caacaatttctac

SEQ ID NO: 2858973 - DNA, 19 bp, Homo sapiens
caacaatttctactttgaa

SEQ ID NO: 2858974 - DNA, 11 bp, Homo sapiens
caacacagagc

SEQ ID NO: 2858975 - DNA, 12 bp, Homo sapiens
catggacacaga

SEQ ID NO: 2858976 - DNA, 13 bp, Homo sapiens
catggacacagac

SEQ ID NO: 2858977 - DNA, 19 bp, Homo sapiens
catggacacagacccacac

SEQ ID NO: 2858978 - DNA, 15 bp, Homo sapiens
catgggcagagccca

SEQ ID NO: 2858979 - DNA, 16 bp, Homo sapiens
catgtaaactgtgcac

SEQ ID NO: 2858980 - DNA, 15 bp, Homo sapiens
catgtaataaacagg

SEQ ID NO: 2858981 - DNA, 18 bp, Homo sapiens
catgtaggaagtaggaag

SEQ ID NO: 2858982 - DNA, 16 bp, Homo sapiens
catgtgttaagtattt

SEQ ID NO: 2858983 - DNA, 18 bp, Homo sapiens
catgttcccaaaacaatg

SEQ ID NO: 2858984 - DNA, 16 bp, Homo sapiens
catgtttttgttttaa

SEQ ID NO: 2858985 - DNA, 23 bp, Homo sapiens
cattaactgttgcacttttgaat

SEQ ID NO: 2858986 - DNA, 18 bp, Homo sapiens
cattattcaagaatgaaa

SEQ ID NO: 2858987 - DNA, 16 bp, Homo sapiens
cattccggactggcag

SEQ ID NO: 2858988 - DNA, 17 bp, Homo sapiens
cattccggactggcaga

SEQ ID NO: 2858989 - DNA, 14 bp, Homo sapiens
cattctctgtctca

SEQ ID NO: 2858990 - DNA, 20 bp, Homo sapiens
cattcttcagtttttcactt

SEQ ID NO: 2858991 - DNA, 17 bp, Homo sapiens
cattgaagccgactctg

SEQ ID NO: 2858992 - DNA, 21 bp, Homo sapiens
cattgaattcttggttgagga

SEQ ID NO: 2858993 - DNA, 15 bp, Homo sapiens
cattgccaagggctt

SEQ ID NO: 2858994 - DNA, 12 bp, Homo sapiens
cattgcctggac

SEQ ID NO: 2858995 - DNA, 13 bp, Homo sapiens
cattgcctggact

SEQ ID NO: 2858996 - DNA, 14 bp, Homo sapiens
cattgcctggactg

SEQ ID NO: 2858997 - DNA, 16 bp, Homo sapiens
cattggacccttccat

SEQ ID NO: 2858998 - DNA, 21 bp, Homo sapiens
cattgtaattatgtaaataac

SEQ ID NO: 2858999 - DNA, 21 bp, Homo sapiens
cattgtccaatcctatgtttt

SEQ ID NO: 2859000 - DNA, 22 bp, Homo sapiens
cattgtttgtctgtcttcatag

SEQ ID NO: 2859001 - DNA, 17 bp, Homo sapiens
catttaaatacagtctt

SEQ ID NO: 2859002 - DNA, 13 bp, Homo sapiens
catttaatgccat

SEQ ID NO: 2859003 - DNA, 21 bp, Homo sapiens
catttagaagcctgacaactc

SEQ ID NO: 2859004 - DNA, 17 bp, Homo sapiens
catttagtttgattatt

SEQ ID NO: 2859005 - DNA, 18 bp, Homo sapiens
catttatgacaagctgta

SEQ ID NO: 2859006 - DNA, 13 bp, Homo sapiens
catttctatttat

SEQ ID NO: 2859007 - DNA, 14 bp, Homo sapiens
catttctatttatt

SEQ ID NO: 2859008 - DNA, 19 bp, Homo sapiens
catttgtaagtgtaaaaaa

SEQ ID NO: 2859009 - DNA, 20 bp, Homo sapiens
catttgtaagtgtaaaaaat

SEQ ID NO: 2859010 - DNA, 19 bp, Homo sapiens
cattttcatattgtaatct

SEQ ID NO: 2859011 - DNA, 12 bp, Homo sapiens
cattttctaaat

SEQ ID NO: 2859012 - DNA, 18 bp, Homo sapiens
cattttctaaataaaaat

SEQ ID NO: 2859013 - DNA, 14 bp, Homo sapiens
cattttgaaacaaa

SEQ ID NO: 2859014 - DNA, 17 bp, Homo sapiens
ccaaaatttatatttta

SEQ ID NO: 2859015 - DNA, 17 bp, Homo sapiens
ccaaagactgcagaacc

SEQ ID NO: 2859016 - DNA, 23 bp, Homo sapiens
ccaaagcaatgtgagtcccagag

SEQ ID NO: 2859017 - DNA, 13 bp, Homo sapiens
ccaaaggcagcta

SEQ ID NO: 2859018 - DNA, 16 bp, Homo sapiens
ccaaaggcagctaaga

SEQ ID NO: 2859019 - DNA, 17 bp, Homo sapiens
ccaaaggcagctaagat

SEQ ID NO: 2859020 - DNA, 21 bp, Homo sapiens
ccaaaggcagctaagatagaa

SEQ ID NO: 2859021 - DNA, 16 bp, Homo sapiens
ccaaagtggggaggga

SEQ ID NO: 2859022 - DNA, 20 bp, Homo sapiens
ccaaccaggccttcatcctc

SEQ ID NO: 2859023 - DNA, 17 bp, Homo sapiens
ccaacctggacttcctg

SEQ ID NO: 2859024 - DNA, 18 bp, Homo sapiens
ccaagcaggaaatgaaaa

SEQ ID NO: 2859025 - DNA, 18 bp, Homo sapiens
ccaaggaaaggcatgtac

SEQ ID NO: 2859026 - DNA, 21 bp, Homo sapiens
ccaaggaaaggcatgtacaaa

SEQ ID NO: 2859027 - DNA, 13 bp, Homo sapiens
ccaaggagcccct

SEQ ID NO: 2859028 - DNA, 17 bp, Homo sapiens
ccaaggctgtgtttaga

SEQ ID NO: 2859029 - DNA, 13 bp, Homo sapiens
ccaatatatgtat

SEQ ID NO: 2859030 - DNA, 13 bp, Homo sapiens
ccacaattccatt

SEQ ID NO: 2859031 - DNA, 17 bp, Homo sapiens
ccacaccaaccaggcct

SEQ ID NO: 2859032 - DNA, 13 bp, Homo sapiens
ccacatcctccac

SEQ ID NO: 2859033 - DNA, 17 bp, Homo sapiens
ccaccaagagggacgcc

SEQ ID NO: 2859034 - DNA, 21 bp, Homo sapiens
ccaccaagagggacgcctggg

SEQ ID NO: 2859035 - DNA, 22 bp, Homo sapiens
ccaccaccttggactcctccca

SEQ ID NO: 2859036 - DNA, 12 bp, Homo sapiens
ccaccagtgcct

SEQ ID NO: 2859037 - DNA, 13 bp, Homo sapiens
ccacccacagcca

SEQ ID NO: 2859038 - DNA, 18 bp, Homo sapiens
ccacccagcaacacagag

SEQ ID NO: 2859039 - DNA, 23 bp, Homo sapiens
ccaccgggttctgcagcggcaga

SEQ ID NO: 2859040 - DNA, 12 bp, Homo sapiens
ccaccttcccca

SEQ ID NO: 2859041 - DNA, 16 bp, Homo sapiens
ccaccttccccagact

SEQ ID NO: 2859042 - DNA, 18 bp, Homo sapiens
ccaccttccccagactca

SEQ ID NO: 2859043 - DNA, 17 bp, Homo sapiens
ccaccttggactcctcc

SEQ ID NO: 2859044 - DNA, 22 bp, Homo sapiens
ccaccttggactcctcccacaa

SEQ ID NO: 2859045 - DNA, 14 bp, Homo sapiens
ccacgcacacatgg

SEQ ID NO: 2859046 - DNA, 17 bp, Homo sapiens
ccacgcacacatggaca

SEQ ID NO: 2859047 - DNA, 20 bp, Homo sapiens
ccacggagccactcctctga

SEQ ID NO: 2859048 - DNA, 13 bp, Homo sapiens
ccacgttctgtta

SEQ ID NO: 2859049 - DNA, 14 bp, Homo sapiens
ccactactgcagca

SEQ ID NO: 2859050 - DNA, 20 bp, Homo sapiens
ccactactgcagcacctcca

SEQ ID NO: 2859051 - DNA, 22 bp, Homo sapiens
ccactcccagcagctcaaccta

SEQ ID NO: 2859052 - DNA, 20 bp, Homo sapiens
ccactcctctgactcagggc

SEQ ID NO: 2859053 - DNA, 13 bp, Homo sapiens
ccactctcccctc

SEQ ID NO: 2859054 - DNA, 23 bp, Homo sapiens
ccactctcccctccctcttcctt

SEQ ID NO: 2859055 - DNA, 17 bp, Homo sapiens
ccactgaggagacagaa

SEQ ID NO: 2859056 - DNA, 13 bp, Homo sapiens
ccactgagggcag

SEQ ID NO: 2859057 - DNA, 18 bp, Homo sapiens
ccactgcctgcctcccct

SEQ ID NO: 2859058 - DNA, 15 bp, Homo sapiens
ccacttcaaccccca

SEQ ID NO: 2859059 - DNA, 21 bp, Homo sapiens
ccacttcattcttgaaagctg

SEQ ID NO: 2859060 - DNA, 18 bp, Homo sapiens
ccactttattgcaatgca

SEQ ID NO: 2859061 - DNA, 14 bp, Homo sapiens
ccagactcagctcc

SEQ ID NO: 2859062 - DNA, 21 bp, Homo sapiens
ccagagaaagcacaatttaaa

SEQ ID NO: 2859063 - DNA, 16 bp, Homo sapiens
ccagagaccccttcct

SEQ ID NO: 2859064 - DNA, 21 bp, Homo sapiens
ccagagaccccttcctttcct

SEQ ID NO: 2859065 - DNA, 11 bp, Homo sapiens
ccagagccaac

SEQ ID NO: 2859066 - DNA, 13 bp, Homo sapiens
ccagagccaacct

SEQ ID NO: 2859067 - DNA, 21 bp, Homo sapiens
ccagagcctggctgcccatca

SEQ ID NO: 2859068 - DNA, 18 bp, Homo sapiens
ccagagcttctctgggct

SEQ ID NO: 2859069 - DNA, 22 bp, Homo sapiens
ccagagcttctctgggctgaat

SEQ ID NO: 2859070 - DNA, 17 bp, Homo sapiens
ccagaggaaggggccag

SEQ ID NO: 2859071 - DNA, 17 bp, Homo sapiens
ccagagtctgtattttt

SEQ ID NO: 2859072 - DNA, 19 bp, Homo sapiens
ccagcactgcttgaggaaa

SEQ ID NO: 2859073 - DNA, 22 bp, Homo sapiens
ccagccccacccctaagtgccc

SEQ ID NO: 2859074 - DNA, 13 bp, Homo sapiens
ccagcccctgtcc

SEQ ID NO: 2859075 - DNA, 17 bp, Homo sapiens
ccagcccctgtcccacc

SEQ ID NO: 2859076 - DNA, 14 bp, Homo sapiens
ccagccccttgaga

SEQ ID NO: 2859077 - DNA, 14 bp, Homo sapiens
ccagccctcatccc

SEQ ID NO: 2859078 - DNA, 17 bp, Homo sapiens
ccagcgtcctcctctgt

SEQ ID NO: 2859079 - DNA, 19 bp, Homo sapiens
ccagcgtcctcctctgtga

SEQ ID NO: 2859080 - DNA, 15 bp, Homo sapiens
ccagctaataaacca

SEQ ID NO: 2859081 - DNA, 14 bp, Homo sapiens
ccagctcagtgttt

SEQ ID NO: 2859082 - DNA, 14 bp, Homo sapiens
ccagctctctctac

SEQ ID NO: 2859083 - DNA, 14 bp, Homo sapiens
ccagctctgtatca

SEQ ID NO: 2859084 - DNA, 18 bp, Homo sapiens
ccagctcttctcttccta

SEQ ID NO: 2859085 - DNA, 17 bp, Homo sapiens
ccttgggccctttgagt

SEQ ID NO: 2859086 - DNA, 12 bp, Homo sapiens
ccttgggctccc

SEQ ID NO: 2859087 - DNA, 16 bp, Homo sapiens
ccttggttcccccact

SEQ ID NO: 2859088 - DNA, 21 bp, Homo sapiens
cctttcctctgcagcacttta

SEQ ID NO: 2859089 - DNA, 21 bp, Homo sapiens
cctttgattaaagactccagt

SEQ ID NO: 2859090 - DNA, 16 bp, Homo sapiens
cgaatgcccctgttca

SEQ ID NO: 2859091 - DNA, 18 bp, Homo sapiens
cgagatgtgacccaccag

SEQ ID NO: 2859092 - DNA, 23 bp, Homo sapiens
cgagatgtgacccaccagtgcct

SEQ ID NO: 2859093 - DNA, 15 bp, Homo sapiens
cgattagtgatgtcc

SEQ ID NO: 2859094 - DNA, 15 bp, Homo sapiens
cgcagcagggaagct

SEQ ID NO: 2859095 - DNA, 23 bp, Homo sapiens
cgccaaggaaaggcatgtacaaa

SEQ ID NO: 2859096 - DNA, 12 bp, Homo sapiens
cgccccaacact

SEQ ID NO: 2859097 - DNA, 20 bp, Homo sapiens
cgccccaacactgtccttcc

SEQ ID NO: 2859098 - DNA, 13 bp, Homo sapiens
cgcctttcccagg

SEQ ID NO: 2859099 - DNA, 16 bp, Homo sapiens
cgctgctagagaaggg

SEQ ID NO: 2859100 - DNA, 12 bp, Homo sapiens
cgcttgtagaac

SEQ ID NO: 2859101 - DNA, 20 bp, Homo sapiens
cgcttgtagaactcactctg

SEQ ID NO: 2859102 - DNA, 14 bp, Homo sapiens
cggactggcagaag

SEQ ID NO: 2859103 - DNA, 11 bp, Homo sapiens
cggagccactc

SEQ ID NO: 2859104 - DNA, 21 bp, Homo sapiens
cggagccactcctctgactca

SEQ ID NO: 2859105 - DNA, 15 bp, Homo sapiens
cggaggtccagctgg

SEQ ID NO: 2859106 - DNA, 19 bp, Homo sapiens
cggaggtccagctgggcct

SEQ ID NO: 2859107 - DNA, 21 bp, Homo sapiens
cggcagagcaattccaggctg

SEQ ID NO: 2859108 - DNA, 20 bp, Homo sapiens
cggcagatgatgctttggaa

SEQ ID NO: 2859109 - DNA, 15 bp, Homo sapiens
cggcaggttctcttt

SEQ ID NO: 2859110 - DNA, 17 bp, Homo sapiens
cggcccagagacccctt

SEQ ID NO: 2859111 - DNA, 20 bp, Homo sapiens
cggcccagagaccccttcct

SEQ ID NO: 2859112 - DNA, 21 bp, Homo sapiens
cggcccagagaccccttcctt

SEQ ID NO: 2859113 - DNA, 15 bp, Homo sapiens
cggcctgagaaacac

SEQ ID NO: 2859114 - DNA, 21 bp, Homo sapiens
cgggcccttcccacaggacat

SEQ ID NO: 2859115 - DNA, 23 bp, Homo sapiens
cgggtggaaaagaatccctgcag

SEQ ID NO: 2859116 - DNA, 20 bp, Homo sapiens
cggtggctcacgcctgtaat

SEQ ID NO: 2859117 - DNA, 15 bp, Homo sapiens
cgtattaaaaaacaa

SEQ ID NO: 2859118 - DNA, 16 bp, Homo sapiens
cgtattaaaaaacaat

SEQ ID NO: 2859119 - DNA, 13 bp, Homo sapiens
cgtcatttgtgca

SEQ ID NO: 2859120 - DNA, 15 bp, Homo sapiens
cgttctaaatatgaa

SEQ ID NO: 2859121 - DNA, 21 bp, Homo sapiens
cgtttatatttttttaactgt

SEQ ID NO: 2859122 - DNA, 22 bp, Homo sapiens
cgtttatatttttttaactgtg

SEQ ID NO: 2859123 - DNA, 18 bp, Homo sapiens
ctaaaagttctcaatgta

SEQ ID NO: 2859124 - DNA, 15 bp, Homo sapiens
ctaaaattatgttac

SEQ ID NO: 2859125 - DNA, 16 bp, Homo sapiens
ctaaaattatgttact

SEQ ID NO: 2859126 - DNA, 13 bp, Homo sapiens
ctaaatgtgtaat

SEQ ID NO: 2859127 - DNA, 19 bp, Homo sapiens
ctaaatgtgtaataatgta

SEQ ID NO: 2859128 - DNA, 23 bp, Homo sapiens
ctaaatgtgtaataatgtaacat

SEQ ID NO: 2859129 - DNA, 13 bp, Homo sapiens
ctaacaaaatgag

SEQ ID NO: 2859130 - DNA, 12 bp, Homo sapiens
ctaacctcatct

SEQ ID NO: 2859131 - DNA, 15 bp, Homo sapiens
ctaactaaataccat

SEQ ID NO: 2859132 - DNA, 16 bp, Homo sapiens
ctaactaaataccatt

SEQ ID NO: 2859133 - DNA, 14 bp, Homo sapiens
ctaagatagaaagc

SEQ ID NO: 2859134 - DNA, 17 bp, Homo sapiens
ctaagatagaaagctgg

SEQ ID NO: 2859135 - DNA, 22 bp, Homo sapiens
ctaagatagaaagctggactga

SEQ ID NO: 2859136 - DNA, 11 bp, Homo sapiens
ctaagtgccca

SEQ ID NO: 2859137 - DNA, 13 bp, Homo sapiens
ctaagtgcccaaa

SEQ ID NO: 2859138 - DNA, 17 bp, Homo sapiens
ctaagtgcccaaagtgg

SEQ ID NO: 2859139 - DNA, 21 bp, Homo sapiens
ctaataaaccagattccagag

SEQ ID NO: 2859140 - DNA, 21 bp, Homo sapiens
ctaatttatcttgtctctggg

SEQ ID NO: 2859141 - DNA, 11 bp, Homo sapiens
ctacaaaatgg

SEQ ID NO: 2859142 - DNA, 18 bp, Homo sapiens
ctacacccttttccagct

SEQ ID NO: 2859143 - DNA, 21 bp, Homo sapiens
ctacagacctggctctcagag

SEQ ID NO: 2859144 - DNA, 14 bp, Homo sapiens
ctacagtcaggaaa

SEQ ID NO: 2859145 - DNA, 19 bp, Homo sapiens
ctacatatttgtatgtttt

SEQ ID NO: 2859146 - DNA, 18 bp, Homo sapiens
ctaccctgagctgaggca

SEQ ID NO: 2859147 - DNA, 13 bp, Homo sapiens
ctactgcagcacc

SEQ ID NO: 2859148 - DNA, 18 bp, Homo sapiens
ctactgcagcacctccag

SEQ ID NO: 2859149 - DNA, 20 bp, Homo sapiens
ctactgcagcacctccaggc

SEQ ID NO: 2859150 - DNA, 22 bp, Homo sapiens
ctactggtgtaatctcaatgca

SEQ ID NO: 2859151 - DNA, 23 bp, Homo sapiens
ctactggtgtaatctcaatgcaa

SEQ ID NO: 2859152 - DNA, 16 bp, Homo sapiens
ctacttcccactgtat

SEQ ID NO: 2859153 - DNA, 14 bp, Homo sapiens
ctagaaacttccaa

SEQ ID NO: 2859154 - DNA, 13 bp, Homo sapiens
ctagaatttattc

SEQ ID NO: 2859155 - DNA, 22 bp, Homo sapiens
ctagaatttattcaattcctct

SEQ ID NO: 2859156 - DNA, 23 bp, Homo sapiens
ctagaatttattcaattcctctg

SEQ ID NO: 2859157 - DNA, 13 bp, Homo sapiens
ctagactcctcag

SEQ ID NO: 2859158 - DNA, 16 bp, Homo sapiens
ctagctctctaggcct

SEQ ID NO: 2859159 - DNA, 22 bp, Homo sapiens
ctagctctctaggcctctccag

SEQ ID NO: 2859160 - DNA, 14 bp, Homo sapiens
ctaggaaacccaag

SEQ ID NO: 2859161 - DNA, 16 bp, Homo sapiens
ctagggccaagcccag

SEQ ID NO: 2859162 - DNA, 17 bp, Homo sapiens
ctagggccaagcccagc

SEQ ID NO: 2859163 - DNA, 14 bp, Homo sapiens
ctaggttctgtaga

SEQ ID NO: 2859164 - DNA, 17 bp, Homo sapiens
ctagtgaaggcttctct

SEQ ID NO: 2859165 - DNA, 12 bp, Homo sapiens
ctataaagctgt

SEQ ID NO: 2859166 - DNA, 16 bp, Homo sapiens
ctataaatgccagagc

SEQ ID NO: 2859167 - DNA, 19 bp, Homo sapiens
ctataaatgccagagccaa

SEQ ID NO: 2859168 - DNA, 14 bp, Homo sapiens
ctatatagacttgg

SEQ ID NO: 2859169 - DNA, 21 bp, Homo sapiens
ctatcagttgatttttcttat

SEQ ID NO: 2859170 - DNA, 21 bp, Homo sapiens
ctatccacactgtcaaacagg

SEQ ID NO: 2859171 - DNA, 22 bp, Homo sapiens
ctatcttctttggacttctgaa

SEQ ID NO: 2859172 - DNA, 16 bp, Homo sapiens
ctatggcttatttcta

SEQ ID NO: 2859173 - DNA, 21 bp, Homo sapiens
ctatggcttatttctatgaca

SEQ ID NO: 2859174 - DNA, 15 bp, Homo sapiens
ctatttatttactga

SEQ ID NO: 2859175 - DNA, 18 bp, Homo sapiens
ctatttatttactgagct

SEQ ID NO: 2859176 - DNA, 16 bp, Homo sapiens
ctatttctcctccatg

SEQ ID NO: 2859177 - DNA, 15 bp, Homo sapiens
ctatttgtgactttt

SEQ ID NO: 2859178 - DNA, 17 bp, Homo sapiens
ctatttgtgacttttta

SEQ ID NO: 2859179 - DNA, 13 bp, Homo sapiens
ctattttcataat

SEQ ID NO: 2859180 - DNA, 21 bp, Homo sapiens
ctattttcataatcagtaaat

SEQ ID NO: 2859181 - DNA, 15 bp, Homo sapiens
ctatttttatgatga

SEQ ID NO: 2859182 - DNA, 14 bp, Homo sapiens
ctatttttgtgaag

SEQ ID NO: 2859183 - DNA, 19 bp, Homo sapiens
ctcaaagtatgcaatgctt

SEQ ID NO: 2859184 - DNA, 19 bp, Homo sapiens
ctcaacccccatttctatt

SEQ ID NO: 2859185 - DNA, 16 bp, Homo sapiens
ctcaacctaccctggt

SEQ ID NO: 2859186 - DNA, 23 bp, Homo sapiens
ctcaagaaatatactctcccaga

SEQ ID NO: 2859187 - DNA, 18 bp, Homo sapiens
ctcaagggaaaggcaagc

SEQ ID NO: 2859188 - DNA, 20 bp, Homo sapiens
ctcaataaacagtcactgga

SEQ ID NO: 2859189 - DNA, 22 bp, Homo sapiens
ctcaatgtacatagaccctctt

SEQ ID NO: 2859190 - DNA, 22 bp, Homo sapiens
ctcaccaggggtgctatgacat

SEQ ID NO: 2859191 - DNA, 19 bp, Homo sapiens
ctcactccccagccccacc

SEQ ID NO: 2859192 - DNA, 23 bp, Homo sapiens
ctcactgaaacatggctgtgttt

SEQ ID NO: 2859193 - DNA, 16 bp, Homo sapiens
ctcagctgtcctgcag

SEQ ID NO: 2859194 - DNA, 17 bp, Homo sapiens
ctcaggagagacccctc

SEQ ID NO: 2859195 - DNA, 23 bp, Homo sapiens
ctttcttgtttgtcagcatctga

SEQ ID NO: 2859196 - DNA, 16 bp, Homo sapiens
ctttgaagtcatacca

SEQ ID NO: 2859197 - DNA, 20 bp, Homo sapiens
ctttgattaaagactccagt

SEQ ID NO: 2859198 - DNA, 22 bp, Homo sapiens
ctttggaacagggttggcattc

SEQ ID NO: 2859199 - DNA, 18 bp, Homo sapiens
ctttggaagatgcagaag

SEQ ID NO: 2859200 - DNA, 21 bp, Homo sapiens
ctttggaagatgcagaagcaa

SEQ ID NO: 2859201 - DNA, 19 bp, Homo sapiens
ctttgggattctaggaaac

SEQ ID NO: 2859202 - DNA, 19 bp, Homo sapiens
ctttgttttgcacactttg

SEQ ID NO: 2859203 - DNA, 14 bp, Homo sapiens
ctttgttttgcact

SEQ ID NO: 2859204 - DNA, 19 bp, Homo sapiens
cttttgaatgtccaaaatt

SEQ ID NO: 2859205 - DNA, 14 bp, Homo sapiens
cttttggcctcctg

SEQ ID NO: 2859206 - DNA, 15 bp, Homo sapiens
cttttgttcttcccc

SEQ ID NO: 2859207 - DNA, 16 bp, Homo sapiens
ctttttcataattact

SEQ ID NO: 2859208 - DNA, 20 bp, Homo sapiens
ctttttcatagtaagtgcga

SEQ ID NO: 2859209 - DNA, 20 bp, Homo sapiens
gaaaaatgggagccaggagt

SEQ ID NO: 2859210 - DNA, 11 bp, Homo sapiens
gaaaaattaac

SEQ ID NO: 2859211 - DNA, 16 bp, Homo sapiens
gaaaaattaacttttt

SEQ ID NO: 2859212 - DNA, 22 bp, Homo sapiens
gaaaagaatccctgcagcctgg

SEQ ID NO: 2859213 - DNA, 16 bp, Homo sapiens
gaaaatataatgatca

SEQ ID NO: 2859214 - DNA, 18 bp, Homo sapiens
gaaaatggtccaggagaa

SEQ ID NO: 2859215 - DNA, 15 bp, Homo sapiens
gaaaatttgccaatc

SEQ ID NO: 2859216 - DNA, 14 bp, Homo sapiens
gaaacaaacaaaac

SEQ ID NO: 2859217 - DNA, 13 bp, Homo sapiens
gaaacactgactt

SEQ ID NO: 2859218 - DNA, 15 bp, Homo sapiens
gaaacagaagtagaa

SEQ ID NO: 2859219 - DNA, 18 bp, Homo sapiens
gaaacatgggctgtgatt

SEQ ID NO: 2859220 - DNA, 20 bp, Homo sapiens
gaaacattttatcattaaaa

SEQ ID NO: 2859221 - DNA, 17 bp, Homo sapiens
gaaaccttattgtacct

SEQ ID NO: 2859222 - DNA, 19 bp, Homo sapiens
gaaaccttattgtacctct

SEQ ID NO: 2859223 - DNA, 15 bp, Homo sapiens
gaaactgcagggaaa

SEQ ID NO: 2859224 - DNA, 19 bp, Homo sapiens
gaaagctaaagtttggttt

SEQ ID NO: 2859225 - DNA, 13 bp, Homo sapiens
gaaagctggactg

SEQ ID NO: 2859226 - DNA, 15 bp, Homo sapiens
gaaagctggactgac

SEQ ID NO: 2859227 - DNA, 17 bp, Homo sapiens
gaaagtcaaaaaattat

SEQ ID NO: 2859228 - DNA, 21 bp, Homo sapiens
gaaagtcaaaaaattatttgc

SEQ ID NO: 2859229 - DNA, 19 bp, Homo sapiens
gaaatccagtttcccacca

SEQ ID NO: 2859230 - DNA, 20 bp, Homo sapiens
gaaatccagtttcccaccac

SEQ ID NO: 2859231 - DNA, 16 bp, Homo sapiens
gaaatgtacgtcattt

SEQ ID NO: 2859232 - DNA, 20 bp, Homo sapiens
gaacagggacttgtttagag

SEQ ID NO: 2859233 - DNA, 12 bp, Homo sapiens
gaacccccaggt

SEQ ID NO: 2859234 - DNA, 19 bp, Homo sapiens
gaactaccttggttccccc

SEQ ID NO: 2859235 - DNA, 14 bp, Homo sapiens
gaactcactctggg

SEQ ID NO: 2859236 - DNA, 18 bp, Homo sapiens
gaactcactctgggctgt

SEQ ID NO: 2859237 - DNA, 19 bp, Homo sapiens
gaactgggtgactggaggc

SEQ ID NO: 2859238 - DNA, 17 bp, Homo sapiens
gaacttcagcattgtaa

SEQ ID NO: 2859239 - DNA, 21 bp, Homo sapiens
gaacttgttaacctttctaac

SEQ ID NO: 2859240 - DNA, 16 bp, Homo sapiens
gaactttattaagtaa

SEQ ID NO: 2859241 - DNA, 15 bp, Homo sapiens
gaactttgtcagtgt

SEQ ID NO: 2859242 - DNA, 22 bp, Homo sapiens
gaactttgtgcttcaaggacat

SEQ ID NO: 2859243 - DNA, 20 bp, Homo sapiens
gaactttttaaagaagtgca

SEQ ID NO: 2859244 - DNA, 21 bp, Homo sapiens
gaagaaaatttgccaatcttt

SEQ ID NO: 2859245 - DNA, 22 bp, Homo sapiens
gaagaaagtcaaaaaattattt

SEQ ID NO: 2859246 - DNA, 15 bp, Homo sapiens
gaagaaagtggaaaa

SEQ ID NO: 2859247 - DNA, 24 bp, Homo sapiens
gaagaagggggtggggggagtttg

SEQ ID NO: 2859248 - DNA, 11 bp, Homo sapiens
gaagagaccac

SEQ ID NO: 2859249 - DNA, 20 bp, Homo sapiens
gaagaggaggagggattctg

SEQ ID NO: 2859250 - DNA, 14 bp, Homo sapiens
gaagattctttccc

SEQ ID NO: 2859251 - DNA, 17 bp, Homo sapiens
gaagcaataataaagta

SEQ ID NO: 2859252 - DNA, 14 bp, Homo sapiens
gaagccgactctgg

SEQ ID NO: 2859253 - DNA, 16 bp, Homo sapiens
gaagccgactctggcc

SEQ ID NO: 2859254 - DNA, 19 bp, Homo sapiens
gaagccgactctggccctg

SEQ ID NO: 2859255 - DNA, 21 bp, Homo sapiens
gaagctcttttctcctgcaga

SEQ ID NO: 2859256 - DNA, 13 bp, Homo sapiens
gaagctgggggaa

SEQ ID NO: 2859257 - DNA, 22 bp, Homo sapiens
gaaggagccccattcctgggaa

SEQ ID NO: 2859258 - DNA, 20 bp, Homo sapiens
gaaggaggaatgctggactg

SEQ ID NO: 2859259 - DNA, 13 bp, Homo sapiens
gaagggaagtggg

SEQ ID NO: 2859260 - DNA, 16 bp, Homo sapiens
gaagggaagtggggag

SEQ ID NO: 2859261 - DNA, 14 bp, Homo sapiens
gaaggggccagagg

SEQ ID NO: 2859262 - DNA, 13 bp, Homo sapiens
gaagtaggaagta

SEQ ID NO: 2859263 - DNA, 22 bp, Homo sapiens
gaagtgatatggtgaagggaag

SEQ ID NO: 2859264 - DNA, 17 bp, Homo sapiens
gaagtttggagatagat

SEQ ID NO: 2859265 - DNA, 19 bp, Homo sapiens
gaataatatcaaataaaat

SEQ ID NO: 2859266 - DNA, 17 bp, Homo sapiens
gaatactgccaaaacat

SEQ ID NO: 2859267 - DNA, 12 bp, Homo sapiens
gaatatttatta

SEQ ID NO: 2859268 - DNA, 21 bp, Homo sapiens
gaatatttattacctctgata

SEQ ID NO: 2859269 - DNA, 20 bp, Homo sapiens
gaatgcccctgttcatgttt

SEQ ID NO: 2859270 - DNA, 18 bp, Homo sapiens
gaatgctggactggaggc

SEQ ID NO: 2859271 - DNA, 23 bp, Homo sapiens
gaatgctggactggaggcccctg

SEQ ID NO: 2859272 - DNA, 22 bp, Homo sapiens
gaatgtccaaaatttatatttt

SEQ ID NO: 2859273 - DNA, 16 bp, Homo sapiens
gaattgggaagctggg

SEQ ID NO: 2859274 - DNA, 16 bp, Homo sapiens
gaattgtaactgttct

SEQ ID NO: 2859275 - DNA, 15 bp, Homo sapiens
gaatttttaactgta

SEQ ID NO: 2859276 - DNA, 11 bp, Homo sapiens
gacaaaatgga

SEQ ID NO: 2859277 - DNA, 17 bp, Homo sapiens
gacaagaaggccactgg

SEQ ID NO: 2859278 - DNA, 19 bp, Homo sapiens
gacaagggattctgggaag

SEQ ID NO: 2859279 - DNA, 14 bp, Homo sapiens
gacaatgccttggg

SEQ ID NO: 2859280 - DNA, 18 bp, Homo sapiens
gacactcaataaacagtc

SEQ ID NO: 2859281 - DNA, 15 bp, Homo sapiens
gacactcccttgggc

SEQ ID NO: 2859282 - DNA, 13 bp, Homo sapiens
gacagaaagcctc

SEQ ID NO: 2859283 - DNA, 23 bp, Homo sapiens
gacagaaagcctccgctgggctt

SEQ ID NO: 2859284 - DNA, 19 bp, Homo sapiens
gacagaacttcagcattgt

SEQ ID NO: 2859285 - DNA, 17 bp, Homo sapiens
gacagcccagagcctgg

SEQ ID NO: 2859286 - DNA, 19 bp, Homo sapiens
gacaggaggggcccacaat

SEQ ID NO: 2859287 - DNA, 21 bp, Homo sapiens
gacaggaggggcccacaatgg

SEQ ID NO: 2859288 - DNA, 13 bp, Homo sapiens
gacagtttccaaa

SEQ ID NO: 2859289 - DNA, 14 bp, Homo sapiens
gacataagataaaa

SEQ ID NO: 2859290 - DNA, 19 bp, Homo sapiens
gacataagataaaatgatg

SEQ ID NO: 2859291 - DNA, 20 bp, Homo sapiens
gacatgaagattctttccca

SEQ ID NO: 2859292 - DNA, 12 bp, Homo sapiens
gacattcacctg

SEQ ID NO: 2859293 - DNA, 16 bp, Homo sapiens
gaccaaagactgcaga

SEQ ID NO: 2859294 - DNA, 19 bp, Homo sapiens
gaccaaagactgcagaacc

SEQ ID NO: 2859295 - DNA, 18 bp, Homo sapiens
gaccagtcaacctgggca

SEQ ID NO: 2859296 - DNA, 13 bp, Homo sapiens
gaccatctgtgac

SEQ ID NO: 2859297 - DNA, 23 bp, Homo sapiens
gaccatctgtgactataaagctg

SEQ ID NO: 2859298 - DNA, 23 bp, Homo sapiens
gacccagccccttgagaaacctt

SEQ ID NO: 2859299 - DNA, 16 bp, Homo sapiens
gacccagccctcatcc

SEQ ID NO: 2859300 - DNA, 12 bp, Homo sapiens
gaccccagagga

SEQ ID NO: 2859301 - DNA, 16 bp, Homo sapiens
gaccccttcctttcct

SEQ ID NO: 2859302 - DNA, 11 bp, Homo sapiens
gacctacagac

SEQ ID NO: 2859303 - DNA, 22 bp, Homo sapiens
gacctggtgctgcctctacctg

SEQ ID NO: 2859304 - DNA, 18 bp, Homo sapiens
gaccttaatttaactttc

SEQ ID NO: 2859305 - DNA, 18 bp, Homo sapiens
ggactctcagtctctgag

SEQ ID NO: 2859306 - DNA, 18 bp, Homo sapiens
ggactctgctagactcct

SEQ ID NO: 2859307 - DNA, 22 bp, Homo sapiens
ggactgaccaaagactgcagaa

SEQ ID NO: 2859308 - DNA, 14 bp, Homo sapiens
ggacttcctgtcat

SEQ ID NO: 2859309 - DNA, 12 bp, Homo sapiens
ggagaatactgc

SEQ ID NO: 2859310 - DNA, 17 bp, Homo sapiens
ggagaatatttactaac

SEQ ID NO: 2859311 - DNA, 14 bp, Homo sapiens
ggagacagaaagcc

SEQ ID NO: 2859312 - DNA, 18 bp, Homo sapiens
ggagacagaaagcctccg

SEQ ID NO: 2859313 - DNA, 17 bp, Homo sapiens
ggagactgggctgaggg

SEQ ID NO: 2859314 - DNA, 23 bp, Homo sapiens
ggagagacccctcccctcccacc

SEQ ID NO: 2859315 - DNA, 14 bp, Homo sapiens
ggagagagggactc

SEQ ID NO: 2859316 - DNA, 22 bp, Homo sapiens
ggagagccaccaagagggacgc

SEQ ID NO: 2859317 - DNA, 15 bp, Homo sapiens
ggagatgctccttgg

SEQ ID NO: 2859318 - DNA, 20 bp, Homo sapiens
ggagatggaagttgcagtga

SEQ ID NO: 2859319 - DNA, 13 bp, Homo sapiens
ggagattgaactt

SEQ ID NO: 2859320 - DNA, 16 bp, Homo sapiens
ggagccactcctctga

SEQ ID NO: 2859321 - DNA, 17 bp, Homo sapiens
ggagccgggtctgcctc

SEQ ID NO: 2859322 - DNA, 22 bp, Homo sapiens
ggaggaactgggtgactggagg

SEQ ID NO: 2859323 - DNA, 23 bp, Homo sapiens
ggaggaactgggtgactggaggc

SEQ ID NO: 2859324 - DNA, 16 bp, Homo sapiens
ggaggaatgctggact

SEQ ID NO: 2859325 - DNA, 13 bp, Homo sapiens
ggaggcctcgccc

SEQ ID NO: 2859326 - DNA, 17 bp, Homo sapiens
ggaggtccagctgggcc

SEQ ID NO: 2859327 - DNA, 18 bp, Homo sapiens
ggagtatttgaacacagt

SEQ ID NO: 2859328 - DNA, 20 bp, Homo sapiens
ggagttgatcgcctttccca

SEQ ID NO: 2859329 - DNA, 12 bp, Homo sapiens
ggataagaaagc

SEQ ID NO: 2859330 - DNA, 20 bp, Homo sapiens
ggatccagagacttggggac

SEQ ID NO: 2859331 - DNA, 17 bp, Homo sapiens
ggatgccaaggagcccc

SEQ ID NO: 2859332 - DNA, 13 bp, Homo sapiens
ggattgagtctgt

SEQ ID NO: 2859333 - DNA, 16 bp, Homo sapiens
ggcaagagaaaataaa

SEQ ID NO: 2859334 - DNA, 13 bp, Homo sapiens
ggcactgggctgt

SEQ ID NO: 2859335 - DNA, 21 bp, Homo sapiens
ggcagaagcattgcctggact

SEQ ID NO: 2859336 - DNA, 17 bp, Homo sapiens
ggcagaaggcaaaccca

SEQ ID NO: 2859337 - DNA, 20 bp, Homo sapiens
ggcagagcaattccaggctg

SEQ ID NO: 2859338 - DNA, 21 bp, Homo sapiens
ggcagagcaattccaggctga

SEQ ID NO: 2859339 - DNA, 16 bp, Homo sapiens
ggcagagcccaaggga

SEQ ID NO: 2859340 - DNA, 21 bp, Homo sapiens
ggcagcagggctaccctgagc

SEQ ID NO: 2859341 - DNA, 19 bp, Homo sapiens
ggcagcagtgtgaggccag

SEQ ID NO: 2859342 - DNA, 22 bp, Homo sapiens
ggcagctaagatagaaagctgg

SEQ ID NO: 2859343 - DNA, 16 bp, Homo sapiens
ggcagggccccaggca

SEQ ID NO: 2859344 - DNA, 15 bp, Homo sapiens
ggcaggggtgggaga

SEQ ID NO: 2859345 - DNA, 18 bp, Homo sapiens
ggccaagatggctgctgc

SEQ ID NO: 2859346 - DNA, 18 bp, Homo sapiens
ggccacatgggaggctca

SEQ ID NO: 2859347 - DNA, 16 bp, Homo sapiens
ggccactctcccctcc

SEQ ID NO: 2859348 - DNA, 19 bp, Homo sapiens
ggccactctcccctccctc

SEQ ID NO: 2859349 - DNA, 17 bp, Homo sapiens
ggccagcaacgcttgta

SEQ ID NO: 2859350 - DNA, 19 bp, Homo sapiens
ggccaggcaggggtgggag

SEQ ID NO: 2859351 - DNA, 22 bp, Homo sapiens
ggcccacgccctccctctccca

SEQ ID NO: 2859352 - DNA, 18 bp, Homo sapiens
ggcccagagaccccttcc

SEQ ID NO: 2859353 - DNA, 23 bp, Homo sapiens
ggcccagagaccccttcctttcc

SEQ ID NO: 2859354 - DNA, 13 bp, Homo sapiens
ggcccctggagcc

SEQ ID NO: 2859355 - DNA, 21 bp, Homo sapiens
ggccctcgctgccagctctgt

SEQ ID NO: 2859356 - DNA, 23 bp, Homo sapiens
ggccctcgctgccagctctgtat

SEQ ID NO: 2859357 - DNA, 21 bp, Homo sapiens
ggccctctctgctctgcgtgt

SEQ ID NO: 2859358 - DNA, 22 bp, Homo sapiens
ggccctgcaaaaggactctcag

SEQ ID NO: 2859359 - DNA, 20 bp, Homo sapiens
ggcccttacttgcttctcta

SEQ ID NO: 2859360 - DNA, 22 bp, Homo sapiens
ggccgtggccatcagggtgggc

SEQ ID NO: 2859361 - DNA, 24 bp, Homo sapiens
ggcctcctgcctccgggcaggcaa

SEQ ID NO: 2859362 - DNA, 16 bp, Homo sapiens
ggcctgaccagggggc

SEQ ID NO: 2859363 - DNA, 17 bp, Homo sapiens
ggcctgaccagggggcc

SEQ ID NO: 2859364 - DNA, 22 bp, Homo sapiens
ggctgaatgtatgtcagtgcta

SEQ ID NO: 2859365 - DNA, 12 bp, Homo sapiens
ggctgagccatg

SEQ ID NO: 2859366 - DNA, 23 bp, Homo sapiens
ggctgagccatgaggagcgtgga

SEQ ID NO: 2859367 - DNA, 16 bp, Homo sapiens
ggctgatgaagaaggg

SEQ ID NO: 2859368 - DNA, 17 bp, Homo sapiens
ggctgatgaagaagggg

SEQ ID NO: 2859369 - DNA, 16 bp, Homo sapiens
ggctgcacctctggct

SEQ ID NO: 2859370 - DNA, 22 bp, Homo sapiens
ggctgcacctctggctagagcc

SEQ ID NO: 2859371 - DNA, 17 bp, Homo sapiens
gggaaaattatttgcat

SEQ ID NO: 2859372 - DNA, 22 bp, Homo sapiens
gggaaacaaataatttgaactt

SEQ ID NO: 2859373 - DNA, 23 bp, Homo sapiens
gggaaacaaataatttgaacttt

SEQ ID NO: 2859374 - DNA, 22 bp, Homo sapiens
gggacgcctgggggtgccagga

SEQ ID NO: 2859375 - DNA, 18 bp, Homo sapiens
gggacttgtttagagagc

SEQ ID NO: 2859376 - DNA, 14 bp, Homo sapiens
gggagactgggctg

SEQ ID NO: 2859377 - DNA, 16 bp, Homo sapiens
gggagactgggctgag

SEQ ID NO: 2859378 - DNA, 20 bp, Homo sapiens
gggagactgggctgagggag

SEQ ID NO: 2859379 - DNA, 17 bp, Homo sapiens
gggatggtggagggcca

SEQ ID NO: 2859380 - DNA, 14 bp, Homo sapiens
gggcaaagcctagt

SEQ ID NO: 2859381 - DNA, 14 bp, Homo sapiens
gggcagcagggcta

SEQ ID NO: 2859382 - DNA, 19 bp, Homo sapiens
gggccacatgggaggctca

SEQ ID NO: 2859383 - DNA, 17 bp, Homo sapiens
gggccactctcccctcc

SEQ ID NO: 2859384 - DNA, 17 bp, Homo sapiens
gggccctttgagtgcag

SEQ ID NO: 2859385 - DNA, 13 bp, Homo sapiens
gggcctcctgcct

SEQ ID NO: 2859386 - DNA, 20 bp, Homo sapiens
gggcctcctgcctccgggca

SEQ ID NO: 2859387 - DNA, 22 bp, Homo sapiens
gggctaccctgagctgaggcag

SEQ ID NO: 2859388 - DNA, 22 bp, Homo sapiens
gggctatcaacttaataagata

SEQ ID NO: 2859389 - DNA, 12 bp, Homo sapiens
gggctccctgac

SEQ ID NO: 2859390 - DNA, 21 bp, Homo sapiens
gggctccctgtaacctcttca

SEQ ID NO: 2859391 - DNA, 23 bp, Homo sapiens
gggctgaatgtatgtcagtgcta

SEQ ID NO: 2859392 - DNA, 13 bp, Homo sapiens
gggctgagggagc

SEQ ID NO: 2859393 - DNA, 24 bp, Homo sapiens
gggcttcattccggactggcagaa

SEQ ID NO: 2859394 - DNA, 22 bp, Homo sapiens
ggggagaagtgatatggtgaag

SEQ ID NO: 2859395 - DNA, 17 bp, Homo sapiens
ggggagactgggctgag

SEQ ID NO: 2859396 - DNA, 18 bp, Homo sapiens
ggggattggagggaagac

SEQ ID NO: 2859397 - DNA, 14 bp, Homo sapiens
ggggcccgaacagg

SEQ ID NO: 2859398 - DNA, 23 bp, Homo sapiens
ggggccttagggcactgggctgt

SEQ ID NO: 2859399 - DNA, 23 bp, Homo sapiens
ggggcttgcccactgcctgcctc

SEQ ID NO: 2859400 - DNA, 20 bp, Homo sapiens
ggggttccttccacttctgg

SEQ ID NO: 2859401 - DNA, 19 bp, Homo sapiens
gggtcaagaaacagccagc

SEQ ID NO: 2859402 - DNA, 23 bp, Homo sapiens
gggtctaccaatacaaaatgtat

SEQ ID NO: 2859403 - DNA, 22 bp, Homo sapiens
gggtggttattggactccaggc

SEQ ID NO: 2859404 - DNA, 22 bp, Homo sapiens
gggtgtggtatgagggggtggt

SEQ ID NO: 2859405 - DNA, 23 bp, Homo sapiens
ggtagaattgggaagctggggga

SEQ ID NO: 2859406 - DNA, 15 bp, Homo sapiens
ggtaggttgggacac

SEQ ID NO: 2859407 - DNA, 17 bp, Homo sapiens
ggtaggttgggacacca

SEQ ID NO: 2859408 - DNA, 19 bp, Homo sapiens
ggtcaagaaacagccagca

SEQ ID NO: 2859409 - DNA, 15 bp, Homo sapiens
ggtccagctgggcct

SEQ ID NO: 2859410 - DNA, 22 bp, Homo sapiens
ggtccagctgggcctcctgcct

SEQ ID NO: 2859411 - DNA, 17 bp, Homo sapiens
ggtccagtcgggaggag

SEQ ID NO: 2859412 - DNA, 19 bp, Homo sapiens
ggtccagtcgggaggagca

SEQ ID NO: 2859413 - DNA, 13 bp, Homo sapiens
tatactctcccag

SEQ ID NO: 2859414 - DNA, 14 bp, Homo sapiens
tatactctcccaga

SEQ ID NO: 2859415 - DNA, 21 bp, Homo sapiens
tatagaatatttattacctct

SEQ ID NO: 2859416 - DNA, 14 bp, Homo sapiens
tatatattaagtgt

SEQ ID NO: 2859417 - DNA, 20 bp, Homo sapiens
tatatcattatctttgctgt

SEQ ID NO: 2859418 - DNA, 12 bp, Homo sapiens
tatatgactgca

SEQ ID NO: 2859419 - DNA, 20 bp, Homo sapiens
tatattaagtgtgccaaatc

SEQ ID NO: 2859420 - DNA, 18 bp, Homo sapiens
tatattacccaatggaaa

SEQ ID NO: 2859421 - DNA, 14 bp, Homo sapiens
tatatttcaataaa

SEQ ID NO: 2859422 - DNA, 15 bp, Homo sapiens
tatatttcaataaat

SEQ ID NO: 2859423 - DNA, 17 bp, Homo sapiens
tatatttttttaactgt

SEQ ID NO: 2859424 - DNA, 21 bp, Homo sapiens
tatatttttttaactgtgata

SEQ ID NO: 2859425 - DNA, 14 bp, Homo sapiens
tatcaaataaaata

SEQ ID NO: 2859426 - DNA, 17 bp, Homo sapiens
tatcaaataaaatatca

SEQ ID NO: 2859427 - DNA, 19 bp, Homo sapiens
tatcaccgtgggctccctg

SEQ ID NO: 2859428 - DNA, 23 bp, Homo sapiens
tatcaccgtgggctccctgactg

SEQ ID NO: 2859429 - DNA, 23 bp, Homo sapiens
tatcactgccttcgtttatattt

SEQ ID NO: 2859430 - DNA, 18 bp, Homo sapiens
tatcatgcccctgtactc

SEQ ID NO: 2859431 - DNA, 12 bp, Homo sapiens
tatccaaggaaa

SEQ ID NO: 2859432 - DNA, 23 bp, Homo sapiens
tatccaaggaaacattttatcat

SEQ ID NO: 2859433 - DNA, 15 bp, Homo sapiens
tatccacactgtcaa

SEQ ID NO: 2859434 - DNA, 16 bp, Homo sapiens
tatccacactgtcaaa

SEQ ID NO: 2859435 - DNA, 18 bp, Homo sapiens
tatccacactgtcaaaca

SEQ ID NO: 2859436 - DNA, 17 bp, Homo sapiens
tatcggcagatgatgct

SEQ ID NO: 2859437 - DNA, 23 bp, Homo sapiens
tatcggcagatgatgctttggaa

SEQ ID NO: 2859438 - DNA, 15 bp, Homo sapiens
tatcttgtctctggg

SEQ ID NO: 2859439 - DNA, 18 bp, Homo sapiens
tatcttttttagtgttaa

SEQ ID NO: 2859440 - DNA, 20 bp, Homo sapiens
tatgaaaagtactaatagaa

SEQ ID NO: 2859441 - DNA, 13 bp, Homo sapiens
tatgaatctataa

SEQ ID NO: 2859442 - DNA, 22 bp, Homo sapiens
tatgacaagctgtatcactgcc

SEQ ID NO: 2859443 - DNA, 23 bp, Homo sapiens
tatgacaagctgtatcactgcct

SEQ ID NO: 2859444 - DNA, 20 bp, Homo sapiens
tatgcacttataattttcct

SEQ ID NO: 2859445 - DNA, 13 bp, Homo sapiens
tatgcacttttag

SEQ ID NO: 2859446 - DNA, 23 bp, Homo sapiens
tatgcacttttagaaatgcatat

SEQ ID NO: 2859447 - DNA, 22 bp, Homo sapiens
tatgcatttaaatacagtcttc

SEQ ID NO: 2859448 - DNA, 17 bp, Homo sapiens
tatggcaggataagaaa

SEQ ID NO: 2859449 - DNA, 15 bp, Homo sapiens
tatggcttatttcta

SEQ ID NO: 2859450 - DNA, 19 bp, Homo sapiens
tatgggggagattgaactt

SEQ ID NO: 2859451 - DNA, 17 bp, Homo sapiens
tatggtgaagggaagtg

SEQ ID NO: 2859452 - DNA, 15 bp, Homo sapiens
tatgtaaataactct

SEQ ID NO: 2859453 - DNA, 16 bp, Homo sapiens
tatgtaaataactcta

SEQ ID NO: 2859454 - DNA, 14 bp, Homo sapiens
tatgtaatttcaaa

SEQ ID NO: 2859455 - DNA, 15 bp, Homo sapiens
tatgtagcaaaatac

SEQ ID NO: 2859456 - DNA, 18 bp, Homo sapiens
tatgtattttttgaatct

SEQ ID NO: 2859457 - DNA, 21 bp, Homo sapiens
tatgtgaaaaattaacttttt

SEQ ID NO: 2859458 - DNA, 19 bp, Homo sapiens
tatgttcctaacaaaatga

SEQ ID NO: 2859459 - DNA, 16 bp, Homo sapiens
tatgtttaaaagaaat

SEQ ID NO: 2859460 - DNA, 19 bp, Homo sapiens
tatgtttaaaagaaatata

SEQ ID NO: 2859461 - DNA, 15 bp, Homo sapiens
tatgtttttgttcaa

SEQ ID NO: 2859462 - DNA, 15 bp, Homo sapiens
tattaaataacatgt

SEQ ID NO: 2859463 - DNA, 22 bp, Homo sapiens
tattacccaatggaaaatataa

SEQ ID NO: 2859464 - DNA, 11 bp, Homo sapiens
tattacctctg

SEQ ID NO: 2859465 - DNA, 19 bp, Homo sapiens
tattacctctgatacctca

SEQ ID NO: 2859466 - DNA, 19 bp, Homo sapiens
tattactgaataatatcaa

SEQ ID NO: 2859467 - DNA, 22 bp, Homo sapiens
tattactgaataatatcaaata

SEQ ID NO: 2859468 - DNA, 18 bp, Homo sapiens
tattagagtgtctttcca

SEQ ID NO: 2859469 - DNA, 15 bp, Homo sapiens
tattcaattcctctg

SEQ ID NO: 2859470 - DNA, 21 bp, Homo sapiens
tattccctagaaacttccaaa

SEQ ID NO: 2859471 - DNA, 11 bp, Homo sapiens
tattgcaatgc

SEQ ID NO: 2859472 - DNA, 13 bp, Homo sapiens
tattgcaatgcag

SEQ ID NO: 2859473 - DNA, 19 bp, Homo sapiens
tattgctgtgagccttgca

SEQ ID NO: 2859474 - DNA, 19 bp, Homo sapiens
tattgtaatctatgtttat

SEQ ID NO: 2859475 - DNA, 12 bp, Homo sapiens
tattgtttcaat

SEQ ID NO: 2859476 - DNA, 13 bp, Homo sapiens
tatttactaacta

SEQ ID NO: 2859477 - DNA, 19 bp, Homo sapiens
tatttactgagcttctctg

SEQ ID NO: 2859478 - DNA, 22 bp, Homo sapiens
tatttactgagcttctctgtga

SEQ ID NO: 2859479 - DNA, 15 bp, Homo sapiens
tatttattacctctg

SEQ ID NO: 2859480 - DNA, 14 bp, Homo sapiens
tatttcaaattgga

SEQ ID NO: 2859481 - DNA, 18 bp, Homo sapiens
tatttcaaattggagctt

SEQ ID NO: 2859482 - DNA, 15 bp, Homo sapiens
tatttcaataaatga

SEQ ID NO: 2859483 - DNA, 12 bp, Homo sapiens
tatttctatata

SEQ ID NO: 2859484 - DNA, 15 bp, Homo sapiens
tatttgatttctaat

SEQ ID NO: 2859485 - DNA, 20 bp, Homo sapiens
tatttgtatgtttttctgta

SEQ ID NO: 2859486 - DNA, 11 bp, Homo sapiens
tatttgtgact

SEQ ID NO: 2859487 - DNA, 18 bp, Homo sapiens
tattttaaaatctgtcac

SEQ ID NO: 2859488 - DNA, 13 bp, Homo sapiens
tattttcaccatt

SEQ ID NO: 2859489 - DNA, 19 bp, Homo sapiens
tattttttgaatctatgaa

SEQ ID NO: 2859490 - DNA, 16 bp, Homo sapiens
tatttttttaactgtg

SEQ ID NO: 2859491 - DNA, 17 bp, Homo sapiens
tatttttttaactgtga

SEQ ID NO: 2859492 - DNA, 19 bp, Homo sapiens
tatttttttaactgtgata

SEQ ID NO: 2859493 - DNA, 12 bp, Homo sapiens
tcaaaaaattat

SEQ ID NO: 2859494 - DNA, 19 bp, Homo sapiens
tcaaaaaattatttgctat

SEQ ID NO: 2859495 - DNA, 14 bp, Homo sapiens
tcaaagatttttat

SEQ ID NO: 2859496 - DNA, 15 bp, Homo sapiens
tcaaagcaaggaaac

SEQ ID NO: 2859497 - DNA, 16 bp, Homo sapiens
tcaaagcaaggaaact

SEQ ID NO: 2859498 - DNA, 12 bp, Homo sapiens
tcaaagccagcg

SEQ ID NO: 2859499 - DNA, 22 bp, Homo sapiens
tcaaagccagcgtcctcctctg

SEQ ID NO: 2859500 - DNA, 23 bp, Homo sapiens
tcaaagccagcgtcctcctctgt

SEQ ID NO: 2859501 - DNA, 17 bp, Homo sapiens
tcaaagccggcctgaga

SEQ ID NO: 2859502 - DNA, 19 bp, Homo sapiens
tcaaagccggcctgagaaa

SEQ ID NO: 2859503 - DNA, 16 bp, Homo sapiens
tcaaataaaatatcat

SEQ ID NO: 2859504 - DNA, 18 bp, Homo sapiens
tcaaataaaatatcataa

SEQ ID NO: 2859505 - DNA, 19 bp, Homo sapiens
tcaaataaaatatcataaa

SEQ ID NO: 2859506 - DNA, 11 bp, Homo sapiens
tcaaataaact

SEQ ID NO: 2859507 - DNA, 23 bp, Homo sapiens
tcaacccccagctaataaaccag

SEQ ID NO: 2859508 - DNA, 18 bp, Homo sapiens
tcaacctgggcaaagcct

SEQ ID NO: 2859509 - DNA, 19 bp, Homo sapiens
tcaacgcctcactgaaaca

SEQ ID NO: 2859510 - DNA, 12 bp, Homo sapiens
tcaagaaacagc

SEQ ID NO: 2859511 - DNA, 20 bp, Homo sapiens
tcaagaaacagccagcaaga

SEQ ID NO: 2859512 - DNA, 20 bp, Homo sapiens
tcaagaagtaatcagtatgc

SEQ ID NO: 2859513 - DNA, 17 bp, Homo sapiens
tcaataaacaacagctg

SEQ ID NO: 2859514 - DNA, 15 bp, Homo sapiens
tcaataaacagtcac

SEQ ID NO: 2859515 - DNA, 13 bp, Homo sapiens
tcaataaatgata

SEQ ID NO: 2859516 - DNA, 16 bp, Homo sapiens
tcaataaatgatatat

SEQ ID NO: 2859517 - DNA, 15 bp, Homo sapiens
tcaatagcttgtctt

SEQ ID NO: 2859518 - DNA, 12 bp, Homo sapiens
tcaatatttatt

SEQ ID NO: 2859519 - DNA, 13 bp, Homo sapiens
tcaatcatgccct

SEQ ID NO: 2859520 - DNA, 20 bp, Homo sapiens
tcaatccatccatgtacttc

SEQ ID NO: 2859521 - DNA, 17 bp, Homo sapiens
tcaatgtacatagaccc

SEQ ID NO: 2859522 - DNA, 18 bp, Homo sapiens
tcaattagtggtcataaa

SEQ ID NO: 2859523 - DNA, 19 bp, Homo sapiens
tgacccagccccttgagaa

SEQ ID NO: 2859524 - DNA, 21 bp, Homo sapiens
tgacccagccccttgagaaac

SEQ ID NO: 2859525 - DNA, 17 bp, Homo sapiens
tgactacagtcaggaaa

SEQ ID NO: 2859526 - DNA, 18 bp, Homo sapiens
tgactacagtcaggaaag

SEQ ID NO: 2859527 - DNA, 13 bp, Homo sapiens
tgactataaagct

SEQ ID NO: 2859528 - DNA, 19 bp, Homo sapiens
tgactcagggctcctgggt

SEQ ID NO: 2859529 - DNA, 20 bp, Homo sapiens
tgacttaggtttcaggaagt

SEQ ID NO: 2859530 - DNA, 23 bp, Homo sapiens
tgactttttaaacgattagtgat

SEQ ID NO: 2859531 - DNA, 18 bp, Homo sapiens
tgagaaaaactaacttga

SEQ ID NO: 2859532 - DNA, 19 bp, Homo sapiens
tgagaagctgggcatgaac

SEQ ID NO: 2859533 - DNA, 18 bp, Homo sapiens
tgagacatgaagacacca

SEQ ID NO: 2859534 - DNA, 18 bp, Homo sapiens
tgagacccagccctcatc

SEQ ID NO: 2859535 - DNA, 20 bp, Homo sapiens
tgagaggaggacttggttga

SEQ ID NO: 2859536 - DNA, 16 bp, Homo sapiens
tgagattctgaagtat

SEQ ID NO: 2859537 - DNA, 18 bp, Homo sapiens
tgagattctgaagtatga

SEQ ID NO: 2859538 - DNA, 21 bp, Homo sapiens
tgagattctgaagtatgaagt

SEQ ID NO: 2859539 - DNA, 17 bp, Homo sapiens
tgagcatagagaacaaa

SEQ ID NO: 2859540 - DNA, 20 bp, Homo sapiens
tgagcatagagaacaaagta

SEQ ID NO: 2859541 - DNA, 13 bp, Homo sapiens
tgagccatgagga

SEQ ID NO: 2859542 - DNA, 14 bp, Homo sapiens
tgagccatgaggag

SEQ ID NO: 2859543 - DNA, 14 bp, Homo sapiens
tgagcctcccccaa

SEQ ID NO: 2859544 - DNA, 11 bp, Homo sapiens
tgagctgtttt

SEQ ID NO: 2859545 - DNA, 19 bp, Homo sapiens
tgaggagacagaaagcctc

SEQ ID NO: 2859546 - DNA, 21 bp, Homo sapiens
tgaggcagcagtgtgaggcca

SEQ ID NO: 2859547 - DNA, 19 bp, Homo sapiens
tgaggccaagatggctgct

SEQ ID NO: 2859548 - DNA, 23 bp, Homo sapiens
tgaggccaagatggctgctgcct

SEQ ID NO: 2859549 - DNA, 14 bp, Homo sapiens
tgaggctgagaaag

SEQ ID NO: 2859550 - DNA, 14 bp, Homo sapiens
tgagggagcctggc

SEQ ID NO: 2859551 - DNA, 23 bp, Homo sapiens
tgagtcccagagcccgcttttgt

SEQ ID NO: 2859552 - DNA, 17 bp, Homo sapiens
tgagttttgtttcactt

SEQ ID NO: 2859553 - DNA, 22 bp, Homo sapiens
tgatcagagccgtggtcctttg

SEQ ID NO: 2859554 - DNA, 15 bp, Homo sapiens
tgatcgcctttccca

SEQ ID NO: 2859555 - DNA, 14 bp, Homo sapiens
tgatgaagaagggg

SEQ ID NO: 2859556 - DNA, 23 bp, Homo sapiens
tgatgcatgcactgttccccctg

SEQ ID NO: 2859557 - DNA, 19 bp, Homo sapiens
tgatgctttggaagatgca

SEQ ID NO: 2859558 - DNA, 23 bp, Homo sapiens
tgatgctttggaagatgcagaag

SEQ ID NO: 2859559 - DNA, 23 bp, Homo sapiens
tgatgttatacatcaatatgtat

SEQ ID NO: 2859560 - DNA, 15 bp, Homo sapiens
tgatgtttaaagaga

SEQ ID NO: 2859561 - DNA, 18 bp, Homo sapiens
tgattactgcaatcactg

SEQ ID NO: 2859562 - DNA, 18 bp, Homo sapiens
tgattatagcaactaatg

SEQ ID NO: 2859563 - DNA, 21 bp, Homo sapiens
tgattatagcaactaatgttt

SEQ ID NO: 2859564 - DNA, 14 bp, Homo sapiens
tgattattcagtgt

SEQ ID NO: 2859565 - DNA, 15 bp, Homo sapiens
tgattcaagaaacag

SEQ ID NO: 2859566 - DNA, 24 bp, Homo sapiens
tgattcagtgttaaatgtgatgaa

SEQ ID NO: 2859567 - DNA, 22 bp, Homo sapiens
tgatttccctccagagaaagca

SEQ ID NO: 2859568 - DNA, 14 bp, Homo sapiens
tgatttctaattgt

SEQ ID NO: 2859569 - DNA, 15 bp, Homo sapiens
tgcaaagtctccaga

SEQ ID NO: 2859570 - DNA, 22 bp, Homo sapiens
tgcaaagtctccagaagaaaat

SEQ ID NO: 2859571 - DNA, 14 bp, Homo sapiens
tgcaacctcgctgg

SEQ ID NO: 2859572 - DNA, 21 bp, Homo sapiens
tgcaagaccgtttgtccactt

SEQ ID NO: 2859573 - DNA, 21 bp, Homo sapiens
tgcaagccccaactttcttat

SEQ ID NO: 2859574 - DNA, 14 bp, Homo sapiens
tgcaatcactgtgc

SEQ ID NO: 2859575 - DNA, 17 bp, Homo sapiens
tgcaatcactgtgctat

SEQ ID NO: 2859576 - DNA, 15 bp, Homo sapiens
tgcaatgcagaggtt

SEQ ID NO: 2859577 - DNA, 15 bp, Homo sapiens
tgcaattcagtgttc

SEQ ID NO: 2859578 - DNA, 22 bp, Homo sapiens
tgcacactttgccatattttca

SEQ ID NO: 2859579 - DNA, 22 bp, Homo sapiens
tgcacagggtgtggtatgaggg

SEQ ID NO: 2859580 - DNA, 20 bp, Homo sapiens
tgcacatacgggctttaata

SEQ ID NO: 2859581 - DNA, 16 bp, Homo sapiens
tgcacatctgtgtctt

SEQ ID NO: 2859582 - DNA, 14 bp, Homo sapiens
tgcaccaagcagga

SEQ ID NO: 2859583 - DNA, 23 bp, Homo sapiens
tgcaccagggttgaccccagagg

SEQ ID NO: 2859584 - DNA, 13 bp, Homo sapiens
tgcacctctggct

SEQ ID NO: 2859585 - DNA, 19 bp, Homo sapiens
tgcacctctggctagagcc

SEQ ID NO: 2859586 - DNA, 21 bp, Homo sapiens
tgcacctctggctagagccga

SEQ ID NO: 2859587 - DNA, 22 bp, Homo sapiens
tgcacctctggctagagccgag

SEQ ID NO: 2859588 - DNA, 23 bp, Homo sapiens
tgcacctctggctagagccgagg

SEQ ID NO: 2859589 - DNA, 23 bp, Homo sapiens
tgcactgttccccctgtgcagcc

SEQ ID NO: 2859590 - DNA, 20 bp, Homo sapiens
tgcagaaagggccacccatg

SEQ ID NO: 2859591 - DNA, 15 bp, Homo sapiens
tgcagaacccccagg

SEQ ID NO: 2859592 - DNA, 20 bp, Homo sapiens
tgcagaacccccaggtggcc

SEQ ID NO: 2859593 - DNA, 21 bp, Homo sapiens
tgcagaacccccaggtggcct

SEQ ID NO: 2859594 - DNA, 21 bp, Homo sapiens
tgcagaagcaataataaagta

SEQ ID NO: 2859595 - DNA, 22 bp, Homo sapiens
tgcagcaaacactccaccctcc

SEQ ID NO: 2859596 - DNA, 19 bp, Homo sapiens
tgcagcacctccaggcctg

SEQ ID NO: 2859597 - DNA, 19 bp, Homo sapiens
tgcagcactttaaccctct

SEQ ID NO: 2859598 - DNA, 20 bp, Homo sapiens
tgcagcactttaaccctctc

SEQ ID NO: 2859599 - DNA, 12 bp, Homo sapiens
tgcagcctgctc

SEQ ID NO: 2859600 - DNA, 15 bp, Homo sapiens
tgcagcctggtagaa

SEQ ID NO: 2859601 - DNA, 15 bp, Homo sapiens
tgcagcggcagagca

SEQ ID NO: 2859602 - DNA, 19 bp, Homo sapiens
tgcaggctgcacctctggc

SEQ ID NO: 2859603 - DNA, 15 bp, Homo sapiens
tgcagggaaaattat

SEQ ID NO: 2859604 - DNA, 22 bp, Homo sapiens
tgcagggaaaattatttgcata

SEQ ID NO: 2859605 - DNA, 22 bp, Homo sapiens
tgcagtcctgatcagagccgtg

SEQ ID NO: 2859606 - DNA, 23 bp, Homo sapiens
tgcatatttgccacaaaacctgt

SEQ ID NO: 2859607 - DNA, 15 bp, Homo sapiens
tgcatgaaaaaccat

SEQ ID NO: 2859608 - DNA, 17 bp, Homo sapiens
tgcattttgatattgct

SEQ ID NO: 2859609 - DNA, 13 bp, Homo sapiens
tgccacagcctcc

SEQ ID NO: 2859610 - DNA, 12 bp, Homo sapiens
tgccagagccaa

SEQ ID NO: 2859611 - DNA, 15 bp, Homo sapiens
tgccagagccaacct

SEQ ID NO: 2859612 - DNA, 16 bp, Homo sapiens
tgccagagccaacctg

SEQ ID NO: 2859613 - DNA, 18 bp, Homo sapiens
tgccagagccaacctgga

SEQ ID NO: 2859614 - DNA, 20 bp, Homo sapiens
tgccagagccaacctggact

SEQ ID NO: 2859615 - DNA, 22 bp, Homo sapiens
tgccagctctgtatcaggaccc

SEQ ID NO: 2859616 - DNA, 11 bp, Homo sapiens
tgccagggcag

SEQ ID NO: 2859617 - DNA, 21 bp, Homo sapiens
tgcccagaggactcccaaccc

SEQ ID NO: 2859618 - DNA, 13 bp, Homo sapiens
tgcccctgttcat

SEQ ID NO: 2859619 - DNA, 17 bp, Homo sapiens
tgcctcaagaacacctt

SEQ ID NO: 2859620 - DNA, 16 bp, Homo sapiens
tgcctccgggcaggca

SEQ ID NO: 2859621 - DNA, 15 bp, Homo sapiens
tgcctctacctgaca

SEQ ID NO: 2859622 - DNA, 23 bp, Homo sapiens
tgcctctacctgacactcccttg

SEQ ID NO: 2859623 - DNA, 23 bp, Homo sapiens
tgccttattagagtgtctttcca

SEQ ID NO: 2859624 - DNA, 17 bp, Homo sapiens
tgccttcctcctgggcc

SEQ ID NO: 2859625 - DNA, 20 bp, Homo sapiens
tgccttcctcctgggccctc

SEQ ID NO: 2859626 - DNA, 16 bp, Homo sapiens
tgccttcgtttatatt

SEQ ID NO: 2859627 - DNA, 13 bp, Homo sapiens
tgctaaatgtgta

SEQ ID NO: 2859628 - DNA, 15 bp, Homo sapiens
tgctaaatgtgtaat

SEQ ID NO: 2859629 - DNA, 15 bp, Homo sapiens
tgctagactcctcag

SEQ ID NO: 2859630 - DNA, 22 bp, Homo sapiens
tgctagactcctcaggagagac

SEQ ID NO: 2859631 - DNA, 19 bp, Homo sapiens
tgctatcttttttagtgtt

SEQ ID NO: 2859632 - DNA, 20 bp, Homo sapiens
ttgaaccttaaaaggtactg

SEQ ID NO: 2859633 - DNA, 18 bp, Homo sapiens
ttgaagccgactctggcc

SEQ ID NO: 2859634 - DNA, 13 bp, Homo sapiens
ttgaatgtccaaa

SEQ ID NO: 2859635 - DNA, 17 bp, Homo sapiens
ttgaatgtccaaaattt

SEQ ID NO: 2859636 - DNA, 14 bp, Homo sapiens
ttgacatttatatt

SEQ ID NO: 2859637 - DNA, 17 bp, Homo sapiens
ttgacatttatattaaa

SEQ ID NO: 2859638 - DNA, 24 bp, Homo sapiens
ttgacatttatattaaataacatg

SEQ ID NO: 2859639 - DNA, 10 bp, Homo sapiens
ttgagaaacc

SEQ ID NO: 2859640 - DNA, 23 bp, Homo sapiens
ttgagaaaccttattgtacctct

SEQ ID NO: 2859641 - DNA, 13 bp, Homo sapiens
ttgagcctccccc

SEQ ID NO: 2859642 - DNA, 14 bp, Homo sapiens
ttgagtgctctgat

SEQ ID NO: 2859643 - DNA, 17 bp, Homo sapiens
ttgagtgttttaagata

SEQ ID NO: 2859644 - DNA, 19 bp, Homo sapiens
ttgagttttcagtggggca

SEQ ID NO: 2859645 - DNA, 19 bp, Homo sapiens
ttgatcgcctttcccaggt

SEQ ID NO: 2859646 - DNA, 22 bp, Homo sapiens
ttgcaagggaaaagtctcttgt

SEQ ID NO: 2859647 - DNA, 13 bp, Homo sapiens
ttgcacctgtccc

SEQ ID NO: 2859648 - DNA, 22 bp, Homo sapiens
ttgcagcctgctctagtgggac

SEQ ID NO: 2859649 - DNA, 13 bp, Homo sapiens
ttgcctggactga

SEQ ID NO: 2859650 - DNA, 14 bp, Homo sapiens
ttgcctggactgac

SEQ ID NO: 2859651 - DNA, 19 bp, Homo sapiens
ttgcgaccttaatttaact

SEQ ID NO: 2859652 - DNA, 10 bp, Homo sapiens
ttgctgctgt

SEQ ID NO: 2859653 - DNA, 16 bp, Homo sapiens
ttggaagatgcagaag

SEQ ID NO: 2859654 - DNA, 17 bp, Homo sapiens
ttggaagatgcagaagc

SEQ ID NO: 2859655 - DNA, 13 bp, Homo sapiens
ttggacaaaatgg

SEQ ID NO: 2859656 - DNA, 13 bp, Homo sapiens
ttggactcctccc

SEQ ID NO: 2859657 - DNA, 18 bp, Homo sapiens
ttggagaatactgccaaa

SEQ ID NO: 2859658 - DNA, 14 bp, Homo sapiens
ttggagcttcatgg

SEQ ID NO: 2859659 - DNA, 22 bp, Homo sapiens
ttggagtgttccccttccactg

SEQ ID NO: 2859660 - DNA, 15 bp, Homo sapiens
ttggcattctttgca

SEQ ID NO: 2859661 - DNA, 16 bp, Homo sapiens
ttggcctcctgcaaag

SEQ ID NO: 2859662 - DNA, 13 bp, Homo sapiens
ttggggaccagag

SEQ ID NO: 2859663 - DNA, 23 bp, Homo sapiens
ttggggtcaagaaacagccagca

SEQ ID NO: 2859664 - DNA, 21 bp, Homo sapiens
ttgggtcatttagaagcctga

SEQ ID NO: 2859665 - DNA, 13 bp, Homo sapiens
ttggtgctttgca

SEQ ID NO: 2859666 - DNA, 19 bp, Homo sapiens
ttggttctaatagaactca

SEQ ID NO: 2859667 - DNA, 18 bp, Homo sapiens
ttgtatatgactgcattt

SEQ ID NO: 2859668 - DNA, 18 bp, Homo sapiens
ttgtatgtttttctgtat

SEQ ID NO: 2859669 - DNA, 15 bp, Homo sapiens
ttgtattgtttcaat

SEQ ID NO: 2859670 - DNA, 22 bp, Homo sapiens
ttgtcagcatctgaccatctgt

SEQ ID NO: 2859671 - DNA, 13 bp, Homo sapiens
ttgtccaggaagt

SEQ ID NO: 2859672 - DNA, 13 bp, Homo sapiens
ttgtccattgtcc

SEQ ID NO: 2859673 - DNA, 20 bp, Homo sapiens
ttgtccctctcactccccag

SEQ ID NO: 2859674 - DNA, 12 bp, Homo sapiens
ttgtctctgggc

SEQ ID NO: 2859675 - DNA, 14 bp, Homo sapiens
ttgtgactttttaa

SEQ ID NO: 2859676 - DNA, 21 bp, Homo sapiens
ttgtgttcagctctttccaaa

SEQ ID NO: 2859677 - DNA, 13 bp, Homo sapiens
ttgtgtttctaga

SEQ ID NO: 2859678 - DNA, 20 bp, Homo sapiens
ttgttgggcttgggggaaaa

SEQ ID NO: 2859679 - DNA, 15 bp, Homo sapiens
ttgttgttgctgctg

SEQ ID NO: 2859680 - DNA, 16 bp, Homo sapiens
ttgttgttgctgctgt

SEQ ID NO: 2859681 - DNA, 16 bp, Homo sapiens
ttgtttaatagatttg

SEQ ID NO: 2859682 - DNA, 16 bp, Homo sapiens
ttgtttcaattgcatc

SEQ ID NO: 2859683 - DNA, 14 bp, Homo sapiens
ttgtttgtcagcat

SEQ ID NO: 2859684 - DNA, 15 bp, Homo sapiens
tttaaaacgtgtaaa

SEQ ID NO: 2859685 - DNA, 13 bp, Homo sapiens
tttaaagaaattt

SEQ ID NO: 2859686 - DNA, 20 bp, Homo sapiens
tttaaatacagtcttccatt

SEQ ID NO: 2859687 - DNA, 18 bp, Homo sapiens
tttaaccctctcttccct

SEQ ID NO: 2859688 - DNA, 17 bp, Homo sapiens
tttaattttaatgctgt

SEQ ID NO: 2859689 - DNA, 19 bp, Homo sapiens
tttacactgcggaagccaa

SEQ ID NO: 2859690 - DNA, 23 bp, Homo sapiens
tttactagggatccctcatctgt

SEQ ID NO: 2859691 - DNA, 14 bp, Homo sapiens
tttactgagcttct

SEQ ID NO: 2859692 - DNA, 21 bp, Homo sapiens
tttactgagcttctctgtgaa

SEQ ID NO: 2859693 - DNA, 15 bp, Homo sapiens
tttagaaataataaa

SEQ ID NO: 2859694 - DNA, 14 bp, Homo sapiens
tttagaaatgcata

SEQ ID NO: 2859695 - DNA, 13 bp, Homo sapiens
tttagagagcctg

SEQ ID NO: 2859696 - DNA, 19 bp, Homo sapiens
tttatattaaataacatgt

SEQ ID NO: 2859697 - DNA, 20 bp, Homo sapiens
tttatatttcaataaatgat

SEQ ID NO: 2859698 - DNA, 19 bp, Homo sapiens
tttatatttttttaactgt

SEQ ID NO: 2859699 - DNA, 14 bp, Homo sapiens
tttattacctctga

SEQ ID NO: 2859700 - DNA, 20 bp, Homo sapiens
tttattacctctgatacctc

SEQ ID NO: 2859701 - DNA, 13 bp, Homo sapiens
tttcaaaatacat

SEQ ID NO: 2859702 - DNA, 13 bp, Homo sapiens
tttcaataaatga

SEQ ID NO: 2859703 - DNA, 14 bp, Homo sapiens
tttcaataaatgat

SEQ ID NO: 2859704 - DNA, 20 bp, Homo sapiens
tttcaattgcatctcccaga

SEQ ID NO: 2859705 - DNA, 22 bp, Homo sapiens
tttcaccatttgattatgtagc

SEQ ID NO: 2859706 - DNA, 22 bp, Homo sapiens
tttcacctgtttttaagctgtt

SEQ ID NO: 2859707 - DNA, 23 bp, Homo sapiens
tttcacctgtttttaagctgttt

SEQ ID NO: 2859708 - DNA, 12 bp, Homo sapiens
tttcagaaatca

SEQ ID NO: 2859709 - DNA, 21 bp, Homo sapiens
tttcagtggggcagtcattat

SEQ ID NO: 2859710 - DNA, 14 bp, Homo sapiens
tttcataagtattt

SEQ ID NO: 2859711 - DNA, 15 bp, Homo sapiens
tttcataatcagtaa

SEQ ID NO: 2859712 - DNA, 12 bp, Homo sapiens
tttcattatgca

SEQ ID NO: 2859713 - DNA, 23 bp, Homo sapiens
tttccacggagccactcctctga

SEQ ID NO: 2859714 - DNA, 22 bp, Homo sapiens
tttcccaccaccttggactcct

SEQ ID NO: 2859715 - DNA, 14 bp, Homo sapiens
tttcctactttcta

SEQ ID NO: 2859716 - DNA, 15 bp, Homo sapiens
tttcggaaacactga

SEQ ID NO: 2859717 - DNA, 14 bp, Homo sapiens
tttctaaataaaaa

SEQ ID NO: 2859718 - DNA, 17 bp, Homo sapiens
tttctaaataaaaatat

SEQ ID NO: 2859719 - DNA, 22 bp, Homo sapiens
tttctaaccttcacgattaact

SEQ ID NO: 2859720 - DNA, 15 bp, Homo sapiens
tttctaagaaaatgt

SEQ ID NO: 2859721 - DNA, 12 bp, Homo sapiens
tttctaattgta

SEQ ID NO: 2859722 - DNA, 19 bp, Homo sapiens
tttctagctgttgagctgt

SEQ ID NO: 2859723 - DNA, 14 bp, Homo sapiens
tttctcctccatgg

SEQ ID NO: 2859724 - DNA, 13 bp, Homo sapiens
tttctcttccctt

SEQ ID NO: 2859725 - DNA, 19 bp, Homo sapiens
tttctcttcccttcccaga

SEQ ID NO: 2859726 - DNA, 15 bp, Homo sapiens
tttcttgtttgtcag

SEQ ID NO: 2859727 - DNA, 18 bp, Homo sapiens
tttcttgtttgtcagcat

SEQ ID NO: 2859728 - DNA, 23 bp, Homo sapiens
tttgaatgtccaaaatttatatt

SEQ ID NO: 2859729 - DNA, 12 bp, Homo sapiens
tttgatttctaa

SEQ ID NO: 2859730 - DNA, 18 bp, Homo sapiens
tttgatttctaattgtaa

SEQ ID NO: 2859731 - DNA, 14 bp, Homo sapiens
tttgcaacctcgct

SEQ ID NO: 2859732 - DNA, 21 bp, Homo sapiens
tttgcaagggaaaagtctctt

SEQ ID NO: 2859733 - DNA, 15 bp, Homo sapiens
tttgcacctgtcccc

SEQ ID NO: 2859734 - DNA, 22 bp, Homo sapiens
tttgcataacaattcctctact

SEQ ID NO: 2859735 - DNA, 15 bp, Homo sapiens
tttggacaaaatgga

SEQ ID NO: 2859736 - DNA, 13 bp, Homo sapiens
tttggttctaata

SEQ ID NO: 2859737 - DNA, 17 bp, Homo sapiens
tttgtatgtttttctgt

SEQ ID NO: 2859738 - DNA, 14 bp, Homo sapiens
tttgtattctctga

SEQ ID NO: 2859739 - DNA, 21 bp, Homo sapiens
tttgtattgtttcaattgcat

SEQ ID NO: 2859740 - DNA, 16 bp, Homo sapiens
tttgttattttgcaac

SEQ ID NO: 2859741 - DNA, 12 bp, Homo sapiens
tttgttttgcac

SEQ ID NO: 2859742 - DNA, 14 bp, Homo sapiens
tttgttttgcactg

SEQ ID NO: 2859743 - DNA, 22 bp, Homo sapiens
aaacctgactaggttctgtaga

SEQ ID NO: 2859744 - DNA, 23 bp, Homo sapiens
aaacctgatgtcagctgctgttg

SEQ ID NO: 2859745 - DNA, 16 bp, Homo sapiens
aaacgattagtgatgt

SEQ ID NO: 2859746 - DNA, 15 bp, Homo sapiens
aaactatgttcctaa

SEQ ID NO: 2859747 - DNA, 16 bp, Homo sapiens
aaactccctggctgtt

SEQ ID NO: 2859748 - DNA, 20 bp, Homo sapiens
aaactgactttttcccccca

SEQ ID NO: 2859749 - DNA, 23 bp, Homo sapiens
aaactgcatcccacgttctgtta

SEQ ID NO: 2859750 - DNA, 11 bp, Homo sapiens
aaagagaaaga

SEQ ID NO: 2859751 - DNA, 12 bp, Homo sapiens
aaagagaaagag

SEQ ID NO: 2859752 - DNA, 21 bp, Homo sapiens
aaagatacagaactctttcaa

SEQ ID NO: 2859753 - DNA, 13 bp, Homo sapiens
aaagatacttaca

SEQ ID NO: 2859754 - DNA, 20 bp, Homo sapiens
aaagcaaggaaactatgtaa

SEQ ID NO: 2859755 - DNA, 14 bp, Homo sapiens
aaagcaatctttta

SEQ ID NO: 2859756 - DNA, 13 bp, Homo sapiens
aaagctggactga

SEQ ID NO: 2859757 - DNA, 14 bp, Homo sapiens
aaagctggactgac

SEQ ID NO: 2859758 - DNA, 17 bp, Homo sapiens
aaagctggactgaccaa

SEQ ID NO: 2859759 - DNA, 23 bp, Homo sapiens
aaagctgtggccagcttgttatt

SEQ ID NO: 2859760 - DNA, 20 bp, Homo sapiens
aaagctgttattcttgttat

SEQ ID NO: 2859761 - DNA, 17 bp, Homo sapiens
aaaggaatcatttctat

SEQ ID NO: 2859762 - DNA, 13 bp, Homo sapiens
aaaggcaagcttg

SEQ ID NO: 2859763 - DNA, 21 bp, Homo sapiens
aaaggcagctaagatagaaag

SEQ ID NO: 2859764 - DNA, 15 bp, Homo sapiens
aaaggcatgtacaaa

SEQ ID NO: 2859765 - DNA, 12 bp, Homo sapiens
aaaggcttggct

SEQ ID NO: 2859766 - DNA, 15 bp, Homo sapiens
aaagtaacaatctat

SEQ ID NO: 2859767 - DNA, 17 bp, Homo sapiens
aaagtacaaatgaagaa

SEQ ID NO: 2859768 - DNA, 14 bp, Homo sapiens
aaagtactctttaa

SEQ ID NO: 2859769 - DNA, 19 bp, Homo sapiens
aaagtctccagaagaaaat

SEQ ID NO: 2859770 - DNA, 19 bp, Homo sapiens
aaagtggaaaacaaggaag

SEQ ID NO: 2859771 - DNA, 15 bp, Homo sapiens
aaagttctcaatgta

SEQ ID NO: 2859772 - DNA, 14 bp, Homo sapiens
aaagttctgtactc

SEQ ID NO: 2859773 - DNA, 17 bp, Homo sapiens
aaagtttggttttgaca

SEQ ID NO: 2859774 - DNA, 14 bp, Homo sapiens
aaataaaaataaat

SEQ ID NO: 2859775 - DNA, 17 bp, Homo sapiens
aaataaaaatatgtaat

SEQ ID NO: 2859776 - DNA, 20 bp, Homo sapiens
aaataaaatgtttcattatg

SEQ ID NO: 2859777 - DNA, 21 bp, Homo sapiens
aaataacatgtttctctataa

SEQ ID NO: 2859778 - DNA, 14 bp, Homo sapiens
aaataataaaaaga

SEQ ID NO: 2859779 - DNA, 14 bp, Homo sapiens
aaataatttgaact

SEQ ID NO: 2859780 - DNA, 20 bp, Homo sapiens
aaataatttgaactttggaa

SEQ ID NO: 2859781 - DNA, 13 bp, Homo sapiens
aaatacatgacat

SEQ ID NO: 2859782 - DNA, 13 bp, Homo sapiens
aaatagaataatt

SEQ ID NO: 2859783 - DNA, 14 bp, Homo sapiens
aaatagaataattc

SEQ ID NO: 2859784 - DNA, 16 bp, Homo sapiens
aaatagaataattctt

SEQ ID NO: 2859785 - DNA, 21 bp, Homo sapiens
aaatagataagagtagaaact

SEQ ID NO: 2859786 - DNA, 18 bp, Homo sapiens
aaatatacattttctaaa

SEQ ID NO: 2859787 - DNA, 12 bp, Homo sapiens
aaatatgtaatt

SEQ ID NO: 2859788 - DNA, 19 bp, Homo sapiens
aaatatgtaatttcaaaat

SEQ ID NO: 2859789 - DNA, 20 bp, Homo sapiens
aaatatgtaatttcaaaata

SEQ ID NO: 2859790 - DNA, 16 bp, Homo sapiens
aaatcagaaagtaaca

SEQ ID NO: 2859791 - DNA, 18 bp, Homo sapiens
aaatcagaaagtaacaat

SEQ ID NO: 2859792 - DNA, 20 bp, Homo sapiens
aaatccccttcgctgaaatt

SEQ ID NO: 2859793 - DNA, 22 bp, Homo sapiens
aaatcggatctggggctctggg

SEQ ID NO: 2859794 - DNA, 23 bp, Homo sapiens
aaatcggatctggggctctggga

SEQ ID NO: 2859795 - DNA, 11 bp, Homo sapiens
aaatgaacttt

SEQ ID NO: 2859796 - DNA, 16 bp, Homo sapiens
aaatgccagagccaac

SEQ ID NO: 2859797 - DNA, 17 bp, Homo sapiens
aaatgccagagccaacc

SEQ ID NO: 2859798 - DNA, 23 bp, Homo sapiens
aaatgccagagccaacctggact

SEQ ID NO: 2859799 - DNA, 20 bp, Homo sapiens
aaatgctcccacctgaattt

SEQ ID NO: 2859800 - DNA, 23 bp, Homo sapiens
aaatgctcccacctgaatttgta

SEQ ID NO: 2859801 - DNA, 15 bp, Homo sapiens
aaatgggagccagga

SEQ ID NO: 2859802 - DNA, 21 bp, Homo sapiens
aaatggtcctatttttgtgaa

SEQ ID NO: 2859803 - DNA, 23 bp, Homo sapiens
aaatggtcctatttttgtgaaga

SEQ ID NO: 2859804 - DNA, 14 bp, Homo sapiens
aaatgtatcttatt

SEQ ID NO: 2859805 - DNA, 17 bp, Homo sapiens
aaatgtatcttattcac

SEQ ID NO: 2859806 - DNA, 13 bp, Homo sapiens
aaatgtgatgaat

SEQ ID NO: 2859807 - DNA, 23 bp, Homo sapiens
aaatgtggtctgccaatctgtac

SEQ ID NO: 2859808 - DNA, 13 bp, Homo sapiens
aaatgttcacttt

SEQ ID NO: 2859809 - DNA, 16 bp, Homo sapiens
aaatgttcacttttga

SEQ ID NO: 2859810 - DNA, 15 bp, Homo sapiens
aaatgttctttgggg

SEQ ID NO: 2859811 - DNA, 14 bp, Homo sapiens
aaattaaaacaaat

SEQ ID NO: 2859812 - DNA, 15 bp, Homo sapiens
aaattaaaacaaata

SEQ ID NO: 2859813 - DNA, 12 bp, Homo sapiens
aaattaactttt

SEQ ID NO: 2859814 - DNA, 16 bp, Homo sapiens
aaattacctttaattt

SEQ ID NO: 2859815 - DNA, 21 bp, Homo sapiens
aaattatgcaattcagtgttc

SEQ ID NO: 2859816 - DNA, 22 bp, Homo sapiens
aaattatgttactgtatttttc

SEQ ID NO: 2859817 - DNA, 23 bp, Homo sapiens
aaattatgttactgtatttttca

SEQ ID NO: 2859818 - DNA, 21 bp, Homo sapiens
aaattgtcccttaaacaaaaa

SEQ ID NO: 2859819 - DNA, 15 bp, Homo sapiens
aacaaagtactcttt

SEQ ID NO: 2859820 - DNA, 22 bp, Homo sapiens
aacaaatatacattttctaaat

SEQ ID NO: 2859821 - DNA, 17 bp, Homo sapiens
aacaatccttactaagt

SEQ ID NO: 2859822 - DNA, 21 bp, Homo sapiens
aacaatggtgtggtgaatgtg

SEQ ID NO: 2859823 - DNA, 15 bp, Homo sapiens
aacactgtccttccc

SEQ ID NO: 2859824 - DNA, 21 bp, Homo sapiens
aacactgtccttccctgccac

SEQ ID NO: 2859825 - DNA, 22 bp, Homo sapiens
aacactgtccttccctgccact

SEQ ID NO: 2859826 - DNA, 22 bp, Homo sapiens
aacactgtgcacatctgtgtct

SEQ ID NO: 2859827 - DNA, 14 bp, Homo sapiens
aacagaagcttcca

SEQ ID NO: 2859828 - DNA, 23 bp, Homo sapiens
aacagggacttgtttagagagcc

SEQ ID NO: 2859829 - DNA, 23 bp, Homo sapiens
aacaggtttttagtttgttcttc

SEQ ID NO: 2859830 - DNA, 13 bp, Homo sapiens
aacatccaagcca

SEQ ID NO: 2859831 - DNA, 15 bp, Homo sapiens
aacatccaagccaga

SEQ ID NO: 2859832 - DNA, 16 bp, Homo sapiens
aacatccaagccagag

SEQ ID NO: 2859833 - DNA, 21 bp, Homo sapiens
aacattttaagttttactgat

SEQ ID NO: 2859834 - DNA, 22 bp, Homo sapiens
aacattttaagttttactgata

SEQ ID NO: 2859835 - DNA, 19 bp, Homo sapiens
aaccaaggctgtgtttaga

SEQ ID NO: 2859836 - DNA, 17 bp, Homo sapiens
aaccagagtctgtattt

SEQ ID NO: 2859837 - DNA, 13 bp, Homo sapiens
aaccagattccag

SEQ ID NO: 2859838 - DNA, 15 bp, Homo sapiens
aaccagctcagtgtt

SEQ ID NO: 2859839 - DNA, 19 bp, Homo sapiens
aaccagctcagtgttttgg

SEQ ID NO: 2859840 - DNA, 18 bp, Homo sapiens
aaccaggccttcatcctc

SEQ ID NO: 2859841 - DNA, 20 bp, Homo sapiens
aaccaggccttcatcctcct

SEQ ID NO: 2859842 - DNA, 17 bp, Homo sapiens
aaccatgtagaaaattt

SEQ ID NO: 2859843 - DNA, 18 bp, Homo sapiens
aaccatttttgaacctta

SEQ ID NO: 2859844 - DNA, 14 bp, Homo sapiens
aacccatattttaa

SEQ ID NO: 2859845 - DNA, 15 bp, Homo sapiens
aaccctctcttccct

SEQ ID NO: 2859846 - DNA, 19 bp, Homo sapiens
aacctgcctgacatttgga

SEQ ID NO: 2859847 - DNA, 15 bp, Homo sapiens
aacctggacttcctg

SEQ ID NO: 2859848 - DNA, 19 bp, Homo sapiens
aacctggacttcctgtcat

SEQ ID NO: 2859849 - DNA, 22 bp, Homo sapiens
aacctgtattactgaataatat

SEQ ID NO: 2859850 - DNA, 23 bp, Homo sapiens
aaccttagatgttctaagtcttt

SEQ ID NO: 2859851 - DNA, 14 bp, Homo sapiens
aacgaaaacctgac

SEQ ID NO: 2859852 - DNA, 13 bp, Homo sapiens
aacgatttagaaa

SEQ ID NO: 2859853 - DNA, 19 bp, Homo sapiens
aacgcactttataaaagca

SEQ ID NO: 2859854 - DNA, 21 bp, Homo sapiens
aattaaaacaaatatacattt

SEQ ID NO: 2859855 - DNA, 21 bp, Homo sapiens
aattaagcattttgaaacaaa

SEQ ID NO: 2859856 - DNA, 23 bp, Homo sapiens
aattagtgtgacagtttccaaat

SEQ ID NO: 2859857 - DNA, 21 bp, Homo sapiens
aattatgcaattcagtgttcc

SEQ ID NO: 2859858 - DNA, 17 bp, Homo sapiens
aattatgtaaataactc

SEQ ID NO: 2859859 - DNA, 16 bp, Homo sapiens
aattatgttactgtat

SEQ ID NO: 2859860 - DNA, 18 bp, Homo sapiens
aattatgttactgtattt

SEQ ID NO: 2859861 - DNA, 12 bp, Homo sapiens
aattatttgcat

SEQ ID NO: 2859862 - DNA, 13 bp, Homo sapiens
aattccaggctga

SEQ ID NO: 2859863 - DNA, 22 bp, Homo sapiens
aattcctatacgcagcgtgctt

SEQ ID NO: 2859864 - DNA, 18 bp, Homo sapiens
aattcttggttgaggaaa

SEQ ID NO: 2859865 - DNA, 21 bp, Homo sapiens
aattgacataggcaataataa

SEQ ID NO: 2859866 - DNA, 16 bp, Homo sapiens
aattgggaagctgggg

SEQ ID NO: 2859867 - DNA, 18 bp, Homo sapiens
aattgtaagtgaaattaa

SEQ ID NO: 2859868 - DNA, 15 bp, Homo sapiens
aattgtcacatctat

SEQ ID NO: 2859869 - DNA, 18 bp, Homo sapiens
aattgtcccttaaacaaa

SEQ ID NO: 2859870 - DNA, 15 bp, Homo sapiens
aatttatattttaga

SEQ ID NO: 2859871 - DNA, 23 bp, Homo sapiens
aatttatattttagaaataataa

SEQ ID NO: 2859872 - DNA, 11 bp, Homo sapiens
aatttcaaaat

SEQ ID NO: 2859873 - DNA, 16 bp, Homo sapiens
aatttgaactttggaa

SEQ ID NO: 2859874 - DNA, 17 bp, Homo sapiens
aatttgtatatgactgc

SEQ ID NO: 2859875 - DNA, 18 bp, Homo sapiens
aattttaatgctgtttct

SEQ ID NO: 2859876 - DNA, 19 bp, Homo sapiens
aattttaatgctgtttcta

SEQ ID NO: 2859877 - DNA, 22 bp, Homo sapiens
aattttaatgctgtttctaaga

SEQ ID NO: 2859878 - DNA, 18 bp, Homo sapiens
aatttttaactgtactga

SEQ ID NO: 2859879 - DNA, 15 bp, Homo sapiens
aatttttttcaatat

SEQ ID NO: 2859880 - DNA, 14 bp, Homo sapiens
acaaaaattatgca

SEQ ID NO: 2859881 - DNA, 13 bp, Homo sapiens
acaaaactcttaa

SEQ ID NO: 2859882 - DNA, 11 bp, Homo sapiens
acaaacaaaac

SEQ ID NO: 2859883 - DNA, 18 bp, Homo sapiens
acaaagtactctttaaca

SEQ ID NO: 2859884 - DNA, 22 bp, Homo sapiens
acaagatggaaaataaattata

SEQ ID NO: 2859885 - DNA, 19 bp, Homo sapiens
acaagctgtatcactgcct

SEQ ID NO: 2859886 - DNA, 11 bp, Homo sapiens
acaagggattc

SEQ ID NO: 2859887 - DNA, 13 bp, Homo sapiens
acaagggattctg

SEQ ID NO: 2859888 - DNA, 14 bp, Homo sapiens
acaagggattctgg

SEQ ID NO: 2859889 - DNA, 17 bp, Homo sapiens
acaagggattctgggaa

SEQ ID NO: 2859890 - DNA, 22 bp, Homo sapiens
acaatcagctccttcctggaga

SEQ ID NO: 2859891 - DNA, 21 bp, Homo sapiens
acaatctatggcttatttcta

SEQ ID NO: 2859892 - DNA, 15 bp, Homo sapiens
acaatcttggggctg

SEQ ID NO: 2859893 - DNA, 23 bp, Homo sapiens
acaatggagtgggagatcagcca

SEQ ID NO: 2859894 - DNA, 19 bp, Homo sapiens
acaatggtgtggtgaatgt

SEQ ID NO: 2859895 - DNA, 20 bp, Homo sapiens
acaatggtgtggtgaatgtg

SEQ ID NO: 2859896 - DNA, 23 bp, Homo sapiens
acaatggtgtggtgaatgtgtga

SEQ ID NO: 2859897 - DNA, 15 bp, Homo sapiens
acaattaactgccct

SEQ ID NO: 2859898 - DNA, 23 bp, Homo sapiens
acaattcctctactaacaatcag

SEQ ID NO: 2859899 - DNA, 13 bp, Homo sapiens
acaatttaaaaca

SEQ ID NO: 2859900 - DNA, 17 bp, Homo sapiens
acaccaaccaggccttc

SEQ ID NO: 2859901 - DNA, 22 bp, Homo sapiens
acactatggtatttgagtgttt

SEQ ID NO: 2859902 - DNA, 14 bp, Homo sapiens
acactatttgtgac

SEQ ID NO: 2859903 - DNA, 15 bp, Homo sapiens
acactatttgtgact

SEQ ID NO: 2859904 - DNA, 16 bp, Homo sapiens
acactatttgtgactt

SEQ ID NO: 2859905 - DNA, 18 bp, Homo sapiens
acactcaataaacagtca

SEQ ID NO: 2859906 - DNA, 14 bp, Homo sapiens
acactcccttgggc

SEQ ID NO: 2859907 - DNA, 18 bp, Homo sapiens
acactgtgcacatctgtg

SEQ ID NO: 2859908 - DNA, 20 bp, Homo sapiens
acagaacttcagcattgtaa

SEQ ID NO: 2859909 - DNA, 13 bp, Homo sapiens
acagaagcttcca

SEQ ID NO: 2859910 - DNA, 12 bp, Homo sapiens
acagacccacac

SEQ ID NO: 2859911 - DNA, 15 bp, Homo sapiens
acagagcaagactct

SEQ ID NO: 2859912 - DNA, 13 bp, Homo sapiens
aagtacaaatgaa

SEQ ID NO: 2859913 - DNA, 19 bp, Homo sapiens
aagtacttgactacctact

SEQ ID NO: 2859914 - DNA, 14 bp, Homo sapiens
aagtagaagaggag

SEQ ID NO: 2859915 - DNA, 14 bp, Homo sapiens
aagtagcattcatg

SEQ ID NO: 2859916 - DNA, 17 bp, Homo sapiens
aagtagcattcatgtaa

SEQ ID NO: 2859917 - DNA, 17 bp, Homo sapiens
aagtagtgttgtccagg

SEQ ID NO: 2859918 - DNA, 18 bp, Homo sapiens
aagtatggtaatagcttt

SEQ ID NO: 2859919 - DNA, 21 bp, Homo sapiens
aagtatttcaaattggagctt

SEQ ID NO: 2859920 - DNA, 22 bp, Homo sapiens
aagtatttcaaattggagcttc

SEQ ID NO: 2859921 - DNA, 22 bp, Homo sapiens
aagtattttcataagtatttca

SEQ ID NO: 2859922 - DNA, 13 bp, Homo sapiens
aagtcaaaaaatt

SEQ ID NO: 2859923 - DNA, 11 bp, Homo sapiens
aagtgcccaaa

SEQ ID NO: 2859924 - DNA, 12 bp, Homo sapiens
aagtgcccaaag

SEQ ID NO: 2859925 - DNA, 14 bp, Homo sapiens
aagtgcccaaagtg

SEQ ID NO: 2859926 - DNA, 19 bp, Homo sapiens
aagtgcccaaagtggggag

SEQ ID NO: 2859927 - DNA, 20 bp, Homo sapiens
aagtggggagggacaaggga

SEQ ID NO: 2859928 - DNA, 12 bp, Homo sapiens
aagtgtaaaaaa

SEQ ID NO: 2859929 - DNA, 18 bp, Homo sapiens
aagtgttccctttttcat

SEQ ID NO: 2859930 - DNA, 16 bp, Homo sapiens
aagttgcagtgagctg

SEQ ID NO: 2859931 - DNA, 22 bp, Homo sapiens
aagttgcagtgagctgatatca

SEQ ID NO: 2859932 - DNA, 19 bp, Homo sapiens
aataaaatatcataaagca

SEQ ID NO: 2859933 - DNA, 20 bp, Homo sapiens
aataaaatcatgtagtttgt

SEQ ID NO: 2859934 - DNA, 12 bp, Homo sapiens
aataaacagtca

SEQ ID NO: 2859935 - DNA, 18 bp, Homo sapiens
aataaacagtcactggaa

SEQ ID NO: 2859936 - DNA, 12 bp, Homo sapiens
aataaaccagat

SEQ ID NO: 2859937 - DNA, 14 bp, Homo sapiens
aataaagtacttga

SEQ ID NO: 2859938 - DNA, 14 bp, Homo sapiens
aataacatgtttct

SEQ ID NO: 2859939 - DNA, 15 bp, Homo sapiens
aataataaagtactt

SEQ ID NO: 2859940 - DNA, 20 bp, Homo sapiens
aataataagtgatgtgctga

SEQ ID NO: 2859941 - DNA, 14 bp, Homo sapiens
aataatatcaaata

SEQ ID NO: 2859942 - DNA, 17 bp, Homo sapiens
aataatgtaacatgatt

SEQ ID NO: 2859943 - DNA, 19 bp, Homo sapiens
aataattaaccaaccttgt

SEQ ID NO: 2859944 - DNA, 17 bp, Homo sapiens
aataattcttttctgag

SEQ ID NO: 2859945 - DNA, 17 bp, Homo sapiens
aataattgaagtgttcc

SEQ ID NO: 2859946 - DNA, 14 bp, Homo sapiens
aataatttgaactt

SEQ ID NO: 2859947 - DNA, 15 bp, Homo sapiens
aataatttgaacttt

SEQ ID NO: 2859948 - DNA, 16 bp, Homo sapiens
aatacaaaatgtatta

SEQ ID NO: 2859949 - DNA, 21 bp, Homo sapiens
aatacagtcttccatttgcaa

SEQ ID NO: 2859950 - DNA, 17 bp, Homo sapiens
aatacatttgtaagtgt

SEQ ID NO: 2859951 - DNA, 13 bp, Homo sapiens
aatacgtttgtgt

SEQ ID NO: 2859952 - DNA, 17 bp, Homo sapiens
aatacgtttgtgtttct

SEQ ID NO: 2859953 - DNA, 17 bp, Homo sapiens
aatactgccaaaacatt

SEQ ID NO: 2859954 - DNA, 19 bp, Homo sapiens
aatactgcttaattgctga

SEQ ID NO: 2859955 - DNA, 16 bp, Homo sapiens
aatactgtattttgta

SEQ ID NO: 2859956 - DNA, 17 bp, Homo sapiens
aatagaataattctttt

SEQ ID NO: 2859957 - DNA, 14 bp, Homo sapiens
aatagcactttttg

SEQ ID NO: 2859958 - DNA, 19 bp, Homo sapiens
aatagtcaccttcatgatt

SEQ ID NO: 2859959 - DNA, 20 bp, Homo sapiens
aatagtgtcatataaactca

SEQ ID NO: 2859960 - DNA, 12 bp, Homo sapiens
aatataatgttg

SEQ ID NO: 2859961 - DNA, 19 bp, Homo sapiens
aatatacattttctaaata

SEQ ID NO: 2859962 - DNA, 20 bp, Homo sapiens
aatatacattttctaaataa

SEQ ID NO: 2859963 - DNA, 21 bp, Homo sapiens
aatatacattttctaaataaa

SEQ ID NO: 2859964 - DNA, 15 bp, Homo sapiens
aatatcataaagcat

SEQ ID NO: 2859965 - DNA, 13 bp, Homo sapiens
aatatgaatctat

SEQ ID NO: 2859966 - DNA, 14 bp, Homo sapiens
aatatgaatctata

SEQ ID NO: 2859967 - DNA, 13 bp, Homo sapiens
aatatgaatgaat

SEQ ID NO: 2859968 - DNA, 15 bp, Homo sapiens
actaatagaacttgt

SEQ ID NO: 2859969 - DNA, 18 bp, Homo sapiens
actaccttggttccccca

SEQ ID NO: 2859970 - DNA, 14 bp, Homo sapiens
actactctctgttt

SEQ ID NO: 2859971 - DNA, 12 bp, Homo sapiens
actactgcagca

SEQ ID NO: 2859972 - DNA, 23 bp, Homo sapiens
actactgttatcagtaatgctaa

SEQ ID NO: 2859973 - DNA, 15 bp, Homo sapiens
actagaatttattca

SEQ ID NO: 2859974 - DNA, 16 bp, Homo sapiens
actagggatccctcat

SEQ ID NO: 2859975 - DNA, 20 bp, Homo sapiens
actagggatccctcatctgt

SEQ ID NO: 2859976 - DNA, 18 bp, Homo sapiens
actataaagctgttattc

SEQ ID NO: 2859977 - DNA, 18 bp, Homo sapiens
actatcttctttggactt

SEQ ID NO: 2859978 - DNA, 15 bp, Homo sapiens
actatggtatttgag

SEQ ID NO: 2859979 - DNA, 13 bp, Homo sapiens
actatgttcctaa

SEQ ID NO: 2859980 - DNA, 21 bp, Homo sapiens
actatgttcctaacaaaatga

SEQ ID NO: 2859981 - DNA, 19 bp, Homo sapiens
actcaagggaaaggcaagc

SEQ ID NO: 2859982 - DNA, 20 bp, Homo sapiens
actcaagggaaaggcaagct

SEQ ID NO: 2859983 - DNA, 14 bp, Homo sapiens
actcaataaaagaa

SEQ ID NO: 2859984 - DNA, 14 bp, Homo sapiens
actcagctccagaa

SEQ ID NO: 2859985 - DNA, 16 bp, Homo sapiens
actcagggctcctggg

SEQ ID NO: 2859986 - DNA, 16 bp, Homo sapiens
actcatcctcttttaa

SEQ ID NO: 2859987 - DNA, 18 bp, Homo sapiens
actcatttatctcctctt

SEQ ID NO: 2859988 - DNA, 22 bp, Homo sapiens
actcattttcatattgtaatct

SEQ ID NO: 2859989 - DNA, 20 bp, Homo sapiens
actccacattcttcagtttt

SEQ ID NO: 2859990 - DNA, 11 bp, Homo sapiens
actccaggcct

SEQ ID NO: 2859991 - DNA, 22 bp, Homo sapiens
actccaggcctgaccagggggc

SEQ ID NO: 2859992 - DNA, 14 bp, Homo sapiens
actccccagcccca

SEQ ID NO: 2859993 - DNA, 12 bp, Homo sapiens
actcctcccaca

SEQ ID NO: 2859994 - DNA, 18 bp, Homo sapiens
actcgagaccataaagat

SEQ ID NO: 2859995 - DNA, 15 bp, Homo sapiens
actctatagactcta

SEQ ID NO: 2859996 - DNA, 11 bp, Homo sapiens
actctcccctc

SEQ ID NO: 2859997 - DNA, 12 bp, Homo sapiens
actctcccctcc

SEQ ID NO: 2859998 - DNA, 16 bp, Homo sapiens
actctcccctccctct

SEQ ID NO: 2859999 - DNA, 20 bp, Homo sapiens
actctcccctccctcttcct

SEQ ID NO: 2860000 - DNA, 22 bp, Homo sapiens
actctcccctccctcttccttc

SEQ ID NO: 2860001 - DNA, 15 bp, Homo sapiens
actctggccctggcc

SEQ ID NO: 2860002 - DNA, 11 bp, Homo sapiens
actctgtccag

SEQ ID NO: 2860003 - DNA, 19 bp, Homo sapiens
actcttaggaagagaaacc

SEQ ID NO: 2860004 - DNA, 16 bp, Homo sapiens
actctttgagaaacaa

SEQ ID NO: 2860005 - DNA, 16 bp, Homo sapiens
actgaccaaagactgc

SEQ ID NO: 2860006 - DNA, 22 bp, Homo sapiens
actgaccacaccaaccaggcct

SEQ ID NO: 2860007 - DNA, 22 bp, Homo sapiens
actgagccagattggccaatta

SEQ ID NO: 2860008 - DNA, 17 bp, Homo sapiens
actgagcttctctgtga

SEQ ID NO: 2860009 - DNA, 14 bp, Homo sapiens
actgaggagacaga

SEQ ID NO: 2860010 - DNA, 12 bp, Homo sapiens
actgagggcagt

SEQ ID NO: 2860011 - DNA, 23 bp, Homo sapiens
actgagggcagtcgatagagctg

SEQ ID NO: 2860012 - DNA, 20 bp, Homo sapiens
actgagttttgtttcacttt

SEQ ID NO: 2860013 - DNA, 22 bp, Homo sapiens
actgcagaacccccaggtggcc

SEQ ID NO: 2860014 - DNA, 16 bp, Homo sapiens
actgcagcacctccag

SEQ ID NO: 2860015 - DNA, 12 bp, Homo sapiens
agagcttctctg

SEQ ID NO: 2860016 - DNA, 18 bp, Homo sapiens
agagcttctctgggctga

SEQ ID NO: 2860017 - DNA, 22 bp, Homo sapiens
agaggaaaaatgggagccagga

SEQ ID NO: 2860018 - DNA, 21 bp, Homo sapiens
agaggactcccaaccctggct

SEQ ID NO: 2860019 - DNA, 14 bp, Homo sapiens
agaggccctcgctg

SEQ ID NO: 2860020 - DNA, 23 bp, Homo sapiens
agagggacataagataaaatgat

SEQ ID NO: 2860021 - DNA, 21 bp, Homo sapiens
agagggacgcctgggggtgcc

SEQ ID NO: 2860022 - DNA, 19 bp, Homo sapiens
agagggactcaagggaaag

SEQ ID NO: 2860023 - DNA, 16 bp, Homo sapiens
agagggcactctgctt

SEQ ID NO: 2860024 - DNA, 22 bp, Homo sapiens
agaggtgagaccaaaggatcca

SEQ ID NO: 2860025 - DNA, 23 bp, Homo sapiens
agaggtgagaccaaaggatccag

SEQ ID NO: 2860026 - DNA, 14 bp, Homo sapiens
agagtttgaaactc

SEQ ID NO: 2860027 - DNA, 22 bp, Homo sapiens
agagtttgaaactcgagaccat

SEQ ID NO: 2860028 - DNA, 18 bp, Homo sapiens
agagtttttaaagccttc

SEQ ID NO: 2860029 - DNA, 16 bp, Homo sapiens
agataaagaataataa

SEQ ID NO: 2860030 - DNA, 13 bp, Homo sapiens
agataacttcttt

SEQ ID NO: 2860031 - DNA, 14 bp, Homo sapiens
agataatatttttg

SEQ ID NO: 2860032 - DNA, 15 bp, Homo sapiens
agataatatttttgt

SEQ ID NO: 2860033 - DNA, 21 bp, Homo sapiens
agataatatttttgtatttct

SEQ ID NO: 2860034 - DNA, 13 bp, Homo sapiens
agataatgtgaaa

SEQ ID NO: 2860035 - DNA, 18 bp, Homo sapiens
agatacagaactctttca

SEQ ID NO: 2860036 - DNA, 17 bp, Homo sapiens
agatagaaagctggact

SEQ ID NO: 2860037 - DNA, 18 bp, Homo sapiens
agatagaaagctggactg

SEQ ID NO: 2860038 - DNA, 19 bp, Homo sapiens
agatagaaagctggactga

SEQ ID NO: 2860039 - DNA, 16 bp, Homo sapiens
agatcaacgcctcact

SEQ ID NO: 2860040 - DNA, 12 bp, Homo sapiens
agatctgcaggc

SEQ ID NO: 2860041 - DNA, 14 bp, Homo sapiens
agatctgcaggctg

SEQ ID NO: 2860042 - DNA, 13 bp, Homo sapiens
agatctttatatt

SEQ ID NO: 2860043 - DNA, 22 bp, Homo sapiens
agatgctacttcccactgtatg

SEQ ID NO: 2860044 - DNA, 23 bp, Homo sapiens
agatggaagttgcagtgagctga

SEQ ID NO: 2860045 - DNA, 14 bp, Homo sapiens
agatggctgctgcc

SEQ ID NO: 2860046 - DNA, 19 bp, Homo sapiens
agatggctgctgcctgctc

SEQ ID NO: 2860047 - DNA, 21 bp, Homo sapiens
agatgtgacccaccagtgcct

SEQ ID NO: 2860048 - DNA, 17 bp, Homo sapiens
agatgttctaagtcttt

SEQ ID NO: 2860049 - DNA, 21 bp, Homo sapiens
agatgttctaagtctttccat

SEQ ID NO: 2860050 - DNA, 11 bp, Homo sapiens
agattgaactt

SEQ ID NO: 2860051 - DNA, 17 bp, Homo sapiens
agattttaattttgaat

SEQ ID NO: 2860052 - DNA, 14 bp, Homo sapiens
agcaaattccagat

SEQ ID NO: 2860053 - DNA, 16 bp, Homo sapiens
agcaaattccagattt

SEQ ID NO: 2860054 - DNA, 23 bp, Homo sapiens
agcaaattccagatttgtttcct

SEQ ID NO: 2860055 - DNA, 17 bp, Homo sapiens
agcaacgcttgtagaac

SEQ ID NO: 2860056 - DNA, 16 bp, Homo sapiens
agcaactaatgtttga

SEQ ID NO: 2860057 - DNA, 13 bp, Homo sapiens
agcaatgtgagtc

SEQ ID NO: 2860058 - DNA, 22 bp, Homo sapiens
agcaatgtgagtcccagagccc

SEQ ID NO: 2860059 - DNA, 18 bp, Homo sapiens
agcaattccaggctgagc

SEQ ID NO: 2860060 - DNA, 19 bp, Homo sapiens
agcaattccaggctgagcc

SEQ ID NO: 2860061 - DNA, 20 bp, Homo sapiens
agcaattccaggctgagcca

SEQ ID NO: 2860062 - DNA, 23 bp, Homo sapiens
agcaattccaggctgagccatga

SEQ ID NO: 2860063 - DNA, 22 bp, Homo sapiens
agcaattgcgaccttaatttaa

SEQ ID NO: 2860064 - DNA, 12 bp, Homo sapiens
agcaccccctca

SEQ ID NO: 2860065 - DNA, 22 bp, Homo sapiens
agcactttaaccctctcttccc

SEQ ID NO: 2860066 - DNA, 23 bp, Homo sapiens
agcactttaaccctctcttccct

SEQ ID NO: 2860067 - DNA, 14 bp, Homo sapiens
agcactttgggagg

SEQ ID NO: 2860068 - DNA, 13 bp, Homo sapiens
agcagattttaat

SEQ ID NO: 2860069 - DNA, 18 bp, Homo sapiens
agcagcttagactaaggc

SEQ ID NO: 2860070 - DNA, 13 bp, Homo sapiens
agcagtttccagt

SEQ ID NO: 2860071 - DNA, 17 bp, Homo sapiens
agcatagagaacaaagt

SEQ ID NO: 2860072 - DNA, 23 bp, Homo sapiens
agcatctcagtggtgtgtgaagt

SEQ ID NO: 2860073 - DNA, 16 bp, Homo sapiens
agcatctgaccatctg

SEQ ID NO: 2860074 - DNA, 17 bp, Homo sapiens
agcatctgaccatctgt

SEQ ID NO: 2860075 - DNA, 20 bp, Homo sapiens
agcatctgaccatctgtgac

SEQ ID NO: 2860076 - DNA, 21 bp, Homo sapiens
agcatctgaccatctgtgact

SEQ ID NO: 2860077 - DNA, 18 bp, Homo sapiens
agcattgcctggactgac

SEQ ID NO: 2860078 - DNA, 14 bp, Homo sapiens
agcattttgaaaca

SEQ ID NO: 2860079 - DNA, 18 bp, Homo sapiens
agcattttgaaacaaagt

SEQ ID NO: 2860080 - DNA, 17 bp, Homo sapiens
agccaaaggcagctaag

SEQ ID NO: 2860081 - DNA, 20 bp, Homo sapiens
cagccgctgagcgaggagat

SEQ ID NO: 2860082 - DNA, 20 bp, Homo sapiens
cagcctcccctgccagggca

SEQ ID NO: 2860083 - DNA, 23 bp, Homo sapiens
cagcctgctctagtgggacagcc

SEQ ID NO: 2860084 - DNA, 20 bp, Homo sapiens
cagcctggtcaacatggtga

SEQ ID NO: 2860085 - DNA, 18 bp, Homo sapiens
cagcgaggaggctccaga

SEQ ID NO: 2860086 - DNA, 15 bp, Homo sapiens
cagcggcagagcaat

SEQ ID NO: 2860087 - DNA, 19 bp, Homo sapiens
cagctaagatagaaagctg

SEQ ID NO: 2860088 - DNA, 13 bp, Homo sapiens
cagctaataaacc

SEQ ID NO: 2860089 - DNA, 20 bp, Homo sapiens
cagctatgttatattgaaaa

SEQ ID NO: 2860090 - DNA, 21 bp, Homo sapiens
cagctatgttatattgaaaaa

SEQ ID NO: 2860091 - DNA, 16 bp, Homo sapiens
cagctcaacctaccct

SEQ ID NO: 2860092 - DNA, 16 bp, Homo sapiens
cagctccttcctggag

SEQ ID NO: 2860093 - DNA, 15 bp, Homo sapiens
cagctctctctaccc

SEQ ID NO: 2860094 - DNA, 19 bp, Homo sapiens
cagctctgaaaccagtgtt

SEQ ID NO: 2860095 - DNA, 15 bp, Homo sapiens
cagctctttccaaat

SEQ ID NO: 2860096 - DNA, 23 bp, Homo sapiens
cagctctttccaaattaaaacaa

SEQ ID NO: 2860097 - DNA, 16 bp, Homo sapiens
cagctgggcctcctgc

SEQ ID NO: 2860098 - DNA, 23 bp, Homo sapiens
cagctgggcctcctgcctccggg

SEQ ID NO: 2860099 - DNA, 22 bp, Homo sapiens
cagctgtcctgcagcaaacact

SEQ ID NO: 2860100 - DNA, 20 bp, Homo sapiens
cagcttcctttcctgtgtgt

SEQ ID NO: 2860101 - DNA, 13 bp, Homo sapiens
caggaaatgaaaa

SEQ ID NO: 2860102 - DNA, 20 bp, Homo sapiens
caggaagcctactatttaaa

SEQ ID NO: 2860103 - DNA, 21 bp, Homo sapiens
caggaccagtcaacctgggca

SEQ ID NO: 2860104 - DNA, 15 bp, Homo sapiens
caggacccagaggaa

SEQ ID NO: 2860105 - DNA, 19 bp, Homo sapiens
caggagaaggccaattcct

SEQ ID NO: 2860106 - DNA, 21 bp, Homo sapiens
attactgcaatcactgtgcta

SEQ ID NO: 2860107 - DNA, 20 bp, Homo sapiens
attagagattacctcctgag

SEQ ID NO: 2860108 - DNA, 16 bp, Homo sapiens
attagagtgtctttcc

SEQ ID NO: 2860109 - DNA, 23 bp, Homo sapiens
attagagtgtctttccacggagc

SEQ ID NO: 2860110 - DNA, 14 bp, Homo sapiens
attagataatattt

SEQ ID NO: 2860111 - DNA, 13 bp, Homo sapiens
attagtaacatgt

SEQ ID NO: 2860112 - DNA, 18 bp, Homo sapiens
attagtggtcataaaata

SEQ ID NO: 2860113 - DNA, 23 bp, Homo sapiens
attatagtgatgtaatcttgaat

SEQ ID NO: 2860114 - DNA, 21 bp, Homo sapiens
attatgcacttttagaaatgc

SEQ ID NO: 2860115 - DNA, 17 bp, Homo sapiens
attattagataatattt

SEQ ID NO: 2860116 - DNA, 12 bp, Homo sapiens
attattcaagaa

SEQ ID NO: 2860117 - DNA, 16 bp, Homo sapiens
attattcaagaatgaa

SEQ ID NO: 2860118 - DNA, 19 bp, Homo sapiens
attattcaagaatgaaaaa

SEQ ID NO: 2860119 - DNA, 20 bp, Homo sapiens
attattcaagaatgaaaaat

SEQ ID NO: 2860120 - DNA, 23 bp, Homo sapiens
attattcaagaatgaaaaatata

SEQ ID NO: 2860121 - DNA, 16 bp, Homo sapiens
attcaagaatgaaaaa

SEQ ID NO: 2860122 - DNA, 18 bp, Homo sapiens
attcaagaatgaaaaata

SEQ ID NO: 2860123 - DNA, 19 bp, Homo sapiens
attcaagagctagaaaaat

SEQ ID NO: 2860124 - DNA, 22 bp, Homo sapiens
attcaattagtggtcataaaat

SEQ ID NO: 2860125 - DNA, 14 bp, Homo sapiens
attcaattcctctg

SEQ ID NO: 2860126 - DNA, 17 bp, Homo sapiens
attcacatctaacctca

SEQ ID NO: 2860127 - DNA, 17 bp, Homo sapiens
attccaggctgagccat

SEQ ID NO: 2860128 - DNA, 17 bp, Homo sapiens
attccctagaaacttcc

SEQ ID NO: 2860129 - DNA, 21 bp, Homo sapiens
attccctagaaacttccaaat

SEQ ID NO: 2860130 - DNA, 13 bp, Homo sapiens
attcctctgggaa

SEQ ID NO: 2860131 - DNA, 21 bp, Homo sapiens
attcctgggcaagaacctaaa

SEQ ID NO: 2860132 - DNA, 19 bp, Homo sapiens
attctaggaaacccaagga

SEQ ID NO: 2860133 - DNA, 13 bp, Homo sapiens
attctctgagctg

SEQ ID NO: 2860134 - DNA, 19 bp, Homo sapiens
attctctgtctcatccatc

SEQ ID NO: 2860135 - DNA, 15 bp, Homo sapiens
attctgaaggagccc

SEQ ID NO: 2860136 - DNA, 16 bp, Homo sapiens
attctggtcttcactg

SEQ ID NO: 2860137 - DNA, 17 bp, Homo sapiens
attcttggttgaggaaa

SEQ ID NO: 2860138 - DNA, 17 bp, Homo sapiens
attctttgcaatactgc

SEQ ID NO: 2860139 - DNA, 11 bp, Homo sapiens
attgaactttc

SEQ ID NO: 2860140 - DNA, 18 bp, Homo sapiens
attgaagccgactctggc

SEQ ID NO: 2860141 - DNA, 22 bp, Homo sapiens
attgaattcttggttgaggaaa

SEQ ID NO: 2860142 - DNA, 15 bp, Homo sapiens
attgcatctcccaga

SEQ ID NO: 2860143 - DNA, 23 bp, Homo sapiens
attgcatctcccagataatgtga

SEQ ID NO: 2860144 - DNA, 17 bp, Homo sapiens
attgccctatgctgtgc

SEQ ID NO: 2860145 - DNA, 13 bp, Homo sapiens
attgcctggactg

SEQ ID NO: 2860146 - DNA, 23 bp, Homo sapiens
attgctgataccatatgaatgaa

SEQ ID NO: 2860147 - DNA, 13 bp, Homo sapiens
attggactccagg

SEQ ID NO: 2860148 - DNA, 15 bp, Homo sapiens
attgtaactgttctt

SEQ ID NO: 2860149 - DNA, 18 bp, Homo sapiens
attgtaagtgaaattaag

SEQ ID NO: 2860150 - DNA, 13 bp, Homo sapiens
attgtaatctatg

SEQ ID NO: 2860151 - DNA, 12 bp, Homo sapiens
attgtacctctc

SEQ ID NO: 2860152 - DNA, 18 bp, Homo sapiens
attgtacctctcttatag

SEQ ID NO: 2860153 - DNA, 13 bp, Homo sapiens
attgtttcaattg

SEQ ID NO: 2860154 - DNA, 20 bp, Homo sapiens
attgtttgtctgtcttcata

SEQ ID NO: 2860155 - DNA, 13 bp, Homo sapiens
atttaaaacaatc

SEQ ID NO: 2860156 - DNA, 16 bp, Homo sapiens
atttactaactaaata

SEQ ID NO: 2860157 - DNA, 21 bp, Homo sapiens
atttactgagcttctctgtga

SEQ ID NO: 2860158 - DNA, 22 bp, Homo sapiens
atttagaaagaagcccaatatt

SEQ ID NO: 2860159 - DNA, 13 bp, Homo sapiens
atttaggcaagag

SEQ ID NO: 2860160 - DNA, 22 bp, Homo sapiens
atttagtttgattattcagtgt

SEQ ID NO: 2860161 - DNA, 20 bp, Homo sapiens
atttatattaaataacatgt

SEQ ID NO: 2860162 - DNA, 19 bp, Homo sapiens
atttattcaattcctctgg

SEQ ID NO: 2860163 - DNA, 17 bp, Homo sapiens
atttcaaattggagctt

SEQ ID NO: 2860164 - DNA, 15 bp, Homo sapiens
atttcaataaatgat

SEQ ID NO: 2860165 - DNA, 20 bp, Homo sapiens
atttccctccagagaaagca

SEQ ID NO: 2860166 - DNA, 12 bp, Homo sapiens
atttctaattgt

SEQ ID NO: 2860167 - DNA, 19 bp, Homo sapiens
atttctatgacaaattcaa

SEQ ID NO: 2860168 - DNA, 13 bp, Homo sapiens
atttctatttatt

SEQ ID NO: 2860169 - DNA, 16 bp, Homo sapiens
atttctatttatttac

SEQ ID NO: 2860170 - DNA, 17 bp, Homo sapiens
atttctatttatttact

SEQ ID NO: 2860171 - DNA, 20 bp, Homo sapiens
atttctatttctcctccatg

SEQ ID NO: 2860172 - DNA, 20 bp, Homo sapiens
atttctcctccatgggagaa

SEQ ID NO: 2860173 - DNA, 23 bp, Homo sapiens
atttctctattttcataatcagt

SEQ ID NO: 2860174 - DNA, 11 bp, Homo sapiens
atttgaacttt

SEQ ID NO: 2860175 - DNA, 14 bp, Homo sapiens
atttgagtgctctg

SEQ ID NO: 2860176 - DNA, 12 bp, Homo sapiens
atttgagtgttt

SEQ ID NO: 2860177 - DNA, 13 bp, Homo sapiens
atttgatttctaa

SEQ ID NO: 2860178 - DNA, 14 bp, Homo sapiens
atttgatttctaat

SEQ ID NO: 2860179 - DNA, 15 bp, Homo sapiens
atttgatttctaatt

SEQ ID NO: 2860180 - DNA, 21 bp, Homo sapiens
atttgcataacaattcctcta

SEQ ID NO: 2860181 - DNA, 15 bp, Homo sapiens
atttgtaagtgtaaa

SEQ ID NO: 2860182 - DNA, 16 bp, Homo sapiens
atttgtatatgactgc

SEQ ID NO: 2860183 - DNA, 18 bp, Homo sapiens
atttgtatgtttttctgt

SEQ ID NO: 2860184 - DNA, 19 bp, Homo sapiens
atttgtatgtttttctgta

SEQ ID NO: 2860185 - DNA, 13 bp, Homo sapiens
acccacacatgtt

SEQ ID NO: 2860186 - DNA, 12 bp, Homo sapiens
acccacagccat

SEQ ID NO: 2860187 - DNA, 14 bp, Homo sapiens
acccacagccatag

SEQ ID NO: 2860188 - DNA, 15 bp, Homo sapiens
acccacagccataga

SEQ ID NO: 2860189 - DNA, 14 bp, Homo sapiens
acccaccagtgcct

SEQ ID NO: 2860190 - DNA, 15 bp, Homo sapiens
acccagcaacacaga

SEQ ID NO: 2860191 - DNA, 21 bp, Homo sapiens
acccagccccttgagaaacct

SEQ ID NO: 2860192 - DNA, 15 bp, Homo sapiens
accccaaagagaaag

SEQ ID NO: 2860193 - DNA, 17 bp, Homo sapiens
acccccaggtggcctgc

SEQ ID NO: 2860194 - DNA, 18 bp, Homo sapiens
acccccatttctatttat

SEQ ID NO: 2860195 - DNA, 11 bp, Homo sapiens
accccctcatt

SEQ ID NO: 2860196 - DNA, 12 bp, Homo sapiens
acccccttcccc

SEQ ID NO: 2860197 - DNA, 19 bp, Homo sapiens
acccccttctccatccaca

SEQ ID NO: 2860198 - DNA, 17 bp, Homo sapiens
acccctaagtgcccaaa

SEQ ID NO: 2860199 - DNA, 17 bp, Homo sapiens
acccctcccctcccacc

SEQ ID NO: 2860200 - DNA, 23 bp, Homo sapiens
accccttaccccaaagagaaaga

SEQ ID NO: 2860201 - DNA, 14 bp, Homo sapiens
acccggcccagaga

SEQ ID NO: 2860202 - DNA, 12 bp, Homo sapiens
accctctcttcc

SEQ ID NO: 2860203 - DNA, 13 bp, Homo sapiens
acccttacagtag

SEQ ID NO: 2860204 - DNA, 14 bp, Homo sapiens
acctacagacctgg

SEQ ID NO: 2860205 - DNA, 16 bp, Homo sapiens
acctacagacctggct

SEQ ID NO: 2860206 - DNA, 17 bp, Homo sapiens
acctacagacctggctc

SEQ ID NO: 2860207 - DNA, 22 bp, Homo sapiens
acctacatatgctgatctttta

SEQ ID NO: 2860208 - DNA, 13 bp, Homo sapiens
acctacatatttg

SEQ ID NO: 2860209 - DNA, 17 bp, Homo sapiens
acctactggtgtaatct

SEQ ID NO: 2860210 - DNA, 18 bp, Homo sapiens
acctcgctggactctcag

SEQ ID NO: 2860211 - DNA, 20 bp, Homo sapiens
acctctggctagagccgagg

SEQ ID NO: 2860212 - DNA, 17 bp, Homo sapiens
acctcttcagaggccct

SEQ ID NO: 2860213 - DNA, 13 bp, Homo sapiens
acctgaatttgta

SEQ ID NO: 2860214 - DNA, 20 bp, Homo sapiens
acctgaatttgtatatgact

SEQ ID NO: 2860215 - DNA, 16 bp, Homo sapiens
acctgacactcccttg

SEQ ID NO: 2860216 - DNA, 20 bp, Homo sapiens
acctgatgtcagctgctgtt

SEQ ID NO: 2860217 - DNA, 21 bp, Homo sapiens
acctgcctgacatttggagtg

SEQ ID NO: 2860218 - DNA, 15 bp, Homo sapiens
acctggacttcctgt

SEQ ID NO: 2860219 - DNA, 17 bp, Homo sapiens
acctggacttcctgtca

SEQ ID NO: 2860220 - DNA, 18 bp, Homo sapiens
acctggacttcctgtcat

SEQ ID NO: 2860221 - DNA, 14 bp, Homo sapiens
acctggctctcaga

SEQ ID NO: 2860222 - DNA, 16 bp, Homo sapiens
acctggtgctgcctct

SEQ ID NO: 2860223 - DNA, 20 bp, Homo sapiens
acctgtaatcccagctactt

SEQ ID NO: 2860224 - DNA, 19 bp, Homo sapiens
acctgtatatttcttttaa

SEQ ID NO: 2860225 - DNA, 21 bp, Homo sapiens
acctgtccccaccctccactc

SEQ ID NO: 2860226 - DNA, 22 bp, Homo sapiens
acctgtgcttcgggcccttccc

SEQ ID NO: 2860227 - DNA, 23 bp, Homo sapiens
acctgtgcttcgggcccttccca

SEQ ID NO: 2860228 - DNA, 14 bp, Homo sapiens
accttaatttaact

SEQ ID NO: 2860229 - DNA, 22 bp, Homo sapiens
accttattgtacctctcttata

SEQ ID NO: 2860230 - DNA, 15 bp, Homo sapiens
accttccccagactc

SEQ ID NO: 2860231 - DNA, 16 bp, Homo sapiens
accttccccagactca

SEQ ID NO: 2860232 - DNA, 15 bp, Homo sapiens
accttggactcctcc

SEQ ID NO: 2860233 - DNA, 18 bp, Homo sapiens
accttggactcctcccac

SEQ ID NO: 2860234 - DNA, 18 bp, Homo sapiens
acctttgttttgcactga

SEQ ID NO: 2860235 - DNA, 19 bp, Homo sapiens
acgcacacatggacacaga

SEQ ID NO: 2860236 - DNA, 22 bp, Homo sapiens
acgccctccctctcccaggccc

SEQ ID NO: 2860237 - DNA, 20 bp, Homo sapiens
acgcctgtaatcccagcact

SEQ ID NO: 2860238 - DNA, 21 bp, Homo sapiens
acgcttgtagaactcactctg

SEQ ID NO: 2860239 - DNA, 23 bp, Homo sapiens
acgcttgtagaactcactctggg

SEQ ID NO: 2860240 - DNA, 17 bp, Homo sapiens
acgctttctagctgttg

SEQ ID NO: 2860241 - DNA, 21 bp, Homo sapiens
acggagccactcctctgactc

SEQ ID NO: 2860242 - DNA, 16 bp, Homo sapiens
acgtgaagccacagga

SEQ ID NO: 2860243 - DNA, 20 bp, Homo sapiens
acgttctgttaatttagtaa

SEQ ID NO: 2860244 - DNA, 12 bp, Homo sapiens
actaaaattatg

SEQ ID NO: 2860245 - DNA, 14 bp, Homo sapiens
actaatagaacttg

SEQ ID NO: 2860246 - DNA, 16 bp, Homo sapiens
agttttaaagaaattt

SEQ ID NO: 2860247 - DNA, 18 bp, Homo sapiens
agttttaactagaattta

SEQ ID NO: 2860248 - DNA, 16 bp, Homo sapiens
agttttgtttcacttt

SEQ ID NO: 2860249 - DNA, 15 bp, Homo sapiens
agtttttaaagcctt

SEQ ID NO: 2860250 - DNA, 16 bp, Homo sapiens
agtttttaaagccttc

SEQ ID NO: 2860251 - DNA, 15 bp, Homo sapiens
ataaaatagaataat

SEQ ID NO: 2860252 - DNA, 21 bp, Homo sapiens
ataaaatagaataattctttt

SEQ ID NO: 2860253 - DNA, 17 bp, Homo sapiens
ataaaatatcataaagc

SEQ ID NO: 2860254 - DNA, 16 bp, Homo sapiens
ataaacagtcactgga

SEQ ID NO: 2860255 - DNA, 14 bp, Homo sapiens
ataaactcatttat

SEQ ID NO: 2860256 - DNA, 16 bp, Homo sapiens
ataaagctgttattct

SEQ ID NO: 2860257 - DNA, 21 bp, Homo sapiens
ataaagctgttattcttgtta

SEQ ID NO: 2860258 - DNA, 15 bp, Homo sapiens
ataaagtacaaatga

SEQ ID NO: 2860259 - DNA, 13 bp, Homo sapiens
ataaatgccagag

SEQ ID NO: 2860260 - DNA, 18 bp, Homo sapiens
ataaatgtatcttattca

SEQ ID NO: 2860261 - DNA, 13 bp, Homo sapiens
ataaattataagt

SEQ ID NO: 2860262 - DNA, 23 bp, Homo sapiens
ataaattatattaatttttgaaa

SEQ ID NO: 2860263 - DNA, 14 bp, Homo sapiens
ataacaattcctct

SEQ ID NO: 2860264 - DNA, 17 bp, Homo sapiens
ataacagccttttcctt

SEQ ID NO: 2860265 - DNA, 17 bp, Homo sapiens
ataacttctcatgtata

SEQ ID NO: 2860266 - DNA, 20 bp, Homo sapiens
ataacttctcatgtatatta

SEQ ID NO: 2860267 - DNA, 15 bp, Homo sapiens
ataagataaaatgat

SEQ ID NO: 2860268 - DNA, 16 bp, Homo sapiens
ataagataaaatgatg

SEQ ID NO: 2860269 - DNA, 18 bp, Homo sapiens
ataagataaaatgatgtt

SEQ ID NO: 2860270 - DNA, 13 bp, Homo sapiens
ataagcaggaagg

SEQ ID NO: 2860271 - DNA, 13 bp, Homo sapiens
ataagtagtaaat

SEQ ID NO: 2860272 - DNA, 22 bp, Homo sapiens
ataagtagtaaatcagaaagta

SEQ ID NO: 2860273 - DNA, 16 bp, Homo sapiens
ataagtatttcaaatt

SEQ ID NO: 2860274 - DNA, 18 bp, Homo sapiens
ataagtatttcaaattgg

SEQ ID NO: 2860275 - DNA, 19 bp, Homo sapiens
ataagtatttcaaattgga

SEQ ID NO: 2860276 - DNA, 16 bp, Homo sapiens
ataataaaaagaaaga

SEQ ID NO: 2860277 - DNA, 17 bp, Homo sapiens
ataataaaaagaaagat

SEQ ID NO: 2860278 - DNA, 23 bp, Homo sapiens
ataataaaaagaaagatacttac

SEQ ID NO: 2860279 - DNA, 21 bp, Homo sapiens
ataataagtgatgtgctgaat

SEQ ID NO: 2860280 - DNA, 16 bp, Homo sapiens
ataatactactactgt

SEQ ID NO: 2860281 - DNA, 14 bp, Homo sapiens
ataatatatattaa

SEQ ID NO: 2860282 - DNA, 14 bp, Homo sapiens
ataatatcaaataa

SEQ ID NO: 2860283 - DNA, 15 bp, Homo sapiens
ataatatttttgtat

SEQ ID NO: 2860284 - DNA, 15 bp, Homo sapiens
atctagaattcactg

SEQ ID NO: 2860285 - DNA, 22 bp, Homo sapiens
atctataagtagtaaatcagaa

SEQ ID NO: 2860286 - DNA, 15 bp, Homo sapiens
atctatccacactgt

SEQ ID NO: 2860287 - DNA, 13 bp, Homo sapiens
atctatggcttat

SEQ ID NO: 2860288 - DNA, 18 bp, Homo sapiens
atctatggcttatttcta

SEQ ID NO: 2860289 - DNA, 14 bp, Homo sapiens
atctcaatgcaagc

SEQ ID NO: 2860290 - DNA, 19 bp, Homo sapiens
atctcattggacccttcca

SEQ ID NO: 2860291 - DNA, 12 bp, Homo sapiens
atctgaccatct

SEQ ID NO: 2860292 - DNA, 18 bp, Homo sapiens
atctgaccatctgtgact

SEQ ID NO: 2860293 - DNA, 19 bp, Homo sapiens
atctgaccatctgtgacta

SEQ ID NO: 2860294 - DNA, 20 bp, Homo sapiens
atctgaccatctgtgactat

SEQ ID NO: 2860295 - DNA, 18 bp, Homo sapiens
atctggctttttctgcca

SEQ ID NO: 2860296 - DNA, 14 bp, Homo sapiens
atctgtacaaaatg

SEQ ID NO: 2860297 - DNA, 13 bp, Homo sapiens
atctgtgactata

SEQ ID NO: 2860298 - DNA, 15 bp, Homo sapiens
atctgtgactataaa

SEQ ID NO: 2860299 - DNA, 20 bp, Homo sapiens
atctgtgactataaagctgt

SEQ ID NO: 2860300 - DNA, 21 bp, Homo sapiens
atctgtgactataaagctgtt

SEQ ID NO: 2860301 - DNA, 12 bp, Homo sapiens
atctgtgtcttg

SEQ ID NO: 2860302 - DNA, 14 bp, Homo sapiens
atctgttgacaaat

SEQ ID NO: 2860303 - DNA, 14 bp, Homo sapiens
atcttcaatatgaa

SEQ ID NO: 2860304 - DNA, 20 bp, Homo sapiens
atcttcaatatgaatctata

SEQ ID NO: 2860305 - DNA, 21 bp, Homo sapiens
atcttctttggacttctgaag

SEQ ID NO: 2860306 - DNA, 22 bp, Homo sapiens
atcttctttggacttctgaaga

SEQ ID NO: 2860307 - DNA, 14 bp, Homo sapiens
atcttgtctctggg

SEQ ID NO: 2860308 - DNA, 18 bp, Homo sapiens
atcttttttagtgttaaa

SEQ ID NO: 2860309 - DNA, 16 bp, Homo sapiens
atgaaaatgtcttgtg

SEQ ID NO: 2860310 - DNA, 14 bp, Homo sapiens
atgaacctgaaaag

SEQ ID NO: 2860311 - DNA, 20 bp, Homo sapiens
atgaactttgtcagtgttgc

SEQ ID NO: 2860312 - DNA, 14 bp, Homo sapiens
atgaagaaagtgga

SEQ ID NO: 2860313 - DNA, 14 bp, Homo sapiens
atgacaatcaaagc

SEQ ID NO: 2860314 - DNA, 20 bp, Homo sapiens
atgactgcatttgtgtgtgt

SEQ ID NO: 2860315 - DNA, 21 bp, Homo sapiens
atgagaatttgagtgctctga

SEQ ID NO: 2860316 - DNA, 19 bp, Homo sapiens
atgaggagcgtggactctg

SEQ ID NO: 2860317 - DNA, 15 bp, Homo sapiens
atgatgctttggaag

SEQ ID NO: 2860318 - DNA, 16 bp, Homo sapiens
atgatgctttggaaga

SEQ ID NO: 2860319 - DNA, 16 bp, Homo sapiens
atgattcagtgttaaa

SEQ ID NO: 2860320 - DNA, 19 bp, Homo sapiens
atgatttccctccagagaa

SEQ ID NO: 2860321 - DNA, 18 bp, Homo sapiens
atgcaatgcttcattatt

SEQ ID NO: 2860322 - DNA, 22 bp, Homo sapiens
atgcactgttccccctgtgcag

SEQ ID NO: 2860323 - DNA, 18 bp, Homo sapiens
atgcacttttagaaatgc

SEQ ID NO: 2860324 - DNA, 21 bp, Homo sapiens
atgcacttttagaaatgcata

SEQ ID NO: 2860325 - DNA, 22 bp, Homo sapiens
atgcacttttagaaatgcatat

SEQ ID NO: 2860326 - DNA, 14 bp, Homo sapiens
atgcatatttgcca

SEQ ID NO: 2860327 - DNA, 16 bp, Homo sapiens
atgccaaggagcccct

SEQ ID NO: 2860328 - DNA, 14 bp, Homo sapiens
atgccagagccaac

SEQ ID NO: 2860329 - DNA, 18 bp, Homo sapiens
atgctgatcttttaaaat

SEQ ID NO: 2860330 - DNA, 16 bp, Homo sapiens
atgctggactggaggc

SEQ ID NO: 2860331 - DNA, 20 bp, Homo sapiens
atgctggactggaggcccct

SEQ ID NO: 2860332 - DNA, 20 bp, Homo sapiens
atgcttcattattcaagaat

SEQ ID NO: 2860333 - DNA, 16 bp, Homo sapiens
atggaaaataaattat

SEQ ID NO: 2860334 - DNA, 13 bp, Homo sapiens
atggacacagacc

SEQ ID NO: 2860335 - DNA, 13 bp, Homo sapiens
atggagggagcca

SEQ ID NO: 2860336 - DNA, 15 bp, Homo sapiens
atggcagaaggcaaa

SEQ ID NO: 2860337 - DNA, 20 bp, Homo sapiens
atggcagaaggcaaacccat

SEQ ID NO: 2860338 - DNA, 21 bp, Homo sapiens
atggcagaaggcaaacccatc

SEQ ID NO: 2860339 - DNA, 16 bp, Homo sapiens
atggcatttctcttta

SEQ ID NO: 2860340 - DNA, 21 bp, Homo sapiens
atggccctcggaggtccagct

SEQ ID NO: 2860341 - DNA, 22 bp, Homo sapiens
atggccctcggaggtccagctg

SEQ ID NO: 2860342 - DNA, 23 bp, Homo sapiens
atggccctcggaggtccagctgg

SEQ ID NO: 2860343 - DNA, 13 bp, Homo sapiens
atggctgctgcct

SEQ ID NO: 2860344 - DNA, 15 bp, Homo sapiens
atggctgctgcctgc

SEQ ID NO: 2860345 - DNA, 16 bp, Homo sapiens
atggctgctgcctgct

SEQ ID NO: 2860346 - DNA, 20 bp, Homo sapiens
atggctgtgtttgcagcctg

SEQ ID NO: 2860347 - DNA, 21 bp, Homo sapiens
atggctgtgtttgcagcctgc

SEQ ID NO: 2860348 - DNA, 15 bp, Homo sapiens
atggcttatttctat

SEQ ID NO: 2860349 - DNA, 15 bp, Homo sapiens
atgggagccaggagt

SEQ ID NO: 2860350 - DNA, 17 bp, Homo sapiens
atgggagccgggtctgc

SEQ ID NO: 2860351 - DNA, 23 bp, Homo sapiens
atgggatattttgaaatgaactt

SEQ ID NO: 2860352 - DNA, 18 bp, Homo sapiens
atgggatggtggagggcc

SEQ ID NO: 2860353 - DNA, 15 bp, Homo sapiens
atgggattagaaaca

SEQ ID NO: 2860354 - DNA, 13 bp, Homo sapiens
atgggctgtgatt

SEQ ID NO: 2860355 - DNA, 12 bp, Homo sapiens
atggggggagaa

SEQ ID NO: 2860356 - DNA, 14 bp, Homo sapiens
atggggggagaagt

SEQ ID NO: 2860357 - DNA, 16 bp, Homo sapiens
atggtccaggagaagg

SEQ ID NO: 2860358 - DNA, 18 bp, Homo sapiens
atggtccaggagaaggcc

SEQ ID NO: 2860359 - DNA, 19 bp, Homo sapiens
atggtccaggagaaggcca

SEQ ID NO: 2860360 - DNA, 13 bp, Homo sapiens
atggtggagggcc

SEQ ID NO: 2860361 - DNA, 15 bp, Homo sapiens
agcgttctaaatatg

SEQ ID NO: 2860362 - DNA, 21 bp, Homo sapiens
agcgttctaaatatgaatgaa

SEQ ID NO: 2860363 - DNA, 16 bp, Homo sapiens
agctaagatagaaagc

SEQ ID NO: 2860364 - DNA, 22 bp, Homo sapiens
agctaagatagaaagctggact

SEQ ID NO: 2860365 - DNA, 16 bp, Homo sapiens
agctacttgggaggct

SEQ ID NO: 2860366 - DNA, 18 bp, Homo sapiens
agctatgttatattgaaa

SEQ ID NO: 2860367 - DNA, 17 bp, Homo sapiens
agctcaagcattctgtt

SEQ ID NO: 2860368 - DNA, 19 bp, Homo sapiens
agctccagaataccttctt

SEQ ID NO: 2860369 - DNA, 16 bp, Homo sapiens
agctctctaggcctct

SEQ ID NO: 2860370 - DNA, 23 bp, Homo sapiens
agctctgtatcaggacccagagg

SEQ ID NO: 2860371 - DNA, 14 bp, Homo sapiens
agctcttctcttcc

SEQ ID NO: 2860372 - DNA, 15 bp, Homo sapiens
agctcttctcttcct

SEQ ID NO: 2860373 - DNA, 14 bp, Homo sapiens
agctcttctttttt

SEQ ID NO: 2860374 - DNA, 17 bp, Homo sapiens
agctctttccaaattaa

SEQ ID NO: 2860375 - DNA, 23 bp, Homo sapiens
agctgacccagccccttgagaaa

SEQ ID NO: 2860376 - DNA, 19 bp, Homo sapiens
agctgaggctgagaaagct

SEQ ID NO: 2860377 - DNA, 17 bp, Homo sapiens
agctggactgaccaaag

SEQ ID NO: 2860378 - DNA, 21 bp, Homo sapiens
agctgggcctcctgcctccgg

SEQ ID NO: 2860379 - DNA, 14 bp, Homo sapiens
agctgtatcactgc

SEQ ID NO: 2860380 - DNA, 16 bp, Homo sapiens
agctgtcctgcagcaa

SEQ ID NO: 2860381 - DNA, 18 bp, Homo sapiens
agctgtgcaggtggggag

SEQ ID NO: 2860382 - DNA, 19 bp, Homo sapiens
agctgtgcaggtggggaga

SEQ ID NO: 2860383 - DNA, 12 bp, Homo sapiens
agctgttattct

SEQ ID NO: 2860384 - DNA, 13 bp, Homo sapiens
agctgttattctt

SEQ ID NO: 2860385 - DNA, 13 bp, Homo sapiens
agctgttgagctg

SEQ ID NO: 2860386 - DNA, 15 bp, Homo sapiens
agctgttgagctgtt

SEQ ID NO: 2860387 - DNA, 15 bp, Homo sapiens
agctgttttccctga

SEQ ID NO: 2860388 - DNA, 14 bp, Homo sapiens
agcttctctgggct

SEQ ID NO: 2860389 - DNA, 14 bp, Homo sapiens
agcttctctgtgaa

SEQ ID NO: 2860390 - DNA, 12 bp, Homo sapiens
agcttgagcctc

SEQ ID NO: 2860391 - DNA, 13 bp, Homo sapiens
agcttgaggccaa

SEQ ID NO: 2860392 - DNA, 15 bp, Homo sapiens
agcttgaggccaaga

SEQ ID NO: 2860393 - DNA, 16 bp, Homo sapiens
agcttgttatttataa

SEQ ID NO: 2860394 - DNA, 21 bp, Homo sapiens
aggaaaaatgggagccaggag

SEQ ID NO: 2860395 - DNA, 14 bp, Homo sapiens
aggaaacattttat

SEQ ID NO: 2860396 - DNA, 22 bp, Homo sapiens
aggaaacccaaggaacaagaga

SEQ ID NO: 2860397 - DNA, 19 bp, Homo sapiens
aggaaatgaaaatgtcttg

SEQ ID NO: 2860398 - DNA, 23 bp, Homo sapiens
aggaacaagagaaaaaactagag

SEQ ID NO: 2860399 - DNA, 19 bp, Homo sapiens
aggaactgggtgactggag

SEQ ID NO: 2860400 - DNA, 20 bp, Homo sapiens
aggaaggggccagaggctcg

SEQ ID NO: 2860401 - DNA, 15 bp, Homo sapiens
aggaagtaggaagta

SEQ ID NO: 2860402 - DNA, 23 bp, Homo sapiens
aggaagtcagaatttttaactgt

SEQ ID NO: 2860403 - DNA, 13 bp, Homo sapiens
aggacccagagga

SEQ ID NO: 2860404 - DNA, 17 bp, Homo sapiens
aggactcccaaccctgg

SEQ ID NO: 2860405 - DNA, 17 bp, Homo sapiens
aggagacagaaagcctc

SEQ ID NO: 2860406 - DNA, 16 bp, Homo sapiens
aggagagacccctccc

SEQ ID NO: 2860407 - DNA, 19 bp, Homo sapiens
aggagagacccctcccctc

SEQ ID NO: 2860408 - DNA, 23 bp, Homo sapiens
aggagagacccctcccctcccac

SEQ ID NO: 2860409 - DNA, 17 bp, Homo sapiens
aggagatgctccttggg

SEQ ID NO: 2860410 - DNA, 18 bp, Homo sapiens
aggagccccattcctggg

SEQ ID NO: 2860411 - DNA, 13 bp, Homo sapiens
aggagcgtggact

SEQ ID NO: 2860412 - DNA, 14 bp, Homo sapiens
aggagcgtggactc

SEQ ID NO: 2860413 - DNA, 16 bp, Homo sapiens
aggagcgtggactctg

SEQ ID NO: 2860414 - DNA, 19 bp, Homo sapiens
aggaggctccagagggcac

SEQ ID NO: 2860415 - DNA, 17 bp, Homo sapiens
aggagtaagacaagtgg

SEQ ID NO: 2860416 - DNA, 18 bp, Homo sapiens
aggagtaagacaagtggg

SEQ ID NO: 2860417 - DNA, 22 bp, Homo sapiens
aggataagaaagcctaaaattg

SEQ ID NO: 2860418 - DNA, 20 bp, Homo sapiens
aggatagtagttaaataact

SEQ ID NO: 2860419 - DNA, 12 bp, Homo sapiens
aggatccagaga

SEQ ID NO: 2860420 - DNA, 19 bp, Homo sapiens
aggatgcccagacatcagc

SEQ ID NO: 2860421 - DNA, 22 bp, Homo sapiens
aggcaaggtttacactgcggaa

SEQ ID NO: 2860422 - DNA, 14 bp, Homo sapiens
aggccaagatggct

SEQ ID NO: 2860423 - DNA, 23 bp, Homo sapiens
aggccaagatggctgctgcctgc

SEQ ID NO: 2860424 - DNA, 21 bp, Homo sapiens
aggccacagaaggtgaacttt

SEQ ID NO: 2860425 - DNA, 13 bp, Homo sapiens
aggccagcaacgc

SEQ ID NO: 2860426 - DNA, 14 bp, Homo sapiens
aggccagcaacgct

SEQ ID NO: 2860427 - DNA, 17 bp, Homo sapiens
aggccagcaacgcttgt

SEQ ID NO: 2860428 - DNA, 13 bp, Homo sapiens
aggccattattgt

SEQ ID NO: 2860429 - DNA, 11 bp, Homo sapiens
aggccttcatc

SEQ ID NO: 2860430 - DNA, 22 bp, Homo sapiens
aggccttcatcctcctccccag

SEQ ID NO: 2860431 - DNA, 21 bp, Homo sapiens
aggctcacccccttctccatc

SEQ ID NO: 2860432 - DNA, 23 bp, Homo sapiens
aggctcacccccttctccatcca

SEQ ID NO: 2860433 - DNA, 15 bp, Homo sapiens
aggctccagagggca

SEQ ID NO: 2860434 - DNA, 18 bp, Homo sapiens
aggctgaggcaagagaat

SEQ ID NO: 2860435 - DNA, 24 bp, Homo sapiens
aggctgcacctctggctagagccg

SEQ ID NO: 2860436 - DNA, 11 bp, Homo sapiens
aggctgtgttt

SEQ ID NO: 2860437 - DNA, 17 bp, Homo sapiens
aggctgtgtttagattg

SEQ ID NO: 2860438 - DNA, 21 bp, Homo sapiens
agggaataataggccacagaa

SEQ ID NO: 2860439 - DNA, 14 bp, Homo sapiens
agggacaagggatt

SEQ ID NO: 2860440 - DNA, 21 bp, Homo sapiens
agggacaagggattctgggaa

SEQ ID NO: 2860441 - DNA, 17 bp, Homo sapiens
agggactcaagggaaag

SEQ ID NO: 2860442 - DNA, 23 bp, Homo sapiens
agggactcaagggaaaggcaagc

SEQ ID NO: 2860443 - DNA, 16 bp, Homo sapiens
agggacttgtttagag

SEQ ID NO: 2860444 - DNA, 18 bp, Homo sapiens
agggagccatcccttccc

SEQ ID NO: 2860445 - DNA, 19 bp, Homo sapiens
agggagttttaaagaaatt

SEQ ID NO: 2860446 - DNA, 22 bp, Homo sapiens
agggatccctcatctgtccctc

SEQ ID NO: 2860447 - DNA, 21 bp, Homo sapiens
agggattctggtcttcactgc

SEQ ID NO: 2860448 - DNA, 22 bp, Homo sapiens
agggattctggtcttcactgcc

SEQ ID NO: 2860449 - DNA, 13 bp, Homo sapiens
agggcactgggct

SEQ ID NO: 2860450 - DNA, 14 bp, Homo sapiens
agggcactgggctg

SEQ ID NO: 2860451 - DNA, 14 bp, Homo sapiens
agggcagcagggct

SEQ ID NO: 2860452 - DNA, 15 bp, Homo sapiens
agggcagcagggcta

SEQ ID NO: 2860453 - DNA, 20 bp, Homo sapiens
agggccacatgggaggctca

SEQ ID NO: 2860454 - DNA, 18 bp, Homo sapiens
agggctttgttttgcaca

SEQ ID NO: 2860455 - DNA, 18 bp, Homo sapiens
aggggaagtaaaacagtc

SEQ ID NO: 2860456 - DNA, 16 bp, Homo sapiens
aggggagagagggact

SEQ ID NO: 2860457 - DNA, 15 bp, Homo sapiens
aggggccagaggctc

SEQ ID NO: 2860458 - DNA, 21 bp, Homo sapiens
aggggccttagggcactgggc

SEQ ID NO: 2860459 - DNA, 22 bp, Homo sapiens
aggggccttagggcactgggct

SEQ ID NO: 2860460 - DNA, 17 bp, Homo sapiens
agggggattggagggaa

SEQ ID NO: 2860461 - DNA, 20 bp, Homo sapiens
agggggcccgaacagggact

SEQ ID NO: 2860462 - DNA, 12 bp, Homo sapiens
agggggtggggg

SEQ ID NO: 2860463 - DNA, 19 bp, Homo sapiens
agggggtggttattggact

SEQ ID NO: 2860464 - DNA, 15 bp, Homo sapiens
aggggtgggagagcc

SEQ ID NO: 2860465 - DNA, 18 bp, Homo sapiens
aggggtgggagagccagc

SEQ ID NO: 2860466 - DNA, 21 bp, Homo sapiens
aggggttccttccacttctgg

SEQ ID NO: 2860467 - DNA, 18 bp, Homo sapiens
agggtgggccactctccc

SEQ ID NO: 2860468 - DNA, 20 bp, Homo sapiens
agggtggtctgagcaccccc

SEQ ID NO: 2860469 - DNA, 18 bp, Homo sapiens
agggttgaccccagagga

SEQ ID NO: 2860470 - DNA, 15 bp, Homo sapiens
aggtcaggagttcct

SEQ ID NO: 2860471 - DNA, 14 bp, Homo sapiens
gaggtccagctggg

SEQ ID NO: 2860472 - DNA, 23 bp, Homo sapiens
gcatttgtgtgtgtgtgtgtgtt

SEQ ID NO: 2860473 - DNA, 22 bp, Homo sapiens
ctttatatttcaataaatgata

SEQ ID NO: 2860474 - DNA, 21 bp, Homo sapiens
ctttcatgtaaactgtgcacc

SEQ ID NO: 2860475 - DNA, 10 bp, Homo sapiens
ctttccaaat

SEQ ID NO: 2860476 - DNA, 22 bp, Homo sapiens
ctttccacggagccactcctct

SEQ ID NO: 2860477 - DNA, 20 bp, Homo sapiens
ctttcctccccaccttcccc

SEQ ID NO: 2860478 - DNA, 17 bp, Homo sapiens
ctttctatttttatgat

SEQ ID NO: 2860479 - DNA, 14 bp, Homo sapiens
catgatactccact

SEQ ID NO: 2860480 - DNA, 21 bp, Homo sapiens
catgattatagcaactaatgt

SEQ ID NO: 2860481 - DNA, 23 bp, Homo sapiens
catgatttccctccagagaaagc

SEQ ID NO: 2860482 - DNA, 19 bp, Homo sapiens
catgcactgttccccctgt

SEQ ID NO: 2860483 - DNA, 20 bp, Homo sapiens
catgccctgccttgtccctc

SEQ ID NO: 2860484 - DNA, 16 bp, Homo sapiens
catgcctcaagaacac

SEQ ID NO: 2860485 - DNA, 15 bp, Homo sapiens
catggccctcggagg

SEQ ID NO: 2860486 - DNA, 17 bp, Homo sapiens
catggctgtgtttgcag

SEQ ID NO: 2860487 - DNA, 22 bp, Homo sapiens
catgggagccgggtctgcctct

SEQ ID NO: 2860488 - DNA, 11 bp, Homo sapiens
catggggggag

SEQ ID NO: 2860489 - DNA, 16 bp, Homo sapiens
catggtcagccctagg

SEQ ID NO: 2860490 - DNA, 21 bp, Homo sapiens
catggtgggtccatgggcaga

SEQ ID NO: 2860491 - DNA, 19 bp, Homo sapiens
catgtacaaaaattatgca

SEQ ID NO: 2860492 - DNA, 21 bp, Homo sapiens
catgtacaaaaattatgcaat

SEQ ID NO: 2860493 - DNA, 15 bp, Homo sapiens
catgtggccccaccc

SEQ ID NO: 2860494 - DNA, 16 bp, Homo sapiens
catgttcccaaaacaa

SEQ ID NO: 2860495 - DNA, 15 bp, Homo sapiens
catgtttacagaact

SEQ ID NO: 2860496 - DNA, 13 bp, Homo sapiens
cattaaaaattac

SEQ ID NO: 2860497 - DNA, 11 bp, Homo sapiens
cattaactgtt

SEQ ID NO: 2860498 - DNA, 14 bp, Homo sapiens
cattaactgttgca

SEQ ID NO: 2860499 - DNA, 20 bp, Homo sapiens
cattaggccagcaacgcttg

SEQ ID NO: 2860500 - DNA, 16 bp, Homo sapiens
cattatctttgctgtt

SEQ ID NO: 2860501 - DNA, 17 bp, Homo sapiens
cattatctttgctgtta

SEQ ID NO: 2860502 - DNA, 21 bp, Homo sapiens
cattatgcacttttagaaatg

SEQ ID NO: 2860503 - DNA, 19 bp, Homo sapiens
caaactagggccaagccca

SEQ ID NO: 2860504 - DNA, 22 bp, Homo sapiens
caaagagaaagagtttgaaact

SEQ ID NO: 2860505 - DNA, 20 bp, Homo sapiens
caaagcaatgtgagtcccag

SEQ ID NO: 2860506 - DNA, 23 bp, Homo sapiens
caaagccagcgtcctcctctgtg

SEQ ID NO: 2860507 - DNA, 15 bp, Homo sapiens
caaaggcaagcactt

SEQ ID NO: 2860508 - DNA, 14 bp, Homo sapiens
caaagtggggaggg

SEQ ID NO: 2860509 - DNA, 15 bp, Homo sapiens
caaataaaatatcat

SEQ ID NO: 2860510 - DNA, 16 bp, Homo sapiens
caaataatttgaactt

SEQ ID NO: 2860511 - DNA, 12 bp, Homo sapiens
caaatgaagaaa

SEQ ID NO: 2860512 - DNA, 15 bp, Homo sapiens
caaatgaagaaagtc

SEQ ID NO: 2860513 - DNA, 16 bp, Homo sapiens
caaatgacagatcttt

SEQ ID NO: 2860514 - DNA, 20 bp, Homo sapiens
caaattgccctatgctgtgc

SEQ ID NO: 2860515 - DNA, 21 bp, Homo sapiens
caaattggagcttcatggcag

SEQ ID NO: 2860516 - DNA, 18 bp, Homo sapiens
caacaatttctactttga

SEQ ID NO: 2860517 - DNA, 17 bp, Homo sapiens
caacactgtccttccct

SEQ ID NO: 2860518 - DNA, 21 bp, Homo sapiens
caacactgtccttccctgcca

SEQ ID NO: 2860519 - DNA, 18 bp, Homo sapiens
caaccaggccttcatcct

SEQ ID NO: 2860520 - DNA, 21 bp, Homo sapiens
caacctgcctgacatttggag

SEQ ID NO: 2860521 - DNA, 14 bp, Homo sapiens
caacctggacttcc

SEQ ID NO: 2860522 - DNA, 14 bp, Homo sapiens
caaccttgtttaat

SEQ ID NO: 2860523 - DNA, 13 bp, Homo sapiens
caactctttgaga

SEQ ID NO: 2860524 - DNA, 15 bp, Homo sapiens
caactctttgagaaa

SEQ ID NO: 2860525 - DNA, 15 bp, Homo sapiens
caactttttcatagt

SEQ ID NO: 2860526 - DNA, 13 bp, Homo sapiens
caagaaacagaag

SEQ ID NO: 2860527 - DNA, 17 bp, Homo sapiens
caagaaacagaagtaga

SEQ ID NO: 2860528 - DNA, 18 bp, Homo sapiens
caagaaacagaagtagaa

SEQ ID NO: 2860529 - DNA, 12 bp, Homo sapiens
caagaaacagcc

SEQ ID NO: 2860530 - DNA, 14 bp, Homo sapiens
caagaaacagccag

SEQ ID NO: 2860531 - DNA, 16 bp, Homo sapiens
caagaaacagccagca

SEQ ID NO: 2860532 - DNA, 19 bp, Homo sapiens
caagaaacagccagcaaga

SEQ ID NO: 2860533 - DNA, 22 bp, Homo sapiens
caagaaatatactctcccagat

SEQ ID NO: 2860534 - DNA, 22 bp, Homo sapiens
caagagaattgcttgaacccag

SEQ ID NO: 2860535 - DNA, 17 bp, Homo sapiens
caagagggacgcctggg

SEQ ID NO: 2860536 - DNA, 16 bp, Homo sapiens
caagatggctgctgcc

SEQ ID NO: 2860537 - DNA, 18 bp, Homo sapiens
caagatggctgctgcctg

SEQ ID NO: 2860538 - DNA, 17 bp, Homo sapiens
caagcaggaaatgaaaa

SEQ ID NO: 2860539 - DNA, 23 bp, Homo sapiens
caagccagagtttttaaagcctt

SEQ ID NO: 2860540 - DNA, 21 bp, Homo sapiens
caagcctgaccacgctttcta

SEQ ID NO: 2860541 - DNA, 15 bp, Homo sapiens
caaggaacaagagaa

SEQ ID NO: 2860542 - DNA, 15 bp, Homo sapiens
caagggaaaagtctc

SEQ ID NO: 2860543 - DNA, 12 bp, Homo sapiens
caagggattctg

SEQ ID NO: 2860544 - DNA, 15 bp, Homo sapiens
caagggattctggga

SEQ ID NO: 2860545 - DNA, 17 bp, Homo sapiens
caagggattctgggaag

SEQ ID NO: 2860546 - DNA, 18 bp, Homo sapiens
caaggtttacactgcgga

SEQ ID NO: 2860547 - DNA, 21 bp, Homo sapiens
caaggtttacactgcggaagc

SEQ ID NO: 2860548 - DNA, 12 bp, Homo sapiens
caataaacagtc

SEQ ID NO: 2860549 - DNA, 13 bp, Homo sapiens
caataaacagtca

SEQ ID NO: 2860550 - DNA, 21 bp, Homo sapiens
caataataagtgatgtgctga

SEQ ID NO: 2860551 - DNA, 15 bp, Homo sapiens
caataattgaagtgt

SEQ ID NO: 2860552 - DNA, 12 bp, Homo sapiens
caatatatgtat

SEQ ID NO: 2860553 - DNA, 20 bp, Homo sapiens
caatatatgtattttttgaa

SEQ ID NO: 2860554 - DNA, 17 bp, Homo sapiens
caatatgtatatatgta

SEQ ID NO: 2860555 - DNA, 14 bp, Homo sapiens
caatattataattt

SEQ ID NO: 2860556 - DNA, 22 bp, Homo sapiens
caatattataatttttttcaat

SEQ ID NO: 2860557 - DNA, 13 bp, Homo sapiens
caatatttattat

SEQ ID NO: 2860558 - DNA, 15 bp, Homo sapiens
caatccatccatgta

SEQ ID NO: 2860559 - DNA, 17 bp, Homo sapiens
caatctgtacaaaatgg

SEQ ID NO: 2860560 - DNA, 21 bp, Homo sapiens
caatcttggggctgatgaaga

SEQ ID NO: 2860561 - DNA, 12 bp, Homo sapiens
caatgccttggg

SEQ ID NO: 2860562 - DNA, 16 bp, Homo sapiens
caattaaaaacgaaaa

SEQ ID NO: 2860563 - DNA, 17 bp, Homo sapiens
caattagacttgaaata

SEQ ID NO: 2860564 - DNA, 13 bp, Homo sapiens
caattccaggctg

SEQ ID NO: 2860565 - DNA, 14 bp, Homo sapiens
caattccaggctga

SEQ ID NO: 2860566 - DNA, 20 bp, Homo sapiens
caattccaggctgagccatg

SEQ ID NO: 2860567 - DNA, 13 bp, Homo sapiens
caattcctctggg

SEQ ID NO: 2860568 - DNA, 22 bp, Homo sapiens
caattgacataggcaataataa

SEQ ID NO: 2860569 - DNA, 20 bp, Homo sapiens
cacaatctgggactttcact

SEQ ID NO: 2860570 - DNA, 17 bp, Homo sapiens
cacaccaaccaggcctt

SEQ ID NO: 2860571 - DNA, 19 bp, Homo sapiens
cacagaaggtgaactttgt

SEQ ID NO: 2860572 - DNA, 20 bp, Homo sapiens
cacagaaggtgaactttgtg

SEQ ID NO: 2860573 - DNA, 17 bp, Homo sapiens
cacaggacatttctcta

SEQ ID NO: 2860574 - DNA, 17 bp, Homo sapiens
cacaggcacattaactg

SEQ ID NO: 2860575 - DNA, 17 bp, Homo sapiens
cacatctgtgtcttgtt

SEQ ID NO: 2860576 - DNA, 16 bp, Homo sapiens
cacatggacacagacc

SEQ ID NO: 2860577 - DNA, 22 bp, Homo sapiens
cacatggggcctggcccacgcc

SEQ ID NO: 2860578 - DNA, 15 bp, Homo sapiens
cacattaactgttgc

SEQ ID NO: 2860579 - DNA, 16 bp, Homo sapiens
cacattaactgttgca

SEQ ID NO: 2860580 - DNA, 16 bp, Homo sapiens
cacattcttcagtttt

SEQ ID NO: 2860581 - DNA, 15 bp, Homo sapiens
caccaaccaggcctt

SEQ ID NO: 2860582 - DNA, 19 bp, Homo sapiens
caccaaccaggccttcatc

SEQ ID NO: 2860583 - DNA, 21 bp, Homo sapiens
caccaaccaggccttcatcct

SEQ ID NO: 2860584 - DNA, 21 bp, Homo sapiens
caccaagcaggaaatgaaaat

SEQ ID NO: 2860585 - DNA, 17 bp, Homo sapiens
ggctccctgactgggag

SEQ ID NO: 2860586 - DNA, 20 bp, Homo sapiens
ggctccctgtaacctcttca

SEQ ID NO: 2860587 - DNA, 21 bp, Homo sapiens
ggctccctgtaacctcttcag

SEQ ID NO: 2860588 - DNA, 15 bp, Homo sapiens
ggctctcagaggaaa

SEQ ID NO: 2860589 - DNA, 14 bp, Homo sapiens
ggctgagccatgag

SEQ ID NO: 2860590 - DNA, 15 bp, Homo sapiens
ggctgagccatgagg

SEQ ID NO: 2860591 - DNA, 16 bp, Homo sapiens
ggctgagggagcctgg

SEQ ID NO: 2860592 - DNA, 13 bp, Homo sapiens
ggcttatttctat

SEQ ID NO: 2860593 - DNA, 19 bp, Homo sapiens
ggcttatttctatgacaaa

SEQ ID NO: 2860594 - DNA, 18 bp, Homo sapiens
ggcttcattccggactgg

SEQ ID NO: 2860595 - DNA, 19 bp, Homo sapiens
ggcttcattccggactggc

SEQ ID NO: 2860596 - DNA, 21 bp, Homo sapiens
ggcttcattccggactggcag

SEQ ID NO: 2860597 - DNA, 17 bp, Homo sapiens
ggcttgggggaaaagag

SEQ ID NO: 2860598 - DNA, 19 bp, Homo sapiens
gggaaattattatgactca

SEQ ID NO: 2860599 - DNA, 20 bp, Homo sapiens
gggaagacaggtctagactt

SEQ ID NO: 2860600 - DNA, 14 bp, Homo sapiens
gggaagctggggga

SEQ ID NO: 2860601 - DNA, 18 bp, Homo sapiens
gggaagctgggggaaggg

SEQ ID NO: 2860602 - DNA, 18 bp, Homo sapiens
gggaagcttgagcctccc

SEQ ID NO: 2860603 - DNA, 19 bp, Homo sapiens
gggacaagggattctggga

SEQ ID NO: 2860604 - DNA, 17 bp, Homo sapiens
gggacaccagggaagaa

SEQ ID NO: 2860605 - DNA, 16 bp, Homo sapiens
gggacagcccagagcc

SEQ ID NO: 2860606 - DNA, 21 bp, Homo sapiens
gggacgcctgggggtgccagg

SEQ ID NO: 2860607 - DNA, 21 bp, Homo sapiens
gggagaagtgatatggtgaag

SEQ ID NO: 2860608 - DNA, 19 bp, Homo sapiens
gggagactgggctgaggga

SEQ ID NO: 2860609 - DNA, 14 bp, Homo sapiens
gggagagccagctc

SEQ ID NO: 2860610 - DNA, 13 bp, Homo sapiens
gggagggcagcag

SEQ ID NO: 2860611 - DNA, 16 bp, Homo sapiens
gggatattttgaaatg

SEQ ID NO: 2860612 - DNA, 18 bp, Homo sapiens
gggatggtggagggccac

SEQ ID NO: 2860613 - DNA, 11 bp, Homo sapiens
gggattctggg

SEQ ID NO: 2860614 - DNA, 19 bp, Homo sapiens
gggattctggtcttcactg

SEQ ID NO: 2860615 - DNA, 17 bp, Homo sapiens
gggcagagtgagaccca

SEQ ID NO: 2860616 - DNA, 17 bp, Homo sapiens
gggcagtcattatccag

SEQ ID NO: 2860617 - DNA, 13 bp, Homo sapiens
gggccaagcccag

SEQ ID NO: 2860618 - DNA, 12 bp, Homo sapiens
gggccagaggct

SEQ ID NO: 2860619 - DNA, 24 bp, Homo sapiens
gggcccacaatggagtgggagatc

SEQ ID NO: 2860620 - DNA, 16 bp, Homo sapiens
gggccctctctgctct

SEQ ID NO: 2860621 - DNA, 22 bp, Homo sapiens
gggcctcctgcctccgggcagg

SEQ ID NO: 2860622 - DNA, 17 bp, Homo sapiens
gggccttagggcactgg

SEQ ID NO: 2860623 - DNA, 21 bp, Homo sapiens
gggccttagggcactgggctg

SEQ ID NO: 2860624 - DNA, 16 bp, Homo sapiens
gggctaccctgagctg

SEQ ID NO: 2860625 - DNA, 14 bp, Homo sapiens
gggctgatgaagaa

SEQ ID NO: 2860626 - DNA, 20 bp, Homo sapiens
gggctgatgaagaagggggt

SEQ ID NO: 2860627 - DNA, 15 bp, Homo sapiens
ggggagattgaactt

SEQ ID NO: 2860628 - DNA, 14 bp, Homo sapiens
ggggccacctctgg

SEQ ID NO: 2860629 - DNA, 12 bp, Homo sapiens
ggggccagaggc

SEQ ID NO: 2860630 - DNA, 12 bp, Homo sapiens
ggggctctggga

SEQ ID NO: 2860631 - DNA, 16 bp, Homo sapiens
ggggctgatgaagaag

SEQ ID NO: 2860632 - DNA, 20 bp, Homo sapiens
ggggcttgcccactgcctgc

SEQ ID NO: 2860633 - DNA, 22 bp, Homo sapiens
ggggcttgcccactgcctgcct

SEQ ID NO: 2860634 - DNA, 19 bp, Homo sapiens
gggtcagacgcctgaggaa

SEQ ID NO: 2860635 - DNA, 12 bp, Homo sapiens
gggtccatgggc

SEQ ID NO: 2860636 - DNA, 16 bp, Homo sapiens
gggtgggagagccagc

SEQ ID NO: 2860637 - DNA, 16 bp, Homo sapiens
gggtggtctgagcacc

SEQ ID NO: 2860638 - DNA, 21 bp, Homo sapiens
gggtggttattggactccagg

SEQ ID NO: 2860639 - DNA, 16 bp, Homo sapiens
ggtagaattgggaagc

SEQ ID NO: 2860640 - DNA, 18 bp, Homo sapiens
ggtagaattgggaagctg

SEQ ID NO: 2860641 - DNA, 18 bp, Homo sapiens
ggtaggttgggacaccag

SEQ ID NO: 2860642 - DNA, 13 bp, Homo sapiens
ggtatgagggggt

SEQ ID NO: 2860643 - DNA, 19 bp, Homo sapiens
ggtcaacatggtgaaaccc

SEQ ID NO: 2860644 - DNA, 14 bp, Homo sapiens
ggtcaagaaacagc

SEQ ID NO: 2860645 - DNA, 21 bp, Homo sapiens
ggtcaggagttcctaaccagc

SEQ ID NO: 2860646 - DNA, 12 bp, Homo sapiens
ggtcataaaata

SEQ ID NO: 2860647 - DNA, 13 bp, Homo sapiens
ggtccatgggcag

SEQ ID NO: 2860648 - DNA, 16 bp, Homo sapiens
ggtccatgggcagagc

SEQ ID NO: 2860649 - DNA, 21 bp, Homo sapiens
ggtctaccaatacaaaatgta

SEQ ID NO: 2860650 - DNA, 23 bp, Homo sapiens
ggtctgcctcttctgggagggca

SEQ ID NO: 2860651 - DNA, 12 bp, Homo sapiens
ggtgaactttgt

SEQ ID NO: 2860652 - DNA, 20 bp, Homo sapiens
ggtgaagggaagtggggagt

SEQ ID NO: 2860653 - DNA, 23 bp, Homo sapiens
ggtgctacacccttttccagctg

SEQ ID NO: 2860654 - DNA, 13 bp, Homo sapiens
ggtggagggccac

SEQ ID NO: 2860655 - DNA, 18 bp, Homo sapiens
ggtggattcctgggcaag

SEQ ID NO: 2860656 - DNA, 22 bp, Homo sapiens
ggtggattcctgggcaagaacc

SEQ ID NO: 2860657 - DNA, 12 bp, Homo sapiens
ggtgggccactc

SEQ ID NO: 2860658 - DNA, 21 bp, Homo sapiens
ggtggttattggactccaggc

SEQ ID NO: 2860659 - DNA, 22 bp, Homo sapiens
ggtggttattggactccaggcc

SEQ ID NO: 2860660 - DNA, 16 bp, Homo sapiens
ggtgtgcaccagggtt

SEQ ID NO: 2860661 - DNA, 13 bp, Homo sapiens
ggtgttgaatcca

SEQ ID NO: 2860662 - DNA, 15 bp, Homo sapiens
ggttccgcttggagc

SEQ ID NO: 2860663 - DNA, 12 bp, Homo sapiens
ggttctctttga

SEQ ID NO: 2860664 - DNA, 20 bp, Homo sapiens
ggttctgcagcggcagagca

SEQ ID NO: 2860665 - DNA, 17 bp, Homo sapiens
ggttttgtattctctga

SEQ ID NO: 2860666 - DNA, 19 bp, Homo sapiens
ggttttgtattctctgagc

SEQ ID NO: 2860667 - DNA, 23 bp, Homo sapiens
gtaaaatccccttcgctgaaatt

SEQ ID NO: 2860668 - DNA, 15 bp, Homo sapiens
gtaaatcagaaagta

SEQ ID NO: 2860669 - DNA, 18 bp, Homo sapiens
gtaaatcagaaagtaaca

SEQ ID NO: 2860670 - DNA, 22 bp, Homo sapiens
gtaaatctaactacaaggacaa

SEQ ID NO: 2860671 - DNA, 18 bp, Homo sapiens
gtaaatgaagatctttat

SEQ ID NO: 2860672 - DNA, 15 bp, Homo sapiens
gtaacatccaagcca

SEQ ID NO: 2860673 - DNA, 16 bp, Homo sapiens
gtaaccagctcagtgt

SEQ ID NO: 2860674 - DNA, 16 bp, Homo sapiens
gtaagacaagtgggat

SEQ ID NO: 2860675 - DNA, 14 bp, Homo sapiens
gtaagtgtaaaaaa

SEQ ID NO: 2860676 - DNA, 15 bp, Homo sapiens
gtaatagctttagtg

SEQ ID NO: 2860677 - DNA, 18 bp, Homo sapiens
gtaatattttactttgag

SEQ ID NO: 2860678 - DNA, 20 bp, Homo sapiens
gtaatcccagctacttggga

SEQ ID NO: 2860679 - DNA, 15 bp, Homo sapiens
gtaatctcaatgcaa

SEQ ID NO: 2860680 - DNA, 16 bp, Homo sapiens
gtaatgctaaatgtgt

SEQ ID NO: 2860681 - DNA, 16 bp, Homo sapiens
gtacaaaatggtccta

SEQ ID NO: 2860682 - DNA, 22 bp, Homo sapiens
gtacttgccttattagagtgtc

SEQ ID NO: 2860683 - DNA, 15 bp, Homo sapiens
gtagaaactgcaggg

SEQ ID NO: 2860684 - DNA, 22 bp, Homo sapiens
gtagaactcactctgggctgta

SEQ ID NO: 2860685 - DNA, 20 bp, Homo sapiens
gtagaactttattaagtaaa

SEQ ID NO: 2860686 - DNA, 14 bp, Homo sapiens
gtagagccaattag

SEQ ID NO: 2860687 - DNA, 15 bp, Homo sapiens
gtagcatctcagtgg

SEQ ID NO: 2860688 - DNA, 19 bp, Homo sapiens
gtaggttgggacaccaggg

SEQ ID NO: 2860689 - DNA, 19 bp, Homo sapiens
gtagtgttgtccaggaagt

SEQ ID NO: 2860690 - DNA, 14 bp, Homo sapiens
gtagttaaataact

SEQ ID NO: 2860691 - DNA, 14 bp, Homo sapiens
gtataatcacagtt

SEQ ID NO: 2860692 - DNA, 16 bp, Homo sapiens
gtatatgactgcattt

SEQ ID NO: 2860693 - DNA, 20 bp, Homo sapiens
gtatatgactgcatttgtgt

SEQ ID NO: 2860694 - DNA, 18 bp, Homo sapiens
gtatattacccaatggaa

SEQ ID NO: 2860695 - DNA, 23 bp, Homo sapiens
gtatgtcagtgctataaatgcca

SEQ ID NO: 2860696 - DNA, 14 bp, Homo sapiens
gttccctttttcat

SEQ ID NO: 2860697 - DNA, 19 bp, Homo sapiens
gttctaagtctttccattg

SEQ ID NO: 2860698 - DNA, 16 bp, Homo sapiens
gttctgcagcggcaga

SEQ ID NO: 2860699 - DNA, 18 bp, Homo sapiens
gttctgcagcggcagagc

SEQ ID NO: 2860700 - DNA, 20 bp, Homo sapiens
gttctgcagcggcagagcaa

SEQ ID NO: 2860701 - DNA, 15 bp, Homo sapiens
gttctgctcatcatt

SEQ ID NO: 2860702 - DNA, 19 bp, Homo sapiens
gttgaatccagcacgtctg

SEQ ID NO: 2860703 - DNA, 15 bp, Homo sapiens
gttgaccccagagga

SEQ ID NO: 2860704 - DNA, 16 bp, Homo sapiens
gttgagaggaggactt

SEQ ID NO: 2860705 - DNA, 18 bp, Homo sapiens
gttgagaggaggacttgg

SEQ ID NO: 2860706 - DNA, 13 bp, Homo sapiens
gttgagctgtttt

SEQ ID NO: 2860707 - DNA, 15 bp, Homo sapiens
gttgcacttttgaat

SEQ ID NO: 2860708 - DNA, 17 bp, Homo sapiens
gttgcacttttgaatgt

SEQ ID NO: 2860709 - DNA, 22 bp, Homo sapiens
gttgcacttttgaatgtccaaa

SEQ ID NO: 2860710 - DNA, 15 bp, Homo sapiens
gttgcagtgagctga

SEQ ID NO: 2860711 - DNA, 16 bp, Homo sapiens
gttgcctcttgcaatg

SEQ ID NO: 2860712 - DNA, 15 bp, Homo sapiens
gttgttggtctgtgt

SEQ ID NO: 2860713 - DNA, 14 bp, Homo sapiens
gttgttgttgctgc

SEQ ID NO: 2860714 - DNA, 22 bp, Homo sapiens
gtttactagggatccctcatct

SEQ ID NO: 2860715 - DNA, 21 bp, Homo sapiens
gtttatatttttttaactgtg

SEQ ID NO: 2860716 - DNA, 23 bp, Homo sapiens
gtttatatttttttaactgtgat

SEQ ID NO: 2860717 - DNA, 16 bp, Homo sapiens
gtttctctataaagta

SEQ ID NO: 2860718 - DNA, 13 bp, Homo sapiens
gtttgtcagcatc

SEQ ID NO: 2860719 - DNA, 17 bp, Homo sapiens
gtttgtcagcatctgac

SEQ ID NO: 2860720 - DNA, 20 bp, Homo sapiens
gtttgtgttgttgttgctgc

SEQ ID NO: 2860721 - DNA, 21 bp, Homo sapiens
gtttgtgttgttgttgctgct

SEQ ID NO: 2860722 - DNA, 20 bp, Homo sapiens
gttttaaaacgtgtaaatga

SEQ ID NO: 2860723 - DNA, 19 bp, Homo sapiens
gttttaaagaaattttagt

SEQ ID NO: 2860724 - DNA, 14 bp, Homo sapiens
gtttttcacttcta

SEQ ID NO: 2860725 - DNA, 12 bp, Homo sapiens
taaaaaatgtct

SEQ ID NO: 2860726 - DNA, 12 bp, Homo sapiens
taaaaagaaaga

SEQ ID NO: 2860727 - DNA, 17 bp, Homo sapiens
taaaaataaatttggtt

SEQ ID NO: 2860728 - DNA, 11 bp, Homo sapiens
taaaacaaata

SEQ ID NO: 2860729 - DNA, 19 bp, Homo sapiens
taaaacaaatatacatttt

SEQ ID NO: 2860730 - DNA, 13 bp, Homo sapiens
taaaacagtcatc

SEQ ID NO: 2860731 - DNA, 14 bp, Homo sapiens
taaaagttctcaat

SEQ ID NO: 2860732 - DNA, 16 bp, Homo sapiens
taaaatagaataattc

SEQ ID NO: 2860733 - DNA, 18 bp, Homo sapiens
taaaatatcataaagcat

SEQ ID NO: 2860734 - DNA, 22 bp, Homo sapiens
taaaatccccttcgctgaaatt

SEQ ID NO: 2860735 - DNA, 17 bp, Homo sapiens
taaaatgttcacttttg

SEQ ID NO: 2860736 - DNA, 12 bp, Homo sapiens
taaaatgtttca

SEQ ID NO: 2860737 - DNA, 22 bp, Homo sapiens
taaaatgtttcattatgcactt

SEQ ID NO: 2860738 - DNA, 23 bp, Homo sapiens
taaaatgtttcattatgcacttt

SEQ ID NO: 2860739 - DNA, 19 bp, Homo sapiens
taaaattatgttactgtat

SEQ ID NO: 2860740 - DNA, 23 bp, Homo sapiens
taaaattgagtttgtagaacttt

SEQ ID NO: 2860741 - DNA, 18 bp, Homo sapiens
taaacaacagctgaagca

SEQ ID NO: 2860742 - DNA, 23 bp, Homo sapiens
taaactatgttcctaacaaaatg

SEQ ID NO: 2860743 - DNA, 21 bp, Homo sapiens
taaactccctggctgttctga

SEQ ID NO: 2860744 - DNA, 21 bp, Homo sapiens
taaagccttctggatccatgg

SEQ ID NO: 2860745 - DNA, 13 bp, Homo sapiens
taaagtacaaatg

SEQ ID NO: 2860746 - DNA, 18 bp, Homo sapiens
taaagtacaaatgaagaa

SEQ ID NO: 2860747 - DNA, 21 bp, Homo sapiens
taaagtacaaatgaagaaagt

SEQ ID NO: 2860748 - DNA, 15 bp, Homo sapiens
taaagtacttgacta

SEQ ID NO: 2860749 - DNA, 16 bp, Homo sapiens
taaagtttggttttga

SEQ ID NO: 2860750 - DNA, 18 bp, Homo sapiens
taaagtttggttttgaca

SEQ ID NO: 2860751 - DNA, 15 bp, Homo sapiens
taaataaaaatatgt

SEQ ID NO: 2860752 - DNA, 17 bp, Homo sapiens
taaataaaaatatgtaa

SEQ ID NO: 2860753 - DNA, 21 bp, Homo sapiens
taaataaaaatatgtaatttc

SEQ ID NO: 2860754 - DNA, 14 bp, Homo sapiens
taaataactgtgtg

SEQ ID NO: 2860755 - DNA, 23 bp, Homo sapiens
taaatagtgtcatataaactcat

SEQ ID NO: 2860756 - DNA, 21 bp, Homo sapiens
taaatcagaaagtaacaatct

SEQ ID NO: 2860757 - DNA, 15 bp, Homo sapiens
taaatgaagatcttt

SEQ ID NO: 2860758 - DNA, 18 bp, Homo sapiens
taaatgaagatctttata

SEQ ID NO: 2860759 - DNA, 12 bp, Homo sapiens
taaatgagcttt

SEQ ID NO: 2860760 - DNA, 13 bp, Homo sapiens
taaatgccagagc

SEQ ID NO: 2860761 - DNA, 15 bp, Homo sapiens
taaatgccagagcca

SEQ ID NO: 2860762 - DNA, 19 bp, Homo sapiens
taaatgtgatgaatactgt

SEQ ID NO: 2860763 - DNA, 13 bp, Homo sapiens
taacaattcctct

SEQ ID NO: 2860764 - DNA, 15 bp, Homo sapiens
taacagccttttcct

SEQ ID NO: 2860765 - DNA, 20 bp, Homo sapiens
taacatacaagaaaatgtat

SEQ ID NO: 2860766 - DNA, 23 bp, Homo sapiens
taacatacaagaaaatgtatcca

SEQ ID NO: 2860767 - DNA, 17 bp, Homo sapiens
taaccagctcagtgttt

SEQ ID NO: 2860768 - DNA, 14 bp, Homo sapiens
taaccctctcttcc

SEQ ID NO: 2860769 - DNA, 14 bp, Homo sapiens
taacctcatcttct

SEQ ID NO: 2860770 - DNA, 17 bp, Homo sapiens
taactagaatttattca

SEQ ID NO: 2860771 - DNA, 18 bp, Homo sapiens
taactatcttctttggac

SEQ ID NO: 2860772 - DNA, 15 bp, Homo sapiens
taactgttgcacttt

SEQ ID NO: 2860773 - DNA, 17 bp, Homo sapiens
taacttctcatgtatat

SEQ ID NO: 2860774 - DNA, 21 bp, Homo sapiens
taagaaacaactctttgagaa

SEQ ID NO: 2860775 - DNA, 23 bp, Homo sapiens
taagactcgcggcaggttctctt

SEQ ID NO: 2860776 - DNA, 21 bp, Homo sapiens
taagagtagaaactgcaggga

SEQ ID NO: 2860777 - DNA, 15 bp, Homo sapiens
taagatagaaagctg

SEQ ID NO: 2860778 - DNA, 20 bp, Homo sapiens
taagatagaaagctggactg

SEQ ID NO: 2860779 - DNA, 17 bp, Homo sapiens
taagcagaccactgata

SEQ ID NO: 2860780 - DNA, 21 bp, Homo sapiens
taagcaggaaggatggcaagc

SEQ ID NO: 2860781 - DNA, 19 bp, Homo sapiens
taagccacttaaaatgttc

SEQ ID NO: 2860782 - DNA, 13 bp, Homo sapiens
taagtagcattca

SEQ ID NO: 2860783 - DNA, 14 bp, Homo sapiens
taagtaggtgatga

SEQ ID NO: 2860784 - DNA, 10 bp, Homo sapiens
taagtgccca

SEQ ID NO: 2860785 - DNA, 15 bp, Homo sapiens
taagtgcccaaagtg

SEQ ID NO: 2860786 - DNA, 19 bp, Homo sapiens
taagtgtaaaaaatgtctc

SEQ ID NO: 2860787 - DNA, 19 bp, Homo sapiens
taataaaaagaaagatact

SEQ ID NO: 2860788 - DNA, 13 bp, Homo sapiens
taataaagtactt

SEQ ID NO: 2860789 - DNA, 12 bp, Homo sapiens
taatagaacttg

SEQ ID NO: 2860790 - DNA, 15 bp, Homo sapiens
taatagaacttgtta

SEQ ID NO: 2860791 - DNA, 18 bp, Homo sapiens
taatatatcattatcttt

SEQ ID NO: 2860792 - DNA, 14 bp, Homo sapiens
taatatcaaataaa

SEQ ID NO: 2860793 - DNA, 21 bp, Homo sapiens
taatatcaaataaaatatcat

SEQ ID NO: 2860794 - DNA, 19 bp, Homo sapiens
taatcccagcactttggga

SEQ ID NO: 2860795 - DNA, 21 bp, Homo sapiens
taatccgaatctctttttgct

SEQ ID NO: 2860796 - DNA, 14 bp, Homo sapiens
taatctatgtttat

SEQ ID NO: 2860797 - DNA, 14 bp, Homo sapiens
taatctcaatgcaa

SEQ ID NO: 2860798 - DNA, 16 bp, Homo sapiens
taatcttgaattgtaa

SEQ ID NO: 2860799 - DNA, 23 bp, Homo sapiens
taatgaagaaagtggaaaacaag

SEQ ID NO: 2860800 - DNA, 17 bp, Homo sapiens
taatgctaaatgtgtaa

SEQ ID NO: 2860801 - DNA, 22 bp, Homo sapiens
taatgctaaatgtgtaataatg

SEQ ID NO: 2860802 - DNA, 16 bp, Homo sapiens
taatgtaacatgattt

SEQ ID NO: 2860803 - DNA, 13 bp, Homo sapiens
taatgttgataat

SEQ ID NO: 2860804 - DNA, 18 bp, Homo sapiens
taattgctgataccatat

SEQ ID NO: 2860805 - DNA, 17 bp, Homo sapiens
taatttaactttccagt

SEQ ID NO: 2860806 - DNA, 18 bp, Homo sapiens
ttatattaaataacatgt

SEQ ID NO: 2860807 - DNA, 22 bp, Homo sapiens
ttatatttttttaactgtgata

SEQ ID NO: 2860808 - DNA, 21 bp, Homo sapiens
ttatcaccgtgggctccctga

SEQ ID NO: 2860809 - DNA, 15 bp, Homo sapiens
ttatcattaaaaatt

SEQ ID NO: 2860810 - DNA, 17 bp, Homo sapiens
ttatcattaaaaattac

SEQ ID NO: 2860811 - DNA, 14 bp, Homo sapiens
ttatgaaaagtact

SEQ ID NO: 2860812 - DNA, 17 bp, Homo sapiens
ttatgatgacaatcaaa

SEQ ID NO: 2860813 - DNA, 17 bp, Homo sapiens
ttatgcaattcagtgtt

SEQ ID NO: 2860814 - DNA, 19 bp, Homo sapiens
ttatgcacttttagaaatg

SEQ ID NO: 2860815 - DNA, 20 bp, Homo sapiens
ttatgcacttttagaaatgc

SEQ ID NO: 2860816 - DNA, 20 bp, Homo sapiens
ttatgttactgtatttttca

SEQ ID NO: 2860817 - DNA, 12 bp, Homo sapiens
ttattacctctg

SEQ ID NO: 2860818 - DNA, 17 bp, Homo sapiens
ttattcaagaatgaaaa

SEQ ID NO: 2860819 - DNA, 18 bp, Homo sapiens
ttattcaattcctctggg

SEQ ID NO: 2860820 - DNA, 19 bp, Homo sapiens
ttattcaattcctctggga

SEQ ID NO: 2860821 - DNA, 13 bp, Homo sapiens
ttattcagtgtca

SEQ ID NO: 2860822 - DNA, 14 bp, Homo sapiens
ttattcagtgtcac

SEQ ID NO: 2860823 - DNA, 15 bp, Homo sapiens
ttattgtacctctct

SEQ ID NO: 2860824 - DNA, 12 bp, Homo sapiens
ttattgtacttg

SEQ ID NO: 2860825 - DNA, 14 bp, Homo sapiens
ttattttcacctgt

SEQ ID NO: 2860826 - DNA, 12 bp, Homo sapiens
ttattttgcaac

SEQ ID NO: 2860827 - DNA, 17 bp, Homo sapiens
ttcaaaaccttttgaaa

SEQ ID NO: 2860828 - DNA, 18 bp, Homo sapiens
ttcaagaatgaaaaatat

SEQ ID NO: 2860829 - DNA, 23 bp, Homo sapiens
ttcaagagctagaaaaataaaat

SEQ ID NO: 2860830 - DNA, 17 bp, Homo sapiens
ttcaataaatgatatat

SEQ ID NO: 2860831 - DNA, 22 bp, Homo sapiens
ttcaatatgaatctataagtag

SEQ ID NO: 2860832 - DNA, 15 bp, Homo sapiens
ttcaattgcatctcc

SEQ ID NO: 2860833 - DNA, 20 bp, Homo sapiens
ttcacatctaacctcatctt

SEQ ID NO: 2860834 - DNA, 16 bp, Homo sapiens
ttcacctgtatatttc

SEQ ID NO: 2860835 - DNA, 22 bp, Homo sapiens
ttcacctgtttttaagctgttt

SEQ ID NO: 2860836 - DNA, 17 bp, Homo sapiens
ttcactgccagttgtct

SEQ ID NO: 2860837 - DNA, 17 bp, Homo sapiens
ttcacttttgacaaagg

SEQ ID NO: 2860838 - DNA, 18 bp, Homo sapiens
ttcagctctttccaaatt

SEQ ID NO: 2860839 - DNA, 14 bp, Homo sapiens
ttcagtggggcagt

SEQ ID NO: 2860840 - DNA, 12 bp, Homo sapiens
ttcagtgttaaa

SEQ ID NO: 2860841 - DNA, 15 bp, Homo sapiens
ttcagtttttcactt

SEQ ID NO: 2860842 - DNA, 18 bp, Homo sapiens
ttcagtttttcacttcta

SEQ ID NO: 2860843 - DNA, 13 bp, Homo sapiens
ttcataatcagta

SEQ ID NO: 2860844 - DNA, 13 bp, Homo sapiens
tgtgaggccaggg

SEQ ID NO: 2860845 - DNA, 17 bp, Homo sapiens
tgtgaggccagggcaga

SEQ ID NO: 2860846 - DNA, 14 bp, Homo sapiens
tgtgatgaatactg

SEQ ID NO: 2860847 - DNA, 16 bp, Homo sapiens
tgtgatgaatactgta

SEQ ID NO: 2860848 - DNA, 15 bp, Homo sapiens
tgtgattactgcaat

SEQ ID NO: 2860849 - DNA, 21 bp, Homo sapiens
tgtgcacatctgtgtcttgtt

SEQ ID NO: 2860850 - DNA, 14 bp, Homo sapiens
tgtgcaccagggtt

SEQ ID NO: 2860851 - DNA, 16 bp, Homo sapiens
tgtgcaggtggggaga

SEQ ID NO: 2860852 - DNA, 19 bp, Homo sapiens
tgtgctgaacataacttct

SEQ ID NO: 2860853 - DNA, 21 bp, Homo sapiens
tgtgctgaacataacttctca

SEQ ID NO: 2860854 - DNA, 23 bp, Homo sapiens
tgtggtctgccaatctgtacaaa

SEQ ID NO: 2860855 - DNA, 20 bp, Homo sapiens
tgtgtaacatccaagccaga

SEQ ID NO: 2860856 - DNA, 22 bp, Homo sapiens
tgtgtaacatccaagccagagt

SEQ ID NO: 2860857 - DNA, 21 bp, Homo sapiens
tgtgtaataatgtaacatgat

SEQ ID NO: 2860858 - DNA, 19 bp, Homo sapiens
tgtgtccacgactgtctcc

SEQ ID NO: 2860859 - DNA, 16 bp, Homo sapiens
tgtgtccccctctgtc

SEQ ID NO: 2860860 - DNA, 23 bp, Homo sapiens
tgtgtgagaaaaactaacttgat

SEQ ID NO: 2860861 - DNA, 17 bp, Homo sapiens
tgttaaagagataaaga

SEQ ID NO: 2860862 - DNA, 15 bp, Homo sapiens
tgttaacctttctaa

SEQ ID NO: 2860863 - DNA, 15 bp, Homo sapiens
tgttacctgaaaaca

SEQ ID NO: 2860864 - DNA, 19 bp, Homo sapiens
tgttatcaccgtgggctcc

SEQ ID NO: 2860865 - DNA, 15 bp, Homo sapiens
tgttcccaaaacaat

SEQ ID NO: 2860866 - DNA, 20 bp, Homo sapiens
tgttccccttccactgaggg

SEQ ID NO: 2860867 - DNA, 23 bp, Homo sapiens
tgttccccttccactgagggcag

SEQ ID NO: 2860868 - DNA, 17 bp, Homo sapiens
tgttccctttttcataa

SEQ ID NO: 2860869 - DNA, 20 bp, Homo sapiens
tgttcctaacaaaatgagat

SEQ ID NO: 2860870 - DNA, 22 bp, Homo sapiens
tgttcctgacactcaataaaca

SEQ ID NO: 2860871 - DNA, 23 bp, Homo sapiens
tgttcttgaatttaataatctgt

SEQ ID NO: 2860872 - DNA, 13 bp, Homo sapiens
tgttctttgggga

SEQ ID NO: 2860873 - DNA, 20 bp, Homo sapiens
tgttgaactttttaaagaag

SEQ ID NO: 2860874 - DNA, 15 bp, Homo sapiens
tgttgacaaatgaca

SEQ ID NO: 2860875 - DNA, 20 bp, Homo sapiens
tgttgacaaatgacagatct

SEQ ID NO: 2860876 - DNA, 13 bp, Homo sapiens
tgttgagctgttt

SEQ ID NO: 2860877 - DNA, 14 bp, Homo sapiens
tgttgcacttttga

SEQ ID NO: 2860878 - DNA, 24 bp, Homo sapiens
tgttgcacttttgaatgtccaaaa

SEQ ID NO: 2860879 - DNA, 17 bp, Homo sapiens
tgcaccatcacacatgc

SEQ ID NO: 2860880 - DNA, 14 bp, Homo sapiens
tgcacctctggcta

SEQ ID NO: 2860881 - DNA, 17 bp, Homo sapiens
tgcacctgtccccaccc

SEQ ID NO: 2860882 - DNA, 21 bp, Homo sapiens
tgcacctgtccccaccctcca

SEQ ID NO: 2860883 - DNA, 15 bp, Homo sapiens
tgcactgacaagatg

SEQ ID NO: 2860884 - DNA, 21 bp, Homo sapiens
tgcacttttagaaatgcatat

SEQ ID NO: 2860885 - DNA, 16 bp, Homo sapiens
tgcacttttgaatgtc

SEQ ID NO: 2860886 - DNA, 15 bp, Homo sapiens
tgcagaagcaataat

SEQ ID NO: 2860887 - DNA, 12 bp, Homo sapiens
tgcagcacctcc

SEQ ID NO: 2860888 - DNA, 18 bp, Homo sapiens
tgcagcacctccaggcct

SEQ ID NO: 2860889 - DNA, 14 bp, Homo sapiens
tgcagccgctgagc

SEQ ID NO: 2860890 - DNA, 22 bp, Homo sapiens
tgcagcctgctctagtgggaca

SEQ ID NO: 2860891 - DNA, 13 bp, Homo sapiens
tgcaggtggggag

SEQ ID NO: 2860892 - DNA, 19 bp, Homo sapiens
tgcagtcctgatcagagcc

SEQ ID NO: 2860893 - DNA, 19 bp, Homo sapiens
tgcatcccacgttctgtta

SEQ ID NO: 2860894 - DNA, 16 bp, Homo sapiens
tgcatttaaatacagt

SEQ ID NO: 2860895 - DNA, 15 bp, Homo sapiens
tgccaaggagcccct

SEQ ID NO: 2860896 - DNA, 21 bp, Homo sapiens
tgccaagggctttgttttgca

SEQ ID NO: 2860897 - DNA, 20 bp, Homo sapiens
tgccaatctgtacaaaatgg

SEQ ID NO: 2860898 - DNA, 22 bp, Homo sapiens
tgccacagcctcccctgccagg

SEQ ID NO: 2860899 - DNA, 17 bp, Homo sapiens
tgccactgaggagacag

SEQ ID NO: 2860900 - DNA, 18 bp, Homo sapiens
tgccactgaggagacaga

SEQ ID NO: 2860901 - DNA, 19 bp, Homo sapiens
tgccactgaggagacagaa

SEQ ID NO: 2860902 - DNA, 20 bp, Homo sapiens
tgccacttcaacccccagct

SEQ ID NO: 2860903 - DNA, 11 bp, Homo sapiens
tgccagagcca

SEQ ID NO: 2860904 - DNA, 21 bp, Homo sapiens
tgccagagccaacctggactt

SEQ ID NO: 2860905 - DNA, 22 bp, Homo sapiens
tgccagagccaacctggacttc

SEQ ID NO: 2860906 - DNA, 14 bp, Homo sapiens
tgccatattttcac

SEQ ID NO: 2860907 - DNA, 17 bp, Homo sapiens
tgccatattttcaccat

SEQ ID NO: 2860908 - DNA, 15 bp, Homo sapiens
tgccatcatctcctg

SEQ ID NO: 2860909 - DNA, 15 bp, Homo sapiens
tgccatgggaaacaa

SEQ ID NO: 2860910 - DNA, 15 bp, Homo sapiens
tgcccaaagtgggga

SEQ ID NO: 2860911 - DNA, 21 bp, Homo sapiens
tgcccatcatgtggccccacc

SEQ ID NO: 2860912 - DNA, 20 bp, Homo sapiens
tgccccatcagtgctccctc

SEQ ID NO: 2860913 - DNA, 21 bp, Homo sapiens
tgccccatcagtgctccctca

SEQ ID NO: 2860914 - DNA, 16 bp, Homo sapiens
tgcccctgttcatgtt

SEQ ID NO: 2860915 - DNA, 19 bp, Homo sapiens
tgccctgccttgtccctct

SEQ ID NO: 2860916 - DNA, 20 bp, Homo sapiens
tgcctcagtagcatctcagt

SEQ ID NO: 2860917 - DNA, 19 bp, Homo sapiens
tgcctccgggcaggcaagg

SEQ ID NO: 2860918 - DNA, 19 bp, Homo sapiens
tgcctcttctgggagggca

SEQ ID NO: 2860919 - DNA, 14 bp, Homo sapiens
tgcctgcctcccct

SEQ ID NO: 2860920 - DNA, 15 bp, Homo sapiens
tgccttcctcctggg

SEQ ID NO: 2860921 - DNA, 19 bp, Homo sapiens
tgccttcctcctgggccct

SEQ ID NO: 2860922 - DNA, 13 bp, Homo sapiens
tgccttgtccctc

SEQ ID NO: 2860923 - DNA, 18 bp, Homo sapiens
tgccttgtccctctcact

SEQ ID NO: 2860924 - DNA, 13 bp, Homo sapiens
tgcggaagccaaa

SEQ ID NO: 2860925 - DNA, 20 bp, Homo sapiens
tgctagactcctcaggagag

SEQ ID NO: 2860926 - DNA, 16 bp, Homo sapiens
tgctataaatgccaga

SEQ ID NO: 2860927 - DNA, 20 bp, Homo sapiens
tgctataaatgccagagcca

SEQ ID NO: 2860928 - DNA, 21 bp, Homo sapiens
tgctataaatgccagagccaa

SEQ ID NO: 2860929 - DNA, 20 bp, Homo sapiens
tgctatcggcagatgatgct

SEQ ID NO: 2860930 - DNA, 15 bp, Homo sapiens
tgctccatatttgat

SEQ ID NO: 2860931 - DNA, 20 bp, Homo sapiens
tgctgataccatatgaatga

SEQ ID NO: 2860932 - DNA, 20 bp, Homo sapiens
tgctgatcttttaaaatcat

SEQ ID NO: 2860933 - DNA, 15 bp, Homo sapiens
tgctgattcaagaaa

SEQ ID NO: 2860934 - DNA, 18 bp, Homo sapiens
tgctgattcaagaaacag

SEQ ID NO: 2860935 - DNA, 18 bp, Homo sapiens
tgctgccccatcagtgct

SEQ ID NO: 2860936 - DNA, 19 bp, Homo sapiens
tgctgccccatcagtgctc

SEQ ID NO: 2860937 - DNA, 21 bp, Homo sapiens
tgctgccccatcagtgctccc

SEQ ID NO: 2860938 - DNA, 13 bp, Homo sapiens
tgctgcctgctca

SEQ ID NO: 2860939 - DNA, 23 bp, Homo sapiens
tgctgtggtgtgtccccctctgt

SEQ ID NO: 2860940 - DNA, 18 bp, Homo sapiens
tgctgttgaactttttaa

SEQ ID NO: 2860941 - DNA, 12 bp, Homo sapiens
tgctgtttctaa

SEQ ID NO: 2860942 - DNA, 23 bp, Homo sapiens
tgctgtttctaagaaaatgtagt

SEQ ID NO: 2860943 - DNA, 12 bp, Homo sapiens
tgcttcattatt

SEQ ID NO: 2860944 - DNA, 15 bp, Homo sapiens
tgcttcgggcccttc

SEQ ID NO: 2860945 - DNA, 21 bp, Homo sapiens
tgcttctctagctctctaggc

SEQ ID NO: 2860946 - DNA, 23 bp, Homo sapiens
tgcttctctagctctctaggcct

SEQ ID NO: 2860947 - DNA, 17 bp, Homo sapiens
tgcttgaacccaggaga

SEQ ID NO: 2860948 - DNA, 16 bp, Homo sapiens
tgcttgaggaaaacaa

SEQ ID NO: 2860949 - DNA, 15 bp, Homo sapiens
tgctttgcattttga

SEQ ID NO: 2860950 - DNA, 13 bp, Homo sapiens
tggaaaaaacatt

SEQ ID NO: 2860951 - DNA, 14 bp, Homo sapiens
tggaaaaaacattt

SEQ ID NO: 2860952 - DNA, 17 bp, Homo sapiens
tggaaaacaaggaagtc

SEQ ID NO: 2860953 - DNA, 16 bp, Homo sapiens
tggaaaataaattata

SEQ ID NO: 2860954 - DNA, 12 bp, Homo sapiens
tggactccaggc

SEQ ID NO: 2860955 - DNA, 15 bp, Homo sapiens
tggactccaggcctg

SEQ ID NO: 2860956 - DNA, 21 bp, Homo sapiens
tggactccaggcctgaccagg

SEQ ID NO: 2860957 - DNA, 14 bp, Homo sapiens
tggactcctcccac

SEQ ID NO: 2860958 - DNA, 20 bp, Homo sapiens
tggactctcagtctctgagc

SEQ ID NO: 2860959 - DNA, 13 bp, Homo sapiens
tggactctgctag

SEQ ID NO: 2860960 - DNA, 19 bp, Homo sapiens
tggactgaccaaagactgc

SEQ ID NO: 2860961 - DNA, 23 bp, Homo sapiens
tggactgaccacaccaaccaggc

SEQ ID NO: 2860962 - DNA, 14 bp, Homo sapiens
tggacttcctgtca

SEQ ID NO: 2860963 - DNA, 15 bp, Homo sapiens
tggacttctgaagag

SEQ ID NO: 2860964 - DNA, 16 bp, Homo sapiens
tggagaatactgccaa

SEQ ID NO: 2860965 - DNA, 17 bp, Homo sapiens
tggagaatactgccaaa

SEQ ID NO: 2860966 - DNA, 18 bp, Homo sapiens
tggagaatactgccaaaa

SEQ ID NO: 2860967 - DNA, 13 bp, Homo sapiens
tggagcagagggg

SEQ ID NO: 2860968 - DNA, 17 bp, Homo sapiens
tggagcagaggggctga

SEQ ID NO: 2860969 - DNA, 16 bp, Homo sapiens
tggaggcccctggagc

SEQ ID NO: 2860970 - DNA, 22 bp, Homo sapiens
tggatcccgttcagaaaaccac

SEQ ID NO: 2860971 - DNA, 18 bp, Homo sapiens
tggatctcattggaccct

SEQ ID NO: 2860972 - DNA, 15 bp, Homo sapiens
tggatgcccagagga

SEQ ID NO: 2860973 - DNA, 21 bp, Homo sapiens
tggcagaagcattgcctggac

SEQ ID NO: 2860974 - DNA, 23 bp, Homo sapiens
tggcagaagcattgcctggactg

SEQ ID NO: 2860975 - DNA, 16 bp, Homo sapiens
tggcattctttgcaat

SEQ ID NO: 2860976 - DNA, 23 bp, Homo sapiens
tggcatttctctttaaactatgt

SEQ ID NO: 2860977 - DNA, 22 bp, Homo sapiens
tggccctcggaggtccagctgg

SEQ ID NO: 2860978 - DNA, 19 bp, Homo sapiens
tggctggtgtatgcacagg

SEQ ID NO: 2860979 - DNA, 22 bp, Homo sapiens
tggcttggggtcaagaaacagc

SEQ ID NO: 2860980 - DNA, 18 bp, Homo sapiens
tgggaaacaaataatttg

SEQ ID NO: 2860981 - DNA, 14 bp, Homo sapiens
tgggacaccaggga

SEQ ID NO: 2860982 - DNA, 20 bp, Homo sapiens
tgggacagcccagagcctgg

SEQ ID NO: 2860983 - DNA, 16 bp, Homo sapiens
tgggagagccagctct

SEQ ID NO: 2860984 - DNA, 14 bp, Homo sapiens
tgggagggcagcag

SEQ ID NO: 2860985 - DNA, 18 bp, Homo sapiens
tgggagggcagcagggct

SEQ ID NO: 2860986 - DNA, 22 bp, Homo sapiens
tgggatattttgaaatgaactt

SEQ ID NO: 2860987 - DNA, 17 bp, Homo sapiens
tgggatggtggagggcc

SEQ ID NO: 2860988 - DNA, 18 bp, Homo sapiens
tgggatggtggagggcca

SEQ ID NO: 2860989 - DNA, 15 bp, Homo sapiens
tgggattagaaacaa

SEQ ID NO: 2860990 - DNA, 18 bp, Homo sapiens
tacactgcggaagccaaa

SEQ ID NO: 2860991 - DNA, 16 bp, Homo sapiens
tacagaactctttcaa

SEQ ID NO: 2860992 - DNA, 19 bp, Homo sapiens
tacagaactctttcaaaac

SEQ ID NO: 2860993 - DNA, 23 bp, Homo sapiens
tacagccttattttgttggtgct

SEQ ID NO: 2860994 - DNA, 14 bp, Homo sapiens
tacagtaggagccc

SEQ ID NO: 2860995 - DNA, 15 bp, Homo sapiens
tacagtaggagccca

SEQ ID NO: 2860996 - DNA, 20 bp, Homo sapiens
tacagtaggagcccagctct

SEQ ID NO: 2860997 - DNA, 20 bp, Homo sapiens
tacagtcttccatttgcaag

SEQ ID NO: 2860998 - DNA, 16 bp, Homo sapiens
tacatcaatatgtata

SEQ ID NO: 2860999 - DNA, 23 bp, Homo sapiens
tacatttgtaagtgtaaaaaatg

SEQ ID NO: 2861000 - DNA, 14 bp, Homo sapiens
taccaatacaaaat

SEQ ID NO: 2861001 - DNA, 13 bp, Homo sapiens
taccagcgaggag

SEQ ID NO: 2861002 - DNA, 20 bp, Homo sapiens
taccagcgaggaggctccag

SEQ ID NO: 2861003 - DNA, 14 bp, Homo sapiens
taccatatgaatga

SEQ ID NO: 2861004 - DNA, 13 bp, Homo sapiens
tacccggcccaga

SEQ ID NO: 2861005 - DNA, 18 bp, Homo sapiens
taccctgagctgaggcag

SEQ ID NO: 2861006 - DNA, 13 bp, Homo sapiens
tacctacatattt

SEQ ID NO: 2861007 - DNA, 22 bp, Homo sapiens
tacctacatatttgtatgtttt

SEQ ID NO: 2861008 - DNA, 16 bp, Homo sapiens
tacctactggtgtaat

SEQ ID NO: 2861009 - DNA, 23 bp, Homo sapiens
tacctactggtgtaatctcaatg

SEQ ID NO: 2861010 - DNA, 17 bp, Homo sapiens
tacctctcttatagaat

SEQ ID NO: 2861011 - DNA, 15 bp, Homo sapiens
tacctctgatacctc

SEQ ID NO: 2861012 - DNA, 20 bp, Homo sapiens
tacctgacactcccttgggc

SEQ ID NO: 2861013 - DNA, 15 bp, Homo sapiens
taccttcttcgctgc

SEQ ID NO: 2861014 - DNA, 13 bp, Homo sapiens
taccttggttccc

SEQ ID NO: 2861015 - DNA, 22 bp, Homo sapiens
taccttggttcccccactgatc

SEQ ID NO: 2861016 - DNA, 23 bp, Homo sapiens
tactaacaatcagctccttcctg

SEQ ID NO: 2861017 - DNA, 15 bp, Homo sapiens
tactactactgttat

SEQ ID NO: 2861018 - DNA, 13 bp, Homo sapiens
tactactgttatc

SEQ ID NO: 2861019 - DNA, 21 bp, Homo sapiens
tactcttaggaagagaaacca

SEQ ID NO: 2861020 - DNA, 18 bp, Homo sapiens
tactgagcttctctgtga

SEQ ID NO: 2861021 - DNA, 15 bp, Homo sapiens
tactgcagcacctcc

SEQ ID NO: 2861022 - DNA, 12 bp, Homo sapiens
tactggtgtaat

SEQ ID NO: 2861023 - DNA, 19 bp, Homo sapiens
tactggtgtaatctcaatg

SEQ ID NO: 2861024 - DNA, 15 bp, Homo sapiens
tactgtatttttcag

SEQ ID NO: 2861025 - DNA, 15 bp, Homo sapiens
tacttccctcttgaa

SEQ ID NO: 2861026 - DNA, 17 bp, Homo sapiens
tacttgactacctactg

SEQ ID NO: 2861027 - DNA, 22 bp, Homo sapiens
tacttgactacctactggtgta

SEQ ID NO: 2861028 - DNA, 23 bp, Homo sapiens
tacttgccttattagagtgtctt

SEQ ID NO: 2861029 - DNA, 12 bp, Homo sapiens
tacttgggaggc

SEQ ID NO: 2861030 - DNA, 21 bp, Homo sapiens
tactttctatttttatgatga

SEQ ID NO: 2861031 - DNA, 22 bp, Homo sapiens
tactttctatttttatgatgac

SEQ ID NO: 2861032 - DNA, 14 bp, Homo sapiens
tactttgaagtcat

SEQ ID NO: 2861033 - DNA, 18 bp, Homo sapiens
tactttgaagtcatacca

SEQ ID NO: 2861034 - DNA, 15 bp, Homo sapiens
tacttttgccctttg

SEQ ID NO: 2861035 - DNA, 12 bp, Homo sapiens
tagaaaaataaa

SEQ ID NO: 2861036 - DNA, 15 bp, Homo sapiens
tagaaaaataaaatg

SEQ ID NO: 2861037 - DNA, 14 bp, Homo sapiens
tagaaagaagccca

SEQ ID NO: 2861038 - DNA, 23 bp, Homo sapiens
tagaaagaagcccaatattataa

SEQ ID NO: 2861039 - DNA, 18 bp, Homo sapiens
tagaaagctggactgacc

SEQ ID NO: 2861040 - DNA, 13 bp, Homo sapiens
tagaaatgcatat

SEQ ID NO: 2861041 - DNA, 15 bp, Homo sapiens
tagaactcactctgg

SEQ ID NO: 2861042 - DNA, 16 bp, Homo sapiens
tagaactcactctggg

SEQ ID NO: 2861043 - DNA, 19 bp, Homo sapiens
tagaactcactctgggctg

SEQ ID NO: 2861044 - DNA, 21 bp, Homo sapiens
tagaagcctgacaactcattt

SEQ ID NO: 2861045 - DNA, 11 bp, Homo sapiens
tagaataattc

SEQ ID NO: 2861046 - DNA, 20 bp, Homo sapiens
tagaataattcttttctgag

SEQ ID NO: 2861047 - DNA, 12 bp, Homo sapiens
tagaatatttat

SEQ ID NO: 2861048 - DNA, 16 bp, Homo sapiens
tagacctacagacctg

SEQ ID NO: 2861049 - DNA, 22 bp, Homo sapiens
tagacttggagaatactgccaa

SEQ ID NO: 2861050 - DNA, 21 bp, Homo sapiens
tagactttctcagtgggacaa

SEQ ID NO: 2861051 - DNA, 12 bp, Homo sapiens
tagagagcctgt

SEQ ID NO: 2861052 - DNA, 18 bp, Homo sapiens
tagagattacctcctgag

SEQ ID NO: 2861053 - DNA, 19 bp, Homo sapiens
tagagattacctcctgaga

SEQ ID NO: 2861054 - DNA, 15 bp, Homo sapiens
tagatctgcaggctg

SEQ ID NO: 2861055 - DNA, 17 bp, Homo sapiens
tagatctgcaggctgca

SEQ ID NO: 2861056 - DNA, 20 bp, Homo sapiens
tagatgggaggatgaattgt

SEQ ID NO: 2861057 - DNA, 16 bp, Homo sapiens
tagattgtattaacta

SEQ ID NO: 2861058 - DNA, 13 bp, Homo sapiens
tagctctctaggc

SEQ ID NO: 2861059 - DNA, 21 bp, Homo sapiens
tagctgacccagccccttgag

SEQ ID NO: 2861060 - DNA, 23 bp, Homo sapiens
tagctgacccagccccttgagaa

SEQ ID NO: 2861061 - DNA, 20 bp, Homo sapiens
tagctgaggctgagaaagct

SEQ ID NO: 2861062 - DNA, 21 bp, Homo sapiens
tagctgaggctgagaaagcta

SEQ ID NO: 2861063 - DNA, 23 bp, Homo sapiens
tagctgaggctgagaaagctaaa

SEQ ID NO: 2861064 - DNA, 17 bp, Homo sapiens
tagctgttgagctgttt

SEQ ID NO: 2861065 - DNA, 21 bp, Homo sapiens
taggaagtgaacccatatttt

SEQ ID NO: 2861066 - DNA, 18 bp, Homo sapiens
tagggagaatatttacta

SEQ ID NO: 2861067 - DNA, 17 bp, Homo sapiens
tagggatccctcatctg

SEQ ID NO: 2861068 - DNA, 18 bp, Homo sapiens
tagggtctaccaatacaa

SEQ ID NO: 2861069 - DNA, 13 bp, Homo sapiens
taggttgggacac

SEQ ID NO: 2861070 - DNA, 16 bp, Homo sapiens
tagtagttaaataact

SEQ ID NO: 2861071 - DNA, 19 bp, Homo sapiens
tagtgaaggcttctctctg

SEQ ID NO: 2861072 - DNA, 21 bp, Homo sapiens
tagtgaaggcttctctctgtg

SEQ ID NO: 2861073 - DNA, 21 bp, Homo sapiens
tagtgatgtccttaaaatgtg

SEQ ID NO: 2861074 - DNA, 22 bp, Homo sapiens
tagtgatgtccttaaaatgtgg

SEQ ID NO: 2861075 - DNA, 19 bp, Homo sapiens
tagtgtgacagtttccaaa

SEQ ID NO: 2861076 - DNA, 21 bp, Homo sapiens
tagtttgattattcagtgtca

SEQ ID NO: 2861077 - DNA, 12 bp, Homo sapiens
tataaactcatt

SEQ ID NO: 2861078 - DNA, 17 bp, Homo sapiens
tataaatgccagagcca

SEQ ID NO: 2861079 - DNA, 21 bp, Homo sapiens
tataaatgccagagccaacct

SEQ ID NO: 2861080 - DNA, 15 bp, Homo sapiens
tataagtagtaaatc

SEQ ID NO: 2861081 - DNA, 20 bp, Homo sapiens
tataagtagtaaatcagaaa

SEQ ID NO: 2861082 - DNA, 12 bp, Homo sapiens
tataatactact

SEQ ID NO: 2861083 - DNA, 13 bp, Homo sapiens
tataatactacta

SEQ ID NO: 2861084 - DNA, 16 bp, Homo sapiens
tatacatcaatatgta

SEQ ID NO: 2861085 - DNA, 20 bp, Homo sapiens
tcagtccagcagtttccagt

SEQ ID NO: 2861086 - DNA, 21 bp, Homo sapiens
tcagtccagcagtttccagtc

SEQ ID NO: 2861087 - DNA, 18 bp, Homo sapiens
tcagtgctataaatgcca

SEQ ID NO: 2861088 - DNA, 21 bp, Homo sapiens
tcagtgctataaatgccagag

SEQ ID NO: 2861089 - DNA, 22 bp, Homo sapiens
tcagtgctataaatgccagagc

SEQ ID NO: 2861090 - DNA, 23 bp, Homo sapiens
tcagtgctataaatgccagagcc

SEQ ID NO: 2861091 - DNA, 19 bp, Homo sapiens
tcagtgctccctcacatgt

SEQ ID NO: 2861092 - DNA, 20 bp, Homo sapiens
tcagtgggacaaaccagagc

SEQ ID NO: 2861093 - DNA, 23 bp, Homo sapiens
tcagtgggacaaaccagagcaga

SEQ ID NO: 2861094 - DNA, 12 bp, Homo sapiens
tcagttctcaaa

SEQ ID NO: 2861095 - DNA, 20 bp, Homo sapiens
tcataagtatttcaaattgg

SEQ ID NO: 2861096 - DNA, 18 bp, Homo sapiens
tcataatcagtaaatagt

SEQ ID NO: 2861097 - DNA, 20 bp, Homo sapiens
tcataatcagtaaatagtgt

SEQ ID NO: 2861098 - DNA, 22 bp, Homo sapiens
tcatagtaagtgcgaagactga

SEQ ID NO: 2861099 - DNA, 16 bp, Homo sapiens
tcatataaactcattt

SEQ ID NO: 2861100 - DNA, 22 bp, Homo sapiens
tcatcattctctgtctcatcca

SEQ ID NO: 2861101 - DNA, 12 bp, Homo sapiens
tcatccatcatc

SEQ ID NO: 2861102 - DNA, 17 bp, Homo sapiens
tcatccatcatcatgtg

SEQ ID NO: 2861103 - DNA, 20 bp, Homo sapiens
tcatcctcctccccagctct

SEQ ID NO: 2861104 - DNA, 18 bp, Homo sapiens
tcatctagaattcactga

SEQ ID NO: 2861105 - DNA, 15 bp, Homo sapiens
tcatctcctgccttc

SEQ ID NO: 2861106 - DNA, 22 bp, Homo sapiens
tccgggcaggcaaggtttacac

SEQ ID NO: 2861107 - DNA, 19 bp, Homo sapiens
tcctaaaagttctcaatgt

SEQ ID NO: 2861108 - DNA, 18 bp, Homo sapiens
tcctaataaagttctgta

SEQ ID NO: 2861109 - DNA, 21 bp, Homo sapiens
tcctactttctatttttatga

SEQ ID NO: 2861110 - DNA, 22 bp, Homo sapiens
tcctagatctgcaggctgcacc

SEQ ID NO: 2861111 - DNA, 13 bp, Homo sapiens
tcctcaatccagc

SEQ ID NO: 2861112 - DNA, 12 bp, Homo sapiens
tcctccatggga

SEQ ID NO: 2861113 - DNA, 14 bp, Homo sapiens
tcctccccaccttc

SEQ ID NO: 2861114 - DNA, 23 bp, Homo sapiens
tcctccccaccttccccagactc

SEQ ID NO: 2861115 - DNA, 19 bp, Homo sapiens
tcctccccagctcttctct

SEQ ID NO: 2861116 - DNA, 15 bp, Homo sapiens
tcctcctccccagct

SEQ ID NO: 2861117 - DNA, 13 bp, Homo sapiens
tcctcctctgtga

SEQ ID NO: 2861118 - DNA, 14 bp, Homo sapiens
tcctcctgggccct

SEQ ID NO: 2861119 - DNA, 20 bp, Homo sapiens
tcctcctgggccctctctgc

SEQ ID NO: 2861120 - DNA, 19 bp, Homo sapiens
tcctgagaaaaaaggttcc

SEQ ID NO: 2861121 - DNA, 24 bp, Homo sapiens
tcctgagaaaaaaggttccgcttg

SEQ ID NO: 2861122 - DNA, 15 bp, Homo sapiens
tcctgatcagagccg

SEQ ID NO: 2861123 - DNA, 13 bp, Homo sapiens
tcctgcagcaaac

SEQ ID NO: 2861124 - DNA, 20 bp, Homo sapiens
tcctgcagcaaacactccac

SEQ ID NO: 2861125 - DNA, 22 bp, Homo sapiens
tcctgcagcaaacactccaccc

SEQ ID NO: 2861126 - DNA, 13 bp, Homo sapiens
tcctgcctccggg

SEQ ID NO: 2861127 - DNA, 14 bp, Homo sapiens
tcctgcctccgggc

SEQ ID NO: 2861128 - DNA, 16 bp, Homo sapiens
tcctgccttcctcctg

SEQ ID NO: 2861129 - DNA, 21 bp, Homo sapiens
tcctggacatgaagattcttt

SEQ ID NO: 2861130 - DNA, 14 bp, Homo sapiens
tcctgggaaatatt

SEQ ID NO: 2861131 - DNA, 16 bp, Homo sapiens
tcctgggaaatattcc

SEQ ID NO: 2861132 - DNA, 23 bp, Homo sapiens
tcctgggccctctctgctctgcg

SEQ ID NO: 2861133 - DNA, 14 bp, Homo sapiens
tcctgggtttccat

SEQ ID NO: 2861134 - DNA, 21 bp, Homo sapiens
tcctgggttttgtattctctg

SEQ ID NO: 2861135 - DNA, 22 bp, Homo sapiens
tcctgggttttgtattctctga

SEQ ID NO: 2861136 - DNA, 18 bp, Homo sapiens
tcctgtgtgtactctgtc

SEQ ID NO: 2861137 - DNA, 23 bp, Homo sapiens
tccttcccccatcccctttcctc

SEQ ID NO: 2861138 - DNA, 11 bp, Homo sapiens
tcctttcctct

SEQ ID NO: 2861139 - DNA, 15 bp, Homo sapiens
tcctttcctctgcag

SEQ ID NO: 2861140 - DNA, 17 bp, Homo sapiens
tcgctgaaattgcttat

SEQ ID NO: 2861141 - DNA, 19 bp, Homo sapiens
tcgctgccagctctgtatc

SEQ ID NO: 2861142 - DNA, 23 bp, Homo sapiens
tcgctggactctcagtctctgag

SEQ ID NO: 2861143 - DNA, 21 bp, Homo sapiens
tcggcagatgatgctttggaa

SEQ ID NO: 2861144 - DNA, 13 bp, Homo sapiens
tcgggcccttccc

SEQ ID NO: 2861145 - DNA, 16 bp, Homo sapiens
tctaaaaagaaaaaga

SEQ ID NO: 2861146 - DNA, 15 bp, Homo sapiens
tctaaataaaaatat

SEQ ID NO: 2861147 - DNA, 22 bp, Homo sapiens
tctaaataaaaatatgtaattt

SEQ ID NO: 2861148 - DNA, 16 bp, Homo sapiens
tctaaatatgaatgaa

SEQ ID NO: 2861149 - DNA, 13 bp, Homo sapiens
tctaacctcatct

SEQ ID NO: 2861150 - DNA, 22 bp, Homo sapiens
tctaaccttcacgattaactgt

SEQ ID NO: 2861151 - DNA, 17 bp, Homo sapiens
tctaactacaaggacaa

SEQ ID NO: 2861152 - DNA, 14 bp, Homo sapiens
tctaagaaaatgta

SEQ ID NO: 2861153 - DNA, 20 bp, Homo sapiens
tctaagagaacaatgtgcta

SEQ ID NO: 2861154 - DNA, 14 bp, Homo sapiens
tctaagtctttcca

SEQ ID NO: 2861155 - DNA, 19 bp, Homo sapiens
tctaatagaactcagtttt

SEQ ID NO: 2861156 - DNA, 17 bp, Homo sapiens
tctacagagcttccctg

SEQ ID NO: 2861157 - DNA, 17 bp, Homo sapiens
tctacctacatatttgt

SEQ ID NO: 2861158 - DNA, 20 bp, Homo sapiens
tctactttgaagtcatacca

SEQ ID NO: 2861159 - DNA, 15 bp, Homo sapiens
tctagaattcactga

SEQ ID NO: 2861160 - DNA, 18 bp, Homo sapiens
tctagctgttgagctgtt

SEQ ID NO: 2861161 - DNA, 24 bp, Homo sapiens
tctagtgggacagcccagagcctg

SEQ ID NO: 2861162 - DNA, 13 bp, Homo sapiens
tctatagactcta

SEQ ID NO: 2861163 - DNA, 16 bp, Homo sapiens
tctatagactctagga

SEQ ID NO: 2861164 - DNA, 14 bp, Homo sapiens
tctatgacaaattc

SEQ ID NO: 2861165 - DNA, 15 bp, Homo sapiens
tctatgacaaattca

SEQ ID NO: 2861166 - DNA, 16 bp, Homo sapiens
tctatggcttatttct

SEQ ID NO: 2861167 - DNA, 15 bp, Homo sapiens
tctatttctcctcca

SEQ ID NO: 2861168 - DNA, 20 bp, Homo sapiens
tctatttctcctccatggga

SEQ ID NO: 2861169 - DNA, 14 bp, Homo sapiens
tctatttttatgat

SEQ ID NO: 2861170 - DNA, 18 bp, Homo sapiens
tctatttttatgatgaca

SEQ ID NO: 2861171 - DNA, 23 bp, Homo sapiens
tctcaggaccaaagctttcatgt

SEQ ID NO: 2861172 - DNA, 17 bp, Homo sapiens
tctcagtctctgagcag

SEQ ID NO: 2861173 - DNA, 23 bp, Homo sapiens
tctcagtgggacaaaccagagca

SEQ ID NO: 2861174 - DNA, 18 bp, Homo sapiens
tctcagtggtgtgtgaag

SEQ ID NO: 2861175 - DNA, 13 bp, Homo sapiens
tctcatccatcat

SEQ ID NO: 2861176 - DNA, 19 bp, Homo sapiens
tctcattggacccttccat

SEQ ID NO: 2861177 - DNA, 14 bp, Homo sapiens
tctccatggccctg

SEQ ID NO: 2861178 - DNA, 22 bp, Homo sapiens
tctcctcttcatggcatcttca

SEQ ID NO: 2861179 - DNA, 18 bp, Homo sapiens
tctcctgccttcctcctg

SEQ ID NO: 2861180 - DNA, 18 bp, Homo sapiens
tctctaggcctctccagt

SEQ ID NO: 2861181 - DNA, 13 bp, Homo sapiens
tctctattttcat

SEQ ID NO: 2861182 - DNA, 22 bp, Homo sapiens
tctctgctctgcgtgtcacctg

SEQ ID NO: 2861183 - DNA, 12 bp, Homo sapiens
tctctgggctga

SEQ ID NO: 2861184 - DNA, 15 bp, Homo sapiens
tctctgtctcatcca

SEQ ID NO: 2861185 - DNA, 16 bp, Homo sapiens
tctctgtgaacgattt

SEQ ID NO: 2861186 - DNA, 15 bp, Homo sapiens
tctcttatagaatat

SEQ ID NO: 2861187 - DNA, 21 bp, Homo sapiens
tctcttatagaatatttatta

SEQ ID NO: 2861188 - DNA, 18 bp, Homo sapiens
tctcttcccttcccagac

SEQ ID NO: 2861189 - DNA, 20 bp, Homo sapiens
tctcttcccttcccagacca

SEQ ID NO: 2861190 - DNA, 21 bp, Homo sapiens
tctcttcccttcccagaccag

SEQ ID NO: 2861191 - DNA, 16 bp, Homo sapiens
tctctttgagtcaata

SEQ ID NO: 2861192 - DNA, 20 bp, Homo sapiens
tctgaaggagccccattcct

SEQ ID NO: 2861193 - DNA, 19 bp, Homo sapiens
tctgaccatctgtgactat

SEQ ID NO: 2861194 - DNA, 14 bp, Homo sapiens
tctgactcagggct

SEQ ID NO: 2861195 - DNA, 20 bp, Homo sapiens
tctgactcagggctcctggg

SEQ ID NO: 2861196 - DNA, 19 bp, Homo sapiens
tctgagcaccccctcattc

SEQ ID NO: 2861197 - DNA, 20 bp, Homo sapiens
tctgagcaccccctcattcc

SEQ ID NO: 2861198 - DNA, 22 bp, Homo sapiens
tctgagcaccccctcattcccc

SEQ ID NO: 2861199 - DNA, 19 bp, Homo sapiens
tctgagcagtgaatgattc

SEQ ID NO: 2861200 - DNA, 19 bp, Homo sapiens
tctgagggaaaccagagtc

SEQ ID NO: 2861201 - DNA, 20 bp, Homo sapiens
tctgcagcactttaaccctc

SEQ ID NO: 2861202 - DNA, 14 bp, Homo sapiens
tctgccaatctgta

SEQ ID NO: 2861203 - DNA, 20 bp, Homo sapiens
tctgccaatctgtacaaaat

SEQ ID NO: 2861204 - DNA, 15 bp, Homo sapiens
tctgccactgaggag

SEQ ID NO: 2861205 - DNA, 14 bp, Homo sapiens
tctgcctcttctgg

SEQ ID NO: 2861206 - DNA, 15 bp, Homo sapiens
tctgcctcttctggg

SEQ ID NO: 2861207 - DNA, 19 bp, Homo sapiens
tctgctagactcctcagga

SEQ ID NO: 2861208 - DNA, 23 bp, Homo sapiens
tctgctagactcctcaggagaga

SEQ ID NO: 2861209 - DNA, 12 bp, Homo sapiens
tctgctcatcat

SEQ ID NO: 2861210 - DNA, 23 bp, Homo sapiens
tctgctcatcattctctgtctca

SEQ ID NO: 2861211 - DNA, 19 bp, Homo sapiens
tctgcttgttattagagat

SEQ ID NO: 2861212 - DNA, 14 bp, Homo sapiens
tctggctagagccg

SEQ ID NO: 2861213 - DNA, 21 bp, Homo sapiens
tctgggaagcttgagcctccc

SEQ ID NO: 2861214 - DNA, 15 bp, Homo sapiens
tctgtagagccaatt

SEQ ID NO: 2861215 - DNA, 18 bp, Homo sapiens
tgatatggtgaagggaag

SEQ ID NO: 2861216 - DNA, 12 bp, Homo sapiens
tgatattgctgt

SEQ ID NO: 2861217 - DNA, 21 bp, Homo sapiens
tgatcagagccgtggtccttt

SEQ ID NO: 2861218 - DNA, 15 bp, Homo sapiens
tgatcagcaaaaaga

SEQ ID NO: 2861219 - DNA, 17 bp, Homo sapiens
tgatcgcctttcccagg

SEQ ID NO: 2861220 - DNA, 19 bp, Homo sapiens
tgatgaagaagggggtggg

SEQ ID NO: 2861221 - DNA, 17 bp, Homo sapiens
tgatgcatgcactgttc

SEQ ID NO: 2861222 - DNA, 22 bp, Homo sapiens
tgatgtaatcttgaattgtaac

SEQ ID NO: 2861223 - DNA, 18 bp, Homo sapiens
tgatgtccttaaaatgtg

SEQ ID NO: 2861224 - DNA, 14 bp, Homo sapiens
tgattactgcaatc

SEQ ID NO: 2861225 - DNA, 20 bp, Homo sapiens
tgattatagcaactaatgtt

SEQ ID NO: 2861226 - DNA, 16 bp, Homo sapiens
tgattattcagtgtca

SEQ ID NO: 2861227 - DNA, 16 bp, Homo sapiens
tgattcaagaaacaga

SEQ ID NO: 2861228 - DNA, 12 bp, Homo sapiens
tgattcagtgtt

SEQ ID NO: 2861229 - DNA, 19 bp, Homo sapiens
tgatttccctccagagaaa

SEQ ID NO: 2861230 - DNA, 12 bp, Homo sapiens
tgatttctaatt

SEQ ID NO: 2861231 - DNA, 20 bp, Homo sapiens
tgatttgtgaaacagttgct

SEQ ID NO: 2861232 - DNA, 19 bp, Homo sapiens
tgcaaaaggactctcagga

SEQ ID NO: 2861233 - DNA, 22 bp, Homo sapiens
tgcaaaaggactctcaggacca

SEQ ID NO: 2861234 - DNA, 19 bp, Homo sapiens
tgcaaagtctccagaagaa

SEQ ID NO: 2861235 - DNA, 21 bp, Homo sapiens
tgcaaagtctccagaagaaaa

SEQ ID NO: 2861236 - DNA, 19 bp, Homo sapiens
tgcaacctcgctggactct

SEQ ID NO: 2861237 - DNA, 22 bp, Homo sapiens
tgcaacctcgctggactctcag

SEQ ID NO: 2861238 - DNA, 20 bp, Homo sapiens
tgcaagccccaactttctta

SEQ ID NO: 2861239 - DNA, 23 bp, Homo sapiens
tgcaatactgcttaattgctgat

SEQ ID NO: 2861240 - DNA, 16 bp, Homo sapiens
tgcaatcactgtgcta

SEQ ID NO: 2861241 - DNA, 14 bp, Homo sapiens
tgcacactttgcca

SEQ ID NO: 2861242 - DNA, 14 bp, Homo sapiens
tgcacagggtgtgg

SEQ ID NO: 2861243 - DNA, 15 bp, Homo sapiens
tgcacatctgtgtct

SEQ ID NO: 2861244 - DNA, 19 bp, Homo sapiens
tgcacatctgtgtcttgtt

SEQ ID NO: 2861245 - DNA, 20 bp, Homo sapiens
ttgacaaatgacagatcttt

SEQ ID NO: 2861246 - DNA, 17 bp, Homo sapiens
ttgacaggttttccaaa

SEQ ID NO: 2861247 - DNA, 16 bp, Homo sapiens
ttgacagtttttgaca

SEQ ID NO: 2861248 - DNA, 12 bp, Homo sapiens
ttgagcctcccc

SEQ ID NO: 2861249 - DNA, 13 bp, Homo sapiens
ttgaggaaaacaa

SEQ ID NO: 2861250 - DNA, 15 bp, Homo sapiens
ttgaggccaagatgg

SEQ ID NO: 2861251 - DNA, 15 bp, Homo sapiens
ttgagtgctctgatc

SEQ ID NO: 2861252 - DNA, 15 bp, Homo sapiens
ttgattattcagtgt

SEQ ID NO: 2861253 - DNA, 14 bp, Homo sapiens
ttgatttttcttat

SEQ ID NO: 2861254 - DNA, 19 bp, Homo sapiens
ttgcaagggaaaagtctct

SEQ ID NO: 2861255 - DNA, 16 bp, Homo sapiens
ttgcacctgtccccac

SEQ ID NO: 2861256 - DNA, 18 bp, Homo sapiens
ttgcacctgtccccaccc

SEQ ID NO: 2861257 - DNA, 15 bp, Homo sapiens
ttgcactgacaagat

SEQ ID NO: 2861258 - DNA, 16 bp, Homo sapiens
ttgcactgacaagatg

SEQ ID NO: 2861259 - DNA, 12 bp, Homo sapiens
ttgcattttgat

SEQ ID NO: 2861260 - DNA, 19 bp, Homo sapiens
ttgccatattttcaccatt

SEQ ID NO: 2861261 - DNA, 16 bp, Homo sapiens
ttgccctatgctgtgc

SEQ ID NO: 2861262 - DNA, 16 bp, Homo sapiens
ttgcctggactgacca

SEQ ID NO: 2861263 - DNA, 23 bp, Homo sapiens
ttgctatggcaggataagaaagc

SEQ ID NO: 2861264 - DNA, 11 bp, Homo sapiens
ttgctgctgtt

SEQ ID NO: 2861265 - DNA, 23 bp, Homo sapiens
ttggaatattgtccattgtccaa

SEQ ID NO: 2861266 - DNA, 15 bp, Homo sapiens
ttggactccaggcct

SEQ ID NO: 2861267 - DNA, 14 bp, Homo sapiens
ttggactcctccca

SEQ ID NO: 2861268 - DNA, 12 bp, Homo sapiens
ttggacttctga

SEQ ID NO: 2861269 - DNA, 16 bp, Homo sapiens
ttggcattctttgcaa

SEQ ID NO: 2861270 - DNA, 11 bp, Homo sapiens
ttggccaatta

SEQ ID NO: 2861271 - DNA, 22 bp, Homo sapiens
ttggccgtggccatcagggtgg

SEQ ID NO: 2861272 - DNA, 23 bp, Homo sapiens
ttggccgtggccatcagggtggg

SEQ ID NO: 2861273 - DNA, 20 bp, Homo sapiens
ttgtaagtgtaaaaaatgtc

SEQ ID NO: 2861274 - DNA, 15 bp, Homo sapiens
ttgtaattatgtaaa

SEQ ID NO: 2861275 - DNA, 20 bp, Homo sapiens
ttgtagaactcactctgggc

SEQ ID NO: 2861276 - DNA, 14 bp, Homo sapiens
ttgtatatgactgc

SEQ ID NO: 2861277 - DNA, 15 bp, Homo sapiens
ttgtattctctgagc

SEQ ID NO: 2861278 - DNA, 16 bp, Homo sapiens
ttgtattctctgagct

SEQ ID NO: 2861279 - DNA, 20 bp, Homo sapiens
ttgtattctctgagctgtgc

SEQ ID NO: 2861280 - DNA, 15 bp, Homo sapiens
ttgtcagcatctgac

SEQ ID NO: 2861281 - DNA, 13 bp, Homo sapiens
ttgtccctctcac

SEQ ID NO: 2861282 - DNA, 18 bp, Homo sapiens
ttgtcttatgtgaaaaat

SEQ ID NO: 2861283 - DNA, 20 bp, Homo sapiens
ttgtcttatgtgaaaaatta

SEQ ID NO: 2861284 - DNA, 21 bp, Homo sapiens
ttgtgtttctagaatcacagc

SEQ ID NO: 2861285 - DNA, 16 bp, Homo sapiens
ttgttaacctttctaa

SEQ ID NO: 2861286 - DNA, 23 bp, Homo sapiens
aacaaataatttgaactttggaa

SEQ ID NO: 2861287 - DNA, 13 bp, Homo sapiens
aacaattaactgc

SEQ ID NO: 2861288 - DNA, 14 bp, Homo sapiens
aacactatttgtga

SEQ ID NO: 2861289 - DNA, 15 bp, Homo sapiens
aacactatttgtgac

SEQ ID NO: 2861290 - DNA, 18 bp, Homo sapiens
aacactgtccttccctgc

SEQ ID NO: 2861291 - DNA, 13 bp, Homo sapiens
aacagacacaatt

SEQ ID NO: 2861292 - DNA, 17 bp, Homo sapiens
aacagacacaatttata

SEQ ID NO: 2861293 - DNA, 12 bp, Homo sapiens
aacagccagcaa

SEQ ID NO: 2861294 - DNA, 24 bp, Homo sapiens
aacagggacttgtttagagagcct

SEQ ID NO: 2861295 - DNA, 17 bp, Homo sapiens
aacagtcactggaaaga

SEQ ID NO: 2861296 - DNA, 14 bp, Homo sapiens
aacagttgctgtga

SEQ ID NO: 2861297 - DNA, 21 bp, Homo sapiens
aacataacttctcatgtatat

SEQ ID NO: 2861298 - DNA, 15 bp, Homo sapiens
aacatacaagaaaat

SEQ ID NO: 2861299 - DNA, 18 bp, Homo sapiens
aacatacaagaaaatgta

SEQ ID NO: 2861300 - DNA, 14 bp, Homo sapiens
aacatccaagccag

SEQ ID NO: 2861301 - DNA, 17 bp, Homo sapiens
aacatccaagccagagt

SEQ ID NO: 2861302 - DNA, 17 bp, Homo sapiens
aacatgggctgtgatta

SEQ ID NO: 2861303 - DNA, 23 bp, Homo sapiens
aacattttatcattaaaaattac

SEQ ID NO: 2861304 - DNA, 13 bp, Homo sapiens
aaccaatcctgga

SEQ ID NO: 2861305 - DNA, 14 bp, Homo sapiens
aaccacgcaggaag

SEQ ID NO: 2861306 - DNA, 14 bp, Homo sapiens
aaccaggccttcat

SEQ ID NO: 2861307 - DNA, 21 bp, Homo sapiens
aaccagggagcccctttgatg

SEQ ID NO: 2861308 - DNA, 15 bp, Homo sapiens
aaccatttttgaacc

SEQ ID NO: 2861309 - DNA, 17 bp, Homo sapiens
aaccatttttgaacctt

SEQ ID NO: 2861310 - DNA, 21 bp, Homo sapiens
aacccccagctaataaaccag

SEQ ID NO: 2861311 - DNA, 15 bp, Homo sapiens
aacccccaggtggcc

SEQ ID NO: 2861312 - DNA, 13 bp, Homo sapiens
aaccctctcttcc

SEQ ID NO: 2861313 - DNA, 16 bp, Homo sapiens
aaccctctcttcccta

SEQ ID NO: 2861314 - DNA, 23 bp, Homo sapiens
aaccctctcttccctattatttc

SEQ ID NO: 2861315 - DNA, 18 bp, Homo sapiens
aacctcttcagaggccct

SEQ ID NO: 2861316 - DNA, 17 bp, Homo sapiens
aaccttattgtacctct

SEQ ID NO: 2861317 - DNA, 24 bp, Homo sapiens
aaccttcacgattaactgtgaaat

SEQ ID NO: 2861318 - DNA, 12 bp, Homo sapiens
aacgatttagaa

SEQ ID NO: 2861319 - DNA, 23 bp, Homo sapiens
aacgcttgtagaactcactctgg

SEQ ID NO: 2861320 - DNA, 18 bp, Homo sapiens
aactaaataccattcact

SEQ ID NO: 2861321 - DNA, 14 bp, Homo sapiens
aactaatgtttgaa

SEQ ID NO: 2861322 - DNA, 17 bp, Homo sapiens
aactagggccaagccca

SEQ ID NO: 2861323 - DNA, 18 bp, Homo sapiens
aactatcttctttggact

SEQ ID NO: 2861324 - DNA, 17 bp, Homo sapiens
aactatgttcctaacaa

SEQ ID NO: 2861325 - DNA, 20 bp, Homo sapiens
aactatgttcctaacaaaat

SEQ ID NO: 2861326 - DNA, 17 bp, Homo sapiens
aactcactctgggctgt

SEQ ID NO: 2861327 - DNA, 18 bp, Homo sapiens
aactcagttttaactaga

SEQ ID NO: 2861328 - DNA, 18 bp, Homo sapiens
aactcattttcatattgt

SEQ ID NO: 2861329 - DNA, 23 bp, Homo sapiens
aactcattttcatattgtaatct

SEQ ID NO: 2861330 - DNA, 14 bp, Homo sapiens
aactctttgagaaa

SEQ ID NO: 2861331 - DNA, 18 bp, Homo sapiens
aactgactttttcccccc

SEQ ID NO: 2861332 - DNA, 13 bp, Homo sapiens
aactgtactgaat

SEQ ID NO: 2861333 - DNA, 22 bp, Homo sapiens
aactgttgcacttttgaatgtc

SEQ ID NO: 2861334 - DNA, 18 bp, Homo sapiens
aagaaaatttgccaatct

SEQ ID NO: 2861335 - DNA, 21 bp, Homo sapiens
aagaaacacatcaaataaact

SEQ ID NO: 2861336 - DNA, 14 bp, Homo sapiens
aagaagggggtggg

SEQ ID NO: 2861337 - DNA, 19 bp, Homo sapiens
aagaatgaaaaatataatg

SEQ ID NO: 2861338 - DNA, 19 bp, Homo sapiens
aagactgagccagattggc

SEQ ID NO: 2861339 - DNA, 13 bp, Homo sapiens
aagactgcagaac

SEQ ID NO: 2861340 - DNA, 22 bp, Homo sapiens
aagactgcagaacccccaggtg

SEQ ID NO: 2861341 - DNA, 11 bp, Homo sapiens
aagagaaagag

SEQ ID NO: 2861342 - DNA, 16 bp, Homo sapiens
aagagctagaaaaata

SEQ ID NO: 2861343 - DNA, 15 bp, Homo sapiens
aagaggaggagggat

SEQ ID NO: 2861344 - DNA, 16 bp, Homo sapiens
aagatacttacatgtt

SEQ ID NO: 2861345 - DNA, 13 bp, Homo sapiens
aagatagaaagct

SEQ ID NO: 2861346 - DNA, 19 bp, Homo sapiens
aagatagaaagctggactg

SEQ ID NO: 2861347 - DNA, 22 bp, Homo sapiens
aagatagaaagctggactgacc

SEQ ID NO: 2861348 - DNA, 13 bp, Homo sapiens
aagatctttatat

SEQ ID NO: 2861349 - DNA, 13 bp, Homo sapiens
acatggacacaga

SEQ ID NO: 2861350 - DNA, 21 bp, Homo sapiens
acatgggctgtgattactgca

SEQ ID NO: 2861351 - DNA, 23 bp, Homo sapiens
acatgggctgtgattactgcaat

SEQ ID NO: 2861352 - DNA, 18 bp, Homo sapiens
acatggtgggtccatggg

SEQ ID NO: 2861353 - DNA, 21 bp, Homo sapiens
acatgttcccaaaacaatggt

SEQ ID NO: 2861354 - DNA, 12 bp, Homo sapiens
acattaactgtt

SEQ ID NO: 2861355 - DNA, 21 bp, Homo sapiens
acattcacctgtatatttctt

SEQ ID NO: 2861356 - DNA, 23 bp, Homo sapiens
acatttctctaagagaacaatgt

SEQ ID NO: 2861357 - DNA, 15 bp, Homo sapiens
acatttggagtgttc

SEQ ID NO: 2861358 - DNA, 23 bp, Homo sapiens
acatttgtaagtgtaaaaaatgt

SEQ ID NO: 2861359 - DNA, 12 bp, Homo sapiens
acattttctaaa

SEQ ID NO: 2861360 - DNA, 16 bp, Homo sapiens
acattttctaaataaa

SEQ ID NO: 2861361 - DNA, 19 bp, Homo sapiens
acattttctaaataaaaat

SEQ ID NO: 2861362 - DNA, 14 bp, Homo sapiens
accaaccaggcctt

SEQ ID NO: 2861363 - DNA, 20 bp, Homo sapiens
accaatacaaaatgtattac

SEQ ID NO: 2861364 - DNA, 17 bp, Homo sapiens
accacaccaaccaggcc

SEQ ID NO: 2861365 - DNA, 17 bp, Homo sapiens
accaccttggactcctc

SEQ ID NO: 2861366 - DNA, 14 bp, Homo sapiens
accacgcaggaagc

SEQ ID NO: 2861367 - DNA, 17 bp, Homo sapiens
accacttcattcttgaa

SEQ ID NO: 2861368 - DNA, 21 bp, Homo sapiens
accactttattgcaatgcaga

SEQ ID NO: 2861369 - DNA, 20 bp, Homo sapiens
accagagcttctctgggctg

SEQ ID NO: 2861370 - DNA, 23 bp, Homo sapiens
accagagcttctctgggctgaat

SEQ ID NO: 2861371 - DNA, 17 bp, Homo sapiens
accagagtctgtatttt

SEQ ID NO: 2861372 - DNA, 20 bp, Homo sapiens
accagggagcccctttgatg

SEQ ID NO: 2861373 - DNA, 19 bp, Homo sapiens
accagttaagaatggaaga

SEQ ID NO: 2861374 - DNA, 12 bp, Homo sapiens
accatctgtgac

SEQ ID NO: 2861375 - DNA, 23 bp, Homo sapiens
accatctgtgactataaagctgt

SEQ ID NO: 2861376 - DNA, 22 bp, Homo sapiens
accattcactactcatgcgtga

SEQ ID NO: 2861377 - DNA, 18 bp, Homo sapiens
accattgaattcttggtt

SEQ ID NO: 2861378 - DNA, 22 bp, Homo sapiens
acccagaggaaggggccagagg

SEQ ID NO: 2861379 - DNA, 16 bp, Homo sapiens
acccagtccacaaaat

SEQ ID NO: 2861380 - DNA, 16 bp, Homo sapiens
acccatgatactccac

SEQ ID NO: 2861381 - DNA, 22 bp, Homo sapiens
acccatgatactccactcccag

SEQ ID NO: 2861382 - DNA, 19 bp, Homo sapiens
acccattaggcatgcctaa

SEQ ID NO: 2861383 - DNA, 14 bp, Homo sapiens
accccaaagagaaa

SEQ ID NO: 2861384 - DNA, 17 bp, Homo sapiens
accccaaagagaaagag

SEQ ID NO: 2861385 - DNA, 18 bp, Homo sapiens
accccaatatatgtattt

SEQ ID NO: 2861386 - DNA, 19 bp, Homo sapiens
accccaatatatgtatttt

SEQ ID NO: 2861387 - DNA, 23 bp, Homo sapiens
accccaatatatgtattttttga

SEQ ID NO: 2861388 - DNA, 19 bp, Homo sapiens
acccccagctaataaacca

SEQ ID NO: 2861389 - DNA, 20 bp, Homo sapiens
acccccagctaataaaccag

SEQ ID NO: 2861390 - DNA, 17 bp, Homo sapiens
acccccatttctattta

SEQ ID NO: 2861391 - DNA, 15 bp, Homo sapiens
accccctcattcccc

SEQ ID NO: 2861392 - DNA, 17 bp, Homo sapiens
accccctcattcccctc

SEQ ID NO: 2861393 - DNA, 18 bp, Homo sapiens
acccccttctccatccac

SEQ ID NO: 2861394 - DNA, 22 bp, Homo sapiens
acccctcccctcccacccacag

SEQ ID NO: 2861395 - DNA, 11 bp, Homo sapiens
accccttcctt

SEQ ID NO: 2861396 - DNA, 12 bp, Homo sapiens
accccttccttt

SEQ ID NO: 2861397 - DNA, 16 bp, Homo sapiens
accccttcctttcctc

SEQ ID NO: 2861398 - DNA, 18 bp, Homo sapiens
accccttcctttcctctg

SEQ ID NO: 2861399 - DNA, 15 bp, Homo sapiens
accctccaccttcca

SEQ ID NO: 2861400 - DNA, 21 bp, Homo sapiens
accctccactcagctgtcctg

SEQ ID NO: 2861401 - DNA, 16 bp, Homo sapiens
accctctttcttgttt

SEQ ID NO: 2861402 - DNA, 22 bp, Homo sapiens
accctctttcttgtttgtcagc

SEQ ID NO: 2861403 - DNA, 23 bp, Homo sapiens
accctctttcttgtttgtcagca

SEQ ID NO: 2861404 - DNA, 17 bp, Homo sapiens
accctgagctgaggcag

SEQ ID NO: 2861405 - DNA, 22 bp, Homo sapiens
accctgagctgaggcagcagtg

SEQ ID NO: 2861406 - DNA, 21 bp, Homo sapiens
accctggtccagtcgggagga

SEQ ID NO: 2861407 - DNA, 22 bp, Homo sapiens
accctggtccagtcgggaggag

SEQ ID NO: 2861408 - DNA, 14 bp, Homo sapiens
accgtgggctccct

SEQ ID NO: 2861409 - DNA, 16 bp, Homo sapiens
accgtgggctccctga

SEQ ID NO: 2861410 - DNA, 23 bp, Homo sapiens
acctacagacctggctctcagag

SEQ ID NO: 2861411 - DNA, 21 bp, Homo sapiens
acctcaacccccatttctatt

SEQ ID NO: 2861412 - DNA, 22 bp, Homo sapiens
acctcaacccccatttctattt

SEQ ID NO: 2861413 - DNA, 16 bp, Homo sapiens
acctccacatcctcca

SEQ ID NO: 2861414 - DNA, 15 bp, Homo sapiens
acctccaggcctgtt

SEQ ID NO: 2861415 - DNA, 13 bp, Homo sapiens
acctctgatacct

SEQ ID NO: 2861416 - DNA, 15 bp, Homo sapiens
acctctgatacctca

SEQ ID NO: 2861417 - DNA, 18 bp, Homo sapiens
acctctggctagagccga

SEQ ID NO: 2861418 - DNA, 15 bp, Homo sapiens
acctcttcagaggcc

SEQ ID NO: 2861419 - DNA, 18 bp, Homo sapiens
acctcttcagaggccctc

SEQ ID NO: 2861420 - DNA, 21 bp, Homo sapiens
acctgaaaacactgtgcacat

SEQ ID NO: 2861421 - DNA, 14 bp, Homo sapiens
acctgaatttgtat

SEQ ID NO: 2861422 - DNA, 15 bp, Homo sapiens
acctgaatttgtata

SEQ ID NO: 2861423 - DNA, 22 bp, Homo sapiens
acctgaatttgtatatgactgc

SEQ ID NO: 2861424 - DNA, 17 bp, Homo sapiens
acctgacactcccttgg

SEQ ID NO: 2861425 - DNA, 19 bp, Homo sapiens
acctgacactcccttgggc

SEQ ID NO: 2861426 - DNA, 21 bp, Homo sapiens
acctgatgtcagctgctgttg

SEQ ID NO: 2861427 - DNA, 22 bp, Homo sapiens
acctgatgtcagctgctgttga

SEQ ID NO: 2861428 - DNA, 17 bp, Homo sapiens
acctggctctcagagga

SEQ ID NO: 2861429 - DNA, 19 bp, Homo sapiens
acctgtaatcccagctact

SEQ ID NO: 2861430 - DNA, 14 bp, Homo sapiens
acctgtccccaccc

SEQ ID NO: 2861431 - DNA, 22 bp, Homo sapiens
acctgtgctgaacataacttct

SEQ ID NO: 2861432 - DNA, 15 bp, Homo sapiens
accttaatttaactt

SEQ ID NO: 2861433 - DNA, 17 bp, Homo sapiens
accttaatttaactttc

SEQ ID NO: 2861434 - DNA, 22 bp, Homo sapiens
accttagatgttctaagtcttt

SEQ ID NO: 2861435 - DNA, 14 bp, Homo sapiens
accttattgtacct

SEQ ID NO: 2861436 - DNA, 17 bp, Homo sapiens
accttattgtacctctc

SEQ ID NO: 2861437 - DNA, 23 bp, Homo sapiens
accttcacgattaactgtgaaat

SEQ ID NO: 2861438 - DNA, 14 bp, Homo sapiens
accttccccagact

SEQ ID NO: 2861439 - DNA, 16 bp, Homo sapiens
accttggactcctccc

SEQ ID NO: 2861440 - DNA, 17 bp, Homo sapiens
accttggactcctccca

SEQ ID NO: 2861441 - DNA, 17 bp, Homo sapiens
acctttctaaccttcac

SEQ ID NO: 2861442 - DNA, 14 bp, Homo sapiens
acgaatacttttgc

SEQ ID NO: 2861443 - DNA, 22 bp, Homo sapiens
acgaatacttttgccctttgat

SEQ ID NO: 2861444 - DNA, 12 bp, Homo sapiens
acgactgtctcc

SEQ ID NO: 2861445 - DNA, 18 bp, Homo sapiens
acgatttagaaagaagcc

SEQ ID NO: 2861446 - DNA, 14 bp, Homo sapiens
acgcacacatggac

SEQ ID NO: 2861447 - DNA, 15 bp, Homo sapiens
acgcaggaagcctac

SEQ ID NO: 2861448 - DNA, 17 bp, Homo sapiens
acgccctccctctccca

SEQ ID NO: 2861449 - DNA, 18 bp, Homo sapiens
acgccctccctctcccag

SEQ ID NO: 2861450 - DNA, 13 bp, Homo sapiens
acgcctgaggaac

SEQ ID NO: 2861451 - DNA, 18 bp, Homo sapiens
acgcctgggggtgccagg

SEQ ID NO: 2861452 - DNA, 20 bp, Homo sapiens
acgcttgtagaactcactct

SEQ ID NO: 2861453 - DNA, 13 bp, Homo sapiens
acgtggcactggt

SEQ ID NO: 2861454 - DNA, 16 bp, Homo sapiens
acgtgtttgtgctgtg

SEQ ID NO: 2861455 - DNA, 14 bp, Homo sapiens
actaaaattatgtt

SEQ ID NO: 2861456 - DNA, 18 bp, Homo sapiens
actaaaattatgttactg

SEQ ID NO: 2861457 - DNA, 22 bp, Homo sapiens
actactgttatcagtaatgcta

SEQ ID NO: 2861458 - DNA, 18 bp, Homo sapiens
actagggatccctcatct

SEQ ID NO: 2861459 - DNA, 24 bp, Homo sapiens
aagtactctttaacatacaagaaa

SEQ ID NO: 2861460 - DNA, 13 bp, Homo sapiens
aagtagaagagga

SEQ ID NO: 2861461 - DNA, 13 bp, Homo sapiens
aagtaggaagtaa

SEQ ID NO: 2861462 - DNA, 21 bp, Homo sapiens
aagtatgcaatgcttcattat

SEQ ID NO: 2861463 - DNA, 18 bp, Homo sapiens
aagtctccagaagaaaat

SEQ ID NO: 2861464 - DNA, 13 bp, Homo sapiens
aagtctctgtgta

SEQ ID NO: 2861465 - DNA, 18 bp, Homo sapiens
aagtgaaattaagcattt

SEQ ID NO: 2861466 - DNA, 22 bp, Homo sapiens
aagtgatatggtgaagggaagt

SEQ ID NO: 2861467 - DNA, 18 bp, Homo sapiens
aagtgcatgaaaaaccat

SEQ ID NO: 2861468 - DNA, 23 bp, Homo sapiens
aagtgggatttggggcctcaaga

SEQ ID NO: 2861469 - DNA, 15 bp, Homo sapiens
aagtgtaaaaaatgt

SEQ ID NO: 2861470 - DNA, 19 bp, Homo sapiens
aataaaaagaaagatactt

SEQ ID NO: 2861471 - DNA, 21 bp, Homo sapiens
aataaatgtatcttattcaca

SEQ ID NO: 2861472 - DNA, 18 bp, Homo sapiens
aataaatttggttctaat

SEQ ID NO: 2861473 - DNA, 19 bp, Homo sapiens
aataataaagtacttgact

SEQ ID NO: 2861474 - DNA, 16 bp, Homo sapiens
aataatgtaacatgat

SEQ ID NO: 2861475 - DNA, 15 bp, Homo sapiens
aatacgtttgtgttt

SEQ ID NO: 2861476 - DNA, 16 bp, Homo sapiens
aatactgccaaaacat

SEQ ID NO: 2861477 - DNA, 20 bp, Homo sapiens
aatactgcttaattgctgat

SEQ ID NO: 2861478 - DNA, 13 bp, Homo sapiens
aatagaataattc

SEQ ID NO: 2861479 - DNA, 20 bp, Homo sapiens
aatagataagagtagaaact

SEQ ID NO: 2861480 - DNA, 13 bp, Homo sapiens
aatagcacttttt

SEQ ID NO: 2861481 - DNA, 22 bp, Homo sapiens
aatagctttagtgaattaaatt

SEQ ID NO: 2861482 - DNA, 18 bp, Homo sapiens
aatagtgtcatataaact

SEQ ID NO: 2861483 - DNA, 13 bp, Homo sapiens
aatatatattaag

SEQ ID NO: 2861484 - DNA, 11 bp, Homo sapiens
aatatatgtat

SEQ ID NO: 2861485 - DNA, 23 bp, Homo sapiens
aatatatgtattttttgaatcta

SEQ ID NO: 2861486 - DNA, 18 bp, Homo sapiens
aatatcataaagcatttt

SEQ ID NO: 2861487 - DNA, 12 bp, Homo sapiens
aatatgaatgaa

SEQ ID NO: 2861488 - DNA, 19 bp, Homo sapiens
aatatgtaatttcaaaata

SEQ ID NO: 2861489 - DNA, 20 bp, Homo sapiens
aatatgtctgccacagagag

SEQ ID NO: 2861490 - DNA, 13 bp, Homo sapiens
aatattgtccatt

SEQ ID NO: 2861491 - DNA, 20 bp, Homo sapiens
aatatttactaactaaatac

SEQ ID NO: 2861492 - DNA, 15 bp, Homo sapiens
aatatttaggcaaga

SEQ ID NO: 2861493 - DNA, 18 bp, Homo sapiens
aatatttaggcaagagaa

SEQ ID NO: 2861494 - DNA, 18 bp, Homo sapiens
aatatttattacctctga

SEQ ID NO: 2861495 - DNA, 12 bp, Homo sapiens
aatatttattat

SEQ ID NO: 2861496 - DNA, 17 bp, Homo sapiens
aatcagaaagtaacaat

SEQ ID NO: 2861497 - DNA, 13 bp, Homo sapiens
aatcatgtagttt

SEQ ID NO: 2861498 - DNA, 19 bp, Homo sapiens
aatcatttctatttctcct

SEQ ID NO: 2861499 - DNA, 17 bp, Homo sapiens
aatccatccatgtactt

SEQ ID NO: 2861500 - DNA, 20 bp, Homo sapiens
aatccttactaagtaggtga

SEQ ID NO: 2861501 - DNA, 21 bp, Homo sapiens
aatcggatctggggctctggg

SEQ ID NO: 2861502 - DNA, 20 bp, Homo sapiens
aatctatgaacctgaaaagg

SEQ ID NO: 2861503 - DNA, 20 bp, Homo sapiens
aatctatggcttatttctat

SEQ ID NO: 2861504 - DNA, 15 bp, Homo sapiens
aatcttggggctgat

SEQ ID NO: 2861505 - DNA, 18 bp, Homo sapiens
aatcttggggctgatgaa

SEQ ID NO: 2861506 - DNA, 14 bp, Homo sapiens
aatgaaaaaatgta

SEQ ID NO: 2861507 - DNA, 12 bp, Homo sapiens
aatgaagaaagt

SEQ ID NO: 2861508 - DNA, 14 bp, Homo sapiens
aatgaagaaagtca

SEQ ID NO: 2861509 - DNA, 22 bp, Homo sapiens
aatgaagaaagtcaaaaaatta

SEQ ID NO: 2861510 - DNA, 16 bp, Homo sapiens
aatgaagatctttata

SEQ ID NO: 2861511 - DNA, 17 bp, Homo sapiens
aatgatcagcaaaaaga

SEQ ID NO: 2861512 - DNA, 19 bp, Homo sapiens
aatgatcagcaaaaagact

SEQ ID NO: 2861513 - DNA, 22 bp, Homo sapiens
aatgattcagtgttaaatgtga

SEQ ID NO: 2861514 - DNA, 23 bp, Homo sapiens
aatgattcagtgttaaatgtgat

SEQ ID NO: 2861515 - DNA, 20 bp, Homo sapiens
aatgccagagccaacctgga

SEQ ID NO: 2861516 - DNA, 14 bp, Homo sapiens
aatgctaaatgtgt

SEQ ID NO: 2861517 - DNA, 16 bp, Homo sapiens
aatgctaaatgtgtaa

SEQ ID NO: 2861518 - DNA, 21 bp, Homo sapiens
aatgctcccacctgaatttgt

SEQ ID NO: 2861519 - DNA, 14 bp, Homo sapiens
aatgctggactgga

SEQ ID NO: 2861520 - DNA, 22 bp, Homo sapiens
aatgctggactggaggcccctg

SEQ ID NO: 2861521 - DNA, 20 bp, Homo sapiens
aatgctgtttctaagaaaat

SEQ ID NO: 2861522 - DNA, 14 bp, Homo sapiens
aatgcttcattatt

SEQ ID NO: 2861523 - DNA, 12 bp, Homo sapiens
aatgggagccag

SEQ ID NO: 2861524 - DNA, 14 bp, Homo sapiens
aatgggagccagga

SEQ ID NO: 2861525 - DNA, 17 bp, Homo sapiens
aatgggatattttgaaa

SEQ ID NO: 2861526 - DNA, 19 bp, Homo sapiens
actagggatccctcatctg

SEQ ID NO: 2861527 - DNA, 16 bp, Homo sapiens
actagggccaagccca

SEQ ID NO: 2861528 - DNA, 13 bp, Homo sapiens
actataaagctgt

SEQ ID NO: 2861529 - DNA, 17 bp, Homo sapiens
actatgttcctaacaaa

SEQ ID NO: 2861530 - DNA, 19 bp, Homo sapiens
actatttaaatccttggct

SEQ ID NO: 2861531 - DNA, 21 bp, Homo sapiens
actcaagggaaaggcaagctt

SEQ ID NO: 2861532 - DNA, 19 bp, Homo sapiens
actcaataaacagtcactg

SEQ ID NO: 2861533 - DNA, 21 bp, Homo sapiens
actcaataaacagtcactgga

SEQ ID NO: 2861534 - DNA, 13 bp, Homo sapiens
actcactctgggc

SEQ ID NO: 2861535 - DNA, 18 bp, Homo sapiens
actcagctgtcctgcagc

SEQ ID NO: 2861536 - DNA, 22 bp, Homo sapiens
actcagttttaactagaattta

SEQ ID NO: 2861537 - DNA, 14 bp, Homo sapiens
actcatcctctttt

SEQ ID NO: 2861538 - DNA, 19 bp, Homo sapiens
actcattctgaaggagccc

SEQ ID NO: 2861539 - DNA, 16 bp, Homo sapiens
actccaccctccacct

SEQ ID NO: 2861540 - DNA, 18 bp, Homo sapiens
actccactcccagcagct

SEQ ID NO: 2861541 - DNA, 17 bp, Homo sapiens
actccaggcctgaccag

SEQ ID NO: 2861542 - DNA, 20 bp, Homo sapiens
actccagttaaaaaaaattt

SEQ ID NO: 2861543 - DNA, 22 bp, Homo sapiens
actccataccccgccaaggaaa

SEQ ID NO: 2861544 - DNA, 18 bp, Homo sapiens
actcccagcagctcaacc

SEQ ID NO: 2861545 - DNA, 17 bp, Homo sapiens
actccccagccccaccc

SEQ ID NO: 2861546 - DNA, 18 bp, Homo sapiens
actccctggctgttctga

SEQ ID NO: 2861547 - DNA, 20 bp, Homo sapiens
actctaaccaaggctgtgtt

SEQ ID NO: 2861548 - DNA, 13 bp, Homo sapiens
actctcagtctct

SEQ ID NO: 2861549 - DNA, 14 bp, Homo sapiens
actctcagtctctg

SEQ ID NO: 2861550 - DNA, 13 bp, Homo sapiens
actctcccctccc

SEQ ID NO: 2861551 - DNA, 15 bp, Homo sapiens
actctgctagactcc

SEQ ID NO: 2861552 - DNA, 12 bp, Homo sapiens
actctggccctg

SEQ ID NO: 2861553 - DNA, 13 bp, Homo sapiens
actctggccctgg

SEQ ID NO: 2861554 - DNA, 14 bp, Homo sapiens
actctggccctggc

SEQ ID NO: 2861555 - DNA, 17 bp, Homo sapiens
actctggccctggccct

SEQ ID NO: 2861556 - DNA, 12 bp, Homo sapiens
actctgggctgt

SEQ ID NO: 2861557 - DNA, 23 bp, Homo sapiens
actctgggctgtaacgtggcact

SEQ ID NO: 2861558 - DNA, 17 bp, Homo sapiens
actcttaggaagagaaa

SEQ ID NO: 2861559 - DNA, 20 bp, Homo sapiens
actcttaggaagagaaacca

SEQ ID NO: 2861560 - DNA, 13 bp, Homo sapiens
actctttcaaaac

SEQ ID NO: 2861561 - DNA, 18 bp, Homo sapiens
actctttgagaaacaaca

SEQ ID NO: 2861562 - DNA, 17 bp, Homo sapiens
actgaaacatggctgtg

SEQ ID NO: 2861563 - DNA, 22 bp, Homo sapiens
actgaataatatcaaataaaat

SEQ ID NO: 2861564 - DNA, 14 bp, Homo sapiens
actgacaagatgga

SEQ ID NO: 2861565 - DNA, 16 bp, Homo sapiens
actgacaagatggaaa

SEQ ID NO: 2861566 - DNA, 18 bp, Homo sapiens
actgaccaaagactgcag

SEQ ID NO: 2861567 - DNA, 19 bp, Homo sapiens
actgaccaaagactgcaga

SEQ ID NO: 2861568 - DNA, 22 bp, Homo sapiens
actgaccaaagactgcagaacc

SEQ ID NO: 2861569 - DNA, 23 bp, Homo sapiens
actgaccaaagactgcagaaccc

SEQ ID NO: 2861570 - DNA, 13 bp, Homo sapiens
actgacttaggtt

SEQ ID NO: 2861571 - DNA, 19 bp, Homo sapiens
actgagataccagcgagga

SEQ ID NO: 2861572 - DNA, 15 bp, Homo sapiens
actgaggagacagaa

SEQ ID NO: 2861573 - DNA, 18 bp, Homo sapiens
actgaggagacagaaagc

SEQ ID NO: 2861574 - DNA, 15 bp, Homo sapiens
actgatcacaaaaac

SEQ ID NO: 2861575 - DNA, 16 bp, Homo sapiens
actgcaatcactgtgc

SEQ ID NO: 2861576 - DNA, 18 bp, Homo sapiens
actgcagaacccccaggt

SEQ ID NO: 2861577 - DNA, 21 bp, Homo sapiens
actgcagaacccccaggtggc

SEQ ID NO: 2861578 - DNA, 15 bp, Homo sapiens
actgcagcacctcca

SEQ ID NO: 2861579 - DNA, 20 bp, Homo sapiens
actgccatgcctcaagaaca

SEQ ID NO: 2861580 - DNA, 20 bp, Homo sapiens
actgcctgcctcccctccgc

SEQ ID NO: 2861581 - DNA, 21 bp, Homo sapiens
actgcctgcctcccctccgca

SEQ ID NO: 2861582 - DNA, 19 bp, Homo sapiens
actgccttcgtttatattt

SEQ ID NO: 2861583 - DNA, 15 bp, Homo sapiens
actgcggaagccaaa

SEQ ID NO: 2861584 - DNA, 14 bp, Homo sapiens
actgcttgaggaaa

SEQ ID NO: 2861585 - DNA, 13 bp, Homo sapiens
actggcagaagca

SEQ ID NO: 2861586 - DNA, 14 bp, Homo sapiens
actggcagaagcat

SEQ ID NO: 2861587 - DNA, 18 bp, Homo sapiens
actggtaggttgggacac

SEQ ID NO: 2861588 - DNA, 13 bp, Homo sapiens
actggtgtaatct

SEQ ID NO: 2861589 - DNA, 20 bp, Homo sapiens
actggtgtaatctcaatgca

SEQ ID NO: 2861590 - DNA, 22 bp, Homo sapiens
actgtatgggggagattgaact

SEQ ID NO: 2861591 - DNA, 18 bp, Homo sapiens
actgtatttttcagaaat

SEQ ID NO: 2861592 - DNA, 21 bp, Homo sapiens
actgtgcacatctgtgtcttg

SEQ ID NO: 2861593 - DNA, 15 bp, Homo sapiens
actgttccccctgtg

SEQ ID NO: 2861594 - DNA, 16 bp, Homo sapiens
actgttccccctgtgc

SEQ ID NO: 2861595 - DNA, 22 bp, Homo sapiens
acttacatgttcccaaaacaat

SEQ ID NO: 2861596 - DNA, 23 bp, Homo sapiens
acttacatgttcccaaaacaatg

SEQ ID NO: 2861597 - DNA, 14 bp, Homo sapiens
acttcaacccccag

SEQ ID NO: 2861598 - DNA, 15 bp, Homo sapiens
acttcaacccccagc

SEQ ID NO: 2861599 - DNA, 19 bp, Homo sapiens
acttcattcttgaaagctg

SEQ ID NO: 2861600 - DNA, 19 bp, Homo sapiens
acttccaaatcccctaagc

SEQ ID NO: 2861601 - DNA, 15 bp, Homo sapiens
acttccctcttgaaa

SEQ ID NO: 2861602 - DNA, 19 bp, Homo sapiens
acttctacctacatatttg

SEQ ID NO: 2861603 - DNA, 17 bp, Homo sapiens
acttctggggccacctc

SEQ ID NO: 2861604 - DNA, 15 bp, Homo sapiens
acttgcttctctagc

SEQ ID NO: 2861605 - DNA, 14 bp, Homo sapiens
acttggggaccaga

SEQ ID NO: 2861606 - DNA, 17 bp, Homo sapiens
acttggttgatgtttaa

SEQ ID NO: 2861607 - DNA, 16 bp, Homo sapiens
actttattgcaatgca

SEQ ID NO: 2861608 - DNA, 17 bp, Homo sapiens
actttattgcaatgcag

SEQ ID NO: 2861609 - DNA, 13 bp, Homo sapiens
actttcctacaaa

SEQ ID NO: 2861610 - DNA, 22 bp, Homo sapiens
actttttaaagaagtgcatgaa

SEQ ID NO: 2861611 - DNA, 20 bp, Homo sapiens
acttttttgtggcaattagt

SEQ ID NO: 2861612 - DNA, 14 bp, Homo sapiens
agaaaaactaactt

SEQ ID NO: 2861613 - DNA, 13 bp, Homo sapiens
agaaaaataaaat

SEQ ID NO: 2861614 - DNA, 11 bp, Homo sapiens
agaaaatgtag

SEQ ID NO: 2861615 - DNA, 21 bp, Homo sapiens
agaaaatttgccaatctttcc

SEQ ID NO: 2861616 - DNA, 15 bp, Homo sapiens
agaaacaaacaaaac

SEQ ID NO: 2861617 - DNA, 17 bp, Homo sapiens
agaaacaactctttgag

SEQ ID NO: 2861618 - DNA, 19 bp, Homo sapiens
agaaacactatttgtgact

SEQ ID NO: 2861619 - DNA, 16 bp, Homo sapiens
agaaacagaagtagaa

SEQ ID NO: 2861620 - DNA, 16 bp, Homo sapiens
agaaaccttattgtac

SEQ ID NO: 2861621 - DNA, 15 bp, Homo sapiens
agaaactgcagggaa

SEQ ID NO: 2861622 - DNA, 12 bp, Homo sapiens
agaaagaagccc

SEQ ID NO: 2861623 - DNA, 22 bp, Homo sapiens
agaaagagtttgaaactcgaga

SEQ ID NO: 2861624 - DNA, 21 bp, Homo sapiens
agaaagcctccgctgggcttc

SEQ ID NO: 2861625 - DNA, 14 bp, Homo sapiens
agaaagctggactg

SEQ ID NO: 2861626 - DNA, 21 bp, Homo sapiens
agaaagctggactgaccaaag

SEQ ID NO: 2861627 - DNA, 19 bp, Homo sapiens
agaaagtcaaaaaattatt

SEQ ID NO: 2861628 - DNA, 19 bp, Homo sapiens
agaaagtggaaaacaagga

SEQ ID NO: 2861629 - DNA, 23 bp, Homo sapiens
agaaagtggaaaacaaggaagtc

SEQ ID NO: 2861630 - DNA, 21 bp, Homo sapiens
agaaataataaaaagaaagat

SEQ ID NO: 2861631 - DNA, 16 bp, Homo sapiens
agaaatatattttttg

SEQ ID NO: 2861632 - DNA, 15 bp, Homo sapiens
agaaatgcatatttg

SEQ ID NO: 2861633 - DNA, 15 bp, Homo sapiens
agaacaatgtgctat

SEQ ID NO: 2861634 - DNA, 20 bp, Homo sapiens
agaactcactctgggctgta

SEQ ID NO: 2861635 - DNA, 16 bp, Homo sapiens
agaacttcagcattgt

SEQ ID NO: 2861636 - DNA, 18 bp, Homo sapiens
agaacttggatgtacctg

SEQ ID NO: 2861637 - DNA, 22 bp, Homo sapiens
agaactttattaagtaaaatcc

SEQ ID NO: 2861638 - DNA, 18 bp, Homo sapiens
agaagcccaatattataa

SEQ ID NO: 2861639 - DNA, 15 bp, Homo sapiens
agaagccctgctggg

SEQ ID NO: 2861640 - DNA, 17 bp, Homo sapiens
agaagggggtgggggga

SEQ ID NO: 2861641 - DNA, 16 bp, Homo sapiens
agaataataattaacc

SEQ ID NO: 2861642 - DNA, 22 bp, Homo sapiens
agaatactgccaaaacatttat

SEQ ID NO: 2861643 - DNA, 21 bp, Homo sapiens
agaatatttactaactaaata

SEQ ID NO: 2861644 - DNA, 16 bp, Homo sapiens
agaatccctgcagcct

SEQ ID NO: 2861645 - DNA, 15 bp, Homo sapiens
agaattcacacctta

SEQ ID NO: 2861646 - DNA, 18 bp, Homo sapiens
agaattcacaccttaggt

SEQ ID NO: 2861647 - DNA, 12 bp, Homo sapiens
agacagaaagcc

SEQ ID NO: 2861648 - DNA, 14 bp, Homo sapiens
agacagaaagcctc

SEQ ID NO: 2861649 - DNA, 15 bp, Homo sapiens
agacaggtctagact

SEQ ID NO: 2861650 - DNA, 15 bp, Homo sapiens
agaccccttcctttc

SEQ ID NO: 2861651 - DNA, 18 bp, Homo sapiens
agactcctcaggagagac

SEQ ID NO: 2861652 - DNA, 21 bp, Homo sapiens
agactctaggacataaattag

SEQ ID NO: 2861653 - DNA, 20 bp, Homo sapiens
agactggatttgcagaagtt

SEQ ID NO: 2861654 - DNA, 21 bp, Homo sapiens
agactggatttgcagaagttt

SEQ ID NO: 2861655 - DNA, 12 bp, Homo sapiens
agactgggctga

SEQ ID NO: 2861656 - DNA, 14 bp, Homo sapiens
agactgggctgagg

SEQ ID NO: 2861657 - DNA, 16 bp, Homo sapiens
agagaaaaaactagag

SEQ ID NO: 2861658 - DNA, 15 bp, Homo sapiens
agagacccctcccct

SEQ ID NO: 2861659 - DNA, 14 bp, Homo sapiens
agagaccccttcct

SEQ ID NO: 2861660 - DNA, 21 bp, Homo sapiens
agagaccccttcctttcctct

SEQ ID NO: 2861661 - DNA, 13 bp, Homo sapiens
agagagcctgtca

SEQ ID NO: 2861662 - DNA, 19 bp, Homo sapiens
agagagcctgtcaccagag

SEQ ID NO: 2861663 - DNA, 20 bp, Homo sapiens
agagagcctgtcaccagagc

SEQ ID NO: 2861664 - DNA, 13 bp, Homo sapiens
agagagggactca

SEQ ID NO: 2861665 - DNA, 18 bp, Homo sapiens
agagattttgtcgggaca

SEQ ID NO: 2861666 - DNA, 17 bp, Homo sapiens
aggctgagccatgagga

SEQ ID NO: 2861667 - DNA, 20 bp, Homo sapiens
aggctggggctcgtaaatat

SEQ ID NO: 2861668 - DNA, 18 bp, Homo sapiens
agggaaaattatttgcat

SEQ ID NO: 2861669 - DNA, 14 bp, Homo sapiens
agggaaaggcaagc

SEQ ID NO: 2861670 - DNA, 16 bp, Homo sapiens
agggaagggcctgcca

SEQ ID NO: 2861671 - DNA, 14 bp, Homo sapiens
agggaagtggggag

SEQ ID NO: 2861672 - DNA, 18 bp, Homo sapiens
agggacgcctgggggtgc

SEQ ID NO: 2861673 - DNA, 23 bp, Homo sapiens
agggacgcctgggggtgccagga

SEQ ID NO: 2861674 - DNA, 20 bp, Homo sapiens
agggagttttaaagaaattt

SEQ ID NO: 2861675 - DNA, 13 bp, Homo sapiens
agggattctggga

SEQ ID NO: 2861676 - DNA, 16 bp, Homo sapiens
agggcactgggctgtt

SEQ ID NO: 2861677 - DNA, 12 bp, Homo sapiens
agggcagagtga

SEQ ID NO: 2861678 - DNA, 19 bp, Homo sapiens
agggcagagtgagacccag

SEQ ID NO: 2861679 - DNA, 16 bp, Homo sapiens
agggcagcccccactt

SEQ ID NO: 2861680 - DNA, 21 bp, Homo sapiens
agggccaagcccagcactgct

SEQ ID NO: 2861681 - DNA, 18 bp, Homo sapiens
agggctaccctgagctga

SEQ ID NO: 2861682 - DNA, 20 bp, Homo sapiens
agggctaccctgagctgagg

SEQ ID NO: 2861683 - DNA, 22 bp, Homo sapiens
agggctaccctgagctgaggca

SEQ ID NO: 2861684 - DNA, 23 bp, Homo sapiens
agggctaccctgagctgaggcag

SEQ ID NO: 2861685 - DNA, 14 bp, Homo sapiens
aggggccagaggct

SEQ ID NO: 2861686 - DNA, 19 bp, Homo sapiens
aggggccttagggcactgg

SEQ ID NO: 2861687 - DNA, 22 bp, Homo sapiens
agggtctaccaatacaaaatgt

SEQ ID NO: 2861688 - DNA, 23 bp, Homo sapiens
agggtctaccaatacaaaatgta

SEQ ID NO: 2861689 - DNA, 17 bp, Homo sapiens
agggtgggccactctcc

SEQ ID NO: 2861690 - DNA, 20 bp, Homo sapiens
agggtgtggtatgagggggt

SEQ ID NO: 2861691 - DNA, 16 bp, Homo sapiens
agggttgaccccagag

SEQ ID NO: 2861692 - DNA, 21 bp, Homo sapiens
aggtaatccaagatattttaa

SEQ ID NO: 2861693 - DNA, 20 bp, Homo sapiens
aggtcaggagttcctaacca

SEQ ID NO: 2861694 - DNA, 13 bp, Homo sapiens
aggtccagctggg

SEQ ID NO: 2861695 - DNA, 16 bp, Homo sapiens
aggtccagctgggcct

SEQ ID NO: 2861696 - DNA, 17 bp, Homo sapiens
aggtccagctgggcctc

SEQ ID NO: 2861697 - DNA, 22 bp, Homo sapiens
aggtccagctgggcctcctgcc

SEQ ID NO: 2861698 - DNA, 24 bp, Homo sapiens
aggtccagctgggcctcctgcctc

SEQ ID NO: 2861699 - DNA, 13 bp, Homo sapiens
aggtctagacttt

SEQ ID NO: 2861700 - DNA, 15 bp, Homo sapiens
aggtctagactttct

SEQ ID NO: 2861701 - DNA, 21 bp, Homo sapiens
aggtgctacacccttttccag

SEQ ID NO: 2861702 - DNA, 15 bp, Homo sapiens
aggttccccaatcca

SEQ ID NO: 2861703 - DNA, 18 bp, Homo sapiens
aggttccgcttggagcag

SEQ ID NO: 2861704 - DNA, 21 bp, Homo sapiens
aggttccgcttggagcagagg

SEQ ID NO: 2861705 - DNA, 19 bp, Homo sapiens
aggttctgtagagccaatt

SEQ ID NO: 2861706 - DNA, 15 bp, Homo sapiens
agtaaataaacaagt

SEQ ID NO: 2861707 - DNA, 24 bp, Homo sapiens
agtaaatcagaaagtaacaatcta

SEQ ID NO: 2861708 - DNA, 13 bp, Homo sapiens
agtaacaatctat

SEQ ID NO: 2861709 - DNA, 15 bp, Homo sapiens
agtacaaatgaagaa

SEQ ID NO: 2861710 - DNA, 18 bp, Homo sapiens
agtacaaatgaagaaagt

SEQ ID NO: 2861711 - DNA, 13 bp, Homo sapiens
agtaggtgatgag

SEQ ID NO: 2861712 - DNA, 13 bp, Homo sapiens
agtcaaaaaatta

SEQ ID NO: 2861713 - DNA, 15 bp, Homo sapiens
agtcaacctgcctga

SEQ ID NO: 2861714 - DNA, 14 bp, Homo sapiens
agtcaacctgggca

SEQ ID NO: 2861715 - DNA, 13 bp, Homo sapiens
agtcactggaaag

SEQ ID NO: 2861716 - DNA, 20 bp, Homo sapiens
agtcagaatttttaactgta

SEQ ID NO: 2861717 - DNA, 12 bp, Homo sapiens
agtcaggaaagg

SEQ ID NO: 2861718 - DNA, 17 bp, Homo sapiens
agtcataccaatgaaaa

SEQ ID NO: 2861719 - DNA, 13 bp, Homo sapiens
agtcccagagccc

SEQ ID NO: 2861720 - DNA, 24 bp, Homo sapiens
agtcctaaaagttctcaatgtaga

SEQ ID NO: 2861721 - DNA, 16 bp, Homo sapiens
agtcgggaggagcagc

SEQ ID NO: 2861722 - DNA, 11 bp, Homo sapiens
agtctctgagc

SEQ ID NO: 2861723 - DNA, 20 bp, Homo sapiens
agtctgtgccacgtgtttgt

SEQ ID NO: 2861724 - DNA, 15 bp, Homo sapiens
agtcttccatttgca

SEQ ID NO: 2861725 - DNA, 16 bp, Homo sapiens
agtcttccatttgcaa

SEQ ID NO: 2861726 - DNA, 16 bp, Homo sapiens
agtgaacccatatttt

SEQ ID NO: 2861727 - DNA, 16 bp, Homo sapiens
agtgccagtcagcagt

SEQ ID NO: 2861728 - DNA, 13 bp, Homo sapiens
agtgcccaaagtg

SEQ ID NO: 2861729 - DNA, 15 bp, Homo sapiens
agtgcgtccacgagc

SEQ ID NO: 2861730 - DNA, 22 bp, Homo sapiens
agtgggacagcccagagcctgg

SEQ ID NO: 2861731 - DNA, 19 bp, Homo sapiens
agtggggagggacaaggga

SEQ ID NO: 2861732 - DNA, 22 bp, Homo sapiens
agtgtctcggagggattcccct

SEQ ID NO: 2861733 - DNA, 18 bp, Homo sapiens
agtgttagggaagggcct

SEQ ID NO: 2861734 - DNA, 16 bp, Homo sapiens
agttaaataactgtgt

SEQ ID NO: 2861735 - DNA, 15 bp, Homo sapiens
agttagctccataaa

SEQ ID NO: 2861736 - DNA, 18 bp, Homo sapiens
agttctcaaatgtgtgtg

SEQ ID NO: 2861737 - DNA, 23 bp, Homo sapiens
agttgaattttttctaaaaagaa

SEQ ID NO: 2861738 - DNA, 13 bp, Homo sapiens
agttgatttttct

SEQ ID NO: 2861739 - DNA, 19 bp, Homo sapiens
agttgctgtgaactttcat

SEQ ID NO: 2861740 - DNA, 21 bp, Homo sapiens
agttgctgtgaactttcatgt

SEQ ID NO: 2861741 - DNA, 17 bp, Homo sapiens
agtttgattattcagtg

SEQ ID NO: 2861742 - DNA, 18 bp, Homo sapiens
agtttgattattcagtgt

SEQ ID NO: 2861743 - DNA, 23 bp, Homo sapiens
agtttgattattcagtgtcactg

SEQ ID NO: 2861744 - DNA, 16 bp, Homo sapiens
agtttgcacctgtccc

SEQ ID NO: 2861745 - DNA, 15 bp, Homo sapiens
agtttggttttgaca

SEQ ID NO: 2861746 - DNA, 17 bp, Homo sapiens
agtttgttcttcagatt

SEQ ID NO: 2861747 - DNA, 21 bp, Homo sapiens
agttttgtttcactttgacat

SEQ ID NO: 2861748 - DNA, 21 bp, Homo sapiens
agtttttaaagccttctggat

SEQ ID NO: 2861749 - DNA, 16 bp, Homo sapiens
agtttttgacatttat

SEQ ID NO: 2861750 - DNA, 13 bp, Homo sapiens
ataaaaatatgta

SEQ ID NO: 2861751 - DNA, 19 bp, Homo sapiens
ataaaatagaataattctt

SEQ ID NO: 2861752 - DNA, 12 bp, Homo sapiens
ataaaatatcat

SEQ ID NO: 2861753 - DNA, 15 bp, Homo sapiens
ataaaatgatgttat

SEQ ID NO: 2861754 - DNA, 14 bp, Homo sapiens
ataaaatgtttcat

SEQ ID NO: 2861755 - DNA, 13 bp, Homo sapiens
ataaagctgttat

SEQ ID NO: 2861756 - DNA, 23 bp, Homo sapiens
attccaggctgagccatgaggag

SEQ ID NO: 2861757 - DNA, 21 bp, Homo sapiens
attcggtgtgcaccagggttg

SEQ ID NO: 2861758 - DNA, 21 bp, Homo sapiens
attctcataagtagcattcat

SEQ ID NO: 2861759 - DNA, 11 bp, Homo sapiens
attctctgagc

SEQ ID NO: 2861760 - DNA, 18 bp, Homo sapiens
attctctgagctgtgcag

SEQ ID NO: 2861761 - DNA, 16 bp, Homo sapiens
attctctgtctcatcc

SEQ ID NO: 2861762 - DNA, 18 bp, Homo sapiens
attctctgtctcatccat

SEQ ID NO: 2861763 - DNA, 19 bp, Homo sapiens
attctgaagtatgaagtct

SEQ ID NO: 2861764 - DNA, 19 bp, Homo sapiens
attcttcagtttttcactt

SEQ ID NO: 2861765 - DNA, 21 bp, Homo sapiens
attctttcccaattcacatct

SEQ ID NO: 2861766 - DNA, 16 bp, Homo sapiens
attctttgcaatactg

SEQ ID NO: 2861767 - DNA, 19 bp, Homo sapiens
attctttgcaatactgctt

SEQ ID NO: 2861768 - DNA, 19 bp, Homo sapiens
attgaaaaaatagagcctg

SEQ ID NO: 2861769 - DNA, 22 bp, Homo sapiens
attgaaaaaatagagcctgagg

SEQ ID NO: 2861770 - DNA, 22 bp, Homo sapiens
attgaagccgactctggccctg

SEQ ID NO: 2861771 - DNA, 14 bp, Homo sapiens
attgccaagggctt

SEQ ID NO: 2861772 - DNA, 20 bp, Homo sapiens
attgctgccccatcagtgct

SEQ ID NO: 2861773 - DNA, 14 bp, Homo sapiens
attggactccaggc

SEQ ID NO: 2861774 - DNA, 12 bp, Homo sapiens
attggccaatta

SEQ ID NO: 2861775 - DNA, 17 bp, Homo sapiens
attgtaagtgaaattaa

SEQ ID NO: 2861776 - DNA, 23 bp, Homo sapiens
attgtcacatctatccacactgt

SEQ ID NO: 2861777 - DNA, 16 bp, Homo sapiens
atttaaatccttggct

SEQ ID NO: 2861778 - DNA, 15 bp, Homo sapiens
atttaataatctgta

SEQ ID NO: 2861779 - DNA, 20 bp, Homo sapiens
atttactgagcttctctgtg

SEQ ID NO: 2861780 - DNA, 12 bp, Homo sapiens
atttagtaaata

SEQ ID NO: 2861781 - DNA, 17 bp, Homo sapiens
atttagtaaataaacaa

SEQ ID NO: 2861782 - DNA, 15 bp, Homo sapiens
atttagtttgattat

SEQ ID NO: 2861783 - DNA, 19 bp, Homo sapiens
atttatcttgtctctgggc

SEQ ID NO: 2861784 - DNA, 24 bp, Homo sapiens
atttatgacaagctgtatcactgc

SEQ ID NO: 2861785 - DNA, 14 bp, Homo sapiens
atttattacctctg

SEQ ID NO: 2861786 - DNA, 18 bp, Homo sapiens
atttattcaattcctctg

SEQ ID NO: 2861787 - DNA, 14 bp, Homo sapiens
atttcaaaatacat

SEQ ID NO: 2861788 - DNA, 17 bp, Homo sapiens
atttcaataaatgatat

SEQ ID NO: 2861789 - DNA, 22 bp, Homo sapiens
atttcaataaatgatatataat

SEQ ID NO: 2861790 - DNA, 19 bp, Homo sapiens
atttccctccagagaaagc

SEQ ID NO: 2861791 - DNA, 13 bp, Homo sapiens
atttctatgacaa

SEQ ID NO: 2861792 - DNA, 15 bp, Homo sapiens
atttctatgacaaat

SEQ ID NO: 2861793 - DNA, 15 bp, Homo sapiens
atttgaactttggaa

SEQ ID NO: 2861794 - DNA, 16 bp, Homo sapiens
atttgaactttggaac

SEQ ID NO: 2861795 - DNA, 19 bp, Homo sapiens
atttgagtgttttaagata

SEQ ID NO: 2861796 - DNA, 20 bp, Homo sapiens
atttgatttctaattgtaag

SEQ ID NO: 2861797 - DNA, 21 bp, Homo sapiens
atttgatttctaattgtaagt

SEQ ID NO: 2861798 - DNA, 15 bp, Homo sapiens
atttgcaagggaaaa

SEQ ID NO: 2861799 - DNA, 22 bp, Homo sapiens
atttgcataacaattcctctac

SEQ ID NO: 2861800 - DNA, 14 bp, Homo sapiens
atttggacaaaatg

SEQ ID NO: 2861801 - DNA, 16 bp, Homo sapiens
atttggacaaaatgga

SEQ ID NO: 2861802 - DNA, 16 bp, Homo sapiens
atttgttattttgcaa

SEQ ID NO: 2861803 - DNA, 19 bp, Homo sapiens
attttaaattctcataagt

SEQ ID NO: 2861804 - DNA, 18 bp, Homo sapiens
attttaatgctgtttcta

SEQ ID NO: 2861805 - DNA, 20 bp, Homo sapiens
attttaatgctgtttctaag

SEQ ID NO: 2861806 - DNA, 20 bp, Homo sapiens
attttagaaataataaaaag

SEQ ID NO: 2861807 - DNA, 21 bp, Homo sapiens
attttcataagtatttcaaat

SEQ ID NO: 2861808 - DNA, 16 bp, Homo sapiens
attttcatattgtaat

SEQ ID NO: 2861809 - DNA, 22 bp, Homo sapiens
attttgaaacaaagtactcttt

SEQ ID NO: 2861810 - DNA, 16 bp, Homo sapiens
attttgaaatgaactt

SEQ ID NO: 2861811 - DNA, 12 bp, Homo sapiens
attttgatattg

SEQ ID NO: 2861812 - DNA, 19 bp, Homo sapiens
attttgtattgtttcaatt

SEQ ID NO: 2861813 - DNA, 16 bp, Homo sapiens
atttttgaaacccatt

SEQ ID NO: 2861814 - DNA, 14 bp, Homo sapiens
atttttgtatttct

SEQ ID NO: 2861815 - DNA, 18 bp, Homo sapiens
atttttttaactgtgata

SEQ ID NO: 2861816 - DNA, 21 bp, Homo sapiens
atttttttaactgtgataatc

SEQ ID NO: 2861817 - DNA, 15 bp, Homo sapiens
caaaaattagccggg

SEQ ID NO: 2861818 - DNA, 22 bp, Homo sapiens
caaaaattatgcaattcagtgt

SEQ ID NO: 2861819 - DNA, 15 bp, Homo sapiens
caaaatacatttgta

SEQ ID NO: 2861820 - DNA, 23 bp, Homo sapiens
caaaatggtcctatttttgtgaa

SEQ ID NO: 2861821 - DNA, 19 bp, Homo sapiens
caaactgcttatgaaaagt

SEQ ID NO: 2861822 - DNA, 13 bp, Homo sapiens
caaagcaaggaaa

SEQ ID NO: 2861823 - DNA, 20 bp, Homo sapiens
caaagccagcgtcctcctct

SEQ ID NO: 2861824 - DNA, 19 bp, Homo sapiens
caaagccggcctgagaaac

SEQ ID NO: 2861825 - DNA, 23 bp, Homo sapiens
caaaggatccagagacttgggga

SEQ ID NO: 2861826 - DNA, 18 bp, Homo sapiens
caaagtaaaagtagtgtt

SEQ ID NO: 2861827 - DNA, 14 bp, Homo sapiens
caaagtactcttta

SEQ ID NO: 2861828 - DNA, 17 bp, Homo sapiens
caaagtatgcaatgctt

SEQ ID NO: 2861829 - DNA, 18 bp, Homo sapiens
caaagtctccagaagaaa

SEQ ID NO: 2861830 - DNA, 17 bp, Homo sapiens
caaagtggggagggaca

SEQ ID NO: 2861831 - DNA, 18 bp, Homo sapiens
caaagtggggagggacaa

SEQ ID NO: 2861832 - DNA, 12 bp, Homo sapiens
caaataaaatat

SEQ ID NO: 2861833 - DNA, 17 bp, Homo sapiens
caaataatttgaacttt

SEQ ID NO: 2861834 - DNA, 23 bp, Homo sapiens
caaataatttgaactttggaaca

SEQ ID NO: 2861835 - DNA, 14 bp, Homo sapiens
caaatactcttagg

SEQ ID NO: 2861836 - DNA, 19 bp, Homo sapiens
caaatatacattttctaaa

SEQ ID NO: 2861837 - DNA, 21 bp, Homo sapiens
caaatatacattttctaaata

SEQ ID NO: 2861838 - DNA, 22 bp, Homo sapiens
caaatgctcccacctgaatttg

SEQ ID NO: 2861839 - DNA, 22 bp, Homo sapiens
caaattaaaacaaatatacatt

SEQ ID NO: 2861840 - DNA, 23 bp, Homo sapiens
caaattaaaacaaatatacattt

SEQ ID NO: 2861841 - DNA, 20 bp, Homo sapiens
caacaatttctactttgaag

SEQ ID NO: 2861842 - DNA, 24 bp, Homo sapiens
caacacagagctggcgactgcagc

SEQ ID NO: 2861843 - DNA, 15 bp, Homo sapiens
caacagaagcttcca

SEQ ID NO: 2861844 - DNA, 14 bp, Homo sapiens
caacagctgaagca

SEQ ID NO: 2861845 - DNA, 20 bp, Homo sapiens
caaccaggccttcatcctcc

SEQ ID NO: 2861846 - DNA, 21 bp, Homo sapiens
caaccaggccttcatcctcct

SEQ ID NO: 2861847 - DNA, 12 bp, Homo sapiens
caacccccagct

SEQ ID NO: 2861848 - DNA, 13 bp, Homo sapiens
caacctaaatttg

SEQ ID NO: 2861849 - DNA, 12 bp, Homo sapiens
caacctggactt

SEQ ID NO: 2861850 - DNA, 17 bp, Homo sapiens
caacctggacttcctgt

SEQ ID NO: 2861851 - DNA, 23 bp, Homo sapiens
caacgcttgtagaactcactctg

SEQ ID NO: 2861852 - DNA, 13 bp, Homo sapiens
caagaaacagcca

SEQ ID NO: 2861853 - DNA, 18 bp, Homo sapiens
caagaaacagccagcaag

SEQ ID NO: 2861854 - DNA, 16 bp, Homo sapiens
caagaagtaatcagta

SEQ ID NO: 2861855 - DNA, 19 bp, Homo sapiens
caagagctagaaaaataaa

SEQ ID NO: 2861856 - DNA, 21 bp, Homo sapiens
caagagctagaaaaataaaat

SEQ ID NO: 2861857 - DNA, 15 bp, Homo sapiens
ataattcttttctga

SEQ ID NO: 2861858 - DNA, 23 bp, Homo sapiens
ataattgaagtgttccctttttc

SEQ ID NO: 2861859 - DNA, 17 bp, Homo sapiens
ataatttgaactttgga

SEQ ID NO: 2861860 - DNA, 19 bp, Homo sapiens
ataatttgaactttggaac

SEQ ID NO: 2861861 - DNA, 20 bp, Homo sapiens
ataatttttttcaatattta

SEQ ID NO: 2861862 - DNA, 16 bp, Homo sapiens
atacaataattgaagt

SEQ ID NO: 2861863 - DNA, 14 bp, Homo sapiens
atacagaactcttt

SEQ ID NO: 2861864 - DNA, 16 bp, Homo sapiens
atacagaactctttca

SEQ ID NO: 2861865 - DNA, 19 bp, Homo sapiens
atacagtcttccatttgca

SEQ ID NO: 2861866 - DNA, 15 bp, Homo sapiens
atacatcaatatgta

SEQ ID NO: 2861867 - DNA, 12 bp, Homo sapiens
atacatttgtaa

SEQ ID NO: 2861868 - DNA, 16 bp, Homo sapiens
atacattttctaaata

SEQ ID NO: 2861869 - DNA, 22 bp, Homo sapiens
atacattttctaaataaaaata

SEQ ID NO: 2861870 - DNA, 21 bp, Homo sapiens
ataccaatgaaaaaatgtata

SEQ ID NO: 2861871 - DNA, 22 bp, Homo sapiens
ataccagcgaggaggctccaga

SEQ ID NO: 2861872 - DNA, 15 bp, Homo sapiens
atactactactgtta

SEQ ID NO: 2861873 - DNA, 18 bp, Homo sapiens
atagaaagctggactgac

SEQ ID NO: 2861874 - DNA, 21 bp, Homo sapiens
atagaaagctggactgaccaa

SEQ ID NO: 2861875 - DNA, 14 bp, Homo sapiens
atagaataattctt

SEQ ID NO: 2861876 - DNA, 22 bp, Homo sapiens
atagaccctctttcttgtttgt

SEQ ID NO: 2861877 - DNA, 23 bp, Homo sapiens
atagaccctctttcttgtttgtc

SEQ ID NO: 2861878 - DNA, 15 bp, Homo sapiens
atagagcctgaggga

SEQ ID NO: 2861879 - DNA, 13 bp, Homo sapiens
atagagctgtatt

SEQ ID NO: 2861880 - DNA, 23 bp, Homo sapiens
atagaggatagggagaatattta

SEQ ID NO: 2861881 - DNA, 22 bp, Homo sapiens
atagatccatttggacaaaatg

SEQ ID NO: 2861882 - DNA, 14 bp, Homo sapiens
atagctttagtgaa

SEQ ID NO: 2861883 - DNA, 19 bp, Homo sapiens
atagtgtcatataaactca

SEQ ID NO: 2861884 - DNA, 17 bp, Homo sapiens
atagtgttaactgtcag

SEQ ID NO: 2861885 - DNA, 14 bp, Homo sapiens
atataaactcattt

SEQ ID NO: 2861886 - DNA, 20 bp, Homo sapiens
atataatgttgataatatat

SEQ ID NO: 2861887 - DNA, 13 bp, Homo sapiens
atatacattttct

SEQ ID NO: 2861888 - DNA, 17 bp, Homo sapiens
atatacattttctaaat

SEQ ID NO: 2861889 - DNA, 20 bp, Homo sapiens
atatatcattatctttgctg

SEQ ID NO: 2861890 - DNA, 21 bp, Homo sapiens
atatattttttgttattatta

SEQ ID NO: 2861891 - DNA, 19 bp, Homo sapiens
atatcattatctttgctgt

SEQ ID NO: 2861892 - DNA, 14 bp, Homo sapiens
atatgaatctataa

SEQ ID NO: 2861893 - DNA, 13 bp, Homo sapiens
atatgcacttata

SEQ ID NO: 2861894 - DNA, 14 bp, Homo sapiens
atatgcacttataa

SEQ ID NO: 2861895 - DNA, 12 bp, Homo sapiens
atatggtgaagg

SEQ ID NO: 2861896 - DNA, 16 bp, Homo sapiens
atatgtatatatgtat

SEQ ID NO: 2861897 - DNA, 16 bp, Homo sapiens
atattaaataacatgt

SEQ ID NO: 2861898 - DNA, 22 bp, Homo sapiens
atattaaataacatgtttctct

SEQ ID NO: 2861899 - DNA, 16 bp, Homo sapiens
atattacccaatggaa

SEQ ID NO: 2861900 - DNA, 16 bp, Homo sapiens
atatttaggcaagaga

SEQ ID NO: 2861901 - DNA, 16 bp, Homo sapiens
atatttattacctctg

SEQ ID NO: 2861902 - DNA, 23 bp, Homo sapiens
atatttattattttcacctgttt

SEQ ID NO: 2861903 - DNA, 15 bp, Homo sapiens
atatttgatttctaa

SEQ ID NO: 2861904 - DNA, 15 bp, Homo sapiens
atattttgaaatgaa

SEQ ID NO: 2861905 - DNA, 16 bp, Homo sapiens
atcaacaaaaattgtc

SEQ ID NO: 2861906 - DNA, 15 bp, Homo sapiens
atcaatatgtatata

SEQ ID NO: 2861907 - DNA, 13 bp, Homo sapiens
atcaatcatgccc

SEQ ID NO: 2861908 - DNA, 18 bp, Homo sapiens
atcacagttgtgttcctg

SEQ ID NO: 2861909 - DNA, 20 bp, Homo sapiens
atcaccgtgggctccctgac

SEQ ID NO: 2861910 - DNA, 22 bp, Homo sapiens
atcaccgtgggctccctgactg

SEQ ID NO: 2861911 - DNA, 17 bp, Homo sapiens
atcactgccttcgttta

SEQ ID NO: 2861912 - DNA, 20 bp, Homo sapiens
atcactgccttcgtttatat

SEQ ID NO: 2861913 - DNA, 20 bp, Homo sapiens
atcagaaagtaacaatctat

SEQ ID NO: 2861914 - DNA, 14 bp, Homo sapiens
atcagcaaaaagac

SEQ ID NO: 2861915 - DNA, 13 bp, Homo sapiens
atcagctccttcc

SEQ ID NO: 2861916 - DNA, 17 bp, Homo sapiens
atcagctccttcctgga

SEQ ID NO: 2861917 - DNA, 18 bp, Homo sapiens
atcaggacccagaggaag

SEQ ID NO: 2861918 - DNA, 20 bp, Homo sapiens
atcagggtgggccactctcc

SEQ ID NO: 2861919 - DNA, 12 bp, Homo sapiens
atcagtaaatag

SEQ ID NO: 2861920 - DNA, 15 bp, Homo sapiens
atcagttgatttttc

SEQ ID NO: 2861921 - DNA, 23 bp, Homo sapiens
atcatctcctgccttcctcctgg

SEQ ID NO: 2861922 - DNA, 12 bp, Homo sapiens
atcattaaaaat

SEQ ID NO: 2861923 - DNA, 17 bp, Homo sapiens
atcattatctttgctgt

SEQ ID NO: 2861924 - DNA, 12 bp, Homo sapiens
atcattctctgt

SEQ ID NO: 2861925 - DNA, 21 bp, Homo sapiens
atcattctctgtctcatccat

SEQ ID NO: 2861926 - DNA, 15 bp, Homo sapiens
atccacgcacacatg

SEQ ID NO: 2861927 - DNA, 16 bp, Homo sapiens
atccacgcacacatgg

SEQ ID NO: 2861928 - DNA, 18 bp, Homo sapiens
atccatggggggagaagt

SEQ ID NO: 2861929 - DNA, 15 bp, Homo sapiens
atccattaggccagc

SEQ ID NO: 2861930 - DNA, 17 bp, Homo sapiens
atccattaggccagcaa

SEQ ID NO: 2861931 - DNA, 19 bp, Homo sapiens
atcccagcactttgggagg

SEQ ID NO: 2861932 - DNA, 12 bp, Homo sapiens
atcccctttcct

SEQ ID NO: 2861933 - DNA, 13 bp, Homo sapiens
atcccctttcctc

SEQ ID NO: 2861934 - DNA, 14 bp, Homo sapiens
atcccgagcacctc

SEQ ID NO: 2861935 - DNA, 14 bp, Homo sapiens
atccctctcctccc

SEQ ID NO: 2861936 - DNA, 12 bp, Homo sapiens
atcctatgtttt

SEQ ID NO: 2861937 - DNA, 15 bp, Homo sapiens
atcctcaatccagct

SEQ ID NO: 2861938 - DNA, 23 bp, Homo sapiens
atcctcagttctcaaatgtgtgt

SEQ ID NO: 2861939 - DNA, 19 bp, Homo sapiens
atcctccacgttctgctca

SEQ ID NO: 2861940 - DNA, 13 bp, Homo sapiens
atcctcctcccca

SEQ ID NO: 2861941 - DNA, 14 bp, Homo sapiens
atcctcctccccag

SEQ ID NO: 2861942 - DNA, 17 bp, Homo sapiens
atccttggcttcaggtt

SEQ ID NO: 2861943 - DNA, 20 bp, Homo sapiens
atccttgtgttcagctcttt

SEQ ID NO: 2861944 - DNA, 12 bp, Homo sapiens
atcgcctttccc

SEQ ID NO: 2861945 - DNA, 14 bp, Homo sapiens
atctaacctcatct

SEQ ID NO: 2861946 - DNA, 18 bp, Homo sapiens
atctagaattcactgagt

SEQ ID NO: 2861947 - DNA, 23 bp, Homo sapiens
atctagaattcactgagttttgt

SEQ ID NO: 2861948 - DNA, 23 bp, Homo sapiens
atctataagtagtaaatcagaaa

SEQ ID NO: 2861949 - DNA, 15 bp, Homo sapiens
atctatgtttataat

SEQ ID NO: 2861950 - DNA, 18 bp, Homo sapiens
atctcagtggtgtgtgaa

SEQ ID NO: 2861951 - DNA, 20 bp, Homo sapiens
atctcagtggtgtgtgaagt

SEQ ID NO: 2861952 - DNA, 15 bp, Homo sapiens
cagtaggagcccagc

SEQ ID NO: 2861953 - DNA, 21 bp, Homo sapiens
cagtcaacctgggcaaagcct

SEQ ID NO: 2861954 - DNA, 22 bp, Homo sapiens
cagtcaacctgggcaaagccta

SEQ ID NO: 2861955 - DNA, 12 bp, Homo sapiens
cagtcagcagtc

SEQ ID NO: 2861956 - DNA, 20 bp, Homo sapiens
cagtgaatgattcagtgtta

SEQ ID NO: 2861957 - DNA, 14 bp, Homo sapiens
cagtgctccctcac

SEQ ID NO: 2861958 - DNA, 15 bp, Homo sapiens
cagtggtgtgtgaag

SEQ ID NO: 2861959 - DNA, 20 bp, Homo sapiens
cagtggtgtgtgaagtttgg

SEQ ID NO: 2861960 - DNA, 19 bp, Homo sapiens
cagtgtgaggccagggcag

SEQ ID NO: 2861961 - DNA, 19 bp, Homo sapiens
cagtgttaaatgtgatgaa

SEQ ID NO: 2861962 - DNA, 23 bp, Homo sapiens
cagtgttttggtggaaaaaacat

SEQ ID NO: 2861963 - DNA, 19 bp, Homo sapiens
cagttaaaaaaaattttaa

SEQ ID NO: 2861964 - DNA, 14 bp, Homo sapiens
cagttctcaaatgt

SEQ ID NO: 2861965 - DNA, 16 bp, Homo sapiens
cagttctcaaatgtgt

SEQ ID NO: 2861966 - DNA, 19 bp, Homo sapiens
cagttgatttttcttattt

SEQ ID NO: 2861967 - DNA, 12 bp, Homo sapiens
cagttgctgtga

SEQ ID NO: 2861968 - DNA, 22 bp, Homo sapiens
cagtttttgacatttatattaa

SEQ ID NO: 2861969 - DNA, 16 bp, Homo sapiens
cataacaattcctcta

SEQ ID NO: 2861970 - DNA, 19 bp, Homo sapiens
cataacttctcatgtatat

SEQ ID NO: 2861971 - DNA, 22 bp, Homo sapiens
cataagataaaatgatgttata

SEQ ID NO: 2861972 - DNA, 14 bp, Homo sapiens
cataatcagtaaat

SEQ ID NO: 2861973 - DNA, 18 bp, Homo sapiens
catagcagattttaattt

SEQ ID NO: 2861974 - DNA, 20 bp, Homo sapiens
catattgtaatctatgttta

SEQ ID NO: 2861975 - DNA, 14 bp, Homo sapiens
catatttgatttct

SEQ ID NO: 2861976 - DNA, 22 bp, Homo sapiens
catatttgtatgtttttctgta

SEQ ID NO: 2861977 - DNA, 13 bp, Homo sapiens
catcaatatgtat

SEQ ID NO: 2861978 - DNA, 16 bp, Homo sapiens
catcaatatgtatata

SEQ ID NO: 2861979 - DNA, 21 bp, Homo sapiens
catcaatatgtatatatgtat

SEQ ID NO: 2861980 - DNA, 16 bp, Homo sapiens
catcagcctccttctt

SEQ ID NO: 2861981 - DNA, 20 bp, Homo sapiens
catcagggtgggccactctc

SEQ ID NO: 2861982 - DNA, 23 bp, Homo sapiens
catcagggtgggccactctcccc

SEQ ID NO: 2861983 - DNA, 24 bp, Homo sapiens
catcagtgctccctcacatgtcag

SEQ ID NO: 2861984 - DNA, 22 bp, Homo sapiens
catcatgtggccccacccaatc

SEQ ID NO: 2861985 - DNA, 24 bp, Homo sapiens
catcattctctgtctcatccatca

SEQ ID NO: 2861986 - DNA, 15 bp, Homo sapiens
catccaagccagagt

SEQ ID NO: 2861987 - DNA, 17 bp, Homo sapiens
catccacatgggagccg

SEQ ID NO: 2861988 - DNA, 22 bp, Homo sapiens
catccacgcacacatggacaca

SEQ ID NO: 2861989 - DNA, 17 bp, Homo sapiens
catccattaggccagca

SEQ ID NO: 2861990 - DNA, 21 bp, Homo sapiens
catcctccacgttctgctcat

SEQ ID NO: 2861991 - DNA, 14 bp, Homo sapiens
catcctcctcccca

SEQ ID NO: 2861992 - DNA, 18 bp, Homo sapiens
catcctcctccccagctc

SEQ ID NO: 2861993 - DNA, 17 bp, Homo sapiens
catccttgagattctga

SEQ ID NO: 2861994 - DNA, 15 bp, Homo sapiens
catctagaattcact

SEQ ID NO: 2861995 - DNA, 22 bp, Homo sapiens
catctcccagataatgtgaaaa

SEQ ID NO: 2861996 - DNA, 22 bp, Homo sapiens
catctcctgccttcctcctggg

SEQ ID NO: 2861997 - DNA, 15 bp, Homo sapiens
catctgaccatctgt

SEQ ID NO: 2861998 - DNA, 16 bp, Homo sapiens
catctgaccatctgtg

SEQ ID NO: 2861999 - DNA, 17 bp, Homo sapiens
catctgaccatctgtga

SEQ ID NO: 2862000 - DNA, 18 bp, Homo sapiens
catctgaccatctgtgac

SEQ ID NO: 2862001 - DNA, 21 bp, Homo sapiens
catctggctttttctgccact

SEQ ID NO: 2862002 - DNA, 20 bp, Homo sapiens
catctgtccctccgggacct

SEQ ID NO: 2862003 - DNA, 17 bp, Homo sapiens
catctgtgactataaag

SEQ ID NO: 2862004 - DNA, 18 bp, Homo sapiens
catctgtgactataaagc

SEQ ID NO: 2862005 - DNA, 21 bp, Homo sapiens
catctgtgactataaagctgt

SEQ ID NO: 2862006 - DNA, 22 bp, Homo sapiens
catctgtgactataaagctgtt

SEQ ID NO: 2862007 - DNA, 11 bp, Homo sapiens
catctgtgtct

SEQ ID NO: 2862008 - DNA, 19 bp, Homo sapiens
catcttcttcaccatttgg

SEQ ID NO: 2862009 - DNA, 20 bp, Homo sapiens
catgaaaaaccatttttgaa

SEQ ID NO: 2862010 - DNA, 15 bp, Homo sapiens
catgaggagcgtgga

SEQ ID NO: 2862011 - DNA, 14 bp, Homo sapiens
catgattatagcaa

SEQ ID NO: 2862012 - DNA, 22 bp, Homo sapiens
catgattatagcaactaatgtt

SEQ ID NO: 2862013 - DNA, 21 bp, Homo sapiens
catgatttccctccagagaaa

SEQ ID NO: 2862014 - DNA, 23 bp, Homo sapiens
catgcactgttccccctgtgcag

SEQ ID NO: 2862015 - DNA, 13 bp, Homo sapiens
catgcctgatgaa

SEQ ID NO: 2862016 - DNA, 13 bp, Homo sapiens
catggcagaaggc

SEQ ID NO: 2862017 - DNA, 20 bp, Homo sapiens
catggctgtgtttgcagcct

SEQ ID NO: 2862018 - DNA, 23 bp, Homo sapiens
catggctgtgtttgcagcctgct

SEQ ID NO: 2862019 - DNA, 14 bp, Homo sapiens
catgggaggctcac

SEQ ID NO: 2862020 - DNA, 17 bp, Homo sapiens
catgggcagagcccaag

SEQ ID NO: 2862021 - DNA, 22 bp, Homo sapiens
catggtgggtccatgggcagag

SEQ ID NO: 2862022 - DNA, 18 bp, Homo sapiens
catggtgtgatcgtctga

SEQ ID NO: 2862023 - DNA, 15 bp, Homo sapiens
catgtaaactgtgca

SEQ ID NO: 2862024 - DNA, 20 bp, Homo sapiens
catgtacttccctcttgaaa

SEQ ID NO: 2862025 - DNA, 20 bp, Homo sapiens
catgtagaaaatttgttatt

SEQ ID NO: 2862026 - DNA, 19 bp, Homo sapiens
catgtgaccgaacactgca

SEQ ID NO: 2862027 - DNA, 12 bp, Homo sapiens
catgtgtgtcca

SEQ ID NO: 2862028 - DNA, 22 bp, Homo sapiens
catgtgtgtccacgactgtctc

SEQ ID NO: 2862029 - DNA, 23 bp, Homo sapiens
catgtgtgtccacgactgtctcc

SEQ ID NO: 2862030 - DNA, 17 bp, Homo sapiens
catgttcccaaaacaat

SEQ ID NO: 2862031 - DNA, 13 bp, Homo sapiens
cattaactgttgc

SEQ ID NO: 2862032 - DNA, 20 bp, Homo sapiens
cattcaaccacgcaggaagc

SEQ ID NO: 2862033 - DNA, 20 bp, Homo sapiens
cattcccctcgtgtgactct

SEQ ID NO: 2862034 - DNA, 21 bp, Homo sapiens
cattccggactggcagaagca

SEQ ID NO: 2862035 - DNA, 16 bp, Homo sapiens
cattgaagccgactct

SEQ ID NO: 2862036 - DNA, 18 bp, Homo sapiens
cattgaagccgactctgg

SEQ ID NO: 2862037 - DNA, 20 bp, Homo sapiens
cattgaagccgactctggcc

SEQ ID NO: 2862038 - DNA, 21 bp, Homo sapiens
cattgaagccgactctggccc

SEQ ID NO: 2862039 - DNA, 23 bp, Homo sapiens
cattgaagccgactctggccctg

SEQ ID NO: 2862040 - DNA, 18 bp, Homo sapiens
cattgcctggactgacca

SEQ ID NO: 2862041 - DNA, 15 bp, Homo sapiens
cattgtaattatgta

SEQ ID NO: 2862042 - DNA, 20 bp, Homo sapiens
catttaaatacagtcttcca

SEQ ID NO: 2862043 - DNA, 20 bp, Homo sapiens
catttagaagcctgacaact

SEQ ID NO: 2862044 - DNA, 23 bp, Homo sapiens
catttagtttgattattcagtgt

SEQ ID NO: 2862045 - DNA, 15 bp, Homo sapiens
catttatattaaata

SEQ ID NO: 2862046 - DNA, 17 bp, Homo sapiens
catttatattaaataac

SEQ ID NO: 2862047 - DNA, 19 bp, Homo sapiens
catttatgacaagctgtat

SEQ ID NO: 2862048 - DNA, 17 bp, Homo sapiens
cattttaagttttactg

SEQ ID NO: 2862049 - DNA, 18 bp, Homo sapiens
cattttatcattaaaaat

SEQ ID NO: 2862050 - DNA, 11 bp, Homo sapiens
cattttctaaa

SEQ ID NO: 2862051 - DNA, 13 bp, Homo sapiens
cattttctaaata

SEQ ID NO: 2862052 - DNA, 13 bp, Homo sapiens
cattttgaaacaa

SEQ ID NO: 2862053 - DNA, 15 bp, Homo sapiens
ccaaagactgcagaa

SEQ ID NO: 2862054 - DNA, 12 bp, Homo sapiens
ccaaagagaaag

SEQ ID NO: 2862055 - DNA, 20 bp, Homo sapiens
ccaaagtggggagggacaag

SEQ ID NO: 2862056 - DNA, 23 bp, Homo sapiens
ccaaagtggggagggacaaggga

SEQ ID NO: 2862057 - DNA, 15 bp, Homo sapiens
ccaaatcccctaagc

SEQ ID NO: 2862058 - DNA, 22 bp, Homo sapiens
ccaaccaggccttcatcctcct

SEQ ID NO: 2862059 - DNA, 14 bp, Homo sapiens
tgcagaacccccag

SEQ ID NO: 2862060 - DNA, 17 bp, Homo sapiens
tgcagaggttgagagga

SEQ ID NO: 2862061 - DNA, 20 bp, Homo sapiens
tgcagcacctccaggcctgt

SEQ ID NO: 2862062 - DNA, 11 bp, Homo sapiens
tgcagcacttt

SEQ ID NO: 2862063 - DNA, 16 bp, Homo sapiens
tgcagcggcagagcaa

SEQ ID NO: 2862064 - DNA, 19 bp, Homo sapiens
tgcagctgcaccatcacac

SEQ ID NO: 2862065 - DNA, 23 bp, Homo sapiens
tgcagctgcaccatcacacatgc

SEQ ID NO: 2862066 - DNA, 13 bp, Homo sapiens
tgcaggctgcacc

SEQ ID NO: 2862067 - DNA, 20 bp, Homo sapiens
tgcagggaaaattatttgca

SEQ ID NO: 2862068 - DNA, 21 bp, Homo sapiens
tgcagggaaaattatttgcat

SEQ ID NO: 2862069 - DNA, 17 bp, Homo sapiens
tgcataacaattcctct

SEQ ID NO: 2862070 - DNA, 13 bp, Homo sapiens
tgcatctcccaga

SEQ ID NO: 2862071 - DNA, 22 bp, Homo sapiens
tgcattagcctggatcctcagt

SEQ ID NO: 2862072 - DNA, 24 bp, Homo sapiens
tgcatttaaatacagtcttccatt

SEQ ID NO: 2862073 - DNA, 19 bp, Homo sapiens
tgccaaaacatttatgaca

SEQ ID NO: 2862074 - DNA, 14 bp, Homo sapiens
tgccaaatcagttt

SEQ ID NO: 2862075 - DNA, 14 bp, Homo sapiens
tgccaaggagcccc

SEQ ID NO: 2862076 - DNA, 16 bp, Homo sapiens
tgccaatctgtacaaa

SEQ ID NO: 2862077 - DNA, 17 bp, Homo sapiens
tgccacagcctcccctg

SEQ ID NO: 2862078 - DNA, 13 bp, Homo sapiens
tgccactgaggag

SEQ ID NO: 2862079 - DNA, 19 bp, Homo sapiens
tgccacttcaacccccagc

SEQ ID NO: 2862080 - DNA, 13 bp, Homo sapiens
tgccagagccaac

SEQ ID NO: 2862081 - DNA, 19 bp, Homo sapiens
tgccagagccaacctggac

SEQ ID NO: 2862082 - DNA, 16 bp, Homo sapiens
tgccagggcagggccc

SEQ ID NO: 2862083 - DNA, 18 bp, Homo sapiens
ttcaattagtggtcataa

SEQ ID NO: 2862084 - DNA, 17 bp, Homo sapiens
ttcaattgcatctccca

SEQ ID NO: 2862085 - DNA, 19 bp, Homo sapiens
ttcacaatcttggggctga

SEQ ID NO: 2862086 - DNA, 18 bp, Homo sapiens
ttcacatctaacctcatc

SEQ ID NO: 2862087 - DNA, 17 bp, Homo sapiens
ttcacctgtatatttct

SEQ ID NO: 2862088 - DNA, 20 bp, Homo sapiens
ttcacctgtatatttctttt

SEQ ID NO: 2862089 - DNA, 22 bp, Homo sapiens
ttcactgagttttgtttcactt

SEQ ID NO: 2862090 - DNA, 23 bp, Homo sapiens
ttcagaggccctcgctgccagct

SEQ ID NO: 2862091 - DNA, 16 bp, Homo sapiens
ttcaggttagtgacat

SEQ ID NO: 2862092 - DNA, 12 bp, Homo sapiens
ttcagtttttca

SEQ ID NO: 2862093 - DNA, 16 bp, Homo sapiens
ttcagtttttcacttc

SEQ ID NO: 2862094 - DNA, 17 bp, Homo sapiens
ttcataagtatttcaaa

SEQ ID NO: 2862095 - DNA, 23 bp, Homo sapiens
ttggaagatgcagaagcaataat

SEQ ID NO: 2862096 - DNA, 13 bp, Homo sapiens
ttggacccttcca

SEQ ID NO: 2862097 - DNA, 14 bp, Homo sapiens
ttggacccttccat

SEQ ID NO: 2862098 - DNA, 16 bp, Homo sapiens
ttggacccttccatgg

SEQ ID NO: 2862099 - DNA, 14 bp, Homo sapiens
ttggactccaggcc

SEQ ID NO: 2862100 - DNA, 22 bp, Homo sapiens
ttggactccaggcctgaccagg

SEQ ID NO: 2862101 - DNA, 19 bp, Homo sapiens
ttggagtgttccccttcca

SEQ ID NO: 2862102 - DNA, 20 bp, Homo sapiens
ttggcattctttgcaatact

SEQ ID NO: 2862103 - DNA, 14 bp, Homo sapiens
ttgggacaccaggg

SEQ ID NO: 2862104 - DNA, 18 bp, Homo sapiens
ttggtttttaaaacccag

SEQ ID NO: 2862105 - DNA, 18 bp, Homo sapiens
ttgtaagtgtaaaaaatg

SEQ ID NO: 2862106 - DNA, 19 bp, Homo sapiens
ttgtaagtgtaaaaaatgt

SEQ ID NO: 2862107 - DNA, 16 bp, Homo sapiens
ttgtaattatgtaaat

SEQ ID NO: 2862108 - DNA, 17 bp, Homo sapiens
ttgtaattatgtaaata

SEQ ID NO: 2862109 - DNA, 11 bp, Homo sapiens
ttgtacctctc

SEQ ID NO: 2862110 - DNA, 13 bp, Homo sapiens
ttgtagaacttta

SEQ ID NO: 2862111 - DNA, 14 bp, Homo sapiens
ttgtattctctgag

SEQ ID NO: 2862112 - DNA, 16 bp, Homo sapiens
ttgtattgtttcaatt

SEQ ID NO: 2862113 - DNA, 12 bp, Homo sapiens
ttgtcagcatct

SEQ ID NO: 2862114 - DNA, 13 bp, Homo sapiens
ttgtcagcatctg

SEQ ID NO: 2862115 - DNA, 20 bp, Homo sapiens
ttgtcagcatctgaccatct

SEQ ID NO: 2862116 - DNA, 17 bp, Homo sapiens
ttgtccaggaagtcaga

SEQ ID NO: 2862117 - DNA, 15 bp, Homo sapiens
ttgtcgggacagaga

SEQ ID NO: 2862118 - DNA, 21 bp, Homo sapiens
ttgtctagaggtgagaccaaa

SEQ ID NO: 2862119 - DNA, 21 bp, Homo sapiens
ttgtgttgttgttgctgctgt

SEQ ID NO: 2862120 - DNA, 18 bp, Homo sapiens
ttgttaacctttctaacc

SEQ ID NO: 2862121 - DNA, 14 bp, Homo sapiens
ttgttatttataac

SEQ ID NO: 2862122 - DNA, 15 bp, Homo sapiens
ttgttattttgcaac

SEQ ID NO: 2862123 - DNA, 12 bp, Homo sapiens
ttgttcttcaga

SEQ ID NO: 2862124 - DNA, 14 bp, Homo sapiens
ttgttggtctgtgt

SEQ ID NO: 2862125 - DNA, 13 bp, Homo sapiens
ttgtttgtcagca

SEQ ID NO: 2862126 - DNA, 17 bp, Homo sapiens
ttgtttgtcagcatctg

SEQ ID NO: 2862127 - DNA, 21 bp, Homo sapiens
ttgtttgtcagcatctgacca

SEQ ID NO: 2862128 - DNA, 20 bp, Homo sapiens
ttgttttgcacactttgcca

SEQ ID NO: 2862129 - DNA, 17 bp, Homo sapiens
tttaaaacgtgtaaatg

SEQ ID NO: 2862130 - DNA, 22 bp, Homo sapiens
tttaaaacgtgtaaatgaagat

SEQ ID NO: 2862131 - DNA, 20 bp, Homo sapiens
tttaaagaagtgcatgaaaa

SEQ ID NO: 2862132 - DNA, 12 bp, Homo sapiens
tttaaagagaag

SEQ ID NO: 2862133 - DNA, 11 bp, Homo sapiens
tttaagctgtt

SEQ ID NO: 2862134 - DNA, 13 bp, Homo sapiens
tttaattttaatg

SEQ ID NO: 2862135 - DNA, 15 bp, Homo sapiens
tttaattttaatgct

SEQ ID NO: 2862136 - DNA, 19 bp, Homo sapiens
tttactaactaaataccat

SEQ ID NO: 2862137 - DNA, 17 bp, Homo sapiens
tttactgagcttctctg

SEQ ID NO: 2862138 - DNA, 13 bp, Homo sapiens
tttagaaatgcat

SEQ ID NO: 2862139 - DNA, 15 bp, Homo sapiens
tttagaaatgcatat

SEQ ID NO: 2862140 - DNA, 22 bp, Homo sapiens
tttagagagcctgtcaccagag

SEQ ID NO: 2862141 - DNA, 23 bp, Homo sapiens
tttagagagcctgtcaccagagc

SEQ ID NO: 2862142 - DNA, 16 bp, Homo sapiens
tttaggcaagagaaaa

SEQ ID NO: 2862143 - DNA, 18 bp, Homo sapiens
tttagtaatattttactt

SEQ ID NO: 2862144 - DNA, 18 bp, Homo sapiens
tttagtgtttatgtttaa

SEQ ID NO: 2862145 - DNA, 18 bp, Homo sapiens
tttagtttgttcttcaga

SEQ ID NO: 2862146 - DNA, 13 bp, Homo sapiens
tttataaaagcaa

SEQ ID NO: 2862147 - DNA, 20 bp, Homo sapiens
tttataaataaaatcatgta

SEQ ID NO: 2862148 - DNA, 16 bp, Homo sapiens
tttatatttcaataaa

SEQ ID NO: 2862149 - DNA, 15 bp, Homo sapiens
tttatcattaaaaat

SEQ ID NO: 2862150 - DNA, 14 bp, Homo sapiens
tttatcttgtctct

SEQ ID NO: 2862151 - DNA, 16 bp, Homo sapiens
tttatgatgacaatca

SEQ ID NO: 2862152 - DNA, 18 bp, Homo sapiens
tttatgtttaaaagaaat

SEQ ID NO: 2862153 - DNA, 16 bp, Homo sapiens
tttattacatatgatt

SEQ ID NO: 2862154 - DNA, 18 bp, Homo sapiens
tttcaaaaccttttgaaa

SEQ ID NO: 2862155 - DNA, 22 bp, Homo sapiens
tttcacttctacctacatattt

SEQ ID NO: 2862156 - DNA, 14 bp, Homo sapiens
tttcactttgacat

SEQ ID NO: 2862157 - DNA, 15 bp, Homo sapiens
tttcatattgtaatc

SEQ ID NO: 2862158 - DNA, 12 bp, Homo sapiens
tttccaaaagta

SEQ ID NO: 2862159 - DNA, 13 bp, Homo sapiens
tttccaaattgcc

SEQ ID NO: 2862160 - DNA, 13 bp, Homo sapiens
tttcccaccacct

SEQ ID NO: 2862161 - DNA, 13 bp, Homo sapiens
tttccctgacctc

SEQ ID NO: 2862162 - DNA, 23 bp, Homo sapiens
tttcctaataaagttctgtactc

SEQ ID NO: 2862163 - DNA, 24 bp, Homo sapiens
tttcctaataaagttctgtactca

SEQ ID NO: 2862164 - DNA, 19 bp, Homo sapiens
tttcctccccaccttcccc

SEQ ID NO: 2862165 - DNA, 13 bp, Homo sapiens
tttccttctggtt

SEQ ID NO: 2862166 - DNA, 14 bp, Homo sapiens
tttctaagaaaatg

SEQ ID NO: 2862167 - DNA, 13 bp, Homo sapiens
tttctatgacaaa

SEQ ID NO: 2862168 - DNA, 17 bp, Homo sapiens
tttctatttctcctcca

SEQ ID NO: 2862169 - DNA, 15 bp, Homo sapiens
tttctctataaagta

SEQ ID NO: 2862170 - DNA, 14 bp, Homo sapiens
tttctctttaaact

SEQ ID NO: 2862171 - DNA, 17 bp, Homo sapiens
tttctgccactgaggag

SEQ ID NO: 2862172 - DNA, 19 bp, Homo sapiens
tttctgccactgaggagac

SEQ ID NO: 2862173 - DNA, 14 bp, Homo sapiens
tttcttgtttgtca

SEQ ID NO: 2862174 - DNA, 15 bp, Homo sapiens
tttgaaacaaagtac

SEQ ID NO: 2862175 - DNA, 14 bp, Homo sapiens
tttgaaatgaactt

SEQ ID NO: 2862176 - DNA, 16 bp, Homo sapiens
tttgaaatgaactttg

SEQ ID NO: 2862177 - DNA, 11 bp, Homo sapiens
tttgaactttg

SEQ ID NO: 2862178 - DNA, 17 bp, Homo sapiens
tttggcaatgccatcat

SEQ ID NO: 2862179 - DNA, 13 bp, Homo sapiens
tttgtaagtgtaa

SEQ ID NO: 2862180 - DNA, 14 bp, Homo sapiens
tttgtcagcatctg

SEQ ID NO: 2862181 - DNA, 21 bp, Homo sapiens
tttgtcagcatctgaccatct

SEQ ID NO: 2862182 - DNA, 12 bp, Homo sapiens
tttgtcagtgtt

SEQ ID NO: 2862183 - DNA, 21 bp, Homo sapiens
tttgtgaaacagttgctgtga

SEQ ID NO: 2862184 - DNA, 20 bp, Homo sapiens
tttgtgttgttgttgctgct

SEQ ID NO: 2862185 - DNA, 13 bp, Homo sapiens
tttgttcttcaga

SEQ ID NO: 2862186 - DNA, 14 bp, Homo sapiens
tttgttcttcagat

SEQ ID NO: 2862187 - DNA, 12 bp, Homo sapiens
tttgtttcactt

SEQ ID NO: 2862188 - DNA, 12 bp, Homo sapiens
tttgtttttcat

SEQ ID NO: 2862189 - DNA, 13 bp, Homo sapiens
ttttaaaacccag

SEQ ID NO: 2862190 - DNA, 19 bp, Homo sapiens
ttttaaaacgtgtaaatga

SEQ ID NO: 2862191 - DNA, 19 bp, Homo sapiens
ttttaaagaaattttagta

SEQ ID NO: 2862192 - DNA, 12 bp, Homo sapiens
ttttaaagcctt

SEQ ID NO: 2862193 - DNA, 16 bp, Homo sapiens
ttttaactagaattta

SEQ ID NO: 2862194 - DNA, 11 bp, Homo sapiens
ttttaactgta

SEQ ID NO: 2862195 - DNA, 18 bp, Homo sapiens
ttttaatgctgtttctaa

SEQ ID NO: 2862196 - DNA, 19 bp, Homo sapiens
ttttagaaataataaaaag

SEQ ID NO: 2862197 - DNA, 16 bp, Homo sapiens
ttttagaaatgcatat

SEQ ID NO: 2862198 - DNA, 16 bp, Homo sapiens
ttttagtgttaaagag

SEQ ID NO: 2862199 - DNA, 22 bp, Homo sapiens
ttttagtgttaaagagataaag

SEQ ID NO: 2862200 - DNA, 13 bp, Homo sapiens
tgggacaccaggg

SEQ ID NO: 2862201 - DNA, 18 bp, Homo sapiens
tgggacagcccagagcct

SEQ ID NO: 2862202 - DNA, 14 bp, Homo sapiens
tgggagagccagct

SEQ ID NO: 2862203 - DNA, 24 bp, Homo sapiens
tgggagccaggagtaagacaagtg

SEQ ID NO: 2862204 - DNA, 14 bp, Homo sapiens
tgggagccgggtct

SEQ ID NO: 2862205 - DNA, 13 bp, Homo sapiens
tgggaggctcacc

SEQ ID NO: 2862206 - DNA, 20 bp, Homo sapiens
tgggaggctcacccccttct

SEQ ID NO: 2862207 - DNA, 17 bp, Homo sapiens
tgggagggcagcagggc

SEQ ID NO: 2862208 - DNA, 19 bp, Homo sapiens
tgggagggcagcagggcta

SEQ ID NO: 2862209 - DNA, 17 bp, Homo sapiens
tgggatattttgaaatg

SEQ ID NO: 2862210 - DNA, 15 bp, Homo sapiens
tgggcaaagcctagt

SEQ ID NO: 2862211 - DNA, 21 bp, Homo sapiens
tgggcaaagcctagtgaaggc

SEQ ID NO: 2862212 - DNA, 21 bp, Homo sapiens
tgggccactctcccctccctc

SEQ ID NO: 2862213 - DNA, 13 bp, Homo sapiens
tgggccctctctg

SEQ ID NO: 2862214 - DNA, 20 bp, Homo sapiens
tgggctgtaacgtggcactg

SEQ ID NO: 2862215 - DNA, 24 bp, Homo sapiens
tgggcttcattccggactggcaga

SEQ ID NO: 2862216 - DNA, 17 bp, Homo sapiens
tggggagactgggctga

SEQ ID NO: 2862217 - DNA, 21 bp, Homo sapiens
tggggagactgggctgaggga

SEQ ID NO: 2862218 - DNA, 23 bp, Homo sapiens
tggggcctggcccacgccctccc

SEQ ID NO: 2862219 - DNA, 13 bp, Homo sapiens
tggggctctggga

SEQ ID NO: 2862220 - DNA, 14 bp, Homo sapiens
tgggggtgccagga

SEQ ID NO: 2862221 - DNA, 22 bp, Homo sapiens
tggggtcaagaaacagccagca

SEQ ID NO: 2862222 - DNA, 14 bp, Homo sapiens
tgggtccatgggca

SEQ ID NO: 2862223 - DNA, 16 bp, Homo sapiens
tggtccaggagaaggc

SEQ ID NO: 2862224 - DNA, 22 bp, Homo sapiens
tggtccagtcgggaggagcagc

SEQ ID NO: 2862225 - DNA, 22 bp, Homo sapiens
tggtcctatttttgtgaagagg

SEQ ID NO: 2862226 - DNA, 14 bp, Homo sapiens
tggtcttcactgcc

SEQ ID NO: 2862227 - DNA, 15 bp, Homo sapiens
tggtcttcactgcca

SEQ ID NO: 2862228 - DNA, 19 bp, Homo sapiens
tggtgaatgtgtgagaaaa

SEQ ID NO: 2862229 - DNA, 18 bp, Homo sapiens
tggtggaaaaaacatttt

SEQ ID NO: 2862230 - DNA, 16 bp, Homo sapiens
tggtgggtccatgggc

SEQ ID NO: 2862231 - DNA, 16 bp, Homo sapiens
tggtgtaatctcaatg

SEQ ID NO: 2862232 - DNA, 21 bp, Homo sapiens
tggtgtaatctcaatgcaagc

SEQ ID NO: 2862233 - DNA, 15 bp, Homo sapiens
tggtgtatgcacagg

SEQ ID NO: 2862234 - DNA, 18 bp, Homo sapiens
tggtgtcacatggggcct

SEQ ID NO: 2862235 - DNA, 18 bp, Homo sapiens
tggtgtgatcgtctgact

SEQ ID NO: 2862236 - DNA, 15 bp, Homo sapiens
tggtgtggtgaatgt

SEQ ID NO: 2862237 - DNA, 19 bp, Homo sapiens
tggtgtgtccccctctgtc

SEQ ID NO: 2862238 - DNA, 14 bp, Homo sapiens
tggtgtgtgaagtt

SEQ ID NO: 2862239 - DNA, 14 bp, Homo sapiens
tggttattggactc

SEQ ID NO: 2862240 - DNA, 21 bp, Homo sapiens
tggttattggactccaggcct

SEQ ID NO: 2862241 - DNA, 12 bp, Homo sapiens
tggttgaggaaa

SEQ ID NO: 2862242 - DNA, 14 bp, Homo sapiens
tgtaaactgtgcac

SEQ ID NO: 2862243 - DNA, 17 bp, Homo sapiens
tgtaacatccaagccag

SEQ ID NO: 2862244 - DNA, 19 bp, Homo sapiens
tgtaacatccaagccagag

SEQ ID NO: 2862245 - DNA, 16 bp, Homo sapiens
tgtaaccagctcagtg

SEQ ID NO: 2862246 - DNA, 16 bp, Homo sapiens
tgtaacgtggcactgg

SEQ ID NO: 2862247 - DNA, 21 bp, Homo sapiens
tgtaactgaggactgtttgca

SEQ ID NO: 2862248 - DNA, 16 bp, Homo sapiens
tgtaagtgaaattaag

SEQ ID NO: 2862249 - DNA, 18 bp, Homo sapiens
tgtaataatgtaacatga

SEQ ID NO: 2862250 - DNA, 16 bp, Homo sapiens
tgtaatcccagctact

SEQ ID NO: 2862251 - DNA, 13 bp, Homo sapiens
tgtaatctatgtt

SEQ ID NO: 2862252 - DNA, 17 bp, Homo sapiens
tgtaatctatgtttata

SEQ ID NO: 2862253 - DNA, 17 bp, Homo sapiens
tgtaatctcaatgcaag

SEQ ID NO: 2862254 - DNA, 16 bp, Homo sapiens
tgtaattatgtaaata

SEQ ID NO: 2862255 - DNA, 17 bp, Homo sapiens
tgtagaactcactctgg

SEQ ID NO: 2862256 - DNA, 19 bp, Homo sapiens
tgtagaactcactctgggc

SEQ ID NO: 2862257 - DNA, 22 bp, Homo sapiens
tgtataatcacagttgtgttcc

SEQ ID NO: 2862258 - DNA, 14 bp, Homo sapiens
tgtatatgactgca

SEQ ID NO: 2862259 - DNA, 19 bp, Homo sapiens
tgtatattacccaatggaa

SEQ ID NO: 2862260 - DNA, 20 bp, Homo sapiens
tgtatattacccaatggaaa

SEQ ID NO: 2862261 - DNA, 18 bp, Homo sapiens
tgtatccaaggaaacatt

SEQ ID NO: 2862262 - DNA, 22 bp, Homo sapiens
tgtatgggggagattgaacttt

SEQ ID NO: 2862263 - DNA, 15 bp, Homo sapiens
tgtatgtttttctgt

SEQ ID NO: 2862264 - DNA, 16 bp, Homo sapiens
tgtatgtttttctgta

SEQ ID NO: 2862265 - DNA, 18 bp, Homo sapiens
tgtattactgaataatat

SEQ ID NO: 2862266 - DNA, 14 bp, Homo sapiens
tgtattctctgagc

SEQ ID NO: 2862267 - DNA, 14 bp, Homo sapiens
tgtatttctatata

SEQ ID NO: 2862268 - DNA, 13 bp, Homo sapiens
tgtcagcatctga

SEQ ID NO: 2862269 - DNA, 18 bp, Homo sapiens
tgtcagcatctgaccatc

SEQ ID NO: 2862270 - DNA, 20 bp, Homo sapiens
tgtcagcatctgaccatctg

SEQ ID NO: 2862271 - DNA, 23 bp, Homo sapiens
tgtcagcatctgaccatctgtga

SEQ ID NO: 2862272 - DNA, 17 bp, Homo sapiens
tgtcagctgctgttgaa

SEQ ID NO: 2862273 - DNA, 22 bp, Homo sapiens
tgtcagctgctgttgaactttt

SEQ ID NO: 2862274 - DNA, 13 bp, Homo sapiens
tgtccaaaattta

SEQ ID NO: 2862275 - DNA, 18 bp, Homo sapiens
tgtccaaaatttatattt

SEQ ID NO: 2862276 - DNA, 19 bp, Homo sapiens
tgtccacgactgtctccat

SEQ ID NO: 2862277 - DNA, 12 bp, Homo sapiens
tgtccaggaagt

SEQ ID NO: 2862278 - DNA, 19 bp, Homo sapiens
tgtcccacccccttccccc

SEQ ID NO: 2862279 - DNA, 17 bp, Homo sapiens
tgtccccaccctccact

SEQ ID NO: 2862280 - DNA, 22 bp, Homo sapiens
tgtccctctcactccccagccc

SEQ ID NO: 2862281 - DNA, 18 bp, Homo sapiens
tgtccttaaaatgtggtc

SEQ ID NO: 2862282 - DNA, 11 bp, Homo sapiens
tgtccttccct

SEQ ID NO: 2862283 - DNA, 21 bp, Homo sapiens
tgtctcatccatcatcatgtg

SEQ ID NO: 2862284 - DNA, 14 bp, Homo sapiens
tgtctgaccttcca

SEQ ID NO: 2862285 - DNA, 13 bp, Homo sapiens
tgtgaactttcat

SEQ ID NO: 2862286 - DNA, 15 bp, Homo sapiens
tgtgacagtttccaa

SEQ ID NO: 2862287 - DNA, 18 bp, Homo sapiens
tgtgacagtttccaaatt

SEQ ID NO: 2862288 - DNA, 21 bp, Homo sapiens
tgtgacagtttccaaattgcc

SEQ ID NO: 2862289 - DNA, 15 bp, Homo sapiens
tgtgaccaatgtctt

SEQ ID NO: 2862290 - DNA, 16 bp, Homo sapiens
tgtgacccaccagtgc

SEQ ID NO: 2862291 - DNA, 17 bp, Homo sapiens
tgtgacccaccagtgcc

SEQ ID NO: 2862292 - DNA, 15 bp, Homo sapiens
tgtgaggccagggca

SEQ ID NO: 2862293 - DNA, 16 bp, Homo sapiens
tgtgaggccagggcag

SEQ ID NO: 2862294 - DNA, 16 bp, Homo sapiens
tgtgagtcccagagcc

SEQ ID NO: 2862295 - DNA, 18 bp, Homo sapiens
tgtgatgaatactgtatt

SEQ ID NO: 2862296 - DNA, 13 bp, Homo sapiens
tgtgattactgca

SEQ ID NO: 2862297 - DNA, 21 bp, Homo sapiens
tgtgattactgcaatcactgt

SEQ ID NO: 2862298 - DNA, 19 bp, Homo sapiens
tgtgcagccgctgagcgag

SEQ ID NO: 2862299 - DNA, 22 bp, Homo sapiens
tgtgctccatatttgatttcta

SEQ ID NO: 2862300 - DNA, 13 bp, Homo sapiens
tgtggtctgccaa

SEQ ID NO: 2862301 - DNA, 23 bp, Homo sapiens
tgtggtgtgtccccctctgtcca

SEQ ID NO: 2862302 - DNA, 15 bp, Homo sapiens
tgtgtaacatccaag

SEQ ID NO: 2862303 - DNA, 19 bp, Homo sapiens
tgtgtaacatccaagccag

SEQ ID NO: 2862304 - DNA, 20 bp, Homo sapiens
tgtgtaaccagctcagtgtt

SEQ ID NO: 2862305 - DNA, 14 bp, Homo sapiens
tgtgtactctgtcc

SEQ ID NO: 2862306 - DNA, 12 bp, Homo sapiens
tgtgtgaagttt

SEQ ID NO: 2862307 - DNA, 22 bp, Homo sapiens
tgtgtggcagccaggatgacta

SEQ ID NO: 2862308 - DNA, 22 bp, Homo sapiens
tgtgtgtccacgactgtctcca

SEQ ID NO: 2862309 - DNA, 12 bp, Homo sapiens
tgtgtgtgtttt

SEQ ID NO: 2862310 - DNA, 19 bp, Homo sapiens
tgttaaagagataaagaat

SEQ ID NO: 2862311 - DNA, 19 bp, Homo sapiens
taaacgattagtgatgtcc

SEQ ID NO: 2862312 - DNA, 22 bp, Homo sapiens
taaacgattagtgatgtcctta

SEQ ID NO: 2862313 - DNA, 19 bp, Homo sapiens
taaactgactttttccccc

SEQ ID NO: 2862314 - DNA, 21 bp, Homo sapiens
taaactgactttttcccccca

SEQ ID NO: 2862315 - DNA, 15 bp, Homo sapiens
taaagaagtgcatga

SEQ ID NO: 2862316 - DNA, 16 bp, Homo sapiens
taaagaagtgcatgaa

SEQ ID NO: 2862317 - DNA, 15 bp, Homo sapiens
taaagagataaagaa

SEQ ID NO: 2862318 - DNA, 15 bp, Homo sapiens
taaagcaatatgcat

SEQ ID NO: 2862319 - DNA, 17 bp, Homo sapiens
taaagcaatatgcattt

SEQ ID NO: 2862320 - DNA, 13 bp, Homo sapiens
taaagccttctgg

SEQ ID NO: 2862321 - DNA, 16 bp, Homo sapiens
taaagccttctggatc

SEQ ID NO: 2862322 - DNA, 16 bp, Homo sapiens
taaagctgttattctt

SEQ ID NO: 2862323 - DNA, 17 bp, Homo sapiens
taaagctgttattcttg

SEQ ID NO: 2862324 - DNA, 19 bp, Homo sapiens
taaagctgttattcttgtt

SEQ ID NO: 2862325 - DNA, 20 bp, Homo sapiens
taaagctgttattcttgtta

SEQ ID NO: 2862326 - DNA, 12 bp, Homo sapiens
taaagtacaaat

SEQ ID NO: 2862327 - DNA, 22 bp, Homo sapiens
taaataaatgtatcttattcac

SEQ ID NO: 2862328 - DNA, 13 bp, Homo sapiens
taaataactgtgt

SEQ ID NO: 2862329 - DNA, 13 bp, Homo sapiens
taaatacagtctt

SEQ ID NO: 2862330 - DNA, 17 bp, Homo sapiens
taaatacagtcttccat

SEQ ID NO: 2862331 - DNA, 16 bp, Homo sapiens
taaatagcactttttg

SEQ ID NO: 2862332 - DNA, 13 bp, Homo sapiens
taaatatgaatga

SEQ ID NO: 2862333 - DNA, 12 bp, Homo sapiens
taaatcagaaag

SEQ ID NO: 2862334 - DNA, 17 bp, Homo sapiens
taaatcagaaagtaaca

SEQ ID NO: 2862335 - DNA, 19 bp, Homo sapiens
taaatcagaaagtaacaat

SEQ ID NO: 2862336 - DNA, 14 bp, Homo sapiens
taaatgccagagcc

SEQ ID NO: 2862337 - DNA, 16 bp, Homo sapiens
taaatgccagagccaa

SEQ ID NO: 2862338 - DNA, 17 bp, Homo sapiens
taaatgccagagccaac

SEQ ID NO: 2862339 - DNA, 22 bp, Homo sapiens
taaatgccagagccaacctgga

SEQ ID NO: 2862340 - DNA, 13 bp, Homo sapiens
taacatccaagcc

SEQ ID NO: 2862341 - DNA, 15 bp, Homo sapiens
taacatccaagccag

SEQ ID NO: 2862342 - DNA, 18 bp, Homo sapiens
taacatccaagccagagt

SEQ ID NO: 2862343 - DNA, 15 bp, Homo sapiens
taacatgtaggaagt

SEQ ID NO: 2862344 - DNA, 22 bp, Homo sapiens
taacatgtgttaagtattttca

SEQ ID NO: 2862345 - DNA, 15 bp, Homo sapiens
taaccctctcttccc

SEQ ID NO: 2862346 - DNA, 16 bp, Homo sapiens
taaccctctcttccct

SEQ ID NO: 2862347 - DNA, 21 bp, Homo sapiens
taacgggacagtaaacactcc

SEQ ID NO: 2862348 - DNA, 15 bp, Homo sapiens
taactagaatttatt

SEQ ID NO: 2862349 - DNA, 14 bp, Homo sapiens
taactgtactgaat

SEQ ID NO: 2862350 - DNA, 17 bp, Homo sapiens
taactgtgaaatgtacg

SEQ ID NO: 2862351 - DNA, 12 bp, Homo sapiens
taactgtgataa

SEQ ID NO: 2862352 - DNA, 16 bp, Homo sapiens
taacttctcatgtata

SEQ ID NO: 2862353 - DNA, 23 bp, Homo sapiens
taacttgatagggtctaccaata

SEQ ID NO: 2862354 - DNA, 13 bp, Homo sapiens
taactttccagtc

SEQ ID NO: 2862355 - DNA, 23 bp, Homo sapiens
taacttttttgtggcaattagtg

SEQ ID NO: 2862356 - DNA, 12 bp, Homo sapiens
taagaaaatgta

SEQ ID NO: 2862357 - DNA, 14 bp, Homo sapiens
taagatagaaagct

SEQ ID NO: 2862358 - DNA, 17 bp, Homo sapiens
taagcattttgaaacaa

SEQ ID NO: 2862359 - DNA, 21 bp, Homo sapiens
taagcattttgaaacaaagta

SEQ ID NO: 2862360 - DNA, 11 bp, Homo sapiens
taagctgtttc

SEQ ID NO: 2862361 - DNA, 16 bp, Homo sapiens
taagctgtttccatag

SEQ ID NO: 2862362 - DNA, 16 bp, Homo sapiens
taagtagtaaatcaga

SEQ ID NO: 2862363 - DNA, 20 bp, Homo sapiens
taagtagtaaatcagaaagt

SEQ ID NO: 2862364 - DNA, 15 bp, Homo sapiens
tctgaccatctgtga

SEQ ID NO: 2862365 - DNA, 13 bp, Homo sapiens
tctgactcagggc

SEQ ID NO: 2862366 - DNA, 16 bp, Homo sapiens
tctgagcaccccctca

SEQ ID NO: 2862367 - DNA, 21 bp, Homo sapiens
tctgagcaccccctcattccc

SEQ ID NO: 2862368 - DNA, 22 bp, Homo sapiens
tctgaggatagtagttaaataa

SEQ ID NO: 2862369 - DNA, 21 bp, Homo sapiens
tctgatccctctacagagctt

SEQ ID NO: 2862370 - DNA, 14 bp, Homo sapiens
tctgatcggccagt

SEQ ID NO: 2862371 - DNA, 16 bp, Homo sapiens
tctgatcggccagttt

SEQ ID NO: 2862372 - DNA, 16 bp, Homo sapiens
tctgatggctgctcca

SEQ ID NO: 2862373 - DNA, 21 bp, Homo sapiens
tctgcagcactttaaccctct

SEQ ID NO: 2862374 - DNA, 12 bp, Homo sapiens
tctgcagcggca

SEQ ID NO: 2862375 - DNA, 13 bp, Homo sapiens
tctgcagcggcag

SEQ ID NO: 2862376 - DNA, 15 bp, Homo sapiens
tctgccaatctgtac

SEQ ID NO: 2862377 - DNA, 14 bp, Homo sapiens
tctgccactgagga

SEQ ID NO: 2862378 - DNA, 20 bp, Homo sapiens
tctgcgtgtcacctgtgctt

SEQ ID NO: 2862379 - DNA, 18 bp, Homo sapiens
tctgctcatcattctctg

SEQ ID NO: 2862380 - DNA, 22 bp, Homo sapiens
tctgctcatcattctctgtctc

SEQ ID NO: 2862381 - DNA, 15 bp, Homo sapiens
tctggatccatgggg

SEQ ID NO: 2862382 - DNA, 22 bp, Homo sapiens
tctggatccatggggggagaag

SEQ ID NO: 2862383 - DNA, 23 bp, Homo sapiens
tctggctagagccgaggggagag

SEQ ID NO: 2862384 - DNA, 19 bp, Homo sapiens
tctgggagggcagcagggc

SEQ ID NO: 2862385 - DNA, 22 bp, Homo sapiens
tctgggctgtaacgtggcactg

SEQ ID NO: 2862386 - DNA, 19 bp, Homo sapiens
tctgggcttggggcttcct

SEQ ID NO: 2862387 - DNA, 21 bp, Homo sapiens
tctgggcttggggcttcctaa

SEQ ID NO: 2862388 - DNA, 20 bp, Homo sapiens
tctggttctaactgctgtta

SEQ ID NO: 2862389 - DNA, 22 bp, Homo sapiens
tctgtacaaaatggtcctattt

SEQ ID NO: 2862390 - DNA, 14 bp, Homo sapiens
tctgtagagccaat

SEQ ID NO: 2862391 - DNA, 20 bp, Homo sapiens
tctgtagggtaattagtaac

SEQ ID NO: 2862392 - DNA, 21 bp, Homo sapiens
tctgtctcaaaaaataaaaat

SEQ ID NO: 2862393 - DNA, 17 bp, Homo sapiens
tctgtgaacgatttaga

SEQ ID NO: 2862394 - DNA, 16 bp, Homo sapiens
tctgtgaccaatgtct

SEQ ID NO: 2862395 - DNA, 22 bp, Homo sapiens
tctgtgtaacatccaagccaga

SEQ ID NO: 2862396 - DNA, 21 bp, Homo sapiens
tctgtgtaaccagctcagtgt

SEQ ID NO: 2862397 - DNA, 20 bp, Homo sapiens
tcttagctgaggctgagaaa

SEQ ID NO: 2862398 - DNA, 24 bp, Homo sapiens
tcttatccaactttttcatagtaa

SEQ ID NO: 2862399 - DNA, 15 bp, Homo sapiens
tcttatgtgaaaaat

SEQ ID NO: 2862400 - DNA, 17 bp, Homo sapiens
tcttcaatatgaatcta

SEQ ID NO: 2862401 - DNA, 20 bp, Homo sapiens
tcttcactgccatgcctcaa

SEQ ID NO: 2862402 - DNA, 15 bp, Homo sapiens
tcttcagtttttcac

SEQ ID NO: 2862403 - DNA, 14 bp, Homo sapiens
tcttccatttgcaa

SEQ ID NO: 2862404 - DNA, 12 bp, Homo sapiens
tcttccttcccc

SEQ ID NO: 2862405 - DNA, 23 bp, Homo sapiens
tcttgaatttaataatctgtagg

SEQ ID NO: 2862406 - DNA, 21 bp, Homo sapiens
tcttgatgcatgcactgttcc

SEQ ID NO: 2862407 - DNA, 15 bp, Homo sapiens
tcttggggctgatga

SEQ ID NO: 2862408 - DNA, 17 bp, Homo sapiens
tcttggggctgatgaag

SEQ ID NO: 2862409 - DNA, 15 bp, Homo sapiens
tcttggttgaggaaa

SEQ ID NO: 2862410 - DNA, 19 bp, Homo sapiens
tcttgtaatccgaatctct

SEQ ID NO: 2862411 - DNA, 12 bp, Homo sapiens
tcttgtttgtca

SEQ ID NO: 2862412 - DNA, 18 bp, Homo sapiens
tcttgtttgtcagcatct

SEQ ID NO: 2862413 - DNA, 19 bp, Homo sapiens
tcttgtttgtcagcatctg

SEQ ID NO: 2862414 - DNA, 20 bp, Homo sapiens
tcttgtttgtcagcatctga

SEQ ID NO: 2862415 - DNA, 21 bp, Homo sapiens
tcttgtttgtcagcatctgac

SEQ ID NO: 2862416 - DNA, 14 bp, Homo sapiens
tctttaaactatgt

SEQ ID NO: 2862417 - DNA, 23 bp, Homo sapiens
tctttaggggaagtaaaacagtc

SEQ ID NO: 2862418 - DNA, 16 bp, Homo sapiens
tctttatatttcaata

SEQ ID NO: 2862419 - DNA, 11 bp, Homo sapiens
tctttcaaaac

SEQ ID NO: 2862420 - DNA, 23 bp, Homo sapiens
tctttcaaaaccttttgaaatta

SEQ ID NO: 2862421 - DNA, 22 bp, Homo sapiens
tctttccaaattaaaacaaata

SEQ ID NO: 2862422 - DNA, 23 bp, Homo sapiens
tctttccacggagccactcctct

SEQ ID NO: 2862423 - DNA, 13 bp, Homo sapiens
tctttcttgtttg

SEQ ID NO: 2862424 - DNA, 23 bp, Homo sapiens
tctttcttgtttgtcagcatctg

SEQ ID NO: 2862425 - DNA, 22 bp, Homo sapiens
tctttgagtcaatagcttgtct

SEQ ID NO: 2862426 - DNA, 17 bp, Homo sapiens
tctttggacttctgaag

SEQ ID NO: 2862427 - DNA, 17 bp, Homo sapiens
tcttttttagtgttaaa

SEQ ID NO: 2862428 - DNA, 18 bp, Homo sapiens
tcttttttagtgttaaag

SEQ ID NO: 2862429 - DNA, 14 bp, Homo sapiens
tgaaaaattaactt

SEQ ID NO: 2862430 - DNA, 16 bp, Homo sapiens
tgaaaacactgtgcac

SEQ ID NO: 2862431 - DNA, 19 bp, Homo sapiens
tgaaaagggtcagaaggat

SEQ ID NO: 2862432 - DNA, 13 bp, Homo sapiens
tgaaaatgtcttg

SEQ ID NO: 2862433 - DNA, 16 bp, Homo sapiens
tgaaaatgtcttgtgt

SEQ ID NO: 2862434 - DNA, 19 bp, Homo sapiens
tgaaacaaagtactcttta

SEQ ID NO: 2862435 - DNA, 22 bp, Homo sapiens
tgaaacagttgctgtgaacttt

SEQ ID NO: 2862436 - DNA, 20 bp, Homo sapiens
tgaaaccagtgttagggaag

SEQ ID NO: 2862437 - DNA, 23 bp, Homo sapiens
tgaaataatgggattagaaacaa

SEQ ID NO: 2862438 - DNA, 13 bp, Homo sapiens
tgaaatgaacttt

SEQ ID NO: 2862439 - DNA, 17 bp, Homo sapiens
tgaaatgaactttgtca

SEQ ID NO: 2862440 - DNA, 22 bp, Homo sapiens
tgaaatgaactttgtcagtgtt

SEQ ID NO: 2862441 - DNA, 14 bp, Homo sapiens
tgaaattaacctct

SEQ ID NO: 2862442 - DNA, 13 bp, Homo sapiens
tgaaattaagcat

SEQ ID NO: 2862443 - DNA, 19 bp, Homo sapiens
tgaaattaagcattttgaa

SEQ ID NO: 2862444 - DNA, 18 bp, Homo sapiens
tgaacaaagctcaaagta

SEQ ID NO: 2862445 - DNA, 17 bp, Homo sapiens
tgaacataacttctcat

SEQ ID NO: 2862446 - DNA, 21 bp, Homo sapiens
tgaacataacttctcatgtat

SEQ ID NO: 2862447 - DNA, 22 bp, Homo sapiens
tgaacccatattttaaattctc

SEQ ID NO: 2862448 - DNA, 14 bp, Homo sapiens
tgaactttgtcagt

SEQ ID NO: 2862449 - DNA, 13 bp, Homo sapiens
tgaagaaagtcaa

SEQ ID NO: 2862450 - DNA, 21 bp, Homo sapiens
tgaagaaagtcaaaaaattat

SEQ ID NO: 2862451 - DNA, 16 bp, Homo sapiens
tgaagatctttatatt

SEQ ID NO: 2862452 - DNA, 21 bp, Homo sapiens
tgaagatctttatatttcaat

SEQ ID NO: 2862453 - DNA, 21 bp, Homo sapiens
tgaagattctttcccaattca

SEQ ID NO: 2862454 - DNA, 13 bp, Homo sapiens
tgaaggcttctct

SEQ ID NO: 2862455 - DNA, 17 bp, Homo sapiens
tgaagtatgaagtctga

SEQ ID NO: 2862456 - DNA, 19 bp, Homo sapiens
tgaagtgttccctttttca

SEQ ID NO: 2862457 - DNA, 16 bp, Homo sapiens
tgaataatatcaaata

SEQ ID NO: 2862458 - DNA, 13 bp, Homo sapiens
tgaatgaaacatg

SEQ ID NO: 2862459 - DNA, 17 bp, Homo sapiens
tgaatgtccaaaattta

SEQ ID NO: 2862460 - DNA, 15 bp, Homo sapiens
tgaatgtgtgagaaa

SEQ ID NO: 2862461 - DNA, 18 bp, Homo sapiens
tgaatgtgtgagaaaaac

SEQ ID NO: 2862462 - DNA, 19 bp, Homo sapiens
tgaatttaataatctgtag

SEQ ID NO: 2862463 - DNA, 15 bp, Homo sapiens
tgaatttgtatatga

SEQ ID NO: 2862464 - DNA, 19 bp, Homo sapiens
tgaatttgtatatgactgc

SEQ ID NO: 2862465 - DNA, 18 bp, Homo sapiens
tgacaactcattttcata

SEQ ID NO: 2862466 - DNA, 19 bp, Homo sapiens
tgacaagatggaaaataaa

SEQ ID NO: 2862467 - DNA, 18 bp, Homo sapiens
tgacactcaataaacagt

SEQ ID NO: 2862468 - DNA, 16 bp, Homo sapiens
tgacaggttttccaaa

SEQ ID NO: 2862469 - DNA, 16 bp, Homo sapiens
tgacagtttccaaatt

SEQ ID NO: 2862470 - DNA, 15 bp, Homo sapiens
tgacagtttttgaca

SEQ ID NO: 2862471 - DNA, 23 bp, Homo sapiens
tgacagtttttgacatttatatt

SEQ ID NO: 2862472 - DNA, 17 bp, Homo sapiens
tgacatttaatgccatc

SEQ ID NO: 2862473 - DNA, 16 bp, Homo sapiens
gctttcgaactgctag

SEQ ID NO: 2862474 - DNA, 17 bp, Homo sapiens
ggaaaaatgggagccag

SEQ ID NO: 2862475 - DNA, 23 bp, Homo sapiens
ggaaaagaatccctgcagcctgg

SEQ ID NO: 2862476 - DNA, 22 bp, Homo sapiens
ggaaaataggaagtgaacccat

SEQ ID NO: 2862477 - DNA, 22 bp, Homo sapiens
ggaaacaaataatttgaacttt

SEQ ID NO: 2862478 - DNA, 20 bp, Homo sapiens
ggaaaccagagtctgtattt

SEQ ID NO: 2862479 - DNA, 16 bp, Homo sapiens
ggaaacccaaggaaca

SEQ ID NO: 2862480 - DNA, 15 bp, Homo sapiens
ggaaaggcaagcttg

SEQ ID NO: 2862481 - DNA, 21 bp, Homo sapiens
ggaaaggcaagcttgaggcca

SEQ ID NO: 2862482 - DNA, 24 bp, Homo sapiens
ggaacccttacagtaggagcccag

SEQ ID NO: 2862483 - DNA, 19 bp, Homo sapiens
ggaagacaggtctagactt

SEQ ID NO: 2862484 - DNA, 13 bp, Homo sapiens
ggaagccaaaggc

SEQ ID NO: 2862485 - DNA, 16 bp, Homo sapiens
ggaagcttgagcctcc

SEQ ID NO: 2862486 - DNA, 16 bp, Homo sapiens
ggaagtaggaagtaaa

SEQ ID NO: 2862487 - DNA, 20 bp, Homo sapiens
ggaagtcagaatttttaact

SEQ ID NO: 2862488 - DNA, 22 bp, Homo sapiens
ggaagtcagaatttttaactgt

SEQ ID NO: 2862489 - DNA, 14 bp, Homo sapiens
ggaatgctggactg

SEQ ID NO: 2862490 - DNA, 16 bp, Homo sapiens
ggacaatgccttggga

SEQ ID NO: 2862491 - DNA, 14 bp, Homo sapiens
ggacagcccagagc

SEQ ID NO: 2862492 - DNA, 17 bp, Homo sapiens
ggacagcccagagcctg

SEQ ID NO: 2862493 - DNA, 21 bp, Homo sapiens
ggacagcccagagcctggctg

SEQ ID NO: 2862494 - DNA, 23 bp, Homo sapiens
ggacaggaggggcccacaatgga

SEQ ID NO: 2862495 - DNA, 14 bp, Homo sapiens
ggacatttctctaa

SEQ ID NO: 2862496 - DNA, 17 bp, Homo sapiens
ggacctggtgctgcctc

SEQ ID NO: 2862497 - DNA, 19 bp, Homo sapiens
ggacgcctgggggtgccag

SEQ ID NO: 2862498 - DNA, 11 bp, Homo sapiens
ggactccaggc

SEQ ID NO: 2862499 - DNA, 20 bp, Homo sapiens
ggactccaggcctgaccagg

SEQ ID NO: 2862500 - DNA, 12 bp, Homo sapiens
ggactcctccca

SEQ ID NO: 2862501 - DNA, 17 bp, Homo sapiens
ggactctcagtctctga

SEQ ID NO: 2862502 - DNA, 13 bp, Homo sapiens
ggactctgctaga

SEQ ID NO: 2862503 - DNA, 23 bp, Homo sapiens
ggactggcagaagcattgcctgg

SEQ ID NO: 2862504 - DNA, 20 bp, Homo sapiens
ggacttgtttagagagcctg

SEQ ID NO: 2862505 - DNA, 13 bp, Homo sapiens
ggagactgggctg

SEQ ID NO: 2862506 - DNA, 20 bp, Homo sapiens
ggagactgggctgagggagc

SEQ ID NO: 2862507 - DNA, 17 bp, Homo sapiens
ggagagacccctcccct

SEQ ID NO: 2862508 - DNA, 21 bp, Homo sapiens
ggagagacccctcccctccca

SEQ ID NO: 2862509 - DNA, 17 bp, Homo sapiens
ggagagagggactcaag

SEQ ID NO: 2862510 - DNA, 14 bp, Homo sapiens
ggagagccagctct

SEQ ID NO: 2862511 - DNA, 19 bp, Homo sapiens
ggagagccagctctctcta

SEQ ID NO: 2862512 - DNA, 17 bp, Homo sapiens
ggagattgaactttccc

SEQ ID NO: 2862513 - DNA, 12 bp, Homo sapiens
ggagccaggagt

SEQ ID NO: 2862514 - DNA, 22 bp, Homo sapiens
ggagccaggagtaagacaagtg

SEQ ID NO: 2862515 - DNA, 18 bp, Homo sapiens
ggagccgggtctgcctct

SEQ ID NO: 2862516 - DNA, 18 bp, Homo sapiens
ggagcgtggactctgcta

SEQ ID NO: 2862517 - DNA, 13 bp, Homo sapiens
ggagcgttctaaa

SEQ ID NO: 2862518 - DNA, 20 bp, Homo sapiens
ggagcttcatggcagaaggc

SEQ ID NO: 2862519 - DNA, 16 bp, Homo sapiens
ggaggctccagagggc

SEQ ID NO: 2862520 - DNA, 17 bp, Homo sapiens
ggagggcagcagggcta

SEQ ID NO: 2862521 - DNA, 14 bp, Homo sapiens
ggaggtccagctgg

SEQ ID NO: 2862522 - DNA, 18 bp, Homo sapiens
ggaggtccagctgggcct

SEQ ID NO: 2862523 - DNA, 12 bp, Homo sapiens
ggagtgttcccc

SEQ ID NO: 2862524 - DNA, 13 bp, Homo sapiens
ggatattttgaaa

SEQ ID NO: 2862525 - DNA, 18 bp, Homo sapiens
ggatccctcatctgtccc

SEQ ID NO: 2862526 - DNA, 22 bp, Homo sapiens
ggatccctcatctgtccctccg

SEQ ID NO: 2862527 - DNA, 24 bp, Homo sapiens
ggatctcattggacccttccatgg

SEQ ID NO: 2862528 - DNA, 18 bp, Homo sapiens
ggatctggggctctggga

SEQ ID NO: 2862529 - DNA, 18 bp, Homo sapiens
ggattcctgggcaagaac

SEQ ID NO: 2862530 - DNA, 10 bp, Homo sapiens
ggattctggg

SEQ ID NO: 2862531 - DNA, 23 bp, Homo sapiens
ggattctgggaagcttgagcctc

SEQ ID NO: 2862532 - DNA, 21 bp, Homo sapiens
gtagaactcactctgggctgt

SEQ ID NO: 2862533 - DNA, 21 bp, Homo sapiens
gtagcattcatgtaataaaca

SEQ ID NO: 2862534 - DNA, 15 bp, Homo sapiens
gtagttaaataactg

SEQ ID NO: 2862535 - DNA, 15 bp, Homo sapiens
gtatatttcttttaa

SEQ ID NO: 2862536 - DNA, 21 bp, Homo sapiens
gtatcactgccttcgtttata

SEQ ID NO: 2862537 - DNA, 18 bp, Homo sapiens
gtatcaggacccagagga

SEQ ID NO: 2862538 - DNA, 22 bp, Homo sapiens
gtattaaaaaacaattaactgc

SEQ ID NO: 2862539 - DNA, 23 bp, Homo sapiens
gtattaaaaaacaattaactgcc

SEQ ID NO: 2862540 - DNA, 22 bp, Homo sapiens
gtattaactatcttctttggac

SEQ ID NO: 2862541 - DNA, 13 bp, Homo sapiens
gtattctctgagc

SEQ ID NO: 2862542 - DNA, 13 bp, Homo sapiens
gtatttcaaattg

SEQ ID NO: 2862543 - DNA, 18 bp, Homo sapiens
gtattttgtattgtttca

SEQ ID NO: 2862544 - DNA, 14 bp, Homo sapiens
gtcaacctgggcaa

SEQ ID NO: 2862545 - DNA, 18 bp, Homo sapiens
gtcaagaaacagccagca

SEQ ID NO: 2862546 - DNA, 16 bp, Homo sapiens
gtcagacgcctgagga

SEQ ID NO: 2862547 - DNA, 12 bp, Homo sapiens
gtcagcatctga

SEQ ID NO: 2862548 - DNA, 19 bp, Homo sapiens
gtcagcatctgaccatctg

SEQ ID NO: 2862549 - DNA, 17 bp, Homo sapiens
gtcagctgctgttgaac

SEQ ID NO: 2862550 - DNA, 16 bp, Homo sapiens
gtcagtaccttcaaac

SEQ ID NO: 2862551 - DNA, 18 bp, Homo sapiens
gtcataaaatagaataat

SEQ ID NO: 2862552 - DNA, 15 bp, Homo sapiens
gtcataccaatgaaa

SEQ ID NO: 2862553 - DNA, 21 bp, Homo sapiens
gtccaaaatttatattttaga

SEQ ID NO: 2862554 - DNA, 20 bp, Homo sapiens
gtccacaaaataaccaatcc

SEQ ID NO: 2862555 - DNA, 15 bp, Homo sapiens
gtccagcagtttcca

SEQ ID NO: 2862556 - DNA, 21 bp, Homo sapiens
gtccagctgggcctcctgcct

SEQ ID NO: 2862557 - DNA, 15 bp, Homo sapiens
gtccaggcactgaga

SEQ ID NO: 2862558 - DNA, 18 bp, Homo sapiens
gtccagtcgggaggagca

SEQ ID NO: 2862559 - DNA, 18 bp, Homo sapiens
gtccatgggcagagccca

SEQ ID NO: 2862560 - DNA, 23 bp, Homo sapiens
gtccatgggcagagcccaaggga

SEQ ID NO: 2862561 - DNA, 17 bp, Homo sapiens
gtccccaccctccactc

SEQ ID NO: 2862562 - DNA, 18 bp, Homo sapiens
gtccccaccctccactca

SEQ ID NO: 2862563 - DNA, 19 bp, Homo sapiens
gtccccctctgtccaggca

SEQ ID NO: 2862564 - DNA, 16 bp, Homo sapiens
gtccctctcactcccc

SEQ ID NO: 2862565 - DNA, 18 bp, Homo sapiens
gtccctctcactccccag

SEQ ID NO: 2862566 - DNA, 21 bp, Homo sapiens
gtccctctcactccccagccc

SEQ ID NO: 2862567 - DNA, 20 bp, Homo sapiens
gtccgaaaccagttaagaat

SEQ ID NO: 2862568 - DNA, 19 bp, Homo sapiens
gtcctaaaagttctcaatg

SEQ ID NO: 2862569 - DNA, 15 bp, Homo sapiens
gtcctatttttgtga

SEQ ID NO: 2862570 - DNA, 13 bp, Homo sapiens
gtcctcctctgtg

SEQ ID NO: 2862571 - DNA, 14 bp, Homo sapiens
gtcctcctctgtga

SEQ ID NO: 2862572 - DNA, 21 bp, Homo sapiens
gtcctgcagcaaacactccac

SEQ ID NO: 2862573 - DNA, 23 bp, Homo sapiens
gtcctgcagcaaacactccaccc

SEQ ID NO: 2862574 - DNA, 15 bp, Homo sapiens
gtccttccctgccac

SEQ ID NO: 2862575 - DNA, 14 bp, Homo sapiens
gtcgatagagctgt

SEQ ID NO: 2862576 - DNA, 18 bp, Homo sapiens
gtctaccaatacaaaatg

SEQ ID NO: 2862577 - DNA, 13 bp, Homo sapiens
gtctcttgtaatc

SEQ ID NO: 2862578 - DNA, 22 bp, Homo sapiens
gtctgagcaccccctcattccc

SEQ ID NO: 2862579 - DNA, 22 bp, Homo sapiens
gtctgtgtaacatccaagccag

SEQ ID NO: 2862580 - DNA, 18 bp, Homo sapiens
gtgaaacagttgctgtga

SEQ ID NO: 2862581 - DNA, 11 bp, Homo sapiens
gtgaaattaag

SEQ ID NO: 2862582 - DNA, 16 bp, Homo sapiens
gtgaacgatttagaaa

SEQ ID NO: 2862583 - DNA, 16 bp, Homo sapiens
gtgacagtttccaaat

SEQ ID NO: 2862584 - DNA, 16 bp, Homo sapiens
gtgaccaatgtcttga

SEQ ID NO: 2862585 - DNA, 16 bp, Homo sapiens
gtgacccaccagtgcc

SEQ ID NO: 2862586 - DNA, 20 bp, Homo sapiens
gtgagacccagccctcatcc

SEQ ID NO: 2862587 - DNA, 14 bp, Homo sapiens
gtgatgaatactgt

SEQ ID NO: 2862588 - DNA, 20 bp, Homo sapiens
gtgatgtccttaaaatgtgg

SEQ ID NO: 2862589 - DNA, 18 bp, Homo sapiens
gtgcagccgctgagcgag

SEQ ID NO: 2862590 - DNA, 16 bp, Homo sapiens
gtgcagtcctgatcag

SEQ ID NO: 2862591 - DNA, 17 bp, Homo sapiens
gtgcccaaagtggggag

SEQ ID NO: 2862592 - DNA, 18 bp, Homo sapiens
gtgctataaatgccagag

SEQ ID NO: 2862593 - DNA, 19 bp, Homo sapiens
gtgctataaatgccagagc

SEQ ID NO: 2862594 - DNA, 22 bp, Homo sapiens
gtgctccatatttgatttctaa

SEQ ID NO: 2862595 - DNA, 11 bp, Homo sapiens
gtgctgcctct

SEQ ID NO: 2862596 - DNA, 19 bp, Homo sapiens
gtgctgcctctacctgaca

SEQ ID NO: 2862597 - DNA, 13 bp, Homo sapiens
gtgctttgcattt

SEQ ID NO: 2862598 - DNA, 16 bp, Homo sapiens
gtggaaaaaacatttt

SEQ ID NO: 2862599 - DNA, 17 bp, Homo sapiens
gtggaaaaaacatttta

SEQ ID NO: 2862600 - DNA, 22 bp, Homo sapiens
gtggactctgctagactcctca

SEQ ID NO: 2862601 - DNA, 12 bp, Homo sapiens
gtggagggccac

SEQ ID NO: 2862602 - DNA, 12 bp, Homo sapiens
gtggcaattagt

SEQ ID NO: 2862603 - DNA, 21 bp, Homo sapiens
gtggcactggtaggttgggac

SEQ ID NO: 2862604 - DNA, 18 bp, Homo sapiens
gtggccatcagggtgggc

SEQ ID NO: 2862605 - DNA, 21 bp, Homo sapiens
gtgggatttggggcctcaaga

SEQ ID NO: 2862606 - DNA, 14 bp, Homo sapiens
gtgggctccctgac

SEQ ID NO: 2862607 - DNA, 15 bp, Homo sapiens
gtgggctccctgact

SEQ ID NO: 2862608 - DNA, 18 bp, Homo sapiens
gtgggtccatgggcagag

SEQ ID NO: 2862609 - DNA, 12 bp, Homo sapiens
gtggtatgaggg

SEQ ID NO: 2862610 - DNA, 17 bp, Homo sapiens
gtggtatgagggggtgg

SEQ ID NO: 2862611 - DNA, 22 bp, Homo sapiens
gtggtcataaaatagaataatt

SEQ ID NO: 2862612 - DNA, 14 bp, Homo sapiens
gtggtctgccaatc

SEQ ID NO: 2862613 - DNA, 14 bp, Homo sapiens
gtggtgtgtgaagt

SEQ ID NO: 2862614 - DNA, 21 bp, Homo sapiens
gtggttattggactccaggcc

SEQ ID NO: 2862615 - DNA, 16 bp, Homo sapiens
gtgtaaccagctcagt

SEQ ID NO: 2862616 - DNA, 14 bp, Homo sapiens
gtgtccccctctgt

SEQ ID NO: 2862617 - DNA, 17 bp, Homo sapiens
gtgtgacagtttccaaa

SEQ ID NO: 2862618 - DNA, 15 bp, Homo sapiens
gtgtgaggccagggc

SEQ ID NO: 2862619 - DNA, 17 bp, Homo sapiens
gtgtgaggccagggcag

SEQ ID NO: 2862620 - DNA, 16 bp, Homo sapiens
gtgtgcaccagggttg

SEQ ID NO: 2862621 - DNA, 17 bp, Homo sapiens
gtgtggtatgagggggt

SEQ ID NO: 2862622 - DNA, 20 bp, Homo sapiens
gtgtggtatgagggggtggt

SEQ ID NO: 2862623 - DNA, 20 bp, Homo sapiens
gtgtgtccacgactgtctcc

SEQ ID NO: 2862624 - DNA, 17 bp, Homo sapiens
gtgtgtccccctctgtc

SEQ ID NO: 2862625 - DNA, 18 bp, Homo sapiens
gtgtgtccccctctgtcc

SEQ ID NO: 2862626 - DNA, 21 bp, Homo sapiens
gtgtgtggcagccaggatgac

SEQ ID NO: 2862627 - DNA, 16 bp, Homo sapiens
gtgttacctgaaaaca

SEQ ID NO: 2862628 - DNA, 22 bp, Homo sapiens
gtgttagggaagggcctgccac

SEQ ID NO: 2862629 - DNA, 21 bp, Homo sapiens
gtgttcagctctttccaaatt

SEQ ID NO: 2862630 - DNA, 20 bp, Homo sapiens
gtgttccaagtctctgtgta

SEQ ID NO: 2862631 - DNA, 19 bp, Homo sapiens
gtgttccccttccactgag

SEQ ID NO: 2862632 - DNA, 23 bp, Homo sapiens
gtgttccccttccactgagggca

SEQ ID NO: 2862633 - DNA, 16 bp, Homo sapiens
gtgttgtccaggaagt

SEQ ID NO: 2862634 - DNA, 20 bp, Homo sapiens
gtgttgttgttgctgctgtt

SEQ ID NO: 2862635 - DNA, 22 bp, Homo sapiens
gttaggggccttagggcactgg

SEQ ID NO: 2862636 - DNA, 14 bp, Homo sapiens
gttagtgacattta

SEQ ID NO: 2862637 - DNA, 17 bp, Homo sapiens
gttagtgacatttaatg

SEQ ID NO: 2862638 - DNA, 18 bp, Homo sapiens
gttatacatcaatatgta

SEQ ID NO: 2862639 - DNA, 19 bp, Homo sapiens
gttatacatcaatatgtat

SEQ ID NO: 2862640 - DNA, 20 bp, Homo sapiens
gttatacatcaatatgtata

SEQ ID NO: 2862641 - DNA, 21 bp, Homo sapiens
gatgtgacccaccagtgcctt

SEQ ID NO: 2862642 - DNA, 19 bp, Homo sapiens
gatgttctaagtctttcca

SEQ ID NO: 2862643 - DNA, 17 bp, Homo sapiens
gattacctcctgagaaa

SEQ ID NO: 2862644 - DNA, 12 bp, Homo sapiens
gattctgggaag

SEQ ID NO: 2862645 - DNA, 20 bp, Homo sapiens
gattgctgccccatcagtgc

SEQ ID NO: 2862646 - DNA, 19 bp, Homo sapiens
gatttccctccagagaaag

SEQ ID NO: 2862647 - DNA, 20 bp, Homo sapiens
gatttccctccagagaaagc

SEQ ID NO: 2862648 - DNA, 13 bp, Homo sapiens
gattttaattttg

SEQ ID NO: 2862649 - DNA, 14 bp, Homo sapiens
gcaaacactccacc

SEQ ID NO: 2862650 - DNA, 19 bp, Homo sapiens
gcaactaatgtttgaacaa

SEQ ID NO: 2862651 - DNA, 15 bp, Homo sapiens
gcaagcttgaggcca

SEQ ID NO: 2862652 - DNA, 18 bp, Homo sapiens
gcaagcttgaggccaaga

SEQ ID NO: 2862653 - DNA, 20 bp, Homo sapiens
gcaagcttgaggccaagatg

SEQ ID NO: 2862654 - DNA, 14 bp, Homo sapiens
gcaatactgcttaa

SEQ ID NO: 2862655 - DNA, 19 bp, Homo sapiens
gcaatgccatcatctcctg

SEQ ID NO: 2862656 - DNA, 18 bp, Homo sapiens
gcaattccaggctgagcc

SEQ ID NO: 2862657 - DNA, 19 bp, Homo sapiens
gcaattccaggctgagcca

SEQ ID NO: 2862658 - DNA, 15 bp, Homo sapiens
gcacacatggacaca

SEQ ID NO: 2862659 - DNA, 22 bp, Homo sapiens
gcacactttgccatattttcac

SEQ ID NO: 2862660 - DNA, 17 bp, Homo sapiens
gcaccccctcattcccc

SEQ ID NO: 2862661 - DNA, 18 bp, Homo sapiens
gcaccccctcattcccct

SEQ ID NO: 2862662 - DNA, 21 bp, Homo sapiens
gcacctgtccccaccctccac

SEQ ID NO: 2862663 - DNA, 16 bp, Homo sapiens
gcactgcttgaggaaa

SEQ ID NO: 2862664 - DNA, 17 bp, Homo sapiens
gcactgcttgaggaaaa

SEQ ID NO: 2862665 - DNA, 23 bp, Homo sapiens
gcactggtaggttgggacaccag

SEQ ID NO: 2862666 - DNA, 15 bp, Homo sapiens
gcactgttccccctg

SEQ ID NO: 2862667 - DNA, 18 bp, Homo sapiens
gcactgttccccctgtgc

SEQ ID NO: 2862668 - DNA, 19 bp, Homo sapiens
gcactgttccccctgtgca

SEQ ID NO: 2862669 - DNA, 20 bp, Homo sapiens
gcactgttccccctgtgcag

SEQ ID NO: 2862670 - DNA, 16 bp, Homo sapiens
gcactttaaccctctc

SEQ ID NO: 2862671 - DNA, 14 bp, Homo sapiens
gcacttttagaaat

SEQ ID NO: 2862672 - DNA, 18 bp, Homo sapiens
gcagaacccccaggtggc

SEQ ID NO: 2862673 - DNA, 21 bp, Homo sapiens
gcagaagcattgcctggactg

SEQ ID NO: 2862674 - DNA, 22 bp, Homo sapiens
gcagaagcattgcctggactga

SEQ ID NO: 2862675 - DNA, 22 bp, Homo sapiens
gcagagagcaggacaggagaca

SEQ ID NO: 2862676 - DNA, 16 bp, Homo sapiens
gcagagcaattccagg

SEQ ID NO: 2862677 - DNA, 18 bp, Homo sapiens
gcagagcaattccaggct

SEQ ID NO: 2862678 - DNA, 20 bp, Homo sapiens
gcagagcaattccaggctga

SEQ ID NO: 2862679 - DNA, 22 bp, Homo sapiens
gcagcaaacactccaccctcca

SEQ ID NO: 2862680 - DNA, 17 bp, Homo sapiens
gcagcacctccaggcct

SEQ ID NO: 2862681 - DNA, 19 bp, Homo sapiens
gcagcacctccaggcctgt

SEQ ID NO: 2862682 - DNA, 14 bp, Homo sapiens
gcagcagggaagct

SEQ ID NO: 2862683 - DNA, 17 bp, Homo sapiens
gcagcagggctaccctg

SEQ ID NO: 2862684 - DNA, 20 bp, Homo sapiens
gcagcagggctaccctgagc

SEQ ID NO: 2862685 - DNA, 22 bp, Homo sapiens
gcagcctggtagaattgggaag

SEQ ID NO: 2862686 - DNA, 14 bp, Homo sapiens
gcagcggcagagca

SEQ ID NO: 2862687 - DNA, 16 bp, Homo sapiens
gcagcggcagagcaat

SEQ ID NO: 2862688 - DNA, 15 bp, Homo sapiens
gcaggacaggagaca

SEQ ID NO: 2862689 - DNA, 23 bp, Homo sapiens
gcaggactcggaattctcgggaa

SEQ ID NO: 2862690 - DNA, 20 bp, Homo sapiens
gcaggctgcacctctggcta

SEQ ID NO: 2862691 - DNA, 17 bp, Homo sapiens
gcagggctaccctgagc

SEQ ID NO: 2862692 - DNA, 22 bp, Homo sapiens
gcagggctaccctgagctgagg

SEQ ID NO: 2862693 - DNA, 23 bp, Homo sapiens
gcagggctaccctgagctgaggc

SEQ ID NO: 2862694 - DNA, 19 bp, Homo sapiens
gcaggggtgggagagccag

SEQ ID NO: 2862695 - DNA, 19 bp, Homo sapiens
gcagtcattatccaggtaa

SEQ ID NO: 2862696 - DNA, 21 bp, Homo sapiens
gcagtgtgaggccagggcaga

SEQ ID NO: 2862697 - DNA, 14 bp, Homo sapiens
gcatccacgcacac

SEQ ID NO: 2862698 - DNA, 22 bp, Homo sapiens
gcatctcagtggtgtgtgaagt

SEQ ID NO: 2862699 - DNA, 13 bp, Homo sapiens
gcatctcccagat

SEQ ID NO: 2862700 - DNA, 21 bp, Homo sapiens
gcatctcccagataatgtgaa

SEQ ID NO: 2862701 - DNA, 18 bp, Homo sapiens
gcatctgaccatctgtga

SEQ ID NO: 2862702 - DNA, 21 bp, Homo sapiens
gcatctgaccatctgtgacta

SEQ ID NO: 2862703 - DNA, 16 bp, Homo sapiens
gcatgcactgttcccc

SEQ ID NO: 2862704 - DNA, 21 bp, Homo sapiens
gcattagcctggatcctcagt

SEQ ID NO: 2862705 - DNA, 13 bp, Homo sapiens
gcattgcctggac

SEQ ID NO: 2862706 - DNA, 15 bp, Homo sapiens
gcattgcctggactg

SEQ ID NO: 2862707 - DNA, 17 bp, Homo sapiens
gcattgcctggactgac

SEQ ID NO: 2862708 - DNA, 17 bp, Homo sapiens
gccaacagaagcttcca

SEQ ID NO: 2862709 - DNA, 15 bp, Homo sapiens
gccaacctggacttc

SEQ ID NO: 2862710 - DNA, 19 bp, Homo sapiens
gccaacctggacttcctgt

SEQ ID NO: 2862711 - DNA, 20 bp, Homo sapiens
gccaacctggacttcctgtc

SEQ ID NO: 2862712 - DNA, 19 bp, Homo sapiens
gccaagatggctgctgcct

SEQ ID NO: 2862713 - DNA, 11 bp, Homo sapiens
ccaagccagag

SEQ ID NO: 2862714 - DNA, 12 bp, Homo sapiens
ccaagccagagt

SEQ ID NO: 2862715 - DNA, 14 bp, Homo sapiens
ccaaggaacaagag

SEQ ID NO: 2862716 - DNA, 17 bp, Homo sapiens
ccaatacaaaatgtatt

SEQ ID NO: 2862717 - DNA, 17 bp, Homo sapiens
ccaatatatgtattttt

SEQ ID NO: 2862718 - DNA, 20 bp, Homo sapiens
ccaatctttcctactttcta

SEQ ID NO: 2862719 - DNA, 23 bp, Homo sapiens
ccacaaaataaccaatcctggac

SEQ ID NO: 2862720 - DNA, 15 bp, Homo sapiens
ccacaccaaccaggc

SEQ ID NO: 2862721 - DNA, 13 bp, Homo sapiens
ccacagccataga

SEQ ID NO: 2862722 - DNA, 19 bp, Homo sapiens
ccacagcctcccctgccag

SEQ ID NO: 2862723 - DNA, 18 bp, Homo sapiens
ccacaggcacattaactg

SEQ ID NO: 2862724 - DNA, 17 bp, Homo sapiens
ccacattcttcagtttt

SEQ ID NO: 2862725 - DNA, 22 bp, Homo sapiens
ccacattcttcagtttttcact

SEQ ID NO: 2862726 - DNA, 12 bp, Homo sapiens
ccaccaccttgg

SEQ ID NO: 2862727 - DNA, 11 bp, Homo sapiens
ccaccacgtgc

SEQ ID NO: 2862728 - DNA, 13 bp, Homo sapiens
ccaccagtgcctt

SEQ ID NO: 2862729 - DNA, 14 bp, Homo sapiens
ccacccatgatact

SEQ ID NO: 2862730 - DNA, 19 bp, Homo sapiens
ccaccctccaccttccatt

SEQ ID NO: 2862731 - DNA, 13 bp, Homo sapiens
ccaccctccactc

SEQ ID NO: 2862732 - DNA, 21 bp, Homo sapiens
ccaccgggttctgcagcggca

SEQ ID NO: 2862733 - DNA, 16 bp, Homo sapiens
ccaccttggactcctc

SEQ ID NO: 2862734 - DNA, 20 bp, Homo sapiens
ccaccttggactcctcccac

SEQ ID NO: 2862735 - DNA, 14 bp, Homo sapiens
ccacgactgtctcc

SEQ ID NO: 2862736 - DNA, 15 bp, Homo sapiens
ccacgactgtctcca

SEQ ID NO: 2862737 - DNA, 23 bp, Homo sapiens
ccacgttctgctcatcattctct

SEQ ID NO: 2862738 - DNA, 12 bp, Homo sapiens
ccactactgcag

SEQ ID NO: 2862739 - DNA, 21 bp, Homo sapiens
ccactcaatccatccatgtac

SEQ ID NO: 2862740 - DNA, 12 bp, Homo sapiens
ccactcctctga

SEQ ID NO: 2862741 - DNA, 13 bp, Homo sapiens
ccactcctctgac

SEQ ID NO: 2862742 - DNA, 16 bp, Homo sapiens
ccactgaggagacaga

SEQ ID NO: 2862743 - DNA, 23 bp, Homo sapiens
ccactgaggagacagaaagcctc

SEQ ID NO: 2862744 - DNA, 23 bp, Homo sapiens
ccacttcattcttgaaagctgtg

SEQ ID NO: 2862745 - DNA, 17 bp, Homo sapiens
ccagagaccccttcctt

SEQ ID NO: 2862746 - DNA, 14 bp, Homo sapiens
ccagagcagagagc

SEQ ID NO: 2862747 - DNA, 23 bp, Homo sapiens
ccagagccaacctggacttcctg

SEQ ID NO: 2862748 - DNA, 19 bp, Homo sapiens
ccagagcctggctgcccat

SEQ ID NO: 2862749 - DNA, 13 bp, Homo sapiens
ccagagcttctct

SEQ ID NO: 2862750 - DNA, 14 bp, Homo sapiens
ccagagcttctctg

SEQ ID NO: 2862751 - DNA, 21 bp, Homo sapiens
ccagagcttctctgggctgaa

SEQ ID NO: 2862752 - DNA, 19 bp, Homo sapiens
ccagagtttttaaagcctt

SEQ ID NO: 2862753 - DNA, 18 bp, Homo sapiens
ccagattggccaattaaa

SEQ ID NO: 2862754 - DNA, 16 bp, Homo sapiens
ccagatttgtttcctt

SEQ ID NO: 2862755 - DNA, 23 bp, Homo sapiens
ccagcagctcaacctaccctggt

SEQ ID NO: 2862756 - DNA, 11 bp, Homo sapiens
ccagcccctgt

SEQ ID NO: 2862757 - DNA, 13 bp, Homo sapiens
ccagccctcatcc

SEQ ID NO: 2862758 - DNA, 13 bp, Homo sapiens
ccagcgtcctcct

SEQ ID NO: 2862759 - DNA, 16 bp, Homo sapiens
ccagctaataaaccag

SEQ ID NO: 2862760 - DNA, 20 bp, Homo sapiens
ccagctctgaaaccagtgtt

SEQ ID NO: 2862761 - DNA, 22 bp, Homo sapiens
ccagctgggcctcctgcctccg

SEQ ID NO: 2862762 - DNA, 13 bp, Homo sapiens
ccaggaaaggctt

SEQ ID NO: 2862763 - DNA, 15 bp, Homo sapiens
ccaggaaaggcttgg

SEQ ID NO: 2862764 - DNA, 19 bp, Homo sapiens
ccaggaaaggcttggctgg

SEQ ID NO: 2862765 - DNA, 20 bp, Homo sapiens
ccaggaaaggcttggctggt

SEQ ID NO: 2862766 - DNA, 19 bp, Homo sapiens
ccaggatgactagatcctg

SEQ ID NO: 2862767 - DNA, 17 bp, Homo sapiens
ccaggcctgaccagggg

SEQ ID NO: 2862768 - DNA, 15 bp, Homo sapiens
ccaggccttcatcct

SEQ ID NO: 2862769 - DNA, 15 bp, Homo sapiens
ccaggctgagccatg

SEQ ID NO: 2862770 - DNA, 17 bp, Homo sapiens
ccaggctgagccatgag

SEQ ID NO: 2862771 - DNA, 18 bp, Homo sapiens
ccaggctgagccatgagg

SEQ ID NO: 2862772 - DNA, 23 bp, Homo sapiens
ccagggaagaaggtttgaaagat

SEQ ID NO: 2862773 - DNA, 13 bp, Homo sapiens
ccagggggcccga

SEQ ID NO: 2862774 - DNA, 21 bp, Homo sapiens
ccagggttgaccccagaggat

SEQ ID NO: 2862775 - DNA, 22 bp, Homo sapiens
ccaggtgctacacccttttcca

SEQ ID NO: 2862776 - DNA, 15 bp, Homo sapiens
ccagtcctaacaaat

SEQ ID NO: 2862777 - DNA, 17 bp, Homo sapiens
ccagtgttagggaaggg

SEQ ID NO: 2862778 - DNA, 13 bp, Homo sapiens
ccatcatctcctg

SEQ ID NO: 2862779 - DNA, 17 bp, Homo sapiens
ccatccacatgggagcc

SEQ ID NO: 2862780 - DNA, 20 bp, Homo sapiens
ccatcccctttcctccccac

SEQ ID NO: 2862781 - DNA, 15 bp, Homo sapiens
ccatgaaccaagacc

SEQ ID NO: 2862782 - DNA, 11 bp, Homo sapiens
ccatgaggagc

SEQ ID NO: 2862783 - DNA, 19 bp, Homo sapiens
ccatgaggagcgtggactc

SEQ ID NO: 2862784 - DNA, 11 bp, Homo sapiens
ccatgcagcct

SEQ ID NO: 2862785 - DNA, 16 bp, Homo sapiens
ccatgcctcaagaaca

SEQ ID NO: 2862786 - DNA, 19 bp, Homo sapiens
ccattgtccaatcctatgt

SEQ ID NO: 2862787 - DNA, 17 bp, Homo sapiens
cccaaggaacaagagaa

SEQ ID NO: 2862788 - DNA, 19 bp, Homo sapiens
cccacaggacatttctcta

SEQ ID NO: 2862789 - DNA, 18 bp, Homo sapiens
cccaccaccttggactcc

SEQ ID NO: 2862790 - DNA, 14 bp, Homo sapiens
cccaccagtgcctt

SEQ ID NO: 2862791 - DNA, 18 bp, Homo sapiens
cccacccacagccataga

SEQ ID NO: 2862792 - DNA, 16 bp, Homo sapiens
cccacccctaagtgcc

SEQ ID NO: 2862793 - DNA, 18 bp, Homo sapiens
cccacccctaagtgccca

SEQ ID NO: 2862794 - DNA, 20 bp, Homo sapiens
cccacccctaagtgcccaaa

SEQ ID NO: 2862795 - DNA, 14 bp, Homo sapiens
cccaccctccactc

SEQ ID NO: 2862796 - DNA, 18 bp, Homo sapiens
cccaccttccccagactc

SEQ ID NO: 2862797 - DNA, 18 bp, Homo sapiens
cccactactgcagcacct

SEQ ID NO: 2862798 - DNA, 14 bp, Homo sapiens
cccagactcagctc

SEQ ID NO: 2862799 - DNA, 16 bp, Homo sapiens
cccagagcccctcctc

SEQ ID NO: 2862800 - DNA, 21 bp, Homo sapiens
cccagaggaaggggccagagg

SEQ ID NO: 2862801 - DNA, 16 bp, Homo sapiens
cccagaggattgctgc

SEQ ID NO: 2862802 - DNA, 22 bp, Homo sapiens
cccagcccatccattaggccag

SEQ ID NO: 2862803 - DNA, 14 bp, Homo sapiens
cccagccctcatcc

SEQ ID NO: 2862804 - DNA, 16 bp, Homo sapiens
cccagccctcatcccg

SEQ ID NO: 2862805 - DNA, 15 bp, Homo sapiens
cccagctaataaacc

SEQ ID NO: 2862806 - DNA, 15 bp, Homo sapiens
cccagctacttggga

SEQ ID NO: 2862807 - DNA, 12 bp, Homo sapiens
cccagctctgaa

SEQ ID NO: 2862808 - DNA, 22 bp, Homo sapiens
cccagctctgaaaccagtgtta

SEQ ID NO: 2862809 - DNA, 15 bp, Homo sapiens
cccagctcttctctt

SEQ ID NO: 2862810 - DNA, 21 bp, Homo sapiens
cccaggcattgccaagggctt

SEQ ID NO: 2862811 - DNA, 23 bp, Homo sapiens
cccatcagtgctccctcacatgt

SEQ ID NO: 2862812 - DNA, 14 bp, Homo sapiens
cccatcatgtggcc

SEQ ID NO: 2862813 - DNA, 19 bp, Homo sapiens
cccatcatgtggccccacc

SEQ ID NO: 2862814 - DNA, 17 bp, Homo sapiens
cccatcccctttcctcc

SEQ ID NO: 2862815 - DNA, 20 bp, Homo sapiens
cccatctggctttttctgcc

SEQ ID NO: 2862816 - DNA, 21 bp, Homo sapiens
cccatctggctttttctgcca

SEQ ID NO: 2862817 - DNA, 15 bp, Homo sapiens
cccatttctatttat

SEQ ID NO: 2862818 - DNA, 17 bp, Homo sapiens
gaccagtcaacctgggc

SEQ ID NO: 2862819 - DNA, 12 bp, Homo sapiens
gaccatctgtga

SEQ ID NO: 2862820 - DNA, 12 bp, Homo sapiens
gacccaccagtg

SEQ ID NO: 2862821 - DNA, 22 bp, Homo sapiens
gacccagccccttgagaaacct

SEQ ID NO: 2862822 - DNA, 20 bp, Homo sapiens
gaccccaatatatgtatttt

SEQ ID NO: 2862823 - DNA, 17 bp, Homo sapiens
gaccccttcctttcctc

SEQ ID NO: 2862824 - DNA, 15 bp, Homo sapiens
gacctggctctcaga

SEQ ID NO: 2862825 - DNA, 18 bp, Homo sapiens
gacctggctctcagagga

SEQ ID NO: 2862826 - DNA, 22 bp, Homo sapiens
gaccttaatttaactttccagt

SEQ ID NO: 2862827 - DNA, 12 bp, Homo sapiens
gacgcctggggg

SEQ ID NO: 2862828 - DNA, 21 bp, Homo sapiens
gactacctactggtgtaatct

SEQ ID NO: 2862829 - DNA, 22 bp, Homo sapiens
gactaggttctgtagagccaat

SEQ ID NO: 2862830 - DNA, 17 bp, Homo sapiens
gactcagggctcctggg

SEQ ID NO: 2862831 - DNA, 13 bp, Homo sapiens
gactcattctgaa

SEQ ID NO: 2862832 - DNA, 10 bp, Homo sapiens
gactccaggc

SEQ ID NO: 2862833 - DNA, 11 bp, Homo sapiens
gactccaggcc

SEQ ID NO: 2862834 - DNA, 13 bp, Homo sapiens
gactccaggcctg

SEQ ID NO: 2862835 - DNA, 15 bp, Homo sapiens
gactccaggcctgac

SEQ ID NO: 2862836 - DNA, 19 bp, Homo sapiens
gactccaggcctgaccagg

SEQ ID NO: 2862837 - DNA, 13 bp, Homo sapiens
gactcctcccaca

SEQ ID NO: 2862838 - DNA, 16 bp, Homo sapiens
gactctcagtctctga

SEQ ID NO: 2862839 - DNA, 13 bp, Homo sapiens
gactctggccctg

SEQ ID NO: 2862840 - DNA, 18 bp, Homo sapiens
gactctggccctggccct

SEQ ID NO: 2862841 - DNA, 14 bp, Homo sapiens
gactgaccaaagac

SEQ ID NO: 2862842 - DNA, 18 bp, Homo sapiens
gactgaccaaagactgca

SEQ ID NO: 2862843 - DNA, 19 bp, Homo sapiens
gactgaccaaagactgcag

SEQ ID NO: 2862844 - DNA, 13 bp, Homo sapiens
gactgagccagat

SEQ ID NO: 2862845 - DNA, 16 bp, Homo sapiens
gactggaggcccctgg

SEQ ID NO: 2862846 - DNA, 17 bp, Homo sapiens
gactggaggcctcgccc

SEQ ID NO: 2862847 - DNA, 22 bp, Homo sapiens
gactggtgttatcaccgtgggc

SEQ ID NO: 2862848 - DNA, 18 bp, Homo sapiens
gacttggagaatactgcc

SEQ ID NO: 2862849 - DNA, 21 bp, Homo sapiens
gagaagggggattggagggaa

SEQ ID NO: 2862850 - DNA, 22 bp, Homo sapiens
gagaagtgatatggtgaaggga

SEQ ID NO: 2862851 - DNA, 13 bp, Homo sapiens
gagacagaaagcc

SEQ ID NO: 2862852 - DNA, 19 bp, Homo sapiens
gagacccctcccctcccac

SEQ ID NO: 2862853 - DNA, 14 bp, Homo sapiens
gagaccccttcctt

SEQ ID NO: 2862854 - DNA, 14 bp, Homo sapiens
gagactgggctgag

SEQ ID NO: 2862855 - DNA, 16 bp, Homo sapiens
gagagacccctcccct

SEQ ID NO: 2862856 - DNA, 16 bp, Homo sapiens
gagagccaccaagagg

SEQ ID NO: 2862857 - DNA, 17 bp, Homo sapiens
gagagccagctctctct

SEQ ID NO: 2862858 - DNA, 20 bp, Homo sapiens
gagagggactcaagggaaag

SEQ ID NO: 2862859 - DNA, 21 bp, Homo sapiens
gagagtcctttgggattctag

SEQ ID NO: 2862860 - DNA, 22 bp, Homo sapiens
gagagtcctttgggattctagg

SEQ ID NO: 2862861 - DNA, 15 bp, Homo sapiens
gagataccagcgagg

SEQ ID NO: 2862862 - DNA, 12 bp, Homo sapiens
gagattgaactt

SEQ ID NO: 2862863 - DNA, 15 bp, Homo sapiens
gagcaattccaggct

SEQ ID NO: 2862864 - DNA, 20 bp, Homo sapiens
gagcaattccaggctgagcc

SEQ ID NO: 2862865 - DNA, 14 bp, Homo sapiens
gagccaacctggac

SEQ ID NO: 2862866 - DNA, 18 bp, Homo sapiens
gagccaacctggacttcc

SEQ ID NO: 2862867 - DNA, 23 bp, Homo sapiens
gagccaacctggacttcctgtca

SEQ ID NO: 2862868 - DNA, 11 bp, Homo sapiens
gagccaggagt

SEQ ID NO: 2862869 - DNA, 14 bp, Homo sapiens
gagcccagctctga

SEQ ID NO: 2862870 - DNA, 17 bp, Homo sapiens
gagccccattcctggga

SEQ ID NO: 2862871 - DNA, 22 bp, Homo sapiens
gagcccctcctccagcccctgt

SEQ ID NO: 2862872 - DNA, 18 bp, Homo sapiens
gagccgaggggagagagg

SEQ ID NO: 2862873 - DNA, 17 bp, Homo sapiens
gagccgggtctgcctct

SEQ ID NO: 2862874 - DNA, 20 bp, Homo sapiens
gagccgggtctgcctcttct

SEQ ID NO: 2862875 - DNA, 20 bp, Homo sapiens
gagcctacctgtatgtcaat

SEQ ID NO: 2862876 - DNA, 10 bp, Homo sapiens
gagcctgagg

SEQ ID NO: 2862877 - DNA, 16 bp, Homo sapiens
gagcctgtcaccagag

SEQ ID NO: 2862878 - DNA, 19 bp, Homo sapiens
gagcctgtcaccagagctt

SEQ ID NO: 2862879 - DNA, 17 bp, Homo sapiens
gagcttccctgactcat

SEQ ID NO: 2862880 - DNA, 15 bp, Homo sapiens
gagcttctctgggct

SEQ ID NO: 2862881 - DNA, 21 bp, Homo sapiens
gaggaaaaatgggagccagga

SEQ ID NO: 2862882 - DNA, 23 bp, Homo sapiens
gaggaaaaatgggagccaggagt

SEQ ID NO: 2862883 - DNA, 22 bp, Homo sapiens
gaggaggacttggttgatgttt

SEQ ID NO: 2862884 - DNA, 13 bp, Homo sapiens
gaggcaagagaat

SEQ ID NO: 2862885 - DNA, 13 bp, Homo sapiens
gaggcagcagtgt

SEQ ID NO: 2862886 - DNA, 21 bp, Homo sapiens
gaggcagcagtgtgaggccag

SEQ ID NO: 2862887 - DNA, 13 bp, Homo sapiens
gaggccagggcag

SEQ ID NO: 2862888 - DNA, 14 bp, Homo sapiens
gaggctgagaaagc

SEQ ID NO: 2862889 - DNA, 14 bp, Homo sapiens
gagggaaaccagag

SEQ ID NO: 2862890 - DNA, 15 bp, Homo sapiens
gagggacaagggatt

SEQ ID NO: 2862891 - DNA, 24 bp, Homo sapiens
gagggacataagataaaatgatgt

SEQ ID NO: 2862892 - DNA, 14 bp, Homo sapiens
gagggacgcctggg

SEQ ID NO: 2862893 - DNA, 15 bp, Homo sapiens
gagggcagcagggct

SEQ ID NO: 2862894 - DNA, 17 bp, Homo sapiens
gaggtccagctgggcct

SEQ ID NO: 2862895 - DNA, 22 bp, Homo sapiens
gagtgagacccagccctcatcc

SEQ ID NO: 2862896 - DNA, 14 bp, Homo sapiens
gagtgcagtcctga

SEQ ID NO: 2862897 - DNA, 22 bp, Homo sapiens
gagtgcagtcctgatcagagcc

SEQ ID NO: 2862898 - DNA, 15 bp, Homo sapiens
gagtgtctttccacg

SEQ ID NO: 2862899 - DNA, 21 bp, Homo sapiens
gagtgtctttccacggagcca

SEQ ID NO: 2862900 - DNA, 21 bp, Homo sapiens
gagtttgacagtttttgacat

SEQ ID NO: 2862901 - DNA, 20 bp, Homo sapiens
gagtttgtgttgttgttgct

SEQ ID NO: 2862902 - DNA, 23 bp, Homo sapiens
gagtttgtgttgttgttgctgct

SEQ ID NO: 2862903 - DNA, 18 bp, Homo sapiens
gagttttgtttcactttg

SEQ ID NO: 2862904 - DNA, 21 bp, Homo sapiens
gagtttttaaagccttctgga

SEQ ID NO: 2862905 - DNA, 15 bp, Homo sapiens
gataacttctttagg

SEQ ID NO: 2862906 - DNA, 16 bp, Homo sapiens
gataccatatgaatga

SEQ ID NO: 2862907 - DNA, 11 bp, Homo sapiens
gatagaaagct

SEQ ID NO: 2862908 - DNA, 18 bp, Homo sapiens
gatagaaagctggactga

SEQ ID NO: 2862909 - DNA, 20 bp, Homo sapiens
gatattttgaaatgaacttt

SEQ ID NO: 2862910 - DNA, 16 bp, Homo sapiens
gatcaacgcctcactg

SEQ ID NO: 2862911 - DNA, 13 bp, Homo sapiens
gatcacaaaaaca

SEQ ID NO: 2862912 - DNA, 16 bp, Homo sapiens
gatcagcaaaaagact

SEQ ID NO: 2862913 - DNA, 20 bp, Homo sapiens
gatccatttggacaaaatgg

SEQ ID NO: 2862914 - DNA, 21 bp, Homo sapiens
gatccatttggacaaaatgga

SEQ ID NO: 2862915 - DNA, 14 bp, Homo sapiens
gatccctcatctgt

SEQ ID NO: 2862916 - DNA, 20 bp, Homo sapiens
gatcctcagttctcaaatgt

SEQ ID NO: 2862917 - DNA, 15 bp, Homo sapiens
gatcctgggtttcca

SEQ ID NO: 2862918 - DNA, 18 bp, Homo sapiens
gatcgtctgactggtgtt

SEQ ID NO: 2862919 - DNA, 17 bp, Homo sapiens
gatctggggctctggga

SEQ ID NO: 2862920 - DNA, 21 bp, Homo sapiens
gatctttatatttcaataaat

SEQ ID NO: 2862921 - DNA, 16 bp, Homo sapiens
gatgaagaagggggtg

SEQ ID NO: 2862922 - DNA, 21 bp, Homo sapiens
gatgagacagacattcacctg

SEQ ID NO: 2862923 - DNA, 16 bp, Homo sapiens
gatgatgctttggaag

SEQ ID NO: 2862924 - DNA, 22 bp, Homo sapiens
gatgccacccagcaacacagag

SEQ ID NO: 2862925 - DNA, 13 bp, Homo sapiens
gatgctccttggg

SEQ ID NO: 2862926 - DNA, 21 bp, Homo sapiens
gatggaagttgcagtgagctg

SEQ ID NO: 2862927 - DNA, 12 bp, Homo sapiens
gatggctgctgc

SEQ ID NO: 2862928 - DNA, 23 bp, Homo sapiens
gatgtcagctgctgttgaacttt

SEQ ID NO: 2862929 - DNA, 18 bp, Homo sapiens
gatgtccttaaaatgtgg

SEQ ID NO: 2862930 - DNA, 20 bp, Homo sapiens
cactgtgcacatctgtgtct

SEQ ID NO: 2862931 - DNA, 19 bp, Homo sapiens
cactgttccccctgtgcag

SEQ ID NO: 2862932 - DNA, 15 bp, Homo sapiens
aacatgtaggaagta

SEQ ID NO: 2862933 - DNA, 17 bp, Homo sapiens
aacatgtttctctataa

SEQ ID NO: 2862934 - DNA, 13 bp, Homo sapiens
aacattttaagtt

SEQ ID NO: 2862935 - DNA, 19 bp, Homo sapiens
aacattttatcattaaaaa

SEQ ID NO: 2862936 - DNA, 16 bp, Homo sapiens
aaccagctcagtgttt

SEQ ID NO: 2862937 - DNA, 12 bp, Homo sapiens
aaccatttttga

SEQ ID NO: 2862938 - DNA, 13 bp, Homo sapiens
aacccatatttta

SEQ ID NO: 2862939 - DNA, 19 bp, Homo sapiens
aacccatattttaaattct

SEQ ID NO: 2862940 - DNA, 21 bp, Homo sapiens
aaccctaaggaagttgctaac

SEQ ID NO: 2862941 - DNA, 16 bp, Homo sapiens
aacctcatcttcttca

SEQ ID NO: 2862942 - DNA, 14 bp, Homo sapiens
aacctcgctggact

SEQ ID NO: 2862943 - DNA, 19 bp, Homo sapiens
aacctcgctggactctcag

SEQ ID NO: 2862944 - DNA, 12 bp, Homo sapiens
aacctggacttc

SEQ ID NO: 2862945 - DNA, 16 bp, Homo sapiens
aacctggacttcctgt

SEQ ID NO: 2862946 - DNA, 19 bp, Homo sapiens
aaccttattgtacctctct

SEQ ID NO: 2862947 - DNA, 18 bp, Homo sapiens
aactaatgtttgaacaaa

SEQ ID NO: 2862948 - DNA, 22 bp, Homo sapiens
aactagaatttattcaattcct

SEQ ID NO: 2862949 - DNA, 12 bp, Homo sapiens
aactcactctgg

SEQ ID NO: 2862950 - DNA, 15 bp, Homo sapiens
aactcagttttaact

SEQ ID NO: 2862951 - DNA, 17 bp, Homo sapiens
aactcatcctcttttaa

SEQ ID NO: 2862952 - DNA, 24 bp, Homo sapiens
aactcatcctcttttaatggcatt

SEQ ID NO: 2862953 - DNA, 13 bp, Homo sapiens
aactctttcaaaa

SEQ ID NO: 2862954 - DNA, 21 bp, Homo sapiens
aactgcatcccacgttctgtt

SEQ ID NO: 2862955 - DNA, 22 bp, Homo sapiens
aactgcatcccacgttctgtta

SEQ ID NO: 2862956 - DNA, 19 bp, Homo sapiens
aactgctgttaaaattaat

SEQ ID NO: 2862957 - DNA, 15 bp, Homo sapiens
aactgggtgactgga

SEQ ID NO: 2862958 - DNA, 17 bp, Homo sapiens
aactgttgcacttttga

SEQ ID NO: 2862959 - DNA, 18 bp, Homo sapiens
aactgttgcacttttgaa

SEQ ID NO: 2862960 - DNA, 14 bp, Homo sapiens
aactttccagtctt

SEQ ID NO: 2862961 - DNA, 20 bp, Homo sapiens
aactttccagtcttagctga

SEQ ID NO: 2862962 - DNA, 16 bp, Homo sapiens
aactttggaacagggt

SEQ ID NO: 2862963 - DNA, 15 bp, Homo sapiens
aactttgtcagtgtt

SEQ ID NO: 2862964 - DNA, 19 bp, Homo sapiens
aagaaacaactctttgaga

SEQ ID NO: 2862965 - DNA, 11 bp, Homo sapiens
aagaaacagaa

SEQ ID NO: 2862966 - DNA, 14 bp, Homo sapiens
aagaaacagccagc

SEQ ID NO: 2862967 - DNA, 14 bp, Homo sapiens
aagaaagatactta

SEQ ID NO: 2862968 - DNA, 14 bp, Homo sapiens
aagaaattttagta

SEQ ID NO: 2862969 - DNA, 17 bp, Homo sapiens
aagaagggggtgggggg

SEQ ID NO: 2862970 - DNA, 15 bp, Homo sapiens
aagaagtgcatgaaa

SEQ ID NO: 2862971 - DNA, 22 bp, Homo sapiens
aagaatgaaaaatataatgttg

SEQ ID NO: 2862972 - DNA, 15 bp, Homo sapiens
aagaattcacacctt

SEQ ID NO: 2862973 - DNA, 19 bp, Homo sapiens
aagacaggtctagactttc

SEQ ID NO: 2862974 - DNA, 20 bp, Homo sapiens
aagactcgcggcaggttctc

SEQ ID NO: 2862975 - DNA, 20 bp, Homo sapiens
aagagctagaaaaataaaat

SEQ ID NO: 2862976 - DNA, 20 bp, Homo sapiens
aagagggacataagataaaa

SEQ ID NO: 2862977 - DNA, 23 bp, Homo sapiens
aagagggacataagataaaatga

SEQ ID NO: 2862978 - DNA, 16 bp, Homo sapiens
aagagggacgcctggg

SEQ ID NO: 2862979 - DNA, 15 bp, Homo sapiens
aagataaaatgatgt

SEQ ID NO: 2862980 - DNA, 20 bp, Homo sapiens
aagatacagaactctttcaa

SEQ ID NO: 2862981 - DNA, 15 bp, Homo sapiens
aagatattctttagt

SEQ ID NO: 2862982 - DNA, 12 bp, Homo sapiens
aagatgcagaag

SEQ ID NO: 2862983 - DNA, 16 bp, Homo sapiens
aagatgcagaagcaat

SEQ ID NO: 2862984 - DNA, 13 bp, Homo sapiens
aagattctttccc

SEQ ID NO: 2862985 - DNA, 19 bp, Homo sapiens
aagcaatatgcatttaaat

SEQ ID NO: 2862986 - DNA, 14 bp, Homo sapiens
aagcaatcttttat

SEQ ID NO: 2862987 - DNA, 21 bp, Homo sapiens
aagcagaccactgataaaacc

SEQ ID NO: 2862988 - DNA, 22 bp, Homo sapiens
aagcaggaaatgaaaatgtctt

SEQ ID NO: 2862989 - DNA, 16 bp, Homo sapiens
aagcattgcctggact

SEQ ID NO: 2862990 - DNA, 21 bp, Homo sapiens
aagcattgcctggactgacca

SEQ ID NO: 2862991 - DNA, 19 bp, Homo sapiens
aagcattttgaaacaaagt

SEQ ID NO: 2862992 - DNA, 23 bp, Homo sapiens
aagccagagtttttaaagccttc

SEQ ID NO: 2862993 - DNA, 17 bp, Homo sapiens
aagccagcgtcctcctc

SEQ ID NO: 2862994 - DNA, 13 bp, Homo sapiens
aagccctgctggg

SEQ ID NO: 2862995 - DNA, 14 bp, Homo sapiens
aagccgactctggc

SEQ ID NO: 2862996 - DNA, 21 bp, Homo sapiens
aagccgactctggccctggcc

SEQ ID NO: 2862997 - DNA, 18 bp, Homo sapiens
aagcctccgctgggcttc

SEQ ID NO: 2862998 - DNA, 19 bp, Homo sapiens
aagcctccgctgggcttca

SEQ ID NO: 2862999 - DNA, 12 bp, Homo sapiens
aagcctgacaac

SEQ ID NO: 2863000 - DNA, 13 bp, Homo sapiens
aagccttctggat

SEQ ID NO: 2863001 - DNA, 14 bp, Homo sapiens
aagccttctggatc

SEQ ID NO: 2863002 - DNA, 15 bp, Homo sapiens
aagctattgtctgta

SEQ ID NO: 2863003 - DNA, 22 bp, Homo sapiens
aagctcaaagtatgcaatgctt

SEQ ID NO: 2863004 - DNA, 11 bp, Homo sapiens
aagctggactg

SEQ ID NO: 2863005 - DNA, 12 bp, Homo sapiens
aagctggactga

SEQ ID NO: 2863006 - DNA, 14 bp, Homo sapiens
aagctggactgacc

SEQ ID NO: 2863007 - DNA, 15 bp, Homo sapiens
aagctgtatcactgc

SEQ ID NO: 2863008 - DNA, 17 bp, Homo sapiens
aagctgtatcactgcct

SEQ ID NO: 2863009 - DNA, 13 bp, Homo sapiens
aagctgtggccag

SEQ ID NO: 2863010 - DNA, 14 bp, Homo sapiens
aagctgttattctt

SEQ ID NO: 2863011 - DNA, 17 bp, Homo sapiens
aagctgttattcttgtt

SEQ ID NO: 2863012 - DNA, 15 bp, Homo sapiens
aagctgtttccatag

SEQ ID NO: 2863013 - DNA, 13 bp, Homo sapiens
aagcttgagcctc

SEQ ID NO: 2863014 - DNA, 18 bp, Homo sapiens
aagcttgagcctccccca

SEQ ID NO: 2863015 - DNA, 22 bp, Homo sapiens
aagctttcatgtaaactgtgca

SEQ ID NO: 2863016 - DNA, 21 bp, Homo sapiens
aaggaagtcaaagcaaggaaa

SEQ ID NO: 2863017 - DNA, 20 bp, Homo sapiens
aaggacaatgccttgggaga

SEQ ID NO: 2863018 - DNA, 22 bp, Homo sapiens
aaggacaatgccttgggagaga

SEQ ID NO: 2863019 - DNA, 18 bp, Homo sapiens
aaggcaagcacttgtggg

SEQ ID NO: 2863020 - DNA, 22 bp, Homo sapiens
aaggcagctaagatagaaagct

SEQ ID NO: 2863021 - DNA, 20 bp, Homo sapiens
aaggcatgtacaaaaattat

SEQ ID NO: 2863022 - DNA, 21 bp, Homo sapiens
aaggccaattcctatacgcag

SEQ ID NO: 2863023 - DNA, 17 bp, Homo sapiens
aaggcttctctctgtgg

SEQ ID NO: 2863024 - DNA, 16 bp, Homo sapiens
aaggcttggctggtgt

SEQ ID NO: 2863025 - DNA, 18 bp, Homo sapiens
aagggaaaggcaagcttg

SEQ ID NO: 2863026 - DNA, 14 bp, Homo sapiens
aagggaagtgggga

SEQ ID NO: 2863027 - DNA, 15 bp, Homo sapiens
aagggaagtggggag

SEQ ID NO: 2863028 - DNA, 11 bp, Homo sapiens
aagggattctg

SEQ ID NO: 2863029 - DNA, 14 bp, Homo sapiens
aagggattctggga

SEQ ID NO: 2863030 - DNA, 18 bp, Homo sapiens
aagggctttgttttgcac

SEQ ID NO: 2863031 - DNA, 14 bp, Homo sapiens
aaggtgaactttgt

SEQ ID NO: 2863032 - DNA, 23 bp, Homo sapiens
aaggttccgcttggagcagaggg

SEQ ID NO: 2863033 - DNA, 14 bp, Homo sapiens
aagtaaaacagtca

SEQ ID NO: 2863034 - DNA, 16 bp, Homo sapiens
aagtaaaagtagtgtt

SEQ ID NO: 2863035 - DNA, 12 bp, Homo sapiens
aagtaaagatgc

SEQ ID NO: 2863036 - DNA, 13 bp, Homo sapiens
aagtatttcaaat

SEQ ID NO: 2863037 - DNA, 17 bp, Homo sapiens
aagtattttcataagta

SEQ ID NO: 2863038 - DNA, 13 bp, Homo sapiens
aagtcagaatttt

SEQ ID NO: 2863039 - DNA, 19 bp, Homo sapiens
aagtcagaatttttaactg

SEQ ID NO: 2863040 - DNA, 15 bp, Homo sapiens
aagtcctaaaagttc

SEQ ID NO: 2863041 - DNA, 14 bp, Homo sapiens
aagtctctgtgtaa

SEQ ID NO: 2863042 - DNA, 13 bp, Homo sapiens
aagtgaaattaag

SEQ ID NO: 2863043 - DNA, 17 bp, Homo sapiens
aagtgaacccatatttt

SEQ ID NO: 2863044 - DNA, 20 bp, Homo sapiens
aagtgaacccatattttaaa

SEQ ID NO: 2863045 - DNA, 22 bp, Homo sapiens
aagtgagaagctgggcatgaac

SEQ ID NO: 2863046 - DNA, 17 bp, Homo sapiens
aagtgcatgaaaaacca

SEQ ID NO: 2863047 - DNA, 16 bp, Homo sapiens
aagtgcccaaagtggg

SEQ ID NO: 2863048 - DNA, 18 bp, Homo sapiens
aagtgcccaaagtgggga

SEQ ID NO: 2863049 - DNA, 16 bp, Homo sapiens
aagtgtaaaaaatgtc

SEQ ID NO: 2863050 - DNA, 18 bp, Homo sapiens
aagtgtgccaaatcagtt

SEQ ID NO: 2863051 - DNA, 15 bp, Homo sapiens
aagtttggttttgac

SEQ ID NO: 2863052 - DNA, 17 bp, Homo sapiens
aagttttactgataatt

SEQ ID NO: 2863053 - DNA, 22 bp, Homo sapiens
aataaaatatcataaagcattt

SEQ ID NO: 2863054 - DNA, 19 bp, Homo sapiens
aataaaatgtttcattatg

SEQ ID NO: 2863055 - DNA, 13 bp, Homo sapiens
aataaacagtcac

SEQ ID NO: 2863056 - DNA, 20 bp, Homo sapiens
aataaatgtatcttattcac

SEQ ID NO: 2863057 - DNA, 15 bp, Homo sapiens
aataaattatattaa

SEQ ID NO: 2863058 - DNA, 21 bp, Homo sapiens
aataaatttggttctaataga

SEQ ID NO: 2863059 - DNA, 12 bp, Homo sapiens
aataacatgttt

SEQ ID NO: 2863060 - DNA, 13 bp, Homo sapiens
aataactgtgtgg

SEQ ID NO: 2863061 - DNA, 19 bp, Homo sapiens
aataataagtgatgtgctg

SEQ ID NO: 2863062 - DNA, 15 bp, Homo sapiens
aataatgtaacatga

SEQ ID NO: 2863063 - DNA, 21 bp, Homo sapiens
aataattgaagtgttcccttt

SEQ ID NO: 2863064 - DNA, 20 bp, Homo sapiens
aatacaaaaattagccgggc

SEQ ID NO: 2863065 - DNA, 17 bp, Homo sapiens
aatacatgacatttatt

SEQ ID NO: 2863066 - DNA, 23 bp, Homo sapiens
aatacatgacatttatttttcat

SEQ ID NO: 2863067 - DNA, 15 bp, Homo sapiens
aatactactactgtt

SEQ ID NO: 2863068 - DNA, 17 bp, Homo sapiens
aatactactactgttat

SEQ ID NO: 2863069 - DNA, 23 bp, Homo sapiens
aatactcttaggaagagaaacca

SEQ ID NO: 2863070 - DNA, 13 bp, Homo sapiens
aatagaacttgtt

SEQ ID NO: 2863071 - DNA, 14 bp, Homo sapiens
aatagctttagtga

SEQ ID NO: 2863072 - DNA, 13 bp, Homo sapiens
aataggccacaga

SEQ ID NO: 2863073 - DNA, 15 bp, Homo sapiens
aatatacattttcta

SEQ ID NO: 2863074 - DNA, 16 bp, Homo sapiens
aatatacattttctaa

SEQ ID NO: 2863075 - DNA, 23 bp, Homo sapiens
aatatatattaagtgtgccaaat

SEQ ID NO: 2863076 - DNA, 21 bp, Homo sapiens
aatatattttttgttattatt

SEQ ID NO: 2863077 - DNA, 15 bp, Homo sapiens
aatatcaaataaaat

SEQ ID NO: 2863078 - DNA, 16 bp, Homo sapiens
aatatcaaataaaata

SEQ ID NO: 2863079 - DNA, 17 bp, Homo sapiens
aatatcaaataaaatat

SEQ ID NO: 2863080 - DNA, 22 bp, Homo sapiens
aatatgtaatttcaaaatacat

SEQ ID NO: 2863081 - DNA, 17 bp, Homo sapiens
aatatgtatatatgtat

SEQ ID NO: 2863082 - DNA, 17 bp, Homo sapiens
aatatgtctgccacaga

SEQ ID NO: 2863083 - DNA, 17 bp, Homo sapiens
aatattccctagaaact

SEQ ID NO: 2863084 - DNA, 19 bp, Homo sapiens
aatatttactaactaaata

SEQ ID NO: 2863085 - DNA, 12 bp, Homo sapiens
aatatttattac

SEQ ID NO: 2863086 - DNA, 14 bp, Homo sapiens
aatatttattacct

SEQ ID NO: 2863087 - DNA, 17 bp, Homo sapiens
aatatttattacctctg

SEQ ID NO: 2863088 - DNA, 17 bp, Homo sapiens
aatatttttgtatttct

SEQ ID NO: 2863089 - DNA, 20 bp, Homo sapiens
aatatttttgtatttctcta

SEQ ID NO: 2863090 - DNA, 19 bp, Homo sapiens
aatcatgagtacctcaaag

SEQ ID NO: 2863091 - DNA, 20 bp, Homo sapiens
aatcatttctatttctcctc

SEQ ID NO: 2863092 - DNA, 23 bp, Homo sapiens
aatccatcgtattaaaaaacaat

SEQ ID NO: 2863093 - DNA, 22 bp, Homo sapiens
aatcggatctggggctctggga

SEQ ID NO: 2863094 - DNA, 16 bp, Homo sapiens
aatctgtacaaaatgg

SEQ ID NO: 2863095 - DNA, 17 bp, Homo sapiens
aatctgtacaaaatggt

SEQ ID NO: 2863096 - DNA, 22 bp, Homo sapiens
aatcttgactacagtcaggaaa

SEQ ID NO: 2863097 - DNA, 16 bp, Homo sapiens
aatgaaaaatataatg

SEQ ID NO: 2863098 - DNA, 21 bp, Homo sapiens
aatgaaacatgggctgtgatt

SEQ ID NO: 2863099 - DNA, 11 bp, Homo sapiens
aatgaactttg

SEQ ID NO: 2863100 - DNA, 11 bp, Homo sapiens
aatgaagaaag

SEQ ID NO: 2863101 - DNA, 23 bp, Homo sapiens
aatgaagaaagtcaaaaaattat

SEQ ID NO: 2863102 - DNA, 14 bp, Homo sapiens
aatgaatgggatat

SEQ ID NO: 2863103 - DNA, 19 bp, Homo sapiens
aatgaccattcaattagtg

SEQ ID NO: 2863104 - DNA, 23 bp, Homo sapiens
aatgataagcaggaaggatggca

SEQ ID NO: 2863105 - DNA, 20 bp, Homo sapiens
aatgatcagcaaaaagactg

SEQ ID NO: 2863106 - DNA, 19 bp, Homo sapiens
aatgatgttatacatcaat

SEQ ID NO: 2863107 - DNA, 21 bp, Homo sapiens
aatgattcagtgttaaatgtg

SEQ ID NO: 2863108 - DNA, 15 bp, Homo sapiens
aatgccagagccaac

SEQ ID NO: 2863109 - DNA, 19 bp, Homo sapiens
aatgccagagccaacctgg

SEQ ID NO: 2863110 - DNA, 22 bp, Homo sapiens
aatgccagagccaacctggact

SEQ ID NO: 2863111 - DNA, 13 bp, Homo sapiens
aatgctgtttcta

SEQ ID NO: 2863112 - DNA, 14 bp, Homo sapiens
aatgctgtttctaa

SEQ ID NO: 2863113 - DNA, 12 bp, Homo sapiens
aatggaagaaaa

SEQ ID NO: 2863114 - DNA, 14 bp, Homo sapiens
aatggagtgggaga

SEQ ID NO: 2863115 - DNA, 15 bp, Homo sapiens
aatggagtgggagat

SEQ ID NO: 2863116 - DNA, 21 bp, Homo sapiens
aatggagtgggagatcagcca

SEQ ID NO: 2863117 - DNA, 13 bp, Homo sapiens
aatgtaacatgat

SEQ ID NO: 2863118 - DNA, 13 bp, Homo sapiens
aatgtacgtcatt

SEQ ID NO: 2863119 - DNA, 13 bp, Homo sapiens
aatgtatatgcac

SEQ ID NO: 2863120 - DNA, 15 bp, Homo sapiens
aatgtatgtcagtgc

SEQ ID NO: 2863121 - DNA, 12 bp, Homo sapiens
aatgtgatgaat

SEQ ID NO: 2863122 - DNA, 22 bp, Homo sapiens
aatgtggtctgccaatctgtac

SEQ ID NO: 2863123 - DNA, 16 bp, Homo sapiens
aatgtgtgagaaaaac

SEQ ID NO: 2863124 - DNA, 20 bp, Homo sapiens
aattaaaaacgaaaacctga

SEQ ID NO: 2863125 - DNA, 13 bp, Homo sapiens
aattaaaacaaat

SEQ ID NO: 2863126 - DNA, 14 bp, Homo sapiens
aattaaaacaaata

SEQ ID NO: 2863127 - DNA, 16 bp, Homo sapiens
aattaaaacaaatata

SEQ ID NO: 2863128 - DNA, 23 bp, Homo sapiens
aattaagcattttgaaacaaagt

SEQ ID NO: 2863129 - DNA, 20 bp, Homo sapiens
aattacctttaattttaatg

SEQ ID NO: 2863130 - DNA, 17 bp, Homo sapiens
aattagacttgaaatac

SEQ ID NO: 2863131 - DNA, 17 bp, Homo sapiens
aattagtggtcataaaa

SEQ ID NO: 2863132 - DNA, 14 bp, Homo sapiens
aattatgtaaataa

SEQ ID NO: 2863133 - DNA, 14 bp, Homo sapiens
aattatgttactgt

SEQ ID NO: 2863134 - DNA, 22 bp, Homo sapiens
aattatgttactgtatttttca

SEQ ID NO: 2863135 - DNA, 23 bp, Homo sapiens
aattatgttactgtatttttcag

SEQ ID NO: 2863136 - DNA, 12 bp, Homo sapiens
aattatttgcta

SEQ ID NO: 2863137 - DNA, 20 bp, Homo sapiens
aattcaagagctagaaaaat

SEQ ID NO: 2863138 - DNA, 14 bp, Homo sapiens
aattcctctgggaa

SEQ ID NO: 2863139 - DNA, 15 bp, Homo sapiens
aattcggtgtgcacc

SEQ ID NO: 2863140 - DNA, 20 bp, Homo sapiens
aattcttggttgaggaaaca

SEQ ID NO: 2863141 - DNA, 15 bp, Homo sapiens
aattcttttctgagg

SEQ ID NO: 2863142 - DNA, 17 bp, Homo sapiens
aattgagttttcagtgg

SEQ ID NO: 2863143 - DNA, 16 bp, Homo sapiens
aattgtaactgttctt

SEQ ID NO: 2863144 - DNA, 17 bp, Homo sapiens
aatttatattttagaaa

SEQ ID NO: 2863145 - DNA, 18 bp, Homo sapiens
aatttatcttgtctctgg

SEQ ID NO: 2863146 - DNA, 19 bp, Homo sapiens
aatttatcttgtctctggg

SEQ ID NO: 2863147 - DNA, 20 bp, Homo sapiens
aatttatcttgtctctgggc

SEQ ID NO: 2863148 - DNA, 16 bp, Homo sapiens
aatttcaaaatacatt

SEQ ID NO: 2863149 - DNA, 23 bp, Homo sapiens
aatttcaaaatacatttgtaagt

SEQ ID NO: 2863150 - DNA, 16 bp, Homo sapiens
aatttctactttgaag

SEQ ID NO: 2863151 - DNA, 14 bp, Homo sapiens
aattttaatgctgt

SEQ ID NO: 2863152 - DNA, 18 bp, Homo sapiens
aattttagtagttactaa

SEQ ID NO: 2863153 - DNA, 12 bp, Homo sapiens
aatttttaactg

SEQ ID NO: 2863154 - DNA, 14 bp, Homo sapiens
acaaaaattaaaat

SEQ ID NO: 2863155 - DNA, 13 bp, Homo sapiens
acaaaatggaagg

SEQ ID NO: 2863156 - DNA, 21 bp, Homo sapiens
acaaaatgggcccttgcctct

SEQ ID NO: 2863157 - DNA, 23 bp, Homo sapiens
acaaaatggtcctatttttgtga

SEQ ID NO: 2863158 - DNA, 11 bp, Homo sapiens
acaaaggcaag

SEQ ID NO: 2863159 - DNA, 15 bp, Homo sapiens
acaaatgaagaaagt

SEQ ID NO: 2863160 - DNA, 15 bp, Homo sapiens
acaacagctgaagca

SEQ ID NO: 2863161 - DNA, 16 bp, Homo sapiens
acaacagctgaagcac

SEQ ID NO: 2863162 - DNA, 16 bp, Homo sapiens
acaactcattttcata

SEQ ID NO: 2863163 - DNA, 21 bp, Homo sapiens
acaaggaagtcaaagcaagga

SEQ ID NO: 2863164 - DNA, 18 bp, Homo sapiens
acaaggacaatgccttgg

SEQ ID NO: 2863165 - DNA, 19 bp, Homo sapiens
acaatcttggggctgatga

SEQ ID NO: 2863166 - DNA, 21 bp, Homo sapiens
acaattaactgccctctgaaa

SEQ ID NO: 2863167 - DNA, 14 bp, Homo sapiens
acaatttatactgc

SEQ ID NO: 2863168 - DNA, 20 bp, Homo sapiens
acacatgcatcatcagccta

SEQ ID NO: 2863169 - DNA, 21 bp, Homo sapiens
acacatggacacagacccaca

SEQ ID NO: 2863170 - DNA, 17 bp, Homo sapiens
acacctttgttttgcac

SEQ ID NO: 2863171 - DNA, 21 bp, Homo sapiens
acacctttgttttgcactgac

SEQ ID NO: 2863172 - DNA, 21 bp, Homo sapiens
acactatttgtgactttttaa

SEQ ID NO: 2863173 - DNA, 17 bp, Homo sapiens
acactcaataaacagtc

SEQ ID NO: 2863174 - DNA, 22 bp, Homo sapiens
acactccaccctccaccttcca

SEQ ID NO: 2863175 - DNA, 20 bp, Homo sapiens
acactgacttaggtttcagg

SEQ ID NO: 2863176 - DNA, 23 bp, Homo sapiens
acactgacttaggtttcaggaag

SEQ ID NO: 2863177 - DNA, 18 bp, Homo sapiens
acactgcggaagccaaag

SEQ ID NO: 2863178 - DNA, 20 bp, Homo sapiens
acactgcggaagccaaaggc

SEQ ID NO: 2863179 - DNA, 20 bp, Homo sapiens
acactgtccttccctgccac

SEQ ID NO: 2863180 - DNA, 21 bp, Homo sapiens
acactgtgcacatctgtgtct

SEQ ID NO: 2863181 - DNA, 18 bp, Homo sapiens
acagaactctttcaaaac

SEQ ID NO: 2863182 - DNA, 22 bp, Homo sapiens
acagaaggtgaactttgtgctt

SEQ ID NO: 2863183 - DNA, 19 bp, Homo sapiens
acagacctggctctcagag

SEQ ID NO: 2863184 - DNA, 20 bp, Homo sapiens
acagagaggagttgccaggg

SEQ ID NO: 2863185 - DNA, 16 bp, Homo sapiens
acagagcttccctgac

SEQ ID NO: 2863186 - DNA, 19 bp, Homo sapiens
acagccatagacctacaga

SEQ ID NO: 2863187 - DNA, 22 bp, Homo sapiens
acagccatagacctacagacct

SEQ ID NO: 2863188 - DNA, 10 bp, Homo sapiens
acagcccaga

SEQ ID NO: 2863189 - DNA, 15 bp, Homo sapiens
acagccttattttgt

SEQ ID NO: 2863190 - DNA, 18 bp, Homo sapiens
acagggacttgtttagag

SEQ ID NO: 2863191 - DNA, 22 bp, Homo sapiens
acagggacttgtttagagagcc

SEQ ID NO: 2863192 - DNA, 22 bp, Homo sapiens
acagggtgtggtatgagggggt

SEQ ID NO: 2863193 - DNA, 23 bp, Homo sapiens
acagggtgtggtatgagggggtg

SEQ ID NO: 2863194 - DNA, 13 bp, Homo sapiens
acagttgctgtga

SEQ ID NO: 2863195 - DNA, 17 bp, Homo sapiens
acataacttctcatgta

SEQ ID NO: 2863196 - DNA, 18 bp, Homo sapiens
acataacttctcatgtat

SEQ ID NO: 2863197 - DNA, 13 bp, Homo sapiens
acatagaccctct

SEQ ID NO: 2863198 - DNA, 17 bp, Homo sapiens
acatatttgtatgtttt

SEQ ID NO: 2863199 - DNA, 21 bp, Homo sapiens
acatatttgtatgtttttctg

SEQ ID NO: 2863200 - DNA, 13 bp, Homo sapiens
acatcaatatgta

SEQ ID NO: 2863201 - DNA, 14 bp, Homo sapiens
acatcaatatgtat

SEQ ID NO: 2863202 - DNA, 14 bp, Homo sapiens
acatcagcctcctt

SEQ ID NO: 2863203 - DNA, 15 bp, Homo sapiens
acatccaagccagag

SEQ ID NO: 2863204 - DNA, 16 bp, Homo sapiens
acatccaagccagagt

SEQ ID NO: 2863205 - DNA, 19 bp, Homo sapiens
acatctatccacactgtca

SEQ ID NO: 2863206 - DNA, 16 bp, Homo sapiens
acatctgtgtcttgtt

SEQ ID NO: 2863207 - DNA, 18 bp, Homo sapiens
acatgaagacaccatctc

SEQ ID NO: 2863208 - DNA, 19 bp, Homo sapiens
acatgaccctaaatcttga

SEQ ID NO: 2863209 - DNA, 19 bp, Homo sapiens
acatggtgggtccatgggc

SEQ ID NO: 2863210 - DNA, 18 bp, Homo sapiens
acatgtcagtaccttcaa

SEQ ID NO: 2863211 - DNA, 21 bp, Homo sapiens
acatgtcagtaccttcaaact

SEQ ID NO: 2863212 - DNA, 20 bp, Homo sapiens
acatgtgttaagtattttca

SEQ ID NO: 2863213 - DNA, 23 bp, Homo sapiens
acatgttcccaaaacaatggtgt

SEQ ID NO: 2863214 - DNA, 11 bp, Homo sapiens
acatgtttctc

SEQ ID NO: 2863215 - DNA, 22 bp, Homo sapiens
acatgtttctctataaagtatg

SEQ ID NO: 2863216 - DNA, 11 bp, Homo sapiens
acattaactgt

SEQ ID NO: 2863217 - DNA, 13 bp, Homo sapiens
acattaactgttg

SEQ ID NO: 2863218 - DNA, 22 bp, Homo sapiens
acattcacctgtatatttcttt

SEQ ID NO: 2863219 - DNA, 21 bp, Homo sapiens
acattcttcagtttttcactt

SEQ ID NO: 2863220 - DNA, 20 bp, Homo sapiens
acatttatgacaagctgtat

SEQ ID NO: 2863221 - DNA, 22 bp, Homo sapiens
acatttatgacaagctgtatca

SEQ ID NO: 2863222 - DNA, 18 bp, Homo sapiens
acattttatcattaaaaa

SEQ ID NO: 2863223 - DNA, 22 bp, Homo sapiens
acattttatcattaaaaattac

SEQ ID NO: 2863224 - DNA, 13 bp, Homo sapiens
accaaagactgca

SEQ ID NO: 2863225 - DNA, 13 bp, Homo sapiens
accaaccaggcct

SEQ ID NO: 2863226 - DNA, 14 bp, Homo sapiens
accaatgaaaaaat

SEQ ID NO: 2863227 - DNA, 17 bp, Homo sapiens
accaatgaaaaaatgta

SEQ ID NO: 2863228 - DNA, 12 bp, Homo sapiens
accaatgtcttg

SEQ ID NO: 2863229 - DNA, 18 bp, Homo sapiens
accacaccaaccaggcct

SEQ ID NO: 2863230 - DNA, 18 bp, Homo sapiens
accactcttttgctgtgc

SEQ ID NO: 2863231 - DNA, 15 bp, Homo sapiens
accagagcagagagc

SEQ ID NO: 2863232 - DNA, 19 bp, Homo sapiens
accagagcttctctgggct

SEQ ID NO: 2863233 - DNA, 14 bp, Homo sapiens
accagttaagaatg

SEQ ID NO: 2863234 - DNA, 15 bp, Homo sapiens
accatatgaatgaaa

SEQ ID NO: 2863235 - DNA, 23 bp, Homo sapiens
acccacacatgtttacagaactg

SEQ ID NO: 2863236 - DNA, 11 bp, Homo sapiens
acccaccagtg

SEQ ID NO: 2863237 - DNA, 13 bp, Homo sapiens
acccaccagtgcc

SEQ ID NO: 2863238 - DNA, 16 bp, Homo sapiens
acccagccccttgaga

SEQ ID NO: 2863239 - DNA, 17 bp, Homo sapiens
acccagccccttgagaa

SEQ ID NO: 2863240 - DNA, 20 bp, Homo sapiens
acccagccccttgagaaacc

SEQ ID NO: 2863241 - DNA, 16 bp, Homo sapiens
acccagccctcatccc

SEQ ID NO: 2863242 - DNA, 23 bp, Homo sapiens
acccaggagatggaagttgcagt

SEQ ID NO: 2863243 - DNA, 15 bp, Homo sapiens
acccatcaacaaaaa

SEQ ID NO: 2863244 - DNA, 13 bp, Homo sapiens
acccatgatactc

SEQ ID NO: 2863245 - DNA, 16 bp, Homo sapiens
acccattaggcatgcc

SEQ ID NO: 2863246 - DNA, 16 bp, Homo sapiens
accccaaagagaaaga

SEQ ID NO: 2863247 - DNA, 16 bp, Homo sapiens
accccaatatatgtat

SEQ ID NO: 2863248 - DNA, 14 bp, Homo sapiens
acccccaggtggcc

SEQ ID NO: 2863249 - DNA, 18 bp, Homo sapiens
acccccaggtggcctgcg

SEQ ID NO: 2863250 - DNA, 16 bp, Homo sapiens
accccctcattcccct

SEQ ID NO: 2863251 - DNA, 17 bp, Homo sapiens
accccttcctttcctct

SEQ ID NO: 2863252 - DNA, 22 bp, Homo sapiens
accccttcctttcctctgcagc

SEQ ID NO: 2863253 - DNA, 22 bp, Homo sapiens
acccggcccagagaccccttcc

SEQ ID NO: 2863254 - DNA, 16 bp, Homo sapiens
accctaaatcttgact

SEQ ID NO: 2863255 - DNA, 12 bp, Homo sapiens
accctccacctt

SEQ ID NO: 2863256 - DNA, 13 bp, Homo sapiens
accctctcttccc

SEQ ID NO: 2863257 - DNA, 14 bp, Homo sapiens
accctctcttccct

SEQ ID NO: 2863258 - DNA, 20 bp, Homo sapiens
accctctttcttgtttgtca

SEQ ID NO: 2863259 - DNA, 23 bp, Homo sapiens
accctgagctgaggcagcagtgt

SEQ ID NO: 2863260 - DNA, 19 bp, Homo sapiens
acccttacagtaggagccc

SEQ ID NO: 2863261 - DNA, 12 bp, Homo sapiens
acccttttccag

SEQ ID NO: 2863262 - DNA, 18 bp, Homo sapiens
accgtttgtccacttcat

SEQ ID NO: 2863263 - DNA, 15 bp, Homo sapiens
acctacagacctggc

SEQ ID NO: 2863264 - DNA, 20 bp, Homo sapiens
acctacatatgctgatcttt

SEQ ID NO: 2863265 - DNA, 23 bp, Homo sapiens
acctacatatgctgatcttttaa

SEQ ID NO: 2863266 - DNA, 19 bp, Homo sapiens
acctcaacccccatttcta

SEQ ID NO: 2863267 - DNA, 14 bp, Homo sapiens
acctccacatcctc

SEQ ID NO: 2863268 - DNA, 14 bp, Homo sapiens
acctccaggcctgt

SEQ ID NO: 2863269 - DNA, 13 bp, Homo sapiens
acctcctgagaaa

SEQ ID NO: 2863270 - DNA, 16 bp, Homo sapiens
acctcgctggactctc

SEQ ID NO: 2863271 - DNA, 22 bp, Homo sapiens
acctctcttatagaatatttat

SEQ ID NO: 2863272 - DNA, 11 bp, Homo sapiens
acctgaaaaca

SEQ ID NO: 2863273 - DNA, 18 bp, Homo sapiens
acctgaaaacactgtgca

SEQ ID NO: 2863274 - DNA, 19 bp, Homo sapiens
acctgaaaacactgtgcac

SEQ ID NO: 2863275 - DNA, 20 bp, Homo sapiens
acctgaaaacactgtgcaca

SEQ ID NO: 2863276 - DNA, 20 bp, Homo sapiens
acctgactaggttctgtaga

SEQ ID NO: 2863277 - DNA, 16 bp, Homo sapiens
acctgcccccaatcca

SEQ ID NO: 2863278 - DNA, 15 bp, Homo sapiens
acctggctctcagag

SEQ ID NO: 2863279 - DNA, 15 bp, Homo sapiens
acctgtaatcccagc

SEQ ID NO: 2863280 - DNA, 17 bp, Homo sapiens
acctgtatatttctttt

SEQ ID NO: 2863281 - DNA, 22 bp, Homo sapiens
acctgtccccaccctccactca

SEQ ID NO: 2863282 - DNA, 19 bp, Homo sapiens
acctgtgcttcgggccctt

SEQ ID NO: 2863283 - DNA, 16 bp, Homo sapiens
acctgtttttaagctg

SEQ ID NO: 2863284 - DNA, 16 bp, Homo sapiens
accttaaaaggtactg

SEQ ID NO: 2863285 - DNA, 20 bp, Homo sapiens
accttattgtacctctctta

SEQ ID NO: 2863286 - DNA, 19 bp, Homo sapiens
accttcaaactagggccaa

SEQ ID NO: 2863287 - DNA, 21 bp, Homo sapiens
accttcttcgctgctagagaa

SEQ ID NO: 2863288 - DNA, 15 bp, Homo sapiens
acgcacacatggaca

SEQ ID NO: 2863289 - DNA, 14 bp, Homo sapiens
acgccctccctctc

SEQ ID NO: 2863290 - DNA, 18 bp, Homo sapiens
acgcctcactgaaacatg

SEQ ID NO: 2863291 - DNA, 18 bp, Homo sapiens
acggagccactcctctga

SEQ ID NO: 2863292 - DNA, 21 bp, Homo sapiens
acggagcctggagggatgcca

SEQ ID NO: 2863293 - DNA, 19 bp, Homo sapiens
acgtctggcctacagaatg

SEQ ID NO: 2863294 - DNA, 22 bp, Homo sapiens
acgtgtaaatgaagatctttat

SEQ ID NO: 2863295 - DNA, 19 bp, Homo sapiens
actaaaattatgttactgt

SEQ ID NO: 2863296 - DNA, 19 bp, Homo sapiens
actaatgtttgaacaaagc

SEQ ID NO: 2863297 - DNA, 15 bp, Homo sapiens
actacagtcaggaaa

SEQ ID NO: 2863298 - DNA, 14 bp, Homo sapiens
actacctactggtg

SEQ ID NO: 2863299 - DNA, 13 bp, Homo sapiens
actactactgtta

SEQ ID NO: 2863300 - DNA, 21 bp, Homo sapiens
actagagcctgtgctaaagaa

SEQ ID NO: 2863301 - DNA, 22 bp, Homo sapiens
actatcttctttggacttctga

SEQ ID NO: 2863302 - DNA, 16 bp, Homo sapiens
actatggtatttgagt

SEQ ID NO: 2863303 - DNA, 14 bp, Homo sapiens
actatttgtgactt

SEQ ID NO: 2863304 - DNA, 22 bp, Homo sapiens
actcaagggaaaggcaagcttg

SEQ ID NO: 2863305 - DNA, 13 bp, Homo sapiens
actcaataaaaga

SEQ ID NO: 2863306 - DNA, 14 bp, Homo sapiens
actcaataaacagt

SEQ ID NO: 2863307 - DNA, 18 bp, Homo sapiens
actcaatccatccatgta

SEQ ID NO: 2863308 - DNA, 14 bp, Homo sapiens
actcagctgtcctg

SEQ ID NO: 2863309 - DNA, 17 bp, Homo sapiens
actcagctgtcctgcag

SEQ ID NO: 2863310 - DNA, 15 bp, Homo sapiens
actcagttttaacta

SEQ ID NO: 2863311 - DNA, 23 bp, Homo sapiens
actcatcctcttttaatggcatt

SEQ ID NO: 2863312 - DNA, 19 bp, Homo sapiens
actcattttcatattgtaa

SEQ ID NO: 2863313 - DNA, 13 bp, Homo sapiens
actccactcccag

SEQ ID NO: 2863314 - DNA, 15 bp, Homo sapiens
actccactcccagca

SEQ ID NO: 2863315 - DNA, 19 bp, Homo sapiens
actccaggcctgaccaggg

SEQ ID NO: 2863316 - DNA, 20 bp, Homo sapiens
actccaggcctgaccagggg

SEQ ID NO: 2863317 - DNA, 18 bp, Homo sapiens
actccagttaaaaaaaat

SEQ ID NO: 2863318 - DNA, 15 bp, Homo sapiens
actccccagccccac

SEQ ID NO: 2863319 - DNA, 14 bp, Homo sapiens
actcccttgggctc

SEQ ID NO: 2863320 - DNA, 14 bp, Homo sapiens
actcctctgactca

SEQ ID NO: 2863321 - DNA, 20 bp, Homo sapiens
actcctctgactcagggctc

SEQ ID NO: 2863322 - DNA, 22 bp, Homo sapiens
actctcaggaccaaagctttca

SEQ ID NO: 2863323 - DNA, 14 bp, Homo sapiens
actctcccctccct

SEQ ID NO: 2863324 - DNA, 19 bp, Homo sapiens
actctcccctccctcttcc

SEQ ID NO: 2863325 - DNA, 21 bp, Homo sapiens
actctgctagactcctcagga

SEQ ID NO: 2863326 - DNA, 16 bp, Homo sapiens
actctggccctggccc

SEQ ID NO: 2863327 - DNA, 18 bp, Homo sapiens
actgaataatatcaaata

SEQ ID NO: 2863328 - DNA, 20 bp, Homo sapiens
actgaccaaagactgcagaa

SEQ ID NO: 2863329 - DNA, 16 bp, Homo sapiens
actgactttttccccc

SEQ ID NO: 2863330 - DNA, 17 bp, Homo sapiens
actgactttttcccccc

SEQ ID NO: 2863331 - DNA, 18 bp, Homo sapiens
actgagataccagcgagg

SEQ ID NO: 2863332 - DNA, 19 bp, Homo sapiens
actgaggagacagaaagcc

SEQ ID NO: 2863333 - DNA, 22 bp, Homo sapiens
actgaggagacagaaagcctcc

SEQ ID NO: 2863334 - DNA, 21 bp, Homo sapiens
actgagttttgtttcactttg

SEQ ID NO: 2863335 - DNA, 14 bp, Homo sapiens
actgcaatcactgt

SEQ ID NO: 2863336 - DNA, 20 bp, Homo sapiens
actgcagaacccccaggtgg

SEQ ID NO: 2863337 - DNA, 22 bp, Homo sapiens
actgcagcacctccaggcctgt

SEQ ID NO: 2863338 - DNA, 14 bp, Homo sapiens
actgccctctgaaa

SEQ ID NO: 2863339 - DNA, 22 bp, Homo sapiens
actgcctgcctcccctccgcag

SEQ ID NO: 2863340 - DNA, 14 bp, Homo sapiens
actgcggaagccaa

SEQ ID NO: 2863341 - DNA, 23 bp, Homo sapiens
actgctacaaatactcttaggaa

SEQ ID NO: 2863342 - DNA, 16 bp, Homo sapiens
actgcttaattgctga

SEQ ID NO: 2863343 - DNA, 18 bp, Homo sapiens
actggaggcccctggagc

SEQ ID NO: 2863344 - DNA, 13 bp, Homo sapiens
actgggctgaggg

SEQ ID NO: 2863345 - DNA, 20 bp, Homo sapiens
actgggtgactggaggcctc

SEQ ID NO: 2863346 - DNA, 19 bp, Homo sapiens
actggtgtaatctcaatgc

SEQ ID NO: 2863347 - DNA, 21 bp, Homo sapiens
actggtgttatcaccgtgggc

SEQ ID NO: 2863348 - DNA, 21 bp, Homo sapiens
actgtattttgtattgtttca

SEQ ID NO: 2863349 - DNA, 17 bp, Homo sapiens
actgtccttccctgcca

SEQ ID NO: 2863350 - DNA, 19 bp, Homo sapiens
actgtccttccctgccact

SEQ ID NO: 2863351 - DNA, 15 bp, Homo sapiens
actgtgcacatctgt

SEQ ID NO: 2863352 - DNA, 18 bp, Homo sapiens
actgtgcaccaagcagga

SEQ ID NO: 2863353 - DNA, 21 bp, Homo sapiens
actgttatcagtaatgctaaa

SEQ ID NO: 2863354 - DNA, 13 bp, Homo sapiens
actgttcttgaat

SEQ ID NO: 2863355 - DNA, 16 bp, Homo sapiens
actgttgcacttttga

SEQ ID NO: 2863356 - DNA, 15 bp, Homo sapiens
acttaaaaaactgca

SEQ ID NO: 2863357 - DNA, 21 bp, Homo sapiens
acttacatgttcccaaaacaa

SEQ ID NO: 2863358 - DNA, 18 bp, Homo sapiens
acttaggtttcaggaagt

SEQ ID NO: 2863359 - DNA, 16 bp, Homo sapiens
acttcagcattgtaat

SEQ ID NO: 2863360 - DNA, 14 bp, Homo sapiens
acttcattcttgaa

SEQ ID NO: 2863361 - DNA, 21 bp, Homo sapiens
acttcattcttgaaagctgtg

SEQ ID NO: 2863362 - DNA, 14 bp, Homo sapiens
acttcattttgtat

SEQ ID NO: 2863363 - DNA, 14 bp, Homo sapiens
acttctcatgtata

SEQ ID NO: 2863364 - DNA, 20 bp, Homo sapiens
acttgaaatacgtttgtgtt

SEQ ID NO: 2863365 - DNA, 16 bp, Homo sapiens
acttggagaatactgc

SEQ ID NO: 2863366 - DNA, 20 bp, Homo sapiens
acttggagaatactgccaaa

SEQ ID NO: 2863367 - DNA, 20 bp, Homo sapiens
acttgttaacctttctaacc

SEQ ID NO: 2863368 - DNA, 15 bp, Homo sapiens
actttaaccctctct

SEQ ID NO: 2863369 - DNA, 20 bp, Homo sapiens
actttaaccctctcttccct

SEQ ID NO: 2863370 - DNA, 18 bp, Homo sapiens
actttcctacaaaatgga

SEQ ID NO: 2863371 - DNA, 18 bp, Homo sapiens
actttctatttttatgat

SEQ ID NO: 2863372 - DNA, 20 bp, Homo sapiens
actttcttatccaacttttt

SEQ ID NO: 2863373 - DNA, 13 bp, Homo sapiens
acttttgaatgtc

SEQ ID NO: 2863374 - DNA, 12 bp, Homo sapiens
acttttgacaaa

SEQ ID NO: 2863375 - DNA, 18 bp, Homo sapiens
actttttaaagaagtgca

SEQ ID NO: 2863376 - DNA, 23 bp, Homo sapiens
agaaaaccactttattgcaatgc

SEQ ID NO: 2863377 - DNA, 18 bp, Homo sapiens
agaaacactatttgtgac

SEQ ID NO: 2863378 - DNA, 14 bp, Homo sapiens
agaaacttccaaat

SEQ ID NO: 2863379 - DNA, 19 bp, Homo sapiens
agaaacttccaaatcccct

SEQ ID NO: 2863380 - DNA, 15 bp, Homo sapiens
agaaagagtttgaaa

SEQ ID NO: 2863381 - DNA, 22 bp, Homo sapiens
agaaagcacaatttaaaacaat

SEQ ID NO: 2863382 - DNA, 20 bp, Homo sapiens
agaaagcctccgctgggctt

SEQ ID NO: 2863383 - DNA, 13 bp, Homo sapiens
agaaagctggact

SEQ ID NO: 2863384 - DNA, 19 bp, Homo sapiens
agaaagctggactgaccaa

SEQ ID NO: 2863385 - DNA, 20 bp, Homo sapiens
agaaagctggactgaccaaa

SEQ ID NO: 2863386 - DNA, 14 bp, Homo sapiens
agaaatatattttt

SEQ ID NO: 2863387 - DNA, 13 bp, Homo sapiens
agaaatgcatatt

SEQ ID NO: 2863388 - DNA, 22 bp, Homo sapiens
agaaatgcatatttgccacaaa

SEQ ID NO: 2863389 - DNA, 13 bp, Homo sapiens
agaaattttagta

SEQ ID NO: 2863390 - DNA, 11 bp, Homo sapiens
agaacaccttt

SEQ ID NO: 2863391 - DNA, 19 bp, Homo sapiens
agaacccccaggtggcctg

SEQ ID NO: 2863392 - DNA, 23 bp, Homo sapiens
agaacttggatgtacctgccccc

SEQ ID NO: 2863393 - DNA, 21 bp, Homo sapiens
agaacttgttaacctttctaa

SEQ ID NO: 2863394 - DNA, 20 bp, Homo sapiens
agaactttattaagtaaaat

SEQ ID NO: 2863395 - DNA, 20 bp, Homo sapiens
agaagatcaacgcctcactg

SEQ ID NO: 2863396 - DNA, 16 bp, Homo sapiens
agaagcattgcctgga

SEQ ID NO: 2863397 - DNA, 19 bp, Homo sapiens
agaagcattgcctggactg

SEQ ID NO: 2863398 - DNA, 21 bp, Homo sapiens
agaagcccaatattataattt

SEQ ID NO: 2863399 - DNA, 19 bp, Homo sapiens
agaagccctgctgggccca

SEQ ID NO: 2863400 - DNA, 22 bp, Homo sapiens
agaaggaggaatgctggactgg

SEQ ID NO: 2863401 - DNA, 23 bp, Homo sapiens
agaagggggattggagggaagac

SEQ ID NO: 2863402 - DNA, 13 bp, Homo sapiens
agaagggggtggg

SEQ ID NO: 2863403 - DNA, 11 bp, Homo sapiens
agaagtgatat

SEQ ID NO: 2863404 - DNA, 21 bp, Homo sapiens
agaagtgatatggtgaaggga

SEQ ID NO: 2863405 - DNA, 22 bp, Homo sapiens
agaagtgatatggtgaagggaa

SEQ ID NO: 2863406 - DNA, 19 bp, Homo sapiens
agaagtgcatgaaaaacca

SEQ ID NO: 2863407 - DNA, 13 bp, Homo sapiens
agaatactgccaa

SEQ ID NO: 2863408 - DNA, 13 bp, Homo sapiens
agaatatttacta

SEQ ID NO: 2863409 - DNA, 15 bp, Homo sapiens
agaatcacagctcaa

SEQ ID NO: 2863410 - DNA, 12 bp, Homo sapiens
agaatccctgca

SEQ ID NO: 2863411 - DNA, 14 bp, Homo sapiens
agaatccctgcagc

SEQ ID NO: 2863412 - DNA, 13 bp, Homo sapiens
agaatttattcaa

SEQ ID NO: 2863413 - DNA, 14 bp, Homo sapiens
agaatttattcaat

SEQ ID NO: 2863414 - DNA, 17 bp, Homo sapiens
agaatttgagtgctctg

SEQ ID NO: 2863415 - DNA, 18 bp, Homo sapiens
agaatttgagtgctctga

SEQ ID NO: 2863416 - DNA, 15 bp, Homo sapiens
agaatttttaactgt

SEQ ID NO: 2863417 - DNA, 13 bp, Homo sapiens
agacagaaagcct

SEQ ID NO: 2863418 - DNA, 23 bp, Homo sapiens
agacagaaagcctccgctgggct

SEQ ID NO: 2863419 - DNA, 13 bp, Homo sapiens
agaccaggaaagg

SEQ ID NO: 2863420 - DNA, 13 bp, Homo sapiens
agaccccttcctt

SEQ ID NO: 2863421 - DNA, 18 bp, Homo sapiens
agaccccttcctttcctc

SEQ ID NO: 2863422 - DNA, 18 bp, Homo sapiens
agacctacagacctggct

SEQ ID NO: 2863423 - DNA, 20 bp, Homo sapiens
agacctggctctcagaggaa

SEQ ID NO: 2863424 - DNA, 15 bp, Homo sapiens
agactcagctccaga

SEQ ID NO: 2863425 - DNA, 17 bp, Homo sapiens
agactcagctccagaat

SEQ ID NO: 2863426 - DNA, 13 bp, Homo sapiens
agactcctcagga

SEQ ID NO: 2863427 - DNA, 21 bp, Homo sapiens
agactcgcggcaggttctctt

SEQ ID NO: 2863428 - DNA, 19 bp, Homo sapiens
agactgcagaacccccagg

SEQ ID NO: 2863429 - DNA, 22 bp, Homo sapiens
agactgcagaacccccaggtgg

SEQ ID NO: 2863430 - DNA, 15 bp, Homo sapiens
agactgggctgaggg

SEQ ID NO: 2863431 - DNA, 16 bp, Homo sapiens
agactgggctgaggga

SEQ ID NO: 2863432 - DNA, 14 bp, Homo sapiens
agactttctcagtg

SEQ ID NO: 2863433 - DNA, 15 bp, Homo sapiens
agagaaagcacaatt

SEQ ID NO: 2863434 - DNA, 19 bp, Homo sapiens
agagaccccttcctttcct

SEQ ID NO: 2863435 - DNA, 22 bp, Homo sapiens
agagagggactcaagggaaagg

SEQ ID NO: 2863436 - DNA, 21 bp, Homo sapiens
agagcaattccaggctgagcc

SEQ ID NO: 2863437 - DNA, 14 bp, Homo sapiens
agagcagagagcag

SEQ ID NO: 2863438 - DNA, 16 bp, Homo sapiens
agagccaacctggact

SEQ ID NO: 2863439 - DNA, 19 bp, Homo sapiens
agagccaacctggacttcc

SEQ ID NO: 2863440 - DNA, 18 bp, Homo sapiens
agagccgaggggagagag

SEQ ID NO: 2863441 - DNA, 19 bp, Homo sapiens
agagccgaggggagagagg

SEQ ID NO: 2863442 - DNA, 13 bp, Homo sapiens
agagcctgaggga

SEQ ID NO: 2863443 - DNA, 13 bp, Homo sapiens
agagcctgtcacc

SEQ ID NO: 2863444 - DNA, 18 bp, Homo sapiens
agagcctgtcaccagagc

SEQ ID NO: 2863445 - DNA, 13 bp, Homo sapiens
agagcttccctga

SEQ ID NO: 2863446 - DNA, 17 bp, Homo sapiens
agagcttccctgactca

SEQ ID NO: 2863447 - DNA, 16 bp, Homo sapiens
agaggaaaaatgggag

SEQ ID NO: 2863448 - DNA, 20 bp, Homo sapiens
agaggaaaaatgggagccag

SEQ ID NO: 2863449 - DNA, 23 bp, Homo sapiens
agaggaaggggccagaggctcgt

SEQ ID NO: 2863450 - DNA, 18 bp, Homo sapiens
agaggactcccaaccctg

SEQ ID NO: 2863451 - DNA, 22 bp, Homo sapiens
agaggcataaacctgtgctgaa

SEQ ID NO: 2863452 - DNA, 12 bp, Homo sapiens
agagtcctttgg

SEQ ID NO: 2863453 - DNA, 14 bp, Homo sapiens
agagtgtctttcca

SEQ ID NO: 2863454 - DNA, 17 bp, Homo sapiens
agagtttttaaagcctt

SEQ ID NO: 2863455 - DNA, 19 bp, Homo sapiens
agagtttttaaagccttct

SEQ ID NO: 2863456 - DNA, 20 bp, Homo sapiens
agatacagaactctttcaaa

SEQ ID NO: 2863457 - DNA, 23 bp, Homo sapiens
agataccagcgaggaggctccag

SEQ ID NO: 2863458 - DNA, 13 bp, Homo sapiens
agatagaaagctg

SEQ ID NO: 2863459 - DNA, 15 bp, Homo sapiens
agatagaaagctgga

SEQ ID NO: 2863460 - DNA, 22 bp, Homo sapiens
agatagaaagctggactgacca

SEQ ID NO: 2863461 - DNA, 17 bp, Homo sapiens
agatcaacgcctcactg

SEQ ID NO: 2863462 - DNA, 21 bp, Homo sapiens
agatcagccacggagcctgga

SEQ ID NO: 2863463 - DNA, 15 bp, Homo sapiens
agatctttatatttc

SEQ ID NO: 2863464 - DNA, 17 bp, Homo sapiens
agatcttttttttttcc

SEQ ID NO: 2863465 - DNA, 16 bp, Homo sapiens
agatgatgctttggaa

SEQ ID NO: 2863466 - DNA, 17 bp, Homo sapiens
agatgatgctttggaag

SEQ ID NO: 2863467 - DNA, 18 bp, Homo sapiens
agatgatgctttggaaga

SEQ ID NO: 2863468 - DNA, 22 bp, Homo sapiens
agatggcaagagggtgacagct

SEQ ID NO: 2863469 - DNA, 15 bp, Homo sapiens
agatggctgctgcct

SEQ ID NO: 2863470 - DNA, 11 bp, Homo sapiens
agattctgaag

SEQ ID NO: 2863471 - DNA, 13 bp, Homo sapiens
agattgaactttc

SEQ ID NO: 2863472 - DNA, 21 bp, Homo sapiens
agattggccaattaaaaacga

SEQ ID NO: 2863473 - DNA, 18 bp, Homo sapiens
agatttgggtcatttaga

SEQ ID NO: 2863474 - DNA, 14 bp, Homo sapiens
agattttaattttg

SEQ ID NO: 2863475 - DNA, 21 bp, Homo sapiens
agattttaattttgaataaat

SEQ ID NO: 2863476 - DNA, 13 bp, Homo sapiens
agcaacacagagc

SEQ ID NO: 2863477 - DNA, 14 bp, Homo sapiens
agcaacgcttgtag

SEQ ID NO: 2863478 - DNA, 21 bp, Homo sapiens
agcaatgtgagtcccagagcc

SEQ ID NO: 2863479 - DNA, 14 bp, Homo sapiens
agcaattccaggct

SEQ ID NO: 2863480 - DNA, 17 bp, Homo sapiens
agcaattccaggctgag

SEQ ID NO: 2863481 - DNA, 17 bp, Homo sapiens
agcacaatttaaaacaa

SEQ ID NO: 2863482 - DNA, 18 bp, Homo sapiens
agcaccccctcattcccc

SEQ ID NO: 2863483 - DNA, 20 bp, Homo sapiens
agcaccccctcattcccctc

SEQ ID NO: 2863484 - DNA, 16 bp, Homo sapiens
agcacctccaggcctg

SEQ ID NO: 2863485 - DNA, 18 bp, Homo sapiens
agcactttaaccctctct

SEQ ID NO: 2863486 - DNA, 19 bp, Homo sapiens
agcactttaaccctctctt

SEQ ID NO: 2863487 - DNA, 20 bp, Homo sapiens
agcactttaaccctctcttc

SEQ ID NO: 2863488 - DNA, 14 bp, Homo sapiens
agcagaggggctga

SEQ ID NO: 2863489 - DNA, 18 bp, Homo sapiens
agcagctcaacctaccct

SEQ ID NO: 2863490 - DNA, 23 bp, Homo sapiens
agcagggctaccctgagctgagg

SEQ ID NO: 2863491 - DNA, 21 bp, Homo sapiens
agcagtgaatgattcagtgtt

SEQ ID NO: 2863492 - DNA, 15 bp, Homo sapiens
agcagtgtgaggcca

SEQ ID NO: 2863493 - DNA, 21 bp, Homo sapiens
agcagtgtgaggccagggcag

SEQ ID NO: 2863494 - DNA, 13 bp, Homo sapiens
agcatagagaaca

SEQ ID NO: 2863495 - DNA, 13 bp, Homo sapiens
agcatctgaccat

SEQ ID NO: 2863496 - DNA, 15 bp, Homo sapiens
agcatctgaccatct

SEQ ID NO: 2863497 - DNA, 19 bp, Homo sapiens
agcatctgaccatctgtga

SEQ ID NO: 2863498 - DNA, 19 bp, Homo sapiens
agcattgcctggactgacc

SEQ ID NO: 2863499 - DNA, 16 bp, Homo sapiens
agcattgtaattatgt

SEQ ID NO: 2863500 - DNA, 13 bp, Homo sapiens
agccaaaggcagc

SEQ ID NO: 2863501 - DNA, 18 bp, Homo sapiens
agccaacagaagcttcca

SEQ ID NO: 2863502 - DNA, 14 bp, Homo sapiens
agccaacctggact

SEQ ID NO: 2863503 - DNA, 21 bp, Homo sapiens
agccaacctggacttcctgtc

SEQ ID NO: 2863504 - DNA, 11 bp, Homo sapiens
agccacaggag

SEQ ID NO: 2863505 - DNA, 13 bp, Homo sapiens
agccactcctctg

SEQ ID NO: 2863506 - DNA, 15 bp, Homo sapiens
agccactcctctgac

SEQ ID NO: 2863507 - DNA, 21 bp, Homo sapiens
agccagagtttttaaagcctt

SEQ ID NO: 2863508 - DNA, 16 bp, Homo sapiens
agccagcgtcctcctc

SEQ ID NO: 2863509 - DNA, 13 bp, Homo sapiens
agccatgaggagc

SEQ ID NO: 2863510 - DNA, 16 bp, Homo sapiens
agcccaatattataat

SEQ ID NO: 2863511 - DNA, 22 bp, Homo sapiens
agccccacccctaagtgcccaa

SEQ ID NO: 2863512 - DNA, 16 bp, Homo sapiens
agccccattcctggga

SEQ ID NO: 2863513 - DNA, 23 bp, Homo sapiens
agcccctcctccagcccctgtcc

SEQ ID NO: 2863514 - DNA, 20 bp, Homo sapiens
agccctagggtggagagcca

SEQ ID NO: 2863515 - DNA, 20 bp, Homo sapiens
agccctgctgggcccatgtg

SEQ ID NO: 2863516 - DNA, 16 bp, Homo sapiens
agccgactctggccct

SEQ ID NO: 2863517 - DNA, 17 bp, Homo sapiens
agccgactctggccctg

SEQ ID NO: 2863518 - DNA, 15 bp, Homo sapiens
agccgctgagcgagg

SEQ ID NO: 2863519 - DNA, 19 bp, Homo sapiens
agccgctgagcgaggagat

SEQ ID NO: 2863520 - DNA, 21 bp, Homo sapiens
agccgggtctgcctcttctgg

SEQ ID NO: 2863521 - DNA, 14 bp, Homo sapiens
agcctactatttaa

SEQ ID NO: 2863522 - DNA, 17 bp, Homo sapiens
agcctcccctgccaggg

SEQ ID NO: 2863523 - DNA, 19 bp, Homo sapiens
agcctcccctgccagggca

SEQ ID NO: 2863524 - DNA, 22 bp, Homo sapiens
agcctccgctgggcttcattcc

SEQ ID NO: 2863525 - DNA, 23 bp, Homo sapiens
agcctggatcctcagttctcaaa

SEQ ID NO: 2863526 - DNA, 23 bp, Homo sapiens
agcctggatgccaaggagcccct

SEQ ID NO: 2863527 - DNA, 17 bp, Homo sapiens
agcctggccccatggtc

SEQ ID NO: 2863528 - DNA, 22 bp, Homo sapiens
agcctggtagaattgggaagct

SEQ ID NO: 2863529 - DNA, 13 bp, Homo sapiens
agcctgtcaccag

SEQ ID NO: 2863530 - DNA, 24 bp, Homo sapiens
agcctgtcaccagagcttctctgg

SEQ ID NO: 2863531 - DNA, 20 bp, Homo sapiens
agcgaggagatgctccttgg

SEQ ID NO: 2863532 - DNA, 13 bp, Homo sapiens
agcggcagagcaa

SEQ ID NO: 2863533 - DNA, 19 bp, Homo sapiens
agcgtcctcctctgtgacc

SEQ ID NO: 2863534 - DNA, 17 bp, Homo sapiens
agcgtgctttaaaaaat

SEQ ID NO: 2863535 - DNA, 14 bp, Homo sapiens
agcgtggactctgc

SEQ ID NO: 2863536 - DNA, 20 bp, Homo sapiens
agcgttctaaatatgaatga

SEQ ID NO: 2863537 - DNA, 20 bp, Homo sapiens
agctaagatagaaagctgga

SEQ ID NO: 2863538 - DNA, 21 bp, Homo sapiens
agctaagatagaaagctggac

SEQ ID NO: 2863539 - DNA, 13 bp, Homo sapiens
agctaataaacca

SEQ ID NO: 2863540 - DNA, 16 bp, Homo sapiens
agctaataaaccagat

SEQ ID NO: 2863541 - DNA, 20 bp, Homo sapiens
agctatgttatattgaaaaa

SEQ ID NO: 2863542 - DNA, 22 bp, Homo sapiens
agctatgttatattgaaaaaat

SEQ ID NO: 2863543 - DNA, 19 bp, Homo sapiens
agctcaagcattctgttta

SEQ ID NO: 2863544 - DNA, 15 bp, Homo sapiens
agctccttcctggag

SEQ ID NO: 2863545 - DNA, 19 bp, Homo sapiens
agctccttcctggagactg

SEQ ID NO: 2863546 - DNA, 14 bp, Homo sapiens
agctctttccaaat

SEQ ID NO: 2863547 - DNA, 21 bp, Homo sapiens
agctctttccaaattaaaaca

SEQ ID NO: 2863548 - DNA, 16 bp, Homo sapiens
agctgaggcagcagtg

SEQ ID NO: 2863549 - DNA, 17 bp, Homo sapiens
agctgaggcagcagtgt

SEQ ID NO: 2863550 - DNA, 18 bp, Homo sapiens
agctgaggctgagaaagc

SEQ ID NO: 2863551 - DNA, 19 bp, Homo sapiens
agctgcaccatcacacatg

SEQ ID NO: 2863552 - DNA, 14 bp, Homo sapiens
agctggatgagaat

SEQ ID NO: 2863553 - DNA, 17 bp, Homo sapiens
agctgggcctcctgcct

SEQ ID NO: 2863554 - DNA, 18 bp, Homo sapiens
agctgggcctcctgcctc

SEQ ID NO: 2863555 - DNA, 15 bp, Homo sapiens
agctgggggaagggt

SEQ ID NO: 2863556 - DNA, 16 bp, Homo sapiens
agctgtatcactgcct

SEQ ID NO: 2863557 - DNA, 22 bp, Homo sapiens
agctgtcctgcagcaaacactc

SEQ ID NO: 2863558 - DNA, 10 bp, Homo sapiens
agctgtgcag

SEQ ID NO: 2863559 - DNA, 12 bp, Homo sapiens
agctgtgcaggt

SEQ ID NO: 2863560 - DNA, 16 bp, Homo sapiens
agctgttgagctgttt

SEQ ID NO: 2863561 - DNA, 16 bp, Homo sapiens
agctgtttactaggga

SEQ ID NO: 2863562 - DNA, 14 bp, Homo sapiens
agcttgagcctccc

SEQ ID NO: 2863563 - DNA, 17 bp, Homo sapiens
agcttgagcctccccca

SEQ ID NO: 2863564 - DNA, 19 bp, Homo sapiens
agcttgaggccaagatggc

SEQ ID NO: 2863565 - DNA, 21 bp, Homo sapiens
agcttgaggccaagatggctg

SEQ ID NO: 2863566 - DNA, 16 bp, Homo sapiens
agctttaatcaatcat

SEQ ID NO: 2863567 - DNA, 21 bp, Homo sapiens
agctttaatcaatcatgccct

SEQ ID NO: 2863568 - DNA, 22 bp, Homo sapiens
agctttcatgtaaactgtgcac

SEQ ID NO: 2863569 - DNA, 18 bp, Homo sapiens
aggaaaaatgggagccag

SEQ ID NO: 2863570 - DNA, 19 bp, Homo sapiens
aggaaaaatgggagccagg

SEQ ID NO: 2863571 - DNA, 20 bp, Homo sapiens
aggaaaaatgggagccagga

SEQ ID NO: 2863572 - DNA, 18 bp, Homo sapiens
aggaaacattttatcatt

SEQ ID NO: 2863573 - DNA, 18 bp, Homo sapiens
aggaaaggcatgtacaaa

SEQ ID NO: 2863574 - DNA, 18 bp, Homo sapiens
aggaaggggccagaggct

SEQ ID NO: 2863575 - DNA, 14 bp, Homo sapiens
aggaagtgaaccca

SEQ ID NO: 2863576 - DNA, 16 bp, Homo sapiens
aggaatgctggactgg

SEQ ID NO: 2863577 - DNA, 14 bp, Homo sapiens
aggacatttctcta

SEQ ID NO: 2863578 - DNA, 18 bp, Homo sapiens
aggactcccaaccctggc

SEQ ID NO: 2863579 - DNA, 20 bp, Homo sapiens
aggactcccaaccctggctt

SEQ ID NO: 2863580 - DNA, 12 bp, Homo sapiens
aggactctcagg

SEQ ID NO: 2863581 - DNA, 13 bp, Homo sapiens
aggagacagaaag

SEQ ID NO: 2863582 - DNA, 15 bp, Homo sapiens
aggagacagaaagcc

SEQ ID NO: 2863583 - DNA, 16 bp, Homo sapiens
aggagatgctccttgg

SEQ ID NO: 2863584 - DNA, 22 bp, Homo sapiens
aggagcgtggactctgctagac

SEQ ID NO: 2863585 - DNA, 16 bp, Homo sapiens
aggaggctccagaggg

SEQ ID NO: 2863586 - DNA, 17 bp, Homo sapiens
aggaggctccagagggc

SEQ ID NO: 2863587 - DNA, 18 bp, Homo sapiens
aggaggctccagagggca

SEQ ID NO: 2863588 - DNA, 14 bp, Homo sapiens
aggagttgccaggg

SEQ ID NO: 2863589 - DNA, 15 bp, Homo sapiens
aggcaagcttgaggc

SEQ ID NO: 2863590 - DNA, 22 bp, Homo sapiens
aggcaagcttgaggccaagatg

SEQ ID NO: 2863591 - DNA, 15 bp, Homo sapiens
aggcaaggtttacac

SEQ ID NO: 2863592 - DNA, 14 bp, Homo sapiens
aggcacattaactg

SEQ ID NO: 2863593 - DNA, 23 bp, Homo sapiens
aggcactgagataccagcgagga

SEQ ID NO: 2863594 - DNA, 17 bp, Homo sapiens
aggcagctaagatagaa

SEQ ID NO: 2863595 - DNA, 21 bp, Homo sapiens
aggcagctaagatagaaagct

SEQ ID NO: 2863596 - DNA, 16 bp, Homo sapiens
aggcaggggtgggaga

SEQ ID NO: 2863597 - DNA, 19 bp, Homo sapiens
aggcaggggtgggagagcc

SEQ ID NO: 2863598 - DNA, 14 bp, Homo sapiens
aggcataaacctgt

SEQ ID NO: 2863599 - DNA, 22 bp, Homo sapiens
aggccacagaaggtgaactttg

SEQ ID NO: 2863600 - DNA, 12 bp, Homo sapiens
aggccagcaacg

SEQ ID NO: 2863601 - DNA, 13 bp, Homo sapiens
aggccagggcaga

SEQ ID NO: 2863602 - DNA, 15 bp, Homo sapiens
aggccagggcagagt

SEQ ID NO: 2863603 - DNA, 16 bp, Homo sapiens
aggcccctggagccag

SEQ ID NO: 2863604 - DNA, 23 bp, Homo sapiens
aggcccgagatgtgacccaccag

SEQ ID NO: 2863605 - DNA, 15 bp, Homo sapiens
aggccctcgctgcca

SEQ ID NO: 2863606 - DNA, 24 bp, Homo sapiens
aggcctctccagtttgcacctgtc

SEQ ID NO: 2863607 - DNA, 15 bp, Homo sapiens
aggcctgaccagggg

SEQ ID NO: 2863608 - DNA, 19 bp, Homo sapiens
aggccttcatcctcctccc

SEQ ID NO: 2863609 - DNA, 16 bp, Homo sapiens
aggctcacccccttct

SEQ ID NO: 2863610 - DNA, 14 bp, Homo sapiens
aggctccagagggc

SEQ ID NO: 2863611 - DNA, 16 bp, Homo sapiens
aggctccagagggcac

SEQ ID NO: 2863612 - DNA, 21 bp, Homo sapiens
aggctgagaaagctaaagttt

SEQ ID NO: 2863613 - DNA, 13 bp, Homo sapiens
aggctgagccatg

SEQ ID NO: 2863614 - DNA, 14 bp, Homo sapiens
aggctgagccatga

SEQ ID NO: 2863615 - DNA, 15 bp, Homo sapiens
aggctgagccatgag

SEQ ID NO: 2863616 - DNA, 23 bp, Homo sapiens
aggctgcacctctggctagagcc

SEQ ID NO: 2863617 - DNA, 20 bp, Homo sapiens
aggctgtgtttagattgtat

SEQ ID NO: 2863618 - DNA, 16 bp, Homo sapiens
aggcttctctctgtgg

SEQ ID NO: 2863619 - DNA, 21 bp, Homo sapiens
agggaaaccagagtctgtatt

SEQ ID NO: 2863620 - DNA, 17 bp, Homo sapiens
agggaaaggcaagcttg

SEQ ID NO: 2863621 - DNA, 15 bp, Homo sapiens
agggaagaaggagga

SEQ ID NO: 2863622 - DNA, 15 bp, Homo sapiens
agggaagacaggtct

SEQ ID NO: 2863623 - DNA, 21 bp, Homo sapiens
agggaagacaggtctagactt

SEQ ID NO: 2863624 - DNA, 17 bp, Homo sapiens
agggaagctcttttctc

SEQ ID NO: 2863625 - DNA, 13 bp, Homo sapiens
agggaagggcctg

SEQ ID NO: 2863626 - DNA, 14 bp, Homo sapiens
agggaagggcctgc

SEQ ID NO: 2863627 - DNA, 18 bp, Homo sapiens
agggaagggcctgccaca

SEQ ID NO: 2863628 - DNA, 15 bp, Homo sapiens
agggaagtggggagt

SEQ ID NO: 2863629 - DNA, 13 bp, Homo sapiens
agggacaagggat

SEQ ID NO: 2863630 - DNA, 15 bp, Homo sapiens
agggacaagggattc

SEQ ID NO: 2863631 - DNA, 13 bp, Homo sapiens
agggacgcctggg

SEQ ID NO: 2863632 - DNA, 22 bp, Homo sapiens
agggacgcctgggggtgccagg

SEQ ID NO: 2863633 - DNA, 21 bp, Homo sapiens
agggacttgtttagagagcct

SEQ ID NO: 2863634 - DNA, 14 bp, Homo sapiens
agggagcctggccc

SEQ ID NO: 2863635 - DNA, 15 bp, Homo sapiens
agggatccctcatct

SEQ ID NO: 2863636 - DNA, 16 bp, Homo sapiens
agggatccctcatctg

SEQ ID NO: 2863637 - DNA, 15 bp, Homo sapiens
agggcactgggctgt

SEQ ID NO: 2863638 - DNA, 12 bp, Homo sapiens
agggcagggccc

SEQ ID NO: 2863639 - DNA, 12 bp, Homo sapiens
agggctcctggg

SEQ ID NO: 2863640 - DNA, 19 bp, Homo sapiens
aggggaagtaaaacagtca

SEQ ID NO: 2863641 - DNA, 12 bp, Homo sapiens
aggggccagagg

SEQ ID NO: 2863642 - DNA, 13 bp, Homo sapiens
aggggccagaggc

SEQ ID NO: 2863643 - DNA, 20 bp, Homo sapiens
aggggccttagggcactggg

SEQ ID NO: 2863644 - DNA, 19 bp, Homo sapiens
aggggttccttccacttct

SEQ ID NO: 2863645 - DNA, 19 bp, Homo sapiens
agggtcagacgcctgagga

SEQ ID NO: 2863646 - DNA, 21 bp, Homo sapiens
agggtcagacgcctgaggaac

SEQ ID NO: 2863647 - DNA, 17 bp, Homo sapiens
agggtgacagcttcctt

SEQ ID NO: 2863648 - DNA, 17 bp, Homo sapiens
agggtggtctgagcacc

SEQ ID NO: 2863649 - DNA, 18 bp, Homo sapiens
agggtgtggtatgagggg

SEQ ID NO: 2863650 - DNA, 17 bp, Homo sapiens
agggttgaccccagagg

SEQ ID NO: 2863651 - DNA, 20 bp, Homo sapiens
aggtccagctgggcctcctg

SEQ ID NO: 2863652 - DNA, 16 bp, Homo sapiens
aggtctagactttctc

SEQ ID NO: 2863653 - DNA, 13 bp, Homo sapiens
aggtgatgagttt

SEQ ID NO: 2863654 - DNA, 14 bp, Homo sapiens
aggtggcctgcgtc

SEQ ID NO: 2863655 - DNA, 18 bp, Homo sapiens
aggtggggagactgggct

SEQ ID NO: 2863656 - DNA, 20 bp, Homo sapiens
aggttctgtagagccaatta

SEQ ID NO: 2863657 - DNA, 21 bp, Homo sapiens
aggttgagaggaggacttggt

SEQ ID NO: 2863658 - DNA, 22 bp, Homo sapiens
aggttttccaaaagtaaagatg

SEQ ID NO: 2863659 - DNA, 14 bp, Homo sapiens
agtaaaacagtcat

SEQ ID NO: 2863660 - DNA, 16 bp, Homo sapiens
agtaacgggacagtaa

SEQ ID NO: 2863661 - DNA, 17 bp, Homo sapiens
agtaatgctaaatgtgt

SEQ ID NO: 2863662 - DNA, 21 bp, Homo sapiens
agtaatgctaaatgtgtaata

SEQ ID NO: 2863663 - DNA, 12 bp, Homo sapiens
agtactctttaa

SEQ ID NO: 2863664 - DNA, 14 bp, Homo sapiens
agtactctttaaca

SEQ ID NO: 2863665 - DNA, 23 bp, Homo sapiens
agtagcatctcagtggtgtgtga

SEQ ID NO: 2863666 - DNA, 15 bp, Homo sapiens
agtagttaaataact

SEQ ID NO: 2863667 - DNA, 14 bp, Homo sapiens
agtatgcaatgctt

SEQ ID NO: 2863668 - DNA, 21 bp, Homo sapiens
agtcaaaaaattatttgctat

SEQ ID NO: 2863669 - DNA, 14 bp, Homo sapiens
agtcataccaatga

SEQ ID NO: 2863670 - DNA, 19 bp, Homo sapiens
agtcatctagaattcactg

SEQ ID NO: 2863671 - DNA, 19 bp, Homo sapiens
agtcctaaaagttctcaat

SEQ ID NO: 2863672 - DNA, 16 bp, Homo sapiens
agtctgagggaaacca

SEQ ID NO: 2863673 - DNA, 16 bp, Homo sapiens
agtctgtatttttcta

SEQ ID NO: 2863674 - DNA, 23 bp, Homo sapiens
agtcttagctgaggctgagaaag

SEQ ID NO: 2863675 - DNA, 19 bp, Homo sapiens
agtcttccatttgcaaggg

SEQ ID NO: 2863676 - DNA, 15 bp, Homo sapiens
agtgaaggcttctct

SEQ ID NO: 2863677 - DNA, 13 bp, Homo sapiens
agtgaatgattca

SEQ ID NO: 2863678 - DNA, 16 bp, Homo sapiens
agtgacatttaatgcc

SEQ ID NO: 2863679 - DNA, 16 bp, Homo sapiens
agtgatatggtgaagg

SEQ ID NO: 2863680 - DNA, 20 bp, Homo sapiens
agtgatgtccttaaaatgtg

SEQ ID NO: 2863681 - DNA, 22 bp, Homo sapiens
agtgcagtcctgatcagagccg

SEQ ID NO: 2863682 - DNA, 18 bp, Homo sapiens
agtgccagcacctgccca

SEQ ID NO: 2863683 - DNA, 10 bp, Homo sapiens
agtgcccaaa

SEQ ID NO: 2863684 - DNA, 19 bp, Homo sapiens
agtgcccaaagtggggagg

SEQ ID NO: 2863685 - DNA, 19 bp, Homo sapiens
agtgctataaatgccagag

SEQ ID NO: 2863686 - DNA, 20 bp, Homo sapiens
agtgctataaatgccagagc

SEQ ID NO: 2863687 - DNA, 21 bp, Homo sapiens
agtgctataaatgccagagcc

SEQ ID NO: 2863688 - DNA, 11 bp, Homo sapiens
agtgctccctc

SEQ ID NO: 2863689 - DNA, 14 bp, Homo sapiens
agtgctccctcaca

SEQ ID NO: 2863690 - DNA, 17 bp, Homo sapiens
agtgctccctcacatgt

SEQ ID NO: 2863691 - DNA, 16 bp, Homo sapiens
agtgctctgatccctc

SEQ ID NO: 2863692 - DNA, 21 bp, Homo sapiens
agtgggacaaaccagagcaga

SEQ ID NO: 2863693 - DNA, 15 bp, Homo sapiens
agtgggacagcccag

SEQ ID NO: 2863694 - DNA, 15 bp, Homo sapiens
agtgttaaatgtgat

SEQ ID NO: 2863695 - DNA, 20 bp, Homo sapiens
agtgttgcctcttgcaatgc

SEQ ID NO: 2863696 - DNA, 20 bp, Homo sapiens
agtgtttatgtttaaaagaa

SEQ ID NO: 2863697 - DNA, 21 bp, Homo sapiens
agttaattggatgttcactgc

SEQ ID NO: 2863698 - DNA, 17 bp, Homo sapiens
agttagctccataaagt

SEQ ID NO: 2863699 - DNA, 15 bp, Homo sapiens
agttctcaatgtaga

SEQ ID NO: 2863700 - DNA, 23 bp, Homo sapiens
agttctgtactcaaatgtagcca

SEQ ID NO: 2863701 - DNA, 22 bp, Homo sapiens
agttgaattttttctaaaaaga

SEQ ID NO: 2863702 - DNA, 23 bp, Homo sapiens
agttgctaacttaaaaaactgca

SEQ ID NO: 2863703 - DNA, 16 bp, Homo sapiens
agttgctgtgaacttt

SEQ ID NO: 2863704 - DNA, 19 bp, Homo sapiens
agtttgacagtttttgaca

SEQ ID NO: 2863705 - DNA, 17 bp, Homo sapiens
agtttgtagaactttat

SEQ ID NO: 2863706 - DNA, 22 bp, Homo sapiens
agtttgtgttgttgttgctgct

SEQ ID NO: 2863707 - DNA, 22 bp, Homo sapiens
agttttaaagaaattttagtag

SEQ ID NO: 2863708 - DNA, 12 bp, Homo sapiens
agttttcagtgg

SEQ ID NO: 2863709 - DNA, 17 bp, Homo sapiens
agttttcggaaacactg

SEQ ID NO: 2863710 - DNA, 22 bp, Homo sapiens
agttttcggaaacactgactta

SEQ ID NO: 2863711 - DNA, 14 bp, Homo sapiens
agtttttcacttct

SEQ ID NO: 2863712 - DNA, 15 bp, Homo sapiens
ataaaaatatgtaat

SEQ ID NO: 2863713 - DNA, 15 bp, Homo sapiens
ataaaatatcataaa

SEQ ID NO: 2863714 - DNA, 20 bp, Homo sapiens
ataaaatatcataaagcatt

SEQ ID NO: 2863715 - DNA, 16 bp, Homo sapiens
ataaaatgatgttata

SEQ ID NO: 2863716 - DNA, 19 bp, Homo sapiens
ataaacaagtcaaagactt

SEQ ID NO: 2863717 - DNA, 11 bp, Homo sapiens
ataaacagtca

SEQ ID NO: 2863718 - DNA, 12 bp, Homo sapiens
ataaacagtcac

SEQ ID NO: 2863719 - DNA, 12 bp, Homo sapiens
ataaagtacaaa

SEQ ID NO: 2863720 - DNA, 14 bp, Homo sapiens
ataaagtacaaatg

SEQ ID NO: 2863721 - DNA, 22 bp, Homo sapiens
ataaagtacaaatgaagaaagt

SEQ ID NO: 2863722 - DNA, 16 bp, Homo sapiens
ataaagtacttgacta

SEQ ID NO: 2863723 - DNA, 15 bp, Homo sapiens
ataaagttctgtact

SEQ ID NO: 2863724 - DNA, 20 bp, Homo sapiens
ataaataaaatcatgtagtt

SEQ ID NO: 2863725 - DNA, 16 bp, Homo sapiens
ataaatgccagagcca

SEQ ID NO: 2863726 - DNA, 15 bp, Homo sapiens
ataaatgtatcttat

SEQ ID NO: 2863727 - DNA, 18 bp, Homo sapiens
ataacttctcatgtatat

SEQ ID NO: 2863728 - DNA, 19 bp, Homo sapiens
ataagtagcattcatgtaa

SEQ ID NO: 2863729 - DNA, 14 bp, Homo sapiens
ataatactactact

SEQ ID NO: 2863730 - DNA, 19 bp, Homo sapiens
ataatactactactgttat

SEQ ID NO: 2863731 - DNA, 13 bp, Homo sapiens
ataatatcaaata

SEQ ID NO: 2863732 - DNA, 21 bp, Homo sapiens
ataatatttttgtatttctct

SEQ ID NO: 2863733 - DNA, 13 bp, Homo sapiens
ataatgtgaaaat

SEQ ID NO: 2863734 - DNA, 16 bp, Homo sapiens
ataatgtgaaaatggt

SEQ ID NO: 2863735 - DNA, 21 bp, Homo sapiens
ataattaaccaaccttgttta

SEQ ID NO: 2863736 - DNA, 13 bp, Homo sapiens
ataatttaaagtt

SEQ ID NO: 2863737 - DNA, 13 bp, Homo sapiens
ataatttgaactt

SEQ ID NO: 2863738 - DNA, 18 bp, Homo sapiens
ataatttgaactttggaa

SEQ ID NO: 2863739 - DNA, 15 bp, Homo sapiens
ataattttattacat

SEQ ID NO: 2863740 - DNA, 15 bp, Homo sapiens
atacaagaaaatgta

SEQ ID NO: 2863741 - DNA, 15 bp, Homo sapiens
atacagaactctttc

SEQ ID NO: 2863742 - DNA, 13 bp, Homo sapiens
atacattttctaa

SEQ ID NO: 2863743 - DNA, 14 bp, Homo sapiens
atacattttctaaa

SEQ ID NO: 2863744 - DNA, 24 bp, Homo sapiens
atacattttctaaataaaaatatg

SEQ ID NO: 2863745 - DNA, 16 bp, Homo sapiens
ataccagcgaggaggc

SEQ ID NO: 2863746 - DNA, 14 bp, Homo sapiens
ataccttcttcgct

SEQ ID NO: 2863747 - DNA, 18 bp, Homo sapiens
atactactactgttatca

SEQ ID NO: 2863748 - DNA, 19 bp, Homo sapiens
atactcttaggaagagaaa

SEQ ID NO: 2863749 - DNA, 23 bp, Homo sapiens
atactgccaaaacatttatgaca

SEQ ID NO: 2863750 - DNA, 13 bp, Homo sapiens
atagaatatttat

SEQ ID NO: 2863751 - DNA, 19 bp, Homo sapiens
atagaatatttattacctc

SEQ ID NO: 2863752 - DNA, 22 bp, Homo sapiens
atagacttggagaatactgcca

SEQ ID NO: 2863753 - DNA, 14 bp, Homo sapiens
atagagaacaaagt

SEQ ID NO: 2863754 - DNA, 14 bp, Homo sapiens
atagagctgtatta

SEQ ID NO: 2863755 - DNA, 20 bp, Homo sapiens
atagataagagtagaaactg

SEQ ID NO: 2863756 - DNA, 14 bp, Homo sapiens
atagcaactaatgt

SEQ ID NO: 2863757 - DNA, 14 bp, Homo sapiens
atagcagattttaa

SEQ ID NO: 2863758 - DNA, 20 bp, Homo sapiens
atagggagaatatttactaa

SEQ ID NO: 2863759 - DNA, 22 bp, Homo sapiens
atagggtctaccaatacaaaat

SEQ ID NO: 2863760 - DNA, 17 bp, Homo sapiens
atagtagttaaataact

SEQ ID NO: 2863761 - DNA, 21 bp, Homo sapiens
atagtgtcatataaactcatt

SEQ ID NO: 2863762 - DNA, 16 bp, Homo sapiens
atataaactcatttat

SEQ ID NO: 2863763 - DNA, 15 bp, Homo sapiens
atataatgttgataa

SEQ ID NO: 2863764 - DNA, 14 bp, Homo sapiens
atatacattttcta

SEQ ID NO: 2863765 - DNA, 16 bp, Homo sapiens
atatacattttctaaa

SEQ ID NO: 2863766 - DNA, 21 bp, Homo sapiens
atatcaaataaaatatcataa

SEQ ID NO: 2863767 - DNA, 12 bp, Homo sapiens
atatgaatctat

SEQ ID NO: 2863768 - DNA, 13 bp, Homo sapiens
atatgaatgaaac

SEQ ID NO: 2863769 - DNA, 12 bp, Homo sapiens
atatgaatgaat

SEQ ID NO: 2863770 - DNA, 15 bp, Homo sapiens
atatgctgatctttt

SEQ ID NO: 2863771 - DNA, 13 bp, Homo sapiens
atatggtgaaggg

SEQ ID NO: 2863772 - DNA, 14 bp, Homo sapiens
atatgtaatttcaa

SEQ ID NO: 2863773 - DNA, 20 bp, Homo sapiens
atatgtaatttcaaaataca

SEQ ID NO: 2863774 - DNA, 21 bp, Homo sapiens
atatgtaatttcaaaatacat

SEQ ID NO: 2863775 - DNA, 23 bp, Homo sapiens
atatgtaatttcaaaatacattt

SEQ ID NO: 2863776 - DNA, 14 bp, Homo sapiens
atatgtatatatgt

SEQ ID NO: 2863777 - DNA, 16 bp, Homo sapiens
atatgtattttttgaa

SEQ ID NO: 2863778 - DNA, 18 bp, Homo sapiens
atatgtattttttgaatc

SEQ ID NO: 2863779 - DNA, 19 bp, Homo sapiens
atatgtattttttgaatct

SEQ ID NO: 2863780 - DNA, 23 bp, Homo sapiens
atatgtattttttgaatctatga

SEQ ID NO: 2863781 - DNA, 12 bp, Homo sapiens
atatgtctgcca

SEQ ID NO: 2863782 - DNA, 19 bp, Homo sapiens
atattaaataacatgtttc

SEQ ID NO: 2863783 - DNA, 21 bp, Homo sapiens
atattaaataacatgtttctc

SEQ ID NO: 2863784 - DNA, 17 bp, Homo sapiens
atattccctagaaactt

SEQ ID NO: 2863785 - DNA, 22 bp, Homo sapiens
atattgataagctattgtctgt

SEQ ID NO: 2863786 - DNA, 12 bp, Homo sapiens
atattgtaatct

SEQ ID NO: 2863787 - DNA, 18 bp, Homo sapiens
atattgtaatctatgttt

SEQ ID NO: 2863788 - DNA, 18 bp, Homo sapiens
atatttgatttctaattg

SEQ ID NO: 2863789 - DNA, 18 bp, Homo sapiens
atatttgtatgtttttct

SEQ ID NO: 2863790 - DNA, 22 bp, Homo sapiens
atatttgtatgtttttctgtat

SEQ ID NO: 2863791 - DNA, 16 bp, Homo sapiens
atatttttttaactgt

SEQ ID NO: 2863792 - DNA, 11 bp, Homo sapiens
atcaaactgct

SEQ ID NO: 2863793 - DNA, 19 bp, Homo sapiens
atcaaagccggcctgagaa

SEQ ID NO: 2863794 - DNA, 18 bp, Homo sapiens
atcagaaagtaacaatct

SEQ ID NO: 2863795 - DNA, 22 bp, Homo sapiens
atcagtaaatagtgtcatataa

SEQ ID NO: 2863796 - DNA, 16 bp, Homo sapiens
atcagttgatttttct

SEQ ID NO: 2863797 - DNA, 14 bp, Homo sapiens
atcatgccctgcct

SEQ ID NO: 2863798 - DNA, 17 bp, Homo sapiens
atcatgtggccccaccc

SEQ ID NO: 2863799 - DNA, 20 bp, Homo sapiens
atcattaaaaattaccttta

SEQ ID NO: 2863800 - DNA, 14 bp, Homo sapiens
atcattctctgtct

SEQ ID NO: 2863801 - DNA, 16 bp, Homo sapiens
atccaactttttcata

SEQ ID NO: 2863802 - DNA, 15 bp, Homo sapiens
atccagtttcccacc

SEQ ID NO: 2863803 - DNA, 19 bp, Homo sapiens
atccagtttcccaccacct

SEQ ID NO: 2863804 - DNA, 14 bp, Homo sapiens
atccatcatcatgt

SEQ ID NO: 2863805 - DNA, 18 bp, Homo sapiens
atccatcatcatgtgtgt

SEQ ID NO: 2863806 - DNA, 16 bp, Homo sapiens
atccatccatgtactt

SEQ ID NO: 2863807 - DNA, 18 bp, Homo sapiens
atccattaggccagcaac

SEQ ID NO: 2863808 - DNA, 17 bp, Homo sapiens
atccatttggacaaaat

SEQ ID NO: 2863809 - DNA, 18 bp, Homo sapiens
atccatttggacaaaatg

SEQ ID NO: 2863810 - DNA, 19 bp, Homo sapiens
atccatttggacaaaatgg

SEQ ID NO: 2863811 - DNA, 20 bp, Homo sapiens
atccatttggacaaaatgga

SEQ ID NO: 2863812 - DNA, 22 bp, Homo sapiens
atcccagcactttgggaggctg

SEQ ID NO: 2863813 - DNA, 15 bp, Homo sapiens
atcccctttcctccc

SEQ ID NO: 2863814 - DNA, 16 bp, Homo sapiens
atcccctttcctcccc

SEQ ID NO: 2863815 - DNA, 19 bp, Homo sapiens
atcccgagcacctccacat

SEQ ID NO: 2863816 - DNA, 16 bp, Homo sapiens
atcccgttcagaaaac

SEQ ID NO: 2863817 - DNA, 23 bp, Homo sapiens
atcccgttcagaaaaccacttta

SEQ ID NO: 2863818 - DNA, 20 bp, Homo sapiens
atccctctacagagcttccc

SEQ ID NO: 2863819 - DNA, 17 bp, Homo sapiens
atcctcagttctcaaat

SEQ ID NO: 2863820 - DNA, 21 bp, Homo sapiens
atcctcagttctcaaatgtgt

SEQ ID NO: 2863821 - DNA, 15 bp, Homo sapiens
atcctcctccccagc

SEQ ID NO: 2863822 - DNA, 16 bp, Homo sapiens
atcctcctccccagct

SEQ ID NO: 2863823 - DNA, 20 bp, Homo sapiens
atcctcctccccagctcttc

SEQ ID NO: 2863824 - DNA, 22 bp, Homo sapiens
atcctcttttaatggcatttct

SEQ ID NO: 2863825 - DNA, 17 bp, Homo sapiens
atccttgagattctgaa

SEQ ID NO: 2863826 - DNA, 18 bp, Homo sapiens
atccttgagattctgaag

SEQ ID NO: 2863827 - DNA, 21 bp, Homo sapiens
atcggatctggggctctggga

SEQ ID NO: 2863828 - DNA, 16 bp, Homo sapiens
atcgtattaaaaaaca

SEQ ID NO: 2863829 - DNA, 18 bp, Homo sapiens
atctaacctcatcttctt

SEQ ID NO: 2863830 - DNA, 11 bp, Homo sapiens
atctatgaacc

SEQ ID NO: 2863831 - DNA, 14 bp, Homo sapiens
atctatgaacctga

SEQ ID NO: 2863832 - DNA, 15 bp, Homo sapiens
atctatgaacctgaa

SEQ ID NO: 2863833 - DNA, 19 bp, Homo sapiens
atctatgaacctgaaaagg

SEQ ID NO: 2863834 - DNA, 19 bp, Homo sapiens
atctatggcttatttctat

SEQ ID NO: 2863835 - DNA, 21 bp, Homo sapiens
atctatggcttatttctatga

SEQ ID NO: 2863836 - DNA, 21 bp, Homo sapiens
atctatgtttataatactact

SEQ ID NO: 2863837 - DNA, 12 bp, Homo sapiens
atctcaatgcaa

SEQ ID NO: 2863838 - DNA, 22 bp, Homo sapiens
atctcaatgcaagccccaactt

SEQ ID NO: 2863839 - DNA, 17 bp, Homo sapiens
atctcagtggtgtgtga

SEQ ID NO: 2863840 - DNA, 14 bp, Homo sapiens
atctcattggaccc

SEQ ID NO: 2863841 - DNA, 16 bp, Homo sapiens
atctgcaggctgcacc

SEQ ID NO: 2863842 - DNA, 17 bp, Homo sapiens
atctggctttttctgcc

SEQ ID NO: 2863843 - DNA, 21 bp, Homo sapiens
atctggctttttctgccactg

SEQ ID NO: 2863844 - DNA, 16 bp, Homo sapiens
atctgtacaaaatggt

SEQ ID NO: 2863845 - DNA, 19 bp, Homo sapiens
atctgtgactataaagctg

SEQ ID NO: 2863846 - DNA, 14 bp, Homo sapiens
atctgtgtcttgtt

SEQ ID NO: 2863847 - DNA, 15 bp, Homo sapiens
atctgtgtcttgttt

SEQ ID NO: 2863848 - DNA, 12 bp, Homo sapiens
atctttgctgtt

SEQ ID NO: 2863849 - DNA, 14 bp, Homo sapiens
atcttttaaaatca

SEQ ID NO: 2863850 - DNA, 13 bp, Homo sapiens
atcttttatacaa

SEQ ID NO: 2863851 - DNA, 14 bp, Homo sapiens
atgaaaatgtcttg

SEQ ID NO: 2863852 - DNA, 15 bp, Homo sapiens
atgaaacttctcagt

SEQ ID NO: 2863853 - DNA, 15 bp, Homo sapiens
atgaacctgaaaagg

SEQ ID NO: 2863854 - DNA, 18 bp, Homo sapiens
atgaactttgtcagtgtt

SEQ ID NO: 2863855 - DNA, 19 bp, Homo sapiens
atgaagatctttatatttc

SEQ ID NO: 2863856 - DNA, 20 bp, Homo sapiens
atgaaggtaatattgataag

SEQ ID NO: 2863857 - DNA, 20 bp, Homo sapiens
atgaatgggatattttgaaa

SEQ ID NO: 2863858 - DNA, 19 bp, Homo sapiens
atgacaagctgtatcactg

SEQ ID NO: 2863859 - DNA, 16 bp, Homo sapiens
atgactgcatttgtgt

SEQ ID NO: 2863860 - DNA, 16 bp, Homo sapiens
atgaggagcgtggact

SEQ ID NO: 2863861 - DNA, 16 bp, Homo sapiens
atgatcagcaaaaaga

SEQ ID NO: 2863862 - DNA, 11 bp, Homo sapiens
atgatgacaat

SEQ ID NO: 2863863 - DNA, 16 bp, Homo sapiens
atgatgacaatcaaag

SEQ ID NO: 2863864 - DNA, 14 bp, Homo sapiens
atgatgctttggaa

SEQ ID NO: 2863865 - DNA, 17 bp, Homo sapiens
atgatgttatacatcaa

SEQ ID NO: 2863866 - DNA, 16 bp, Homo sapiens
atgattaattcacctt

SEQ ID NO: 2863867 - DNA, 22 bp, Homo sapiens
atgatttccctccagagaaagc

SEQ ID NO: 2863868 - DNA, 24 bp, Homo sapiens
atgatttccctccagagaaagcac

SEQ ID NO: 2863869 - DNA, 21 bp, Homo sapiens
atgcactgttccccctgtgca

SEQ ID NO: 2863870 - DNA, 16 bp, Homo sapiens
atgcacttttagaaat

SEQ ID NO: 2863871 - DNA, 19 bp, Homo sapiens
atgcagcctcttccccacc

SEQ ID NO: 2863872 - DNA, 15 bp, Homo sapiens
atgccacccagcaac

SEQ ID NO: 2863873 - DNA, 12 bp, Homo sapiens
atgccagagcca

SEQ ID NO: 2863874 - DNA, 17 bp, Homo sapiens
atgccagagccaacctg

SEQ ID NO: 2863875 - DNA, 14 bp, Homo sapiens
atgccatcatctcc

SEQ ID NO: 2863876 - DNA, 16 bp, Homo sapiens
atgccatcatctcctg

SEQ ID NO: 2863877 - DNA, 21 bp, Homo sapiens
atgccctgccttgtccctctc

SEQ ID NO: 2863878 - DNA, 22 bp, Homo sapiens
atgccctgccttgtccctctca

SEQ ID NO: 2863879 - DNA, 21 bp, Homo sapiens
atgcctaatatttaggcaaga

SEQ ID NO: 2863880 - DNA, 19 bp, Homo sapiens
atgcctcaagaacaccttt

SEQ ID NO: 2863881 - DNA, 22 bp, Homo sapiens
atgcgtgagatgggtgtacaaa

SEQ ID NO: 2863882 - DNA, 18 bp, Homo sapiens
atgctacttcccactgta

SEQ ID NO: 2863883 - DNA, 19 bp, Homo sapiens
atgctacttcccactgtat

SEQ ID NO: 2863884 - DNA, 16 bp, Homo sapiens
atgctccttgggccct

SEQ ID NO: 2863885 - DNA, 17 bp, Homo sapiens
atgctgatcttttaaaa

SEQ ID NO: 2863886 - DNA, 14 bp, Homo sapiens
atgctgtttctaag

SEQ ID NO: 2863887 - DNA, 22 bp, Homo sapiens
atgctgtttctaagaaaatgta

SEQ ID NO: 2863888 - DNA, 17 bp, Homo sapiens
atggaaaataaattata

SEQ ID NO: 2863889 - DNA, 22 bp, Homo sapiens
atggacacagacccacacatgt

SEQ ID NO: 2863890 - DNA, 17 bp, Homo sapiens
atggcatcttcaatatg

SEQ ID NO: 2863891 - DNA, 17 bp, Homo sapiens
atggcatttctctttaa

SEQ ID NO: 2863892 - DNA, 21 bp, Homo sapiens
atggcatttctctttaaacta

SEQ ID NO: 2863893 - DNA, 12 bp, Homo sapiens
atggccctcgga

SEQ ID NO: 2863894 - DNA, 18 bp, Homo sapiens
atggctgctgcctgctca

SEQ ID NO: 2863895 - DNA, 12 bp, Homo sapiens
atgggaaacaaa

SEQ ID NO: 2863896 - DNA, 11 bp, Homo sapiens
atgggagccag

SEQ ID NO: 2863897 - DNA, 14 bp, Homo sapiens
atgggagccaggag

SEQ ID NO: 2863898 - DNA, 20 bp, Homo sapiens
atgggagccgggtctgcctc

SEQ ID NO: 2863899 - DNA, 23 bp, Homo sapiens
atgggaggctcacccccttctcc

SEQ ID NO: 2863900 - DNA, 17 bp, Homo sapiens
atgggattagaaacaaa

SEQ ID NO: 2863901 - DNA, 14 bp, Homo sapiens
atgggcagagccca

SEQ ID NO: 2863902 - DNA, 18 bp, Homo sapiens
atgggctgtgattactgc

SEQ ID NO: 2863903 - DNA, 18 bp, Homo sapiens
atgggggagattgaactt

SEQ ID NO: 2863904 - DNA, 13 bp, Homo sapiens
atggtccaggaga

SEQ ID NO: 2863905 - DNA, 14 bp, Homo sapiens
atggtggagggcca

SEQ ID NO: 2863906 - DNA, 16 bp, Homo sapiens
atggtggcgcgcacct

SEQ ID NO: 2863907 - DNA, 18 bp, Homo sapiens
atggtgtggtgaatgtgt

SEQ ID NO: 2863908 - DNA, 14 bp, Homo sapiens
atgtaataaacagg

SEQ ID NO: 2863909 - DNA, 21 bp, Homo sapiens
atgtaatttcaaaatacattt

SEQ ID NO: 2863910 - DNA, 21 bp, Homo sapiens
atgtagcaaaatacatgacat

SEQ ID NO: 2863911 - DNA, 14 bp, Homo sapiens
atgtatatatgtat

SEQ ID NO: 2863912 - DNA, 15 bp, Homo sapiens
atgtatgtcagtgct

SEQ ID NO: 2863913 - DNA, 18 bp, Homo sapiens
atgtattttttgaatcta

SEQ ID NO: 2863914 - DNA, 19 bp, Homo sapiens
atgtcaataaacaacagct

SEQ ID NO: 2863915 - DNA, 23 bp, Homo sapiens
atgtcaataaacaacagctgaag

SEQ ID NO: 2863916 - DNA, 16 bp, Homo sapiens
atgtcagctgctgttg

SEQ ID NO: 2863917 - DNA, 22 bp, Homo sapiens
atgtcagctgctgttgaacttt

SEQ ID NO: 2863918 - DNA, 24 bp, Homo sapiens
atgtcagtgctataaatgccagag

SEQ ID NO: 2863919 - DNA, 15 bp, Homo sapiens
atgtccaaaatttat

SEQ ID NO: 2863920 - DNA, 16 bp, Homo sapiens
atgtctgccacagaga

SEQ ID NO: 2863921 - DNA, 10 bp, Homo sapiens
atgtcttgtg

SEQ ID NO: 2863922 - DNA, 18 bp, Homo sapiens
cagctcaacctaccctgg

SEQ ID NO: 2863923 - DNA, 13 bp, Homo sapiens
cagctcagtgttt

SEQ ID NO: 2863924 - DNA, 16 bp, Homo sapiens
cagctccagaatacct

SEQ ID NO: 2863925 - DNA, 19 bp, Homo sapiens
cagctccagaataccttct

SEQ ID NO: 2863926 - DNA, 14 bp, Homo sapiens
cagctccttcctgg

SEQ ID NO: 2863927 - DNA, 23 bp, Homo sapiens
cagctctctctacccggcccaga

SEQ ID NO: 2863928 - DNA, 13 bp, Homo sapiens
cagctgctgttga

SEQ ID NO: 2863929 - DNA, 17 bp, Homo sapiens
cagctgctgttgaactt

SEQ ID NO: 2863930 - DNA, 18 bp, Homo sapiens
cagctgctgttgaacttt

SEQ ID NO: 2863931 - DNA, 19 bp, Homo sapiens
cagctgctgttgaactttt

SEQ ID NO: 2863932 - DNA, 18 bp, Homo sapiens
cagctgggcctcctgcct

SEQ ID NO: 2863933 - DNA, 16 bp, Homo sapiens
cagctgtcctgcagca

SEQ ID NO: 2863934 - DNA, 15 bp, Homo sapiens
caggaaaggaatcat

SEQ ID NO: 2863935 - DNA, 20 bp, Homo sapiens
caggaaatgaaaatgtcttg

SEQ ID NO: 2863936 - DNA, 18 bp, Homo sapiens
caggacatttctctaaga

SEQ ID NO: 2863937 - DNA, 22 bp, Homo sapiens
caggagaaggccaattcctata

SEQ ID NO: 2863938 - DNA, 12 bp, Homo sapiens
caggagacaaga

SEQ ID NO: 2863939 - DNA, 17 bp, Homo sapiens
caggcacattaactgtt

SEQ ID NO: 2863940 - DNA, 18 bp, Homo sapiens
caggcaggggtgggagag

SEQ ID NO: 2863941 - DNA, 19 bp, Homo sapiens
caggcattgccaagggctt

SEQ ID NO: 2863942 - DNA, 18 bp, Homo sapiens
caggcctgaccagggggc

SEQ ID NO: 2863943 - DNA, 18 bp, Homo sapiens
caggccttcatcctcctc

SEQ ID NO: 2863944 - DNA, 22 bp, Homo sapiens
caggccttcatcctcctcccca

SEQ ID NO: 2863945 - DNA, 12 bp, Homo sapiens
caggctgagcca

SEQ ID NO: 2863946 - DNA, 13 bp, Homo sapiens
caggctgagccat

SEQ ID NO: 2863947 - DNA, 14 bp, Homo sapiens
caggctgagccatg

SEQ ID NO: 2863948 - DNA, 15 bp, Homo sapiens
caggctgagccatga

SEQ ID NO: 2863949 - DNA, 18 bp, Homo sapiens
caggctgagccatgagga

SEQ ID NO: 2863950 - DNA, 13 bp, Homo sapiens
caggctgcacctc

SEQ ID NO: 2863951 - DNA, 23 bp, Homo sapiens
caggctgcacctctggctagagc

SEQ ID NO: 2863952 - DNA, 20 bp, Homo sapiens
cagggaaaattatttgcata

SEQ ID NO: 2863953 - DNA, 14 bp, Homo sapiens
cagggaagctcttt

SEQ ID NO: 2863954 - DNA, 22 bp, Homo sapiens
cagggacttgtttagagagcct

SEQ ID NO: 2863955 - DNA, 23 bp, Homo sapiens
cagggacttgtttagagagcctg

SEQ ID NO: 2863956 - DNA, 14 bp, Homo sapiens
cagggctaccctga

SEQ ID NO: 2863957 - DNA, 18 bp, Homo sapiens
cagggctaccctgagctg

SEQ ID NO: 2863958 - DNA, 19 bp, Homo sapiens
cagggctaccctgagctga

SEQ ID NO: 2863959 - DNA, 12 bp, Homo sapiens
cagggctcctgg

SEQ ID NO: 2863960 - DNA, 16 bp, Homo sapiens
caggggtgggagagcc

SEQ ID NO: 2863961 - DNA, 17 bp, Homo sapiens
caggggtgggagagcca

SEQ ID NO: 2863962 - DNA, 23 bp, Homo sapiens
cagggtgggccactctcccctcc

SEQ ID NO: 2863963 - DNA, 19 bp, Homo sapiens
cagggtgtggtatgagggg

SEQ ID NO: 2863964 - DNA, 19 bp, Homo sapiens
cagggttgaccccagagga

SEQ ID NO: 2863965 - DNA, 18 bp, Homo sapiens
caggtctagactttctca

SEQ ID NO: 2863966 - DNA, 12 bp, Homo sapiens
caggtggcctgc

SEQ ID NO: 2863967 - DNA, 22 bp, Homo sapiens
caggtggggagactgggctgag

SEQ ID NO: 2863968 - DNA, 15 bp, Homo sapiens
caggttctctttgag

SEQ ID NO: 2863969 - DNA, 22 bp, Homo sapiens
cagtaatgctaaatgtgtaata

SEQ ID NO: 2863970 - DNA, 23 bp, Homo sapiens
cagtaccttcaaactagggccaa

SEQ ID NO: 2863971 - DNA, 22 bp, Homo sapiens
cagtaggagcccagctctgaaa

SEQ ID NO: 2863972 - DNA, 23 bp, Homo sapiens
cagtataattgagttttcagtgg

SEQ ID NO: 2863973 - DNA, 14 bp, Homo sapiens
cagtcaacctgggc

SEQ ID NO: 2863974 - DNA, 15 bp, Homo sapiens
cagtcagcagtcatg

SEQ ID NO: 2863975 - DNA, 21 bp, Homo sapiens
cagtcaggaaaggaatcattt

SEQ ID NO: 2863976 - DNA, 16 bp, Homo sapiens
cagtcatctagaattc

SEQ ID NO: 2863977 - DNA, 15 bp, Homo sapiens
cagtcgatagagctg

SEQ ID NO: 2863978 - DNA, 16 bp, Homo sapiens
cagtcgatagagctgt

SEQ ID NO: 2863979 - DNA, 17 bp, Homo sapiens
cagtcttccatttgcaa

SEQ ID NO: 2863980 - DNA, 21 bp, Homo sapiens
cagtcttccatttgcaaggga

SEQ ID NO: 2863981 - DNA, 21 bp, Homo sapiens
cagtgctataaatgccagagc

SEQ ID NO: 2863982 - DNA, 22 bp, Homo sapiens
cagtgctataaatgccagagcc

SEQ ID NO: 2863983 - DNA, 23 bp, Homo sapiens
cagtgctataaatgccagagcca

SEQ ID NO: 2863984 - DNA, 11 bp, Homo sapiens
cagtgggacaa

SEQ ID NO: 2863985 - DNA, 18 bp, Homo sapiens
cagtggtgtgtgaagttt

SEQ ID NO: 2863986 - DNA, 14 bp, Homo sapiens
cagtgtctcggagg

SEQ ID NO: 2863987 - DNA, 17 bp, Homo sapiens
cagtgtgaggccagggc

SEQ ID NO: 2863988 - DNA, 19 bp, Homo sapiens
cagtgttagggaagggcct

SEQ ID NO: 2863989 - DNA, 17 bp, Homo sapiens
cagtgttgcctcttgca

SEQ ID NO: 2863990 - DNA, 15 bp, Homo sapiens
cagttaaaaaaaatt

SEQ ID NO: 2863991 - DNA, 15 bp, Homo sapiens
cagttcctttagaaa

SEQ ID NO: 2863992 - DNA, 13 bp, Homo sapiens
cagttgatttttc

SEQ ID NO: 2863993 - DNA, 14 bp, Homo sapiens
cagttgctgtgaac

SEQ ID NO: 2863994 - DNA, 20 bp, Homo sapiens
cagttgctgtgaactttcat

SEQ ID NO: 2863995 - DNA, 21 bp, Homo sapiens
cagttgtcttatgtgaaaaat

SEQ ID NO: 2863996 - DNA, 15 bp, Homo sapiens
cagtttttcacttct

SEQ ID NO: 2863997 - DNA, 16 bp, Homo sapiens
cagtttttgacattta

SEQ ID NO: 2863998 - DNA, 17 bp, Homo sapiens
cataaacctgtgctgaa

SEQ ID NO: 2863999 - DNA, 16 bp, Homo sapiens
cataaagtacaaatga

SEQ ID NO: 2864000 - DNA, 18 bp, Homo sapiens
cataaagtacaaatgaag

SEQ ID NO: 2864001 - DNA, 15 bp, Homo sapiens
cataacaattcctct

SEQ ID NO: 2864002 - DNA, 12 bp, Homo sapiens
cataagataaaa

SEQ ID NO: 2864003 - DNA, 24 bp, Homo sapiens
cataagataaaatgatgttataca

SEQ ID NO: 2864004 - DNA, 15 bp, Homo sapiens
cataagtatttcaaa

SEQ ID NO: 2864005 - DNA, 23 bp, Homo sapiens
cataatcagtaaatagtgtcata

SEQ ID NO: 2864006 - DNA, 22 bp, Homo sapiens
catacaagaaaatgtatccaag

SEQ ID NO: 2864007 - DNA, 14 bp, Homo sapiens
cataccaatgaaaa

SEQ ID NO: 2864008 - DNA, 18 bp, Homo sapiens
catagacctacagacctg

SEQ ID NO: 2864009 - DNA, 19 bp, Homo sapiens
catagacctacagacctgg

SEQ ID NO: 2864010 - DNA, 22 bp, Homo sapiens
catagacctacagacctggctc

SEQ ID NO: 2864011 - DNA, 13 bp, Homo sapiens
catagagaacaaa

SEQ ID NO: 2864012 - DNA, 17 bp, Homo sapiens
catagcagattttaatt

SEQ ID NO: 2864013 - DNA, 13 bp, Homo sapiens
catatgaatgaaa

SEQ ID NO: 2864014 - DNA, 17 bp, Homo sapiens
catatgaatgaaacatg

SEQ ID NO: 2864015 - DNA, 18 bp, Homo sapiens
catattgtaatctatgtt

SEQ ID NO: 2864016 - DNA, 17 bp, Homo sapiens
catatttgatttctaat

SEQ ID NO: 2864017 - DNA, 18 bp, Homo sapiens
catatttgatttctaatt

SEQ ID NO: 2864018 - DNA, 23 bp, Homo sapiens
catatttgatttctaattgtaag

SEQ ID NO: 2864019 - DNA, 16 bp, Homo sapiens
catatttgtatgtttt

SEQ ID NO: 2864020 - DNA, 16 bp, Homo sapiens
catattttaaattctc

SEQ ID NO: 2864021 - DNA, 14 bp, Homo sapiens
catcaaataaactg

SEQ ID NO: 2864022 - DNA, 13 bp, Homo sapiens
catcaacaaaaat

SEQ ID NO: 2864023 - DNA, 15 bp, Homo sapiens
catcaacaaaaattg

SEQ ID NO: 2864024 - DNA, 15 bp, Homo sapiens
catcaatatgtatat

SEQ ID NO: 2864025 - DNA, 13 bp, Homo sapiens
catcagggtgggc

SEQ ID NO: 2864026 - DNA, 13 bp, Homo sapiens
catcatctcctgc

SEQ ID NO: 2864027 - DNA, 20 bp, Homo sapiens
catcatctcctgccttcctc

SEQ ID NO: 2864028 - DNA, 21 bp, Homo sapiens
catcatctcctgccttcctcc

SEQ ID NO: 2864029 - DNA, 23 bp, Homo sapiens
catcatgaggccggatgaaactt

SEQ ID NO: 2864030 - DNA, 16 bp, Homo sapiens
catcattctctgtctc

SEQ ID NO: 2864031 - DNA, 17 bp, Homo sapiens
catcattctctgtctca

SEQ ID NO: 2864032 - DNA, 22 bp, Homo sapiens
cctgtcccacccccttccccca

SEQ ID NO: 2864033 - DNA, 14 bp, Homo sapiens
cctgtccccaccct

SEQ ID NO: 2864034 - DNA, 17 bp, Homo sapiens
cctgtccccaccctcca

SEQ ID NO: 2864035 - DNA, 21 bp, Homo sapiens
cctgtgcagccgctgagcgag

SEQ ID NO: 2864036 - DNA, 20 bp, Homo sapiens
cctgttcatgtttttgtttt

SEQ ID NO: 2864037 - DNA, 21 bp, Homo sapiens
cctgttcatgtttttgtttta

SEQ ID NO: 2864038 - DNA, 17 bp, Homo sapiens
cctgtttttaagctgtt

SEQ ID NO: 2864039 - DNA, 15 bp, Homo sapiens
ccttccactgagggc

SEQ ID NO: 2864040 - DNA, 17 bp, Homo sapiens
ccttccattttccccca

SEQ ID NO: 2864041 - DNA, 14 bp, Homo sapiens
ccttcccagaccag

SEQ ID NO: 2864042 - DNA, 19 bp, Homo sapiens
ccttccccagactcagctc

SEQ ID NO: 2864043 - DNA, 23 bp, Homo sapiens
ccttccccagactcagctccaga

SEQ ID NO: 2864044 - DNA, 17 bp, Homo sapiens
ccttcccccagcccatc

SEQ ID NO: 2864045 - DNA, 21 bp, Homo sapiens
ccttcccccatcccctttcct

SEQ ID NO: 2864046 - DNA, 20 bp, Homo sapiens
ccttcctggagactgcccag

SEQ ID NO: 2864047 - DNA, 17 bp, Homo sapiens
ccttcctttcctctgca

SEQ ID NO: 2864048 - DNA, 19 bp, Homo sapiens
ccttcctttcctctgcagc

SEQ ID NO: 2864049 - DNA, 22 bp, Homo sapiens
ccttcctttcctctgcagcact

SEQ ID NO: 2864050 - DNA, 13 bp, Homo sapiens
ccttctccatcca

SEQ ID NO: 2864051 - DNA, 16 bp, Homo sapiens
ccttctggatccatgg

SEQ ID NO: 2864052 - DNA, 18 bp, Homo sapiens
ccttctggatccatgggg

SEQ ID NO: 2864053 - DNA, 16 bp, Homo sapiens
ccttggactcctccca

SEQ ID NO: 2864054 - DNA, 14 bp, Homo sapiens
ccttgggccctttg

SEQ ID NO: 2864055 - DNA, 13 bp, Homo sapiens
ccttgggctccct

SEQ ID NO: 2864056 - DNA, 12 bp, Homo sapiens
cctttcctcccc

SEQ ID NO: 2864057 - DNA, 13 bp, Homo sapiens
cctttcctcccca

SEQ ID NO: 2864058 - DNA, 19 bp, Homo sapiens
cctttcctctgcagcactt

SEQ ID NO: 2864059 - DNA, 21 bp, Homo sapiens
ccttttgaaattaacctctca

SEQ ID NO: 2864060 - DNA, 22 bp, Homo sapiens
cgaatctctttttgctttcgaa

SEQ ID NO: 2864061 - DNA, 18 bp, Homo sapiens
cgactctatagactctag

SEQ ID NO: 2864062 - DNA, 16 bp, Homo sapiens
cgactctggccctggc

SEQ ID NO: 2864063 - DNA, 16 bp, Homo sapiens
cgagatgtgacccacc

SEQ ID NO: 2864064 - DNA, 15 bp, Homo sapiens
cgccctccctctccc

SEQ ID NO: 2864065 - DNA, 23 bp, Homo sapiens
cgccctccctctcccaggcccga

SEQ ID NO: 2864066 - DNA, 20 bp, Homo sapiens
cgcctgaggaacccttacag

SEQ ID NO: 2864067 - DNA, 19 bp, Homo sapiens
cgctgccagctctgtatca

SEQ ID NO: 2864068 - DNA, 21 bp, Homo sapiens
cgctgggcttcattccggact

SEQ ID NO: 2864069 - DNA, 21 bp, Homo sapiens
cgcttgtagaactcactctgg

SEQ ID NO: 2864070 - DNA, 22 bp, Homo sapiens
cgctttctagctgttgagctgt

SEQ ID NO: 2864071 - DNA, 22 bp, Homo sapiens
cggaagccaaaggcagctaaga

SEQ ID NO: 2864072 - DNA, 16 bp, Homo sapiens
cggactggcagaagca

SEQ ID NO: 2864073 - DNA, 23 bp, Homo sapiens
cggactggcagaagcattgcctg

SEQ ID NO: 2864074 - DNA, 17 bp, Homo sapiens
cggagccactcctctga

SEQ ID NO: 2864075 - DNA, 18 bp, Homo sapiens
cggagccactcctctgac

SEQ ID NO: 2864076 - DNA, 16 bp, Homo sapiens
cggaggtccagctggg

SEQ ID NO: 2864077 - DNA, 12 bp, Homo sapiens
cggcccagagac

SEQ ID NO: 2864078 - DNA, 20 bp, Homo sapiens
cgggctttaatagtcacctt

SEQ ID NO: 2864079 - DNA, 13 bp, Homo sapiens
cgggtctgcctct

SEQ ID NO: 2864080 - DNA, 21 bp, Homo sapiens
cgggttctgcagcggcagagc

SEQ ID NO: 2864081 - DNA, 22 bp, Homo sapiens
cggtgcatccacgcacacatgg

SEQ ID NO: 2864082 - DNA, 15 bp, Homo sapiens
cggtgtgcaccaggg

SEQ ID NO: 2864083 - DNA, 23 bp, Homo sapiens
cgtattaaaaaacaattaactgc

SEQ ID NO: 2864084 - DNA, 12 bp, Homo sapiens
cgtcctcctctg

SEQ ID NO: 2864085 - DNA, 14 bp, Homo sapiens
cgtcctcctctgtg

SEQ ID NO: 2864086 - DNA, 15 bp, Homo sapiens
cgtcctcctctgtga

SEQ ID NO: 2864087 - DNA, 14 bp, Homo sapiens
cgttctaaatatga

SEQ ID NO: 2864088 - DNA, 14 bp, Homo sapiens
cgtttgtgtttcta

SEQ ID NO: 2864089 - DNA, 16 bp, Homo sapiens
ctaaataaaaatatgt

SEQ ID NO: 2864090 - DNA, 15 bp, Homo sapiens
ctaaatatgaatgaa

SEQ ID NO: 2864091 - DNA, 22 bp, Homo sapiens
ctaacaatcagctccttcctgg

SEQ ID NO: 2864092 - DNA, 19 bp, Homo sapiens
ctaaccaaggctgtgttta

SEQ ID NO: 2864093 - DNA, 21 bp, Homo sapiens
ctaactacaaggacaatgcct

SEQ ID NO: 2864094 - DNA, 13 bp, Homo sapiens
ctaactgctgtta

SEQ ID NO: 2864095 - DNA, 18 bp, Homo sapiens
ctaagatagaaagctgga

SEQ ID NO: 2864096 - DNA, 19 bp, Homo sapiens
ctaagatagaaagctggac

SEQ ID NO: 2864097 - DNA, 14 bp, Homo sapiens
ctaagtctttccat

SEQ ID NO: 2864098 - DNA, 22 bp, Homo sapiens
ctaagtgcccaaagtggggagg

SEQ ID NO: 2864099 - DNA, 20 bp, Homo sapiens
ctaatagaactcagttttaa

SEQ ID NO: 2864100 - DNA, 16 bp, Homo sapiens
ctaattgtaagtgaaa

SEQ ID NO: 2864101 - DNA, 21 bp, Homo sapiens
ctaattgtaagtgaaattaag

SEQ ID NO: 2864102 - DNA, 13 bp, Homo sapiens
ctacaaaatggag

SEQ ID NO: 2864103 - DNA, 14 bp, Homo sapiens
ctacagacctggct

SEQ ID NO: 2864104 - DNA, 15 bp, Homo sapiens
ctacagacctggctc

SEQ ID NO: 2864105 - DNA, 16 bp, Homo sapiens
ctacagacctggctct

SEQ ID NO: 2864106 - DNA, 16 bp, Homo sapiens
ctacagagcttccctg

SEQ ID NO: 2864107 - DNA, 18 bp, Homo sapiens
ctacagagcttccctgac

SEQ ID NO: 2864108 - DNA, 23 bp, Homo sapiens
ctacatatttgtatgtttttctg

SEQ ID NO: 2864109 - DNA, 16 bp, Homo sapiens
ctacctactggtgtaa

SEQ ID NO: 2864110 - DNA, 19 bp, Homo sapiens
ctacctgacactcccttgg

SEQ ID NO: 2864111 - DNA, 23 bp, Homo sapiens
ctactaacaatcagctccttcct

SEQ ID NO: 2864112 - DNA, 21 bp, Homo sapiens
ctactgcagcacctccaggcc

SEQ ID NO: 2864113 - DNA, 17 bp, Homo sapiens
ctagaaaaataaaatgt

SEQ ID NO: 2864114 - DNA, 18 bp, Homo sapiens
ctagaaaaataaaatgtt

SEQ ID NO: 2864115 - DNA, 16 bp, Homo sapiens
ctagaaacttccaaat

SEQ ID NO: 2864116 - DNA, 12 bp, Homo sapiens
ctagaatttatt

SEQ ID NO: 2864117 - DNA, 16 bp, Homo sapiens
ctagactcctcaggag

SEQ ID NO: 2864118 - DNA, 20 bp, Homo sapiens
ctagactcctcaggagagac

SEQ ID NO: 2864119 - DNA, 12 bp, Homo sapiens
ctagactttctc

SEQ ID NO: 2864120 - DNA, 19 bp, Homo sapiens
ctagatcctgggtttccat

SEQ ID NO: 2864121 - DNA, 14 bp, Homo sapiens
ctagatctgcaggc

SEQ ID NO: 2864122 - DNA, 16 bp, Homo sapiens
ctagatctgcaggctg

SEQ ID NO: 2864123 - DNA, 13 bp, Homo sapiens
ctagggatccctc

SEQ ID NO: 2864124 - DNA, 17 bp, Homo sapiens
ctagggatccctcatct

SEQ ID NO: 2864125 - DNA, 18 bp, Homo sapiens
ctagggccaagcccagca

SEQ ID NO: 2864126 - DNA, 22 bp, Homo sapiens
ctaggttctgtagagccaatta

SEQ ID NO: 2864127 - DNA, 21 bp, Homo sapiens
ctagtgaaggcttctctctgt

SEQ ID NO: 2864128 - DNA, 23 bp, Homo sapiens
ctagtgggacagcccagagcctg

SEQ ID NO: 2864129 - DNA, 14 bp, Homo sapiens
ctataaagctgtta

SEQ ID NO: 2864130 - DNA, 19 bp, Homo sapiens
ctataaagctgttattctt

SEQ ID NO: 2864131 - DNA, 14 bp, Homo sapiens
ctataaatgccaga

SEQ ID NO: 2864132 - DNA, 20 bp, Homo sapiens
ctataaatgccagagccaac

SEQ ID NO: 2864133 - DNA, 19 bp, Homo sapiens
ctatacgcagcgtgcttta

SEQ ID NO: 2864134 - DNA, 12 bp, Homo sapiens
ctatagactcta

SEQ ID NO: 2864135 - DNA, 16 bp, Homo sapiens
ctatagagcctacctg

SEQ ID NO: 2864136 - DNA, 17 bp, Homo sapiens
ctatatagacttggaga

SEQ ID NO: 2864137 - DNA, 15 bp, Homo sapiens
ctatccacactgtca

SEQ ID NO: 2864138 - DNA, 15 bp, Homo sapiens
ctatcttttttagtg

SEQ ID NO: 2864139 - DNA, 14 bp, Homo sapiens
ctatgacaaattca

SEQ ID NO: 2864140 - DNA, 20 bp, Homo sapiens
ctatgtttttgttcaaagcc

SEQ ID NO: 2864141 - DNA, 22 bp, Homo sapiens
ctatgtttttgttcaaagccag

SEQ ID NO: 2864142 - DNA, 14 bp, Homo sapiens
gaccatctgtgact

SEQ ID NO: 2864143 - DNA, 16 bp, Homo sapiens
gaccatctgtgactat

SEQ ID NO: 2864144 - DNA, 13 bp, Homo sapiens
gacccaccagtgc

SEQ ID NO: 2864145 - DNA, 16 bp, Homo sapiens
gacccaccagtgcctt

SEQ ID NO: 2864146 - DNA, 17 bp, Homo sapiens
gacccagccctcatccc

SEQ ID NO: 2864147 - DNA, 18 bp, Homo sapiens
gaccccttcctttcctct

SEQ ID NO: 2864148 - DNA, 16 bp, Homo sapiens
gaccctctttcttgtt

SEQ ID NO: 2864149 - DNA, 21 bp, Homo sapiens
gaccgtttgtccacttcattt

SEQ ID NO: 2864150 - DNA, 14 bp, Homo sapiens
gacctacagacctg

SEQ ID NO: 2864151 - DNA, 19 bp, Homo sapiens
gacctacagacctggctct

SEQ ID NO: 2864152 - DNA, 17 bp, Homo sapiens
gacctggtgctgcctct

SEQ ID NO: 2864153 - DNA, 21 bp, Homo sapiens
gacgcctgggggtgccaggac

SEQ ID NO: 2864154 - DNA, 21 bp, Homo sapiens
gactcaagggaaaggcaagct

SEQ ID NO: 2864155 - DNA, 15 bp, Homo sapiens
gactcaataaaagaa

SEQ ID NO: 2864156 - DNA, 15 bp, Homo sapiens
gactcagctccagaa

SEQ ID NO: 2864157 - DNA, 12 bp, Homo sapiens
gactcagggctc

SEQ ID NO: 2864158 - DNA, 13 bp, Homo sapiens
gactcagggctcc

SEQ ID NO: 2864159 - DNA, 14 bp, Homo sapiens
gactcagggctcct

SEQ ID NO: 2864160 - DNA, 16 bp, Homo sapiens
gactcattctgaagga

SEQ ID NO: 2864161 - DNA, 14 bp, Homo sapiens
gactccaggcctga

SEQ ID NO: 2864162 - DNA, 16 bp, Homo sapiens
gactccaggcctgacc

SEQ ID NO: 2864163 - DNA, 14 bp, Homo sapiens
gactctggccctgg

SEQ ID NO: 2864164 - DNA, 16 bp, Homo sapiens
gactctggccctggcc

SEQ ID NO: 2864165 - DNA, 17 bp, Homo sapiens
gactctggccctggccc

SEQ ID NO: 2864166 - DNA, 23 bp, Homo sapiens
gactgaccacaccaaccaggcct

SEQ ID NO: 2864167 - DNA, 18 bp, Homo sapiens
gactgcagaacccccagg

SEQ ID NO: 2864168 - DNA, 12 bp, Homo sapiens
gactgcatttgt

SEQ ID NO: 2864169 - DNA, 14 bp, Homo sapiens
gactgcatttgtgt

SEQ ID NO: 2864170 - DNA, 17 bp, Homo sapiens
gactgcatttgtgtgtg

SEQ ID NO: 2864171 - DNA, 17 bp, Homo sapiens
gacttgtttagagagcc

SEQ ID NO: 2864172 - DNA, 23 bp, Homo sapiens
gagaaaccttattgtacctctct

SEQ ID NO: 2864173 - DNA, 16 bp, Homo sapiens
gagaatactgccaaaa

SEQ ID NO: 2864174 - DNA, 18 bp, Homo sapiens
gagaattgcttgaaccca

SEQ ID NO: 2864175 - DNA, 20 bp, Homo sapiens
gagacagaaagcctccgctg

SEQ ID NO: 2864176 - DNA, 21 bp, Homo sapiens
gagacagaaagcctccgctgg

SEQ ID NO: 2864177 - DNA, 12 bp, Homo sapiens
gagaccccttcc

SEQ ID NO: 2864178 - DNA, 15 bp, Homo sapiens
gagactgggctgagg

SEQ ID NO: 2864179 - DNA, 21 bp, Homo sapiens
gagactgggctgagggagcct

SEQ ID NO: 2864180 - DNA, 17 bp, Homo sapiens
gagacttggggaccaga

SEQ ID NO: 2864181 - DNA, 12 bp, Homo sapiens
gagagccagctc

SEQ ID NO: 2864182 - DNA, 14 bp, Homo sapiens
gagcacctccacat

SEQ ID NO: 2864183 - DNA, 19 bp, Homo sapiens
gagcacctccacatcctcc

SEQ ID NO: 2864184 - DNA, 16 bp, Homo sapiens
gagcagaggggctgaa

SEQ ID NO: 2864185 - DNA, 16 bp, Homo sapiens
gagccaacctggactt

SEQ ID NO: 2864186 - DNA, 16 bp, Homo sapiens
gagccaattagacttg

SEQ ID NO: 2864187 - DNA, 20 bp, Homo sapiens
gagccaattagacttgaaat

SEQ ID NO: 2864188 - DNA, 15 bp, Homo sapiens
gagccactcctctga

SEQ ID NO: 2864189 - DNA, 18 bp, Homo sapiens
gagccatgaggagcgtgg

SEQ ID NO: 2864190 - DNA, 22 bp, Homo sapiens
gagccatgaggagcgtggactc

SEQ ID NO: 2864191 - DNA, 21 bp, Homo sapiens
gagcccagctctgaaaccagt

SEQ ID NO: 2864192 - DNA, 18 bp, Homo sapiens
gagccccattcctgggaa

SEQ ID NO: 2864193 - DNA, 17 bp, Homo sapiens
gagcccctcctccagcc

SEQ ID NO: 2864194 - DNA, 19 bp, Homo sapiens
gagcccgcttttgttcttc

SEQ ID NO: 2864195 - DNA, 17 bp, Homo sapiens
gagccgaggggagagag

SEQ ID NO: 2864196 - DNA, 20 bp, Homo sapiens
gagccgaggggagagaggga

SEQ ID NO: 2864197 - DNA, 21 bp, Homo sapiens
gagccgggtctgcctcttctg

SEQ ID NO: 2864198 - DNA, 12 bp, Homo sapiens
gagcctccccca

SEQ ID NO: 2864199 - DNA, 12 bp, Homo sapiens
gagcctgtcacc

SEQ ID NO: 2864200 - DNA, 17 bp, Homo sapiens
gagcctgtcaccagagc

SEQ ID NO: 2864201 - DNA, 18 bp, Homo sapiens
gagcctgtcaccagagct

SEQ ID NO: 2864202 - DNA, 18 bp, Homo sapiens
gagcgaggagatgctcct

SEQ ID NO: 2864203 - DNA, 19 bp, Homo sapiens
gagcgtggactctgctaga

SEQ ID NO: 2864204 - DNA, 16 bp, Homo sapiens
gagctgaggcagcagt

SEQ ID NO: 2864205 - DNA, 21 bp, Homo sapiens
gagctggcgactgcagctgca

SEQ ID NO: 2864206 - DNA, 18 bp, Homo sapiens
gagctgtattaagccact

SEQ ID NO: 2864207 - DNA, 13 bp, Homo sapiens
gagcttccctgac

SEQ ID NO: 2864208 - DNA, 10 bp, Homo sapiens
gagcttctct

SEQ ID NO: 2864209 - DNA, 16 bp, Homo sapiens
gagcttctctgggctg

SEQ ID NO: 2864210 - DNA, 20 bp, Homo sapiens
gaggaaaaatgggagccagg

SEQ ID NO: 2864211 - DNA, 18 bp, Homo sapiens
gaggaatgctggactgga

SEQ ID NO: 2864212 - DNA, 20 bp, Homo sapiens
gaggactcccaaccctggct

SEQ ID NO: 2864213 - DNA, 17 bp, Homo sapiens
gaggagatgctccttgg

SEQ ID NO: 2864214 - DNA, 18 bp, Homo sapiens
gaggaggctccagagggc

SEQ ID NO: 2864215 - DNA, 22 bp, Homo sapiens
gaggcagcagtgtgaggccagg

SEQ ID NO: 2864216 - DNA, 15 bp, Homo sapiens
gaggccaagatggct

SEQ ID NO: 2864217 - DNA, 15 bp, Homo sapiens
gaggccagggcagag

SEQ ID NO: 2864218 - DNA, 17 bp, Homo sapiens
gaggcccctggagccag

SEQ ID NO: 2864219 - DNA, 18 bp, Homo sapiens
gaggcccctggagccaga

SEQ ID NO: 2864220 - DNA, 17 bp, Homo sapiens
gaggccctcgctgccag

SEQ ID NO: 2864221 - DNA, 17 bp, Homo sapiens
gaggctccagagggcac

SEQ ID NO: 2864222 - DNA, 23 bp, Homo sapiens
gagggacgcctgggggtgccagg

SEQ ID NO: 2864223 - DNA, 19 bp, Homo sapiens
gagggagccatcccttccc

SEQ ID NO: 2864224 - DNA, 12 bp, Homo sapiens
gagggcagcagg

SEQ ID NO: 2864225 - DNA, 16 bp, Homo sapiens
gagggcagcagggcta

SEQ ID NO: 2864226 - DNA, 20 bp, Homo sapiens
gagggcagcccccactttcc

SEQ ID NO: 2864227 - DNA, 16 bp, Homo sapiens
gaggtccagctgggcc

SEQ ID NO: 2864228 - DNA, 23 bp, Homo sapiens
gagtgagacccagccctcatccc

SEQ ID NO: 2864229 - DNA, 17 bp, Homo sapiens
gagtgcagtcctgatca

SEQ ID NO: 2864230 - DNA, 13 bp, Homo sapiens
gagtgtctttcca

SEQ ID NO: 2864231 - DNA, 22 bp, Homo sapiens
gagtgtctttccacggagccac

SEQ ID NO: 2864232 - DNA, 19 bp, Homo sapiens
gagtgttccccttccactg

SEQ ID NO: 2864233 - DNA, 12 bp, Homo sapiens
gataaaatgatg

SEQ ID NO: 2864234 - DNA, 15 bp, Homo sapiens
gataaatgagctttc

SEQ ID NO: 2864235 - DNA, 17 bp, Homo sapiens
gatagaaagctggactg

SEQ ID NO: 2864236 - DNA, 19 bp, Homo sapiens
gatagaaagctggactgac

SEQ ID NO: 2864237 - DNA, 16 bp, Homo sapiens
gatagggagttttaaa

SEQ ID NO: 2864238 - DNA, 16 bp, Homo sapiens
gatattttgaaatgaa

SEQ ID NO: 2864239 - DNA, 16 bp, Homo sapiens
gatcagagccgtggtc

SEQ ID NO: 2864240 - DNA, 23 bp, Homo sapiens
gatcagagccgtggtcctttggg

SEQ ID NO: 2864241 - DNA, 14 bp, Homo sapiens
gatcagcaaaaaga

SEQ ID NO: 2864242 - DNA, 17 bp, Homo sapiens
gatccatggggggagaa

SEQ ID NO: 2864243 - DNA, 23 bp, Homo sapiens
gatccctctacagagcttccctg

SEQ ID NO: 2864244 - DNA, 20 bp, Homo sapiens
gatcctggttaccactcttt

SEQ ID NO: 2864245 - DNA, 16 bp, Homo sapiens
gatctgcaggctgcac

SEQ ID NO: 2864246 - DNA, 23 bp, Homo sapiens
gatctttatatttcaataaatga

SEQ ID NO: 2864247 - DNA, 16 bp, Homo sapiens
gatcttttaaaatcat

SEQ ID NO: 2864248 - DNA, 14 bp, Homo sapiens
gatgaaacttctca

SEQ ID NO: 2864249 - DNA, 15 bp, Homo sapiens
gatgaagaagggggt

SEQ ID NO: 2864250 - DNA, 18 bp, Homo sapiens
gatgaattgtcacatcta

SEQ ID NO: 2864251 - DNA, 16 bp, Homo sapiens
gatgctccttgggccc

SEQ ID NO: 2864252 - DNA, 14 bp, Homo sapiens
gctttgttttgcac

SEQ ID NO: 2864253 - DNA, 15 bp, Homo sapiens
gctttttctgccact

SEQ ID NO: 2864254 - DNA, 12 bp, Homo sapiens
ggaaaattattt

SEQ ID NO: 2864255 - DNA, 21 bp, Homo sapiens
ggaaacaaataatttgaactt

SEQ ID NO: 2864256 - DNA, 13 bp, Homo sapiens
ggaagacaggtct

SEQ ID NO: 2864257 - DNA, 15 bp, Homo sapiens
ggaaggggccagagg

SEQ ID NO: 2864258 - DNA, 13 bp, Homo sapiens
ggaagtcaaagca

SEQ ID NO: 2864259 - DNA, 24 bp, Homo sapiens
ggaatcatttctatttctcctcca

SEQ ID NO: 2864260 - DNA, 15 bp, Homo sapiens
ggacacagacccaca

SEQ ID NO: 2864261 - DNA, 18 bp, Homo sapiens
ggacaggaggggcccaca

SEQ ID NO: 2864262 - DNA, 21 bp, Homo sapiens
ggacccagaggaaggggccag

SEQ ID NO: 2864263 - DNA, 20 bp, Homo sapiens
ggacgcctgggggtgccagg

SEQ ID NO: 2864264 - DNA, 14 bp, Homo sapiens
ggactcaagggaaa

SEQ ID NO: 2864265 - DNA, 18 bp, Homo sapiens
ggactccaggcctgacca

SEQ ID NO: 2864266 - DNA, 19 bp, Homo sapiens
ggactccaggcctgaccag

SEQ ID NO: 2864267 - DNA, 21 bp, Homo sapiens
ggactcccaaccctggcttgg

SEQ ID NO: 2864268 - DNA, 20 bp, Homo sapiens
ggactctcagtctctgagca

SEQ ID NO: 2864269 - DNA, 16 bp, Homo sapiens
ggactgaccaaagact

SEQ ID NO: 2864270 - DNA, 17 bp, Homo sapiens
ggactgaccaaagactg

SEQ ID NO: 2864271 - DNA, 18 bp, Homo sapiens
ggactgaccaaagactgc

SEQ ID NO: 2864272 - DNA, 20 bp, Homo sapiens
ggactgaccaaagactgcag

SEQ ID NO: 2864273 - DNA, 21 bp, Homo sapiens
ggactgaccaaagactgcaga

SEQ ID NO: 2864274 - DNA, 23 bp, Homo sapiens
ggactgaccaaagactgcagaac

SEQ ID NO: 2864275 - DNA, 18 bp, Homo sapiens
ggactgaccacaccaacc

SEQ ID NO: 2864276 - DNA, 23 bp, Homo sapiens
ggactgaccacaccaaccaggcc

SEQ ID NO: 2864277 - DNA, 21 bp, Homo sapiens
ggactggaggcccctggagcc

SEQ ID NO: 2864278 - DNA, 16 bp, Homo sapiens
ggactggcagaagcat

SEQ ID NO: 2864279 - DNA, 18 bp, Homo sapiens
ggacttgtttagagagcc

SEQ ID NO: 2864280 - DNA, 21 bp, Homo sapiens
ggagaagtgatatggtgaagg

SEQ ID NO: 2864281 - DNA, 14 bp, Homo sapiens
ggagattgaacttt

SEQ ID NO: 2864282 - DNA, 12 bp, Homo sapiens
ggagcagagggg

SEQ ID NO: 2864283 - DNA, 19 bp, Homo sapiens
ggagccactcctctgactc

SEQ ID NO: 2864284 - DNA, 16 bp, Homo sapiens
ggagcccagctctgaa

SEQ ID NO: 2864285 - DNA, 16 bp, Homo sapiens
ggagccccattcctgg

SEQ ID NO: 2864286 - DNA, 23 bp, Homo sapiens
ggagcgttctaaatatgaatgaa

SEQ ID NO: 2864287 - DNA, 15 bp, Homo sapiens
ggaggcccctggagc

SEQ ID NO: 2864288 - DNA, 18 bp, Homo sapiens
ggaggcccctggagccag

SEQ ID NO: 2864289 - DNA, 21 bp, Homo sapiens
ggaggctcacccccttctcca

SEQ ID NO: 2864290 - DNA, 18 bp, Homo sapiens
ggaggctccagagggcac

SEQ ID NO: 2864291 - DNA, 15 bp, Homo sapiens
ggagggcagcagggc

SEQ ID NO: 2864292 - DNA, 16 bp, Homo sapiens
ggagggcagcagggct

SEQ ID NO: 2864293 - DNA, 19 bp, Homo sapiens
ggagggccacatgggaggc

SEQ ID NO: 2864294 - DNA, 20 bp, Homo sapiens
ggagtaagacaagtgggatt

SEQ ID NO: 2864295 - DNA, 17 bp, Homo sapiens
ggagtatttgaacacag

SEQ ID NO: 2864296 - DNA, 20 bp, Homo sapiens
ggagtgttccccttccactg

SEQ ID NO: 2864297 - DNA, 20 bp, Homo sapiens
ggatattttgaaatgaactt

SEQ ID NO: 2864298 - DNA, 21 bp, Homo sapiens
ggatattttgaaatgaacttt

SEQ ID NO: 2864299 - DNA, 19 bp, Homo sapiens
ggatccagagacttgggga

SEQ ID NO: 2864300 - DNA, 18 bp, Homo sapiens
ggatccatggggggagaa

SEQ ID NO: 2864301 - DNA, 22 bp, Homo sapiens
ggatccatggggggagaagtga

SEQ ID NO: 2864302 - DNA, 19 bp, Homo sapiens
ggatcccgttcagaaaacc

SEQ ID NO: 2864303 - DNA, 13 bp, Homo sapiens
ggatccctcatct

SEQ ID NO: 2864304 - DNA, 23 bp, Homo sapiens
ggatcctcagttctcaaatgtgt

SEQ ID NO: 2864305 - DNA, 21 bp, Homo sapiens
ggatgagaatttgagtgctct

SEQ ID NO: 2864306 - DNA, 19 bp, Homo sapiens
ggatgccaaggagcccctg

SEQ ID NO: 2864307 - DNA, 16 bp, Homo sapiens
ggcaagcttgaggcca

SEQ ID NO: 2864308 - DNA, 21 bp, Homo sapiens
ggcaaggtttacactgcggaa

SEQ ID NO: 2864309 - DNA, 11 bp, Homo sapiens
ggcaattagtg

SEQ ID NO: 2864310 - DNA, 15 bp, Homo sapiens
ggcacattaactgtt

SEQ ID NO: 2864311 - DNA, 21 bp, Homo sapiens
ggcacattaactgttgcactt

SEQ ID NO: 2864312 - DNA, 22 bp, Homo sapiens
ggcacattaactgttgcacttt

SEQ ID NO: 2864313 - DNA, 19 bp, Homo sapiens
ggcagaagcattgcctgga

SEQ ID NO: 2864314 - DNA, 20 bp, Homo sapiens
ggcagaagcattgcctggac

SEQ ID NO: 2864315 - DNA, 17 bp, Homo sapiens
ggcagagcaattccagg

SEQ ID NO: 2864316 - DNA, 19 bp, Homo sapiens
ggcagagcaattccaggct

SEQ ID NO: 2864317 - DNA, 23 bp, Homo sapiens
ggcagagcaattccaggctgagc

SEQ ID NO: 2864318 - DNA, 14 bp, Homo sapiens
ggcagcagtgtgag

SEQ ID NO: 2864319 - DNA, 20 bp, Homo sapiens
ggcagcagtgtgaggccagg

SEQ ID NO: 2864320 - DNA, 20 bp, Homo sapiens
ggcagctaagatagaaagct

SEQ ID NO: 2864321 - DNA, 21 bp, Homo sapiens
ggcagctaagatagaaagctg

SEQ ID NO: 2864322 - DNA, 16 bp, Homo sapiens
ggcaggggtgggagag

SEQ ID NO: 2864323 - DNA, 18 bp, Homo sapiens
ggcaggggtgggagagcc

SEQ ID NO: 2864324 - DNA, 17 bp, Homo sapiens
ggccaagatggctgctg

SEQ ID NO: 2864325 - DNA, 21 bp, Homo sapiens
ggccactctcccctccctctt

SEQ ID NO: 2864326 - DNA, 11 bp, Homo sapiens
ggccagaggct

SEQ ID NO: 2864327 - DNA, 13 bp, Homo sapiens
ggccagggcagag

SEQ ID NO: 2864328 - DNA, 18 bp, Homo sapiens
ggcccgaacagggacttg

SEQ ID NO: 2864329 - DNA, 22 bp, Homo sapiens
ggccctcgctgccagctctgta

SEQ ID NO: 2864330 - DNA, 20 bp, Homo sapiens
ggccctcggaggtccagctg

SEQ ID NO: 2864331 - DNA, 15 bp, Homo sapiens
ggccctctctgctct

SEQ ID NO: 2864332 - DNA, 19 bp, Homo sapiens
ggccctgcaaaaggactct

SEQ ID NO: 2864333 - DNA, 12 bp, Homo sapiens
ggcctctccagt

SEQ ID NO: 2864334 - DNA, 15 bp, Homo sapiens
ggcctgaccaggggg

SEQ ID NO: 2864335 - DNA, 23 bp, Homo sapiens
ggcctgcgtcttttttctcttcc

SEQ ID NO: 2864336 - DNA, 24 bp, Homo sapiens
ggcctgttgctatagagcctacct

SEQ ID NO: 2864337 - DNA, 20 bp, Homo sapiens
ggccttagggcactgggctg

SEQ ID NO: 2864338 - DNA, 13 bp, Homo sapiens
ggctagagccgag

SEQ ID NO: 2864339 - DNA, 21 bp, Homo sapiens
ggctagagccgaggggagaga

SEQ ID NO: 2864340 - DNA, 22 bp, Homo sapiens
ggctagagccgaggggagagag

SEQ ID NO: 2864341 - DNA, 17 bp, Homo sapiens
ggctcacccccttctcc

SEQ ID NO: 2864342 - DNA, 22 bp, Homo sapiens
ggctccagagggcactctgctt

SEQ ID NO: 2864343 - DNA, 13 bp, Homo sapiens
ggctgatgaagaa

SEQ ID NO: 2864344 - DNA, 19 bp, Homo sapiens
ggctgcccatcatgtggcc

SEQ ID NO: 2864345 - DNA, 20 bp, Homo sapiens
ggctgtgtttgcagcctgct

SEQ ID NO: 2864346 - DNA, 14 bp, Homo sapiens
ggcttctctctgtg

SEQ ID NO: 2864347 - DNA, 21 bp, Homo sapiens
ggcttgcccactgcctgcctc

SEQ ID NO: 2864348 - DNA, 15 bp, Homo sapiens
ggcttggggcttcct

SEQ ID NO: 2864349 - DNA, 15 bp, Homo sapiens
ggctttttctgccac

SEQ ID NO: 2864350 - DNA, 18 bp, Homo sapiens
gggaaaattatttgcata

SEQ ID NO: 2864351 - DNA, 22 bp, Homo sapiens
gggaagcttgagcctcccccaa

SEQ ID NO: 2864352 - DNA, 13 bp, Homo sapiens
gggaagtggggag

SEQ ID NO: 2864353 - DNA, 23 bp, Homo sapiens
gggacagagaggagttgccaggg

SEQ ID NO: 2864354 - DNA, 21 bp, Homo sapiens
gggacagcccagagcctggct

SEQ ID NO: 2864355 - DNA, 15 bp, Homo sapiens
gggagagccagctct

SEQ ID NO: 2864356 - DNA, 15 bp, Homo sapiens
gggagattgaacttt

SEQ ID NO: 2864357 - DNA, 14 bp, Homo sapiens
gggatattttgaaa

SEQ ID NO: 2864358 - DNA, 21 bp, Homo sapiens
gggcaagaacctaaagtagca

SEQ ID NO: 2864359 - DNA, 14 bp, Homo sapiens
gggcactgggctgt

SEQ ID NO: 2864360 - DNA, 14 bp, Homo sapiens
gggcagagcccaag

SEQ ID NO: 2864361 - DNA, 17 bp, Homo sapiens
tagaaaaataaaatgtt

SEQ ID NO: 2864362 - DNA, 18 bp, Homo sapiens
tagaaaaataaaatgttt

SEQ ID NO: 2864363 - DNA, 22 bp, Homo sapiens
tagaaaatttgttattttgcaa

SEQ ID NO: 2864364 - DNA, 23 bp, Homo sapiens
tagaaaatttgttattttgcaac

SEQ ID NO: 2864365 - DNA, 13 bp, Homo sapiens
tagaaagctggac

SEQ ID NO: 2864366 - DNA, 19 bp, Homo sapiens
tagaaagctggactgacca

SEQ ID NO: 2864367 - DNA, 17 bp, Homo sapiens
tagaactcactctgggc

SEQ ID NO: 2864368 - DNA, 20 bp, Homo sapiens
tagaactcactctgggctgt

SEQ ID NO: 2864369 - DNA, 22 bp, Homo sapiens
tagaactcagttttaactagaa

SEQ ID NO: 2864370 - DNA, 22 bp, Homo sapiens
tagaacttggatgtacctgccc

SEQ ID NO: 2864371 - DNA, 12 bp, Homo sapiens
tagaataattct

SEQ ID NO: 2864372 - DNA, 15 bp, Homo sapiens
tagaattcactgagt

SEQ ID NO: 2864373 - DNA, 22 bp, Homo sapiens
tagaattgggaagctgggggaa

SEQ ID NO: 2864374 - DNA, 15 bp, Homo sapiens
tagaatttattcaat

SEQ ID NO: 2864375 - DNA, 23 bp, Homo sapiens
tagaatttattcaattcctctgg

SEQ ID NO: 2864376 - DNA, 15 bp, Homo sapiens
tagactttctcagtg

SEQ ID NO: 2864377 - DNA, 14 bp, Homo sapiens
tagagaacaaagta

SEQ ID NO: 2864378 - DNA, 13 bp, Homo sapiens
tagagagcctgtc

SEQ ID NO: 2864379 - DNA, 14 bp, Homo sapiens
tagagagcctgtca

SEQ ID NO: 2864380 - DNA, 18 bp, Homo sapiens
tagagagcctgtcaccag

SEQ ID NO: 2864381 - DNA, 19 bp, Homo sapiens
tagagagcctgtcaccaga

SEQ ID NO: 2864382 - DNA, 17 bp, Homo sapiens
tagagattacctcctga

SEQ ID NO: 2864383 - DNA, 21 bp, Homo sapiens
tagagattacctcctgagaaa

SEQ ID NO: 2864384 - DNA, 17 bp, Homo sapiens
tagagccgaggggagag

SEQ ID NO: 2864385 - DNA, 14 bp, Homo sapiens
tagagcctgaggga

SEQ ID NO: 2864386 - DNA, 15 bp, Homo sapiens
tagagtgtctttcca

SEQ ID NO: 2864387 - DNA, 23 bp, Homo sapiens
tagcagaaggttgcacctccccc

SEQ ID NO: 2864388 - DNA, 18 bp, Homo sapiens
tagcagattttaattttg

SEQ ID NO: 2864389 - DNA, 20 bp, Homo sapiens
tagcagattttaattttgaa

SEQ ID NO: 2864390 - DNA, 21 bp, Homo sapiens
tagctccataaagtacaaatg

SEQ ID NO: 2864391 - DNA, 17 bp, Homo sapiens
tagctctctaggcctct

SEQ ID NO: 2864392 - DNA, 16 bp, Homo sapiens
tagctgaggctgagaa

SEQ ID NO: 2864393 - DNA, 16 bp, Homo sapiens
tagctgttgagctgtt

SEQ ID NO: 2864394 - DNA, 24 bp, Homo sapiens
taggaaacccaaggaacaagagaa

SEQ ID NO: 2864395 - DNA, 13 bp, Homo sapiens
tagggcactgggc

SEQ ID NO: 2864396 - DNA, 14 bp, Homo sapiens
tagggcactgggct

SEQ ID NO: 2864397 - DNA, 23 bp, Homo sapiens
tagggccaagcccagcactgctt

SEQ ID NO: 2864398 - DNA, 16 bp, Homo sapiens
tagggtggagagccac

SEQ ID NO: 2864399 - DNA, 17 bp, Homo sapiens
taggttccccaatccat

SEQ ID NO: 2864400 - DNA, 15 bp, Homo sapiens
taggtttcaggaagt

SEQ ID NO: 2864401 - DNA, 13 bp, Homo sapiens
tagtaaataaaca

SEQ ID NO: 2864402 - DNA, 16 bp, Homo sapiens
tagtaaatcagaaagt

SEQ ID NO: 2864403 - DNA, 20 bp, Homo sapiens
tagtagttaaataactgtgt

SEQ ID NO: 2864404 - DNA, 15 bp, Homo sapiens
tagtgacatttaatg

SEQ ID NO: 2864405 - DNA, 20 bp, Homo sapiens
tagtgtgacagtttccaaat

SEQ ID NO: 2864406 - DNA, 21 bp, Homo sapiens
tagtgtgacagtttccaaatt

SEQ ID NO: 2864407 - DNA, 14 bp, Homo sapiens
tagtgttaaagaga

SEQ ID NO: 2864408 - DNA, 17 bp, Homo sapiens
tagttactaaaattatg

SEQ ID NO: 2864409 - DNA, 12 bp, Homo sapiens
tataaagctgtt

SEQ ID NO: 2864410 - DNA, 17 bp, Homo sapiens
tataaagctgttattct

SEQ ID NO: 2864411 - DNA, 16 bp, Homo sapiens
tataaatgccagagcc

SEQ ID NO: 2864412 - DNA, 18 bp, Homo sapiens
tataaatgccagagccaa

SEQ ID NO: 2864413 - DNA, 22 bp, Homo sapiens
tataaatgccagagccaacctg

SEQ ID NO: 2864414 - DNA, 19 bp, Homo sapiens
tataatgttgataatatat

SEQ ID NO: 2864415 - DNA, 20 bp, Homo sapiens
tataatgttgataatatata

SEQ ID NO: 2864416 - DNA, 18 bp, Homo sapiens
tataatttttttcaatat

SEQ ID NO: 2864417 - DNA, 19 bp, Homo sapiens
tatacatcaatatgtatat

SEQ ID NO: 2864418 - DNA, 20 bp, Homo sapiens
tatacatcaatatgtatata

SEQ ID NO: 2864419 - DNA, 21 bp, Homo sapiens
tatacatcaatatgtatatat

SEQ ID NO: 2864420 - DNA, 19 bp, Homo sapiens
tataccagtataattgagt

SEQ ID NO: 2864421 - DNA, 20 bp, Homo sapiens
tatacgcagcgtgctttaaa

SEQ ID NO: 2864422 - DNA, 23 bp, Homo sapiens
tatagacttggagaatactgcca

SEQ ID NO: 2864423 - DNA, 14 bp, Homo sapiens
tatagcaactaatg

SEQ ID NO: 2864424 - DNA, 18 bp, Homo sapiens
tatagtgatgtaatcttg

SEQ ID NO: 2864425 - DNA, 15 bp, Homo sapiens
tatatcattatcttt

SEQ ID NO: 2864426 - DNA, 15 bp, Homo sapiens
tatatgtatttctat

SEQ ID NO: 2864427 - DNA, 15 bp, Homo sapiens
tatattaaataacat

SEQ ID NO: 2864428 - DNA, 18 bp, Homo sapiens
tatattaaataacatgtt

SEQ ID NO: 2864429 - DNA, 16 bp, Homo sapiens
tatatttttttaactg

SEQ ID NO: 2864430 - DNA, 19 bp, Homo sapiens
tatatttttttaactgtga

SEQ ID NO: 2864431 - DNA, 20 bp, Homo sapiens
tatatttttttaactgtgat

SEQ ID NO: 2864432 - DNA, 21 bp, Homo sapiens
tatcactgccttcgtttatat

SEQ ID NO: 2864433 - DNA, 15 bp, Homo sapiens
tatcagtaatgctaa

SEQ ID NO: 2864434 - DNA, 23 bp, Homo sapiens
tatcagtaatgctaaatgtgtaa

SEQ ID NO: 2864435 - DNA, 13 bp, Homo sapiens
tatcataaagcat

SEQ ID NO: 2864436 - DNA, 13 bp, Homo sapiens
tatcattaaaaat

SEQ ID NO: 2864437 - DNA, 16 bp, Homo sapiens
tatcattaaaaattac

SEQ ID NO: 2864438 - DNA, 18 bp, Homo sapiens
tatcattatctttgctgt

SEQ ID NO: 2864439 - DNA, 17 bp, Homo sapiens
tatccaaggaaacattt

SEQ ID NO: 2864440 - DNA, 21 bp, Homo sapiens
tatccaaggaaacattttatc

SEQ ID NO: 2864441 - DNA, 18 bp, Homo sapiens
tatccaggtaatccaaga

SEQ ID NO: 2864442 - DNA, 14 bp, Homo sapiens
tatcttctttggac

SEQ ID NO: 2864443 - DNA, 14 bp, Homo sapiens
tatctttgctgtta

SEQ ID NO: 2864444 - DNA, 14 bp, Homo sapiens
tatgacaaattcaa

SEQ ID NO: 2864445 - DNA, 16 bp, Homo sapiens
tatgacaaattcaaga

SEQ ID NO: 2864446 - DNA, 16 bp, Homo sapiens
tatgatgacaatcaaa

SEQ ID NO: 2864447 - DNA, 22 bp, Homo sapiens
tatgattagagggatgagacag

SEQ ID NO: 2864448 - DNA, 15 bp, Homo sapiens
tatgcaatgcttcat

SEQ ID NO: 2864449 - DNA, 16 bp, Homo sapiens
tatgcaattcagtgtt

SEQ ID NO: 2864450 - DNA, 19 bp, Homo sapiens
tatgcacttataattttcc

SEQ ID NO: 2864451 - DNA, 20 bp, Homo sapiens
tatgcacttttagaaatgca

SEQ ID NO: 2864452 - DNA, 15 bp, Homo sapiens
tatgctgatctttta

SEQ ID NO: 2864453 - DNA, 21 bp, Homo sapiens
tatgtcaataaacaacagctg

SEQ ID NO: 2864454 - DNA, 14 bp, Homo sapiens
tatgtgaaaaatta

SEQ ID NO: 2864455 - DNA, 16 bp, Homo sapiens
tatgtgaaaaattaac

SEQ ID NO: 2864456 - DNA, 14 bp, Homo sapiens
tattaaaaaacaat

SEQ ID NO: 2864457 - DNA, 22 bp, Homo sapiens
tattaaaaaacaattaactgcc

SEQ ID NO: 2864458 - DNA, 23 bp, Homo sapiens
tattaaataacatgtttctctat

SEQ ID NO: 2864459 - DNA, 22 bp, Homo sapiens
tattaagtgtgccaaatcagtt

SEQ ID NO: 2864460 - DNA, 13 bp, Homo sapiens
tattacctctgat

SEQ ID NO: 2864461 - DNA, 16 bp, Homo sapiens
tattactgaataatat

SEQ ID NO: 2864462 - DNA, 21 bp, Homo sapiens
tattactgaataatatcaaat

SEQ ID NO: 2864463 - DNA, 23 bp, Homo sapiens
tattactgaataatatcaaataa

SEQ ID NO: 2864464 - DNA, 15 bp, Homo sapiens
tattagagtgtcttt

SEQ ID NO: 2864465 - DNA, 17 bp, Homo sapiens
tattagataatattttt

SEQ ID NO: 2864466 - DNA, 17 bp, Homo sapiens
tattattagataatatt

SEQ ID NO: 2864467 - DNA, 17 bp, Homo sapiens
tattcaagaatgaaaaa

SEQ ID NO: 2864468 - DNA, 18 bp, Homo sapiens
tattcaattcctctggga

SEQ ID NO: 2864469 - DNA, 15 bp, Homo sapiens
tattcagtgtcactg

SEQ ID NO: 2864470 - DNA, 22 bp, Homo sapiens
tgggagttgatcgcctttccca

SEQ ID NO: 2864471 - DNA, 16 bp, Homo sapiens
tgggatggtggagggc

SEQ ID NO: 2864472 - DNA, 13 bp, Homo sapiens
tgggattagaaac

SEQ ID NO: 2864473 - DNA, 21 bp, Homo sapiens
tgggatttggggcctcaagaa

SEQ ID NO: 2864474 - DNA, 14 bp, Homo sapiens
tgggcagagcccaa

SEQ ID NO: 2864475 - DNA, 18 bp, Homo sapiens
tgggccactctcccctcc

SEQ ID NO: 2864476 - DNA, 20 bp, Homo sapiens
tgggccactctcccctccct

SEQ ID NO: 2864477 - DNA, 18 bp, Homo sapiens
tgggccctctctgctctg

SEQ ID NO: 2864478 - DNA, 13 bp, Homo sapiens
tgggccctttgag

SEQ ID NO: 2864479 - DNA, 14 bp, Homo sapiens
tgggcctcctgcct

SEQ ID NO: 2864480 - DNA, 11 bp, Homo sapiens
tgggctccctg

SEQ ID NO: 2864481 - DNA, 21 bp, Homo sapiens
tgggctgtgattactgcaatc

SEQ ID NO: 2864482 - DNA, 16 bp, Homo sapiens
tgggcttcattccgga

SEQ ID NO: 2864483 - DNA, 16 bp, Homo sapiens
tggggagccaacagaa

SEQ ID NO: 2864484 - DNA, 23 bp, Homo sapiens
tggggagggacaagggattctgg

SEQ ID NO: 2864485 - DNA, 14 bp, Homo sapiens
tggggcctcaagaa

SEQ ID NO: 2864486 - DNA, 17 bp, Homo sapiens
tggggctgatgaagaag

SEQ ID NO: 2864487 - DNA, 17 bp, Homo sapiens
tgggggagattgaactt

SEQ ID NO: 2864488 - DNA, 20 bp, Homo sapiens
tggggtcaagaaacagccag

SEQ ID NO: 2864489 - DNA, 18 bp, Homo sapiens
tgggtccatgggcagagc

SEQ ID NO: 2864490 - DNA, 16 bp, Homo sapiens
tgggttgttggtctgt

SEQ ID NO: 2864491 - DNA, 18 bp, Homo sapiens
tggtagaattgggaagct

SEQ ID NO: 2864492 - DNA, 15 bp, Homo sapiens
tggtcagccctaggg

SEQ ID NO: 2864493 - DNA, 13 bp, Homo sapiens
tggtcataaaata

SEQ ID NO: 2864494 - DNA, 12 bp, Homo sapiens
tggtccaggaga

SEQ ID NO: 2864495 - DNA, 18 bp, Homo sapiens
tggtctgagcaccccctc

SEQ ID NO: 2864496 - DNA, 20 bp, Homo sapiens
tggtctgagcaccccctcat

SEQ ID NO: 2864497 - DNA, 12 bp, Homo sapiens
tggtctgccaat

SEQ ID NO: 2864498 - DNA, 18 bp, Homo sapiens
tggtctgccaatctgtac

SEQ ID NO: 2864499 - DNA, 14 bp, Homo sapiens
tggtgaagggaagt

SEQ ID NO: 2864500 - DNA, 22 bp, Homo sapiens
tggtggaaaaaacattttaagt

SEQ ID NO: 2864501 - DNA, 13 bp, Homo sapiens
tggtggagggcca

SEQ ID NO: 2864502 - DNA, 16 bp, Homo sapiens
tggtgtggtgaatgtg

SEQ ID NO: 2864503 - DNA, 16 bp, Homo sapiens
tggttaccactctttt

SEQ ID NO: 2864504 - DNA, 18 bp, Homo sapiens
tggttattggactccagg

SEQ ID NO: 2864505 - DNA, 19 bp, Homo sapiens
tggttattggactccaggc

SEQ ID NO: 2864506 - DNA, 15 bp, Homo sapiens
tggttctaatagaac

SEQ ID NO: 2864507 - DNA, 15 bp, Homo sapiens
tgtaaactgtgcacc

SEQ ID NO: 2864508 - DNA, 13 bp, Homo sapiens
tgtaaataactct

SEQ ID NO: 2864509 - DNA, 13 bp, Homo sapiens
tgtaaatgaagat

SEQ ID NO: 2864510 - DNA, 22 bp, Homo sapiens
tgtaaatgaagatctttatatt

SEQ ID NO: 2864511 - DNA, 18 bp, Homo sapiens
tgtaacatccaagccaga

SEQ ID NO: 2864512 - DNA, 18 bp, Homo sapiens
tgtaaccagctcagtgtt

SEQ ID NO: 2864513 - DNA, 19 bp, Homo sapiens
tgtaacctcttcagaggcc

SEQ ID NO: 2864514 - DNA, 13 bp, Homo sapiens
tgtaataaacagg

SEQ ID NO: 2864515 - DNA, 17 bp, Homo sapiens
tgtaataatgtaacatg

SEQ ID NO: 2864516 - DNA, 21 bp, Homo sapiens
tgtaataatgtaacatgattt

SEQ ID NO: 2864517 - DNA, 22 bp, Homo sapiens
tgtaatcccagcactttgggag

SEQ ID NO: 2864518 - DNA, 22 bp, Homo sapiens
tgtaatcccagctacttgggag

SEQ ID NO: 2864519 - DNA, 16 bp, Homo sapiens
tgtaatctcaatgcaa

SEQ ID NO: 2864520 - DNA, 12 bp, Homo sapiens
tgtaatttcaaa

SEQ ID NO: 2864521 - DNA, 13 bp, Homo sapiens
tgtaatttcaaaa

SEQ ID NO: 2864522 - DNA, 14 bp, Homo sapiens
tgtaatttcaaaat

SEQ ID NO: 2864523 - DNA, 17 bp, Homo sapiens
tgtaatttcaaaataca

SEQ ID NO: 2864524 - DNA, 20 bp, Homo sapiens
tgtacaaaaattatgcaatt

SEQ ID NO: 2864525 - DNA, 21 bp, Homo sapiens
tgtacaaaaattatgcaattc

SEQ ID NO: 2864526 - DNA, 14 bp, Homo sapiens
tgtacaaaatggtc

SEQ ID NO: 2864527 - DNA, 22 bp, Homo sapiens
tgtactgaataggttccccaat

SEQ ID NO: 2864528 - DNA, 21 bp, Homo sapiens
tgtagaactcactctgggctg

SEQ ID NO: 2864529 - DNA, 15 bp, Homo sapiens
tgtagaactttatta

SEQ ID NO: 2864530 - DNA, 19 bp, Homo sapiens
tgtagaggcataaacctgt

SEQ ID NO: 2864531 - DNA, 19 bp, Homo sapiens
tgtataacagccttttcct

SEQ ID NO: 2864532 - DNA, 14 bp, Homo sapiens
tgtataatcacagt

SEQ ID NO: 2864533 - DNA, 15 bp, Homo sapiens
tgtatatgactgcat

SEQ ID NO: 2864534 - DNA, 17 bp, Homo sapiens
tgtatatgactgcattt

SEQ ID NO: 2864535 - DNA, 23 bp, Homo sapiens
tgtatcactgccttcgtttatat

SEQ ID NO: 2864536 - DNA, 21 bp, Homo sapiens
tgtatgggggagattgaactt

SEQ ID NO: 2864537 - DNA, 14 bp, Homo sapiens
tgtattaagccact

SEQ ID NO: 2864538 - DNA, 21 bp, Homo sapiens
tgtcacatctatccacactgt

SEQ ID NO: 2864539 - DNA, 13 bp, Homo sapiens
tgtcaccagagct

SEQ ID NO: 2864540 - DNA, 10 bp, Homo sapiens
tgtcagcatc

SEQ ID NO: 2864541 - DNA, 11 bp, Homo sapiens
tgtcagcatct

SEQ ID NO: 2864542 - DNA, 16 bp, Homo sapiens
tgtcagctgctgttga

SEQ ID NO: 2864543 - DNA, 18 bp, Homo sapiens
tgtcagctgctgttgaac

SEQ ID NO: 2864544 - DNA, 20 bp, Homo sapiens
tgtcagtaccttcaaactag

SEQ ID NO: 2864545 - DNA, 23 bp, Homo sapiens
tgtcagtgttgcctcttgcaatg

SEQ ID NO: 2864546 - DNA, 21 bp, Homo sapiens
tgtcatataaactcatttatc

SEQ ID NO: 2864547 - DNA, 17 bp, Homo sapiens
tgtccaaaatttatatt

SEQ ID NO: 2864548 - DNA, 16 bp, Homo sapiens
tgtccacgactgtctc

SEQ ID NO: 2864549 - DNA, 17 bp, Homo sapiens
tgtccacgactgtctcc

SEQ ID NO: 2864550 - DNA, 18 bp, Homo sapiens
tgtccacgactgtctcca

SEQ ID NO: 2864551 - DNA, 14 bp, Homo sapiens
tgtccattgtccaa

SEQ ID NO: 2864552 - DNA, 18 bp, Homo sapiens
tgtccccaccctccactc

SEQ ID NO: 2864553 - DNA, 12 bp, Homo sapiens
tgtccctccggg

SEQ ID NO: 2864554 - DNA, 17 bp, Homo sapiens
tgtccctctcactcccc

SEQ ID NO: 2864555 - DNA, 16 bp, Homo sapiens
tgtccttccctgccac

SEQ ID NO: 2864556 - DNA, 17 bp, Homo sapiens
tgtccttccctgccact

SEQ ID NO: 2864557 - DNA, 16 bp, Homo sapiens
tgtctcatccatcatc

SEQ ID NO: 2864558 - DNA, 15 bp, Homo sapiens
tgtctccatggccct

SEQ ID NO: 2864559 - DNA, 23 bp, Homo sapiens
tgtctctgggcttggggcttcct

SEQ ID NO: 2864560 - DNA, 21 bp, Homo sapiens
tgtcttatgtgaaaaattaac

SEQ ID NO: 2864561 - DNA, 17 bp, Homo sapiens
tgtgaaaaattaacttt

SEQ ID NO: 2864562 - DNA, 22 bp, Homo sapiens
tgtgaaaatggtccaggagaag

SEQ ID NO: 2864563 - DNA, 19 bp, Homo sapiens
tgtgaaacagttgctgtga

SEQ ID NO: 2864564 - DNA, 21 bp, Homo sapiens
tgtgaaacagttgctgtgaac

SEQ ID NO: 2864565 - DNA, 21 bp, Homo sapiens
tgtgaacgatttagaaagaag

SEQ ID NO: 2864566 - DNA, 15 bp, Homo sapiens
tgtgaagtttggaga

SEQ ID NO: 2864567 - DNA, 16 bp, Homo sapiens
tgtgacagtttccaaa

SEQ ID NO: 2864568 - DNA, 13 bp, Homo sapiens
tgtgacccaccag

SEQ ID NO: 2864569 - DNA, 14 bp, Homo sapiens
tgtgacccaccagt

SEQ ID NO: 2864570 - DNA, 12 bp, Homo sapiens
tgtgacttttta

SEQ ID NO: 2864571 - DNA, 14 bp, Homo sapiens
tgtgaggccagggc

SEQ ID NO: 2864572 - DNA, 22 bp, Homo sapiens
tgtgaggccagggcagagtgag

SEQ ID NO: 2864573 - DNA, 13 bp, Homo sapiens
tgtgatcgtctga

SEQ ID NO: 2864574 - DNA, 19 bp, Homo sapiens
tgtgcttcgggcccttccc

SEQ ID NO: 2864575 - DNA, 19 bp, Homo sapiens
tgtggcaattagtgtgaca

SEQ ID NO: 2864576 - DNA, 14 bp, Homo sapiens
tgtggtatgagggg

SEQ ID NO: 2864577 - DNA, 15 bp, Homo sapiens
tgtggtgaatgtgtg

SEQ ID NO: 2864578 - DNA, 21 bp, Homo sapiens
tgtgtaacatccaagccagag

SEQ ID NO: 2864579 - DNA, 14 bp, Homo sapiens
tgtgtaataatgta

SEQ ID NO: 2864580 - DNA, 21 bp, Homo sapiens
ttttgctttcgaactgctagt

SEQ ID NO: 2864581 - DNA, 15 bp, Homo sapiens
ttttgtataatcaca

SEQ ID NO: 2864582 - DNA, 16 bp, Homo sapiens
tttttcaatatttatt

SEQ ID NO: 2864583 - DNA, 13 bp, Homo sapiens
tttttcacttcta

SEQ ID NO: 2864584 - DNA, 18 bp, Homo sapiens
tttttccccctatcagtt

SEQ ID NO: 2864585 - DNA, 16 bp, Homo sapiens
aaaaacaattaactgc

SEQ ID NO: 2864586 - DNA, 19 bp, Homo sapiens
aaaaacaattaactgccct

SEQ ID NO: 2864587 - DNA, 21 bp, Homo sapiens
aaaaataaatttggttctaat

SEQ ID NO: 2864588 - DNA, 14 bp, Homo sapiens
aaaaatatgtaatt

SEQ ID NO: 2864589 - DNA, 19 bp, Homo sapiens
aaaaattacctttaatttt

SEQ ID NO: 2864590 - DNA, 15 bp, Homo sapiens
aaaacgtgtaaatga

SEQ ID NO: 2864591 - DNA, 20 bp, Homo sapiens
aaaagaaagatacttacatg

SEQ ID NO: 2864592 - DNA, 16 bp, Homo sapiens
aaaataaaatgtttca

SEQ ID NO: 2864593 - DNA, 16 bp, Homo sapiens
aaaatatcataaagca

SEQ ID NO: 2864594 - DNA, 14 bp, Homo sapiens
aaaatatgtaattt

SEQ ID NO: 2864595 - DNA, 17 bp, Homo sapiens
aaaatccccttcgctga

SEQ ID NO: 2864596 - DNA, 14 bp, Homo sapiens
aaaatgtatatgca

SEQ ID NO: 2864597 - DNA, 18 bp, Homo sapiens
aaaattacctttaatttt

SEQ ID NO: 2864598 - DNA, 19 bp, Homo sapiens
aaaattacctttaatttta

SEQ ID NO: 2864599 - DNA, 20 bp, Homo sapiens
aaaattacctttaattttaa

SEQ ID NO: 2864600 - DNA, 15 bp, Homo sapiens
aaaattatttgctat

SEQ ID NO: 2864601 - DNA, 15 bp, Homo sapiens
aaacaaaactcttaa

SEQ ID NO: 2864602 - DNA, 22 bp, Homo sapiens
aaacaacaatttctactttgaa

SEQ ID NO: 2864603 - DNA, 17 bp, Homo sapiens
aaacaactctttgagaa

SEQ ID NO: 2864604 - DNA, 22 bp, Homo sapiens
aaacaatggtgtggtgaatgtg

SEQ ID NO: 2864605 - DNA, 13 bp, Homo sapiens
aaacactatttgt

SEQ ID NO: 2864606 - DNA, 23 bp, Homo sapiens
aaacactatttgtgactttttaa

SEQ ID NO: 2864607 - DNA, 20 bp, Homo sapiens
aaacactccaccctccacct

SEQ ID NO: 2864608 - DNA, 14 bp, Homo sapiens
aaacagccagcaag

SEQ ID NO: 2864609 - DNA, 22 bp, Homo sapiens
aaacagttgctgtgaactttca

SEQ ID NO: 2864610 - DNA, 17 bp, Homo sapiens
aaacatgggctgtgatt

SEQ ID NO: 2864611 - DNA, 23 bp, Homo sapiens
aaacattttatcattaaaaatta

SEQ ID NO: 2864612 - DNA, 17 bp, Homo sapiens
aaaccagagtctgtatt

SEQ ID NO: 2864613 - DNA, 19 bp, Homo sapiens
aaaccagtgttagggaagg

SEQ ID NO: 2864614 - DNA, 13 bp, Homo sapiens
aaaccatgtagaa

SEQ ID NO: 2864615 - DNA, 14 bp, Homo sapiens
aaacccaaggaaca

SEQ ID NO: 2864616 - DNA, 18 bp, Homo sapiens
aaaccttattgtacctct

SEQ ID NO: 2864617 - DNA, 14 bp, Homo sapiens
aaactcatttatct

SEQ ID NO: 2864618 - DNA, 17 bp, Homo sapiens
acatctaacctcatctt

SEQ ID NO: 2864619 - DNA, 15 bp, Homo sapiens
acatctgtgtcttgt

SEQ ID NO: 2864620 - DNA, 15 bp, Homo sapiens
acatgaagattcttt

SEQ ID NO: 2864621 - DNA, 18 bp, Homo sapiens
acatgcaagtgagaagct

SEQ ID NO: 2864622 - DNA, 17 bp, Homo sapiens
acatgcatcatcagcct

SEQ ID NO: 2864623 - DNA, 20 bp, Homo sapiens
acatgggagccgggtctgcc

SEQ ID NO: 2864624 - DNA, 22 bp, Homo sapiens
acatggggcctggcccacgccc

SEQ ID NO: 2864625 - DNA, 17 bp, Homo sapiens
acatgtaggaagtagga

SEQ ID NO: 2864626 - DNA, 19 bp, Homo sapiens
acatgtcagtaccttcaaa

SEQ ID NO: 2864627 - DNA, 16 bp, Homo sapiens
acatgtttctctataa

SEQ ID NO: 2864628 - DNA, 19 bp, Homo sapiens
acattaactgttgcacttt

SEQ ID NO: 2864629 - DNA, 19 bp, Homo sapiens
acatttatattaaataaca

SEQ ID NO: 2864630 - DNA, 16 bp, Homo sapiens
acatttgtaagtgtaa

SEQ ID NO: 2864631 - DNA, 21 bp, Homo sapiens
acatttgtaagtgtaaaaaat

SEQ ID NO: 2864632 - DNA, 13 bp, Homo sapiens
acattttctaaat

SEQ ID NO: 2864633 - DNA, 14 bp, Homo sapiens
acattttctaaata

SEQ ID NO: 2864634 - DNA, 14 bp, Homo sapiens
accaaagactgcag

SEQ ID NO: 2864635 - DNA, 13 bp, Homo sapiens
accaagcaggaaa

SEQ ID NO: 2864636 - DNA, 14 bp, Homo sapiens
accaaggctgtgtt

SEQ ID NO: 2864637 - DNA, 16 bp, Homo sapiens
accaaggctgtgttta

SEQ ID NO: 2864638 - DNA, 13 bp, Homo sapiens
accaatgtcttga

SEQ ID NO: 2864639 - DNA, 19 bp, Homo sapiens
accaccttggactcctccc

SEQ ID NO: 2864640 - DNA, 20 bp, Homo sapiens
accaccttggactcctccca

SEQ ID NO: 2864641 - DNA, 21 bp, Homo sapiens
accaccttggactcctcccac

SEQ ID NO: 2864642 - DNA, 22 bp, Homo sapiens
accaccttggactcctcccaca

SEQ ID NO: 2864643 - DNA, 17 bp, Homo sapiens
accactttattgcaatg

SEQ ID NO: 2864644 - DNA, 15 bp, Homo sapiens
accagagcttctctg

SEQ ID NO: 2864645 - DNA, 22 bp, Homo sapiens
accagagtctgtatttttctaa

SEQ ID NO: 2864646 - DNA, 20 bp, Homo sapiens
accagcctggtcaacatggt

SEQ ID NO: 2864647 - DNA, 14 bp, Homo sapiens
accaggaaaggctt

SEQ ID NO: 2864648 - DNA, 12 bp, Homo sapiens
accaggccttca

SEQ ID NO: 2864649 - DNA, 21 bp, Homo sapiens
accaggccttcatcctcctcc

SEQ ID NO: 2864650 - DNA, 23 bp, Homo sapiens
accagggaagaagatcaacgcct

SEQ ID NO: 2864651 - DNA, 22 bp, Homo sapiens
accaggggtgctatgacatgca

SEQ ID NO: 2864652 - DNA, 20 bp, Homo sapiens
accagttaagaatggaagaa

SEQ ID NO: 2864653 - DNA, 14 bp, Homo sapiens
accatatgaatgaa

SEQ ID NO: 2864654 - DNA, 13 bp, Homo sapiens
accatcacacatg

SEQ ID NO: 2864655 - DNA, 14 bp, Homo sapiens
accatctgtgacta

SEQ ID NO: 2864656 - DNA, 15 bp, Homo sapiens
accatctgtgactat

SEQ ID NO: 2864657 - DNA, 22 bp, Homo sapiens
accatctgtgactataaagctg

SEQ ID NO: 2864658 - DNA, 17 bp, Homo sapiens
accatgtagaaaatttg

SEQ ID NO: 2864659 - DNA, 12 bp, Homo sapiens
acccacacatgt

SEQ ID NO: 2864660 - DNA, 15 bp, Homo sapiens
acccaccagtgcctt

SEQ ID NO: 2864661 - DNA, 15 bp, Homo sapiens
acccagccctcatcc

SEQ ID NO: 2864662 - DNA, 18 bp, Homo sapiens
accccctcattcccctcg

SEQ ID NO: 2864663 - DNA, 14 bp, Homo sapiens
acccctaagtgccc

SEQ ID NO: 2864664 - DNA, 15 bp, Homo sapiens
acccctaagtgccca

SEQ ID NO: 2864665 - DNA, 22 bp, Homo sapiens
accccttaccccaaagagaaag

SEQ ID NO: 2864666 - DNA, 15 bp, Homo sapiens
accccttcctttcct

SEQ ID NO: 2864667 - DNA, 24 bp, Homo sapiens
accccttcctttcctctgcagcac

SEQ ID NO: 2864668 - DNA, 19 bp, Homo sapiens
accctctttcttgtttgtc

SEQ ID NO: 2864669 - DNA, 21 bp, Homo sapiens
accctctttcttgtttgtcag

SEQ ID NO: 2864670 - DNA, 23 bp, Homo sapiens
accgggttctgcagcggcagagc

SEQ ID NO: 2864671 - DNA, 22 bp, Homo sapiens
acctactggtgtaatctcaatg

SEQ ID NO: 2864672 - DNA, 14 bp, Homo sapiens
acctcgctggactc

SEQ ID NO: 2864673 - DNA, 23 bp, Homo sapiens
acctctcttatagaatatttatt

SEQ ID NO: 2864674 - DNA, 14 bp, Homo sapiens
acctggacttcctg

SEQ ID NO: 2864675 - DNA, 18 bp, Homo sapiens
acctgtatatttctttta

SEQ ID NO: 2864676 - DNA, 23 bp, Homo sapiens
acctgtatgtcaataaacaacag

SEQ ID NO: 2864677 - DNA, 20 bp, Homo sapiens
acctgtccccaccctccact

SEQ ID NO: 2864678 - DNA, 18 bp, Homo sapiens
acctgtttttaagctgtt

SEQ ID NO: 2864679 - DNA, 19 bp, Homo sapiens
acctgtttttaagctgttt

SEQ ID NO: 2864680 - DNA, 20 bp, Homo sapiens
acctgtttttaagctgtttc

SEQ ID NO: 2864681 - DNA, 22 bp, Homo sapiens
accttaatttaactttccagtc

SEQ ID NO: 2864682 - DNA, 18 bp, Homo sapiens
accttattgtacctctct

SEQ ID NO: 2864683 - DNA, 20 bp, Homo sapiens
accttcacgattaactgtga

SEQ ID NO: 2864684 - DNA, 22 bp, Homo sapiens
accttcatgattatagcaacta

SEQ ID NO: 2864685 - DNA, 9 bp, Homo sapiens
accttcccc

SEQ ID NO: 2864686 - DNA, 20 bp, Homo sapiens
accttccccagactcagctc

SEQ ID NO: 2864687 - DNA, 13 bp, Homo sapiens
accttggactcct

SEQ ID NO: 2864688 - DNA, 22 bp, Homo sapiens
acctttgttttgcactgacaag

SEQ ID NO: 2864689 - DNA, 12 bp, Homo sapiens
acgacactgaag

SEQ ID NO: 2864690 - DNA, 19 bp, Homo sapiens
acgagctgtttactaggga

SEQ ID NO: 2864691 - DNA, 22 bp, Homo sapiens
acgcctcactgaaacatggctg

SEQ ID NO: 2864692 - DNA, 21 bp, Homo sapiens
acgcctgaggaacccttacag

SEQ ID NO: 2864693 - DNA, 22 bp, Homo sapiens
acgcttgtagaactcactctgg

SEQ ID NO: 2864694 - DNA, 19 bp, Homo sapiens
acggagccactcctctgac

SEQ ID NO: 2864695 - DNA, 20 bp, Homo sapiens
acggagccactcctctgact

SEQ ID NO: 2864696 - DNA, 15 bp, Homo sapiens
actaagaaacacatc

SEQ ID NO: 2864697 - DNA, 17 bp, Homo sapiens
actacctactggtgtaa

SEQ ID NO: 2864698 - DNA, 16 bp, Homo sapiens
actactactgttatca

SEQ ID NO: 2864699 - DNA, 13 bp, Homo sapiens
actactgcagcac

SEQ ID NO: 2864700 - DNA, 15 bp, Homo sapiens
actactgcagcacct

SEQ ID NO: 2864701 - DNA, 13 bp, Homo sapiens
actaggttctgta

SEQ ID NO: 2864702 - DNA, 14 bp, Homo sapiens
actataaagctgtt

SEQ ID NO: 2864703 - DNA, 13 bp, Homo sapiens
actatcttctttg

SEQ ID NO: 2864704 - DNA, 14 bp, Homo sapiens
actatgtaacatgt

SEQ ID NO: 2864705 - DNA, 11 bp, Homo sapiens
actatttgtga

SEQ ID NO: 2864706 - DNA, 19 bp, Homo sapiens
actatttgtgactttttaa

SEQ ID NO: 2864707 - DNA, 15 bp, Homo sapiens
actcaataaacagtc

SEQ ID NO: 2864708 - DNA, 14 bp, Homo sapiens
actcactctgggct

SEQ ID NO: 2864709 - DNA, 15 bp, Homo sapiens
actcactctgggctg

SEQ ID NO: 2864710 - DNA, 16 bp, Homo sapiens
actcactctgggctgt

SEQ ID NO: 2864711 - DNA, 22 bp, Homo sapiens
actcagctccagaataccttct

SEQ ID NO: 2864712 - DNA, 19 bp, Homo sapiens
actcagctgtcctgcagca

SEQ ID NO: 2864713 - DNA, 15 bp, Homo sapiens
actcattctgaagga

SEQ ID NO: 2864714 - DNA, 14 bp, Homo sapiens
actccactcccagc

SEQ ID NO: 2864715 - DNA, 16 bp, Homo sapiens
actccactcccagcag

SEQ ID NO: 2864716 - DNA, 16 bp, Homo sapiens
actccaggcctgacca

SEQ ID NO: 2864717 - DNA, 16 bp, Homo sapiens
actcccaaccctggct

SEQ ID NO: 2864718 - DNA, 16 bp, Homo sapiens
actcctcaggagagac

SEQ ID NO: 2864719 - DNA, 18 bp, Homo sapiens
actcctcaggagagaccc

SEQ ID NO: 2864720 - DNA, 13 bp, Homo sapiens
actcctcccacaa

SEQ ID NO: 2864721 - DNA, 18 bp, Homo sapiens
actctatagactctagga

SEQ ID NO: 2864722 - DNA, 16 bp, Homo sapiens
actctcagtctctgag

SEQ ID NO: 2864723 - DNA, 17 bp, Homo sapiens
actctcagtctctgagc

SEQ ID NO: 2864724 - DNA, 18 bp, Homo sapiens
actctcagtctctgagca

SEQ ID NO: 2864725 - DNA, 12 bp, Homo sapiens
actctcccagat

SEQ ID NO: 2864726 - DNA, 17 bp, Homo sapiens
actctcccctccctctt

SEQ ID NO: 2864727 - DNA, 23 bp, Homo sapiens
actctctgttttagtgtttatgt

SEQ ID NO: 2864728 - DNA, 17 bp, Homo sapiens
atacttacatgttccca

SEQ ID NO: 2864729 - DNA, 13 bp, Homo sapiens
atagaaagctgga

SEQ ID NO: 2864730 - DNA, 17 bp, Homo sapiens
atagaaagctggactga

SEQ ID NO: 2864731 - DNA, 20 bp, Homo sapiens
atagaaagctggactgacca

SEQ ID NO: 2864732 - DNA, 21 bp, Homo sapiens
atagaactcagttttaactag

SEQ ID NO: 2864733 - DNA, 12 bp, Homo sapiens
atagaatattta

SEQ ID NO: 2864734 - DNA, 16 bp, Homo sapiens
atagacctacagacct

SEQ ID NO: 2864735 - DNA, 20 bp, Homo sapiens
atagacctacagacctggct

SEQ ID NO: 2864736 - DNA, 20 bp, Homo sapiens
atagacttggagaatactgc

SEQ ID NO: 2864737 - DNA, 23 bp, Homo sapiens
atagacttggagaatactgccaa

SEQ ID NO: 2864738 - DNA, 13 bp, Homo sapiens
atagagcctgagg

SEQ ID NO: 2864739 - DNA, 23 bp, Homo sapiens
atagatcctggttaccactcttt

SEQ ID NO: 2864740 - DNA, 23 bp, Homo sapiens
atagcaactaatgtttgaacaaa

SEQ ID NO: 2864741 - DNA, 22 bp, Homo sapiens
atagcagattttaattttgaat

SEQ ID NO: 2864742 - DNA, 15 bp, Homo sapiens
atagggagaatattt

SEQ ID NO: 2864743 - DNA, 23 bp, Homo sapiens
atagggtctaccaatacaaaatg

SEQ ID NO: 2864744 - DNA, 18 bp, Homo sapiens
atagtagttaaataactg

SEQ ID NO: 2864745 - DNA, 20 bp, Homo sapiens
atagtgatgtaatcttgaat

SEQ ID NO: 2864746 - DNA, 20 bp, Homo sapiens
atagtgtcatataaactcat

SEQ ID NO: 2864747 - DNA, 19 bp, Homo sapiens
atataatgatcagcaaaaa

SEQ ID NO: 2864748 - DNA, 13 bp, Homo sapiens
atataatttaaag

SEQ ID NO: 2864749 - DNA, 12 bp, Homo sapiens
atatagacttgg

SEQ ID NO: 2864750 - DNA, 15 bp, Homo sapiens
atatagacttggaga

SEQ ID NO: 2864751 - DNA, 14 bp, Homo sapiens
atatatattaagtg

SEQ ID NO: 2864752 - DNA, 15 bp, Homo sapiens
atatatgtatttcta

SEQ ID NO: 2864753 - DNA, 14 bp, Homo sapiens
atatcataaagcat

SEQ ID NO: 2864754 - DNA, 16 bp, Homo sapiens
atatgctgatctttta

SEQ ID NO: 2864755 - DNA, 16 bp, Homo sapiens
atatggtgaagggaag

SEQ ID NO: 2864756 - DNA, 17 bp, Homo sapiens
atatggtgaagggaagt

SEQ ID NO: 2864757 - DNA, 24 bp, Homo sapiens
atatggtgaagggaagtggggagt

SEQ ID NO: 2864758 - DNA, 18 bp, Homo sapiens
atatgtctgccacagaga

SEQ ID NO: 2864759 - DNA, 13 bp, Homo sapiens
atattaaataaca

SEQ ID NO: 2864760 - DNA, 17 bp, Homo sapiens
atattaaataacatgtt

SEQ ID NO: 2864761 - DNA, 18 bp, Homo sapiens
atattaagtgtgccaaat

SEQ ID NO: 2864762 - DNA, 22 bp, Homo sapiens
atattaatttttgaaacccatt

SEQ ID NO: 2864763 - DNA, 17 bp, Homo sapiens
atattacccaatggaaa

SEQ ID NO: 2864764 - DNA, 22 bp, Homo sapiens
atattataatttttttcaatat

SEQ ID NO: 2864765 - DNA, 16 bp, Homo sapiens
atattgaaaaaataga

SEQ ID NO: 2864766 - DNA, 19 bp, Homo sapiens
atattgtaatctatgttta

SEQ ID NO: 2864767 - DNA, 18 bp, Homo sapiens
atatttactaactaaata

SEQ ID NO: 2864768 - DNA, 14 bp, Homo sapiens
atatttcaataaat

SEQ ID NO: 2864769 - DNA, 18 bp, Homo sapiens
atatttcaataaatgata

SEQ ID NO: 2864770 - DNA, 21 bp, Homo sapiens
atatttcaataaatgatatat

SEQ ID NO: 2864771 - DNA, 21 bp, Homo sapiens
atattttcaccatttgattat

SEQ ID NO: 2864772 - DNA, 16 bp, Homo sapiens
atatttttgtatttct

SEQ ID NO: 2864773 - DNA, 15 bp, Homo sapiens
atatttttttaactg

SEQ ID NO: 2864774 - DNA, 18 bp, Homo sapiens
atatttttttaactgtga

SEQ ID NO: 2864775 - DNA, 21 bp, Homo sapiens
atatttttttaactgtgataa

SEQ ID NO: 2864776 - DNA, 23 bp, Homo sapiens
atcaaagccggcctgagaaacac

SEQ ID NO: 2864777 - DNA, 24 bp, Homo sapiens
atcaaagccggcctgagaaacact

SEQ ID NO: 2864778 - DNA, 21 bp, Homo sapiens
atcaaataaaatatcataaag

SEQ ID NO: 2864779 - DNA, 22 bp, Homo sapiens
atcacagctcaagcattctgtt

SEQ ID NO: 2864780 - DNA, 19 bp, Homo sapiens
atcaccgtgggctccctga

SEQ ID NO: 2864781 - DNA, 22 bp, Homo sapiens
atcagaaagtaacaatctatgg

SEQ ID NO: 2864782 - DNA, 16 bp, Homo sapiens
atcaggacccagagga

SEQ ID NO: 2864783 - DNA, 20 bp, Homo sapiens
atcaggacccagaggaaggg

SEQ ID NO: 2864784 - DNA, 19 bp, Homo sapiens
atcagtaatgctaaatgtg

SEQ ID NO: 2864785 - DNA, 20 bp, Homo sapiens
atcagtaatgctaaatgtgt

SEQ ID NO: 2864786 - DNA, 21 bp, Homo sapiens
atcagtaatgctaaatgtgta

SEQ ID NO: 2864787 - DNA, 15 bp, Homo sapiens
atcagtgctccctca

SEQ ID NO: 2864788 - DNA, 14 bp, Homo sapiens
atcataaagcattt

SEQ ID NO: 2864789 - DNA, 18 bp, Homo sapiens
atcatcatgtgtgtccac

SEQ ID NO: 2864790 - DNA, 20 bp, Homo sapiens
atcatgaggccggatgaaac

SEQ ID NO: 2864791 - DNA, 14 bp, Homo sapiens
atcattaaaaatta

SEQ ID NO: 2864792 - DNA, 16 bp, Homo sapiens
atcattctctgtctca

SEQ ID NO: 2864793 - DNA, 24 bp, Homo sapiens
atcattctctgtctcatccatcat

SEQ ID NO: 2864794 - DNA, 14 bp, Homo sapiens
atccaagccagagt

SEQ ID NO: 2864795 - DNA, 18 bp, Homo sapiens
atccaaggaaacatttta

SEQ ID NO: 2864796 - DNA, 15 bp, Homo sapiens
atccagctatgttat

SEQ ID NO: 2864797 - DNA, 14 bp, Homo sapiens
atccaggtaatcca

SEQ ID NO: 2864798 - DNA, 20 bp, Homo sapiens
atccatcgtattaaaaaaca

SEQ ID NO: 2864799 - DNA, 13 bp, Homo sapiens
atccatgggggga

SEQ ID NO: 2864800 - DNA, 15 bp, Homo sapiens
atccatggggggaga

SEQ ID NO: 2864801 - DNA, 16 bp, Homo sapiens
atccattaggccagca

SEQ ID NO: 2864802 - DNA, 19 bp, Homo sapiens
atccattaggccagcaacg

SEQ ID NO: 2864803 - DNA, 23 bp, Homo sapiens
atccatttggacaaaatggaagg

SEQ ID NO: 2864804 - DNA, 20 bp, Homo sapiens
atcccctttcctccccacct

SEQ ID NO: 2864805 - DNA, 13 bp, Homo sapiens
atccctcatctgt

SEQ ID NO: 2864806 - DNA, 17 bp, Homo sapiens
atccctcatctgtccct

SEQ ID NO: 2864807 - DNA, 21 bp, Homo sapiens
atccctctacagagcttccct

SEQ ID NO: 2864808 - DNA, 23 bp, Homo sapiens
atccctctacagagcttccctga

SEQ ID NO: 2864809 - DNA, 20 bp, Homo sapiens
atcctatgtttttgttcaaa

SEQ ID NO: 2864810 - DNA, 12 bp, Homo sapiens
atcctcaatcca

SEQ ID NO: 2864811 - DNA, 19 bp, Homo sapiens
atcctcctccccagctctt

SEQ ID NO: 2864812 - DNA, 23 bp, Homo sapiens
atcctcctccccagctcttctct

SEQ ID NO: 2864813 - DNA, 23 bp, Homo sapiens
atcctcttttaatggcatttctc

SEQ ID NO: 2864814 - DNA, 22 bp, Homo sapiens
atcctggacatgaagattcttt

SEQ ID NO: 2864815 - DNA, 19 bp, Homo sapiens
atcctggttaccactcttt

SEQ ID NO: 2864816 - DNA, 21 bp, Homo sapiens
atccttgagattctgaagtat

SEQ ID NO: 2864817 - DNA, 17 bp, Homo sapiens
atcggcagatgatgctt

SEQ ID NO: 2864818 - DNA, 19 bp, Homo sapiens
atcgtattaaaaaacaatt

SEQ ID NO: 2864819 - DNA, 15 bp, Homo sapiens
atctaacctcatctt

SEQ ID NO: 2864820 - DNA, 19 bp, Homo sapiens
atctatccacactgtcaaa

SEQ ID NO: 2864821 - DNA, 16 bp, Homo sapiens
atctcagtggtgtgtg

SEQ ID NO: 2864822 - DNA, 15 bp, Homo sapiens
atctcattggaccct

SEQ ID NO: 2864823 - DNA, 20 bp, Homo sapiens
atctcattggacccttccat

SEQ ID NO: 2864824 - DNA, 20 bp, Homo sapiens
atctcccagataatgtgaaa

SEQ ID NO: 2864825 - DNA, 19 bp, Homo sapiens
atctctttttgctttcgaa

SEQ ID NO: 2864826 - DNA, 14 bp, Homo sapiens
atctgaccatctgt

SEQ ID NO: 2864827 - DNA, 16 bp, Homo sapiens
atctgaccatctgtga

SEQ ID NO: 2864828 - DNA, 12 bp, Homo sapiens
atctggcttttt

SEQ ID NO: 2864829 - DNA, 14 bp, Homo sapiens
atctgggactttca

SEQ ID NO: 2864830 - DNA, 16 bp, Homo sapiens
atctggttagataatg

SEQ ID NO: 2864831 - DNA, 13 bp, Homo sapiens
atctgtgtcttgt

SEQ ID NO: 2864832 - DNA, 20 bp, Homo sapiens
atctgttgacaaatgacaga

SEQ ID NO: 2864833 - DNA, 14 bp, Homo sapiens
atcttcttcaccat

SEQ ID NO: 2864834 - DNA, 16 bp, Homo sapiens
atcttgaattgtaact

SEQ ID NO: 2864835 - DNA, 17 bp, Homo sapiens
atcttgactacagtcag

SEQ ID NO: 2864836 - DNA, 21 bp, Homo sapiens
atctttgctgttattgacagc

SEQ ID NO: 2864837 - DNA, 13 bp, Homo sapiens
cagctcttctctt

SEQ ID NO: 2864838 - DNA, 17 bp, Homo sapiens
cagctcttctcttccta

SEQ ID NO: 2864839 - DNA, 21 bp, Homo sapiens
cagctcttctcttcctagatc

SEQ ID NO: 2864840 - DNA, 14 bp, Homo sapiens
cagctctttccaaa

SEQ ID NO: 2864841 - DNA, 16 bp, Homo sapiens
cagctctttccaaatt

SEQ ID NO: 2864842 - DNA, 19 bp, Homo sapiens
cagctctttccaaattaaa

SEQ ID NO: 2864843 - DNA, 20 bp, Homo sapiens
cagctgggcctcctgcctcc

SEQ ID NO: 2864844 - DNA, 21 bp, Homo sapiens
cagctgggcctcctgcctccg

SEQ ID NO: 2864845 - DNA, 22 bp, Homo sapiens
cagctgggcctcctgcctccgg

SEQ ID NO: 2864846 - DNA, 17 bp, Homo sapiens
cagcttgttatttataa

SEQ ID NO: 2864847 - DNA, 19 bp, Homo sapiens
caggaaaggaatcatttct

SEQ ID NO: 2864848 - DNA, 21 bp, Homo sapiens
caggaaatgaaaatgtcttgt

SEQ ID NO: 2864849 - DNA, 19 bp, Homo sapiens
caggaaggatggcaagcac

SEQ ID NO: 2864850 - DNA, 23 bp, Homo sapiens
caggaagttgccatgggaaacaa

SEQ ID NO: 2864851 - DNA, 13 bp, Homo sapiens
caggacaggagac

SEQ ID NO: 2864852 - DNA, 12 bp, Homo sapiens
caggacatttct

SEQ ID NO: 2864853 - DNA, 14 bp, Homo sapiens
caggacatttctct

SEQ ID NO: 2864854 - DNA, 14 bp, Homo sapiens
caggacccagagga

SEQ ID NO: 2864855 - DNA, 12 bp, Homo sapiens
caggagagaccc

SEQ ID NO: 2864856 - DNA, 14 bp, Homo sapiens
caggagagacccct

SEQ ID NO: 2864857 - DNA, 16 bp, Homo sapiens
caggagagacccctcc

SEQ ID NO: 2864858 - DNA, 20 bp, Homo sapiens
caggagagacccctcccctc

SEQ ID NO: 2864859 - DNA, 22 bp, Homo sapiens
caggagtaagacaagtgggatt

SEQ ID NO: 2864860 - DNA, 23 bp, Homo sapiens
caggataagaaagcctaaaattg

SEQ ID NO: 2864861 - DNA, 23 bp, Homo sapiens
caggcactgagataccagcgagg

SEQ ID NO: 2864862 - DNA, 20 bp, Homo sapiens
caggcccgagatgtgaccca

SEQ ID NO: 2864863 - DNA, 14 bp, Homo sapiens
caggcctgaccagg

SEQ ID NO: 2864864 - DNA, 23 bp, Homo sapiens
caggcctgttgctatagagccta

SEQ ID NO: 2864865 - DNA, 16 bp, Homo sapiens
cagggacttgtttaga

SEQ ID NO: 2864866 - DNA, 19 bp, Homo sapiens
cagggcagagtgagaccca

SEQ ID NO: 2864867 - DNA, 16 bp, Homo sapiens
cagggctaccctgagc

SEQ ID NO: 2864868 - DNA, 23 bp, Homo sapiens
cagggctaccctgagctgaggca

SEQ ID NO: 2864869 - DNA, 22 bp, Homo sapiens
cagggggcccgaacagggactt

SEQ ID NO: 2864870 - DNA, 19 bp, Homo sapiens
cagggtgggccactctccc

SEQ ID NO: 2864871 - DNA, 17 bp, Homo sapiens
caggtctagactttctc

SEQ ID NO: 2864872 - DNA, 23 bp, Homo sapiens
caggtggggagactgggctgagg

SEQ ID NO: 2864873 - DNA, 20 bp, Homo sapiens
caggttagtgacatttaatg

SEQ ID NO: 2864874 - DNA, 18 bp, Homo sapiens
cagtaatgctaaatgtgt

SEQ ID NO: 2864875 - DNA, 22 bp, Homo sapiens
cagtatgcaaagcaatctttta

SEQ ID NO: 2864876 - DNA, 15 bp, Homo sapiens
cagtcaacctgggca

SEQ ID NO: 2864877 - DNA, 16 bp, Homo sapiens
cagtcaacctgggcaa

SEQ ID NO: 2864878 - DNA, 13 bp, Homo sapiens
cagtccacaaaat

SEQ ID NO: 2864879 - DNA, 14 bp, Homo sapiens
cagtcctaacaaat

SEQ ID NO: 2864880 - DNA, 14 bp, Homo sapiens
cagtcgggaggagc

SEQ ID NO: 2864881 - DNA, 15 bp, Homo sapiens
cagtcttccatttgc

SEQ ID NO: 2864882 - DNA, 17 bp, Homo sapiens
cagtgaatgattcagtg

SEQ ID NO: 2864883 - DNA, 16 bp, Homo sapiens
cagtgctataaatgcc

SEQ ID NO: 2864884 - DNA, 20 bp, Homo sapiens
cagtgggacaaaccagagca

SEQ ID NO: 2864885 - DNA, 22 bp, Homo sapiens
cagtgggacaaaccagagcaga

SEQ ID NO: 2864886 - DNA, 15 bp, Homo sapiens
cagtggggcagtcat

SEQ ID NO: 2864887 - DNA, 23 bp, Homo sapiens
cagtggtgtgtgaagtttggaga

SEQ ID NO: 2864888 - DNA, 16 bp, Homo sapiens
cagtgtgaggccaggg

SEQ ID NO: 2864889 - DNA, 14 bp, Homo sapiens
cagtgttaaatgtg

SEQ ID NO: 2864890 - DNA, 22 bp, Homo sapiens
cagtgttccaagtctctgtgta

SEQ ID NO: 2864891 - DNA, 16 bp, Homo sapiens
cagttaaaaaaaattt

SEQ ID NO: 2864892 - DNA, 23 bp, Homo sapiens
cagttgtcttatgtgaaaaatta

SEQ ID NO: 2864893 - DNA, 13 bp, Homo sapiens
cagtttccaaatt

SEQ ID NO: 2864894 - DNA, 18 bp, Homo sapiens
cagtttgcacctgtcccc

SEQ ID NO: 2864895 - DNA, 16 bp, Homo sapiens
cagttttaactagaat

SEQ ID NO: 2864896 - DNA, 16 bp, Homo sapiens
cagttttcggaaacac

SEQ ID NO: 2864897 - DNA, 18 bp, Homo sapiens
cagttttcggaaacactg

SEQ ID NO: 2864898 - DNA, 13 bp, Homo sapiens
cagtttttcactt

SEQ ID NO: 2864899 - DNA, 14 bp, Homo sapiens
cagtttttgacatt

SEQ ID NO: 2864900 - DNA, 21 bp, Homo sapiens
cataaaatagaataattcttt

SEQ ID NO: 2864901 - DNA, 14 bp, Homo sapiens
cataacaattcctc

SEQ ID NO: 2864902 - DNA, 16 bp, Homo sapiens
cataacttctcatgta

SEQ ID NO: 2864903 - DNA, 16 bp, Homo sapiens
catacaagaaaatgta

SEQ ID NO: 2864904 - DNA, 17 bp, Homo sapiens
catacaagaaaatgtat

SEQ ID NO: 2864905 - DNA, 22 bp, Homo sapiens
catagaccctctttcttgtttg

SEQ ID NO: 2864906 - DNA, 20 bp, Homo sapiens
catagacctacagacctggc

SEQ ID NO: 2864907 - DNA, 17 bp, Homo sapiens
catagagaacaaagtaa

SEQ ID NO: 2864908 - DNA, 16 bp, Homo sapiens
catagcagattttaat

SEQ ID NO: 2864909 - DNA, 12 bp, Homo sapiens
catatgaatgaa

SEQ ID NO: 2864910 - DNA, 13 bp, Homo sapiens
catattgtaatct

SEQ ID NO: 2864911 - DNA, 14 bp, Homo sapiens
catattgtaatcta

SEQ ID NO: 2864912 - DNA, 22 bp, Homo sapiens
catattgtaatctatgtttata

SEQ ID NO: 2864913 - DNA, 15 bp, Homo sapiens
catatttgatttcta

SEQ ID NO: 2864914 - DNA, 21 bp, Homo sapiens
catatttgatttctaattgta

SEQ ID NO: 2864915 - DNA, 19 bp, Homo sapiens
catatttgtatgtttttct

SEQ ID NO: 2864916 - DNA, 23 bp, Homo sapiens
catatttgtatgtttttctgtat

SEQ ID NO: 2864917 - DNA, 15 bp, Homo sapiens
catattttaaattct

SEQ ID NO: 2864918 - DNA, 14 bp, Homo sapiens
catcaatatgtata

SEQ ID NO: 2864919 - DNA, 12 bp, Homo sapiens
catcagggtggg

SEQ ID NO: 2864920 - DNA, 15 bp, Homo sapiens
catcagtgctccctc

SEQ ID NO: 2864921 - DNA, 16 bp, Homo sapiens
catcagtgctccctca

SEQ ID NO: 2864922 - DNA, 14 bp, Homo sapiens
catcattctctgtc

SEQ ID NO: 2864923 - DNA, 15 bp, Homo sapiens
catcattctctgtct

SEQ ID NO: 2864924 - DNA, 21 bp, Homo sapiens
catcattctctgtctcatcca

SEQ ID NO: 2864925 - DNA, 22 bp, Homo sapiens
catcattctctgtctcatccat

SEQ ID NO: 2864926 - DNA, 14 bp, Homo sapiens
catccaagccagag

SEQ ID NO: 2864927 - DNA, 13 bp, Homo sapiens
catccatcatcat

SEQ ID NO: 2864928 - DNA, 14 bp, Homo sapiens
catccatcatcatg

SEQ ID NO: 2864929 - DNA, 13 bp, Homo sapiens
catcccctttcct

SEQ ID NO: 2864930 - DNA, 17 bp, Homo sapiens
catcccctttcctcccc

SEQ ID NO: 2864931 - DNA, 19 bp, Homo sapiens
catcccctttcctccccac

SEQ ID NO: 2864932 - DNA, 19 bp, Homo sapiens
catccttgagattctgaag

SEQ ID NO: 2864933 - DNA, 23 bp, Homo sapiens
catcgtattaaaaaacaattaac

SEQ ID NO: 2864934 - DNA, 19 bp, Homo sapiens
catctatccacactgtcaa

SEQ ID NO: 2864935 - DNA, 18 bp, Homo sapiens
catctcccagataatgtg

SEQ ID NO: 2864936 - DNA, 19 bp, Homo sapiens
catctcctgccttcctcct

SEQ ID NO: 2864937 - DNA, 14 bp, Homo sapiens
catctgaccatctg

SEQ ID NO: 2864938 - DNA, 19 bp, Homo sapiens
catctggctttttctgcca

SEQ ID NO: 2864939 - DNA, 22 bp, Homo sapiens
catctggctttttctgccactg

SEQ ID NO: 2864940 - DNA, 15 bp, Homo sapiens
catcttcaatatgaa

SEQ ID NO: 2864941 - DNA, 16 bp, Homo sapiens
catcttcaatatgaat

SEQ ID NO: 2864942 - DNA, 19 bp, Homo sapiens
catcttcaatatgaatcta

SEQ ID NO: 2864943 - DNA, 17 bp, Homo sapiens
catgaggagcgtggact

SEQ ID NO: 2864944 - DNA, 19 bp, Homo sapiens
catgaggagcgtggactct

SEQ ID NO: 2864945 - DNA, 15 bp, Homo sapiens
catgcatcatcagcc

SEQ ID NO: 2864946 - DNA, 14 bp, Homo sapiens
catgcctgatgaaa

SEQ ID NO: 2864947 - DNA, 18 bp, Homo sapiens
ctcaggagagacccctcc

SEQ ID NO: 2864948 - DNA, 19 bp, Homo sapiens
ctcaggagagacccctccc

SEQ ID NO: 2864949 - DNA, 20 bp, Homo sapiens
ctcaggagagacccctcccc

SEQ ID NO: 2864950 - DNA, 13 bp, Homo sapiens
ctcagggctcctg

SEQ ID NO: 2864951 - DNA, 14 bp, Homo sapiens
ctcagggctcctgg

SEQ ID NO: 2864952 - DNA, 22 bp, Homo sapiens
ctcagtgggacaaaccagagca

SEQ ID NO: 2864953 - DNA, 20 bp, Homo sapiens
ctcagtggtgtgtgaagttt

SEQ ID NO: 2864954 - DNA, 17 bp, Homo sapiens
ctcagttctcaaatgtg

SEQ ID NO: 2864955 - DNA, 14 bp, Homo sapiens
ctcatcattctctg

SEQ ID NO: 2864956 - DNA, 15 bp, Homo sapiens
ctcatcattctctgt

SEQ ID NO: 2864957 - DNA, 17 bp, Homo sapiens
ctcatcattctctgtct

SEQ ID NO: 2864958 - DNA, 15 bp, Homo sapiens
ctcatctgtccctcc

SEQ ID NO: 2864959 - DNA, 17 bp, Homo sapiens
ctcatctgtccctccgg

SEQ ID NO: 2864960 - DNA, 13 bp, Homo sapiens
ctcattggaccct

SEQ ID NO: 2864961 - DNA, 13 bp, Homo sapiens
ctccacatcctcc

SEQ ID NO: 2864962 - DNA, 15 bp, Homo sapiens
ctccacatcctccac

SEQ ID NO: 2864963 - DNA, 17 bp, Homo sapiens
ctccacatcctccacgt

SEQ ID NO: 2864964 - DNA, 14 bp, Homo sapiens
ctccaccctccacc

SEQ ID NO: 2864965 - DNA, 18 bp, Homo sapiens
ctccacgttctgctcatc

SEQ ID NO: 2864966 - DNA, 13 bp, Homo sapiens
ctccagcccctgt

SEQ ID NO: 2864967 - DNA, 16 bp, Homo sapiens
ctccagcccctgtccc

SEQ ID NO: 2864968 - DNA, 17 bp, Homo sapiens
ctccagcccctgtccca

SEQ ID NO: 2864969 - DNA, 10 bp, Homo sapiens
ctccaggcct

SEQ ID NO: 2864970 - DNA, 17 bp, Homo sapiens
ctccaggcctgaccagg

SEQ ID NO: 2864971 - DNA, 19 bp, Homo sapiens
ctccaggcctgaccagggg

SEQ ID NO: 2864972 - DNA, 20 bp, Homo sapiens
ctccaggcctgttgctatag

SEQ ID NO: 2864973 - DNA, 19 bp, Homo sapiens
ctccataaagtacaaatga

SEQ ID NO: 2864974 - DNA, 20 bp, Homo sapiens
ctccatatttgatttctaat

SEQ ID NO: 2864975 - DNA, 20 bp, Homo sapiens
ctccatccacatgggagccg

SEQ ID NO: 2864976 - DNA, 14 bp, Homo sapiens
ctcccacaatctgg

SEQ ID NO: 2864977 - DNA, 13 bp, Homo sapiens
ctcccacccacag

SEQ ID NO: 2864978 - DNA, 22 bp, Homo sapiens
ctcccagatttttactttttcc

SEQ ID NO: 2864979 - DNA, 17 bp, Homo sapiens
ctcccagcagctcaacc

SEQ ID NO: 2864980 - DNA, 12 bp, Homo sapiens
ctcccaggcccg

SEQ ID NO: 2864981 - DNA, 17 bp, Homo sapiens
ctccccaccttccccag

SEQ ID NO: 2864982 - DNA, 16 bp, Homo sapiens
ctccccagccccaccc

SEQ ID NO: 2864983 - DNA, 17 bp, Homo sapiens
ctccccagctcttctct

SEQ ID NO: 2864984 - DNA, 13 bp, Homo sapiens
ctcccctcccacc

SEQ ID NO: 2864985 - DNA, 20 bp, Homo sapiens
ctcccctcccacccacagcc

SEQ ID NO: 2864986 - DNA, 16 bp, Homo sapiens
ctcccctccctcttcc

SEQ ID NO: 2864987 - DNA, 20 bp, Homo sapiens
ctcccctccctcttccttcc

SEQ ID NO: 2864988 - DNA, 12 bp, Homo sapiens
ctccctcttcct

SEQ ID NO: 2864989 - DNA, 12 bp, Homo sapiens
ctccgctgggct

SEQ ID NO: 2864990 - DNA, 15 bp, Homo sapiens
ctcctccagcccctg

SEQ ID NO: 2864991 - DNA, 13 bp, Homo sapiens
ctcctccccagct

SEQ ID NO: 2864992 - DNA, 18 bp, Homo sapiens
ctcctctgactcagggct

SEQ ID NO: 2864993 - DNA, 22 bp, Homo sapiens
ctcctctgtgaccaatgtcttg

SEQ ID NO: 2864994 - DNA, 23 bp, Homo sapiens
ctcctctgtgaccaatgtcttga

SEQ ID NO: 2864995 - DNA, 19 bp, Homo sapiens
ctcctgccttcctcctggg

SEQ ID NO: 2864996 - DNA, 17 bp, Homo sapiens
ctcctgggccctctctg

SEQ ID NO: 2864997 - DNA, 19 bp, Homo sapiens
ctcctgggccctctctgct

SEQ ID NO: 2864998 - DNA, 22 bp, Homo sapiens
ctcctgggttttgtattctctg

SEQ ID NO: 2864999 - DNA, 23 bp, Homo sapiens
ctcctgggttttgtattctctga

SEQ ID NO: 2865000 - DNA, 12 bp, Homo sapiens
ctccttgggccc

SEQ ID NO: 2865001 - DNA, 16 bp, Homo sapiens
ctccttgggccctttg

SEQ ID NO: 2865002 - DNA, 19 bp, Homo sapiens
ctcgctgccagctctgtat

SEQ ID NO: 2865003 - DNA, 15 bp, Homo sapiens
ctcgctggactctca

SEQ ID NO: 2865004 - DNA, 21 bp, Homo sapiens
ctcggaggtccagctgggcct

SEQ ID NO: 2865005 - DNA, 18 bp, Homo sapiens
ctctacagagcttccctg

SEQ ID NO: 2865006 - DNA, 22 bp, Homo sapiens
ctctacagagcttccctgactc

SEQ ID NO: 2865007 - DNA, 21 bp, Homo sapiens
ctctacccggcccagagaccc

SEQ ID NO: 2865008 - DNA, 22 bp, Homo sapiens
ctctacctgacactcccttggg

SEQ ID NO: 2865009 - DNA, 16 bp, Homo sapiens
ctctaggcctctccag

SEQ ID NO: 2865010 - DNA, 13 bp, Homo sapiens
ctctcagtctctg

SEQ ID NO: 2865011 - DNA, 13 bp, Homo sapiens
ctctcccaggccc

SEQ ID NO: 2865012 - DNA, 20 bp, Homo sapiens
ctctctacccggcccagaga

SEQ ID NO: 2865013 - DNA, 19 bp, Homo sapiens
ctctctaggcctctccagt

SEQ ID NO: 2865014 - DNA, 19 bp, Homo sapiens
ctctcttatagaatattta

SEQ ID NO: 2865015 - DNA, 12 bp, Homo sapiens
ctctgaaaccag

SEQ ID NO: 2865016 - DNA, 16 bp, Homo sapiens
ctctgactcagggctc

SEQ ID NO: 2865017 - DNA, 17 bp, Homo sapiens
ctctgactcagggctcc

SEQ ID NO: 2865018 - DNA, 22 bp, Homo sapiens
ctctgcgtgtcacctgtgcttc

SEQ ID NO: 2865019 - DNA, 23 bp, Homo sapiens
ctctgctagactcctcaggagag

SEQ ID NO: 2865020 - DNA, 13 bp, Homo sapiens
ctctgctctgcgt

SEQ ID NO: 2865021 - DNA, 13 bp, Homo sapiens
ctctggccctggc

SEQ ID NO: 2865022 - DNA, 14 bp, Homo sapiens
ctctggccctggcc

SEQ ID NO: 2865023 - DNA, 18 bp, Homo sapiens
ctctggctagagccgagg

SEQ ID NO: 2865024 - DNA, 22 bp, Homo sapiens
ctctggctagagccgaggggag

SEQ ID NO: 2865025 - DNA, 23 bp, Homo sapiens
ctctgggctgtaacgtggcactg

SEQ ID NO: 2865026 - DNA, 14 bp, Homo sapiens
ctctgtctcatcca

SEQ ID NO: 2865027 - DNA, 15 bp, Homo sapiens
ctctgtctcatccat

SEQ ID NO: 2865028 - DNA, 15 bp, Homo sapiens
ctctgtgaccaatgt

SEQ ID NO: 2865029 - DNA, 21 bp, Homo sapiens
ctcttaagtcctaaaagttct

SEQ ID NO: 2865030 - DNA, 21 bp, Homo sapiens
ctcttatagaatatttattac

SEQ ID NO: 2865031 - DNA, 22 bp, Homo sapiens
ctcttatagaatatttattacc

SEQ ID NO: 2865032 - DNA, 13 bp, Homo sapiens
ctcttcagaggcc

SEQ ID NO: 2865033 - DNA, 17 bp, Homo sapiens
ctcttcccttcccagac

SEQ ID NO: 2865034 - DNA, 22 bp, Homo sapiens
ctcttcctagatctgcaggctg

SEQ ID NO: 2865035 - DNA, 22 bp, Homo sapiens
ctcttctgggagggcagcaggg

SEQ ID NO: 2865036 - DNA, 12 bp, Homo sapiens
ctcttgcaatgc

SEQ ID NO: 2865037 - DNA, 12 bp, Homo sapiens
ctctttcaaaac

SEQ ID NO: 2865038 - DNA, 16 bp, Homo sapiens
ctctttccaaattaaa

SEQ ID NO: 2865039 - DNA, 23 bp, Homo sapiens
ctctttcttgtttgtcagcatct

SEQ ID NO: 2865040 - DNA, 14 bp, Homo sapiens
ctcttttgctgtgc

SEQ ID NO: 2865041 - DNA, 15 bp, Homo sapiens
ctgaagaatcaagag

SEQ ID NO: 2865042 - DNA, 21 bp, Homo sapiens
ctgaaggagccccattcctgg

SEQ ID NO: 2865043 - DNA, 21 bp, Homo sapiens
ctgaataatatcaaataaaat

SEQ ID NO: 2865044 - DNA, 12 bp, Homo sapiens
ctgaatgtatgt

SEQ ID NO: 2865045 - DNA, 14 bp, Homo sapiens
ctgaatttgtatat

SEQ ID NO: 2865046 - DNA, 20 bp, Homo sapiens
ctgaatttgtatatgactgc

SEQ ID NO: 2865047 - DNA, 18 bp, Homo sapiens
ctgacactcaataaacag

SEQ ID NO: 2865048 - DNA, 19 bp, Homo sapiens
ctgacactcaataaacagt

SEQ ID NO: 2865049 - DNA, 23 bp, Homo sapiens
ctgacactcaataaacagtcact

SEQ ID NO: 2865050 - DNA, 17 bp, Homo sapiens
ctgaccaaagactgcag

SEQ ID NO: 2865051 - DNA, 20 bp, Homo sapiens
ctgaccacaccaaccaggcc

SEQ ID NO: 2865052 - DNA, 21 bp, Homo sapiens
ctgaccacaccaaccaggcct

SEQ ID NO: 2865053 - DNA, 14 bp, Homo sapiens
ctgactcagggctc

SEQ ID NO: 2865054 - DNA, 18 bp, Homo sapiens
ctgactcagggctcctgg

SEQ ID NO: 2865055 - DNA, 19 bp, Homo sapiens
ctgactcagggctcctggg

SEQ ID NO: 2865056 - DNA, 21 bp, Homo sapiens
ctgactcagggctcctgggtt

SEQ ID NO: 2865057 - DNA, 13 bp, Homo sapiens
gacgcctgaggaa

SEQ ID NO: 2865058 - DNA, 14 bp, Homo sapiens
gacgcctgaggaac

SEQ ID NO: 2865059 - DNA, 19 bp, Homo sapiens
gacgcctgggggtgccagg

SEQ ID NO: 2865060 - DNA, 22 bp, Homo sapiens
gactacctactggtgtaatctc

SEQ ID NO: 2865061 - DNA, 16 bp, Homo sapiens
gactcagggctcctgg

SEQ ID NO: 2865062 - DNA, 17 bp, Homo sapiens
gactcattctgaaggag

SEQ ID NO: 2865063 - DNA, 15 bp, Homo sapiens
gactcccaaccctgg

SEQ ID NO: 2865064 - DNA, 14 bp, Homo sapiens
gactcctcaggaga

SEQ ID NO: 2865065 - DNA, 17 bp, Homo sapiens
gactcctcaggagagac

SEQ ID NO: 2865066 - DNA, 14 bp, Homo sapiens
gactctcagtctct

SEQ ID NO: 2865067 - DNA, 18 bp, Homo sapiens
gactctcagtctctgagc

SEQ ID NO: 2865068 - DNA, 20 bp, Homo sapiens
gactctcagtctctgagcag

SEQ ID NO: 2865069 - DNA, 15 bp, Homo sapiens
gactgaccaaagact

SEQ ID NO: 2865070 - DNA, 13 bp, Homo sapiens
gactgcagaaccc

SEQ ID NO: 2865071 - DNA, 20 bp, Homo sapiens
gactgcagaacccccaggtg

SEQ ID NO: 2865072 - DNA, 23 bp, Homo sapiens
gactgcagaacccccaggtggcc

SEQ ID NO: 2865073 - DNA, 15 bp, Homo sapiens
gactggaggcccctg

SEQ ID NO: 2865074 - DNA, 20 bp, Homo sapiens
gactggatttgcagaagttt

SEQ ID NO: 2865075 - DNA, 14 bp, Homo sapiens
gactgggctgaggg

SEQ ID NO: 2865076 - DNA, 16 bp, Homo sapiens
gactgggctgagggag

SEQ ID NO: 2865077 - DNA, 21 bp, Homo sapiens
gactgggctgagggagcctgg

SEQ ID NO: 2865078 - DNA, 15 bp, Homo sapiens
gacttggggaccaga

SEQ ID NO: 2865079 - DNA, 23 bp, Homo sapiens
gacttgtttagagagcctgtcac

SEQ ID NO: 2865080 - DNA, 19 bp, Homo sapiens
gagaaacactatttgtgac

SEQ ID NO: 2865081 - DNA, 21 bp, Homo sapiens
gagaaacactatttgtgactt

SEQ ID NO: 2865082 - DNA, 21 bp, Homo sapiens
gagaaaccttattgtacctct

SEQ ID NO: 2865083 - DNA, 22 bp, Homo sapiens
gagaaagcacaatttaaaacaa

SEQ ID NO: 2865084 - DNA, 19 bp, Homo sapiens
gagaagggggattggaggg

SEQ ID NO: 2865085 - DNA, 14 bp, Homo sapiens
gagacccctcccct

SEQ ID NO: 2865086 - DNA, 17 bp, Homo sapiens
gagaccccttcctttcc

SEQ ID NO: 2865087 - DNA, 17 bp, Homo sapiens
gagactgggctgaggga

SEQ ID NO: 2865088 - DNA, 20 bp, Homo sapiens
gagactgggctgagggagcc

SEQ ID NO: 2865089 - DNA, 20 bp, Homo sapiens
gagagacccctcccctccca

SEQ ID NO: 2865090 - DNA, 13 bp, Homo sapiens
gagagagggactc

SEQ ID NO: 2865091 - DNA, 23 bp, Homo sapiens
gagagagggactcaagggaaagg

SEQ ID NO: 2865092 - DNA, 23 bp, Homo sapiens
gagagattttgtcgggacagaga

SEQ ID NO: 2865093 - DNA, 13 bp, Homo sapiens
gagagccagctct

SEQ ID NO: 2865094 - DNA, 17 bp, Homo sapiens
gagagcctgtcaccaga

SEQ ID NO: 2865095 - DNA, 21 bp, Homo sapiens
gagagcctgtcaccagagctt

SEQ ID NO: 2865096 - DNA, 15 bp, Homo sapiens
gagagggactcaagg

SEQ ID NO: 2865097 - DNA, 18 bp, Homo sapiens
gagataaatgagctttcc

SEQ ID NO: 2865098 - DNA, 20 bp, Homo sapiens
gagatggaagttgcagtgag

SEQ ID NO: 2865099 - DNA, 16 bp, Homo sapiens
gagatgtgacccacca

SEQ ID NO: 2865100 - DNA, 18 bp, Homo sapiens
gagatgtgacccaccagt

SEQ ID NO: 2865101 - DNA, 20 bp, Homo sapiens
gagatgtgacccaccagtgc

SEQ ID NO: 2865102 - DNA, 15 bp, Homo sapiens
gagattacctcctga

SEQ ID NO: 2865103 - DNA, 12 bp, Homo sapiens
gagcaagactct

SEQ ID NO: 2865104 - DNA, 21 bp, Homo sapiens
gagcaattccaggctgagcca

SEQ ID NO: 2865105 - DNA, 24 bp, Homo sapiens
gagcaattccaggctgagccatga

SEQ ID NO: 2865106 - DNA, 12 bp, Homo sapiens
gagcaccccctc

SEQ ID NO: 2865107 - DNA, 17 bp, Homo sapiens
gagcaccccctcattcc

SEQ ID NO: 2865108 - DNA, 15 bp, Homo sapiens
gagcagaggggctga

SEQ ID NO: 2865109 - DNA, 20 bp, Homo sapiens
gagccaacagaagcttccat

SEQ ID NO: 2865110 - DNA, 15 bp, Homo sapiens
gagccaacctggact

SEQ ID NO: 2865111 - DNA, 19 bp, Homo sapiens
gagccaacctggacttcct

SEQ ID NO: 2865112 - DNA, 20 bp, Homo sapiens
gagccaacctggacttcctg

SEQ ID NO: 2865113 - DNA, 21 bp, Homo sapiens
gagccaacctggacttcctgt

SEQ ID NO: 2865114 - DNA, 15 bp, Homo sapiens
gagccaattagactt

SEQ ID NO: 2865115 - DNA, 19 bp, Homo sapiens
gagccaattagacttgaaa

SEQ ID NO: 2865116 - DNA, 14 bp, Homo sapiens
gagccaggagtaag

SEQ ID NO: 2865117 - DNA, 15 bp, Homo sapiens
gagccaggagtaaga

SEQ ID NO: 2865118 - DNA, 20 bp, Homo sapiens
gagcccctcctccagcccct

SEQ ID NO: 2865119 - DNA, 21 bp, Homo sapiens
gagcccctcctccagcccctg

SEQ ID NO: 2865120 - DNA, 19 bp, Homo sapiens
gagccgaggggagagaggg

SEQ ID NO: 2865121 - DNA, 23 bp, Homo sapiens
gagccgaggggagagagggactc

SEQ ID NO: 2865122 - DNA, 22 bp, Homo sapiens
gagccgggtctgcctcttctgg

SEQ ID NO: 2865123 - DNA, 13 bp, Homo sapiens
gagccgtggtcct

SEQ ID NO: 2865124 - DNA, 17 bp, Homo sapiens
gagccgtggtcctttgg

SEQ ID NO: 2865125 - DNA, 15 bp, Homo sapiens
gagcctgagggatct

SEQ ID NO: 2865126 - DNA, 19 bp, Homo sapiens
gagctagaaaaataaaatg

SEQ ID NO: 2865127 - DNA, 16 bp, Homo sapiens
gagcttcatggcagaa

SEQ ID NO: 2865128 - DNA, 19 bp, Homo sapiens
gagcttctctgggctgaat

SEQ ID NO: 2865129 - DNA, 16 bp, Homo sapiens
gagcttctctgtgaac

SEQ ID NO: 2865130 - DNA, 21 bp, Homo sapiens
gaggaactgggtgactggagg

SEQ ID NO: 2865131 - DNA, 19 bp, Homo sapiens
gaggaaggggccagaggct

SEQ ID NO: 2865132 - DNA, 17 bp, Homo sapiens
gaggaatgctggactgg

SEQ ID NO: 2865133 - DNA, 17 bp, Homo sapiens
gaggagcagcccgggga

SEQ ID NO: 2865134 - DNA, 20 bp, Homo sapiens
gaggcagcagtgtgaggcca

SEQ ID NO: 2865135 - DNA, 20 bp, Homo sapiens
gaggccaagatggctgctgc

SEQ ID NO: 2865136 - DNA, 19 bp, Homo sapiens
gaggccagggcagagtgag

SEQ ID NO: 2865137 - DNA, 19 bp, Homo sapiens
gaggcgggtggatcacttg

SEQ ID NO: 2865138 - DNA, 14 bp, Homo sapiens
gaggctccagaggg

SEQ ID NO: 2865139 - DNA, 15 bp, Homo sapiens
gagggacgcctgggg

SEQ ID NO: 2865140 - DNA, 19 bp, Homo sapiens
gagggactcaagggaaagg

SEQ ID NO: 2865141 - DNA, 19 bp, Homo sapiens
gaggggagagagggactca

SEQ ID NO: 2865142 - DNA, 20 bp, Homo sapiens
gaggggttccttccacttct

SEQ ID NO: 2865143 - DNA, 18 bp, Homo sapiens
gagggtgacagcttcctt

SEQ ID NO: 2865144 - DNA, 20 bp, Homo sapiens
gaggtccagctgggcctcct

SEQ ID NO: 2865145 - DNA, 21 bp, Homo sapiens
gaggtccagctgggcctcctg

SEQ ID NO: 2865146 - DNA, 15 bp, Homo sapiens
gaggtggattcctgg

SEQ ID NO: 2865147 - DNA, 16 bp, Homo sapiens
gagtttttaaagcctt

SEQ ID NO: 2865148 - DNA, 22 bp, Homo sapiens
gataatatttttgtatttctct

SEQ ID NO: 2865149 - DNA, 15 bp, Homo sapiens
gataccagcgaggag

SEQ ID NO: 2865150 - DNA, 18 bp, Homo sapiens
gataccatatgaatgaaa

SEQ ID NO: 2865151 - DNA, 17 bp, Homo sapiens
gatacggttgtctagag

SEQ ID NO: 2865152 - DNA, 16 bp, Homo sapiens
gatagaaagctggact

SEQ ID NO: 2865153 - DNA, 14 bp, Homo sapiens
gatattttgaaatg

SEQ ID NO: 2865154 - DNA, 18 bp, Homo sapiens
gatcaacgcctcactgaa

SEQ ID NO: 2865155 - DNA, 19 bp, Homo sapiens
gatcagcaaaaagactgga

SEQ ID NO: 2865156 - DNA, 21 bp, Homo sapiens
gatccatggggggagaagtga

SEQ ID NO: 2865157 - DNA, 19 bp, Homo sapiens
gatccatttggacaaaatg

SEQ ID NO: 2865158 - DNA, 18 bp, Homo sapiens
gatccctcatctgtccct

SEQ ID NO: 2865159 - DNA, 15 bp, Homo sapiens
gatcctcagttctca

SEQ ID NO: 2865160 - DNA, 13 bp, Homo sapiens
gatctgcaggctg

SEQ ID NO: 2865161 - DNA, 14 bp, Homo sapiens
gatctgcaggctgc

SEQ ID NO: 2865162 - DNA, 18 bp, Homo sapiens
gatctggggctctgggat

SEQ ID NO: 2865163 - DNA, 17 bp, Homo sapiens
gatgaagaagggggtgg

SEQ ID NO: 2865164 - DNA, 18 bp, Homo sapiens
gatgcccagaggactccc

SEQ ID NO: 2865165 - DNA, 14 bp, Homo sapiens
gatgctccttgggc

SEQ ID NO: 2865166 - DNA, 18 bp, Homo sapiens
ggtctgagcaccccctca

SEQ ID NO: 2865167 - DNA, 21 bp, Homo sapiens
ggtctgtgtaacatccaagcc

SEQ ID NO: 2865168 - DNA, 22 bp, Homo sapiens
ggtgctacacccttttccagct

SEQ ID NO: 2865169 - DNA, 17 bp, Homo sapiens
ggtgctgcctctacctg

SEQ ID NO: 2865170 - DNA, 23 bp, Homo sapiens
ggtggagggccacatgggaggct

SEQ ID NO: 2865171 - DNA, 13 bp, Homo sapiens
ggtgggagagcca

SEQ ID NO: 2865172 - DNA, 10 bp, Homo sapiens
ggtgggtcca

SEQ ID NO: 2865173 - DNA, 17 bp, Homo sapiens
ggtgggtccatgggcag

SEQ ID NO: 2865174 - DNA, 16 bp, Homo sapiens
ggtggttattggactc

SEQ ID NO: 2865175 - DNA, 18 bp, Homo sapiens
ggtggttattggactcca

SEQ ID NO: 2865176 - DNA, 14 bp, Homo sapiens
ggtgtaatctcaat

SEQ ID NO: 2865177 - DNA, 23 bp, Homo sapiens
ggtgtgtccccctctgtccaggc

SEQ ID NO: 2865178 - DNA, 21 bp, Homo sapiens
ggtgttatcaccgtgggctcc

SEQ ID NO: 2865179 - DNA, 15 bp, Homo sapiens
ggttgaccccagagg

SEQ ID NO: 2865180 - DNA, 16 bp, Homo sapiens
ggttgaccccagagga

SEQ ID NO: 2865181 - DNA, 16 bp, Homo sapiens
ggtttacactgcggaa

SEQ ID NO: 2865182 - DNA, 21 bp, Homo sapiens
ggtttacactgcggaagccaa

SEQ ID NO: 2865183 - DNA, 13 bp, Homo sapiens
gtaaaaaatgtct

SEQ ID NO: 2865184 - DNA, 14 bp, Homo sapiens
gtaaaacagtcatc

SEQ ID NO: 2865185 - DNA, 24 bp, Homo sapiens
gtaaactgtgcaccaagcaggaaa

SEQ ID NO: 2865186 - DNA, 16 bp, Homo sapiens
gtaaatcagaaagtaa

SEQ ID NO: 2865187 - DNA, 21 bp, Homo sapiens
gtaaatctaactacaaggaca

SEQ ID NO: 2865188 - DNA, 23 bp, Homo sapiens
gtaacatgtgttaagtattttca

SEQ ID NO: 2865189 - DNA, 18 bp, Homo sapiens
gtaacctcttcagaggcc

SEQ ID NO: 2865190 - DNA, 20 bp, Homo sapiens
gtaacctcttcagaggccct

SEQ ID NO: 2865191 - DNA, 13 bp, Homo sapiens
gtaactgttcttg

SEQ ID NO: 2865192 - DNA, 14 bp, Homo sapiens
gtaagacaagtggg

SEQ ID NO: 2865193 - DNA, 12 bp, Homo sapiens
gtaataaacagg

SEQ ID NO: 2865194 - DNA, 15 bp, Homo sapiens
gtaatatgtctgcca

SEQ ID NO: 2865195 - DNA, 20 bp, Homo sapiens
gtaatcccagcactttggga

SEQ ID NO: 2865196 - DNA, 14 bp, Homo sapiens
gtaatctatgttta

SEQ ID NO: 2865197 - DNA, 14 bp, Homo sapiens
gtacaaaatggtcc

SEQ ID NO: 2865198 - DNA, 17 bp, Homo sapiens
gtacctgcccccaatcc

SEQ ID NO: 2865199 - DNA, 22 bp, Homo sapiens
gtacttgactacctactggtgt

SEQ ID NO: 2865200 - DNA, 19 bp, Homo sapiens
gtagaaactgcagggaaaa

SEQ ID NO: 2865201 - DNA, 20 bp, Homo sapiens
gtagaactcactctgggctg

SEQ ID NO: 2865202 - DNA, 18 bp, Homo sapiens
gtagaattgggaagctgg

SEQ ID NO: 2865203 - DNA, 13 bp, Homo sapiens
gtagagccaatta

SEQ ID NO: 2865204 - DNA, 22 bp, Homo sapiens
gtagggtaattagtaacatgtg

SEQ ID NO: 2865205 - DNA, 13 bp, Homo sapiens
gtagttaaataac

SEQ ID NO: 2865206 - DNA, 17 bp, Homo sapiens
gtatatatgtatttcta

SEQ ID NO: 2865207 - DNA, 21 bp, Homo sapiens
gtatcaggacccagaggaagg

SEQ ID NO: 2865208 - DNA, 21 bp, Homo sapiens
gtatccaaggaaacattttat

SEQ ID NO: 2865209 - DNA, 22 bp, Homo sapiens
gtatgtcaataaacaacagctg

SEQ ID NO: 2865210 - DNA, 17 bp, Homo sapiens
gtatgtcagtgctataa

SEQ ID NO: 2865211 - DNA, 16 bp, Homo sapiens
gtatgtttttctgtat

SEQ ID NO: 2865212 - DNA, 21 bp, Homo sapiens
gtatttctctattttcataat

SEQ ID NO: 2865213 - DNA, 22 bp, Homo sapiens
gtatttctctattttcataatc

SEQ ID NO: 2865214 - DNA, 19 bp, Homo sapiens
gtcaaaaaattatttgcta

SEQ ID NO: 2865215 - DNA, 20 bp, Homo sapiens
gtcaaaaaattatttgctat

SEQ ID NO: 2865216 - DNA, 19 bp, Homo sapiens
gtcaacctgggcaaagcct

SEQ ID NO: 2865217 - DNA, 22 bp, Homo sapiens
gtcaataaacaacagctgaagc

SEQ ID NO: 2865218 - DNA, 13 bp, Homo sapiens
gtcaccagagctt

SEQ ID NO: 2865219 - DNA, 21 bp, Homo sapiens
gtcaccagagcttctctgggc

SEQ ID NO: 2865220 - DNA, 13 bp, Homo sapiens
gtcacctgtgctt

SEQ ID NO: 2865221 - DNA, 18 bp, Homo sapiens
gtcagaatttttaactgt

SEQ ID NO: 2865222 - DNA, 18 bp, Homo sapiens
gtcagacgcctgaggaac

SEQ ID NO: 2865223 - DNA, 9 bp, Homo sapiens
gtcagcatc

SEQ ID NO: 2865224 - DNA, 11 bp, Homo sapiens
gtcagcatctg

SEQ ID NO: 2865225 - DNA, 20 bp, Homo sapiens
gtcagcatctgaccatctgt

SEQ ID NO: 2865226 - DNA, 22 bp, Homo sapiens
gtcagcatctgaccatctgtga

SEQ ID NO: 2865227 - DNA, 13 bp, Homo sapiens
gtcagccctaggg

SEQ ID NO: 2865228 - DNA, 22 bp, Homo sapiens
gtcagtaccttcaaactagggc

SEQ ID NO: 2865229 - DNA, 18 bp, Homo sapiens
gtccaaaatttatatttt

SEQ ID NO: 2865230 - DNA, 15 bp, Homo sapiens
gtccacgactgtctc

SEQ ID NO: 2865231 - DNA, 16 bp, Homo sapiens
gtccacgactgtctcc

SEQ ID NO: 2865232 - DNA, 19 bp, Homo sapiens
gtccagctgggcctcctgc

SEQ ID NO: 2865233 - DNA, 14 bp, Homo sapiens
gtccagtcgggagg

SEQ ID NO: 2865234 - DNA, 21 bp, Homo sapiens
gtccattgtccaatcctatgt

SEQ ID NO: 2865235 - DNA, 16 bp, Homo sapiens
gtccccaccctccact

SEQ ID NO: 2865236 - DNA, 13 bp, Homo sapiens
gtccccctctgtc

SEQ ID NO: 2865237 - DNA, 17 bp, Homo sapiens
gtcctaaaagttctcaa

SEQ ID NO: 2865238 - DNA, 17 bp, Homo sapiens
gtcctaacaaatgctcc

SEQ ID NO: 2865239 - DNA, 17 bp, Homo sapiens
gtcctgatcagagccgt

SEQ ID NO: 2865240 - DNA, 15 bp, Homo sapiens
gtcgggaggagcagc

SEQ ID NO: 2865241 - DNA, 14 bp, Homo sapiens
gtctccatggccct

SEQ ID NO: 2865242 - DNA, 15 bp, Homo sapiens
gtctgagcaccccct

SEQ ID NO: 2865243 - DNA, 22 bp, Homo sapiens
gtctgccaatctgtacaaaatg

SEQ ID NO: 2865244 - DNA, 11 bp, Homo sapiens
gtctgcctctt

SEQ ID NO: 2865245 - DNA, 20 bp, Homo sapiens
gtctgtgtaacatccaagcc

SEQ ID NO: 2865246 - DNA, 23 bp, Homo sapiens
gtcttagctgaggctgagaaagc

SEQ ID NO: 2865247 - DNA, 18 bp, Homo sapiens
gtcttatgtgaaaaatta

SEQ ID NO: 2865248 - DNA, 15 bp, Homo sapiens
gtcttccatttgcaa

SEQ ID NO: 2865249 - DNA, 15 bp, Homo sapiens
gtgaaattaagcatt

SEQ ID NO: 2865250 - DNA, 14 bp, Homo sapiens
gtgaacgatttaga

SEQ ID NO: 2865251 - DNA, 14 bp, Homo sapiens
gtgaagtttggaga

SEQ ID NO: 2865252 - DNA, 15 bp, Homo sapiens
gtgacagtttccaaa

SEQ ID NO: 2865253 - DNA, 17 bp, Homo sapiens
gtgacccaccagtgcct

SEQ ID NO: 2865254 - DNA, 13 bp, Homo sapiens
gtgcacctgcccc

SEQ ID NO: 2865255 - DNA, 17 bp, Homo sapiens
gtgcagccgctgagcga

SEQ ID NO: 2865256 - DNA, 15 bp, Homo sapiens
gtgcaggtggggaga

SEQ ID NO: 2865257 - DNA, 20 bp, Homo sapiens
gtgcatccacgcacacatgg

SEQ ID NO: 2865258 - DNA, 16 bp, Homo sapiens
gtgcccaaagtgggga

SEQ ID NO: 2865259 - DNA, 14 bp, Homo sapiens
gtgcgaagactgag

SEQ ID NO: 2865260 - DNA, 15 bp, Homo sapiens
gtgcgtccacgagct

SEQ ID NO: 2865261 - DNA, 20 bp, Homo sapiens
gtgctataaatgccagagcc

SEQ ID NO: 2865262 - DNA, 22 bp, Homo sapiens
gtgctataaatgccagagccaa

SEQ ID NO: 2865263 - DNA, 23 bp, Homo sapiens
gtgctccatatttgatttctaat

SEQ ID NO: 2865264 - DNA, 13 bp, Homo sapiens
gtggaaaaaacat

SEQ ID NO: 2865265 - DNA, 20 bp, Homo sapiens
gtggaaaagaatccctgcag

SEQ ID NO: 2865266 - DNA, 15 bp, Homo sapiens
gtggactctgctaga

SEQ ID NO: 2865267 - DNA, 19 bp, Homo sapiens
gtggattcctgggcaagaa

SEQ ID NO: 2865268 - DNA, 13 bp, Homo sapiens
gtggcaattagtg

SEQ ID NO: 2865269 - DNA, 20 bp, Homo sapiens
gtggcgactctatagactct

SEQ ID NO: 2865270 - DNA, 20 bp, Homo sapiens
gtgggacaaaccagagcaga

SEQ ID NO: 2865271 - DNA, 21 bp, Homo sapiens
gtgggacaaaccagagcagag

SEQ ID NO: 2865272 - DNA, 13 bp, Homo sapiens
gtgggacagccca

SEQ ID NO: 2865273 - DNA, 19 bp, Homo sapiens
gtgggccactctcccctcc

SEQ ID NO: 2865274 - DNA, 13 bp, Homo sapiens
gtgggctccctga

SEQ ID NO: 2865275 - DNA, 17 bp, Homo sapiens
gtggggagactgggctg

SEQ ID NO: 2865276 - DNA, 21 bp, Homo sapiens
tcaattagtggtcataaaata

SEQ ID NO: 2865277 - DNA, 14 bp, Homo sapiens
tcaattcctctggg

SEQ ID NO: 2865278 - DNA, 16 bp, Homo sapiens
tcaattcctctgggaa

SEQ ID NO: 2865279 - DNA, 17 bp, Homo sapiens
tcaattgcatctcccag

SEQ ID NO: 2865280 - DNA, 18 bp, Homo sapiens
tcaattgcatctcccaga

SEQ ID NO: 2865281 - DNA, 17 bp, Homo sapiens
tcacaatcttggggctg

SEQ ID NO: 2865282 - DNA, 22 bp, Homo sapiens
tcacacatgcatcatcagccta

SEQ ID NO: 2865283 - DNA, 21 bp, Homo sapiens
tcacatgtcagtaccttcaaa

SEQ ID NO: 2865284 - DNA, 16 bp, Homo sapiens
tcaccagagcttctct

SEQ ID NO: 2865285 - DNA, 20 bp, Homo sapiens
tcaccagagcttctctgggc

SEQ ID NO: 2865286 - DNA, 22 bp, Homo sapiens
tcaccagagcttctctgggctg

SEQ ID NO: 2865287 - DNA, 23 bp, Homo sapiens
tcaccagagcttctctgggctga

SEQ ID NO: 2865288 - DNA, 22 bp, Homo sapiens
tcaccatttgattatgtagcaa

SEQ ID NO: 2865289 - DNA, 23 bp, Homo sapiens
tcaccatttggcaatgccatcat

SEQ ID NO: 2865290 - DNA, 16 bp, Homo sapiens
tcacccccttctccat

SEQ ID NO: 2865291 - DNA, 17 bp, Homo sapiens
tcaccgtgggctccctg

SEQ ID NO: 2865292 - DNA, 18 bp, Homo sapiens
tcaccgtgggctccctga

SEQ ID NO: 2865293 - DNA, 20 bp, Homo sapiens
tcacctgtgcttcgggccct

SEQ ID NO: 2865294 - DNA, 22 bp, Homo sapiens
tcactgagttttgtttcacttt

SEQ ID NO: 2865295 - DNA, 21 bp, Homo sapiens
tcacttctacctacatatttg

SEQ ID NO: 2865296 - DNA, 14 bp, Homo sapiens
tcagaaaaccactt

SEQ ID NO: 2865297 - DNA, 13 bp, Homo sapiens
tcagaaagtaaca

SEQ ID NO: 2865298 - DNA, 17 bp, Homo sapiens
tcagaaggatgcccaga

SEQ ID NO: 2865299 - DNA, 17 bp, Homo sapiens
tcagaatttttaactgt

SEQ ID NO: 2865300 - DNA, 17 bp, Homo sapiens
tcagacgcctgaggaac

SEQ ID NO: 2865301 - DNA, 23 bp, Homo sapiens
tcagaggaaaaatgggagccagg

SEQ ID NO: 2865302 - DNA, 21 bp, Homo sapiens
tcagaggccctcgctgccagc

SEQ ID NO: 2865303 - DNA, 14 bp, Homo sapiens
tcagcaaaaagact

SEQ ID NO: 2865304 - DNA, 14 bp, Homo sapiens
tcagcatctgacca

SEQ ID NO: 2865305 - DNA, 19 bp, Homo sapiens
tcagctccagaataccttc

SEQ ID NO: 2865306 - DNA, 15 bp, Homo sapiens
tcagctccttcctgg

SEQ ID NO: 2865307 - DNA, 17 bp, Homo sapiens
tcagctccttcctggag

SEQ ID NO: 2865308 - DNA, 16 bp, Homo sapiens
tcagctctttccaaat

SEQ ID NO: 2865309 - DNA, 17 bp, Homo sapiens
tcagctctttccaaatt

SEQ ID NO: 2865310 - DNA, 16 bp, Homo sapiens
tcagctgctgttgaac

SEQ ID NO: 2865311 - DNA, 15 bp, Homo sapiens
tcagctgtcctgcag

SEQ ID NO: 2865312 - DNA, 17 bp, Homo sapiens
tcagctgtcctgcagca

SEQ ID NO: 2865313 - DNA, 19 bp, Homo sapiens
tcagctgtcctgcagcaaa

SEQ ID NO: 2865314 - DNA, 20 bp, Homo sapiens
tcaggaccaaagctttcatg

SEQ ID NO: 2865315 - DNA, 19 bp, Homo sapiens
tcaggacccagaggaaggg

SEQ ID NO: 2865316 - DNA, 18 bp, Homo sapiens
tcagggtgggccactctc

SEQ ID NO: 2865317 - DNA, 20 bp, Homo sapiens
tcagtaaatagtgtcatata

SEQ ID NO: 2865318 - DNA, 13 bp, Homo sapiens
tcagtctctgagc

SEQ ID NO: 2865319 - DNA, 14 bp, Homo sapiens
tcagtggggcagtc

SEQ ID NO: 2865320 - DNA, 17 bp, Homo sapiens
tcagtgttaaatgtgat

SEQ ID NO: 2865321 - DNA, 21 bp, Homo sapiens
tcagtgttaaatgtgatgaat

SEQ ID NO: 2865322 - DNA, 17 bp, Homo sapiens
tcagttctcaaatgtgt

SEQ ID NO: 2865323 - DNA, 13 bp, Homo sapiens
tcagttttaacta

SEQ ID NO: 2865324 - DNA, 16 bp, Homo sapiens
tcagtttttcacttct

SEQ ID NO: 2865325 - DNA, 21 bp, Homo sapiens
tcataaaatagaataattctt

SEQ ID NO: 2865326 - DNA, 20 bp, Homo sapiens
tcatcattctctgtctcatc

SEQ ID NO: 2865327 - DNA, 11 bp, Homo sapiens
tcatccatcat

SEQ ID NO: 2865328 - DNA, 21 bp, Homo sapiens
tcatcccgagcacctccacat

SEQ ID NO: 2865329 - DNA, 18 bp, Homo sapiens
tcatctcctgccttcctc

SEQ ID NO: 2865330 - DNA, 13 bp, Homo sapiens
tcatgtaaactgt

SEQ ID NO: 2865331 - DNA, 16 bp, Homo sapiens
tcatgtaaactgtgca

SEQ ID NO: 2865332 - DNA, 17 bp, Homo sapiens
tcatgtaaactgtgcac

SEQ ID NO: 2865333 - DNA, 15 bp, Homo sapiens
tcatgtcaatgacca

SEQ ID NO: 2865334 - DNA, 16 bp, Homo sapiens
tcattaaaaattacct

SEQ ID NO: 2865335 - DNA, 15 bp, Homo sapiens
tcattatctttgctg

SEQ ID NO: 2865336 - DNA, 22 bp, Homo sapiens
tcattattcaagaatgaaaaat

SEQ ID NO: 2865337 - DNA, 13 bp, Homo sapiens
tcattccggactg

SEQ ID NO: 2865338 - DNA, 15 bp, Homo sapiens
tcattccggactggc

SEQ ID NO: 2865339 - DNA, 21 bp, Homo sapiens
tcattccggactggcagaagc

SEQ ID NO: 2865340 - DNA, 23 bp, Homo sapiens
tcattccggactggcagaagcat

SEQ ID NO: 2865341 - DNA, 17 bp, Homo sapiens
tcattcttgaaagctgt

SEQ ID NO: 2865342 - DNA, 22 bp, Homo sapiens
tcattggcattctttgcaatac

SEQ ID NO: 2865343 - DNA, 13 bp, Homo sapiens
tcatttctatttc

SEQ ID NO: 2865344 - DNA, 17 bp, Homo sapiens
tccaaattaaaacaaat

SEQ ID NO: 2865345 - DNA, 17 bp, Homo sapiens
tccaacagacacaattt

SEQ ID NO: 2865346 - DNA, 12 bp, Homo sapiens
tccaagccagag

SEQ ID NO: 2865347 - DNA, 13 bp, Homo sapiens
tccaagccagagt

SEQ ID NO: 2865348 - DNA, 20 bp, Homo sapiens
tccaagtctctgtgtaacca

SEQ ID NO: 2865349 - DNA, 14 bp, Homo sapiens
tccacactgtcaaa

SEQ ID NO: 2865350 - DNA, 15 bp, Homo sapiens
tccacatgggagccg

SEQ ID NO: 2865351 - DNA, 13 bp, Homo sapiens
tccaccctccacc

SEQ ID NO: 2865352 - DNA, 15 bp, Homo sapiens
tccaccctccacctt

SEQ ID NO: 2865353 - DNA, 14 bp, Homo sapiens
tccacgactgtctc

SEQ ID NO: 2865354 - DNA, 18 bp, Homo sapiens
tccacgactgtctccatg

SEQ ID NO: 2865355 - DNA, 15 bp, Homo sapiens
tccacgcacacatgg

SEQ ID NO: 2865356 - DNA, 22 bp, Homo sapiens
tccacggagccactcctctgac

SEQ ID NO: 2865357 - DNA, 19 bp, Homo sapiens
tccacgttctgctcatcat

SEQ ID NO: 2865358 - DNA, 21 bp, Homo sapiens
tccacgttctgctcatcattc

SEQ ID NO: 2865359 - DNA, 22 bp, Homo sapiens
tccactcagctgtcctgcagca

SEQ ID NO: 2865360 - DNA, 20 bp, Homo sapiens
tccacttctggggccacctc

SEQ ID NO: 2865361 - DNA, 16 bp, Homo sapiens
tccagaagaaaatttg

SEQ ID NO: 2865362 - DNA, 15 bp, Homo sapiens
tccagcccctgtccc

SEQ ID NO: 2865363 - DNA, 13 bp, Homo sapiens
tccagctgggcct

SEQ ID NO: 2865364 - DNA, 21 bp, Homo sapiens
tccagctgggcctcctgcctc

SEQ ID NO: 2865365 - DNA, 16 bp, Homo sapiens
tccaggcactgagata

SEQ ID NO: 2865366 - DNA, 17 bp, Homo sapiens
tccaggctgagccatga

SEQ ID NO: 2865367 - DNA, 18 bp, Homo sapiens
tccagtttgcacctgtcc

SEQ ID NO: 2865368 - DNA, 20 bp, Homo sapiens
tccataaagtacaaatgaag

SEQ ID NO: 2865369 - DNA, 24 bp, Homo sapiens
tccataaagtacaaatgaagaaag

SEQ ID NO: 2865370 - DNA, 13 bp, Homo sapiens
tccatcatcatgt

SEQ ID NO: 2865371 - DNA, 22 bp, Homo sapiens
tccatcgtattaaaaaacaatt

SEQ ID NO: 2865372 - DNA, 20 bp, Homo sapiens
tccatggccctgcaaaagga

SEQ ID NO: 2865373 - DNA, 18 bp, Homo sapiens
tccatgggagaaaataga

SEQ ID NO: 2865374 - DNA, 17 bp, Homo sapiens
tccatgggcagagccca

SEQ ID NO: 2865375 - DNA, 23 bp, Homo sapiens
tccatgggcagagcccaagggaa

SEQ ID NO: 2865376 - DNA, 21 bp, Homo sapiens
tccatgtacttccctcttgaa

SEQ ID NO: 2865377 - DNA, 19 bp, Homo sapiens
tccatgtgaccgaacactg

SEQ ID NO: 2865378 - DNA, 15 bp, Homo sapiens
tccattaggccagca

SEQ ID NO: 2865379 - DNA, 12 bp, Homo sapiens
tccatttgcaag

SEQ ID NO: 2865380 - DNA, 21 bp, Homo sapiens
tccattttcccccactactgc

SEQ ID NO: 2865381 - DNA, 15 bp, Homo sapiens
tcccacccacagcca

SEQ ID NO: 2865382 - DNA, 18 bp, Homo sapiens
tcccacccacagccatag

SEQ ID NO: 2865383 - DNA, 22 bp, Homo sapiens
tcccacgttctgttaatttagt

SEQ ID NO: 2865384 - DNA, 16 bp, Homo sapiens
tcccagcactttggga

SEQ ID NO: 2865385 - DNA, 22 bp, Homo sapiens
tgctatcttttttagtgttaaa

SEQ ID NO: 2865386 - DNA, 15 bp, Homo sapiens
tgctatgacatgcaa

SEQ ID NO: 2865387 - DNA, 12 bp, Homo sapiens
tgctccttgggc

SEQ ID NO: 2865388 - DNA, 16 bp, Homo sapiens
tgctccttgggccctt

SEQ ID NO: 2865389 - DNA, 18 bp, Homo sapiens
tgctccttgggccctttg

SEQ ID NO: 2865390 - DNA, 19 bp, Homo sapiens
tgctccttgggccctttga

SEQ ID NO: 2865391 - DNA, 14 bp, Homo sapiens
tgctctagtgggac

SEQ ID NO: 2865392 - DNA, 18 bp, Homo sapiens
tgctctagtgggacagcc

SEQ ID NO: 2865393 - DNA, 13 bp, Homo sapiens
tgctctgatccct

SEQ ID NO: 2865394 - DNA, 19 bp, Homo sapiens
tgctctgatccctctacag

SEQ ID NO: 2865395 - DNA, 23 bp, Homo sapiens
tgctctgcgtgtcacctgtgctt

SEQ ID NO: 2865396 - DNA, 22 bp, Homo sapiens
tgctgataccatatgaatgaaa

SEQ ID NO: 2865397 - DNA, 19 bp, Homo sapiens
tgctgatcttttaaaatca

SEQ ID NO: 2865398 - DNA, 19 bp, Homo sapiens
tgcttcattattcaagaat

SEQ ID NO: 2865399 - DNA, 23 bp, Homo sapiens
tgcttcattattcaagaatgaaa

SEQ ID NO: 2865400 - DNA, 10 bp, Homo sapiens
tgcttctcta

SEQ ID NO: 2865401 - DNA, 18 bp, Homo sapiens
tgctttcgaactgctagt

SEQ ID NO: 2865402 - DNA, 16 bp, Homo sapiens
tgctttgcattttgat

SEQ ID NO: 2865403 - DNA, 18 bp, Homo sapiens
tggaaaagaatccctgca

SEQ ID NO: 2865404 - DNA, 22 bp, Homo sapiens
tggaaaagaatccctgcagcct

SEQ ID NO: 2865405 - DNA, 23 bp, Homo sapiens
tggaaagagtgccagtcagcagt

SEQ ID NO: 2865406 - DNA, 15 bp, Homo sapiens
tggaatattgtccat

SEQ ID NO: 2865407 - DNA, 20 bp, Homo sapiens
tggaatattgtccattgtcc

SEQ ID NO: 2865408 - DNA, 14 bp, Homo sapiens
tggactccaggcct

SEQ ID NO: 2865409 - DNA, 16 bp, Homo sapiens
tggactccaggcctga

SEQ ID NO: 2865410 - DNA, 18 bp, Homo sapiens
tggactccaggcctgacc

SEQ ID NO: 2865411 - DNA, 16 bp, Homo sapiens
tggactcctcccacaa

SEQ ID NO: 2865412 - DNA, 20 bp, Homo sapiens
tggactctgctagactcctc

SEQ ID NO: 2865413 - DNA, 13 bp, Homo sapiens
tggactgaccaaa

SEQ ID NO: 2865414 - DNA, 18 bp, Homo sapiens
tggactgaccaaagactg

SEQ ID NO: 2865415 - DNA, 23 bp, Homo sapiens
tggactgaccaaagactgcagaa

SEQ ID NO: 2865416 - DNA, 19 bp, Homo sapiens
tggactgaccacaccaacc

SEQ ID NO: 2865417 - DNA, 17 bp, Homo sapiens
tggactggaggcccctg

SEQ ID NO: 2865418 - DNA, 21 bp, Homo sapiens
tggactggaggcccctggagc

SEQ ID NO: 2865419 - DNA, 11 bp, Homo sapiens
tggacttctga

SEQ ID NO: 2865420 - DNA, 22 bp, Homo sapiens
tggagaatactgccaaaacatt

SEQ ID NO: 2865421 - DNA, 16 bp, Homo sapiens
tggagggaagacaggt

SEQ ID NO: 2865422 - DNA, 20 bp, Homo sapiens
tggagggatgccacccagca

SEQ ID NO: 2865423 - DNA, 23 bp, Homo sapiens
tggatccatggggggagaagtga

SEQ ID NO: 2865424 - DNA, 19 bp, Homo sapiens
tggatcctcagttctcaaa

SEQ ID NO: 2865425 - DNA, 18 bp, Homo sapiens
tggatgccaaggagcccc

SEQ ID NO: 2865426 - DNA, 14 bp, Homo sapiens
tggatttgcagaag

SEQ ID NO: 2865427 - DNA, 15 bp, Homo sapiens
tggatttgcagaagt

SEQ ID NO: 2865428 - DNA, 18 bp, Homo sapiens
tggcaagagggtgacagc

SEQ ID NO: 2865429 - DNA, 21 bp, Homo sapiens
tggcactggtaggttgggaca

SEQ ID NO: 2865430 - DNA, 22 bp, Homo sapiens
tggcagaagcattgcctggact

SEQ ID NO: 2865431 - DNA, 23 bp, Homo sapiens
tggcagttaattggatgttcact

SEQ ID NO: 2865432 - DNA, 23 bp, Homo sapiens
tggcattcaaccacgcaggaagc

SEQ ID NO: 2865433 - DNA, 18 bp, Homo sapiens
tggcattctttgcaatac

SEQ ID NO: 2865434 - DNA, 17 bp, Homo sapiens
tggcatttctctttaaa

SEQ ID NO: 2865435 - DNA, 18 bp, Homo sapiens
tggcatttctctttaaac

SEQ ID NO: 2865436 - DNA, 22 bp, Homo sapiens
tggcccacgccctccctctccc

SEQ ID NO: 2865437 - DNA, 21 bp, Homo sapiens
tggcccttacttgcttctcta

SEQ ID NO: 2865438 - DNA, 15 bp, Homo sapiens
tggctagagccgagg

SEQ ID NO: 2865439 - DNA, 14 bp, Homo sapiens
tggctggtgtatgc

SEQ ID NO: 2865440 - DNA, 21 bp, Homo sapiens
tggctgtgtttgcagcctgct

SEQ ID NO: 2865441 - DNA, 15 bp, Homo sapiens
tggctttttctgcca

SEQ ID NO: 2865442 - DNA, 23 bp, Homo sapiens
tgggaaacaaataatttgaactt

SEQ ID NO: 2865443 - DNA, 12 bp, Homo sapiens
tgggaagctggg

SEQ ID NO: 2865444 - DNA, 14 bp, Homo sapiens
tgggaagcttgagc

SEQ ID NO: 2865445 - DNA, 20 bp, Homo sapiens
tgggaatgttacattgtttg

SEQ ID NO: 2865446 - DNA, 23 bp, Homo sapiens
tgggacaaaccagagcagagagc

SEQ ID NO: 2865447 - DNA, 18 bp, Homo sapiens
tgggacaccagggaagaa

SEQ ID NO: 2865448 - DNA, 14 bp, Homo sapiens
tgggacagcccaga

SEQ ID NO: 2865449 - DNA, 17 bp, Homo sapiens
tgggagagccagctctc

SEQ ID NO: 2865450 - DNA, 10 bp, Homo sapiens
tgggagccag

SEQ ID NO: 2865451 - DNA, 11 bp, Homo sapiens
tgggagccagg

SEQ ID NO: 2865452 - DNA, 18 bp, Homo sapiens
tgggagccgggtctgcct

SEQ ID NO: 2865453 - DNA, 23 bp, Homo sapiens
tgggagccgggtctgcctcttct

SEQ ID NO: 2865454 - DNA, 11 bp, Homo sapiens
tgggaggctga

SEQ ID NO: 2865455 - DNA, 16 bp, Homo sapiens
tgggatattttgaaat

SEQ ID NO: 2865456 - DNA, 18 bp, Homo sapiens
tgggatattttgaaatga

SEQ ID NO: 2865457 - DNA, 23 bp, Homo sapiens
tgggatattttgaaatgaacttt

SEQ ID NO: 2865458 - DNA, 16 bp, Homo sapiens
tgggattgagtctgtg

SEQ ID NO: 2865459 - DNA, 20 bp, Homo sapiens
tgggatttggggcctcaaga

SEQ ID NO: 2865460 - DNA, 15 bp, Homo sapiens
tgggccactctcccc

SEQ ID NO: 2865461 - DNA, 19 bp, Homo sapiens
tgggctccctgactgggag

SEQ ID NO: 2865462 - DNA, 16 bp, Homo sapiens
tgggctgagggagcct

SEQ ID NO: 2865463 - DNA, 15 bp, Homo sapiens
tgggcttcattccgg

SEQ ID NO: 2865464 - DNA, 14 bp, Homo sapiens
tggggcctggccca

SEQ ID NO: 2865465 - DNA, 22 bp, Homo sapiens
tggggcctggcccacgccctcc

SEQ ID NO: 2865466 - DNA, 23 bp, Homo sapiens
tggggttcaagaagtaatcagta

SEQ ID NO: 2865467 - DNA, 14 bp, Homo sapiens
tgggtgacagagca

SEQ ID NO: 2865468 - DNA, 21 bp, Homo sapiens
tgggttttgtattctctgagc

SEQ ID NO: 2865469 - DNA, 18 bp, Homo sapiens
tggtaggttgggacacca

SEQ ID NO: 2865470 - DNA, 21 bp, Homo sapiens
tggtaggttgggacaccaggg

SEQ ID NO: 2865471 - DNA, 22 bp, Homo sapiens
tggtcagccctagggtggagag

SEQ ID NO: 2865472 - DNA, 20 bp, Homo sapiens
tggtcctatttttgtgaaga

SEQ ID NO: 2865473 - DNA, 21 bp, Homo sapiens
tggtcctatttttgtgaagag

SEQ ID NO: 2865474 - DNA, 12 bp, Homo sapiens
tggtcctttggg

SEQ ID NO: 2865475 - DNA, 13 bp, Homo sapiens
tggtcttcactgc

SEQ ID NO: 2865476 - DNA, 20 bp, Homo sapiens
tggtgaagggaagtggggag

SEQ ID NO: 2865477 - DNA, 18 bp, Homo sapiens
tggtgtaatctcaatgca

SEQ ID NO: 2865478 - DNA, 16 bp, Homo sapiens
tggtgtgatcgtctga

SEQ ID NO: 2865479 - DNA, 23 bp, Homo sapiens
tggttaccactcttttgctgtgc

SEQ ID NO: 2865480 - DNA, 11 bp, Homo sapiens
tggttctaact

SEQ ID NO: 2865481 - DNA, 18 bp, Homo sapiens
tggttgatgtttaaagag

SEQ ID NO: 2865482 - DNA, 22 bp, Homo sapiens
tgtaaaaaatgtctcatgtcaa

SEQ ID NO: 2865483 - DNA, 20 bp, Homo sapiens
tgtaaatgaagatctttata

SEQ ID NO: 2865484 - DNA, 16 bp, Homo sapiens
tgtaacatccaagcca

SEQ ID NO: 2865485 - DNA, 16 bp, Homo sapiens
tgtaacatgatttccc

SEQ ID NO: 2865486 - DNA, 11 bp, Homo sapiens
tgtaacatgta

SEQ ID NO: 2865487 - DNA, 15 bp, Homo sapiens
tgtaagtgtaaaaaa

SEQ ID NO: 2865488 - DNA, 22 bp, Homo sapiens
tgtaataaacaggtttttagtt

SEQ ID NO: 2865489 - DNA, 13 bp, Homo sapiens
tgtaatctcaatg

SEQ ID NO: 2865490 - DNA, 19 bp, Homo sapiens
tgtaatctcaatgcaagcc

SEQ ID NO: 2865491 - DNA, 21 bp, Homo sapiens
tgtaatcttgaattgtaactg

SEQ ID NO: 2865492 - DNA, 15 bp, Homo sapiens
tgtaattatgtaaat

SEQ ID NO: 2865493 - DNA, 14 bp, Homo sapiens
tgtacaaactcatc

SEQ ID NO: 2865494 - DNA, 20 bp, Homo sapiens
ttttaaaacgtgtaaatgaa

SEQ ID NO: 2865495 - DNA, 18 bp, Homo sapiens
ttttcagcaaattccaga

SEQ ID NO: 2865496 - DNA, 17 bp, Homo sapiens
ttttccaaaagtaaaga

SEQ ID NO: 2865497 - DNA, 16 bp, Homo sapiens
ttttccttctggttct

SEQ ID NO: 2865498 - DNA, 13 bp, Homo sapiens
ttttctcttccct

SEQ ID NO: 2865499 - DNA, 20 bp, Homo sapiens
ttttcttcatgcctgatgaa

SEQ ID NO: 2865500 - DNA, 13 bp, Homo sapiens
ttttgcactgaca

SEQ ID NO: 2865501 - DNA, 17 bp, Homo sapiens
ttttgtattctctgagc

SEQ ID NO: 2865502 - DNA, 13 bp, Homo sapiens
tttttaaagcctt

SEQ ID NO: 2865503 - DNA, 11 bp, Homo sapiens
tttttaactgt

SEQ ID NO: 2865504 - DNA, 18 bp, Homo sapiens
tttttaagctgtttccat

SEQ ID NO: 2865505 - DNA, 13 bp, Homo sapiens
tttttccccccaa

SEQ ID NO: 2865506 - DNA, 15 bp, Homo sapiens
aatatgtaatttcaa

SEQ ID NO: 2865507 - DNA, 23 bp, Homo sapiens
aatatgtaatttcaaaatacatt

SEQ ID NO: 2865508 - DNA, 15 bp, Homo sapiens
aatatttattacctc

SEQ ID NO: 2865509 - DNA, 22 bp, Homo sapiens
aatcaaagccggcctgagaaac

SEQ ID NO: 2865510 - DNA, 17 bp, Homo sapiens
aatcacagttgtgttcc

SEQ ID NO: 2865511 - DNA, 14 bp, Homo sapiens
aatcactgtgctat

SEQ ID NO: 2865512 - DNA, 13 bp, Homo sapiens
aatcagaaagtaa

SEQ ID NO: 2865513 - DNA, 18 bp, Homo sapiens
aatcatgccctgccttgt

SEQ ID NO: 2865514 - DNA, 22 bp, Homo sapiens
aatccaagatattttaaaatct

SEQ ID NO: 2865515 - DNA, 13 bp, Homo sapiens
aatctaactacaa

SEQ ID NO: 2865516 - DNA, 20 bp, Homo sapiens
aatctataagtagtaaatca

SEQ ID NO: 2865517 - DNA, 22 bp, Homo sapiens
aatctatggcttatttctatga

SEQ ID NO: 2865518 - DNA, 13 bp, Homo sapiens
aatctcaatgcaa

SEQ ID NO: 2865519 - DNA, 14 bp, Homo sapiens
aatctcaatgcaag

SEQ ID NO: 2865520 - DNA, 15 bp, Homo sapiens
aatctgggactttca

SEQ ID NO: 2865521 - DNA, 18 bp, Homo sapiens
aatctgtacaaaatggtc

SEQ ID NO: 2865522 - DNA, 18 bp, Homo sapiens
aatctttcctactttcta

SEQ ID NO: 2865523 - DNA, 13 bp, Homo sapiens
aatgaaaaatata

SEQ ID NO: 2865524 - DNA, 18 bp, Homo sapiens
aatgaaaaatataatgtt

SEQ ID NO: 2865525 - DNA, 15 bp, Homo sapiens
aatgaaaatgtcttg

SEQ ID NO: 2865526 - DNA, 16 bp, Homo sapiens
aatgaaaatgtcttgt

SEQ ID NO: 2865527 - DNA, 13 bp, Homo sapiens
aatgaaacatggg

SEQ ID NO: 2865528 - DNA, 23 bp, Homo sapiens
aatgaactttgtcagtgttgcct

SEQ ID NO: 2865529 - DNA, 21 bp, Homo sapiens
aatgaatgggatattttgaaa

SEQ ID NO: 2865530 - DNA, 12 bp, Homo sapiens
aatgatgttata

SEQ ID NO: 2865531 - DNA, 14 bp, Homo sapiens
aatgatgttataca

SEQ ID NO: 2865532 - DNA, 11 bp, Homo sapiens
aatgccagagc

SEQ ID NO: 2865533 - DNA, 13 bp, Homo sapiens
aatgccagagcca

SEQ ID NO: 2865534 - DNA, 18 bp, Homo sapiens
aatgccagagccaacctg

SEQ ID NO: 2865535 - DNA, 21 bp, Homo sapiens
aatgccagagccaacctggac

SEQ ID NO: 2865536 - DNA, 23 bp, Homo sapiens
aatgccagagccaacctggactt

SEQ ID NO: 2865537 - DNA, 15 bp, Homo sapiens
aatgccatcatctcc

SEQ ID NO: 2865538 - DNA, 19 bp, Homo sapiens
aatgcccctgttcatgttt

SEQ ID NO: 2865539 - DNA, 23 bp, Homo sapiens
aatgctcccacctgaatttgtat

SEQ ID NO: 2865540 - DNA, 17 bp, Homo sapiens
aatgctggactggaggc

SEQ ID NO: 2865541 - DNA, 15 bp, Homo sapiens
aatgctgtttctaag

SEQ ID NO: 2865542 - DNA, 18 bp, Homo sapiens
aatgctgtttctaagaaa

SEQ ID NO: 2865543 - DNA, 22 bp, Homo sapiens
aatgctgtttctaagaaaatgt

SEQ ID NO: 2865544 - DNA, 24 bp, Homo sapiens
aatgctgtttctaagaaaatgtag

SEQ ID NO: 2865545 - DNA, 13 bp, Homo sapiens
aatggcatttctc

SEQ ID NO: 2865546 - DNA, 18 bp, Homo sapiens
aatggcatttctctttaa

SEQ ID NO: 2865547 - DNA, 13 bp, Homo sapiens
aatgggagccagg

SEQ ID NO: 2865548 - DNA, 17 bp, Homo sapiens
aatggtcctatttttgt

SEQ ID NO: 2865549 - DNA, 16 bp, Homo sapiens
aatgtaacatgatttc

SEQ ID NO: 2865550 - DNA, 22 bp, Homo sapiens
aatgtagttagctccataaagt

SEQ ID NO: 2865551 - DNA, 13 bp, Homo sapiens
aatgtatcttatt

SEQ ID NO: 2865552 - DNA, 13 bp, Homo sapiens
aatgtccaaaatt

SEQ ID NO: 2865553 - DNA, 19 bp, Homo sapiens
aatgtccaaaatttatatt

SEQ ID NO: 2865554 - DNA, 17 bp, Homo sapiens
aatgtctcatgtcaatg

SEQ ID NO: 2865555 - DNA, 11 bp, Homo sapiens
aatgtcttgtg

SEQ ID NO: 2865556 - DNA, 13 bp, Homo sapiens
aatgtcttgtgtt

SEQ ID NO: 2865557 - DNA, 23 bp, Homo sapiens
aatgtggtctgccaatctgtaca

SEQ ID NO: 2865558 - DNA, 12 bp, Homo sapiens
aatgtgtgagaa

SEQ ID NO: 2865559 - DNA, 19 bp, Homo sapiens
aattaaaacaaatatacat

SEQ ID NO: 2865560 - DNA, 22 bp, Homo sapiens
aacgcttgtagaactcactctg

SEQ ID NO: 2865561 - DNA, 23 bp, Homo sapiens
aacggtgcatccacgcacacatg

SEQ ID NO: 2865562 - DNA, 19 bp, Homo sapiens
aactagaatttattcaatt

SEQ ID NO: 2865563 - DNA, 19 bp, Homo sapiens
aactatcttctttggactt

SEQ ID NO: 2865564 - DNA, 16 bp, Homo sapiens
aactatgttcctaaca

SEQ ID NO: 2865565 - DNA, 22 bp, Homo sapiens
aactatgttcctaacaaaatga

SEQ ID NO: 2865566 - DNA, 13 bp, Homo sapiens
aactcactctggg

SEQ ID NO: 2865567 - DNA, 16 bp, Homo sapiens
aactcactctgggctg

SEQ ID NO: 2865568 - DNA, 23 bp, Homo sapiens
aactctaaccaaggctgtgttta

SEQ ID NO: 2865569 - DNA, 12 bp, Homo sapiens
aactctttcaaa

SEQ ID NO: 2865570 - DNA, 19 bp, Homo sapiens
aactgactttttcccccca

SEQ ID NO: 2865571 - DNA, 23 bp, Homo sapiens
aactgcagggaaaattatttgca

SEQ ID NO: 2865572 - DNA, 13 bp, Homo sapiens
aactgtgtggcag

SEQ ID NO: 2865573 - DNA, 23 bp, Homo sapiens
aacttcagcattgtaattatgta

SEQ ID NO: 2865574 - DNA, 23 bp, Homo sapiens
aagaaaatttgccaatctttcct

SEQ ID NO: 2865575 - DNA, 15 bp, Homo sapiens
aagaaatatattttt

SEQ ID NO: 2865576 - DNA, 15 bp, Homo sapiens
aagaagccctgctgg

SEQ ID NO: 2865577 - DNA, 14 bp, Homo sapiens
aagactgagccaga

SEQ ID NO: 2865578 - DNA, 14 bp, Homo sapiens
aagactggatttgc

SEQ ID NO: 2865579 - DNA, 19 bp, Homo sapiens
aagactggatttgcagaag

SEQ ID NO: 2865580 - DNA, 19 bp, Homo sapiens
aagagggacataagataaa

SEQ ID NO: 2865581 - DNA, 14 bp, Homo sapiens
aagataaaatgatg

SEQ ID NO: 2865582 - DNA, 20 bp, Homo sapiens
aagataaaatgatgttatac

SEQ ID NO: 2865583 - DNA, 17 bp, Homo sapiens
aagatacttacatgttc

SEQ ID NO: 2865584 - DNA, 14 bp, Homo sapiens
aagatagaaagctg

SEQ ID NO: 2865585 - DNA, 16 bp, Homo sapiens
aagatggctgctgcct

SEQ ID NO: 2865586 - DNA, 20 bp, Homo sapiens
aagatggctgctgcctgctc

SEQ ID NO: 2865587 - DNA, 13 bp, Homo sapiens
aagcaatatgcat

SEQ ID NO: 2865588 - DNA, 19 bp, Homo sapiens
aagcacaatttaaaacaat

SEQ ID NO: 2865589 - DNA, 19 bp, Homo sapiens
aagcaggaaggatggcaag

SEQ ID NO: 2865590 - DNA, 13 bp, Homo sapiens
aagcattcacaac

SEQ ID NO: 2865591 - DNA, 15 bp, Homo sapiens
aagcattctgtttat

SEQ ID NO: 2865592 - DNA, 17 bp, Homo sapiens
aagcattgcctggactg

SEQ ID NO: 2865593 - DNA, 18 bp, Homo sapiens
aagcattgcctggactga

SEQ ID NO: 2865594 - DNA, 12 bp, Homo sapiens
aagcattttgaa

SEQ ID NO: 2865595 - DNA, 16 bp, Homo sapiens
aagcattttgaaacaa

SEQ ID NO: 2865596 - DNA, 20 bp, Homo sapiens
aagcattttgaaacaaagta

SEQ ID NO: 2865597 - DNA, 15 bp, Homo sapiens
aagccaaaggcagct

SEQ ID NO: 2865598 - DNA, 19 bp, Homo sapiens
aagccaaaggcagctaaga

SEQ ID NO: 2865599 - DNA, 10 bp, Homo sapiens
aagccagagt

SEQ ID NO: 2865600 - DNA, 21 bp, Homo sapiens
aagccagagtttttaaagcct

SEQ ID NO: 2865601 - DNA, 19 bp, Homo sapiens
aagccagcgtcctcctctg

SEQ ID NO: 2865602 - DNA, 18 bp, Homo sapiens
aagcccaatattataatt

SEQ ID NO: 2865603 - DNA, 23 bp, Homo sapiens
aagcccagcactgcttgaggaaa

SEQ ID NO: 2865604 - DNA, 18 bp, Homo sapiens
aagccgactctggccctg

SEQ ID NO: 2865605 - DNA, 15 bp, Homo sapiens
aagcctactatttaa

SEQ ID NO: 2865606 - DNA, 22 bp, Homo sapiens
aagcctggatgccaaggagccc

SEQ ID NO: 2865607 - DNA, 15 bp, Homo sapiens
aagctggactgacca

SEQ ID NO: 2865608 - DNA, 16 bp, Homo sapiens
aagctggactgaccaa

SEQ ID NO: 2865609 - DNA, 18 bp, Homo sapiens
aagctgttattcttgtta

SEQ ID NO: 2865610 - DNA, 22 bp, Homo sapiens
aaggatggcaagcacgggacag

SEQ ID NO: 2865611 - DNA, 15 bp, Homo sapiens
aaggcaagcttgagg

SEQ ID NO: 2865612 - DNA, 18 bp, Homo sapiens
aaggcttctctctgtggg

SEQ ID NO: 2865613 - DNA, 15 bp, Homo sapiens
aaggcttggctggtg

SEQ ID NO: 2865614 - DNA, 16 bp, Homo sapiens
aagggaaaggcaagct

SEQ ID NO: 2865615 - DNA, 15 bp, Homo sapiens
aagtaaaacagtcat

SEQ ID NO: 2865616 - DNA, 18 bp, Homo sapiens
agaagtgatatggtgaag

SEQ ID NO: 2865617 - DNA, 17 bp, Homo sapiens
agaatactgccaaaaca

SEQ ID NO: 2865618 - DNA, 22 bp, Homo sapiens
agaatatttattacctctgata

SEQ ID NO: 2865619 - DNA, 14 bp, Homo sapiens
agaattgggaagct

SEQ ID NO: 2865620 - DNA, 22 bp, Homo sapiens
agaatttttaactgtactgaat

SEQ ID NO: 2865621 - DNA, 15 bp, Homo sapiens
agacagacattcacc

SEQ ID NO: 2865622 - DNA, 14 bp, Homo sapiens
agacccacacatgt

SEQ ID NO: 2865623 - DNA, 17 bp, Homo sapiens
agacccagccctcatcc

SEQ ID NO: 2865624 - DNA, 18 bp, Homo sapiens
agacccagccctcatccc

SEQ ID NO: 2865625 - DNA, 13 bp, Homo sapiens
agacccctcccct

SEQ ID NO: 2865626 - DNA, 19 bp, Homo sapiens
agaccccttcctttcctct

SEQ ID NO: 2865627 - DNA, 16 bp, Homo sapiens
agaccctctttcttgt

SEQ ID NO: 2865628 - DNA, 17 bp, Homo sapiens
agaccctctttcttgtt

SEQ ID NO: 2865629 - DNA, 17 bp, Homo sapiens
agacctggctctcagag

SEQ ID NO: 2865630 - DNA, 18 bp, Homo sapiens
agacctggctctcagagg

SEQ ID NO: 2865631 - DNA, 13 bp, Homo sapiens
agacgcctgagga

SEQ ID NO: 2865632 - DNA, 17 bp, Homo sapiens
agactgagccagattgg

SEQ ID NO: 2865633 - DNA, 17 bp, Homo sapiens
agactggatttgcagaa

SEQ ID NO: 2865634 - DNA, 20 bp, Homo sapiens
agactgggctgagggagcct

SEQ ID NO: 2865635 - DNA, 22 bp, Homo sapiens
agacttgaaatacgtttgtgtt

SEQ ID NO: 2865636 - DNA, 20 bp, Homo sapiens
agacttggagaatactgcca

SEQ ID NO: 2865637 - DNA, 17 bp, Homo sapiens
agacttggggaccagag

SEQ ID NO: 2865638 - DNA, 22 bp, Homo sapiens
agagaagggggattggagggaa

SEQ ID NO: 2865639 - DNA, 23 bp, Homo sapiens
agagacccctcccctcccaccca

SEQ ID NO: 2865640 - DNA, 20 bp, Homo sapiens
agagaccccttcctttcctc

SEQ ID NO: 2865641 - DNA, 16 bp, Homo sapiens
agagacttggggacca

SEQ ID NO: 2865642 - DNA, 18 bp, Homo sapiens
agagacttggggaccaga

SEQ ID NO: 2865643 - DNA, 14 bp, Homo sapiens
agagagcctgtcac

SEQ ID NO: 2865644 - DNA, 21 bp, Homo sapiens
agagagcctgtcaccagagct

SEQ ID NO: 2865645 - DNA, 16 bp, Homo sapiens
agagagggactcaagg

SEQ ID NO: 2865646 - DNA, 16 bp, Homo sapiens
agagattacctcctga

SEQ ID NO: 2865647 - DNA, 19 bp, Homo sapiens
agagattacctcctgagaa

SEQ ID NO: 2865648 - DNA, 20 bp, Homo sapiens
agagattttgtcgggacaga

SEQ ID NO: 2865649 - DNA, 18 bp, Homo sapiens
agagcaattccaggctga

SEQ ID NO: 2865650 - DNA, 22 bp, Homo sapiens
agagcaattccaggctgagcca

SEQ ID NO: 2865651 - DNA, 14 bp, Homo sapiens
agagccagctctct

SEQ ID NO: 2865652 - DNA, 15 bp, Homo sapiens
agagcccctcctcca

SEQ ID NO: 2865653 - DNA, 20 bp, Homo sapiens
agagcccctcctccagcccc

SEQ ID NO: 2865654 - DNA, 14 bp, Homo sapiens
agagcctgagggat

SEQ ID NO: 2865655 - DNA, 12 bp, Homo sapiens
agagcctgtcac

SEQ ID NO: 2865656 - DNA, 20 bp, Homo sapiens
agagcctgtcaccagagctt

SEQ ID NO: 2865657 - DNA, 20 bp, Homo sapiens
agagctagaaaaataaaatg

SEQ ID NO: 2865658 - DNA, 21 bp, Homo sapiens
agagctagaaaaataaaatgt

SEQ ID NO: 2865659 - DNA, 20 bp, Homo sapiens
agagcttccctgactcattc

SEQ ID NO: 2865660 - DNA, 16 bp, Homo sapiens
acagataacttcttta

SEQ ID NO: 2865661 - DNA, 19 bp, Homo sapiens
acagatcttttttttttcc

SEQ ID NO: 2865662 - DNA, 15 bp, Homo sapiens
acagcccagagcctg

SEQ ID NO: 2865663 - DNA, 18 bp, Homo sapiens
acagcccagagcctggct

SEQ ID NO: 2865664 - DNA, 21 bp, Homo sapiens
acagcctcccctgccagggca

SEQ ID NO: 2865665 - DNA, 21 bp, Homo sapiens
acaggaggggcccacaatgga

SEQ ID NO: 2865666 - DNA, 18 bp, Homo sapiens
acaggcacattaactgtt

SEQ ID NO: 2865667 - DNA, 21 bp, Homo sapiens
acagggtgtggtatgaggggg

SEQ ID NO: 2865668 - DNA, 17 bp, Homo sapiens
acaggtctagactttct

SEQ ID NO: 2865669 - DNA, 13 bp, Homo sapiens
acagtaggagccc

SEQ ID NO: 2865670 - DNA, 14 bp, Homo sapiens
acagtaggagccca

SEQ ID NO: 2865671 - DNA, 14 bp, Homo sapiens
acagtcttccattt

SEQ ID NO: 2865672 - DNA, 23 bp, Homo sapiens
acagttgctgtgaactttcatgt

SEQ ID NO: 2865673 - DNA, 13 bp, Homo sapiens
acagtttccaaat

SEQ ID NO: 2865674 - DNA, 21 bp, Homo sapiens
acagtttttgacatttatatt

SEQ ID NO: 2865675 - DNA, 13 bp, Homo sapiens
acataaattagag

SEQ ID NO: 2865676 - DNA, 20 bp, Homo sapiens
acataacttctcatgtatat

SEQ ID NO: 2865677 - DNA, 16 bp, Homo sapiens
acatacaagaaaatgt

SEQ ID NO: 2865678 - DNA, 19 bp, Homo sapiens
acatacgggctttaatagt

SEQ ID NO: 2865679 - DNA, 24 bp, Homo sapiens
acatatgctgatcttttaaaatca

SEQ ID NO: 2865680 - DNA, 20 bp, Homo sapiens
acatatttgtatgtttttct

SEQ ID NO: 2865681 - DNA, 20 bp, Homo sapiens
acatcagcctccttctttca

SEQ ID NO: 2865682 - DNA, 21 bp, Homo sapiens
acatgaccctaaatcttgact

SEQ ID NO: 2865683 - DNA, 14 bp, Homo sapiens
acatggacacagac

SEQ ID NO: 2865684 - DNA, 23 bp, Homo sapiens
acatgggagccgggtctgcctct

SEQ ID NO: 2865685 - DNA, 20 bp, Homo sapiens
acatgggctgtgattactgc

SEQ ID NO: 2865686 - DNA, 17 bp, Homo sapiens
acatggggcctggccca

SEQ ID NO: 2865687 - DNA, 18 bp, Homo sapiens
acatgttcccaaaacaat

SEQ ID NO: 2865688 - DNA, 19 bp, Homo sapiens
acatgttcccaaaacaatg

SEQ ID NO: 2865689 - DNA, 20 bp, Homo sapiens
acattcttcagtttttcact

SEQ ID NO: 2865690 - DNA, 11 bp, Homo sapiens
acatttatatt

SEQ ID NO: 2865691 - DNA, 20 bp, Homo sapiens
acatttggagtgttcccctt

SEQ ID NO: 2865692 - DNA, 19 bp, Homo sapiens
acattttatcattaaaaat

SEQ ID NO: 2865693 - DNA, 18 bp, Homo sapiens
accaaagactgcagaacc

SEQ ID NO: 2865694 - DNA, 11 bp, Homo sapiens
accaatacaaa

SEQ ID NO: 2865695 - DNA, 13 bp, Homo sapiens
accaatcctggac

SEQ ID NO: 2865696 - DNA, 13 bp, Homo sapiens
accacttcattct

SEQ ID NO: 2865697 - DNA, 15 bp, Homo sapiens
accactttattgcaa

SEQ ID NO: 2865698 - DNA, 18 bp, Homo sapiens
accactttattgcaatgc

SEQ ID NO: 2865699 - DNA, 22 bp, Homo sapiens
accagagcttctctgggctgaa

SEQ ID NO: 2865700 - DNA, 23 bp, Homo sapiens
accagcgaggaggctccagaggg

SEQ ID NO: 2865701 - DNA, 18 bp, Homo sapiens
accaggaaaggcttggct

SEQ ID NO: 2865702 - DNA, 19 bp, Homo sapiens
accaggccttcatcctcct

SEQ ID NO: 2865703 - DNA, 20 bp, Homo sapiens
accagggttgaccccagagg

SEQ ID NO: 2865704 - DNA, 21 bp, Homo sapiens
accagggttgaccccagagga

SEQ ID NO: 2865705 - DNA, 22 bp, Homo sapiens
accagtgttagggaagggcctg

SEQ ID NO: 2865706 - DNA, 16 bp, Homo sapiens
accagttaagaatgga

SEQ ID NO: 2865707 - DNA, 14 bp, Homo sapiens
accatcacacatgc

SEQ ID NO: 2865708 - DNA, 21 bp, Homo sapiens
accatctgtgactataaagct

SEQ ID NO: 2865709 - DNA, 14 bp, Homo sapiens
accattcaattagt

SEQ ID NO: 2865710 - DNA, 18 bp, Homo sapiens
actgcagcacctccaggc

SEQ ID NO: 2865711 - DNA, 21 bp, Homo sapiens
actgcagcacctccaggcctg

SEQ ID NO: 2865712 - DNA, 16 bp, Homo sapiens
actgcggaagccaaag

SEQ ID NO: 2865713 - DNA, 17 bp, Homo sapiens
actgcggaagccaaagg

SEQ ID NO: 2865714 - DNA, 22 bp, Homo sapiens
actgcggaagccaaaggcagct

SEQ ID NO: 2865715 - DNA, 17 bp, Homo sapiens
actgcttatgaaaagta

SEQ ID NO: 2865716 - DNA, 15 bp, Homo sapiens
actgcttgaggaaaa

SEQ ID NO: 2865717 - DNA, 15 bp, Homo sapiens
actggaggcccctgg

SEQ ID NO: 2865718 - DNA, 21 bp, Homo sapiens
actggaggcccctggagccag

SEQ ID NO: 2865719 - DNA, 22 bp, Homo sapiens
actggaggcccctggagccaga

SEQ ID NO: 2865720 - DNA, 18 bp, Homo sapiens
actggatttgcagaagtt

SEQ ID NO: 2865721 - DNA, 19 bp, Homo sapiens
actggcgacacgtagcagc

SEQ ID NO: 2865722 - DNA, 17 bp, Homo sapiens
actgggctgagggagcc

SEQ ID NO: 2865723 - DNA, 21 bp, Homo sapiens
actggtgtaatctcaatgcaa

SEQ ID NO: 2865724 - DNA, 22 bp, Homo sapiens
actggtgttatcaccgtgggct

SEQ ID NO: 2865725 - DNA, 12 bp, Homo sapiens
actgtactgaat

SEQ ID NO: 2865726 - DNA, 23 bp, Homo sapiens
actgtatgggggagattgaactt

SEQ ID NO: 2865727 - DNA, 17 bp, Homo sapiens
actgttgcacttttgaa

SEQ ID NO: 2865728 - DNA, 20 bp, Homo sapiens
acttacatgttcccaaaaca

SEQ ID NO: 2865729 - DNA, 19 bp, Homo sapiens
acttaggtttcaggaagtt

SEQ ID NO: 2865730 - DNA, 17 bp, Homo sapiens
acttataattttcctaa

SEQ ID NO: 2865731 - DNA, 18 bp, Homo sapiens
acttcagcattgtaatta

SEQ ID NO: 2865732 - DNA, 15 bp, Homo sapiens
acttcattcttgaaa

SEQ ID NO: 2865733 - DNA, 21 bp, Homo sapiens
acttccaaatcccctaagcag

SEQ ID NO: 2865734 - DNA, 15 bp, Homo sapiens
acttcccactgtatg

SEQ ID NO: 2865735 - DNA, 16 bp, Homo sapiens
acttctgaagagacca

SEQ ID NO: 2865736 - DNA, 16 bp, Homo sapiens
acttgcttctctagct

SEQ ID NO: 2865737 - DNA, 19 bp, Homo sapiens
acttggagaatactgccaa

SEQ ID NO: 2865738 - DNA, 18 bp, Homo sapiens
acttgttaacctttctaa

SEQ ID NO: 2865739 - DNA, 18 bp, Homo sapiens
actttaaccctctcttcc

SEQ ID NO: 2865740 - DNA, 14 bp, Homo sapiens
actttataaaagca

SEQ ID NO: 2865741 - DNA, 17 bp, Homo sapiens
actttattaagtaaaat

SEQ ID NO: 2865742 - DNA, 18 bp, Homo sapiens
actttattaagtaaaatc

SEQ ID NO: 2865743 - DNA, 13 bp, Homo sapiens
actttattgcaat

SEQ ID NO: 2865744 - DNA, 18 bp, Homo sapiens
actttattgcaatgcaga

SEQ ID NO: 2865745 - DNA, 16 bp, Homo sapiens
actttcctacaaaatg

SEQ ID NO: 2865746 - DNA, 17 bp, Homo sapiens
actttcctacaaaatgg

SEQ ID NO: 2865747 - DNA, 12 bp, Homo sapiens
actttctatttt

SEQ ID NO: 2865748 - DNA, 20 bp, Homo sapiens
actttctatttttatgatga

SEQ ID NO: 2865749 - DNA, 12 bp, Homo sapiens
actttgggaggc

SEQ ID NO: 2865750 - DNA, 14 bp, Homo sapiens
actttgtcagtgtt

SEQ ID NO: 2865751 - DNA, 22 bp, Homo sapiens
actttgtcagtgttgcctcttg

SEQ ID NO: 2865752 - DNA, 21 bp, Homo sapiens
actttttcatagtaagtgcga

SEQ ID NO: 2865753 - DNA, 15 bp, Homo sapiens
agaaaaataaaatgt

SEQ ID NO: 2865754 - DNA, 16 bp, Homo sapiens
agaaaaataaaatgtt

SEQ ID NO: 2865755 - DNA, 12 bp, Homo sapiens
agaaaaccactt

SEQ ID NO: 2865756 - DNA, 16 bp, Homo sapiens
agaaacaaacaaaact

SEQ ID NO: 2865757 - DNA, 18 bp, Homo sapiens
agaaacaacaatttctac

SEQ ID NO: 2865758 - DNA, 20 bp, Homo sapiens
agaaacactatttgtgactt

SEQ ID NO: 2865759 - DNA, 13 bp, Homo sapiens
agaaacagccagc

SEQ ID NO: 2865760 - DNA, 18 bp, Homo sapiens
agaaaccttattgtacct

SEQ ID NO: 2865761 - DNA, 21 bp, Homo sapiens
agaaagcacaatttaaaacaa

SEQ ID NO: 2865762 - DNA, 18 bp, Homo sapiens
agaaagcctaaaattgag

SEQ ID NO: 2865763 - DNA, 19 bp, Homo sapiens
agaaagcctccgctgggct

SEQ ID NO: 2865764 - DNA, 15 bp, Homo sapiens
agaaagctggactga

SEQ ID NO: 2865765 - DNA, 16 bp, Homo sapiens
agaaagctggactgac

SEQ ID NO: 2865766 - DNA, 18 bp, Homo sapiens
agaaagtcaaaaaattat

SEQ ID NO: 2865767 - DNA, 17 bp, Homo sapiens
agaaataataaaaagaa

SEQ ID NO: 2865768 - DNA, 14 bp, Homo sapiens
agaacccccaggtg

SEQ ID NO: 2865769 - DNA, 17 bp, Homo sapiens
agaactcagttttaact

SEQ ID NO: 2865770 - DNA, 22 bp, Homo sapiens
agaagaggaggagggattctgg

SEQ ID NO: 2865771 - DNA, 21 bp, Homo sapiens
agaagcaataataaagtactt

SEQ ID NO: 2865772 - DNA, 18 bp, Homo sapiens
agaagcttccattccaag

SEQ ID NO: 2865773 - DNA, 15 bp, Homo sapiens
agaagtaatcagtat

SEQ ID NO: 2865774 - DNA, 18 bp, Homo sapiens
caccaccttggactcctc

SEQ ID NO: 2865775 - DNA, 15 bp, Homo sapiens
caccagagcttctct

SEQ ID NO: 2865776 - DNA, 17 bp, Homo sapiens
caccagagcttctctgg

SEQ ID NO: 2865777 - DNA, 20 bp, Homo sapiens
caccagagcttctctgggct

SEQ ID NO: 2865778 - DNA, 13 bp, Homo sapiens
caccagggaagaa

SEQ ID NO: 2865779 - DNA, 23 bp, Homo sapiens
caccagggttgaccccagaggat

SEQ ID NO: 2865780 - DNA, 11 bp, Homo sapiens
caccagtgcct

SEQ ID NO: 2865781 - DNA, 15 bp, Homo sapiens
caccatcacacatgc

SEQ ID NO: 2865782 - DNA, 19 bp, Homo sapiens
cacccaatcaagggaagaa

SEQ ID NO: 2865783 - DNA, 15 bp, Homo sapiens
cacccacagccatag

SEQ ID NO: 2865784 - DNA, 14 bp, Homo sapiens
caccccctcattcc

SEQ ID NO: 2865785 - DNA, 14 bp, Homo sapiens
cacccccttccccc

SEQ ID NO: 2865786 - DNA, 23 bp, Homo sapiens
caccccttaccccaaagagaaag

SEQ ID NO: 2865787 - DNA, 15 bp, Homo sapiens
caccctccactcagc

SEQ ID NO: 2865788 - DNA, 14 bp, Homo sapiens
cacctccaggcctg

SEQ ID NO: 2865789 - DNA, 20 bp, Homo sapiens
cacctctggctagagccgag

SEQ ID NO: 2865790 - DNA, 21 bp, Homo sapiens
cacctgtaatcccagctactt

SEQ ID NO: 2865791 - DNA, 22 bp, Homo sapiens
cacctgtccccaccctccactc

SEQ ID NO: 2865792 - DNA, 16 bp, Homo sapiens
caccttcatgattata

SEQ ID NO: 2865793 - DNA, 21 bp, Homo sapiens
caccttggactcctcccacaa

SEQ ID NO: 2865794 - DNA, 14 bp, Homo sapiens
cacgccctccctct

SEQ ID NO: 2865795 - DNA, 14 bp, Homo sapiens
cacgctttctagct

SEQ ID NO: 2865796 - DNA, 17 bp, Homo sapiens
cacgctttctagctgtt

SEQ ID NO: 2865797 - DNA, 15 bp, Homo sapiens
cacggagccactcct

SEQ ID NO: 2865798 - DNA, 16 bp, Homo sapiens
cacggagccactcctc

SEQ ID NO: 2865799 - DNA, 12 bp, Homo sapiens
cactactgcagc

SEQ ID NO: 2865800 - DNA, 17 bp, Homo sapiens
cactatggtatttgagt

SEQ ID NO: 2865801 - DNA, 19 bp, Homo sapiens
cactcaatccatccatgta

SEQ ID NO: 2865802 - DNA, 17 bp, Homo sapiens
cactccaccctccacct

SEQ ID NO: 2865803 - DNA, 18 bp, Homo sapiens
cactccaccctccacctt

SEQ ID NO: 2865804 - DNA, 21 bp, Homo sapiens
cactccaccctccaccttcca

SEQ ID NO: 2865805 - DNA, 19 bp, Homo sapiens
cactcccagcagctcaacc

SEQ ID NO: 2865806 - DNA, 13 bp, Homo sapiens
cactcccttgggc

SEQ ID NO: 2865807 - DNA, 20 bp, Homo sapiens
cactcctctgactcagggct

SEQ ID NO: 2865808 - DNA, 14 bp, Homo sapiens
cactctcccctccc

SEQ ID NO: 2865809 - DNA, 21 bp, Homo sapiens
cactctcccctccctcttcct

SEQ ID NO: 2865810 - DNA, 22 bp, Homo sapiens
cactctcccctccctcttcctt

SEQ ID NO: 2865811 - DNA, 18 bp, Homo sapiens
cactgagataccagcgag

SEQ ID NO: 2865812 - DNA, 23 bp, Homo sapiens
cactgagataccagcgaggaggc

SEQ ID NO: 2865813 - DNA, 21 bp, Homo sapiens
cactgagttttgtttcacttt

SEQ ID NO: 2865814 - DNA, 14 bp, Homo sapiens
cactgccatgcctc

SEQ ID NO: 2865815 - DNA, 12 bp, Homo sapiens
cactgcctgcct

SEQ ID NO: 2865816 - DNA, 13 bp, Homo sapiens
cactgcctgcctc

SEQ ID NO: 2865817 - DNA, 23 bp, Homo sapiens
cactgcctgcctcccctccgcag

SEQ ID NO: 2865818 - DNA, 19 bp, Homo sapiens
cactgccttcgtttatatt

SEQ ID NO: 2865819 - DNA, 18 bp, Homo sapiens
cactggtaggttgggaca

SEQ ID NO: 2865820 - DNA, 17 bp, Homo sapiens
cactgtccttccctgcc

SEQ ID NO: 2865821 - DNA, 20 bp, Homo sapiens
cactgtccttccctgccact

SEQ ID NO: 2865822 - DNA, 17 bp, Homo sapiens
cacttcaacccccagct

SEQ ID NO: 2865823 - DNA, 20 bp, Homo sapiens
cactttaaccctctcttccc

SEQ ID NO: 2865824 - DNA, 19 bp, Homo sapiens
cactttcctacaaaatgga

SEQ ID NO: 2865825 - DNA, 12 bp, Homo sapiens
cactttgggagg

SEQ ID NO: 2865826 - DNA, 15 bp, Homo sapiens
cacttttagaaatgc

SEQ ID NO: 2865827 - DNA, 17 bp, Homo sapiens
cacttttagaaatgcat

SEQ ID NO: 2865828 - DNA, 17 bp, Homo sapiens
cacttttgacaaaggca

SEQ ID NO: 2865829 - DNA, 18 bp, Homo sapiens
cacttttgacaaaggcaa

SEQ ID NO: 2865830 - DNA, 15 bp, Homo sapiens
cagaaagcctccgct

SEQ ID NO: 2865831 - DNA, 20 bp, Homo sapiens
cagaacccccaggtggcctg

SEQ ID NO: 2865832 - DNA, 14 bp, Homo sapiens
cagaactctttcaa

SEQ ID NO: 2865833 - DNA, 13 bp, Homo sapiens
cagaagaaaattt

SEQ ID NO: 2865834 - DNA, 23 bp, Homo sapiens
cagaagcattgcctggactgacc

SEQ ID NO: 2865835 - DNA, 15 bp, Homo sapiens
cagaaggtgaacttt

SEQ ID NO: 2865836 - DNA, 21 bp, Homo sapiens
cagaaggtgaactttgtgctt

SEQ ID NO: 2865837 - DNA, 16 bp, Homo sapiens
cagaccaggaaaggct

SEQ ID NO: 2865838 - DNA, 17 bp, Homo sapiens
cagaccaggaaaggctt

SEQ ID NO: 2865839 - DNA, 20 bp, Homo sapiens
cagaccaggaaaggcttggc

SEQ ID NO: 2865840 - DNA, 14 bp, Homo sapiens
cagactcagctcca

SEQ ID NO: 2865841 - DNA, 20 bp, Homo sapiens
cagagaccccttcctttcct

SEQ ID NO: 2865842 - DNA, 16 bp, Homo sapiens
cagagagtcctttggg

SEQ ID NO: 2865843 - DNA, 20 bp, Homo sapiens
cagagcaagactctgtctca

SEQ ID NO: 2865844 - DNA, 18 bp, Homo sapiens
cagagcaattccaggctg

SEQ ID NO: 2865845 - DNA, 23 bp, Homo sapiens
cagagcaattccaggctgagcca

SEQ ID NO: 2865846 - DNA, 13 bp, Homo sapiens
cagagcagagagc

SEQ ID NO: 2865847 - DNA, 17 bp, Homo sapiens
cagagcccctcctccag

SEQ ID NO: 2865848 - DNA, 21 bp, Homo sapiens
cagagcccctcctccagcccc

SEQ ID NO: 2865849 - DNA, 22 bp, Homo sapiens
cagagcccctcctccagcccct

SEQ ID NO: 2865850 - DNA, 17 bp, Homo sapiens
cagagcttctctgggct

SEQ ID NO: 2865851 - DNA, 20 bp, Homo sapiens
cagagcttctctgggctgaa

SEQ ID NO: 2865852 - DNA, 21 bp, Homo sapiens
cagagcttctctgggctgaat

SEQ ID NO: 2865853 - DNA, 23 bp, Homo sapiens
cagagcttctctgggctgaatgt

SEQ ID NO: 2865854 - DNA, 21 bp, Homo sapiens
cagaggaaggggccagaggct

SEQ ID NO: 2865855 - DNA, 22 bp, Homo sapiens
cagaggactcccaaccctggct

SEQ ID NO: 2865856 - DNA, 15 bp, Homo sapiens
cagaggtgacagtgg

SEQ ID NO: 2865857 - DNA, 14 bp, Homo sapiens
cagagtgagaccca

SEQ ID NO: 2865858 - DNA, 15 bp, Homo sapiens
cagagtgagacccag

SEQ ID NO: 2865859 - DNA, 20 bp, Homo sapiens
cagagtgagacccagccctc

SEQ ID NO: 2865860 - DNA, 13 bp, Homo sapiens
cagagtttttaaa

SEQ ID NO: 2865861 - DNA, 22 bp, Homo sapiens
cagagtttttaaagccttctgg

SEQ ID NO: 2865862 - DNA, 14 bp, Homo sapiens
cagataatgtgaaa

SEQ ID NO: 2865863 - DNA, 16 bp, Homo sapiens
cagataatgtgaaaat

SEQ ID NO: 2865864 - DNA, 17 bp, Homo sapiens
cagatgatgctttggaa

SEQ ID NO: 2865865 - DNA, 17 bp, Homo sapiens
cagattggccaattaaa

SEQ ID NO: 2865866 - DNA, 15 bp, Homo sapiens
cagattttaattttg

SEQ ID NO: 2865867 - DNA, 15 bp, Homo sapiens
cagcaaacactccac

SEQ ID NO: 2865868 - DNA, 13 bp, Homo sapiens
cagcaacacagag

SEQ ID NO: 2865869 - DNA, 14 bp, Homo sapiens
cagcagctcaacct

SEQ ID NO: 2865870 - DNA, 18 bp, Homo sapiens
cagcagctcaacctaccc

SEQ ID NO: 2865871 - DNA, 16 bp, Homo sapiens
cagcagggaagctctt

SEQ ID NO: 2865872 - DNA, 21 bp, Homo sapiens
cagcagggctaccctgagctg

SEQ ID NO: 2865873 - DNA, 20 bp, Homo sapiens
cagcagtgtgaggccagggc

SEQ ID NO: 2865874 - DNA, 22 bp, Homo sapiens
cagcagtgtgaggccagggcag

SEQ ID NO: 2865875 - DNA, 15 bp, Homo sapiens
cagcatctgaccatc

SEQ ID NO: 2865876 - DNA, 16 bp, Homo sapiens
cagcatctgaccatct

SEQ ID NO: 2865877 - DNA, 20 bp, Homo sapiens
cagcatctgaccatctgtga

SEQ ID NO: 2865878 - DNA, 18 bp, Homo sapiens
cagccatagacctacaga

SEQ ID NO: 2865879 - DNA, 23 bp, Homo sapiens
cagccatagacctacagacctgg

SEQ ID NO: 2865880 - DNA, 15 bp, Homo sapiens
cagcccagagcctgg

SEQ ID NO: 2865881 - DNA, 22 bp, Homo sapiens
cagcccatccattaggccagca

SEQ ID NO: 2865882 - DNA, 21 bp, Homo sapiens
cagccccacccctaagtgccc

SEQ ID NO: 2865883 - DNA, 23 bp, Homo sapiens
cagccccacccctaagtgcccaa

SEQ ID NO: 2865884 - DNA, 18 bp, Homo sapiens
cagccctagggtggagag

SEQ ID NO: 2865885 - DNA, 14 bp, Homo sapiens
atgtaaactgtgca

SEQ ID NO: 2865886 - DNA, 14 bp, Homo sapiens
atgtaaataactct

SEQ ID NO: 2865887 - DNA, 19 bp, Homo sapiens
atgtaatttcaaaatacat

SEQ ID NO: 2865888 - DNA, 20 bp, Homo sapiens
atgtaatttcaaaatacatt

SEQ ID NO: 2865889 - DNA, 18 bp, Homo sapiens
atgtacaaaaattatgca

SEQ ID NO: 2865890 - DNA, 20 bp, Homo sapiens
atgtacaaaaattatgcaat

SEQ ID NO: 2865891 - DNA, 19 bp, Homo sapiens
atgtacttccctcttgaaa

SEQ ID NO: 2865892 - DNA, 17 bp, Homo sapiens
atgtatatatgtatttc

SEQ ID NO: 2865893 - DNA, 15 bp, Homo sapiens
atgtattttttgaat

SEQ ID NO: 2865894 - DNA, 18 bp, Homo sapiens
atgtcagctgctgttgaa

SEQ ID NO: 2865895 - DNA, 23 bp, Homo sapiens
atgtcagctgctgttgaactttt

SEQ ID NO: 2865896 - DNA, 17 bp, Homo sapiens
atgtcagtaccttcaaa

SEQ ID NO: 2865897 - DNA, 22 bp, Homo sapiens
atgtcagtgctataaatgccag

SEQ ID NO: 2865898 - DNA, 14 bp, Homo sapiens
atgtccaaaattta

SEQ ID NO: 2865899 - DNA, 17 bp, Homo sapiens
atgtgaaaaattaactt

SEQ ID NO: 2865900 - DNA, 18 bp, Homo sapiens
atgtgaaaaattaacttt

SEQ ID NO: 2865901 - DNA, 19 bp, Homo sapiens
atgtgaaaaattaactttt

SEQ ID NO: 2865902 - DNA, 22 bp, Homo sapiens
atgtgaaaatggtccaggagaa

SEQ ID NO: 2865903 - DNA, 19 bp, Homo sapiens
atgtggtctgccaatctgt

SEQ ID NO: 2865904 - DNA, 17 bp, Homo sapiens
atgtgtaataatgtaac

SEQ ID NO: 2865905 - DNA, 21 bp, Homo sapiens
atgtgtgtccacgactgtctc

SEQ ID NO: 2865906 - DNA, 14 bp, Homo sapiens
atgttacattgttt

SEQ ID NO: 2865907 - DNA, 20 bp, Homo sapiens
atgttcacttttgacaaagg

SEQ ID NO: 2865908 - DNA, 21 bp, Homo sapiens
atgtttcattatgcactttta

SEQ ID NO: 2865909 - DNA, 19 bp, Homo sapiens
atgtttttgttcaaagcca

SEQ ID NO: 2865910 - DNA, 20 bp, Homo sapiens
attaaaaaacaattaactgc

SEQ ID NO: 2865911 - DNA, 13 bp, Homo sapiens
attaaaaattacc

SEQ ID NO: 2865912 - DNA, 14 bp, Homo sapiens
attaaaacaaatat

SEQ ID NO: 2865913 - DNA, 14 bp, Homo sapiens
attaaaatcctcaa

SEQ ID NO: 2865914 - DNA, 16 bp, Homo sapiens
attaaaatcctcaatc

SEQ ID NO: 2865915 - DNA, 12 bp, Homo sapiens
attacctcctga

SEQ ID NO: 2865916 - DNA, 13 bp, Homo sapiens
attacctctgata

SEQ ID NO: 2865917 - DNA, 22 bp, Homo sapiens
ataatatttttgtatttctcta

SEQ ID NO: 2865918 - DNA, 19 bp, Homo sapiens
ataatcacagttgtgttcc

SEQ ID NO: 2865919 - DNA, 15 bp, Homo sapiens
ataatcagtaaatag

SEQ ID NO: 2865920 - DNA, 23 bp, Homo sapiens
ataatgggattagaaacaaacaa

SEQ ID NO: 2865921 - DNA, 15 bp, Homo sapiens
ataatgtaacatgat

SEQ ID NO: 2865922 - DNA, 22 bp, Homo sapiens
ataattaaccaaccttgtttaa

SEQ ID NO: 2865923 - DNA, 19 bp, Homo sapiens
ataattgagttttcagtgg

SEQ ID NO: 2865924 - DNA, 14 bp, Homo sapiens
ataatttgaacttt

SEQ ID NO: 2865925 - DNA, 21 bp, Homo sapiens
ataatttttttcaatatttat

SEQ ID NO: 2865926 - DNA, 16 bp, Homo sapiens
atacaagaaaatgtat

SEQ ID NO: 2865927 - DNA, 17 bp, Homo sapiens
atacaagaaaatgtatc

SEQ ID NO: 2865928 - DNA, 18 bp, Homo sapiens
atacagaactctttcaaa

SEQ ID NO: 2865929 - DNA, 23 bp, Homo sapiens
atacagaactctttcaaaacctt

SEQ ID NO: 2865930 - DNA, 20 bp, Homo sapiens
atacagtcttccatttgcaa

SEQ ID NO: 2865931 - DNA, 14 bp, Homo sapiens
atacatcaatatgt

SEQ ID NO: 2865932 - DNA, 16 bp, Homo sapiens
atacatcaatatgtat

SEQ ID NO: 2865933 - DNA, 17 bp, Homo sapiens
atacatcaatatgtata

SEQ ID NO: 2865934 - DNA, 23 bp, Homo sapiens
atacatttgtaagtgtaaaaaat

SEQ ID NO: 2865935 - DNA, 18 bp, Homo sapiens
atacattttctaaataaa

SEQ ID NO: 2865936 - DNA, 19 bp, Homo sapiens
ataccaatgaaaaaatgta

SEQ ID NO: 2865937 - DNA, 15 bp, Homo sapiens
ataccatatgaatga

SEQ ID NO: 2865938 - DNA, 16 bp, Homo sapiens
ataccatatgaatgaa

SEQ ID NO: 2865939 - DNA, 23 bp, Homo sapiens
ataccatatgaatgaaacatggg

SEQ ID NO: 2865940 - DNA, 20 bp, Homo sapiens
atactccactcccagcagct

SEQ ID NO: 2865941 - DNA, 21 bp, Homo sapiens
atactgccaaaacatttatga

SEQ ID NO: 2865942 - DNA, 19 bp, Homo sapiens
atactgtattttgtattgt

SEQ ID NO: 2865943 - DNA, 16 bp, Homo sapiens
atacttttgccctttg

SEQ ID NO: 2865944 - DNA, 16 bp, Homo sapiens
atagaaagctggactg

SEQ ID NO: 2865945 - DNA, 19 bp, Homo sapiens
atagaataattcttttctg

SEQ ID NO: 2865946 - DNA, 20 bp, Homo sapiens
atagaataattcttttctga

SEQ ID NO: 2865947 - DNA, 22 bp, Homo sapiens
atagaatatttattacctctga

SEQ ID NO: 2865948 - DNA, 16 bp, Homo sapiens
atagaccctctttctt

SEQ ID NO: 2865949 - DNA, 19 bp, Homo sapiens
atagaccctctttcttgtt

SEQ ID NO: 2865950 - DNA, 21 bp, Homo sapiens
atagaccctctttcttgtttg

SEQ ID NO: 2865951 - DNA, 21 bp, Homo sapiens
atagacctacagacctggctc

SEQ ID NO: 2865952 - DNA, 19 bp, Homo sapiens
atagacttggagaatactg

SEQ ID NO: 2865953 - DNA, 16 bp, Homo sapiens
atagcaactaatgttt

SEQ ID NO: 2865954 - DNA, 17 bp, Homo sapiens
atagcaactaatgtttg

SEQ ID NO: 2865955 - DNA, 22 bp, Homo sapiens
atagcttgtcttcgtccatctg

SEQ ID NO: 2865956 - DNA, 15 bp, Homo sapiens
atagctttagtgaat

SEQ ID NO: 2865957 - DNA, 22 bp, Homo sapiens
ataggccacagaaggtgaactt

SEQ ID NO: 2865958 - DNA, 18 bp, Homo sapiens
atagggagaatatttact

SEQ ID NO: 2865959 - DNA, 20 bp, Homo sapiens
atagggtctaccaatacaaa

SEQ ID NO: 2865960 - DNA, 18 bp, Homo sapiens
atagtgtcatataaactc

SEQ ID NO: 2865961 - DNA, 21 bp, Homo sapiens
atataatgatcagcaaaaaga

SEQ ID NO: 2865962 - DNA, 15 bp, Homo sapiens
atatacattttctaa

SEQ ID NO: 2865963 - DNA, 23 bp, Homo sapiens
atatacattttctaaataaaaat

SEQ ID NO: 2865964 - DNA, 16 bp, Homo sapiens
atatagacttggagaa

SEQ ID NO: 2865965 - DNA, 22 bp, Homo sapiens
atatagacttggagaatactgc

SEQ ID NO: 2865966 - DNA, 14 bp, Homo sapiens
atatcaaataaaat

SEQ ID NO: 2865967 - DNA, 15 bp, Homo sapiens
atatcaaataaaata

SEQ ID NO: 2865968 - DNA, 17 bp, Homo sapiens
atatcaaataaaatatc

SEQ ID NO: 2865969 - DNA, 23 bp, Homo sapiens
atatcaaataaaatatcataaag

SEQ ID NO: 2865970 - DNA, 16 bp, Homo sapiens
atatcataaagcattt

SEQ ID NO: 2865971 - DNA, 16 bp, Homo sapiens
atatgactgcatttgt

SEQ ID NO: 2865972 - DNA, 17 bp, Homo sapiens
atatgctgatcttttaa

SEQ ID NO: 2865973 - DNA, 13 bp, Homo sapiens
atatgtaatttca

SEQ ID NO: 2865974 - DNA, 19 bp, Homo sapiens
atatgtatatatgtatttc

SEQ ID NO: 2865975 - DNA, 14 bp, Homo sapiens
atattaaataacat

SEQ ID NO: 2865976 - DNA, 22 bp, Homo sapiens
atattaagtgtgccaaatcagt

SEQ ID NO: 2865977 - DNA, 23 bp, Homo sapiens
atattccctagaaacttccaaat

SEQ ID NO: 2865978 - DNA, 23 bp, Homo sapiens
atattgtaatctatgtttataat

SEQ ID NO: 2865979 - DNA, 14 bp, Homo sapiens
atatttaggcaaga

SEQ ID NO: 2865980 - DNA, 14 bp, Homo sapiens
atatttattacctc

SEQ ID NO: 2865981 - DNA, 13 bp, Homo sapiens
atatttgatttct

SEQ ID NO: 2865982 - DNA, 14 bp, Homo sapiens
atatttgatttcta

SEQ ID NO: 2865983 - DNA, 16 bp, Homo sapiens
atatttgatttctaat

SEQ ID NO: 2865984 - DNA, 20 bp, Homo sapiens
atatttgtatgtttttctgt

SEQ ID NO: 2865985 - DNA, 15 bp, Homo sapiens
atattttaaattctc

SEQ ID NO: 2865986 - DNA, 18 bp, Homo sapiens
atattttaaattctcata

SEQ ID NO: 2865987 - DNA, 19 bp, Homo sapiens
atattttgaaatgaacttt

SEQ ID NO: 2865988 - DNA, 19 bp, Homo sapiens
atatttttgtatttctcta

SEQ ID NO: 2865989 - DNA, 14 bp, Homo sapiens
atatttttttaact

SEQ ID NO: 2865990 - DNA, 17 bp, Homo sapiens
atatttttttaactgtg

SEQ ID NO: 2865991 - DNA, 22 bp, Homo sapiens
atcaaactgcttatgaaaagta

SEQ ID NO: 2865992 - DNA, 21 bp, Homo sapiens
atcaatcatgccctgccttgt

SEQ ID NO: 2865993 - DNA, 19 bp, Homo sapiens
atcactgccttcgtttata

SEQ ID NO: 2865994 - DNA, 19 bp, Homo sapiens
atcacttgaggtcaggagt

SEQ ID NO: 2865995 - DNA, 15 bp, Homo sapiens
atcagcaaaaagact

SEQ ID NO: 2865996 - DNA, 20 bp, Homo sapiens
atcagcaaaaagactggatt

SEQ ID NO: 2865997 - DNA, 15 bp, Homo sapiens
atcagctccttcctg

SEQ ID NO: 2865998 - DNA, 18 bp, Homo sapiens
atcagtaaatagtgtcat

SEQ ID NO: 2865999 - DNA, 12 bp, Homo sapiens
atcataaagcat

SEQ ID NO: 2866000 - DNA, 20 bp, Homo sapiens
atcatctcctgccttcctcc

SEQ ID NO: 2866001 - DNA, 15 bp, Homo sapiens
atcatttctatttct

SEQ ID NO: 2866002 - DNA, 19 bp, Homo sapiens
atccaagatattttaaaat

SEQ ID NO: 2866003 - DNA, 13 bp, Homo sapiens
atccaagccagag

SEQ ID NO: 2866004 - DNA, 19 bp, Homo sapiens
atccaaggaaacattttat

SEQ ID NO: 2866005 - DNA, 16 bp, Homo sapiens
atcccacgttctgtta

SEQ ID NO: 2866006 - DNA, 17 bp, Homo sapiens
atcccacgttctgttaa

SEQ ID NO: 2866007 - DNA, 22 bp, Homo sapiens
atcccagctacttgggaggctg

SEQ ID NO: 2866008 - DNA, 22 bp, Homo sapiens
atccccacaggcacattaactg

SEQ ID NO: 2866009 - DNA, 14 bp, Homo sapiens
atcccctttcctcc

SEQ ID NO: 2866010 - DNA, 18 bp, Homo sapiens
atcccctttcctccccac

SEQ ID NO: 2866011 - DNA, 19 bp, Homo sapiens
atcccctttcctccccacc

SEQ ID NO: 2866012 - DNA, 17 bp, Homo sapiens
atcccgagcacctccac

SEQ ID NO: 2866013 - DNA, 11 bp, Homo sapiens
atccctcatct

SEQ ID NO: 2866014 - DNA, 17 bp, Homo sapiens
atccctctacagagctt

SEQ ID NO: 2866015 - DNA, 22 bp, Homo sapiens
atccctctacagagcttccctg

SEQ ID NO: 2866016 - DNA, 14 bp, Homo sapiens
atccgaatctcttt

SEQ ID NO: 2866017 - DNA, 21 bp, Homo sapiens
atccgtctttggcctcctcca

SEQ ID NO: 2866018 - DNA, 18 bp, Homo sapiens
atcctcttttaatggcat

SEQ ID NO: 2866019 - DNA, 16 bp, Homo sapiens
atccttgagattctga

SEQ ID NO: 2866020 - DNA, 19 bp, Homo sapiens
atccttgtgttcagctctt

SEQ ID NO: 2866021 - DNA, 18 bp, Homo sapiens
atcgtattaaaaaacaat

SEQ ID NO: 2866022 - DNA, 13 bp, Homo sapiens
atctaacctcatc

SEQ ID NO: 2866023 - DNA, 14 bp, Homo sapiens
atctagaattcact

SEQ ID NO: 2866024 - DNA, 13 bp, Homo sapiens
agccaacctggac

SEQ ID NO: 2866025 - DNA, 16 bp, Homo sapiens
agccaacctggacttc

SEQ ID NO: 2866026 - DNA, 17 bp, Homo sapiens
agccaacctggacttcc

SEQ ID NO: 2866027 - DNA, 14 bp, Homo sapiens
agccaattagactt

SEQ ID NO: 2866028 - DNA, 21 bp, Homo sapiens
agccactcctctgactcaggg

SEQ ID NO: 2866029 - DNA, 22 bp, Homo sapiens
agccactcctctgactcagggc

SEQ ID NO: 2866030 - DNA, 23 bp, Homo sapiens
agccagagtttttaaagccttct

SEQ ID NO: 2866031 - DNA, 17 bp, Homo sapiens
agccagcgtcctcctct

SEQ ID NO: 2866032 - DNA, 11 bp, Homo sapiens
agccagctctc

SEQ ID NO: 2866033 - DNA, 14 bp, Homo sapiens
agccagctctctct

SEQ ID NO: 2866034 - DNA, 15 bp, Homo sapiens
agccagctctctcta

SEQ ID NO: 2866035 - DNA, 20 bp, Homo sapiens
agccaggagtaagacaagtg

SEQ ID NO: 2866036 - DNA, 12 bp, Homo sapiens
agccatgaggag

SEQ ID NO: 2866037 - DNA, 15 bp, Homo sapiens
agcccaatattataa

SEQ ID NO: 2866038 - DNA, 14 bp, Homo sapiens
agcccagctctgaa

SEQ ID NO: 2866039 - DNA, 11 bp, Homo sapiens
agccccacccc

SEQ ID NO: 2866040 - DNA, 21 bp, Homo sapiens
agccccacccctaagtgccca

SEQ ID NO: 2866041 - DNA, 22 bp, Homo sapiens
agcccctcctccagcccctgtc

SEQ ID NO: 2866042 - DNA, 13 bp, Homo sapiens
agcccgcttttgt

SEQ ID NO: 2866043 - DNA, 21 bp, Homo sapiens
agcccgcttttgttcttcccc

SEQ ID NO: 2866044 - DNA, 14 bp, Homo sapiens
agcccggggaggaa

SEQ ID NO: 2866045 - DNA, 16 bp, Homo sapiens
agccctagggtggaga

SEQ ID NO: 2866046 - DNA, 21 bp, Homo sapiens
agccctgctgggcccatgtga

SEQ ID NO: 2866047 - DNA, 12 bp, Homo sapiens
agccgactctgg

SEQ ID NO: 2866048 - DNA, 13 bp, Homo sapiens
agccgactctggc

SEQ ID NO: 2866049 - DNA, 18 bp, Homo sapiens
agccgactctggccctgg

SEQ ID NO: 2866050 - DNA, 16 bp, Homo sapiens
agccgaggggagagag

SEQ ID NO: 2866051 - DNA, 22 bp, Homo sapiens
agccgggtctgcctcttctggg

SEQ ID NO: 2866052 - DNA, 14 bp, Homo sapiens
agcctagtgaaggc

SEQ ID NO: 2866053 - DNA, 20 bp, Homo sapiens
agcctagtgaaggcttctct

SEQ ID NO: 2866054 - DNA, 12 bp, Homo sapiens
agcctcccccaa

SEQ ID NO: 2866055 - DNA, 15 bp, Homo sapiens
agcctcccctgccag

SEQ ID NO: 2866056 - DNA, 18 bp, Homo sapiens
agcctcccctgccagggc

SEQ ID NO: 2866057 - DNA, 15 bp, Homo sapiens
agcctccgctgggct

SEQ ID NO: 2866058 - DNA, 20 bp, Homo sapiens
agcctgtcaccagagcttct

SEQ ID NO: 2866059 - DNA, 22 bp, Homo sapiens
agcctgtcaccagagcttctct

SEQ ID NO: 2866060 - DNA, 17 bp, Homo sapiens
agccttctggatccatg

SEQ ID NO: 2866061 - DNA, 18 bp, Homo sapiens
agccttctggatccatgg

SEQ ID NO: 2866062 - DNA, 19 bp, Homo sapiens
agcgaggaggctccagagg

SEQ ID NO: 2866063 - DNA, 20 bp, Homo sapiens
agcggcagagcaattccagg

SEQ ID NO: 2866064 - DNA, 21 bp, Homo sapiens
agcggcagagcaattccaggc

SEQ ID NO: 2866065 - DNA, 18 bp, Homo sapiens
agcgtggactctgctaga

SEQ ID NO: 2866066 - DNA, 19 bp, Homo sapiens
aggtccagctgggcctcct

SEQ ID NO: 2866067 - DNA, 21 bp, Homo sapiens
aggtccagctgggcctcctgc

SEQ ID NO: 2866068 - DNA, 20 bp, Homo sapiens
aggtgagaccaaaggatcca

SEQ ID NO: 2866069 - DNA, 22 bp, Homo sapiens
aggtgagaccaaaggatccaga

SEQ ID NO: 2866070 - DNA, 18 bp, Homo sapiens
aggtggattcctgggcaa

SEQ ID NO: 2866071 - DNA, 19 bp, Homo sapiens
aggtggggagactgggctg

SEQ ID NO: 2866072 - DNA, 23 bp, Homo sapiens
aggttccgcttggagcagagggg

SEQ ID NO: 2866073 - DNA, 22 bp, Homo sapiens
aggttctgtagagccaattaga

SEQ ID NO: 2866074 - DNA, 16 bp, Homo sapiens
aggtttacactgcgga

SEQ ID NO: 2866075 - DNA, 15 bp, Homo sapiens
agtaaatcagaaagt

SEQ ID NO: 2866076 - DNA, 21 bp, Homo sapiens
agtaaatcagaaagtaacaat

SEQ ID NO: 2866077 - DNA, 17 bp, Homo sapiens
agtaacaatctatggct

SEQ ID NO: 2866078 - DNA, 21 bp, Homo sapiens
agtaacgggacagtaaacact

SEQ ID NO: 2866079 - DNA, 14 bp, Homo sapiens
agtaagtgcgaaga

SEQ ID NO: 2866080 - DNA, 21 bp, Homo sapiens
agtaagtgcgaagactgagcc

SEQ ID NO: 2866081 - DNA, 19 bp, Homo sapiens
agtaatattttactttgag

SEQ ID NO: 2866082 - DNA, 16 bp, Homo sapiens
agtactaatagaactt

SEQ ID NO: 2866083 - DNA, 17 bp, Homo sapiens
agtagcatctcagtggt

SEQ ID NO: 2866084 - DNA, 14 bp, Homo sapiens
agtaggtgatgagt

SEQ ID NO: 2866085 - DNA, 13 bp, Homo sapiens
agtagttaaataa

SEQ ID NO: 2866086 - DNA, 22 bp, Homo sapiens
agtatgcaaagcaatcttttat

SEQ ID NO: 2866087 - DNA, 16 bp, Homo sapiens
agtatttcaaattgga

SEQ ID NO: 2866088 - DNA, 20 bp, Homo sapiens
agtatttcaaattggagctt

SEQ ID NO: 2866089 - DNA, 17 bp, Homo sapiens
agtatttgaacacagtt

SEQ ID NO: 2866090 - DNA, 14 bp, Homo sapiens
agtcaaaaaattat

SEQ ID NO: 2866091 - DNA, 20 bp, Homo sapiens
agtcaagtgcgtccacgagc

SEQ ID NO: 2866092 - DNA, 17 bp, Homo sapiens
agtcaatagcttgtctt

SEQ ID NO: 2866093 - DNA, 16 bp, Homo sapiens
agtcagcagtcatgca

SEQ ID NO: 2866094 - DNA, 23 bp, Homo sapiens
agtcataccaatgaaaaaatgta

SEQ ID NO: 2866095 - DNA, 20 bp, Homo sapiens
agtcctaaaagttctcaatg

SEQ ID NO: 2866096 - DNA, 13 bp, Homo sapiens
agtcctaacaaat

SEQ ID NO: 2866097 - DNA, 12 bp, Homo sapiens
agtcgggaggag

SEQ ID NO: 2866098 - DNA, 16 bp, Homo sapiens
agtctctgagcagtga

SEQ ID NO: 2866099 - DNA, 16 bp, Homo sapiens
agtgaatgattcagtg

SEQ ID NO: 2866100 - DNA, 17 bp, Homo sapiens
agtgacatttaatgcca

SEQ ID NO: 2866101 - DNA, 21 bp, Homo sapiens
agtgagacccagccctcatcc

SEQ ID NO: 2866102 - DNA, 17 bp, Homo sapiens
agtgatatggtgaaggg

SEQ ID NO: 2866103 - DNA, 20 bp, Homo sapiens
agtgatatggtgaagggaag

SEQ ID NO: 2866104 - DNA, 21 bp, Homo sapiens
agtgatgtccttaaaatgtgg

SEQ ID NO: 2866105 - DNA, 16 bp, Homo sapiens
agtgcagtcctgatca

SEQ ID NO: 2866106 - DNA, 23 bp, Homo sapiens
agtgcagtcctgatcagagccgt

SEQ ID NO: 2866107 - DNA, 16 bp, Homo sapiens
agtgcatgaaaaacca

SEQ ID NO: 2866108 - DNA, 21 bp, Homo sapiens
agtgcatgaaaaaccattttt

SEQ ID NO: 2866109 - DNA, 23 bp, Homo sapiens
agtgctataaatgccagagccaa

SEQ ID NO: 2866110 - DNA, 11 bp, Homo sapiens
agtgctctgat

SEQ ID NO: 2866111 - DNA, 17 bp, Homo sapiens
agtgctctgatccctct

SEQ ID NO: 2866112 - DNA, 21 bp, Homo sapiens
agtgctctgatccctctacag

SEQ ID NO: 2866113 - DNA, 21 bp, Homo sapiens
agtgggatttggggcctcaag

SEQ ID NO: 2866114 - DNA, 12 bp, Homo sapiens
agtggggaggga

SEQ ID NO: 2866115 - DNA, 15 bp, Homo sapiens
agtggtcataaaata

SEQ ID NO: 2866116 - DNA, 21 bp, Homo sapiens
agtggtcataaaatagaataa

SEQ ID NO: 2866117 - DNA, 13 bp, Homo sapiens
agtgtctttccac

SEQ ID NO: 2866118 - DNA, 17 bp, Homo sapiens
agtgtgacagtttccaa

SEQ ID NO: 2866119 - DNA, 18 bp, Homo sapiens
agtgtgaggccagggcag

SEQ ID NO: 2866120 - DNA, 18 bp, Homo sapiens
agtgtgccaaatcagttt

SEQ ID NO: 2866121 - DNA, 15 bp, Homo sapiens
agtgttagggaaggg

SEQ ID NO: 2866122 - DNA, 17 bp, Homo sapiens
agtgttccaagtctctg

SEQ ID NO: 2866123 - DNA, 16 bp, Homo sapiens
agtgttccccttccac

SEQ ID NO: 2866124 - DNA, 19 bp, Homo sapiens
agtgttgcctcttgcaatg

SEQ ID NO: 2866125 - DNA, 16 bp, Homo sapiens
agttactaaaattatg

SEQ ID NO: 2866126 - DNA, 23 bp, Homo sapiens
agttagctccataaagtacaaat

SEQ ID NO: 2866127 - DNA, 14 bp, Homo sapiens
agttcctttagaaa

SEQ ID NO: 2866128 - DNA, 15 bp, Homo sapiens
agttctcaaatgtgt

SEQ ID NO: 2866129 - DNA, 16 bp, Homo sapiens
agttctcaaatgtgtg

SEQ ID NO: 2866130 - DNA, 19 bp, Homo sapiens
agttctcaaatgtgtgtgg

SEQ ID NO: 2866131 - DNA, 21 bp, Homo sapiens
agttgatcgcctttcccaggt

SEQ ID NO: 2866132 - DNA, 13 bp, Homo sapiens
agttgtcttatgt

SEQ ID NO: 2866133 - DNA, 21 bp, Homo sapiens
agttgtcttatgtgaaaaatt

SEQ ID NO: 2866134 - DNA, 18 bp, Homo sapiens
agtttgacagtttttgac

SEQ ID NO: 2866135 - DNA, 14 bp, Homo sapiens
agtttgattattca

SEQ ID NO: 2866136 - DNA, 11 bp, Homo sapiens
aaaaacatttt

SEQ ID NO: 2866137 - DNA, 15 bp, Homo sapiens
aaaaataaaatgttt

SEQ ID NO: 2866138 - DNA, 14 bp, Homo sapiens
aaaaatataatgtt

SEQ ID NO: 2866139 - DNA, 16 bp, Homo sapiens
aaaaatataatgttga

SEQ ID NO: 2866140 - DNA, 17 bp, Homo sapiens
aaaaatgggagccagga

SEQ ID NO: 2866141 - DNA, 16 bp, Homo sapiens
aaaaatgtatatgcac

SEQ ID NO: 2866142 - DNA, 15 bp, Homo sapiens
aaaaattaacttttt

SEQ ID NO: 2866143 - DNA, 23 bp, Homo sapiens
aaaaattacctttaattttaatg

SEQ ID NO: 2866144 - DNA, 12 bp, Homo sapiens
aaaaattatgca

SEQ ID NO: 2866145 - DNA, 23 bp, Homo sapiens
aaaagaaatatattttttgttat

SEQ ID NO: 2866146 - DNA, 17 bp, Homo sapiens
aaaatacatttgtaagt

SEQ ID NO: 2866147 - DNA, 16 bp, Homo sapiens
aaaatagaataattct

SEQ ID NO: 2866148 - DNA, 22 bp, Homo sapiens
aaaatagataagagtagaaact

SEQ ID NO: 2866149 - DNA, 16 bp, Homo sapiens
aaaatatgtaatttca

SEQ ID NO: 2866150 - DNA, 17 bp, Homo sapiens
aaaatatgtaatttcaa

SEQ ID NO: 2866151 - DNA, 22 bp, Homo sapiens
aaaatcatgatccttgtgttca

SEQ ID NO: 2866152 - DNA, 15 bp, Homo sapiens
aaaatgagagctgta

SEQ ID NO: 2866153 - DNA, 13 bp, Homo sapiens
aaaatgatgttat

SEQ ID NO: 2866154 - DNA, 18 bp, Homo sapiens
aaaatgggagccaggagt

SEQ ID NO: 2866155 - DNA, 22 bp, Homo sapiens
aaaatggtcctatttttgtgaa

SEQ ID NO: 2866156 - DNA, 18 bp, Homo sapiens
aaaatgtcttgtgttacc

SEQ ID NO: 2866157 - DNA, 21 bp, Homo sapiens
aaaatgtttcattatgcactt

SEQ ID NO: 2866158 - DNA, 13 bp, Homo sapiens
aaaattaactttt

SEQ ID NO: 2866159 - DNA, 14 bp, Homo sapiens
aaaattatttgcat

SEQ ID NO: 2866160 - DNA, 13 bp, Homo sapiens
aaaatttatattt

SEQ ID NO: 2866161 - DNA, 18 bp, Homo sapiens
aaaatttgttattttgca

SEQ ID NO: 2866162 - DNA, 17 bp, Homo sapiens
aaacaaataatttgaac

SEQ ID NO: 2866163 - DNA, 15 bp, Homo sapiens
aaacactatttgtga

SEQ ID NO: 2866164 - DNA, 21 bp, Homo sapiens
aaacatgaccctaaatcttga

SEQ ID NO: 2866165 - DNA, 23 bp, Homo sapiens
aaaccactttattgcaatgcaga

SEQ ID NO: 2866166 - DNA, 15 bp, Homo sapiens
aaaccatttttgaac

SEQ ID NO: 2866167 - DNA, 21 bp, Homo sapiens
caggagaaggccaattcctat

SEQ ID NO: 2866168 - DNA, 23 bp, Homo sapiens
caggagagacccctcccctccca

SEQ ID NO: 2866169 - DNA, 20 bp, Homo sapiens
caggagatggaagttgcagt

SEQ ID NO: 2866170 - DNA, 19 bp, Homo sapiens
caggaggggcccacaatgg

SEQ ID NO: 2866171 - DNA, 16 bp, Homo sapiens
caggcacattaactgt

SEQ ID NO: 2866172 - DNA, 20 bp, Homo sapiens
caggcaggggtgggagagcc

SEQ ID NO: 2866173 - DNA, 23 bp, Homo sapiens
caggcccgagatgtgacccacca

SEQ ID NO: 2866174 - DNA, 16 bp, Homo sapiens
caggcctgaccagggg

SEQ ID NO: 2866175 - DNA, 16 bp, Homo sapiens
caggccttcatcctcc

SEQ ID NO: 2866176 - DNA, 16 bp, Homo sapiens
caggctgagccatgag

SEQ ID NO: 2866177 - DNA, 17 bp, Homo sapiens
caggctgagccatgagg

SEQ ID NO: 2866178 - DNA, 19 bp, Homo sapiens
caggctgagccatgaggag

SEQ ID NO: 2866179 - DNA, 18 bp, Homo sapiens
caggctgcacctctggct

SEQ ID NO: 2866180 - DNA, 21 bp, Homo sapiens
caggctgcacctctggctaga

SEQ ID NO: 2866181 - DNA, 19 bp, Homo sapiens
cagggacttgtttagagag

SEQ ID NO: 2866182 - DNA, 20 bp, Homo sapiens
cagggacttgtttagagagc

SEQ ID NO: 2866183 - DNA, 20 bp, Homo sapiens
cagggccccaggcattgcca

SEQ ID NO: 2866184 - DNA, 22 bp, Homo sapiens
cagggctaccctgagctgaggc

SEQ ID NO: 2866185 - DNA, 13 bp, Homo sapiens
caggggtgggaga

SEQ ID NO: 2866186 - DNA, 15 bp, Homo sapiens
caggggtgggagagc

SEQ ID NO: 2866187 - DNA, 17 bp, Homo sapiens
cagggtgggccactctc

SEQ ID NO: 2866188 - DNA, 15 bp, Homo sapiens
cagggtgtggtatga

SEQ ID NO: 2866189 - DNA, 20 bp, Homo sapiens
cagggtgtggtatgaggggg

SEQ ID NO: 2866190 - DNA, 20 bp, Homo sapiens
cagggttgaccccagaggat

SEQ ID NO: 2866191 - DNA, 21 bp, Homo sapiens
caggtgctacacccttttcca

SEQ ID NO: 2866192 - DNA, 19 bp, Homo sapiens
caggtggggagactgggct

SEQ ID NO: 2866193 - DNA, 13 bp, Homo sapiens
caggttctctttg

SEQ ID NO: 2866194 - DNA, 20 bp, Homo sapiens
cagtaaatagtgtcatataa

SEQ ID NO: 2866195 - DNA, 19 bp, Homo sapiens
cagtaatgctaaatgtgta

SEQ ID NO: 2866196 - DNA, 14 bp, Homo sapiens
cagtaggagcccag

SEQ ID NO: 2866197 - DNA, 21 bp, Homo sapiens
cagtaggagcccagctctgaa

SEQ ID NO: 2866198 - DNA, 22 bp, Homo sapiens
cagtcctgatcagagccgtggt

SEQ ID NO: 2866199 - DNA, 12 bp, Homo sapiens
cagtctctgagc

SEQ ID NO: 2866200 - DNA, 14 bp, Homo sapiens
cagtctctgagcag

SEQ ID NO: 2866201 - DNA, 18 bp, Homo sapiens
cagtcttccatttgcaag

SEQ ID NO: 2866202 - DNA, 18 bp, Homo sapiens
cagtgaatgattcagtgt

SEQ ID NO: 2866203 - DNA, 17 bp, Homo sapiens
cagtgctataaatgcca

SEQ ID NO: 2866204 - DNA, 20 bp, Homo sapiens
cagtgctataaatgccagag

SEQ ID NO: 2866205 - DNA, 16 bp, Homo sapiens
cagtggtgtgtgaagt

SEQ ID NO: 2866206 - DNA, 18 bp, Homo sapiens
cagtgtgaggccagggca

SEQ ID NO: 2866207 - DNA, 23 bp, Homo sapiens
cagtgttccaagtctctgtgtaa

SEQ ID NO: 2866208 - DNA, 19 bp, Homo sapiens
cagtgttttggtggaaaaa

SEQ ID NO: 2866209 - DNA, 21 bp, Homo sapiens
cagtgttttggtggaaaaaac

SEQ ID NO: 2866210 - DNA, 18 bp, Homo sapiens
cagttctcaaatgtgtgt

SEQ ID NO: 2866211 - DNA, 13 bp, Homo sapiens
cagttgctgtgaa

SEQ ID NO: 2866212 - DNA, 12 bp, Homo sapiens
cagtttccaaat

SEQ ID NO: 2866213 - DNA, 12 bp, Homo sapiens
cagtttccagtc

SEQ ID NO: 2866214 - DNA, 13 bp, Homo sapiens
cagttttcggaaa

SEQ ID NO: 2866215 - DNA, 19 bp, Homo sapiens
cagttttcggaaacactga

SEQ ID NO: 2866216 - DNA, 14 bp, Homo sapiens
cagtttttcacttc

SEQ ID NO: 2866217 - DNA, 17 bp, Homo sapiens
cataacaattcctctac

SEQ ID NO: 2866218 - DNA, 19 bp, Homo sapiens
cataatcagtaaatagtgt

SEQ ID NO: 2866219 - DNA, 21 bp, Homo sapiens
catagaccctctttcttgttt

SEQ ID NO: 2866220 - DNA, 23 bp, Homo sapiens
catagaccctctttcttgtttgt

SEQ ID NO: 2866221 - DNA, 22 bp, Homo sapiens
catagagaacaaagtaaaagta

SEQ ID NO: 2866222 - DNA, 21 bp, Homo sapiens
catagtaagtgcgaagactga

SEQ ID NO: 2866223 - DNA, 23 bp, Homo sapiens
catatgctgatcttttaaaatca

SEQ ID NO: 2866224 - DNA, 21 bp, Homo sapiens
catattgtaatctatgtttat

SEQ ID NO: 2866225 - DNA, 16 bp, Homo sapiens
catatttgatttctaa

SEQ ID NO: 2866226 - DNA, 22 bp, Homo sapiens
catatttgatttctaattgtaa

SEQ ID NO: 2866227 - DNA, 17 bp, Homo sapiens
catatttgtatgttttt

SEQ ID NO: 2866228 - DNA, 18 bp, Homo sapiens
catattttcaccatttga

SEQ ID NO: 2866229 - DNA, 22 bp, Homo sapiens
catcagggtgggccactctccc

SEQ ID NO: 2866230 - DNA, 12 bp, Homo sapiens
catcattctctg

SEQ ID NO: 2866231 - DNA, 13 bp, Homo sapiens
catccaagccaga

SEQ ID NO: 2866232 - DNA, 17 bp, Homo sapiens
catccacgcacacatgg

SEQ ID NO: 2866233 - DNA, 23 bp, Homo sapiens
catccatgtacttccctcttgaa

SEQ ID NO: 2866234 - DNA, 20 bp, Homo sapiens
catccattaggccagcaacg

SEQ ID NO: 2866235 - DNA, 16 bp, Homo sapiens
catcccctttcctccc

SEQ ID NO: 2866236 - DNA, 16 bp, Homo sapiens
catcccttccctgtcc

SEQ ID NO: 2866237 - DNA, 21 bp, Homo sapiens
catcccttccctgtccacctc

SEQ ID NO: 2866238 - DNA, 18 bp, Homo sapiens
catcctccacgttctgct

SEQ ID NO: 2866239 - DNA, 19 bp, Homo sapiens
catcctcctccccagctct

SEQ ID NO: 2866240 - DNA, 23 bp, Homo sapiens
catcctcttttaatggcatttct

SEQ ID NO: 2866241 - DNA, 22 bp, Homo sapiens
catcgtattaaaaaacaattaa

SEQ ID NO: 2866242 - DNA, 17 bp, Homo sapiens
catctcccagataatgt

SEQ ID NO: 2866243 - DNA, 16 bp, Homo sapiens
catctcctgccttcct

SEQ ID NO: 2866244 - DNA, 17 bp, Homo sapiens
catctggctttttctgc

SEQ ID NO: 2866245 - DNA, 20 bp, Homo sapiens
catctggctttttctgccac

SEQ ID NO: 2866246 - DNA, 17 bp, Homo sapiens
catctgtccctccggga

SEQ ID NO: 2866247 - DNA, 18 bp, Homo sapiens
catctgtccctccgggac

SEQ ID NO: 2866248 - DNA, 13 bp, Homo sapiens
catctgtgtcttg

SEQ ID NO: 2866249 - DNA, 13 bp, Homo sapiens
catcttcaatatg

SEQ ID NO: 2866250 - DNA, 17 bp, Homo sapiens
catgaaaaaccattttt

SEQ ID NO: 2866251 - DNA, 18 bp, Homo sapiens
catgaagattctttccca

SEQ ID NO: 2866252 - DNA, 20 bp, Homo sapiens
atttgtatgtttttctgtat

SEQ ID NO: 2866253 - DNA, 14 bp, Homo sapiens
atttgtgacttttt

SEQ ID NO: 2866254 - DNA, 23 bp, Homo sapiens
atttgtttccttttggcctcctg

SEQ ID NO: 2866255 - DNA, 14 bp, Homo sapiens
attttaaattctca

SEQ ID NO: 2866256 - DNA, 19 bp, Homo sapiens
attttaatgctgtttctaa

SEQ ID NO: 2866257 - DNA, 23 bp, Homo sapiens
attttaatgctgtttctaagaaa

SEQ ID NO: 2866258 - DNA, 14 bp, Homo sapiens
attttagaaataat

SEQ ID NO: 2866259 - DNA, 13 bp, Homo sapiens
attttatcattaa

SEQ ID NO: 2866260 - DNA, 22 bp, Homo sapiens
attttcataagtatttcaaatt

SEQ ID NO: 2866261 - DNA, 16 bp, Homo sapiens
attttcataatcagta

SEQ ID NO: 2866262 - DNA, 18 bp, Homo sapiens
attttcatattgtaatct

SEQ ID NO: 2866263 - DNA, 20 bp, Homo sapiens
attttcccccactactgcag

SEQ ID NO: 2866264 - DNA, 21 bp, Homo sapiens
attttcccccactactgcagc

SEQ ID NO: 2866265 - DNA, 22 bp, Homo sapiens
attttctaaataaaaatatgta

SEQ ID NO: 2866266 - DNA, 12 bp, Homo sapiens
attttgaaatga

SEQ ID NO: 2866267 - DNA, 15 bp, Homo sapiens
attttgaaatgaact

SEQ ID NO: 2866268 - DNA, 17 bp, Homo sapiens
attttgaaatgaacttt

SEQ ID NO: 2866269 - DNA, 19 bp, Homo sapiens
attttgaaatgaactttgt

SEQ ID NO: 2866270 - DNA, 20 bp, Homo sapiens
attttgtataatcacagttg

SEQ ID NO: 2866271 - DNA, 11 bp, Homo sapiens
atttttatgat

SEQ ID NO: 2866272 - DNA, 15 bp, Homo sapiens
atttttcagaaatca

SEQ ID NO: 2866273 - DNA, 15 bp, Homo sapiens
atttttttaactgtg

SEQ ID NO: 2866274 - DNA, 15 bp, Homo sapiens
caaaaattatgcaat

SEQ ID NO: 2866275 - DNA, 18 bp, Homo sapiens
caaaacatttatgacaag

SEQ ID NO: 2866276 - DNA, 20 bp, Homo sapiens
caaaacctgtattactgaat

SEQ ID NO: 2866277 - DNA, 16 bp, Homo sapiens
caaaatacatttgtaa

SEQ ID NO: 2866278 - DNA, 18 bp, Homo sapiens
caaaatacatttgtaagt

SEQ ID NO: 2866279 - DNA, 13 bp, Homo sapiens
caaaatttatatt

SEQ ID NO: 2866280 - DNA, 15 bp, Homo sapiens
caaaatttatatttt

SEQ ID NO: 2866281 - DNA, 14 bp, Homo sapiens
caaacaaaactctt

SEQ ID NO: 2866282 - DNA, 18 bp, Homo sapiens
ctcatcattctctgtctc

SEQ ID NO: 2866283 - DNA, 22 bp, Homo sapiens
ctcatcccgagcacctccacat

SEQ ID NO: 2866284 - DNA, 18 bp, Homo sapiens
ctcatctgtccctccggg

SEQ ID NO: 2866285 - DNA, 17 bp, Homo sapiens
ctcatcttcttcaccat

SEQ ID NO: 2866286 - DNA, 13 bp, Homo sapiens
ctcattcccctcg

SEQ ID NO: 2866287 - DNA, 19 bp, Homo sapiens
ctcattctgaaggagcccc

SEQ ID NO: 2866288 - DNA, 17 bp, Homo sapiens
ctcattggacccttcca

SEQ ID NO: 2866289 - DNA, 15 bp, Homo sapiens
ctccaccctccacct

SEQ ID NO: 2866290 - DNA, 14 bp, Homo sapiens
ctccactcagctgt

SEQ ID NO: 2866291 - DNA, 23 bp, Homo sapiens
ctccactcagctgtcctgcagca

SEQ ID NO: 2866292 - DNA, 13 bp, Homo sapiens
ctccagaagaaaa

SEQ ID NO: 2866293 - DNA, 13 bp, Homo sapiens
ctccagagaaagc

SEQ ID NO: 2866294 - DNA, 23 bp, Homo sapiens
ctccagagaaagcacaatttaaa

SEQ ID NO: 2866295 - DNA, 20 bp, Homo sapiens
ctccagagggcactctgctt

SEQ ID NO: 2866296 - DNA, 15 bp, Homo sapiens
ctccagcccctgtcc

SEQ ID NO: 2866297 - DNA, 16 bp, Homo sapiens
ctccagtttgcacctg

SEQ ID NO: 2866298 - DNA, 17 bp, Homo sapiens
ctccagtttgcacctgt

SEQ ID NO: 2866299 - DNA, 16 bp, Homo sapiens
ctcccaaccctggctt

SEQ ID NO: 2866300 - DNA, 17 bp, Homo sapiens
ctcccacccacagccat

SEQ ID NO: 2866301 - DNA, 16 bp, Homo sapiens
ctccccaccttcccca

SEQ ID NO: 2866302 - DNA, 16 bp, Homo sapiens
ctccccagctcttctc

SEQ ID NO: 2866303 - DNA, 16 bp, Homo sapiens
ctcccctcccacccac

SEQ ID NO: 2866304 - DNA, 23 bp, Homo sapiens
ctcccctccgcagcagggaagct

SEQ ID NO: 2866305 - DNA, 16 bp, Homo sapiens
ctcccctgccagggca

SEQ ID NO: 2866306 - DNA, 12 bp, Homo sapiens
ctccctctccca

SEQ ID NO: 2866307 - DNA, 16 bp, Homo sapiens
ctccctctcccaggcc

SEQ ID NO: 2866308 - DNA, 17 bp, Homo sapiens
ctccctctcccaggccc

SEQ ID NO: 2866309 - DNA, 15 bp, Homo sapiens
ctccctcttccttcc

SEQ ID NO: 2866310 - DNA, 16 bp, Homo sapiens
ctccctcttccttccc

SEQ ID NO: 2866311 - DNA, 19 bp, Homo sapiens
ctccctgtaacctcttcag

SEQ ID NO: 2866312 - DNA, 14 bp, Homo sapiens
ctcccttgggctcc

SEQ ID NO: 2866313 - DNA, 15 bp, Homo sapiens
ctccgctgggcttca

SEQ ID NO: 2866314 - DNA, 19 bp, Homo sapiens
ctccgctgggcttcattcc

SEQ ID NO: 2866315 - DNA, 15 bp, Homo sapiens
ctccgggacctggtg

SEQ ID NO: 2866316 - DNA, 14 bp, Homo sapiens
ctccgggcaggcaa

SEQ ID NO: 2866317 - DNA, 16 bp, Homo sapiens
ctcctccagcccctgt

SEQ ID NO: 2866318 - DNA, 18 bp, Homo sapiens
ctcctccatgggagaaaa

SEQ ID NO: 2866319 - DNA, 20 bp, Homo sapiens
ctcctcccacaatctgggac

SEQ ID NO: 2866320 - DNA, 14 bp, Homo sapiens
ctcctccccagctc

SEQ ID NO: 2866321 - DNA, 22 bp, Homo sapiens
ctcctccccagctcttctcttc

SEQ ID NO: 2866322 - DNA, 19 bp, Homo sapiens
ctcctctgactcagggctc

SEQ ID NO: 2866323 - DNA, 22 bp, Homo sapiens
ctcctctgactcagggctcctg

SEQ ID NO: 2866324 - DNA, 14 bp, Homo sapiens
ctcctgcaaagtct

SEQ ID NO: 2866325 - DNA, 20 bp, Homo sapiens
ctcctgggccctctctgctc

SEQ ID NO: 2866326 - DNA, 14 bp, Homo sapiens
ctccttcctggaga

SEQ ID NO: 2866327 - DNA, 13 bp, Homo sapiens
ctccttgggccct

SEQ ID NO: 2866328 - DNA, 16 bp, Homo sapiens
ctcgctgccagctctg

SEQ ID NO: 2866329 - DNA, 19 bp, Homo sapiens
ctcgctggactctcagtct

SEQ ID NO: 2866330 - DNA, 17 bp, Homo sapiens
ctcggagggattcccct

SEQ ID NO: 2866331 - DNA, 16 bp, Homo sapiens
ctcggaggtccagctg

SEQ ID NO: 2866332 - DNA, 18 bp, Homo sapiens
ctcggaggtccagctggg

SEQ ID NO: 2866333 - DNA, 20 bp, Homo sapiens
ctcgttgactggctgtgtgt

SEQ ID NO: 2866334 - DNA, 18 bp, Homo sapiens
ctctaaatagcacttttt

SEQ ID NO: 2866335 - DNA, 17 bp, Homo sapiens
ctctacagagcttccct

SEQ ID NO: 2866336 - DNA, 17 bp, Homo sapiens
ctctacccggcccagag

SEQ ID NO: 2866337 - DNA, 18 bp, Homo sapiens
ctctagtgggacagccca

SEQ ID NO: 2866338 - DNA, 19 bp, Homo sapiens
ctctagtgggacagcccag

SEQ ID NO: 2866339 - DNA, 13 bp, Homo sapiens
ctctataaagtat

SEQ ID NO: 2866340 - DNA, 19 bp, Homo sapiens
ctctcactccccagcccca

SEQ ID NO: 2866341 - DNA, 17 bp, Homo sapiens
ctctcaggaccaaagct

SEQ ID NO: 2866342 - DNA, 15 bp, Homo sapiens
ctctcagtctctgag

SEQ ID NO: 2866343 - DNA, 17 bp, Homo sapiens
ctctcagtctctgagca

SEQ ID NO: 2866344 - DNA, 20 bp, Homo sapiens
ctctccagtttgcacctgtc

SEQ ID NO: 2866345 - DNA, 12 bp, Homo sapiens
ctctcccctccc

SEQ ID NO: 2866346 - DNA, 17 bp, Homo sapiens
ctctcccctccctcttc

SEQ ID NO: 2866347 - DNA, 19 bp, Homo sapiens
ctctcccctccctcttcct

SEQ ID NO: 2866348 - DNA, 18 bp, Homo sapiens
ctctctacccggcccaga

SEQ ID NO: 2866349 - DNA, 12 bp, Homo sapiens
ctctctgctctg

SEQ ID NO: 2866350 - DNA, 14 bp, Homo sapiens
ctctctgctctgcg

SEQ ID NO: 2866351 - DNA, 13 bp, Homo sapiens
ctctcttccctat

SEQ ID NO: 2866352 - DNA, 17 bp, Homo sapiens
ctctgaaataatgggat

SEQ ID NO: 2866353 - DNA, 14 bp, Homo sapiens
ctctgactcagggc

SEQ ID NO: 2866354 - DNA, 21 bp, Homo sapiens
ctctgactcagggctcctggg

SEQ ID NO: 2866355 - DNA, 13 bp, Homo sapiens
ctctgagcagtga

SEQ ID NO: 2866356 - DNA, 21 bp, Homo sapiens
ctctgatccctctacagagct

SEQ ID NO: 2866357 - DNA, 18 bp, Homo sapiens
ctctgctagactcctcag

SEQ ID NO: 2866358 - DNA, 20 bp, Homo sapiens
ctctggatcccgttcagaaa

SEQ ID NO: 2866359 - DNA, 24 bp, Homo sapiens
ctctggatcccgttcagaaaacca

SEQ ID NO: 2866360 - DNA, 20 bp, Homo sapiens
ctctggccctggcccttact

SEQ ID NO: 2866361 - DNA, 13 bp, Homo sapiens
ctctggctagagc

SEQ ID NO: 2866362 - DNA, 17 bp, Homo sapiens
ctctggctagagccgag

SEQ ID NO: 2866363 - DNA, 19 bp, Homo sapiens
ctctggctagagccgaggg

SEQ ID NO: 2866364 - DNA, 14 bp, Homo sapiens
ctctgtccaggcac

SEQ ID NO: 2866365 - DNA, 19 bp, Homo sapiens
ctctgtccaggcactgaga

SEQ ID NO: 2866366 - DNA, 21 bp, Homo sapiens
ctctgtgtaaccagctcagtg

SEQ ID NO: 2866367 - DNA, 22 bp, Homo sapiens
ctctgtgtaaccagctcagtgt

SEQ ID NO: 2866368 - DNA, 23 bp, Homo sapiens
ctcttaagtcctaaaagttctca

SEQ ID NO: 2866369 - DNA, 17 bp, Homo sapiens
ctcttatagaatattta

SEQ ID NO: 2866370 - DNA, 17 bp, Homo sapiens
ctcttcagaggccctcg

SEQ ID NO: 2866371 - DNA, 23 bp, Homo sapiens
ctcttcatggcatcttcaatatg

SEQ ID NO: 2866372 - DNA, 15 bp, Homo sapiens
ctcttcccttcccag

SEQ ID NO: 2866373 - DNA, 16 bp, Homo sapiens
ctcttcccttcccaga

SEQ ID NO: 2866374 - DNA, 18 bp, Homo sapiens
ctcttcccttcccagacc

SEQ ID NO: 2866375 - DNA, 12 bp, Homo sapiens
ctcttccttccc

SEQ ID NO: 2866376 - DNA, 20 bp, Homo sapiens
ctcttccttcccccatcccc

SEQ ID NO: 2866377 - DNA, 12 bp, Homo sapiens
ctcttctcttcc

SEQ ID NO: 2866378 - DNA, 14 bp, Homo sapiens
ctcttctcttccta

SEQ ID NO: 2866379 - DNA, 17 bp, Homo sapiens
ctctttaacatacaaga

SEQ ID NO: 2866380 - DNA, 13 bp, Homo sapiens
ctctttccaaatt

SEQ ID NO: 2866381 - DNA, 19 bp, Homo sapiens
gaggtggattcctgggcaa

SEQ ID NO: 2866382 - DNA, 21 bp, Homo sapiens
gaggtggattcctgggcaaga

SEQ ID NO: 2866383 - DNA, 22 bp, Homo sapiens
gaggtggattcctgggcaagaa

SEQ ID NO: 2866384 - DNA, 17 bp, Homo sapiens
gagtaagacaagtggga

SEQ ID NO: 2866385 - DNA, 15 bp, Homo sapiens
gagtacctcaaagga

SEQ ID NO: 2866386 - DNA, 19 bp, Homo sapiens
gagtagaaactgcagggaa

SEQ ID NO: 2866387 - DNA, 23 bp, Homo sapiens
gagtccaacagacacaatttata

SEQ ID NO: 2866388 - DNA, 18 bp, Homo sapiens
gagtctgtatttttctaa

SEQ ID NO: 2866389 - DNA, 18 bp, Homo sapiens
gagtgcagtcctgatcag

SEQ ID NO: 2866390 - DNA, 19 bp, Homo sapiens
gagtgtctttccacggagc

SEQ ID NO: 2866391 - DNA, 18 bp, Homo sapiens
gagttaggggccttaggg

SEQ ID NO: 2866392 - DNA, 16 bp, Homo sapiens
gagttgccagggaaga

SEQ ID NO: 2866393 - DNA, 18 bp, Homo sapiens
gagtttttaaagccttct

SEQ ID NO: 2866394 - DNA, 16 bp, Homo sapiens
gataaagaataataat

SEQ ID NO: 2866395 - DNA, 12 bp, Homo sapiens
gataaattataa

SEQ ID NO: 2866396 - DNA, 13 bp, Homo sapiens
gataaattataag

SEQ ID NO: 2866397 - DNA, 22 bp, Homo sapiens
gataagagtagaaactgcaggg

SEQ ID NO: 2866398 - DNA, 22 bp, Homo sapiens
gataccagcgaggaggctccag

SEQ ID NO: 2866399 - DNA, 14 bp, Homo sapiens
gatacttacatgtt

SEQ ID NO: 2866400 - DNA, 14 bp, Homo sapiens
gatagaaagctgga

SEQ ID NO: 2866401 - DNA, 23 bp, Homo sapiens
gatagatccatttggacaaaatg

SEQ ID NO: 2866402 - DNA, 22 bp, Homo sapiens
gatagtagttaaataactgtgt

SEQ ID NO: 2866403 - DNA, 18 bp, Homo sapiens
gatatggtgaagggaagt

SEQ ID NO: 2866404 - DNA, 18 bp, Homo sapiens
gatcagcaaaaagactgg

SEQ ID NO: 2866405 - DNA, 23 bp, Homo sapiens
gatccagagacttggggaccaga

SEQ ID NO: 2866406 - DNA, 14 bp, Homo sapiens
gatccatgggggga

SEQ ID NO: 2866407 - DNA, 12 bp, Homo sapiens
gatccctcatct

SEQ ID NO: 2866408 - DNA, 21 bp, Homo sapiens
gatccttgtgttcagctcttt

SEQ ID NO: 2866409 - DNA, 21 bp, Homo sapiens
gatctcattggacccttccat

SEQ ID NO: 2866410 - DNA, 15 bp, Homo sapiens
gatctgcaggctgca

SEQ ID NO: 2866411 - DNA, 19 bp, Homo sapiens
gatgaattgtcacatctat

SEQ ID NO: 2866412 - DNA, 17 bp, Homo sapiens
gatgccaaggagcccct

SEQ ID NO: 2866413 - DNA, 21 bp, Homo sapiens
gatgctccttgggccctttga

SEQ ID NO: 2866414 - DNA, 14 bp, Homo sapiens
gatgctttggaaga

SEQ ID NO: 2866415 - DNA, 18 bp, Homo sapiens
gatgctttggaagatgca

SEQ ID NO: 2866416 - DNA, 22 bp, Homo sapiens
gatgtcagctgctgttgaactt

SEQ ID NO: 2866417 - DNA, 15 bp, Homo sapiens
gatgtgacccaccag

SEQ ID NO: 2866418 - DNA, 20 bp, Homo sapiens
gatgtgacccaccagtgcct

SEQ ID NO: 2866419 - DNA, 14 bp, Homo sapiens
gattacctcctgag

SEQ ID NO: 2866420 - DNA, 21 bp, Homo sapiens
gattcccctaacctcattccc

SEQ ID NO: 2866421 - DNA, 20 bp, Homo sapiens
gattctttcccaattcacat

SEQ ID NO: 2866422 - DNA, 11 bp, Homo sapiens
gattgaacttt

SEQ ID NO: 2866423 - DNA, 15 bp, Homo sapiens
gatttctaattgtaa

SEQ ID NO: 2866424 - DNA, 23 bp, Homo sapiens
gatttgtgaaacagttgctgtga

SEQ ID NO: 2866425 - DNA, 17 bp, Homo sapiens
gcaaagcaatcttttat

SEQ ID NO: 2866426 - DNA, 20 bp, Homo sapiens
gcaactaatgtttgaacaaa

SEQ ID NO: 2866427 - DNA, 19 bp, Homo sapiens
gcaagagaattgcttgaac

SEQ ID NO: 2866428 - DNA, 18 bp, Homo sapiens
gcaagcacgggacaggag

SEQ ID NO: 2866429 - DNA, 19 bp, Homo sapiens
gcaaggtttacactgcgga

SEQ ID NO: 2866430 - DNA, 13 bp, Homo sapiens
gcaattccaggct

SEQ ID NO: 2866431 - DNA, 15 bp, Homo sapiens
gcaattccaggctga

SEQ ID NO: 2866432 - DNA, 16 bp, Homo sapiens
gcaattccaggctgag

SEQ ID NO: 2866433 - DNA, 22 bp, Homo sapiens
gcaattccaggctgagccatga

SEQ ID NO: 2866434 - DNA, 15 bp, Homo sapiens
gcacaatttaaaaca

SEQ ID NO: 2866435 - DNA, 14 bp, Homo sapiens
gcacactttgccat

SEQ ID NO: 2866436 - DNA, 23 bp, Homo sapiens
gcacatacgggctttaatagtca

SEQ ID NO: 2866437 - DNA, 17 bp, Homo sapiens
gcacatctgtgtcttgt

SEQ ID NO: 2866438 - DNA, 13 bp, Homo sapiens
gcacattaactgt

SEQ ID NO: 2866439 - DNA, 14 bp, Homo sapiens
gcacattaactgtt

SEQ ID NO: 2866440 - DNA, 23 bp, Homo sapiens
gcaccagggttgaccccagagga

SEQ ID NO: 2866441 - DNA, 20 bp, Homo sapiens
gcaccccctcattcccctcg

SEQ ID NO: 2866442 - DNA, 13 bp, Homo sapiens
gcacctccaggcc

SEQ ID NO: 2866443 - DNA, 15 bp, Homo sapiens
gcacctccaggcctg

SEQ ID NO: 2866444 - DNA, 16 bp, Homo sapiens
gcacctccaggcctgt

SEQ ID NO: 2866445 - DNA, 16 bp, Homo sapiens
gcacctctggctagag

SEQ ID NO: 2866446 - DNA, 22 bp, Homo sapiens
gcacctctggctagagccgagg

SEQ ID NO: 2866447 - DNA, 21 bp, Homo sapiens
gcacctgtaatcccagctact

SEQ ID NO: 2866448 - DNA, 11 bp, Homo sapiens
gcacctgtccc

SEQ ID NO: 2866449 - DNA, 15 bp, Homo sapiens
gcacctgtccccacc

SEQ ID NO: 2866450 - DNA, 18 bp, Homo sapiens
gcacctgtccccaccctc

SEQ ID NO: 2866451 - DNA, 12 bp, Homo sapiens
gcactgacaaga

SEQ ID NO: 2866452 - DNA, 22 bp, Homo sapiens
gcactttaaccctctcttccct

SEQ ID NO: 2866453 - DNA, 16 bp, Homo sapiens
gcagaaagggccaccc

SEQ ID NO: 2866454 - DNA, 19 bp, Homo sapiens
gcagaaagggccacccatg

SEQ ID NO: 2866455 - DNA, 16 bp, Homo sapiens
gcagaacccccaggtg

SEQ ID NO: 2866456 - DNA, 17 bp, Homo sapiens
gcagaacccccaggtgg

SEQ ID NO: 2866457 - DNA, 19 bp, Homo sapiens
gcagaagcattgcctggac

SEQ ID NO: 2866458 - DNA, 14 bp, Homo sapiens
gcagcacctccagg

SEQ ID NO: 2866459 - DNA, 16 bp, Homo sapiens
gcagcacctccaggcc

SEQ ID NO: 2866460 - DNA, 19 bp, Homo sapiens
gcagcactttaaccctctc

SEQ ID NO: 2866461 - DNA, 15 bp, Homo sapiens
gcagcagtgtgaggc

SEQ ID NO: 2866462 - DNA, 20 bp, Homo sapiens
gcagcagtgtgaggccaggg

SEQ ID NO: 2866463 - DNA, 22 bp, Homo sapiens
gcagcagtgtgaggccagggca

SEQ ID NO: 2866464 - DNA, 16 bp, Homo sapiens
gcagccgctgagcgag

SEQ ID NO: 2866465 - DNA, 12 bp, Homo sapiens
gcagcggcagag

SEQ ID NO: 2866466 - DNA, 21 bp, Homo sapiens
gcagcggcagagcaattccag

SEQ ID NO: 2866467 - DNA, 24 bp, Homo sapiens
gcagctaagatagaaagctggact

SEQ ID NO: 2866468 - DNA, 18 bp, Homo sapiens
gcagctcaacctaccctg

SEQ ID NO: 2866469 - DNA, 20 bp, Homo sapiens
gcagctcaacctaccctggt

SEQ ID NO: 2866470 - DNA, 21 bp, Homo sapiens
gcaggaaatgaaaatgtcttg

SEQ ID NO: 2866471 - DNA, 23 bp, Homo sapiens
gcaggaaatgaaaatgtcttgtg

SEQ ID NO: 2866472 - DNA, 21 bp, Homo sapiens
gcaggctgcacctctggctag

SEQ ID NO: 2866473 - DNA, 21 bp, Homo sapiens
gcagggaaaattatttgcata

SEQ ID NO: 2866474 - DNA, 12 bp, Homo sapiens
gcagggaagctc

SEQ ID NO: 2866475 - DNA, 21 bp, Homo sapiens
gcagggccccaggcattgcca

SEQ ID NO: 2866476 - DNA, 20 bp, Homo sapiens
gcaggggtgggagagccagc

SEQ ID NO: 2866477 - DNA, 21 bp, Homo sapiens
gcaggtggggagactgggctg

SEQ ID NO: 2866478 - DNA, 13 bp, Homo sapiens
gcaggttctcttt

SEQ ID NO: 2866479 - DNA, 19 bp, Homo sapiens
gcagtcctgatcagagccg

SEQ ID NO: 2866480 - DNA, 14 bp, Homo sapiens
gcatctgaccatct

SEQ ID NO: 2866481 - DNA, 16 bp, Homo sapiens
gcatctgaccatctgt

SEQ ID NO: 2866482 - DNA, 22 bp, Homo sapiens
gcatgaaaaaccatttttgaac

SEQ ID NO: 2866483 - DNA, 18 bp, Homo sapiens
gcatgtacaaaaattatg

SEQ ID NO: 2866484 - DNA, 13 bp, Homo sapiens
gcattctttgcaa

SEQ ID NO: 2866485 - DNA, 16 bp, Homo sapiens
gcattctttgcaatac

SEQ ID NO: 2866486 - DNA, 14 bp, Homo sapiens
gcattgccaagggc

SEQ ID NO: 2866487 - DNA, 19 bp, Homo sapiens
gcattgcctggactgacca

SEQ ID NO: 2866488 - DNA, 20 bp, Homo sapiens
gcattgcctggactgaccac

SEQ ID NO: 2866489 - DNA, 14 bp, Homo sapiens
gcatttctctttaa

SEQ ID NO: 2866490 - DNA, 21 bp, Homo sapiens
gaccatctgtgactataaagc

SEQ ID NO: 2866491 - DNA, 15 bp, Homo sapiens
gaccattcaattagt

SEQ ID NO: 2866492 - DNA, 14 bp, Homo sapiens
gacccaccagtgcc

SEQ ID NO: 2866493 - DNA, 15 bp, Homo sapiens
gacccaccagtgcct

SEQ ID NO: 2866494 - DNA, 23 bp, Homo sapiens
gacccctcccctcccacccacag

SEQ ID NO: 2866495 - DNA, 22 bp, Homo sapiens
gaccccttcctttcctctgcag

SEQ ID NO: 2866496 - DNA, 16 bp, Homo sapiens
gaccctaaatcttgac

SEQ ID NO: 2866497 - DNA, 23 bp, Homo sapiens
gaccgtttgtccacttcattttg

SEQ ID NO: 2866498 - DNA, 17 bp, Homo sapiens
gacctacagacctggct

SEQ ID NO: 2866499 - DNA, 18 bp, Homo sapiens
gactacagtcaggaaagg

SEQ ID NO: 2866500 - DNA, 14 bp, Homo sapiens
gactataaagctgt

SEQ ID NO: 2866501 - DNA, 15 bp, Homo sapiens
gactataaagctgtt

SEQ ID NO: 2866502 - DNA, 19 bp, Homo sapiens
gactcagggctcctgggtt

SEQ ID NO: 2866503 - DNA, 12 bp, Homo sapiens
gactccaggcct

SEQ ID NO: 2866504 - DNA, 17 bp, Homo sapiens
gactccaggcctgacca

SEQ ID NO: 2866505 - DNA, 18 bp, Homo sapiens
gactccaggcctgaccag

SEQ ID NO: 2866506 - DNA, 16 bp, Homo sapiens
gactcctcaggagaga

SEQ ID NO: 2866507 - DNA, 19 bp, Homo sapiens
gactcctcaggagagaccc

SEQ ID NO: 2866508 - DNA, 11 bp, Homo sapiens
gactcctccca

SEQ ID NO: 2866509 - DNA, 14 bp, Homo sapiens
gactcctcccacaa

SEQ ID NO: 2866510 - DNA, 14 bp, Homo sapiens
gactctgctagact

SEQ ID NO: 2866511 - DNA, 12 bp, Homo sapiens
gactctggccct

SEQ ID NO: 2866512 - DNA, 20 bp, Homo sapiens
gactgaccaaagactgcaga

SEQ ID NO: 2866513 - DNA, 21 bp, Homo sapiens
gactgaccaaagactgcagaa

SEQ ID NO: 2866514 - DNA, 22 bp, Homo sapiens
gactgaccaaagactgcagaac

SEQ ID NO: 2866515 - DNA, 23 bp, Homo sapiens
gactgaccaaagactgcagaacc

SEQ ID NO: 2866516 - DNA, 21 bp, Homo sapiens
gactgaccacaccaaccaggc

SEQ ID NO: 2866517 - DNA, 22 bp, Homo sapiens
gactgcagaacccccaggtggc

SEQ ID NO: 2866518 - DNA, 20 bp, Homo sapiens
gactggaggcccctggagcc

SEQ ID NO: 2866519 - DNA, 23 bp, Homo sapiens
gactggaggcccctggagccaga

SEQ ID NO: 2866520 - DNA, 13 bp, Homo sapiens
gactggcagaagc

SEQ ID NO: 2866521 - DNA, 14 bp, Homo sapiens
gactggcagaagca

SEQ ID NO: 2866522 - DNA, 15 bp, Homo sapiens
gactgggctgaggga

SEQ ID NO: 2866523 - DNA, 18 bp, Homo sapiens
gactgtctccatggccct

SEQ ID NO: 2866524 - DNA, 21 bp, Homo sapiens
gacttgaaatacgtttgtgtt

SEQ ID NO: 2866525 - DNA, 20 bp, Homo sapiens
gacttggagaatactgccaa

SEQ ID NO: 2866526 - DNA, 21 bp, Homo sapiens
gacttggagaatactgccaaa

SEQ ID NO: 2866527 - DNA, 16 bp, Homo sapiens
gacttggggaccagag

SEQ ID NO: 2866528 - DNA, 19 bp, Homo sapiens
gacttgtttagagagcctg

SEQ ID NO: 2866529 - DNA, 18 bp, Homo sapiens
gagaaagcacaatttaaa

SEQ ID NO: 2866530 - DNA, 15 bp, Homo sapiens
gagaagggggattgg

SEQ ID NO: 2866531 - DNA, 22 bp, Homo sapiens
gagaatactgccaaaacattta

SEQ ID NO: 2866532 - DNA, 22 bp, Homo sapiens
gagaatatttactaactaaata

SEQ ID NO: 2866533 - DNA, 15 bp, Homo sapiens
gagacagaaagcctc

SEQ ID NO: 2866534 - DNA, 15 bp, Homo sapiens
gagacagacattcac

SEQ ID NO: 2866535 - DNA, 18 bp, Homo sapiens
gagacccagccctcatcc

SEQ ID NO: 2866536 - DNA, 15 bp, Homo sapiens
gagaccccttccttt

SEQ ID NO: 2866537 - DNA, 19 bp, Homo sapiens
gagaccccttcctttcctc

SEQ ID NO: 2866538 - DNA, 20 bp, Homo sapiens
gagaccccttcctttcctct

SEQ ID NO: 2866539 - DNA, 15 bp, Homo sapiens
gagactgcccagcta

SEQ ID NO: 2866540 - DNA, 13 bp, Homo sapiens
gagactgggctga

SEQ ID NO: 2866541 - DNA, 17 bp, Homo sapiens
gagagagggactcaagg

SEQ ID NO: 2866542 - DNA, 14 bp, Homo sapiens
gagagccagctctc

SEQ ID NO: 2866543 - DNA, 19 bp, Homo sapiens
gagagcctgtcaccagagc

SEQ ID NO: 2866544 - DNA, 20 bp, Homo sapiens
gagagcctgtcaccagagct

SEQ ID NO: 2866545 - DNA, 15 bp, Homo sapiens
gagataaatgagctt

SEQ ID NO: 2866546 - DNA, 13 bp, Homo sapiens
gagattgaacttt

SEQ ID NO: 2866547 - DNA, 18 bp, Homo sapiens
gagattttgtcgggacag

SEQ ID NO: 2866548 - DNA, 14 bp, Homo sapiens
gagcaagactctgt

SEQ ID NO: 2866549 - DNA, 14 bp, Homo sapiens
gagcaattccaggc

SEQ ID NO: 2866550 - DNA, 16 bp, Homo sapiens
gagcaattccaggctg

SEQ ID NO: 2866551 - DNA, 17 bp, Homo sapiens
gagcaattccaggctga

SEQ ID NO: 2866552 - DNA, 18 bp, Homo sapiens
gagcaattccaggctgag

SEQ ID NO: 2866553 - DNA, 22 bp, Homo sapiens
gagcaattccaggctgagccat

SEQ ID NO: 2866554 - DNA, 18 bp, Homo sapiens
gagcaccccctcattccc

SEQ ID NO: 2866555 - DNA, 21 bp, Homo sapiens
gagcagtgaatgattcagtgt

SEQ ID NO: 2866556 - DNA, 14 bp, Homo sapiens
gagcatagagaaca

SEQ ID NO: 2866557 - DNA, 13 bp, Homo sapiens
gagccaacctgga

SEQ ID NO: 2866558 - DNA, 22 bp, Homo sapiens
gagccaacctggacttcctgtc

SEQ ID NO: 2866559 - DNA, 18 bp, Homo sapiens
gagccaattagacttgaa

SEQ ID NO: 2866560 - DNA, 14 bp, Homo sapiens
gagccactcctctg

SEQ ID NO: 2866561 - DNA, 15 bp, Homo sapiens
gagccagatggcaag

SEQ ID NO: 2866562 - DNA, 10 bp, Homo sapiens
gagccaggag

SEQ ID NO: 2866563 - DNA, 15 bp, Homo sapiens
gagccatgaggagcg

SEQ ID NO: 2866564 - DNA, 20 bp, Homo sapiens
gagccatgaggagcgtggac

SEQ ID NO: 2866565 - DNA, 14 bp, Homo sapiens
gagcccaagggaat

SEQ ID NO: 2866566 - DNA, 12 bp, Homo sapiens
gagcccagctct

SEQ ID NO: 2866567 - DNA, 16 bp, Homo sapiens
gagccccattcctggg

SEQ ID NO: 2866568 - DNA, 15 bp, Homo sapiens
gagcccctcctccag

SEQ ID NO: 2866569 - DNA, 14 bp, Homo sapiens
gagccgaggggaga

SEQ ID NO: 2866570 - DNA, 16 bp, Homo sapiens
gagcctcccccaaagc

SEQ ID NO: 2866571 - DNA, 12 bp, Homo sapiens
gagcctgaggga

SEQ ID NO: 2866572 - DNA, 16 bp, Homo sapiens
gagcctggctgcccat

SEQ ID NO: 2866573 - DNA, 15 bp, Homo sapiens
gagcctgtcaccaga

SEQ ID NO: 2866574 - DNA, 24 bp, Homo sapiens
gagcctgtcaccagagcttctctg

SEQ ID NO: 2866575 - DNA, 21 bp, Homo sapiens
gagcgaggagatgctccttgg

SEQ ID NO: 2866576 - DNA, 12 bp, Homo sapiens
gagcgtggactc

SEQ ID NO: 2866577 - DNA, 18 bp, Homo sapiens
gagctgtgcaggtgggga

SEQ ID NO: 2866578 - DNA, 17 bp, Homo sapiens
gagctgtttactaggga

SEQ ID NO: 2866579 - DNA, 19 bp, Homo sapiens
gagcttcatggcagaaggc

SEQ ID NO: 2866580 - DNA, 14 bp, Homo sapiens
gagcttctctgggc

SEQ ID NO: 2866581 - DNA, 14 bp, Homo sapiens
gagcttctctgtga

SEQ ID NO: 2866582 - DNA, 19 bp, Homo sapiens
gaggaaaaatgggagccag

SEQ ID NO: 2866583 - DNA, 17 bp, Homo sapiens
gaggactcccaaccctg

SEQ ID NO: 2866584 - DNA, 18 bp, Homo sapiens
gaggactcccaaccctgg

SEQ ID NO: 2866585 - DNA, 21 bp, Homo sapiens
gaggactcccaaccctggctt

SEQ ID NO: 2866586 - DNA, 21 bp, Homo sapiens
gaggacttggttgatgtttaa

SEQ ID NO: 2866587 - DNA, 16 bp, Homo sapiens
gaggagacagaaagcc

SEQ ID NO: 2866588 - DNA, 20 bp, Homo sapiens
gaggatagtagttaaataac

SEQ ID NO: 2866589 - DNA, 14 bp, Homo sapiens
gaggccaagatggc

SEQ ID NO: 2866590 - DNA, 16 bp, Homo sapiens
gaggctgaggcaagag

SEQ ID NO: 2866591 - DNA, 13 bp, Homo sapiens
gaggctggggctc

SEQ ID NO: 2866592 - DNA, 21 bp, Homo sapiens
gagggacaagggattctggga

SEQ ID NO: 2866593 - DNA, 16 bp, Homo sapiens
gagggacgcctggggg

SEQ ID NO: 2866594 - DNA, 14 bp, Homo sapiens
gagggcagcagggc

SEQ ID NO: 2866595 - DNA, 19 bp, Homo sapiens
gagggcagcagggctaccc

SEQ ID NO: 2866596 - DNA, 16 bp, Homo sapiens
gagggccacatgggag

SEQ ID NO: 2866597 - DNA, 12 bp, Homo sapiens
gaggggagagag

SEQ ID NO: 2866598 - DNA, 12 bp, Homo sapiens
ctctttcttgtt

SEQ ID NO: 2866599 - DNA, 17 bp, Homo sapiens
ctctttcttgtttgtca

SEQ ID NO: 2866600 - DNA, 17 bp, Homo sapiens
ctgaaaacactgtgcac

SEQ ID NO: 2866601 - DNA, 19 bp, Homo sapiens
ctgaaattgcttatttttg

SEQ ID NO: 2866602 - DNA, 12 bp, Homo sapiens
ctgaaggagccc

SEQ ID NO: 2866603 - DNA, 14 bp, Homo sapiens
ctgaataatatcaa

SEQ ID NO: 2866604 - DNA, 18 bp, Homo sapiens
ctgaatgtatgtcagtgc

SEQ ID NO: 2866605 - DNA, 22 bp, Homo sapiens
ctgaatttgtatatgactgcat

SEQ ID NO: 2866606 - DNA, 21 bp, Homo sapiens
ctgacatttggagtgttcccc

SEQ ID NO: 2866607 - DNA, 20 bp, Homo sapiens
ctgtctccatggccctgcaa

SEQ ID NO: 2866608 - DNA, 19 bp, Homo sapiens
ctgtcttcatagcagattt

SEQ ID NO: 2866609 - DNA, 18 bp, Homo sapiens
ctgtgaacgatttagaaa

SEQ ID NO: 2866610 - DNA, 22 bp, Homo sapiens
ctgtgaacgatttagaaagaag

SEQ ID NO: 2866611 - DNA, 15 bp, Homo sapiens
ctgtgaccaatgtct

SEQ ID NO: 2866612 - DNA, 16 bp, Homo sapiens
ctgtgactataaagct

SEQ ID NO: 2866613 - DNA, 15 bp, Homo sapiens
ctgtgattactgcaa

SEQ ID NO: 2866614 - DNA, 23 bp, Homo sapiens
ctgtgattactgcaatcactgtg

SEQ ID NO: 2866615 - DNA, 14 bp, Homo sapiens
ctgtgcaccaagca

SEQ ID NO: 2866616 - DNA, 21 bp, Homo sapiens
ctgtgcagccgctgagcgagg

SEQ ID NO: 2866617 - DNA, 24 bp, Homo sapiens
ctgtgctaaagaagccctgctggg

SEQ ID NO: 2866618 - DNA, 19 bp, Homo sapiens
ctgtgcttcgggcccttcc

SEQ ID NO: 2866619 - DNA, 20 bp, Homo sapiens
ctgtgcttcgggcccttccc

SEQ ID NO: 2866620 - DNA, 14 bp, Homo sapiens
ctgtggtgtgtccc

SEQ ID NO: 2866621 - DNA, 21 bp, Homo sapiens
ctgtgtaacatccaagccaga

SEQ ID NO: 2866622 - DNA, 19 bp, Homo sapiens
ctgtgtttagattgtatta

SEQ ID NO: 2866623 - DNA, 15 bp, Homo sapiens
ctgttccccctgtgc

SEQ ID NO: 2866624 - DNA, 16 bp, Homo sapiens
ctgttccccctgtgca

SEQ ID NO: 2866625 - DNA, 17 bp, Homo sapiens
ctgttccccctgtgcag

SEQ ID NO: 2866626 - DNA, 16 bp, Homo sapiens
ctgttgcacttttgaa

SEQ ID NO: 2866627 - DNA, 18 bp, Homo sapiens
ctgttgcacttttgaatg

SEQ ID NO: 2866628 - DNA, 11 bp, Homo sapiens
ctgtttctaag

SEQ ID NO: 2866629 - DNA, 15 bp, Homo sapiens
ctgtttctaagaaaa

SEQ ID NO: 2866630 - DNA, 16 bp, Homo sapiens
ctgtttctaagaaaat

SEQ ID NO: 2866631 - DNA, 18 bp, Homo sapiens
ctgtttctaagaaaatgt

SEQ ID NO: 2866632 - DNA, 20 bp, Homo sapiens
ctgtttgggttgttggtctg

SEQ ID NO: 2866633 - DNA, 22 bp, Homo sapiens
ctgtttgggttgttggtctgtg

SEQ ID NO: 2866634 - DNA, 16 bp, Homo sapiens
ctgtttttaagctgtt

SEQ ID NO: 2866635 - DNA, 23 bp, Homo sapiens
ctgtttttaagctgtttccatag

SEQ ID NO: 2866636 - DNA, 22 bp, Homo sapiens
cttaagtcctaaaagttctcaa

SEQ ID NO: 2866637 - DNA, 13 bp, Homo sapiens
cttagggcactgg

SEQ ID NO: 2866638 - DNA, 13 bp, Homo sapiens
cttatagaatatt

SEQ ID NO: 2866639 - DNA, 13 bp, Homo sapiens
cttatccaacttt

SEQ ID NO: 2866640 - DNA, 17 bp, Homo sapiens
cttatgtgaaaaattaa

SEQ ID NO: 2866641 - DNA, 17 bp, Homo sapiens
cttattagagtgtcttt

SEQ ID NO: 2866642 - DNA, 20 bp, Homo sapiens
cttattagagtgtctttcca

SEQ ID NO: 2866643 - DNA, 15 bp, Homo sapiens
cttattgtacctctc

SEQ ID NO: 2866644 - DNA, 18 bp, Homo sapiens
cttattgtacctctctta

SEQ ID NO: 2866645 - DNA, 18 bp, Homo sapiens
cttcaaggacattggtga

SEQ ID NO: 2866646 - DNA, 18 bp, Homo sapiens
cttcaatatgaatctata

SEQ ID NO: 2866647 - DNA, 23 bp, Homo sapiens
cttcagaggccctcgctgccagc

SEQ ID NO: 2866648 - DNA, 15 bp, Homo sapiens
cttcagcattgtaat

SEQ ID NO: 2866649 - DNA, 23 bp, Homo sapiens
cttcagcattgtaattatgtaaa

SEQ ID NO: 2866650 - DNA, 17 bp, Homo sapiens
cttcatcctcctcccca

SEQ ID NO: 2866651 - DNA, 19 bp, Homo sapiens
cttcatcctcctccccagc

SEQ ID NO: 2866652 - DNA, 16 bp, Homo sapiens
cttcatgcctgatgaa

SEQ ID NO: 2866653 - DNA, 20 bp, Homo sapiens
cttcatgcctgatgaaagct

SEQ ID NO: 2866654 - DNA, 20 bp, Homo sapiens
cttcattccggactggcaga

SEQ ID NO: 2866655 - DNA, 22 bp, Homo sapiens
cttcattccggactggcagaag

SEQ ID NO: 2866656 - DNA, 23 bp, Homo sapiens
cttcattccggactggcagaagc

SEQ ID NO: 2866657 - DNA, 20 bp, Homo sapiens
cttcattcttgaaagctgtg

SEQ ID NO: 2866658 - DNA, 13 bp, Homo sapiens
cttccacttctgg

SEQ ID NO: 2866659 - DNA, 14 bp, Homo sapiens
cttccattttcccc

SEQ ID NO: 2866660 - DNA, 22 bp, Homo sapiens
cttccattttcccccactactg

SEQ ID NO: 2866661 - DNA, 14 bp, Homo sapiens
cttcccagaccagg

SEQ ID NO: 2866662 - DNA, 18 bp, Homo sapiens
cttcccagaccaggaaag

SEQ ID NO: 2866663 - DNA, 17 bp, Homo sapiens
cttccccagactcagct

SEQ ID NO: 2866664 - DNA, 19 bp, Homo sapiens
cttccccagactcagctcc

SEQ ID NO: 2866665 - DNA, 16 bp, Homo sapiens
cttcccccagcccatc

SEQ ID NO: 2866666 - DNA, 19 bp, Homo sapiens
cttccctgccacttcaacc

SEQ ID NO: 2866667 - DNA, 11 bp, Homo sapiens
cttcccttccc

SEQ ID NO: 2866668 - DNA, 17 bp, Homo sapiens
cttcccttcccagacca

SEQ ID NO: 2866669 - DNA, 17 bp, Homo sapiens
cttcctagatctgcagg

SEQ ID NO: 2866670 - DNA, 21 bp, Homo sapiens
cttcctagatctgcaggctgc

SEQ ID NO: 2866671 - DNA, 14 bp, Homo sapiens
cttcctcctgggcc

SEQ ID NO: 2866672 - DNA, 22 bp, Homo sapiens
cttcctcctgggccctctctgc

SEQ ID NO: 2866673 - DNA, 14 bp, Homo sapiens
cttcctggagactg

SEQ ID NO: 2866674 - DNA, 13 bp, Homo sapiens
cttccttccccca

SEQ ID NO: 2866675 - DNA, 11 bp, Homo sapiens
cttcctttcct

SEQ ID NO: 2866676 - DNA, 14 bp, Homo sapiens
cttcctttcctctg

SEQ ID NO: 2866677 - DNA, 17 bp, Homo sapiens
cttcctttcctctgcag

SEQ ID NO: 2866678 - DNA, 15 bp, Homo sapiens
cttcgtttatatttt

SEQ ID NO: 2866679 - DNA, 17 bp, Homo sapiens
cttctacctacatattt

SEQ ID NO: 2866680 - DNA, 14 bp, Homo sapiens
cttctcatgtatat

SEQ ID NO: 2866681 - DNA, 22 bp, Homo sapiens
cttctctgtgaacgatttagaa

SEQ ID NO: 2866682 - DNA, 21 bp, Homo sapiens
cttctgaagagaccactcaat

SEQ ID NO: 2866683 - DNA, 13 bp, Homo sapiens
cttctggatccat

SEQ ID NO: 2866684 - DNA, 21 bp, Homo sapiens
cttgaattgtaactgttcttg

SEQ ID NO: 2866685 - DNA, 15 bp, Homo sapiens
cttgactacctactg

SEQ ID NO: 2866686 - DNA, 13 bp, Homo sapiens
cttgagcctcccc

SEQ ID NO: 2866687 - DNA, 23 bp, Homo sapiens
cttgaggccaagatggctgctgc

SEQ ID NO: 2866688 - DNA, 16 bp, Homo sapiens
cttgcccactgcctgc

SEQ ID NO: 2866689 - DNA, 21 bp, Homo sapiens
cttgcccactgcctgcctccc

SEQ ID NO: 2866690 - DNA, 22 bp, Homo sapiens
cttgcccactgcctgcctcccc

SEQ ID NO: 2866691 - DNA, 19 bp, Homo sapiens
cttgcttctctagctctct

SEQ ID NO: 2866692 - DNA, 14 bp, Homo sapiens
cttgggccctttga

SEQ ID NO: 2866693 - DNA, 14 bp, Homo sapiens
cttggggcttccta

SEQ ID NO: 2866694 - DNA, 16 bp, Homo sapiens
cttggttcccccactg

SEQ ID NO: 2866695 - DNA, 17 bp, Homo sapiens
cttggttgatgtttaaa

SEQ ID NO: 2866696 - DNA, 20 bp, Homo sapiens
cttgtagaactcactctggg

SEQ ID NO: 2866697 - DNA, 21 bp, Homo sapiens
cttgtagaactcactctgggc

SEQ ID NO: 2866698 - DNA, 14 bp, Homo sapiens
cttgtccctctcac

SEQ ID NO: 2866699 - DNA, 21 bp, Homo sapiens
cttgtgttcagctctttccaa

SEQ ID NO: 2866700 - DNA, 13 bp, Homo sapiens
cttgttatttata

SEQ ID NO: 2866701 - DNA, 23 bp, Homo sapiens
cttgtttagagagcctgtcacca

SEQ ID NO: 2866702 - DNA, 15 bp, Homo sapiens
cttgtttgtcagcat

SEQ ID NO: 2866703 - DNA, 18 bp, Homo sapiens
cttgtttgtcagcatctg

SEQ ID NO: 2866704 - DNA, 22 bp, Homo sapiens
cttgtttgtcagcatctgacca

SEQ ID NO: 2866705 - DNA, 18 bp, Homo sapiens
ctttaaccctctcttccc

SEQ ID NO: 2866706 - DNA, 19 bp, Homo sapiens
ctttaggggaagtaaaaca

SEQ ID NO: 2866707 - DNA, 22 bp, Homo sapiens
ctttaggggaagtaaaacagtc

SEQ ID NO: 2866708 - DNA, 23 bp, Homo sapiens
ctttaggggaagtaaaacagtca

SEQ ID NO: 2866709 - DNA, 11 bp, Homo sapiens
ctttatatttc

SEQ ID NO: 2866710 - DNA, 17 bp, Homo sapiens
tatgacaaattcaagag

SEQ ID NO: 2866711 - DNA, 14 bp, Homo sapiens
tatgagggggtggt

SEQ ID NO: 2866712 - DNA, 12 bp, Homo sapiens
tatgcaattcag

SEQ ID NO: 2866713 - DNA, 17 bp, Homo sapiens
tatgcaattcagtgttc

SEQ ID NO: 2866714 - DNA, 19 bp, Homo sapiens
tatgcacttttagaaatgc

SEQ ID NO: 2866715 - DNA, 21 bp, Homo sapiens
tatgcatttaaatacagtctt

SEQ ID NO: 2866716 - DNA, 17 bp, Homo sapiens
tatgctgatcttttaaa

SEQ ID NO: 2866717 - DNA, 20 bp, Homo sapiens
tatgctgatcttttaaaatc

SEQ ID NO: 2866718 - DNA, 21 bp, Homo sapiens
tatgctgatcttttaaaatca

SEQ ID NO: 2866719 - DNA, 23 bp, Homo sapiens
tatggcttatttctatgacaaat

SEQ ID NO: 2866720 - DNA, 20 bp, Homo sapiens
tatgggggagattgaacttt

SEQ ID NO: 2866721 - DNA, 15 bp, Homo sapiens
tatgtaatttcaaaa

SEQ ID NO: 2866722 - DNA, 19 bp, Homo sapiens
tatgtaatttcaaaataca

SEQ ID NO: 2866723 - DNA, 21 bp, Homo sapiens
tatgtcagtgctataaatgcc

SEQ ID NO: 2866724 - DNA, 23 bp, Homo sapiens
tatgtcagtgctataaatgccag

SEQ ID NO: 2866725 - DNA, 16 bp, Homo sapiens
tatgtttttgttcaaa

SEQ ID NO: 2866726 - DNA, 21 bp, Homo sapiens
tattaaaaaacaattaactgc

SEQ ID NO: 2866727 - DNA, 14 bp, Homo sapiens
tattaagtaaaatc

SEQ ID NO: 2866728 - DNA, 21 bp, Homo sapiens
tattatgactcaataaaagaa

SEQ ID NO: 2866729 - DNA, 17 bp, Homo sapiens
tattcaattcctctggg

SEQ ID NO: 2866730 - DNA, 13 bp, Homo sapiens
tattcttgttata

SEQ ID NO: 2866731 - DNA, 12 bp, Homo sapiens
tattgcaatgca

SEQ ID NO: 2866732 - DNA, 17 bp, Homo sapiens
tattggactccaggcct

SEQ ID NO: 2866733 - DNA, 11 bp, Homo sapiens
tattgtacctc

SEQ ID NO: 2866734 - DNA, 14 bp, Homo sapiens
tattgtacctctct

SEQ ID NO: 2866735 - DNA, 21 bp, Homo sapiens
tatttactaactaaataccat

SEQ ID NO: 2866736 - DNA, 23 bp, Homo sapiens
tatttactgagcttctctgtgaa

SEQ ID NO: 2866737 - DNA, 17 bp, Homo sapiens
tatttatttactgagct

SEQ ID NO: 2866738 - DNA, 20 bp, Homo sapiens
tatttctatgacaaattcaa

SEQ ID NO: 2866739 - DNA, 14 bp, Homo sapiens
tatttgatttctaa

SEQ ID NO: 2866740 - DNA, 12 bp, Homo sapiens
tattttagaaat

SEQ ID NO: 2866741 - DNA, 14 bp, Homo sapiens
tattttcaccattt

SEQ ID NO: 2866742 - DNA, 14 bp, Homo sapiens
tatttttatgatga

SEQ ID NO: 2866743 - DNA, 18 bp, Homo sapiens
tatttttgtatttctcta

SEQ ID NO: 2866744 - DNA, 15 bp, Homo sapiens
tatttttttaactgt

SEQ ID NO: 2866745 - DNA, 15 bp, Homo sapiens
tcaaagtatgcaatg

SEQ ID NO: 2866746 - DNA, 15 bp, Homo sapiens
tcaaataaaatatca

SEQ ID NO: 2866747 - DNA, 17 bp, Homo sapiens
tcaaataaaatatcata

SEQ ID NO: 2866748 - DNA, 23 bp, Homo sapiens
tcaaataaaatatcataaagcat

SEQ ID NO: 2866749 - DNA, 22 bp, Homo sapiens
tcaacccccagctaataaacca

SEQ ID NO: 2866750 - DNA, 15 bp, Homo sapiens
tcaagaaacagccag

SEQ ID NO: 2866751 - DNA, 22 bp, Homo sapiens
tcaagaaatatactctcccaga

SEQ ID NO: 2866752 - DNA, 17 bp, Homo sapiens
tcaagaagtaatcagta

SEQ ID NO: 2866753 - DNA, 14 bp, Homo sapiens
tcaagaatgaaaaa

SEQ ID NO: 2866754 - DNA, 15 bp, Homo sapiens
tcaagaatgaaaaat

SEQ ID NO: 2866755 - DNA, 15 bp, Homo sapiens
tcaagcattctgttt

SEQ ID NO: 2866756 - DNA, 18 bp, Homo sapiens
tcaataaacaacagctga

SEQ ID NO: 2866757 - DNA, 14 bp, Homo sapiens
tcaataaacagtca

SEQ ID NO: 2866758 - DNA, 17 bp, Homo sapiens
tcaatatgtatatatgt

SEQ ID NO: 2866759 - DNA, 13 bp, Homo sapiens
tcaatatttatta

SEQ ID NO: 2866760 - DNA, 19 bp, Homo sapiens
tcaattagtggtcataaaa

SEQ ID NO: 2866761 - DNA, 16 bp, Homo sapiens
tcaattgcatctccca

SEQ ID NO: 2866762 - DNA, 22 bp, Homo sapiens
tcaattgcatctcccagataat

SEQ ID NO: 2866763 - DNA, 19 bp, Homo sapiens
tcacatggggcctggccca

SEQ ID NO: 2866764 - DNA, 11 bp, Homo sapiens
tcaccagagct

SEQ ID NO: 2866765 - DNA, 17 bp, Homo sapiens
tcaccagagcttctctg

SEQ ID NO: 2866766 - DNA, 18 bp, Homo sapiens
tcaccagagcttctctgg

SEQ ID NO: 2866767 - DNA, 13 bp, Homo sapiens
tcacccccttctc

SEQ ID NO: 2866768 - DNA, 13 bp, Homo sapiens
tcaccgtgggctc

SEQ ID NO: 2866769 - DNA, 19 bp, Homo sapiens
tcaccgtgggctccctgac

SEQ ID NO: 2866770 - DNA, 16 bp, Homo sapiens
tcacctgtatatttct

SEQ ID NO: 2866771 - DNA, 20 bp, Homo sapiens
tcacctgtatatttctttta

SEQ ID NO: 2866772 - DNA, 14 bp, Homo sapiens
tcacctgtgcttcg

SEQ ID NO: 2866773 - DNA, 21 bp, Homo sapiens
tcacctgtgcttcgggccctt

SEQ ID NO: 2866774 - DNA, 18 bp, Homo sapiens
tcacctgtttttaagctg

SEQ ID NO: 2866775 - DNA, 19 bp, Homo sapiens
tcacctgtttttaagctgt

SEQ ID NO: 2866776 - DNA, 21 bp, Homo sapiens
tcacgattaactgtgaaatgt

SEQ ID NO: 2866777 - DNA, 13 bp, Homo sapiens
tcactctgggctg

SEQ ID NO: 2866778 - DNA, 21 bp, Homo sapiens
tcactgagttttgtttcactt

SEQ ID NO: 2866779 - DNA, 14 bp, Homo sapiens
tcactgccatgcct

SEQ ID NO: 2866780 - DNA, 18 bp, Homo sapiens
tcactgccttcgtttata

SEQ ID NO: 2866781 - DNA, 19 bp, Homo sapiens
tcactgccttcgtttatat

SEQ ID NO: 2866782 - DNA, 22 bp, Homo sapiens
tcactggcgacacgtagcagct

SEQ ID NO: 2866783 - DNA, 18 bp, Homo sapiens
tcacttttgacaaaggca

SEQ ID NO: 2866784 - DNA, 16 bp, Homo sapiens
tcagaatttttaactg

SEQ ID NO: 2866785 - DNA, 16 bp, Homo sapiens
tcagagccgtggtcct

SEQ ID NO: 2866786 - DNA, 15 bp, Homo sapiens
tcagcaaattccaga

SEQ ID NO: 2866787 - DNA, 13 bp, Homo sapiens
tcagcatctgacc

SEQ ID NO: 2866788 - DNA, 15 bp, Homo sapiens
tcagcatctgaccat

SEQ ID NO: 2866789 - DNA, 19 bp, Homo sapiens
tcagcatctgaccatctgt

SEQ ID NO: 2866790 - DNA, 21 bp, Homo sapiens
tcagcatctgaccatctgtga

SEQ ID NO: 2866791 - DNA, 22 bp, Homo sapiens
tcagcatctgaccatctgtgac

SEQ ID NO: 2866792 - DNA, 17 bp, Homo sapiens
tcagcattgtaattatg

SEQ ID NO: 2866793 - DNA, 22 bp, Homo sapiens
tcagctccagaataccttcttc

SEQ ID NO: 2866794 - DNA, 22 bp, Homo sapiens
tcaggaaaggaatcatttctat

SEQ ID NO: 2866795 - DNA, 13 bp, Homo sapiens
tcagggtgggcca

SEQ ID NO: 2866796 - DNA, 20 bp, Homo sapiens
tcagggtgggccactctccc

SEQ ID NO: 2866797 - DNA, 21 bp, Homo sapiens
tcagggtgggccactctcccc

SEQ ID NO: 2866798 - DNA, 14 bp, Homo sapiens
tcagtaaatagtgt

SEQ ID NO: 2866799 - DNA, 19 bp, Homo sapiens
tcagtaatgctaaatgtgt

SEQ ID NO: 2866800 - DNA, 18 bp, Homo sapiens
gcattttgatattgctgt

SEQ ID NO: 2866801 - DNA, 14 bp, Homo sapiens
gccaaaacatttat

SEQ ID NO: 2866802 - DNA, 13 bp, Homo sapiens
gccaacctggact

SEQ ID NO: 2866803 - DNA, 14 bp, Homo sapiens
gccaacctggactt

SEQ ID NO: 2866804 - DNA, 20 bp, Homo sapiens
gccaagatggctgctgcctg

SEQ ID NO: 2866805 - DNA, 14 bp, Homo sapiens
gccaaggagcccct

SEQ ID NO: 2866806 - DNA, 16 bp, Homo sapiens
gccaagggctttgttt

SEQ ID NO: 2866807 - DNA, 17 bp, Homo sapiens
gccaatctgtacaaaat

SEQ ID NO: 2866808 - DNA, 21 bp, Homo sapiens
gccaatctttcctactttcta

SEQ ID NO: 2866809 - DNA, 19 bp, Homo sapiens
gccaattaaaaacgaaaac

SEQ ID NO: 2866810 - DNA, 18 bp, Homo sapiens
gccaattagacttgaaat

SEQ ID NO: 2866811 - DNA, 13 bp, Homo sapiens
gccaattcctata

SEQ ID NO: 2866812 - DNA, 19 bp, Homo sapiens
gccacagaaggtgaacttt

SEQ ID NO: 2866813 - DNA, 16 bp, Homo sapiens
gccacagcctcccctg

SEQ ID NO: 2866814 - DNA, 14 bp, Homo sapiens
gccactcctctgac

SEQ ID NO: 2866815 - DNA, 23 bp, Homo sapiens
gccactcctctgactcagggctc

SEQ ID NO: 2866816 - DNA, 17 bp, Homo sapiens
gccactgaggagacaga

SEQ ID NO: 2866817 - DNA, 19 bp, Homo sapiens
gccactgaggagacagaaa

SEQ ID NO: 2866818 - DNA, 21 bp, Homo sapiens
gccactgaggagacagaaagc

SEQ ID NO: 2866819 - DNA, 14 bp, Homo sapiens
gccagagccaacct

SEQ ID NO: 2866820 - DNA, 16 bp, Homo sapiens
gccagagccaacctgg

SEQ ID NO: 2866821 - DNA, 23 bp, Homo sapiens
gccagagccaacctggacttcct

SEQ ID NO: 2866822 - DNA, 22 bp, Homo sapiens
gccagaggctcgttgactggct

SEQ ID NO: 2866823 - DNA, 20 bp, Homo sapiens
gccagagtttttaaagcctt

SEQ ID NO: 2866824 - DNA, 21 bp, Homo sapiens
gccagagtttttaaagccttc

SEQ ID NO: 2866825 - DNA, 13 bp, Homo sapiens
gccagcaacgctt

SEQ ID NO: 2866826 - DNA, 22 bp, Homo sapiens
gccagcaacgcttgtagaactc

SEQ ID NO: 2866827 - DNA, 19 bp, Homo sapiens
gccagcgtcctcctctgtg

SEQ ID NO: 2866828 - DNA, 10 bp, Homo sapiens
gccagctctc

SEQ ID NO: 2866829 - DNA, 18 bp, Homo sapiens
gccagcttgttatttata

SEQ ID NO: 2866830 - DNA, 21 bp, Homo sapiens
gccagggcagagtgagaccca

SEQ ID NO: 2866831 - DNA, 14 bp, Homo sapiens
gccagggcagggcc

SEQ ID NO: 2866832 - DNA, 23 bp, Homo sapiens
gccatcagggtgggccactctcc

SEQ ID NO: 2866833 - DNA, 23 bp, Homo sapiens
gccatcatctcctgccttcctcc

SEQ ID NO: 2866834 - DNA, 19 bp, Homo sapiens
gccatgaggagcgtggact

SEQ ID NO: 2866835 - DNA, 13 bp, Homo sapiens
gcccaaagtgggg

SEQ ID NO: 2866836 - DNA, 14 bp, Homo sapiens
gcccaaagtgggga

SEQ ID NO: 2866837 - DNA, 18 bp, Homo sapiens
gcccaatattataatttt

SEQ ID NO: 2866838 - DNA, 16 bp, Homo sapiens
gcccactgcctgcctc

SEQ ID NO: 2866839 - DNA, 18 bp, Homo sapiens
gcccactgcctgcctccc

SEQ ID NO: 2866840 - DNA, 16 bp, Homo sapiens
gcccagaggactccca

SEQ ID NO: 2866841 - DNA, 20 bp, Homo sapiens
gcccagcactgcttgaggaa

SEQ ID NO: 2866842 - DNA, 17 bp, Homo sapiens
gccccacccccatgcag

SEQ ID NO: 2866843 - DNA, 12 bp, Homo sapiens
gccccattcctg

SEQ ID NO: 2866844 - DNA, 15 bp, Homo sapiens
gccccattcctggga

SEQ ID NO: 2866845 - DNA, 20 bp, Homo sapiens
gcccctcctccagcccctgt

SEQ ID NO: 2866846 - DNA, 15 bp, Homo sapiens
gcccgcttttgttct

SEQ ID NO: 2866847 - DNA, 14 bp, Homo sapiens
gccctccctctccc

SEQ ID NO: 2866848 - DNA, 16 bp, Homo sapiens
gccctccctctcccag

SEQ ID NO: 2866849 - DNA, 20 bp, Homo sapiens
gccctcggaggtccagctgg

SEQ ID NO: 2866850 - DNA, 21 bp, Homo sapiens
gccctcggaggtccagctggg

SEQ ID NO: 2866851 - DNA, 22 bp, Homo sapiens
gccctcggaggtccagctgggc

SEQ ID NO: 2866852 - DNA, 21 bp, Homo sapiens
gccctgcaaaaggactctcag

SEQ ID NO: 2866853 - DNA, 18 bp, Homo sapiens
gccctttgagtgcagtcc

SEQ ID NO: 2866854 - DNA, 15 bp, Homo sapiens
gccgactctggccct

SEQ ID NO: 2866855 - DNA, 18 bp, Homo sapiens
gccgactctggccctggc

SEQ ID NO: 2866856 - DNA, 13 bp, Homo sapiens
gccgaggggagag

SEQ ID NO: 2866857 - DNA, 15 bp, Homo sapiens
gccgctgagcgagga

SEQ ID NO: 2866858 - DNA, 19 bp, Homo sapiens
gcctagtgaaggcttctct

SEQ ID NO: 2866859 - DNA, 12 bp, Homo sapiens
gcctcaagaaca

SEQ ID NO: 2866860 - DNA, 17 bp, Homo sapiens
gcctcaagaacaccttt

SEQ ID NO: 2866861 - DNA, 17 bp, Homo sapiens
gcctcccctgccagggc

SEQ ID NO: 2866862 - DNA, 16 bp, Homo sapiens
gcctccgctgggcttc

SEQ ID NO: 2866863 - DNA, 17 bp, Homo sapiens
gcctccgctgggcttca

SEQ ID NO: 2866864 - DNA, 13 bp, Homo sapiens
gcctcctgcctcc

SEQ ID NO: 2866865 - DNA, 23 bp, Homo sapiens
gcctctacctgacactcccttgg

SEQ ID NO: 2866866 - DNA, 15 bp, Homo sapiens
gcctcttctgggagg

SEQ ID NO: 2866867 - DNA, 15 bp, Homo sapiens
gcctgagaaacacta

SEQ ID NO: 2866868 - DNA, 22 bp, Homo sapiens
gcctgagaaacactatttgtga

SEQ ID NO: 2866869 - DNA, 10 bp, Homo sapiens
gcctgaggga

SEQ ID NO: 2866870 - DNA, 19 bp, Homo sapiens
gcctgctctagtgggacag

SEQ ID NO: 2866871 - DNA, 12 bp, Homo sapiens
gcctggactgac

SEQ ID NO: 2866872 - DNA, 17 bp, Homo sapiens
gcctggagggatgccac

SEQ ID NO: 2866873 - DNA, 16 bp, Homo sapiens
gcctgggggtgccagg

SEQ ID NO: 2866874 - DNA, 20 bp, Homo sapiens
gcctgttgctatagagccta

SEQ ID NO: 2866875 - DNA, 19 bp, Homo sapiens
gccttattagagtgtcttt

SEQ ID NO: 2866876 - DNA, 17 bp, Homo sapiens
gccttcatcctcctccc

SEQ ID NO: 2866877 - DNA, 21 bp, Homo sapiens
gccttcatcctcctccccagc

SEQ ID NO: 2866878 - DNA, 20 bp, Homo sapiens
gcgaggagatgctccttggg

SEQ ID NO: 2866879 - DNA, 15 bp, Homo sapiens
gcgaggaggctccag

SEQ ID NO: 2866880 - DNA, 16 bp, Homo sapiens
gcgaggaggctccaga

SEQ ID NO: 2866881 - DNA, 18 bp, Homo sapiens
gcgaggaggctccagagg

SEQ ID NO: 2866882 - DNA, 18 bp, Homo sapiens
gcgtcttttttctcttcc

SEQ ID NO: 2866883 - DNA, 19 bp, Homo sapiens
gctaagatagaaagctgga

SEQ ID NO: 2866884 - DNA, 11 bp, Homo sapiens
gctaataaacc

SEQ ID NO: 2866885 - DNA, 20 bp, Homo sapiens
gctacaaatactcttaggaa

SEQ ID NO: 2866886 - DNA, 17 bp, Homo sapiens
gctacacccttttccag

SEQ ID NO: 2866887 - DNA, 16 bp, Homo sapiens
gctaccctgagctgag

SEQ ID NO: 2866888 - DNA, 20 bp, Homo sapiens
gctaccctgagctgaggcag

SEQ ID NO: 2866889 - DNA, 13 bp, Homo sapiens
gctagagaagggg

SEQ ID NO: 2866890 - DNA, 19 bp, Homo sapiens
gctagagccgaggggagag

SEQ ID NO: 2866891 - DNA, 20 bp, Homo sapiens
gctagagccgaggggagaga

SEQ ID NO: 2866892 - DNA, 14 bp, Homo sapiens
gctataaatgccag

SEQ ID NO: 2866893 - DNA, 15 bp, Homo sapiens
gctatcggcagatga

SEQ ID NO: 2866894 - DNA, 14 bp, Homo sapiens
gctcaacctaccct

SEQ ID NO: 2866895 - DNA, 17 bp, Homo sapiens
gctcaagcattctgttt

SEQ ID NO: 2866896 - DNA, 16 bp, Homo sapiens
gctcatcattctctgt

SEQ ID NO: 2866897 - DNA, 18 bp, Homo sapiens
gctcatcattctctgtct

SEQ ID NO: 2866898 - DNA, 19 bp, Homo sapiens
gctcatcattctctgtctc

SEQ ID NO: 2866899 - DNA, 19 bp, Homo sapiens
gctccatatttgatttcta

SEQ ID NO: 2866900 - DNA, 20 bp, Homo sapiens
gctccatatttgatttctaa

SEQ ID NO: 2866901 - DNA, 19 bp, Homo sapiens
gctccttgggccctttgag

SEQ ID NO: 2866902 - DNA, 21 bp, Homo sapiens
gctctagtgggacagcccaga

SEQ ID NO: 2866903 - DNA, 18 bp, Homo sapiens
gctctctaggcctctcca

SEQ ID NO: 2866904 - DNA, 16 bp, Homo sapiens
gctctgaaaccagtgt

SEQ ID NO: 2866905 - DNA, 13 bp, Homo sapiens
gctctgatccctc

SEQ ID NO: 2866906 - DNA, 21 bp, Homo sapiens
gctctgggatagctgacccag

SEQ ID NO: 2866907 - DNA, 13 bp, Homo sapiens
gctctttccaaat

SEQ ID NO: 2866908 - DNA, 22 bp, Homo sapiens
gtattactgaataatatcaaat

SEQ ID NO: 2866909 - DNA, 12 bp, Homo sapiens
gtattctctgag

SEQ ID NO: 2866910 - DNA, 23 bp, Homo sapiens
gtatttctatatagacttggaga

SEQ ID NO: 2866911 - DNA, 18 bp, Homo sapiens
gtcaataaacaacagctg

SEQ ID NO: 2866912 - DNA, 20 bp, Homo sapiens
gtcacatggggcctggccca

SEQ ID NO: 2866913 - DNA, 12 bp, Homo sapiens
gtcaccagagct

SEQ ID NO: 2866914 - DNA, 23 bp, Homo sapiens
gtcaccagagcttctctgggctg

SEQ ID NO: 2866915 - DNA, 16 bp, Homo sapiens
gtcacctacatatgct

SEQ ID NO: 2866916 - DNA, 17 bp, Homo sapiens
gtcagacgcctgaggaa

SEQ ID NO: 2866917 - DNA, 22 bp, Homo sapiens
gtcagccctagggtggagagcc

SEQ ID NO: 2866918 - DNA, 13 bp, Homo sapiens
gtcaggagttcct

SEQ ID NO: 2866919 - DNA, 21 bp, Homo sapiens
gtcagtgctataaatgccaga

SEQ ID NO: 2866920 - DNA, 23 bp, Homo sapiens
gtcagtgctataaatgccagagc

SEQ ID NO: 2866921 - DNA, 20 bp, Homo sapiens
gtcagtgttgcctcttgcaa

SEQ ID NO: 2866922 - DNA, 16 bp, Homo sapiens
gtcataccaatgaaaa

SEQ ID NO: 2866923 - DNA, 12 bp, Homo sapiens
gtccaatcctat

SEQ ID NO: 2866924 - DNA, 14 bp, Homo sapiens
gtccacttcatttt

SEQ ID NO: 2866925 - DNA, 17 bp, Homo sapiens
gtccagcagtttccagt

SEQ ID NO: 2866926 - DNA, 11 bp, Homo sapiens
gtccagctggg

SEQ ID NO: 2866927 - DNA, 13 bp, Homo sapiens
gtccagctgggcc

SEQ ID NO: 2866928 - DNA, 22 bp, Homo sapiens
gtccagctgggcctcctgcctc

SEQ ID NO: 2866929 - DNA, 23 bp, Homo sapiens
gtccagctgggcctcctgcctcc

SEQ ID NO: 2866930 - DNA, 16 bp, Homo sapiens
gtccatgggcagagcc

SEQ ID NO: 2866931 - DNA, 19 bp, Homo sapiens
gtcccacccccttccccca

SEQ ID NO: 2866932 - DNA, 23 bp, Homo sapiens
gtccctccgggacctggtgctgc

SEQ ID NO: 2866933 - DNA, 12 bp, Homo sapiens
gtccctctcact

SEQ ID NO: 2866934 - DNA, 17 bp, Homo sapiens
gtccctctcactcccca

SEQ ID NO: 2866935 - DNA, 12 bp, Homo sapiens
gtcctcctctgt

SEQ ID NO: 2866936 - DNA, 15 bp, Homo sapiens
gtcctgatcagagcc

SEQ ID NO: 2866937 - DNA, 20 bp, Homo sapiens
gtcctgcagcaaacactcca

SEQ ID NO: 2866938 - DNA, 13 bp, Homo sapiens
gtccttaaaatgt

SEQ ID NO: 2866939 - DNA, 14 bp, Homo sapiens
gtccttaaaatgtg

SEQ ID NO: 2866940 - DNA, 16 bp, Homo sapiens
gtccttccctgccact

SEQ ID NO: 2866941 - DNA, 14 bp, Homo sapiens
gtcgggacagagag

SEQ ID NO: 2866942 - DNA, 15 bp, Homo sapiens
gtctaccaatacaaa

SEQ ID NO: 2866943 - DNA, 15 bp, Homo sapiens
gtctcatccatcatc

SEQ ID NO: 2866944 - DNA, 15 bp, Homo sapiens
gtctctgtgtaacca

SEQ ID NO: 2866945 - DNA, 22 bp, Homo sapiens
gtctctgtgtaaccagctcagt

SEQ ID NO: 2866946 - DNA, 15 bp, Homo sapiens
gtctgccaatctgta

SEQ ID NO: 2866947 - DNA, 20 bp, Homo sapiens
gtcttatgtgaaaaattaac

SEQ ID NO: 2866948 - DNA, 22 bp, Homo sapiens
gtcttatgtgaaaaattaactt

SEQ ID NO: 2866949 - DNA, 20 bp, Homo sapiens
gtctttccattggatctcat

SEQ ID NO: 2866950 - DNA, 15 bp, Homo sapiens
gtgaaaatggtccag

SEQ ID NO: 2866951 - DNA, 17 bp, Homo sapiens
gtgaaaatggtccagga

SEQ ID NO: 2866952 - DNA, 18 bp, Homo sapiens
gtgaagagggacataaga

SEQ ID NO: 2866953 - DNA, 14 bp, Homo sapiens
gtgaaggcttctct

SEQ ID NO: 2866954 - DNA, 14 bp, Homo sapiens
gtgaagggaagtgg

SEQ ID NO: 2866955 - DNA, 15 bp, Homo sapiens
gtgaagggaagtggg

SEQ ID NO: 2866956 - DNA, 17 bp, Homo sapiens
gtgaatgtgtgagaaaa

SEQ ID NO: 2866957 - DNA, 14 bp, Homo sapiens
gtgacagcttcctt

SEQ ID NO: 2866958 - DNA, 14 bp, Homo sapiens
gtgacagtttccaa

SEQ ID NO: 2866959 - DNA, 12 bp, Homo sapiens
gtgactataaag

SEQ ID NO: 2866960 - DNA, 14 bp, Homo sapiens
gtgactataaagct

SEQ ID NO: 2866961 - DNA, 17 bp, Homo sapiens
gtgactataaagctgtt

SEQ ID NO: 2866962 - DNA, 14 bp, Homo sapiens
gtgaggccagggca

SEQ ID NO: 2866963 - DNA, 17 bp, Homo sapiens
gtgaggccagggcagag

SEQ ID NO: 2866964 - DNA, 17 bp, Homo sapiens
gtgagtcccagagcccg

SEQ ID NO: 2866965 - DNA, 19 bp, Homo sapiens
gtgcatccacgcacacatg

SEQ ID NO: 2866966 - DNA, 15 bp, Homo sapiens
gtgcccaaagtgggg

SEQ ID NO: 2866967 - DNA, 19 bp, Homo sapiens
gtgcccaaagtggggaggg

SEQ ID NO: 2866968 - DNA, 23 bp, Homo sapiens
gtgctataaatgccagagccaac

SEQ ID NO: 2866969 - DNA, 17 bp, Homo sapiens
gtgcttcgggcccttcc

SEQ ID NO: 2866970 - DNA, 22 bp, Homo sapiens
gtggcactggtaggttgggaca

SEQ ID NO: 2866971 - DNA, 12 bp, Homo sapiens
gtggccccaccc

SEQ ID NO: 2866972 - DNA, 20 bp, Homo sapiens
gtggcctgcgtcttttttct

SEQ ID NO: 2866973 - DNA, 18 bp, Homo sapiens
gtgggacagcccagagcc

SEQ ID NO: 2866974 - DNA, 17 bp, Homo sapiens
gtgggccactctcccct

SEQ ID NO: 2866975 - DNA, 15 bp, Homo sapiens
gtggtatgagggggt

SEQ ID NO: 2866976 - DNA, 19 bp, Homo sapiens
gtggtctgccaatctgtac

SEQ ID NO: 2866977 - DNA, 23 bp, Homo sapiens
gtggtgtgtccccctctgtccag

SEQ ID NO: 2866978 - DNA, 23 bp, Homo sapiens
gtggttattggactccaggcctg

SEQ ID NO: 2866979 - DNA, 17 bp, Homo sapiens
gtgtaaatgaagatctt

SEQ ID NO: 2866980 - DNA, 18 bp, Homo sapiens
gtgtaaatgaagatcttt

SEQ ID NO: 2866981 - DNA, 15 bp, Homo sapiens
gtgtaacatccaagc

SEQ ID NO: 2866982 - DNA, 18 bp, Homo sapiens
gtgtaacatccaagccag

SEQ ID NO: 2866983 - DNA, 19 bp, Homo sapiens
gtgtaacatccaagccaga

SEQ ID NO: 2866984 - DNA, 16 bp, Homo sapiens
gtgtaatctcaatgca

SEQ ID NO: 2866985 - DNA, 13 bp, Homo sapiens
gtgtatgcacagg

SEQ ID NO: 2866986 - DNA, 14 bp, Homo sapiens
gtgtcacctgtgct

SEQ ID NO: 2866987 - DNA, 21 bp, Homo sapiens
gtgtctcggagggattcccct

SEQ ID NO: 2866988 - DNA, 18 bp, Homo sapiens
gtgtgaagtttggagata

SEQ ID NO: 2866989 - DNA, 12 bp, Homo sapiens
gtgtgaggccag

SEQ ID NO: 2866990 - DNA, 20 bp, Homo sapiens
gtgtggcagccaggatgact

SEQ ID NO: 2866991 - DNA, 16 bp, Homo sapiens
gtgtgtccccctctgt

SEQ ID NO: 2866992 - DNA, 17 bp, Homo sapiens
gtgttcagctctttcca

SEQ ID NO: 2866993 - DNA, 17 bp, Homo sapiens
gtgttccctttttcata

SEQ ID NO: 2866994 - DNA, 14 bp, Homo sapiens
gtgttgttgttgct

SEQ ID NO: 2866995 - DNA, 17 bp, Homo sapiens
gtgttgttgttgctgct

SEQ ID NO: 2866996 - DNA, 18 bp, Homo sapiens
gtgttgttgttgctgctg

SEQ ID NO: 2866997 - DNA, 15 bp, Homo sapiens
gttaaataactgtgt

SEQ ID NO: 2866998 - DNA, 15 bp, Homo sapiens
gttactgtatttttc

SEQ ID NO: 2866999 - DNA, 17 bp, Homo sapiens
gttactgtatttttcag

SEQ ID NO: 2867000 - DNA, 18 bp, Homo sapiens
gttattggactccaggcc

SEQ ID NO: 2867001 - DNA, 13 bp, Homo sapiens
gttcaaagccagc

SEQ ID NO: 2867002 - DNA, 16 bp, Homo sapiens
gttcacttttgacaaa

SEQ ID NO: 2867003 - DNA, 15 bp, Homo sapiens
gttcagaaaaccact

SEQ ID NO: 2867004 - DNA, 17 bp, Homo sapiens
gttcagctctttccaaa

SEQ ID NO: 2867005 - DNA, 22 bp, Homo sapiens
gttcattggcattctttgcaat

SEQ ID NO: 2867006 - DNA, 23 bp, Homo sapiens
gttccattgaagccgactctggc

SEQ ID NO: 2867007 - DNA, 22 bp, Homo sapiens
gttccccttccactgagggcag

SEQ ID NO: 2867008 - DNA, 23 bp, Homo sapiens
taatttatcttgtctctgggctt

SEQ ID NO: 2867009 - DNA, 12 bp, Homo sapiens
taatttcaaaat

SEQ ID NO: 2867010 - DNA, 16 bp, Homo sapiens
taatttcaaaatacat

SEQ ID NO: 2867011 - DNA, 15 bp, Homo sapiens
taatttgaactttgg

SEQ ID NO: 2867012 - DNA, 15 bp, Homo sapiens
taattttaatgctgt

SEQ ID NO: 2867013 - DNA, 15 bp, Homo sapiens
taattttgaataaat

SEQ ID NO: 2867014 - DNA, 17 bp, Homo sapiens
tacaaatactcttagga

SEQ ID NO: 2867015 - DNA, 14 bp, Homo sapiens
tacaaatgaagaaa

SEQ ID NO: 2867016 - DNA, 15 bp, Homo sapiens
tacaaatgaagaaag

SEQ ID NO: 2867017 - DNA, 16 bp, Homo sapiens
tacaaatgaagaaagt

SEQ ID NO: 2867018 - DNA, 17 bp, Homo sapiens
tacaaatgaagaaagtc

SEQ ID NO: 2867019 - DNA, 14 bp, Homo sapiens
tacaagaaaatgta

SEQ ID NO: 2867020 - DNA, 16 bp, Homo sapiens
tacacccttttccagc

SEQ ID NO: 2867021 - DNA, 17 bp, Homo sapiens
tacactgcggaagccaa

SEQ ID NO: 2867022 - DNA, 17 bp, Homo sapiens
tcatctgtccctccggg

SEQ ID NO: 2867023 - DNA, 18 bp, Homo sapiens
tcatgattatagcaacta

SEQ ID NO: 2867024 - DNA, 16 bp, Homo sapiens
tcatgtgtgtccacga

SEQ ID NO: 2867025 - DNA, 17 bp, Homo sapiens
tcatgtttttgttttaa

SEQ ID NO: 2867026 - DNA, 22 bp, Homo sapiens
tcattaaaaattacctttaatt

SEQ ID NO: 2867027 - DNA, 18 bp, Homo sapiens
tcattatctttgctgtta

SEQ ID NO: 2867028 - DNA, 18 bp, Homo sapiens
tcattatgcacttttaga

SEQ ID NO: 2867029 - DNA, 13 bp, Homo sapiens
tcattattcaaga

SEQ ID NO: 2867030 - DNA, 15 bp, Homo sapiens
tcattctctgtctca

SEQ ID NO: 2867031 - DNA, 18 bp, Homo sapiens
tcattctctgtctcatcc

SEQ ID NO: 2867032 - DNA, 16 bp, Homo sapiens
tccaaaagtaaagatg

SEQ ID NO: 2867033 - DNA, 18 bp, Homo sapiens
tccaagatattttaaaat

SEQ ID NO: 2867034 - DNA, 22 bp, Homo sapiens
tccaagatattttaaaatctgt

SEQ ID NO: 2867035 - DNA, 22 bp, Homo sapiens
tccaaggaaacattttatcatt

SEQ ID NO: 2867036 - DNA, 20 bp, Homo sapiens
tccacaaaataaccaatcct

SEQ ID NO: 2867037 - DNA, 12 bp, Homo sapiens
tccacatcctcc

SEQ ID NO: 2867038 - DNA, 13 bp, Homo sapiens
tccacatcctcca

SEQ ID NO: 2867039 - DNA, 19 bp, Homo sapiens
tccacatcctccacgttct

SEQ ID NO: 2867040 - DNA, 14 bp, Homo sapiens
tccaccctccacct

SEQ ID NO: 2867041 - DNA, 15 bp, Homo sapiens
tccacgactgtctcc

SEQ ID NO: 2867042 - DNA, 16 bp, Homo sapiens
tccacgcacacatgga

SEQ ID NO: 2867043 - DNA, 14 bp, Homo sapiens
tccacggagccact

SEQ ID NO: 2867044 - DNA, 15 bp, Homo sapiens
tccacggagccactc

SEQ ID NO: 2867045 - DNA, 21 bp, Homo sapiens
tccactcagctgtcctgcagc

SEQ ID NO: 2867046 - DNA, 22 bp, Homo sapiens
tccacttcattttgtataatca

SEQ ID NO: 2867047 - DNA, 17 bp, Homo sapiens
tccagagaaagcacaat

SEQ ID NO: 2867048 - DNA, 19 bp, Homo sapiens
tccagagaaagcacaattt

SEQ ID NO: 2867049 - DNA, 22 bp, Homo sapiens
tccagagaaagcacaatttaaa

SEQ ID NO: 2867050 - DNA, 20 bp, Homo sapiens
tccagcccctgtcccacccc

SEQ ID NO: 2867051 - DNA, 23 bp, Homo sapiens
tccagcccctgtcccaccccctt

SEQ ID NO: 2867052 - DNA, 12 bp, Homo sapiens
tccagcctgggt

SEQ ID NO: 2867053 - DNA, 20 bp, Homo sapiens
tccagctgggcctcctgcct

SEQ ID NO: 2867054 - DNA, 10 bp, Homo sapiens
tccaggaagt

SEQ ID NO: 2867055 - DNA, 13 bp, Homo sapiens
tccaggcctgacc

SEQ ID NO: 2867056 - DNA, 14 bp, Homo sapiens
tccaggcctgacca

SEQ ID NO: 2867057 - DNA, 16 bp, Homo sapiens
tccaggcctgaccagg

SEQ ID NO: 2867058 - DNA, 15 bp, Homo sapiens
tccaggctgagccat

SEQ ID NO: 2867059 - DNA, 19 bp, Homo sapiens
tccaggctgagccatgagg

SEQ ID NO: 2867060 - DNA, 15 bp, Homo sapiens
tccagtcttagctga

SEQ ID NO: 2867061 - DNA, 14 bp, Homo sapiens
tccagtttcccacc

SEQ ID NO: 2867062 - DNA, 13 bp, Homo sapiens
tccataaagtaca

SEQ ID NO: 2867063 - DNA, 19 bp, Homo sapiens
tccatatttgatttctaat

SEQ ID NO: 2867064 - DNA, 16 bp, Homo sapiens
tccatcgtattaaaaa

SEQ ID NO: 2867065 - DNA, 18 bp, Homo sapiens
tccatgggcagagcccaa

SEQ ID NO: 2867066 - DNA, 22 bp, Homo sapiens
tccatgtacttccctcttgaaa

SEQ ID NO: 2867067 - DNA, 14 bp, Homo sapiens
tccattaggccagc

SEQ ID NO: 2867068 - DNA, 18 bp, Homo sapiens
tccatttggacaaaatgg

SEQ ID NO: 2867069 - DNA, 20 bp, Homo sapiens
tccatttggacaaaatggaa

SEQ ID NO: 2867070 - DNA, 17 bp, Homo sapiens
tccattttcccccacta
